United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 49

SEQ ID NO: 2197764 - RNA, 14 nt, Human
caacagugcuaaaa

SEQ ID NO: 2197765 - RNA, 16 nt, Human
caacagugcuaaaaau

SEQ ID NO: 2197766 - RNA, 17 nt, Human
caacagugcuaaaaaug

SEQ ID NO: 2197767 - RNA, 14 nt, Human
caacagugugaagu

SEQ ID NO: 2197768 - RNA, 16 nt, Human
caacagugugaaguua

SEQ ID NO: 2197769 - RNA, 17 nt, Human
caacagugugaaguuag

SEQ ID NO: 2197770 - RNA, 18 nt, Human
caacagugugaaguuaga

SEQ ID NO: 2197771 - RNA, 19 nt, Human
caacagugugaaguuagaa

SEQ ID NO: 2197772 - RNA, 21 nt, Human
caacagugugaaguuagaauu

SEQ ID NO: 2197773 - RNA, 22 nt, Human
caacagugugaaguuagaauuc

SEQ ID NO: 2197774 - RNA, 23 nt, Human
caacagugugaaguuagaauucc

SEQ ID NO: 2197775 - RNA, 14 nt, Human
caacaggcugggcu

SEQ ID NO: 2197776 - RNA, 23 nt, Human
caaauuuacagagacagaaagca

SEQ ID NO: 2197777 - RNA, 17 nt, Human
caaauuuacagagacag

SEQ ID NO: 2197778 - RNA, 16 nt, Human
caaauuuacagagaca

SEQ ID NO: 2197779 - RNA, 22 nt, Human
caacugaaaagacucaguguuc

SEQ ID NO: 2197780 - RNA, 14 nt, Human
caacugaaaagacu

SEQ ID NO: 2197781 - RNA, 13 nt, Human
caacugaaaagac

SEQ ID NO: 2197782 - RNA, 16 nt, Human
caacucuuugagaaac

SEQ ID NO: 2197783 - RNA, 15 nt, Human
caacucuuugagaaa

SEQ ID NO: 2197784 - RNA, 14 nt, Human
caacucuuugagaa

SEQ ID NO: 2197785 - RNA, 12 nt, Human
caacucuugauu

SEQ ID NO: 2197786 - RNA, 17 nt, Human
caaccugcaaagaucug

SEQ ID NO: 2197787 - RNA, 21 nt, Human
caaccugccugacauuuggag

SEQ ID NO: 2197788 - RNA, 18 nt, Human
caacucuugauuauccau

SEQ ID NO: 2197789 - RNA, 16 nt, Human
caacucuugauuaucc

SEQ ID NO: 2197790 - RNA, 13 nt, Human
caacucuuugaga

SEQ ID NO: 2197791 - RNA, 17 nt, Human
caacucuugcaggucuc

SEQ ID NO: 2197792 - RNA, 17 nt, Human
caaccugauugugucuc

SEQ ID NO: 2197793 - RNA, 19 nt, Human
caaccuccgccucccgggu

SEQ ID NO: 2197794 - RNA, 19 nt, Human
caaccugauugugucucuu

SEQ ID NO: 2197795 - RNA, 21 nt, Human
caaccugauugugucucuugg

SEQ ID NO: 2197796 - RNA, 23 nt, Human
caacugucucgaugcaaugaaca

SEQ ID NO: 2197797 - RNA, 16 nt, Human
caacuguguucauuag

SEQ ID NO: 2197798 - RNA, 12 nt, Human
caacuguauaua

SEQ ID NO: 2197799 - RNA, 13 nt, Human
caacuguauauau

SEQ ID NO: 2197800 - RNA, 15 nt, Human
caacuguauauauuc

SEQ ID NO: 2197801 - RNA, 21 nt, Human
caacugucucgaugcaaugaa

SEQ ID NO: 2197802 - RNA, 18 nt, Human
caacugucuauuucugcu

SEQ ID NO: 2197803 - RNA, 21 nt, Human
caacugucuauuucugcugaa

SEQ ID NO: 2197804 - RNA, 13 nt, Human
caacugggcccaa

SEQ ID NO: 2197805 - RNA, 22 nt, Human
caacuggccggucugcaaguca

SEQ ID NO: 2197806 - RNA, 19 nt, Human
caacuggacauugucugcg

SEQ ID NO: 2197807 - RNA, 18 nt, Human
caacugaauaaauaccuc

SEQ ID NO: 2197808 - RNA, 18 nt, Human
caacugaaugaggucagc

SEQ ID NO: 2197809 - RNA, 17 nt, Human
caacugcaucaagaugu

SEQ ID NO: 2197810 - RNA, 20 nt, Human
caacugcaucaagaugugac

SEQ ID NO: 2197811 - RNA, 23 nt, Human
caacugcaucaagaugugacaug

SEQ ID NO: 2197812 - RNA, 18 nt, Human
caagccaagcagccaagc

SEQ ID NO: 2197813 - RNA, 23 nt, Human
caagguagcccuggccagaggcu

SEQ ID NO: 2197814 - RNA, 13 nt, Human
caaggucauuuuu

SEQ ID NO: 2197815 - RNA, 21 nt, Human
caagguagcccuggccagagg

SEQ ID NO: 2197816 - RNA, 16 nt, Human
caagguagcccuggcc

SEQ ID NO: 2197817 - RNA, 15 nt, Human
caagguagccauccc

SEQ ID NO: 2197818 - RNA, 16 nt, Human
caagguagccauccca

SEQ ID NO: 2197819 - RNA, 22 nt, Human
caagguaauuucuugugccucu

SEQ ID NO: 2197820 - RNA, 20 nt, Human
caaggguucagagacucagg

SEQ ID NO: 2197821 - RNA, 19 nt, Human
caaggggcagucuggaggg

SEQ ID NO: 2197822 - RNA, 16 nt, Human
caaggggcagucugga

SEQ ID NO: 2197823 - RNA, 18 nt, Human
caaggggcagucuggagg

SEQ ID NO: 2197824 - RNA, 12 nt, Human
caagggccucuu

SEQ ID NO: 2197825 - RNA, 21 nt, Human
caagggccaugcugaagggac

SEQ ID NO: 2197826 - RNA, 16 nt, Human
caaggggaaaaucuca

SEQ ID NO: 2197827 - RNA, 18 nt, Human
caaggggaaucagaacuc

SEQ ID NO: 2197828 - RNA, 23 nt, Human
caaggggaauguuugccucugcc

SEQ ID NO: 2197829 - RNA, 14 nt, Human
caagggccaugcug

SEQ ID NO: 2197830 - RNA, 20 nt, Human
caagggccaugcugaaggga

SEQ ID NO: 2197831 - RNA, 20 nt, Human
caagggcagaacacuaaccu

SEQ ID NO: 2197832 - RNA, 13 nt, Human
caagggauggugc

SEQ ID NO: 2197833 - RNA, 19 nt, Human
caagggcaaaaagucuaca

SEQ ID NO: 2197834 - RNA, 17 nt, Human
caagggcaaaauuccca

SEQ ID NO: 2197835 - RNA, 19 nt, Human
caagggcaaaauucccagg

SEQ ID NO: 2197836 - RNA, 14 nt, Human
caagggagagaccu

SEQ ID NO: 2197837 - RNA, 15 nt, Human
caagggagagaccuc

SEQ ID NO: 2197838 - RNA, 17 nt, Human
caagggagagaccucau

SEQ ID NO: 2197839 - RNA, 19 nt, Human
caagggagagaccucauca

SEQ ID NO: 2197840 - RNA, 20 nt, Human
caagggagagaccucaucag

SEQ ID NO: 2197841 - RNA, 21 nt, Human
caagggaucugguccuaccca

SEQ ID NO: 2197842 - RNA, 20 nt, Human
caagggaucugguccuaccc

SEQ ID NO: 2197843 - RNA, 17 nt, Human
caagggaucugguccua

SEQ ID NO: 2197844 - RNA, 21 nt, Human
caaggggaauguuugccucug

SEQ ID NO: 2197845 - RNA, 15 nt, Human
caagggccuggccug

SEQ ID NO: 2197846 - RNA, 13 nt, Human
caagggccuggcc

SEQ ID NO: 2197847 - RNA, 14 nt, Human
caagggccuggccu

SEQ ID NO: 2197848 - RNA, 20 nt, Human
caagugauucuccugccuca

SEQ ID NO: 2197849 - RNA, 13 nt, Human
caagugaaucuaa

SEQ ID NO: 2197850 - RNA, 20 nt, Human
caagugccagucuugugucu

SEQ ID NO: 2197851 - RNA, 21 nt, Human
caagugccagaggugggcagg

SEQ ID NO: 2197852 - RNA, 22 nt, Human
caagugccagaggugggcaggu

SEQ ID NO: 2197853 - RNA, 16 nt, Human
caagugccagaggugg

SEQ ID NO: 2197854 - RNA, 17 nt, Human
caagugccagagguggg

SEQ ID NO: 2197855 - RNA, 19 nt, Human
caagugccagaggugggca

SEQ ID NO: 2197856 - RNA, 20 nt, Human
caagugccagaggugggcag

SEQ ID NO: 2197857 - RNA, 23 nt, Human
caagugccacugcccgagcuggu

SEQ ID NO: 2197858 - RNA, 13 nt, Human
caagugccagagg

SEQ ID NO: 2197859 - RNA, 14 nt, Human
caagugccagaggu

SEQ ID NO: 2197860 - RNA, 15 nt, Human
caagugccagaggug

SEQ ID NO: 2197861 - RNA, 22 nt, Human
caagugccacugcccgagcugg

SEQ ID NO: 2197862 - RNA, 19 nt, Human
caagugcaugcucucugca

SEQ ID NO: 2197863 - RNA, 19 nt, Human
caagugagacccugucuca

SEQ ID NO: 2197864 - RNA, 15 nt, Human
caagugagacccugu

SEQ ID NO: 2197865 - RNA, 19 nt, Human
caagugauucuccugccuc

SEQ ID NO: 2197866 - RNA, 18 nt, Human
caagugauucuccugccu

SEQ ID NO: 2197867 - RNA, 16 nt, Human
caagugacaucucuuu

SEQ ID NO: 2197868 - RNA, 15 nt, Human
caagugacaucucuu

SEQ ID NO: 2197869 - RNA, 19 nt, Human
caagugaauuuuucucuaa

SEQ ID NO: 2197870 - RNA, 14 nt, Human
caagugaagguuua

SEQ ID NO: 2197871 - RNA, 21 nt, Human
caagugaagguuuacaauuua

SEQ ID NO: 2197872 - RNA, 14 nt, Human
caagugagacccug

SEQ ID NO: 2197873 - RNA, 19 nt, Human
caagugaacacuagccaga

SEQ ID NO: 2197874 - RNA, 14 nt, Human
caagugaagaaaag

SEQ ID NO: 2197875 - RNA, 11 nt, Human
caagugaaggu

SEQ ID NO: 2197876 - RNA, 12 nt, Human
caagugaagguu

SEQ ID NO: 2197877 - RNA, 17 nt, Human
caagguuuaggcuggug

SEQ ID NO: 2197878 - RNA, 23 nt, Human
caagugaaaaaggaggaagagaa

SEQ ID NO: 2197879 - RNA, 22 nt, Human
caagugaaaaaggaggaagaga

SEQ ID NO: 2197880 - RNA, 20 nt, Human
caagguuuaggcugguggcc

SEQ ID NO: 2197881 - RNA, 19 nt, Human
caagguucccucugagaau

SEQ ID NO: 2197882 - RNA, 22 nt, Human
caagguuuaaacuucucugaag

SEQ ID NO: 2197883 - RNA, 15 nt, Human
caagguucccucuga

SEQ ID NO: 2197884 - RNA, 16 nt, Human
caagguucccucugag

SEQ ID NO: 2197885 - RNA, 17 nt, Human
caagguucccucugaga

SEQ ID NO: 2197886 - RNA, 18 nt, Human
caagguucccucugagaa

SEQ ID NO: 2197887 - RNA, 13 nt, Human
caagaccuucucc

SEQ ID NO: 2197888 - RNA, 14 nt, Human
caagaccuguuggu

SEQ ID NO: 2197889 - RNA, 17 nt, Human
caagaccucagugccuu

SEQ ID NO: 2197890 - RNA, 20 nt, Human
caagacgcugugcugcccug

SEQ ID NO: 2197891 - RNA, 17 nt, Human
caagaccuguugguucc

SEQ ID NO: 2197892 - RNA, 20 nt, Human
caagaccuucaccaaacaua

SEQ ID NO: 2197893 - RNA, 21 nt, Human
caagacgcugugcugcccugc

SEQ ID NO: 2197894 - RNA, 22 nt, Human
caagacgcugugcugcccugcc

SEQ ID NO: 2197895 - RNA, 12 nt, Human
caagaaagucca

SEQ ID NO: 2197896 - RNA, 13 nt, Human
caagaaauaaaag

SEQ ID NO: 2197897 - RNA, 20 nt, Human
caagaaauaaaaggaagcca

SEQ ID NO: 2197898 - RNA, 19 nt, Human
caagaaauaaaaggaagcc

SEQ ID NO: 2197899 - RNA, 13 nt, Human
caagaaaugaaag

SEQ ID NO: 2197900 - RNA, 15 nt, Human
caagaaaucccuguu

SEQ ID NO: 2197901 - RNA, 23 nt, Human
caagacccuuguggucccacccc

SEQ ID NO: 2197902 - RNA, 21 nt, Human
caagaaauaaaaggaagccaa

SEQ ID NO: 2197903 - RNA, 14 nt, Human
caagaaaucccugu

SEQ ID NO: 2197904 - RNA, 19 nt, Human
caacuucuacuucugcccu

SEQ ID NO: 2197905 - RNA, 14 nt, Human
caacuucuggcucc

SEQ ID NO: 2197906 - RNA, 14 nt, Human
caacuucuucagag

SEQ ID NO: 2197907 - RNA, 23 nt, Human
caacuucuccauccuuucugccu

SEQ ID NO: 2197908 - RNA, 20 nt, Human
caacuucuuuuuauuuucuu

SEQ ID NO: 2197909 - RNA, 13 nt, Human
caacuugagggcc

SEQ ID NO: 2197910 - RNA, 18 nt, Human
caacuucuucagagcuga

SEQ ID NO: 2197911 - RNA, 16 nt, Human
caacuugagggcccag

SEQ ID NO: 2197912 - RNA, 19 nt, Human
caacuugagggcccagagc

SEQ ID NO: 2197913 - RNA, 20 nt, Human
caacuugagggcccagagca

SEQ ID NO: 2197914 - RNA, 21 nt, Human
caacuugagggcccagagcag

SEQ ID NO: 2197915 - RNA, 22 nt, Human
caacuugagggcccagagcagg

SEQ ID NO: 2197916 - RNA, 22 nt, Human
caacuugcauccaacuccagga

SEQ ID NO: 2197917 - RNA, 14 nt, Human
caagacuguugcuc

SEQ ID NO: 2197918 - RNA, 22 nt, Human
caagacuggaagguggggacag

SEQ ID NO: 2197919 - RNA, 18 nt, Human
caagacuguugcucaaau

SEQ ID NO: 2197920 - RNA, 16 nt, Human
caagacuguugcucaa

SEQ ID NO: 2197921 - RNA, 17 nt, Human
caagacuguugcucaaa

SEQ ID NO: 2197922 - RNA, 21 nt, Human
caagacuugguguccuuuccc

SEQ ID NO: 2197923 - RNA, 20 nt, Human
caagacuuggcaacagaagc

SEQ ID NO: 2197924 - RNA, 15 nt, Human
caagacuuggcaaca

SEQ ID NO: 2197925 - RNA, 16 nt, Human
caagacuucaguaugu

SEQ ID NO: 2197926 - RNA, 21 nt, Human
caagacuucaguauguuguca

SEQ ID NO: 2197927 - RNA, 17 nt, Human
caagagcccaggccucc

SEQ ID NO: 2197928 - RNA, 13 nt, Human
caagagccugaga

SEQ ID NO: 2197929 - RNA, 11 nt, Human
caagagccuga

SEQ ID NO: 2197930 - RNA, 17 nt, Human
caagagggcacuggugg

SEQ ID NO: 2197931 - RNA, 18 nt, Human
caagagggcacugguggc

SEQ ID NO: 2197932 - RNA, 19 nt, Human
caagagggcacugguggcc

SEQ ID NO: 2197933 - RNA, 20 nt, Human
caagagggcacugguggccc

SEQ ID NO: 2197934 - RNA, 17 nt, Human
caagagcccccuugaca

SEQ ID NO: 2197935 - RNA, 22 nt, Human
caagagcccccuugacaccggg

SEQ ID NO: 2197936 - RNA, 23 nt, Human
caagagccugagagugaggugga

SEQ ID NO: 2197937 - RNA, 22 nt, Human
caagcagccaagcuccuuggga

SEQ ID NO: 2197938 - RNA, 21 nt, Human
caagcagccugagcaacucuu

SEQ ID NO: 2197939 - RNA, 22 nt, Human
caagcagcgaccgcccccuccu

SEQ ID NO: 2197940 - RNA, 21 nt, Human
caagcagauuggagaaacccu

SEQ ID NO: 2197941 - RNA, 17 nt, Human
caagcagagguggccag

SEQ ID NO: 2197942 - RNA, 18 nt, Human
caagcagagguggccaga

SEQ ID NO: 2197943 - RNA, 14 nt, Human
caagcagccaagcu

SEQ ID NO: 2197944 - RNA, 13 nt, Human
caagcagccaagc

SEQ ID NO: 2197945 - RNA, 12 nt, Human
caagcagccaag

SEQ ID NO: 2197946 - RNA, 20 nt, Human
caagcagagguggccagagc

SEQ ID NO: 2197947 - RNA, 16 nt, Human
caagagggguggagac

SEQ ID NO: 2197948 - RNA, 21 nt, Human
caagagggguggagacugcuu

SEQ ID NO: 2197949 - RNA, 23 nt, Human
caagagggguggagacugcuucc

SEQ ID NO: 2197950 - RNA, 22 nt, Human
caagaggguccuuuaguaccug

SEQ ID NO: 2197951 - RNA, 21 nt, Human
caagagccuugguguccaccu

SEQ ID NO: 2197952 - RNA, 14 nt, Human
caagagggggugga

SEQ ID NO: 2197953 - RNA, 18 nt, Human
caagagccuuggugucca

SEQ ID NO: 2197954 - RNA, 12 nt, Human
caagagccuugg

SEQ ID NO: 2197955 - RNA, 15 nt, Human
caagaggggguggag

SEQ ID NO: 2197956 - RNA, 17 nt, Human
caagaggggguggaggg

SEQ ID NO: 2197957 - RNA, 18 nt, Human
caagaggggguggagggg

SEQ ID NO: 2197958 - RNA, 21 nt, Human
caagaggggguggaggggugu

SEQ ID NO: 2197959 - RNA, 12 nt, Human
caagagggucug

SEQ ID NO: 2197960 - RNA, 16 nt, Human
caagagggucugagga

SEQ ID NO: 2197961 - RNA, 17 nt, Human
caagagggucugaggaa

SEQ ID NO: 2197962 - RNA, 17 nt, Human
caagcccccccuuccac

SEQ ID NO: 2197963 - RNA, 22 nt, Human
caagcugugagacagugggaaa

SEQ ID NO: 2197964 - RNA, 23 nt, Human
caagcugugagacagugggaaau

SEQ ID NO: 2197965 - RNA, 12 nt, Human
caagcugugcca

SEQ ID NO: 2197966 - RNA, 14 nt, Human
caagcugugccacc

SEQ ID NO: 2197967 - RNA, 15 nt, Human
caagcugugccaccc

SEQ ID NO: 2197968 - RNA, 16 nt, Human
caagcugugccacccu

SEQ ID NO: 2197969 - RNA, 17 nt, Human
caagcugugccacccug

SEQ ID NO: 2197970 - RNA, 14 nt, Human
caagcuguuuucuu

SEQ ID NO: 2197971 - RNA, 18 nt, Human
caagcugugccacccugg

SEQ ID NO: 2197972 - RNA, 19 nt, Human
caagcugugccacccuggg

SEQ ID NO: 2197973 - RNA, 20 nt, Human
caagcugugccacccugggc

SEQ ID NO: 2197974 - RNA, 21 nt, Human
caagcugugccacccugggcu

SEQ ID NO: 2197975 - RNA, 13 nt, Human
caagcuucuuuua

SEQ ID NO: 2197976 - RNA, 13 nt, Human
caagcuuggcagc

SEQ ID NO: 2197977 - RNA, 17 nt, Human
caagcuuguccaacccg

SEQ ID NO: 2197978 - RNA, 16 nt, Human
caagcuguuuucuucu

SEQ ID NO: 2197979 - RNA, 22 nt, Human
caagcuucaguuuccuggucug

SEQ ID NO: 2197980 - RNA, 12 nt, Human
caagcuucaguu

SEQ ID NO: 2197981 - RNA, 19 nt, Human
caagcuucaguuuccuggu

SEQ ID NO: 2197982 - RNA, 19 nt, Human
caaggacuaggguccuggg

SEQ ID NO: 2197983 - RNA, 18 nt, Human
caaggacuaggguccugg

SEQ ID NO: 2197984 - RNA, 14 nt, Human
caaggacuaggguc

SEQ ID NO: 2197985 - RNA, 14 nt, Human
caagcuuggcagcc

SEQ ID NO: 2197986 - RNA, 16 nt, Human
caagcuuggcagccga

SEQ ID NO: 2197987 - RNA, 16 nt, Human
caaggacuaggguccu

SEQ ID NO: 2197988 - RNA, 21 nt, Human
caaggacuaggguccugggga

SEQ ID NO: 2197989 - RNA, 20 nt, Human
caaggacuaggguccugggg

SEQ ID NO: 2197990 - RNA, 14 nt, Human
caaggauccugagc

SEQ ID NO: 2197991 - RNA, 21 nt, Human
caaggcugggggaagaagcuc

SEQ ID NO: 2197992 - RNA, 13 nt, Human
caaggcugucaau

SEQ ID NO: 2197993 - RNA, 14 nt, Human
caaggcugucaauu

SEQ ID NO: 2197994 - RNA, 23 nt, Human
caagggaauuucuucaacucccu

SEQ ID NO: 2197995 - RNA, 17 nt, Human
caaggauccugagccag

SEQ ID NO: 2197996 - RNA, 14 nt, Human
caaggacugaggga

SEQ ID NO: 2197997 - RNA, 20 nt, Human
caagcuuggcagccgagcuc

SEQ ID NO: 2197998 - RNA, 15 nt, Human
caaggacugagggac

SEQ ID NO: 2197999 - RNA, 22 nt, Human
caaggacugagggacucugaag

SEQ ID NO: 2198000 - RNA, 15 nt, Human
caaggauccugagcc

SEQ ID NO: 2198001 - RNA, 16 nt, Human
caaggauccugagcca

SEQ ID NO: 2198002 - RNA, 14 nt, Human
caagcccccccuuc

SEQ ID NO: 2198003 - RNA, 16 nt, Human
caagcccccccuucca

SEQ ID NO: 2198004 - RNA, 18 nt, Human
caagccccaggcaggcug

SEQ ID NO: 2198005 - RNA, 17 nt, Human
caagccccaggcaggcu

SEQ ID NO: 2198006 - RNA, 15 nt, Human
caagccccaggcagg

SEQ ID NO: 2198007 - RNA, 13 nt, Human
caagccccaggca

SEQ ID NO: 2198008 - RNA, 20 nt, Human
caagcccaguucagcuuggg

SEQ ID NO: 2198009 - RNA, 14 nt, Human
caagccagcuggag

SEQ ID NO: 2198010 - RNA, 16 nt, Human
caagccaagcagccaa

SEQ ID NO: 2198011 - RNA, 12 nt, Human
caagcccaggag

SEQ ID NO: 2198012 - RNA, 17 nt, Human
caagcccagcacugcuu

SEQ ID NO: 2198013 - RNA, 15 nt, Human
caagccaagcagcca

SEQ ID NO: 2198014 - RNA, 14 nt, Human
caagccaagcagcc

SEQ ID NO: 2198015 - RNA, 13 nt, Human
caagccaagcagc

SEQ ID NO: 2198016 - RNA, 21 nt, Human
caagccaacuuguaaauacac

SEQ ID NO: 2198017 - RNA, 22 nt, Human
caagcauuuaauguagccaugg

SEQ ID NO: 2198018 - RNA, 15 nt, Human
caagccaacuuguaa

SEQ ID NO: 2198019 - RNA, 18 nt, Human
caagccaacuuguaaaua

SEQ ID NO: 2198020 - RNA, 20 nt, Human
caagccaacuuguaaauaca

SEQ ID NO: 2198021 - RNA, 19 nt, Human
caagccaacgacaaagcca

SEQ ID NO: 2198022 - RNA, 18 nt, Human
caagccaacgacaaagcc

SEQ ID NO: 2198023 - RNA, 21 nt, Human
caagcauuuaauguagccaug

SEQ ID NO: 2198024 - RNA, 14 nt, Human
caagcauucugucu

SEQ ID NO: 2198025 - RNA, 16 nt, Human
caagcauuuagaugua

SEQ ID NO: 2198026 - RNA, 19 nt, Human
caagcauuuagauguauag

SEQ ID NO: 2198027 - RNA, 21 nt, Human
caagcauaccaacacgagcag

SEQ ID NO: 2198028 - RNA, 15 nt, Human
caagcauucuccugu

SEQ ID NO: 2198029 - RNA, 13 nt, Human
caagcauucuccu

SEQ ID NO: 2198030 - RNA, 21 nt, Human
caagcaucuuggggggguggc

SEQ ID NO: 2198031 - RNA, 13 nt, Human
caagcaggaagcu

SEQ ID NO: 2198032 - RNA, 12 nt, Human
caagcaggaagc

SEQ ID NO: 2198033 - RNA, 15 nt, Human
caagcagucgugccu

SEQ ID NO: 2198034 - RNA, 23 nt, Human
caagcaggaaaugaaaaugucuu

SEQ ID NO: 2198035 - RNA, 17 nt, Human
caagcaggaaaugaaaa

SEQ ID NO: 2198036 - RNA, 16 nt, Human
caagcagucgugccug

SEQ ID NO: 2198037 - RNA, 18 nt, Human
caagcagucgugccugug

SEQ ID NO: 2198038 - RNA, 19 nt, Human
caagcagucgugccugugu

SEQ ID NO: 2198039 - RNA, 20 nt, Human
caagcagucgugccuguguc

SEQ ID NO: 2198040 - RNA, 18 nt, Human
caagcagucuacccaccu

SEQ ID NO: 2198041 - RNA, 21 nt, Human
caagcagucgugccugugucc

SEQ ID NO: 2198042 - RNA, 14 nt, Human
caagcaggaagcuc

SEQ ID NO: 2198043 - RNA, 16 nt, Human
caagcauaccaacacg

SEQ ID NO: 2198044 - RNA, 22 nt, Human
caaacugaggaauuucaccugu

SEQ ID NO: 2198045 - RNA, 13 nt, Human
auuuuaaucuaau

SEQ ID NO: 2198046 - RNA, 18 nt, Human
auuuuaaucaaguugaau

SEQ ID NO: 2198047 - RNA, 14 nt, Human
auuuuaaucaaguu

SEQ ID NO: 2198048 - RNA, 23 nt, Human
auuuuaaugaagaaaguggaaaa

SEQ ID NO: 2198049 - RNA, 17 nt, Human
caaacugccuaagcccu

SEQ ID NO: 2198050 - RNA, 18 nt, Human
caaacugccuaagcccuc

SEQ ID NO: 2198051 - RNA, 23 nt, Human
caaacugccuaagcccuccgcca

SEQ ID NO: 2198052 - RNA, 18 nt, Human
auuuuaagugcuuuguaa

SEQ ID NO: 2198053 - RNA, 17 nt, Human
auuuuaagugcuuugua

SEQ ID NO: 2198054 - RNA, 16 nt, Human
auuuuaagugcuuugu

SEQ ID NO: 2198055 - RNA, 14 nt, Human
auuuuaagugcuuu

SEQ ID NO: 2198056 - RNA, 12 nt, Human
auuuuaagugcu

SEQ ID NO: 2198057 - RNA, 22 nt, Human
auuuuaaguauugcaucuguau

SEQ ID NO: 2198058 - RNA, 23 nt, Human
auuuuaaguauugcaucuguaua

SEQ ID NO: 2198059 - RNA, 14 nt, Human
auuuuaaguauugc

SEQ ID NO: 2198060 - RNA, 16 nt, Human
auuuuaaguauugcau

SEQ ID NO: 2198061 - RNA, 19 nt, Human
auuuuaaguauugcaucug

SEQ ID NO: 2198062 - RNA, 20 nt, Human
auuuuaaguauugcaucugu

SEQ ID NO: 2198063 - RNA, 18 nt, Human
auuuuaauaauguuucaa

SEQ ID NO: 2198064 - RNA, 19 nt, Human
auuuuaauaauguuucaaa

SEQ ID NO: 2198065 - RNA, 21 nt, Human
auuuuaagacguguuuguguu

SEQ ID NO: 2198066 - RNA, 16 nt, Human
auuuuaacaaaagcaa

SEQ ID NO: 2198067 - RNA, 18 nt, Human
auuuuaacaaaagcaaga

SEQ ID NO: 2198068 - RNA, 16 nt, Human
auuuuaaauucacaau

SEQ ID NO: 2198069 - RNA, 22 nt, Human
auuuuaaauuauaacuuaaaau

SEQ ID NO: 2198070 - RNA, 13 nt, Human
auuuuaacaaaag

SEQ ID NO: 2198071 - RNA, 21 nt, Human
auuuguacauauguaaaauaa

SEQ ID NO: 2198072 - RNA, 19 nt, Human
auuuguacauauguaaaau

SEQ ID NO: 2198073 - RNA, 18 nt, Human
auuuguacauauguaaaa

SEQ ID NO: 2198074 - RNA, 16 nt, Human
auuuguacauauguaa

SEQ ID NO: 2198075 - RNA, 18 nt, Human
auuuguacaguucaguuc

SEQ ID NO: 2198076 - RNA, 20 nt, Human
auuuuaaauaaaagugauca

SEQ ID NO: 2198077 - RNA, 16 nt, Human
auuuuaaauaaaagaa

SEQ ID NO: 2198078 - RNA, 15 nt, Human
auuuuaaauaaaaga

SEQ ID NO: 2198079 - RNA, 14 nt, Human
auuuuaaauaaaag

SEQ ID NO: 2198080 - RNA, 21 nt, Human
auuuuaaauaaaagugaucaa

SEQ ID NO: 2198081 - RNA, 15 nt, Human
auuuuaaauggacag

SEQ ID NO: 2198082 - RNA, 16 nt, Human
auuuuaaauggacaga

SEQ ID NO: 2198083 - RNA, 16 nt, Human
caaagagguauuuauc

SEQ ID NO: 2198084 - RNA, 14 nt, Human
caaagaguagaauu

SEQ ID NO: 2198085 - RNA, 18 nt, Human
caaagaggugacugggcc

SEQ ID NO: 2198086 - RNA, 17 nt, Human
caaagaguagacauuuc

SEQ ID NO: 2198087 - RNA, 17 nt, Human
caaagcccaaaguggua

SEQ ID NO: 2198088 - RNA, 16 nt, Human
caaagaguuaauauau

SEQ ID NO: 2198089 - RNA, 20 nt, Human
caaagagugggcugcaucug

SEQ ID NO: 2198090 - RNA, 22 nt, Human
caaagagugggcugcaucuggg

SEQ ID NO: 2198091 - RNA, 19 nt, Human
caaagcccaaagugguaua

SEQ ID NO: 2198092 - RNA, 14 nt, Human
caaagcccaaggga

SEQ ID NO: 2198093 - RNA, 17 nt, Human
caaagaguguagaucag

SEQ ID NO: 2198094 - RNA, 13 nt, Human
caaagcccagcuu

SEQ ID NO: 2198095 - RNA, 15 nt, Human
caaagccccaugcug

SEQ ID NO: 2198096 - RNA, 16 nt, Human
caaagccccaugcugg

SEQ ID NO: 2198097 - RNA, 19 nt, Human
caaagccccaugcuggagc

SEQ ID NO: 2198098 - RNA, 20 nt, Human
caaagccccaugcuggagcc

SEQ ID NO: 2198099 - RNA, 21 nt, Human
caaagagguuuuaaaaaaauc

SEQ ID NO: 2198100 - RNA, 14 nt, Human
caaagagguuuuaa

SEQ ID NO: 2198101 - RNA, 20 nt, Human
caaagacuuaguauauuuuc

SEQ ID NO: 2198102 - RNA, 19 nt, Human
caaagacuuaguauauuuu

SEQ ID NO: 2198103 - RNA, 16 nt, Human
caaagacuuaguauau

SEQ ID NO: 2198104 - RNA, 18 nt, Human
caaagaccuuguguguau

SEQ ID NO: 2198105 - RNA, 23 nt, Human
caaagaccuuguguguaugugua

SEQ ID NO: 2198106 - RNA, 17 nt, Human
caaagacgaccuuuacc

SEQ ID NO: 2198107 - RNA, 18 nt, Human
caaagaccaaauuccuug

SEQ ID NO: 2198108 - RNA, 14 nt, Human
caaagacagaagcc

SEQ ID NO: 2198109 - RNA, 21 nt, Human
caaagaccacacauuugugua

SEQ ID NO: 2198110 - RNA, 16 nt, Human
caaagaccuugugugu

SEQ ID NO: 2198111 - RNA, 19 nt, Human
caaacugccuuggcuucag

SEQ ID NO: 2198112 - RNA, 17 nt, Human
caaacuggcaaacuuca

SEQ ID NO: 2198113 - RNA, 19 nt, Human
caaacuggcaaacuucaga

SEQ ID NO: 2198114 - RNA, 12 nt, Human
caaagaaauuau

SEQ ID NO: 2198115 - RNA, 14 nt, Human
caaagaaauguaag

SEQ ID NO: 2198116 - RNA, 15 nt, Human
caaagaauguuuaua

SEQ ID NO: 2198117 - RNA, 21 nt, Human
caaagacaaauucuguuucuu

SEQ ID NO: 2198118 - RNA, 20 nt, Human
caaagacaaauucuguuucu

SEQ ID NO: 2198119 - RNA, 13 nt, Human
caaagaaauuaug

SEQ ID NO: 2198120 - RNA, 14 nt, Human
caaagggcugaaag

SEQ ID NO: 2198121 - RNA, 17 nt, Human
caaagggcugaaagcca

SEQ ID NO: 2198122 - RNA, 21 nt, Human
caaagggcugaaagccauuug

SEQ ID NO: 2198123 - RNA, 18 nt, Human
caaagggcugaaagccau

SEQ ID NO: 2198124 - RNA, 20 nt, Human
caaaggguaucaggugcugc

SEQ ID NO: 2198125 - RNA, 21 nt, Human
caaaggguaucaggugcugcc

SEQ ID NO: 2198126 - RNA, 18 nt, Human
caaagugguauagaaaug

SEQ ID NO: 2198127 - RNA, 19 nt, Human
caaagugguauagaaaugc

SEQ ID NO: 2198128 - RNA, 23 nt, Human
caaaggguaucaggugcugccau

SEQ ID NO: 2198129 - RNA, 16 nt, Human
caaaguggugagaggc

SEQ ID NO: 2198130 - RNA, 17 nt, Human
caaaguggugagaggca

SEQ ID NO: 2198131 - RNA, 22 nt, Human
caaagggagcacuggguugacu

SEQ ID NO: 2198132 - RNA, 15 nt, Human
caaagggagcagaac

SEQ ID NO: 2198133 - RNA, 14 nt, Human
caaagggagagaga

SEQ ID NO: 2198134 - RNA, 18 nt, Human
caaagggaaauaucauuu

SEQ ID NO: 2198135 - RNA, 15 nt, Human
caaagggaaauauca

SEQ ID NO: 2198136 - RNA, 17 nt, Human
caaagggaaauaucauu

SEQ ID NO: 2198137 - RNA, 20 nt, Human
caaaggagauuggaaggaac

SEQ ID NO: 2198138 - RNA, 18 nt, Human
caaaggacuugacuugca

SEQ ID NO: 2198139 - RNA, 23 nt, Human
caaaggacuguuuuuuccugagc

SEQ ID NO: 2198140 - RNA, 20 nt, Human
caaaggagauaaaucuagua

SEQ ID NO: 2198141 - RNA, 16 nt, Human
caaaggaccucagcug

SEQ ID NO: 2198142 - RNA, 15 nt, Human
caaaggacuccaccc

SEQ ID NO: 2198143 - RNA, 14 nt, Human
caaaggagauugga

SEQ ID NO: 2198144 - RNA, 23 nt, Human
caaagccccuugcucuccccugc

SEQ ID NO: 2198145 - RNA, 15 nt, Human
caaagcccuaaaauu

SEQ ID NO: 2198146 - RNA, 21 nt, Human
caaagccccaugcuggagccu

SEQ ID NO: 2198147 - RNA, 22 nt, Human
caaagccccaugcuggagccug

SEQ ID NO: 2198148 - RNA, 17 nt, Human
caaauauuccagagacu

SEQ ID NO: 2198149 - RNA, 13 nt, Human
caaauauuccaga

SEQ ID NO: 2198150 - RNA, 14 nt, Human
caaauauuuauuuu

SEQ ID NO: 2198151 - RNA, 12 nt, Human
caaauauuuauu

SEQ ID NO: 2198152 - RNA, 16 nt, Human
caaauauuuauuuucu

SEQ ID NO: 2198153 - RNA, 15 nt, Human
caaauauuuauuuuc

SEQ ID NO: 2198154 - RNA, 21 nt, Human
caaaguucccuacuuccugug

SEQ ID NO: 2198155 - RNA, 19 nt, Human
caaaguggugagaggcauc

SEQ ID NO: 2198156 - RNA, 22 nt, Human
caaaguucccuacuuccuguga

SEQ ID NO: 2198157 - RNA, 11 nt, Human
caaauguuucu

SEQ ID NO: 2198158 - RNA, 14 nt, Human
caaauguuucugca

SEQ ID NO: 2198159 - RNA, 15 nt, Human
caaauguuuugacau

SEQ ID NO: 2198160 - RNA, 17 nt, Human
caaauguuuacagggag

SEQ ID NO: 2198161 - RNA, 18 nt, Human
caaauguuuacagggagc

SEQ ID NO: 2198162 - RNA, 20 nt, Human
caaauguuuacagggagccu

SEQ ID NO: 2198163 - RNA, 22 nt, Human
caaauguuuacagggagccucc

SEQ ID NO: 2198164 - RNA, 18 nt, Human
caaauucugucucuggau

SEQ ID NO: 2198165 - RNA, 15 nt, Human
caaauuaauaaucuu

SEQ ID NO: 2198166 - RNA, 22 nt, Human
caaauuaaggguuaagaaaaga

SEQ ID NO: 2198167 - RNA, 13 nt, Human
caaauuaacuuga

SEQ ID NO: 2198168 - RNA, 19 nt, Human
caaauugagagaauggaaa

SEQ ID NO: 2198169 - RNA, 17 nt, Human
caaauugaacucuuuga

SEQ ID NO: 2198170 - RNA, 15 nt, Human
caaauucuucugaac

SEQ ID NO: 2198171 - RNA, 15 nt, Human
caaauucuguuucuu

SEQ ID NO: 2198172 - RNA, 14 nt, Human
caaauucuucugaa

SEQ ID NO: 2198173 - RNA, 14 nt, Human
caaauucuguuucu

SEQ ID NO: 2198174 - RNA, 17 nt, Human
caaauuaauaaucuuau

SEQ ID NO: 2198175 - RNA, 16 nt, Human
caaauuaauaaucuua

SEQ ID NO: 2198176 - RNA, 17 nt, Human
caaauugcuugaaagaa

SEQ ID NO: 2198177 - RNA, 19 nt, Human
caaauugcuugaaagaaaa

SEQ ID NO: 2198178 - RNA, 22 nt, Human
caaauugcuccuaagcuucaaa

SEQ ID NO: 2198179 - RNA, 15 nt, Human
caaauuaaucuuucu

SEQ ID NO: 2198180 - RNA, 20 nt, Human
caaauugcuuacuuuggaau

SEQ ID NO: 2198181 - RNA, 21 nt, Human
caaauuggagcuucauggcag

SEQ ID NO: 2198182 - RNA, 20 nt, Human
caacaggcugggcuucagug

SEQ ID NO: 2198183 - RNA, 15 nt, Human
caaacuggggccucc

SEQ ID NO: 2198184 - RNA, 19 nt, Human
cacccaagagauuguuguu

SEQ ID NO: 2198185 - RNA, 13 nt, Human
cacccaagcuugg

SEQ ID NO: 2198186 - RNA, 14 nt, Human
cacccaagcuuggc

SEQ ID NO: 2198187 - RNA, 15 nt, Human
cacccaagcuuggca

SEQ ID NO: 2198188 - RNA, 16 nt, Human
cacccaagcaaggcca

SEQ ID NO: 2198189 - RNA, 13 nt, Human
cacccaagggccu

SEQ ID NO: 2198190 - RNA, 17 nt, Human
cacccaagcuuggcagc

SEQ ID NO: 2198191 - RNA, 19 nt, Human
cacccaagcuuggcagccg

SEQ ID NO: 2198192 - RNA, 21 nt, Human
cacccaagcuuggcagccgag

SEQ ID NO: 2198193 - RNA, 23 nt, Human
cacccaaaagucaaaaggugccu

SEQ ID NO: 2198194 - RNA, 14 nt, Human
cacccaaaagucaa

SEQ ID NO: 2198195 - RNA, 22 nt, Human
cacccaaagagguauuuaucuu

SEQ ID NO: 2198196 - RNA, 17 nt, Human
caccauuuggcaaugcc

SEQ ID NO: 2198197 - RNA, 14 nt, Human
caccauucugacuc

SEQ ID NO: 2198198 - RNA, 13 nt, Human
caccauucugacu

SEQ ID NO: 2198199 - RNA, 13 nt, Human
caccauucagguc

SEQ ID NO: 2198200 - RNA, 13 nt, Human
caccauuccugga

SEQ ID NO: 2198201 - RNA, 23 nt, Human
caccauuccuggaaaccacaguc

SEQ ID NO: 2198202 - RNA, 14 nt, Human
caccauuccuggaa

SEQ ID NO: 2198203 - RNA, 23 nt, Human
caccauguuugagcucagacccc

SEQ ID NO: 2198204 - RNA, 14 nt, Human
caccauuaaaaggg

SEQ ID NO: 2198205 - RNA, 22 nt, Human
caccauuaaaagggauuaccca

SEQ ID NO: 2198206 - RNA, 18 nt, Human
caccauguuugagcucag

SEQ ID NO: 2198207 - RNA, 22 nt, Human
caccauguuugagcucagaccc

SEQ ID NO: 2198208 - RNA, 19 nt, Human
caccauguuugagcucaga

SEQ ID NO: 2198209 - RNA, 19 nt, Human
cacagcccaaagaaggaaa

SEQ ID NO: 2198210 - RNA, 22 nt, Human
cacagccaucccagccuuggca

SEQ ID NO: 2198211 - RNA, 14 nt, Human
cacagcccacgucc

SEQ ID NO: 2198212 - RNA, 16 nt, Human
cacagccaucccagcc

SEQ ID NO: 2198213 - RNA, 17 nt, Human
cacagccaucccagccu

SEQ ID NO: 2198214 - RNA, 19 nt, Human
cacagccaucccagccuug

SEQ ID NO: 2198215 - RNA, 20 nt, Human
cacagccaucccagccuugg

SEQ ID NO: 2198216 - RNA, 15 nt, Human
cacagccaggugccu

SEQ ID NO: 2198217 - RNA, 16 nt, Human
cacagccaggugccuu

SEQ ID NO: 2198218 - RNA, 17 nt, Human
cacagccaggugccuug

SEQ ID NO: 2198219 - RNA, 19 nt, Human
cacagccaggugccuugga

SEQ ID NO: 2198220 - RNA, 20 nt, Human
cacagccaggugccuuggag

SEQ ID NO: 2198221 - RNA, 13 nt, Human
cacagccauccca

SEQ ID NO: 2198222 - RNA, 18 nt, Human
cacagcucuucuccaggc

SEQ ID NO: 2198223 - RNA, 16 nt, Human
cacagcccacguccug

SEQ ID NO: 2198224 - RNA, 17 nt, Human
cacagcccacguccugu

SEQ ID NO: 2198225 - RNA, 18 nt, Human
cacagcccacguccuguc

SEQ ID NO: 2198226 - RNA, 20 nt, Human
cacagcccacguccugucag

SEQ ID NO: 2198227 - RNA, 12 nt, Human
cacagcacagcc

SEQ ID NO: 2198228 - RNA, 15 nt, Human
cacagcacagccaac

SEQ ID NO: 2198229 - RNA, 15 nt, Human
cacagccagcaccug

SEQ ID NO: 2198230 - RNA, 16 nt, Human
cacagccagcaccugg

SEQ ID NO: 2198231 - RNA, 17 nt, Human
cacagccagcaccuggc

SEQ ID NO: 2198232 - RNA, 20 nt, Human
cacagccagcaccuggcauc

SEQ ID NO: 2198233 - RNA, 17 nt, Human
cacagcaaggcaccugc

SEQ ID NO: 2198234 - RNA, 19 nt, Human
cacagcaaggcaccugcag

SEQ ID NO: 2198235 - RNA, 16 nt, Human
cacagcaaggaggcug

SEQ ID NO: 2198236 - RNA, 18 nt, Human
cacagcaaggaggcuggc

SEQ ID NO: 2198237 - RNA, 21 nt, Human
cacagcaaggaggcuggcugg

SEQ ID NO: 2198238 - RNA, 22 nt, Human
cacagcaaggaggcuggcuggg

SEQ ID NO: 2198239 - RNA, 23 nt, Human
cacagcaaggaggcuggcugggg

SEQ ID NO: 2198240 - RNA, 15 nt, Human
cacagcaaggcaccu

SEQ ID NO: 2198241 - RNA, 17 nt, Human
cacacgccucccacugg

SEQ ID NO: 2198242 - RNA, 20 nt, Human
cacacgcaggaacucccagc

SEQ ID NO: 2198243 - RNA, 21 nt, Human
cacacgcaggaacucccagca

SEQ ID NO: 2198244 - RNA, 20 nt, Human
cacacgccucccacuggggu

SEQ ID NO: 2198245 - RNA, 22 nt, Human
cacacgcaggaacucccagcaa

SEQ ID NO: 2198246 - RNA, 13 nt, Human
cacacgcacgcac

SEQ ID NO: 2198247 - RNA, 14 nt, Human
cacacgcacgcaca

SEQ ID NO: 2198248 - RNA, 15 nt, Human
cacacgcacgcacac

SEQ ID NO: 2198249 - RNA, 17 nt, Human
cacacgcacgcacacac

SEQ ID NO: 2198250 - RNA, 19 nt, Human
cacacgcacgcacacacac

SEQ ID NO: 2198251 - RNA, 21 nt, Human
cacacgcacgcacacacacaa

SEQ ID NO: 2198252 - RNA, 14 nt, Human
cacacgcaggaacu

SEQ ID NO: 2198253 - RNA, 19 nt, Human
cacacgcaggaacucccag

SEQ ID NO: 2198254 - RNA, 22 nt, Human
cacacggacacucaaaagcugg

SEQ ID NO: 2198255 - RNA, 22 nt, Human
cacacgcuccucccucugaggc

SEQ ID NO: 2198256 - RNA, 20 nt, Human
cacacggaggcaucugcacc

SEQ ID NO: 2198257 - RNA, 18 nt, Human
cacacggaggcaucugca

SEQ ID NO: 2198258 - RNA, 19 nt, Human
cacacguaaugaaacuugg

SEQ ID NO: 2198259 - RNA, 17 nt, Human
cacacguacuuaaauga

SEQ ID NO: 2198260 - RNA, 20 nt, Human
cacacgguuugaagccugga

SEQ ID NO: 2198261 - RNA, 21 nt, Human
cacacggaggcaucugcaccc

SEQ ID NO: 2198262 - RNA, 19 nt, Human
cacacgguuugaagccugg

SEQ ID NO: 2198263 - RNA, 20 nt, Human
cacacguaaugaaacuugga

SEQ ID NO: 2198264 - RNA, 24 nt, Human
cacacgucugacccucuccacccc

SEQ ID NO: 2198265 - RNA, 20 nt, Human
cacacgucugacccucucca

SEQ ID NO: 2198266 - RNA, 19 nt, Human
cacacgucauguuucuuca

SEQ ID NO: 2198267 - RNA, 20 nt, Human
cacacgucauuucuuagcua

SEQ ID NO: 2198268 - RNA, 16 nt, Human
cacacgugcaauuugu

SEQ ID NO: 2198269 - RNA, 18 nt, Human
cacagcaaccccaggcug

SEQ ID NO: 2198270 - RNA, 17 nt, Human
cacagcaaccccaggcu

SEQ ID NO: 2198271 - RNA, 14 nt, Human
cacagcaaccccag

SEQ ID NO: 2198272 - RNA, 16 nt, Human
cacaggaugaaggcaa

SEQ ID NO: 2198273 - RNA, 19 nt, Human
cacaggauccuauucucac

SEQ ID NO: 2198274 - RNA, 20 nt, Human
cacaggauccuauucucacc

SEQ ID NO: 2198275 - RNA, 23 nt, Human
cacaggauccuauucucaccagg

SEQ ID NO: 2198276 - RNA, 17 nt, Human
cacaggaucagucugau

SEQ ID NO: 2198277 - RNA, 15 nt, Human
cacaggacucugccu

SEQ ID NO: 2198278 - RNA, 16 nt, Human
cacaggacucugccuc

SEQ ID NO: 2198279 - RNA, 16 nt, Human
cacaggacccccuucc

SEQ ID NO: 2198280 - RNA, 17 nt, Human
cacaggacccccuuccc

SEQ ID NO: 2198281 - RNA, 19 nt, Human
cacaggacccccuuccccu

SEQ ID NO: 2198282 - RNA, 17 nt, Human
cacaggacauuucucua

SEQ ID NO: 2198283 - RNA, 15 nt, Human
cacaggacauuucuc

SEQ ID NO: 2198284 - RNA, 16 nt, Human
cacaggacacagucag

SEQ ID NO: 2198285 - RNA, 19 nt, Human
cacaggacacagucagauu

SEQ ID NO: 2198286 - RNA, 17 nt, Human
cacaggacacagucaga

SEQ ID NO: 2198287 - RNA, 20 nt, Human
cacaggacaugcgguagcca

SEQ ID NO: 2198288 - RNA, 23 nt, Human
cacaggacaugcgguagccagca

SEQ ID NO: 2198289 - RNA, 22 nt, Human
cacaggacaugcgguagccagc

SEQ ID NO: 2198290 - RNA, 19 nt, Human
cacagcucuucuccaggcu

SEQ ID NO: 2198291 - RNA, 20 nt, Human
cacagcucuucuccaggcug

SEQ ID NO: 2198292 - RNA, 19 nt, Human
cacaggcaacugaggcaga

SEQ ID NO: 2198293 - RNA, 18 nt, Human
cacaggcaacugaggcag

SEQ ID NO: 2198294 - RNA, 17 nt, Human
cacaggcaacugaggca

SEQ ID NO: 2198295 - RNA, 14 nt, Human
cacaggcaacugag

SEQ ID NO: 2198296 - RNA, 24 nt, Human
cacaggauccuauucucaccagga

SEQ ID NO: 2198297 - RNA, 16 nt, Human
cacaggcaaaauccuu

SEQ ID NO: 2198298 - RNA, 13 nt, Human
cacaggcaacuga

SEQ ID NO: 2198299 - RNA, 20 nt, Human
cacaggcaaaauccuugcuu

SEQ ID NO: 2198300 - RNA, 20 nt, Human
cacaggcaacugaggcagac

SEQ ID NO: 2198301 - RNA, 20 nt, Human
cacaggcaguuacuucugag

SEQ ID NO: 2198302 - RNA, 19 nt, Human
cacaggcagguccaggguu

SEQ ID NO: 2198303 - RNA, 22 nt, Human
cacagucucuuuaaucuucagu

SEQ ID NO: 2198304 - RNA, 14 nt, Human
cacagucucucucu

SEQ ID NO: 2198305 - RNA, 16 nt, Human
cacagucuaauuuuua

SEQ ID NO: 2198306 - RNA, 17 nt, Human
cacagucuaauuuuuau

SEQ ID NO: 2198307 - RNA, 23 nt, Human
cacaguccuuaccagcagagcac

SEQ ID NO: 2198308 - RNA, 14 nt, Human
cacaggcccggcuc

SEQ ID NO: 2198309 - RNA, 12 nt, Human
cacaggcccccu

SEQ ID NO: 2198310 - RNA, 13 nt, Human
cacaggcccccuu

SEQ ID NO: 2198311 - RNA, 21 nt, Human
cacaggcccccuugagugggg

SEQ ID NO: 2198312 - RNA, 22 nt, Human
cacaggcccccuugaguggggu

SEQ ID NO: 2198313 - RNA, 23 nt, Human
cacagugacucgggcuccugugc

SEQ ID NO: 2198314 - RNA, 19 nt, Human
cacagugacucgggcuccu

SEQ ID NO: 2198315 - RNA, 20 nt, Human
cacagugacucgggcuccug

SEQ ID NO: 2198316 - RNA, 21 nt, Human
cacagugacucgggcuccugu

SEQ ID NO: 2198317 - RNA, 22 nt, Human
cacagugacucgggcuccugug

SEQ ID NO: 2198318 - RNA, 22 nt, Human
cacagugaaggcuguccuuacc

SEQ ID NO: 2198319 - RNA, 18 nt, Human
cacagugacucgggcucc

SEQ ID NO: 2198320 - RNA, 17 nt, Human
cacagugaaggcugucc

SEQ ID NO: 2198321 - RNA, 15 nt, Human
cacagugaagcaaau

SEQ ID NO: 2198322 - RNA, 15 nt, Human
cacagugaagugcug

SEQ ID NO: 2198323 - RNA, 22 nt, Human
cacaguuuucugagaaagacua

SEQ ID NO: 2198324 - RNA, 21 nt, Human
cacaguuuucugagaaagacu

SEQ ID NO: 2198325 - RNA, 19 nt, Human
cacaguuuugguugcuuua

SEQ ID NO: 2198326 - RNA, 21 nt, Human
cacaguuuucuggcuggagcc

SEQ ID NO: 2198327 - RNA, 16 nt, Human
cacaugaaguccaagc

SEQ ID NO: 2198328 - RNA, 17 nt, Human
cacaugaaguccaagca

SEQ ID NO: 2198329 - RNA, 20 nt, Human
cacaugaaguccaagcauuu

SEQ ID NO: 2198330 - RNA, 15 nt, Human
cacaugagauaauau

SEQ ID NO: 2198331 - RNA, 21 nt, Human
cacaugacaacuuugccagcu

SEQ ID NO: 2198332 - RNA, 20 nt, Human
cacaugacucgggggugggg

SEQ ID NO: 2198333 - RNA, 24 nt, Human
cacaugaaucccacccacauguga

SEQ ID NO: 2198334 - RNA, 23 nt, Human
cacaguuuugguugcuuuaauau

SEQ ID NO: 2198335 - RNA, 20 nt, Human
cacaguuuugguugcuuuaa

SEQ ID NO: 2198336 - RNA, 13 nt, Human
cacaugagcauca

SEQ ID NO: 2198337 - RNA, 17 nt, Human
cacaugagcaucaggcc

SEQ ID NO: 2198338 - RNA, 18 nt, Human
cacaugagcaucaggcca

SEQ ID NO: 2198339 - RNA, 19 nt, Human
cacaugagcaucaggccag

SEQ ID NO: 2198340 - RNA, 20 nt, Human
cacaugagcaucaggccagg

SEQ ID NO: 2198341 - RNA, 21 nt, Human
cacaugagcaucaggccaggc

SEQ ID NO: 2198342 - RNA, 14 nt, Human
cacaugcagcugca

SEQ ID NO: 2198343 - RNA, 20 nt, Human
cacaugccucucucaggcca

SEQ ID NO: 2198344 - RNA, 21 nt, Human
cacaugccucucucaggccaa

SEQ ID NO: 2198345 - RNA, 16 nt, Human
cacaugcugagucucc

SEQ ID NO: 2198346 - RNA, 17 nt, Human
cacaugcugagucuccc

SEQ ID NO: 2198347 - RNA, 18 nt, Human
cacaugcugagucuccca

SEQ ID NO: 2198348 - RNA, 21 nt, Human
cacaugcugagucucccaagg

SEQ ID NO: 2198349 - RNA, 22 nt, Human
cacaugcucaaugacucucugg

SEQ ID NO: 2198350 - RNA, 18 nt, Human
cacaugcggagaacaaau

SEQ ID NO: 2198351 - RNA, 19 nt, Human
cacauguauguuuugguau

SEQ ID NO: 2198352 - RNA, 22 nt, Human
cacaugcugagucucccaaggc

SEQ ID NO: 2198353 - RNA, 12 nt, Human
cacaugucaccg

SEQ ID NO: 2198354 - RNA, 20 nt, Human
cacaugucaguaccuucaaa

SEQ ID NO: 2198355 - RNA, 19 nt, Human
cacaugucaccguggaccu

SEQ ID NO: 2198356 - RNA, 20 nt, Human
cacaugucaccguggaccuu

SEQ ID NO: 2198357 - RNA, 22 nt, Human
cacaugucaccguggaccuucc

SEQ ID NO: 2198358 - RNA, 23 nt, Human
cacaugucaccguggaccuuccu

SEQ ID NO: 2198359 - RNA, 16 nt, Human
cacauguccaagaagc

SEQ ID NO: 2198360 - RNA, 17 nt, Human
cacauguccaagaagcc

SEQ ID NO: 2198361 - RNA, 21 nt, Human
cacaugagaucuaggugagga

SEQ ID NO: 2198362 - RNA, 18 nt, Human
cacaugagcuauuuccau

SEQ ID NO: 2198363 - RNA, 14 nt, Human
cacaugagucccag

SEQ ID NO: 2198364 - RNA, 16 nt, Human
cacaugagauaauaug

SEQ ID NO: 2198365 - RNA, 18 nt, Human
cacaugagucccaguggg

SEQ ID NO: 2198366 - RNA, 15 nt, Human
cacaugagucccagu

SEQ ID NO: 2198367 - RNA, 17 nt, Human
cacaugagucccagugg

SEQ ID NO: 2198368 - RNA, 19 nt, Human
cacaugcaaggucauuuuu

SEQ ID NO: 2198369 - RNA, 17 nt, Human
cacaugcaaggucauuu

SEQ ID NO: 2198370 - RNA, 18 nt, Human
cacaugcacgugugugca

SEQ ID NO: 2198371 - RNA, 20 nt, Human
cacaugcaaggucauuuuuu

SEQ ID NO: 2198372 - RNA, 14 nt, Human
cacaugcauacaca

SEQ ID NO: 2198373 - RNA, 13 nt, Human
cacaugcauacac

SEQ ID NO: 2198374 - RNA, 18 nt, Human
cacaugcauacacacaca

SEQ ID NO: 2198375 - RNA, 17 nt, Human
cacaugcauacacacac

SEQ ID NO: 2198376 - RNA, 16 nt, Human
cacaugcauacacaca

SEQ ID NO: 2198377 - RNA, 15 nt, Human
cacaugcauacacac

SEQ ID NO: 2198378 - RNA, 17 nt, Human
caccagucacugucccu

SEQ ID NO: 2198379 - RNA, 15 nt, Human
caccagucacugucc

SEQ ID NO: 2198380 - RNA, 16 nt, Human
caccagguagaacaca

SEQ ID NO: 2198381 - RNA, 23 nt, Human
caccaggguugaccccagaggau

SEQ ID NO: 2198382 - RNA, 22 nt, Human
caccaggguugaccccagagga

SEQ ID NO: 2198383 - RNA, 21 nt, Human
caccagugacuuuuucuaaga

SEQ ID NO: 2198384 - RNA, 13 nt, Human
caccagugucccc

SEQ ID NO: 2198385 - RNA, 14 nt, Human
caccaguguccccu

SEQ ID NO: 2198386 - RNA, 16 nt, Human
caccaguguccccucc

SEQ ID NO: 2198387 - RNA, 18 nt, Human
caccaguguccccuccac

SEQ ID NO: 2198388 - RNA, 11 nt, Human
caccagcacca

SEQ ID NO: 2198389 - RNA, 21 nt, Human
caccagaggcugcagaaggcc

SEQ ID NO: 2198390 - RNA, 23 nt, Human
caccagaggcugcagaaggccaa

SEQ ID NO: 2198391 - RNA, 21 nt, Human
caccagagcauuuccaacacc

SEQ ID NO: 2198392 - RNA, 11 nt, Human
caccagagcug

SEQ ID NO: 2198393 - RNA, 16 nt, Human
caccagaggcugcaga

SEQ ID NO: 2198394 - RNA, 20 nt, Human
caccagaggcugcagaaggc

SEQ ID NO: 2198395 - RNA, 19 nt, Human
caccaggguugaccccaga

SEQ ID NO: 2198396 - RNA, 15 nt, Human
caccagggguuucuc

SEQ ID NO: 2198397 - RNA, 20 nt, Human
caccaggggcaggcacagca

SEQ ID NO: 2198398 - RNA, 21 nt, Human
caccaggggcaggcacagcac

SEQ ID NO: 2198399 - RNA, 12 nt, Human
caccaggggcag

SEQ ID NO: 2198400 - RNA, 13 nt, Human
caccaggggcagg

SEQ ID NO: 2198401 - RNA, 16 nt, Human
caccaggggcaggcac

SEQ ID NO: 2198402 - RNA, 17 nt, Human
caccaggggcaggcaca

SEQ ID NO: 2198403 - RNA, 18 nt, Human
caccaggggcaggcacag

SEQ ID NO: 2198404 - RNA, 19 nt, Human
caccaggggcaggcacagc

SEQ ID NO: 2198405 - RNA, 18 nt, Human
caccaguuccuuucaaug

SEQ ID NO: 2198406 - RNA, 18 nt, Human
caccauaggucaccuuua

SEQ ID NO: 2198407 - RNA, 21 nt, Human
caccauauuaccacagacaua

SEQ ID NO: 2198408 - RNA, 21 nt, Human
caccauauucagugcuguggc

SEQ ID NO: 2198409 - RNA, 16 nt, Human
caccauauucagugcu

SEQ ID NO: 2198410 - RNA, 13 nt, Human
caccaucaagcca

SEQ ID NO: 2198411 - RNA, 14 nt, Human
caccaucaagccac

SEQ ID NO: 2198412 - RNA, 15 nt, Human
caccaucaagccacc

SEQ ID NO: 2198413 - RNA, 19 nt, Human
caccauguuggccaggcug

SEQ ID NO: 2198414 - RNA, 20 nt, Human
caccauguuggccaggcugg

SEQ ID NO: 2198415 - RNA, 20 nt, Human
caccauguuggccaggcugc

SEQ ID NO: 2198416 - RNA, 16 nt, Human
caccauggccagccaa

SEQ ID NO: 2198417 - RNA, 12 nt, Human
caccauggccag

SEQ ID NO: 2198418 - RNA, 18 nt, Human
caccaugggguccuacca

SEQ ID NO: 2198419 - RNA, 23 nt, Human
caccaugggguccuaccaauaga

SEQ ID NO: 2198420 - RNA, 18 nt, Human
caccauguacauagcuug

SEQ ID NO: 2198421 - RNA, 20 nt, Human
caccauguugcccaggcugg

SEQ ID NO: 2198422 - RNA, 14 nt, Human
caccaucucaggcc

SEQ ID NO: 2198423 - RNA, 13 nt, Human
caccaucucaggc

SEQ ID NO: 2198424 - RNA, 13 nt, Human
caccauccugcug

SEQ ID NO: 2198425 - RNA, 18 nt, Human
caccauccgccagggccc

SEQ ID NO: 2198426 - RNA, 15 nt, Human
caccauccugcagcc

SEQ ID NO: 2198427 - RNA, 20 nt, Human
caccauccugcagccuccuc

SEQ ID NO: 2198428 - RNA, 21 nt, Human
caccauccugcagccuccucc

SEQ ID NO: 2198429 - RNA, 21 nt, Human
caccaucucaggccaccugcc

SEQ ID NO: 2198430 - RNA, 20 nt, Human
caccaucucaggccaccugc

SEQ ID NO: 2198431 - RNA, 19 nt, Human
caccaucucaggccaccug

SEQ ID NO: 2198432 - RNA, 18 nt, Human
caccaucucaggccaccu

SEQ ID NO: 2198433 - RNA, 22 nt, Human
caccaucucaggccaccugccc

SEQ ID NO: 2198434 - RNA, 23 nt, Human
caccaucuuaagagaugccucau

SEQ ID NO: 2198435 - RNA, 14 nt, Human
caccaucuuugcag

SEQ ID NO: 2198436 - RNA, 11 nt, Human
caccaugaaac

SEQ ID NO: 2198437 - RNA, 21 nt, Human
caccaugcagugccccuagcu

SEQ ID NO: 2198438 - RNA, 22 nt, Human
caccaugcagugccccuagcuu

SEQ ID NO: 2198439 - RNA, 21 nt, Human
caccaugccaggcuaauuuuu

SEQ ID NO: 2198440 - RNA, 15 nt, Human
caccaucaugucugg

SEQ ID NO: 2198441 - RNA, 17 nt, Human
caccaucaugucuggcu

SEQ ID NO: 2198442 - RNA, 18 nt, Human
caccaucaugucuggcua

SEQ ID NO: 2198443 - RNA, 15 nt, Human
caccaucccuuuuug

SEQ ID NO: 2198444 - RNA, 16 nt, Human
caccaucccuuuuuga

SEQ ID NO: 2198445 - RNA, 19 nt, Human
caccaucccuuuuugaagu

SEQ ID NO: 2198446 - RNA, 20 nt, Human
caccaucccuuuuugaagug

SEQ ID NO: 2198447 - RNA, 21 nt, Human
caccaucccuuuuugaagugu

SEQ ID NO: 2198448 - RNA, 16 nt, Human
caccaucaagccacca

SEQ ID NO: 2198449 - RNA, 17 nt, Human
caccaucaagccaccaa

SEQ ID NO: 2198450 - RNA, 19 nt, Human
caccaucaagccaccaaca

SEQ ID NO: 2198451 - RNA, 24 nt, Human
caccaucaagccaccaacauacuc

SEQ ID NO: 2198452 - RNA, 14 nt, Human
caccaagccaaggg

SEQ ID NO: 2198453 - RNA, 14 nt, Human
caccaagcugugcc

SEQ ID NO: 2198454 - RNA, 13 nt, Human
caccaagcccagu

SEQ ID NO: 2198455 - RNA, 12 nt, Human
caccaagcccag

SEQ ID NO: 2198456 - RNA, 19 nt, Human
caccaagcacagcagccug

SEQ ID NO: 2198457 - RNA, 18 nt, Human
caccaagcacagcagccu

SEQ ID NO: 2198458 - RNA, 21 nt, Human
caccaagcaggaaaugaaaau

SEQ ID NO: 2198459 - RNA, 13 nt, Human
caccaagccaagg

SEQ ID NO: 2198460 - RNA, 18 nt, Human
caccaauugauuuuaaac

SEQ ID NO: 2198461 - RNA, 15 nt, Human
caccaagcugugcca

SEQ ID NO: 2198462 - RNA, 16 nt, Human
caccaagcugugccac

SEQ ID NO: 2198463 - RNA, 18 nt, Human
caccaagcugugccaccc

SEQ ID NO: 2198464 - RNA, 20 nt, Human
caccaagcugugccacccug

SEQ ID NO: 2198465 - RNA, 21 nt, Human
caccaagcugugccacccugg

SEQ ID NO: 2198466 - RNA, 22 nt, Human
caccaagcugugccacccuggg

SEQ ID NO: 2198467 - RNA, 23 nt, Human
caccaagcugugccacccugggc

SEQ ID NO: 2198468 - RNA, 10 nt, Human
caccaagggc

SEQ ID NO: 2198469 - RNA, 18 nt, Human
caccaagggcgcaagagu

SEQ ID NO: 2198470 - RNA, 19 nt, Human
caccaagggcgcaagagua

SEQ ID NO: 2198471 - RNA, 23 nt, Human
caccaagggcgcaagaguagcgg

SEQ ID NO: 2198472 - RNA, 14 nt, Human
caccaaggucuuca

SEQ ID NO: 2198473 - RNA, 15 nt, Human
caccaaggucuucag

SEQ ID NO: 2198474 - RNA, 20 nt, Human
caccaaggucuucagccauc

SEQ ID NO: 2198475 - RNA, 21 nt, Human
caccaaggucuucagccauca

SEQ ID NO: 2198476 - RNA, 15 nt, Human
caccaagaaagcagg

SEQ ID NO: 2198477 - RNA, 18 nt, Human
caccaacucuugcagguc

SEQ ID NO: 2198478 - RNA, 22 nt, Human
caccaagacuuguuuuaugcuc

SEQ ID NO: 2198479 - RNA, 13 nt, Human
caccaagcacagc

SEQ ID NO: 2198480 - RNA, 17 nt, Human
caccaagcacagcagcc

SEQ ID NO: 2198481 - RNA, 16 nt, Human
caccaagcacagcagc

SEQ ID NO: 2198482 - RNA, 15 nt, Human
caccaagcacagcag

SEQ ID NO: 2198483 - RNA, 14 nt, Human
caccaagcacagca

SEQ ID NO: 2198484 - RNA, 14 nt, Human
caccaacucuugca

SEQ ID NO: 2198485 - RNA, 17 nt, Human
caccaacgucugugcca

SEQ ID NO: 2198486 - RNA, 18 nt, Human
cacauguccaagaagccc

SEQ ID NO: 2198487 - RNA, 19 nt, Human
cacauguccaagaagccca

SEQ ID NO: 2198488 - RNA, 21 nt, Human
cacauguccaagaagcccagg

SEQ ID NO: 2198489 - RNA, 22 nt, Human
cacauguccaagaagcccagga

SEQ ID NO: 2198490 - RNA, 15 nt, Human
caccacgauguggcc

SEQ ID NO: 2198491 - RNA, 21 nt, Human
caccaccuucccagcucuccc

SEQ ID NO: 2198492 - RNA, 22 nt, Human
caccaccuucccagcucucccu

SEQ ID NO: 2198493 - RNA, 19 nt, Human
caccaccuucccagcucuc

SEQ ID NO: 2198494 - RNA, 18 nt, Human
caccaccuucccagcucu

SEQ ID NO: 2198495 - RNA, 16 nt, Human
caccaccuucccagcu

SEQ ID NO: 2198496 - RNA, 15 nt, Human
caccaccuucccagc

SEQ ID NO: 2198497 - RNA, 21 nt, Human
caccacgauguggcccuggcc

SEQ ID NO: 2198498 - RNA, 20 nt, Human
caccacgauguggcccuggc

SEQ ID NO: 2198499 - RNA, 19 nt, Human
caccacgauguggcccugg

SEQ ID NO: 2198500 - RNA, 18 nt, Human
caccacgauguggcccug

SEQ ID NO: 2198501 - RNA, 14 nt, Human
caccacgcccggcu

SEQ ID NO: 2198502 - RNA, 15 nt, Human
caccacgcccggcua

SEQ ID NO: 2198503 - RNA, 19 nt, Human
caccacgcuggggucuggg

SEQ ID NO: 2198504 - RNA, 16 nt, Human
caccacggccacuggc

SEQ ID NO: 2198505 - RNA, 14 nt, Human
caccagacacccag

SEQ ID NO: 2198506 - RNA, 18 nt, Human
caccagacacccaggacu

SEQ ID NO: 2198507 - RNA, 17 nt, Human
caccagacacccaggac

SEQ ID NO: 2198508 - RNA, 16 nt, Human
caccagacacccagga

SEQ ID NO: 2198509 - RNA, 15 nt, Human
caccagacacccagg

SEQ ID NO: 2198510 - RNA, 14 nt, Human
caccaccuucccag

SEQ ID NO: 2198511 - RNA, 13 nt, Human
caccaccuuccca

SEQ ID NO: 2198512 - RNA, 14 nt, Human
caccacagacacac

SEQ ID NO: 2198513 - RNA, 17 nt, Human
caccacacccagccuca

SEQ ID NO: 2198514 - RNA, 18 nt, Human
caccacacccagccucag

SEQ ID NO: 2198515 - RNA, 12 nt, Human
caccacagacac

SEQ ID NO: 2198516 - RNA, 13 nt, Human
caccacagacaca

SEQ ID NO: 2198517 - RNA, 19 nt, Human
caccacacugauccagccc

SEQ ID NO: 2198518 - RNA, 15 nt, Human
caccacacucagccc

SEQ ID NO: 2198519 - RNA, 19 nt, Human
caccacacccagcccacuu

SEQ ID NO: 2198520 - RNA, 14 nt, Human
caccacacucagcc

SEQ ID NO: 2198521 - RNA, 24 nt, Human
caccaauugguuaaucuuuccuga

SEQ ID NO: 2198522 - RNA, 15 nt, Human
caccacacccagccu

SEQ ID NO: 2198523 - RNA, 16 nt, Human
caccacacccagccuc

SEQ ID NO: 2198524 - RNA, 17 nt, Human
caccagagcccaccuug

SEQ ID NO: 2198525 - RNA, 18 nt, Human
caccagagcccaccuugg

SEQ ID NO: 2198526 - RNA, 20 nt, Human
caccagagcccaccuuggcu

SEQ ID NO: 2198527 - RNA, 22 nt, Human
caccagagcccaccuuggcuca

SEQ ID NO: 2198528 - RNA, 22 nt, Human
caccacgauguggcccuggccu

SEQ ID NO: 2198529 - RNA, 16 nt, Human
caccagagaccguccu

SEQ ID NO: 2198530 - RNA, 19 nt, Human
caccagagaccguccucac

SEQ ID NO: 2198531 - RNA, 20 nt, Human
caccagagaccguccucacc

SEQ ID NO: 2198532 - RNA, 21 nt, Human
caccagagaccguccucaccc

SEQ ID NO: 2198533 - RNA, 14 nt, Human
caccagagagggac

SEQ ID NO: 2198534 - RNA, 20 nt, Human
caccagacacccaggacuua

SEQ ID NO: 2198535 - RNA, 19 nt, Human
caccagacacccaggacuu

SEQ ID NO: 2198536 - RNA, 11 nt, Human
caccagagacc

SEQ ID NO: 2198537 - RNA, 15 nt, Human
caccagagcccaccu

SEQ ID NO: 2198538 - RNA, 21 nt, Human
caccagagagggacugacacc

SEQ ID NO: 2198539 - RNA, 12 nt, Human
caccagagcaga

SEQ ID NO: 2198540 - RNA, 16 nt, Human
caccagagcagaugca

SEQ ID NO: 2198541 - RNA, 17 nt, Human
caccagagcagaugcag

SEQ ID NO: 2198542 - RNA, 18 nt, Human
caccagagcagaugcaga

SEQ ID NO: 2198543 - RNA, 19 nt, Human
caccagagcagaugcagag

SEQ ID NO: 2198544 - RNA, 20 nt, Human
caccagagcagaugcagaga

SEQ ID NO: 2198545 - RNA, 23 nt, Human
uuuucacacaauacaauaaguua

SEQ ID NO: 2198546 - RNA, 14 nt, Human
uuuucacaaauaaa

SEQ ID NO: 2198547 - RNA, 18 nt, Human
uuuucaauuuugcaugcu

SEQ ID NO: 2198548 - RNA, 19 nt, Human
uuuucacugcuggcugccu

SEQ ID NO: 2198549 - RNA, 20 nt, Human
uuuucacugcuggcugccuu

SEQ ID NO: 2198550 - RNA, 20 nt, Human
uuuucacggaaguuuucaau

SEQ ID NO: 2198551 - RNA, 19 nt, Human
uuuucacggaaguuuucaa

SEQ ID NO: 2198552 - RNA, 21 nt, Human
uuuucacuggaguuacauuaa

SEQ ID NO: 2198553 - RNA, 15 nt, Human
uuuucagaaaauauu

SEQ ID NO: 2198554 - RNA, 16 nt, Human
uuuucacuguagaaug

SEQ ID NO: 2198555 - RNA, 18 nt, Human
uuuucacuuugugauuau

SEQ ID NO: 2198556 - RNA, 14 nt, Human
uuuucaauauuuau

SEQ ID NO: 2198557 - RNA, 16 nt, Human
uuuucaauauuuauua

SEQ ID NO: 2198558 - RNA, 10 nt, Human
uuuucaauua

SEQ ID NO: 2198559 - RNA, 12 nt, Human
uuuucaauuaaa

SEQ ID NO: 2198560 - RNA, 13 nt, Human
uuuucaauuaaac

SEQ ID NO: 2198561 - RNA, 14 nt, Human
uuuucaauuaaacg

SEQ ID NO: 2198562 - RNA, 15 nt, Human
uuuucaauuaaacgg

SEQ ID NO: 2198563 - RNA, 16 nt, Human
uuuucaauuaaacgga

SEQ ID NO: 2198564 - RNA, 17 nt, Human
uuuucaauuaaacggau

SEQ ID NO: 2198565 - RNA, 18 nt, Human
uuuucaauuaaacggauu

SEQ ID NO: 2198566 - RNA, 21 nt, Human
uuuucaauuaaacggauuauu

SEQ ID NO: 2198567 - RNA, 14 nt, Human
uuuucaauuuugca

SEQ ID NO: 2198568 - RNA, 22 nt, Human
uuuucaauuaaacggauuauuu

SEQ ID NO: 2198569 - RNA, 13 nt, Human
uuuucacaaauaa

SEQ ID NO: 2198570 - RNA, 15 nt, Human
uuuucacaguucucu

SEQ ID NO: 2198571 - RNA, 16 nt, Human
uuuucaagaauaauca

SEQ ID NO: 2198572 - RNA, 16 nt, Human
uuuucaaggcccucag

SEQ ID NO: 2198573 - RNA, 23 nt, Human
uuuucaacugccaaaaugcucua

SEQ ID NO: 2198574 - RNA, 13 nt, Human
uuuucaacugcca

SEQ ID NO: 2198575 - RNA, 15 nt, Human
uuuucaagaaacuga

SEQ ID NO: 2198576 - RNA, 14 nt, Human
uuuucaagaaacug

SEQ ID NO: 2198577 - RNA, 17 nt, Human
uuuucaacgcagcccug

SEQ ID NO: 2198578 - RNA, 15 nt, Human
uuuuaugcaaauauu

SEQ ID NO: 2198579 - RNA, 23 nt, Human
uuuuaugcaaauauuuuuuugua

SEQ ID NO: 2198580 - RNA, 21 nt, Human
uuuucaacgcagcccugcuuu

SEQ ID NO: 2198581 - RNA, 22 nt, Human
uuuucaacgcagcccugcuuug

SEQ ID NO: 2198582 - RNA, 17 nt, Human
uuuuaucccucaccugu

SEQ ID NO: 2198583 - RNA, 19 nt, Human
uuuuccuccgggagagggg

SEQ ID NO: 2198584 - RNA, 21 nt, Human
uuuuccucccuucugcuacug

SEQ ID NO: 2198585 - RNA, 20 nt, Human
uuuuccucccuucugcuacu

SEQ ID NO: 2198586 - RNA, 21 nt, Human
uuuuccucccuuggguucuga

SEQ ID NO: 2198587 - RNA, 22 nt, Human
uuuuccucccuuggguucugau

SEQ ID NO: 2198588 - RNA, 13 nt, Human
uuuuccugaaaac

SEQ ID NO: 2198589 - RNA, 13 nt, Human
uuuucccaaagcc

SEQ ID NO: 2198590 - RNA, 17 nt, Human
uuuuccucccuucugcu

SEQ ID NO: 2198591 - RNA, 14 nt, Human
uuuuccucccuucu

SEQ ID NO: 2198592 - RNA, 13 nt, Human
uuuuccucccuca

SEQ ID NO: 2198593 - RNA, 13 nt, Human
uuuuccuauuugu

SEQ ID NO: 2198594 - RNA, 18 nt, Human
uuuuccuauuuucagccc

SEQ ID NO: 2198595 - RNA, 16 nt, Human
uuuuccauugguuuac

SEQ ID NO: 2198596 - RNA, 14 nt, Human
uuuuccauguaucu

SEQ ID NO: 2198597 - RNA, 17 nt, Human
uuuuccauuguuugaaa

SEQ ID NO: 2198598 - RNA, 20 nt, Human
uuuuccaugcguguuucuga

SEQ ID NO: 2198599 - RNA, 16 nt, Human
uuuucagaaaauauua

SEQ ID NO: 2198600 - RNA, 18 nt, Human
uuuuccaugaguccccug

SEQ ID NO: 2198601 - RNA, 19 nt, Human
uuuuccaugaguccccugu

SEQ ID NO: 2198602 - RNA, 19 nt, Human
uuuucgaagcucagcccac

SEQ ID NO: 2198603 - RNA, 14 nt, Human
uuuucuucucccuc

SEQ ID NO: 2198604 - RNA, 18 nt, Human
uuuucuucuucccucccu

SEQ ID NO: 2198605 - RNA, 14 nt, Human
uuuucuucuucccu

SEQ ID NO: 2198606 - RNA, 15 nt, Human
uuuucuucuucccuc

SEQ ID NO: 2198607 - RNA, 17 nt, Human
uuuucuugcaugaggcu

SEQ ID NO: 2198608 - RNA, 15 nt, Human
uuuuccuugaagccg

SEQ ID NO: 2198609 - RNA, 17 nt, Human
uuuuccuuugaauccuc

SEQ ID NO: 2198610 - RNA, 16 nt, Human
uuuuccuuguccccac

SEQ ID NO: 2198611 - RNA, 12 nt, Human
uuuuccuuuaaa

SEQ ID NO: 2198612 - RNA, 19 nt, Human
uuuuccuuuuuuauacaca

SEQ ID NO: 2198613 - RNA, 21 nt, Human
uuuuccuuuaaaaaaauuuaa

SEQ ID NO: 2198614 - RNA, 16 nt, Human
uuuuccuuugucauca

SEQ ID NO: 2198615 - RNA, 23 nt, Human
uuuucgaacauucuuugccuggu

SEQ ID NO: 2198616 - RNA, 18 nt, Human
uuuuccucuucuauuuug

SEQ ID NO: 2198617 - RNA, 14 nt, Human
uuuuccuugaagcc

SEQ ID NO: 2198618 - RNA, 15 nt, Human
uuuuccuucagugcc

SEQ ID NO: 2198619 - RNA, 15 nt, Human
uuuuacugaagccuu

SEQ ID NO: 2198620 - RNA, 13 nt, Human
uuuuacugaacaa

SEQ ID NO: 2198621 - RNA, 11 nt, Human
uuuuacugaac

SEQ ID NO: 2198622 - RNA, 19 nt, Human
uuuuacugaagccuuucuu

SEQ ID NO: 2198623 - RNA, 14 nt, Human
uuuuacugaacaau

SEQ ID NO: 2198624 - RNA, 14 nt, Human
uuuuacugccacuc

SEQ ID NO: 2198625 - RNA, 22 nt, Human
uuuuacuugcauugaauauauu

SEQ ID NO: 2198626 - RNA, 17 nt, Human
uuuuacugccacucuuu

SEQ ID NO: 2198627 - RNA, 15 nt, Human
uuuuauauauacagu

SEQ ID NO: 2198628 - RNA, 14 nt, Human
uuuuacuguacaga

SEQ ID NO: 2198629 - RNA, 20 nt, Human
uuuuauaucaauuuaaaaaa

SEQ ID NO: 2198630 - RNA, 22 nt, Human
uuuuauaugaagauaaguguau

SEQ ID NO: 2198631 - RNA, 15 nt, Human
uuuuauaugcuucug

SEQ ID NO: 2198632 - RNA, 20 nt, Human
uuuuauaugcuucuguuuua

SEQ ID NO: 2198633 - RNA, 19 nt, Human
uuuuaucauuuucaaaaug

SEQ ID NO: 2198634 - RNA, 18 nt, Human
uuuuaucgucacugcuua

SEQ ID NO: 2198635 - RNA, 16 nt, Human
uuuuaugauacuugaa

SEQ ID NO: 2198636 - RNA, 20 nt, Human
uuuuaugauacuugaaaauu

SEQ ID NO: 2198637 - RNA, 15 nt, Human
uuuuaucaugacaug

SEQ ID NO: 2198638 - RNA, 12 nt, Human
uuuuaucaguag

SEQ ID NO: 2198639 - RNA, 16 nt, Human
uuuuaucaugcauguc

SEQ ID NO: 2198640 - RNA, 17 nt, Human
uuuuaucaugacauguu

SEQ ID NO: 2198641 - RNA, 19 nt, Human
uuuuaucaugacauguuau

SEQ ID NO: 2198642 - RNA, 11 nt, Human
uuuuauauuua

SEQ ID NO: 2198643 - RNA, 22 nt, Human
uuuuauauugauaacagcacug

SEQ ID NO: 2198644 - RNA, 15 nt, Human
uuuuaucacauguau

SEQ ID NO: 2198645 - RNA, 17 nt, Human
uuuuaucacauguaugu

SEQ ID NO: 2198646 - RNA, 17 nt, Human
uuuuauauuaaaauaag

SEQ ID NO: 2198647 - RNA, 14 nt, Human
uuuuauaugucaaa

SEQ ID NO: 2198648 - RNA, 23 nt, Human
uuuuauauuaaaauaagcacugu

SEQ ID NO: 2198649 - RNA, 10 nt, Human
uuuuauauuu

SEQ ID NO: 2198650 - RNA, 13 nt, Human
uuuuaauuugaua

SEQ ID NO: 2198651 - RNA, 22 nt, Human
uuuuaauuuauuuauuaagaug

SEQ ID NO: 2198652 - RNA, 12 nt, Human
uuuuaauuuugu

SEQ ID NO: 2198653 - RNA, 14 nt, Human
uuuuaauuuuaacc

SEQ ID NO: 2198654 - RNA, 13 nt, Human
uuuuaauuuugua

SEQ ID NO: 2198655 - RNA, 16 nt, Human
uuuuaauuuuguauuu

SEQ ID NO: 2198656 - RNA, 15 nt, Human
uuuuaauuuuguauu

SEQ ID NO: 2198657 - RNA, 16 nt, Human
uuuuacagcugccugc

SEQ ID NO: 2198658 - RNA, 16 nt, Human
uuuuacauacugcugu

SEQ ID NO: 2198659 - RNA, 15 nt, Human
uuuuacauacugcug

SEQ ID NO: 2198660 - RNA, 15 nt, Human
uuuuacauucugaau

SEQ ID NO: 2198661 - RNA, 13 nt, Human
uuuuacuccccuu

SEQ ID NO: 2198662 - RNA, 15 nt, Human
uuuuacuccaguggu

SEQ ID NO: 2198663 - RNA, 18 nt, Human
uuuuacccauauccccuc

SEQ ID NO: 2198664 - RNA, 15 nt, Human
uuuuacuagaacaca

SEQ ID NO: 2198665 - RNA, 15 nt, Human
uuuuacuacugugga

SEQ ID NO: 2198666 - RNA, 22 nt, Human
uuuuaccaugccccugagcaau

SEQ ID NO: 2198667 - RNA, 14 nt, Human
uuuuacccauaucc

SEQ ID NO: 2198668 - RNA, 13 nt, Human
uuuuaccaaguuu

SEQ ID NO: 2198669 - RNA, 21 nt, Human
uuuuaauuuauuuauacuauu

SEQ ID NO: 2198670 - RNA, 23 nt, Human
uuuuaauuuaugaguuuuugaua

SEQ ID NO: 2198671 - RNA, 20 nt, Human
uuuuaaacaaaauagaagcu

SEQ ID NO: 2198672 - RNA, 16 nt, Human
uuuuaaacaaaauaga

SEQ ID NO: 2198673 - RNA, 12 nt, Human
uuuuaaaaugag

SEQ ID NO: 2198674 - RNA, 19 nt, Human
uuuuaaaaugagagucacu

SEQ ID NO: 2198675 - RNA, 22 nt, Human
uuuuaaaaugagaaaucuaaaa

SEQ ID NO: 2198676 - RNA, 10 nt, Human
uuuguuguua

SEQ ID NO: 2198677 - RNA, 12 nt, Human
uuuguuuacaca

SEQ ID NO: 2198678 - RNA, 14 nt, Human
uuuguuuaaaagga

SEQ ID NO: 2198679 - RNA, 17 nt, Human
uuuuaaaaucuuuucua

SEQ ID NO: 2198680 - RNA, 18 nt, Human
uuuuaaaaucuuuucuau

SEQ ID NO: 2198681 - RNA, 15 nt, Human
uuuuaaaaugagaaa

SEQ ID NO: 2198682 - RNA, 23 nt, Human
uuugcauaguaccaaucauuuua

SEQ ID NO: 2198683 - RNA, 22 nt, Human
uuugcauaggugaucucauuua

SEQ ID NO: 2198684 - RNA, 21 nt, Human
uuugcauagauucccugagca

SEQ ID NO: 2198685 - RNA, 15 nt, Human
uuugccagugggaac

SEQ ID NO: 2198686 - RNA, 16 nt, Human
uuugccagugggaacu

SEQ ID NO: 2198687 - RNA, 14 nt, Human
uuugccaugggcuu

SEQ ID NO: 2198688 - RNA, 20 nt, Human
uuugccaugggcuucacugu

SEQ ID NO: 2198689 - RNA, 18 nt, Human
uuugccauguuggccagg

SEQ ID NO: 2198690 - RNA, 18 nt, Human
uuugauaguauugugcau

SEQ ID NO: 2198691 - RNA, 15 nt, Human
uuugauacuuguuca

SEQ ID NO: 2198692 - RNA, 19 nt, Human
uuugauaucacagucuaau

SEQ ID NO: 2198693 - RNA, 17 nt, Human
uuugauaucacagucua

SEQ ID NO: 2198694 - RNA, 20 nt, Human
uuugauaucacagucuaauu

SEQ ID NO: 2198695 - RNA, 17 nt, Human
uuugcacuguaugcugg

SEQ ID NO: 2198696 - RNA, 21 nt, Human
uuugcacuugugauuauuuau

SEQ ID NO: 2198697 - RNA, 14 nt, Human
uuugcagacaggca

SEQ ID NO: 2198698 - RNA, 21 nt, Human
uuugcagcagugagucucuuc

SEQ ID NO: 2198699 - RNA, 16 nt, Human
uuugcagaugacaaaa

SEQ ID NO: 2198700 - RNA, 21 nt, Human
uuugcagcugagagaaaauaa

SEQ ID NO: 2198701 - RNA, 22 nt, Human
uuugcagaaaagcaccugccga

SEQ ID NO: 2198702 - RNA, 20 nt, Human
uuugcagaaaagcaccugcc

SEQ ID NO: 2198703 - RNA, 19 nt, Human
uuugcagaaaagcaccugc

SEQ ID NO: 2198704 - RNA, 15 nt, Human
uuugcagaugacaaa

SEQ ID NO: 2198705 - RNA, 19 nt, Human
uuugcauaacguauaaaag

SEQ ID NO: 2198706 - RNA, 23 nt, Human
uuugcauaacguauaaaagccug

SEQ ID NO: 2198707 - RNA, 15 nt, Human
uuugagcaacuuucu

SEQ ID NO: 2198708 - RNA, 15 nt, Human
uuugagcaauuuucg

SEQ ID NO: 2198709 - RNA, 12 nt, Human
uuucuuagcuuu

SEQ ID NO: 2198710 - RNA, 13 nt, Human
uuucuuagcuuuu

SEQ ID NO: 2198711 - RNA, 16 nt, Human
uuucuuagcuuuuuaa

SEQ ID NO: 2198712 - RNA, 15 nt, Human
uuugagcagggcuca

SEQ ID NO: 2198713 - RNA, 22 nt, Human
uuucuuacaggcacaaaaugau

SEQ ID NO: 2198714 - RNA, 22 nt, Human
uuucuuagaaauuuauuuccua

SEQ ID NO: 2198715 - RNA, 14 nt, Human
uuucuuagaaauuu

SEQ ID NO: 2198716 - RNA, 20 nt, Human
uuucuuacugauuuuuaagu

SEQ ID NO: 2198717 - RNA, 22 nt, Human
uuucuuacugucuuuuuucuaa

SEQ ID NO: 2198718 - RNA, 18 nt, Human
uuucugaggagaaacaaa

SEQ ID NO: 2198719 - RNA, 16 nt, Human
uuucugaggagaaaca

SEQ ID NO: 2198720 - RNA, 21 nt, Human
uuucugagcccgggcugccug

SEQ ID NO: 2198721 - RNA, 10 nt, Human
uuucugagcg

SEQ ID NO: 2198722 - RNA, 14 nt, Human
uuucugagcgauua

SEQ ID NO: 2198723 - RNA, 15 nt, Human
uuucugagcugcucu

SEQ ID NO: 2198724 - RNA, 16 nt, Human
uuucugaguuccugca

SEQ ID NO: 2198725 - RNA, 17 nt, Human
uuucuuacauaauuuuu

SEQ ID NO: 2198726 - RNA, 16 nt, Human
uuugauacauauguga

SEQ ID NO: 2198727 - RNA, 16 nt, Human
uuugagugaggguuuc

SEQ ID NO: 2198728 - RNA, 16 nt, Human
uuugagugauuauuug

SEQ ID NO: 2198729 - RNA, 23 nt, Human
uuugauaauguuaaauuuguaag

SEQ ID NO: 2198730 - RNA, 19 nt, Human
uuugauacauaugugaaua

SEQ ID NO: 2198731 - RNA, 19 nt, Human
uuugauaauguuaaauuug

SEQ ID NO: 2198732 - RNA, 17 nt, Human
uuugauaauguuaaauu

SEQ ID NO: 2198733 - RNA, 16 nt, Human
uuugagguggaagagg

SEQ ID NO: 2198734 - RNA, 20 nt, Human
uuugagguuuuuaagccuua

SEQ ID NO: 2198735 - RNA, 19 nt, Human
uuugagcuuagugaaauua

SEQ ID NO: 2198736 - RNA, 17 nt, Human
uuugagcugccuucccu

SEQ ID NO: 2198737 - RNA, 19 nt, Human
uuugagcugaaaugcugca

SEQ ID NO: 2198738 - RNA, 21 nt, Human
uuugagcugaaaugcugcauu

SEQ ID NO: 2198739 - RNA, 12 nt, Human
uuugagcugccu

SEQ ID NO: 2198740 - RNA, 14 nt, Human
uuugagcugccuuc

SEQ ID NO: 2198741 - RNA, 20 nt, Human
uuugagcucugcagcccagg

SEQ ID NO: 2198742 - RNA, 14 nt, Human
uuugagcucagccc

SEQ ID NO: 2198743 - RNA, 22 nt, Human
uuugaggucuguucuuuccaaa

SEQ ID NO: 2198744 - RNA, 17 nt, Human
uuugaggucuguucuuu

SEQ ID NO: 2198745 - RNA, 12 nt, Human
uuuguuccccuc

SEQ ID NO: 2198746 - RNA, 13 nt, Human
uuuguuccccucc

SEQ ID NO: 2198747 - RNA, 15 nt, Human
uuuguuccccuccuc

SEQ ID NO: 2198748 - RNA, 16 nt, Human
uuuguugucagcugaa

SEQ ID NO: 2198749 - RNA, 16 nt, Human
uuuguuccccuccucc

SEQ ID NO: 2198750 - RNA, 18 nt, Human
uuuguuccccuccuccac

SEQ ID NO: 2198751 - RNA, 12 nt, Human
uuuguucaucug

SEQ ID NO: 2198752 - RNA, 13 nt, Human
uuuguucaucugu

SEQ ID NO: 2198753 - RNA, 15 nt, Human
uuuguuauuuugcaa

SEQ ID NO: 2198754 - RNA, 17 nt, Human
uuuguuaaauauuuaca

SEQ ID NO: 2198755 - RNA, 22 nt, Human
uuuguuaaauauuuacauauga

SEQ ID NO: 2198756 - RNA, 18 nt, Human
uuuguuaaauauuuacau

SEQ ID NO: 2198757 - RNA, 16 nt, Human
uuuguuauuuugcaac

SEQ ID NO: 2198758 - RNA, 20 nt, Human
uuuguguuguuggaaaaagu

SEQ ID NO: 2198759 - RNA, 21 nt, Human
uuuguguuguuggaaaaaguc

SEQ ID NO: 2198760 - RNA, 22 nt, Human
uuuguguuucagccauguauuu

SEQ ID NO: 2198761 - RNA, 12 nt, Human
uuugucccaggu

SEQ ID NO: 2198762 - RNA, 17 nt, Human
uuuguccuaaaacaccu

SEQ ID NO: 2198763 - RNA, 17 nt, Human
uuugucaucagccacca

SEQ ID NO: 2198764 - RNA, 21 nt, Human
uuugucaugaauucuuaugcu

SEQ ID NO: 2198765 - RNA, 20 nt, Human
uuugucauuagccugaguag

SEQ ID NO: 2198766 - RNA, 23 nt, Human
uuugucauuagccugaguagaaa

SEQ ID NO: 2198767 - RNA, 13 nt, Human
uuuguccccaccg

SEQ ID NO: 2198768 - RNA, 21 nt, Human
uuuguccccaccgcagacagg

SEQ ID NO: 2198769 - RNA, 14 nt, Human
uuugguguguuccc

SEQ ID NO: 2198770 - RNA, 18 nt, Human
uuugguuaagucuguuuu

SEQ ID NO: 2198771 - RNA, 20 nt, Human
uuugguuaagucuguuuuau

SEQ ID NO: 2198772 - RNA, 19 nt, Human
uuugguuaagucuguuuua

SEQ ID NO: 2198773 - RNA, 19 nt, Human
uuugguguguggagaugca

SEQ ID NO: 2198774 - RNA, 12 nt, Human
uuugguguguuc

SEQ ID NO: 2198775 - RNA, 13 nt, Human
uuugguguguucc

SEQ ID NO: 2198776 - RNA, 14 nt, Human
uuuggaaguuuuca

SEQ ID NO: 2198777 - RNA, 13 nt, Human
uuuggaauaaagu

SEQ ID NO: 2198778 - RNA, 13 nt, Human
uuuggaauacuuu

SEQ ID NO: 2198779 - RNA, 16 nt, Human
uuuggaauacauuucu

SEQ ID NO: 2198780 - RNA, 19 nt, Human
uuuggugguuucagaaaug

SEQ ID NO: 2198781 - RNA, 17 nt, Human
uuuggaauacuuuuugu

SEQ ID NO: 2198782 - RNA, 15 nt, Human
uuuggaauacuuuuu

SEQ ID NO: 2198783 - RNA, 22 nt, Human
uuugguuaagucuguuuuauga

SEQ ID NO: 2198784 - RNA, 15 nt, Human
uuuguaaauuaacuu

SEQ ID NO: 2198785 - RNA, 17 nt, Human
uuuguaaauuaacuuuu

SEQ ID NO: 2198786 - RNA, 16 nt, Human
uuuguaaauuaacuuu

SEQ ID NO: 2198787 - RNA, 18 nt, Human
uuuguauaacuucuuaaa

SEQ ID NO: 2198788 - RNA, 19 nt, Human
uuuguauaacuucuuaaaa

SEQ ID NO: 2198789 - RNA, 13 nt, Human
uuuguauaauugu

SEQ ID NO: 2198790 - RNA, 16 nt, Human
uuuguauaauuguauc

SEQ ID NO: 2198791 - RNA, 17 nt, Human
uuuguauaauuguaucg

SEQ ID NO: 2198792 - RNA, 18 nt, Human
uuuguauaauuguaucgu

SEQ ID NO: 2198793 - RNA, 20 nt, Human
uuuguauaauuguaucguau

SEQ ID NO: 2198794 - RNA, 22 nt, Human
uuuguaaauuaacuuuuauaaa

SEQ ID NO: 2198795 - RNA, 21 nt, Human
uuuguauaaaauaauuuuuau

SEQ ID NO: 2198796 - RNA, 11 nt, Human
uuugucaauga

SEQ ID NO: 2198797 - RNA, 23 nt, Human
uuugucaaacuguagaaaugaug

SEQ ID NO: 2198798 - RNA, 17 nt, Human
uuugucaaacuguagaa

SEQ ID NO: 2198799 - RNA, 16 nt, Human
uuugucaaacuguaga

SEQ ID NO: 2198800 - RNA, 16 nt, Human
uuuguauaguaaagug

SEQ ID NO: 2198801 - RNA, 14 nt, Human
uuugucaaacugua

SEQ ID NO: 2198802 - RNA, 17 nt, Human
uuugucaaugacaguuu

SEQ ID NO: 2198803 - RNA, 23 nt, Human
uuugucacaauccuaacacauua

SEQ ID NO: 2198804 - RNA, 14 nt, Human
uuugucagacuuua

SEQ ID NO: 2198805 - RNA, 20 nt, Human
uuugucagaacuagaauuug

SEQ ID NO: 2198806 - RNA, 22 nt, Human
uuugucagaacuagaauuugau

SEQ ID NO: 2198807 - RNA, 13 nt, Human
uuuauuucuuaaa

SEQ ID NO: 2198808 - RNA, 20 nt, Human
uuuauuuguuugugcauuug

SEQ ID NO: 2198809 - RNA, 21 nt, Human
uuuauuuuaaaacagaagaau

SEQ ID NO: 2198810 - RNA, 20 nt, Human
uuucaauaggaaaaacugau

SEQ ID NO: 2198811 - RNA, 22 nt, Human
uuucaauaggaaaaacugauuu

SEQ ID NO: 2198812 - RNA, 14 nt, Human
uuuauuuauuaaga

SEQ ID NO: 2198813 - RNA, 14 nt, Human
uuuauuuaucagug

SEQ ID NO: 2198814 - RNA, 14 nt, Human
uuuauuuauuuaca

SEQ ID NO: 2198815 - RNA, 13 nt, Human
uuuauuuauuuau

SEQ ID NO: 2198816 - RNA, 15 nt, Human
uuuauuuauuuuauc

SEQ ID NO: 2198817 - RNA, 13 nt, Human
uuuauuuccagug

SEQ ID NO: 2198818 - RNA, 16 nt, Human
uuuauuucugcauaug

SEQ ID NO: 2198819 - RNA, 16 nt, Human
uuucagagaccauugc

SEQ ID NO: 2198820 - RNA, 17 nt, Human
uuucagagaccauugca

SEQ ID NO: 2198821 - RNA, 15 nt, Human
uuucagauaaucaca

SEQ ID NO: 2198822 - RNA, 17 nt, Human
uuucaauauuuuccuuc

SEQ ID NO: 2198823 - RNA, 21 nt, Human
uuucagacucccauuccugaa

SEQ ID NO: 2198824 - RNA, 18 nt, Human
uuucagauaacuguuauu

SEQ ID NO: 2198825 - RNA, 21 nt, Human
uuucagauaaucacaauacau

SEQ ID NO: 2198826 - RNA, 15 nt, Human
uuucagcagcugcag

SEQ ID NO: 2198827 - RNA, 14 nt, Human
uuucauuguaaaac

SEQ ID NO: 2198828 - RNA, 15 nt, Human
uuucauuguaugaug

SEQ ID NO: 2198829 - RNA, 16 nt, Human
uuucauuguaugaugu

SEQ ID NO: 2198830 - RNA, 24 nt, Human
uuuccaaaaguggccucuuugucu

SEQ ID NO: 2198831 - RNA, 17 nt, Human
uuucauuguaugaugug

SEQ ID NO: 2198832 - RNA, 18 nt, Human
uuucauuguaugaugugu

SEQ ID NO: 2198833 - RNA, 14 nt, Human
uuuccaaaauaauu

SEQ ID NO: 2198834 - RNA, 15 nt, Human
uuuccaaaguacacu

SEQ ID NO: 2198835 - RNA, 12 nt, Human
uuuccaaaguac

SEQ ID NO: 2198836 - RNA, 15 nt, Human
uuuccaaauucacaa

SEQ ID NO: 2198837 - RNA, 14 nt, Human
uuuccaaaggcauu

SEQ ID NO: 2198838 - RNA, 15 nt, Human
uuuccaaauaaaaug

SEQ ID NO: 2198839 - RNA, 13 nt, Human
uuuccaaaggcau

SEQ ID NO: 2198840 - RNA, 23 nt, Human
uuuccacuuuguucuuuaggaga

SEQ ID NO: 2198841 - RNA, 19 nt, Human
uuuccagacuuccuugaga

SEQ ID NO: 2198842 - RNA, 18 nt, Human
uuuccagacuuccuugag

SEQ ID NO: 2198843 - RNA, 19 nt, Human
uuuccagaggcuauuauuu

SEQ ID NO: 2198844 - RNA, 13 nt, Human
uuuccaggaaggc

SEQ ID NO: 2198845 - RNA, 14 nt, Human
uuucagcuucugcu

SEQ ID NO: 2198846 - RNA, 16 nt, Human
uuucagccaagaauuc

SEQ ID NO: 2198847 - RNA, 15 nt, Human
uuucagccaagaauu

SEQ ID NO: 2198848 - RNA, 21 nt, Human
uuucaggauacucugucagau

SEQ ID NO: 2198849 - RNA, 20 nt, Human
uuucaggauacucugucaga

SEQ ID NO: 2198850 - RNA, 19 nt, Human
uuucaggauacucugucag

SEQ ID NO: 2198851 - RNA, 16 nt, Human
uuucaggauacucugu

SEQ ID NO: 2198852 - RNA, 13 nt, Human
uuucaggauacuc

SEQ ID NO: 2198853 - RNA, 22 nt, Human
uuucaggagagaguugaaccua

SEQ ID NO: 2198854 - RNA, 19 nt, Human
uuucagcuucugcugggcu

SEQ ID NO: 2198855 - RNA, 20 nt, Human
uuucagcuucugcugggcug

SEQ ID NO: 2198856 - RNA, 16 nt, Human
uuucaggaccuuuuga

SEQ ID NO: 2198857 - RNA, 17 nt, Human
uuucaggagcagccuca

SEQ ID NO: 2198858 - RNA, 22 nt, Human
uuucauugauaugaaaaauaug

SEQ ID NO: 2198859 - RNA, 21 nt, Human
uuucauugauaugaaaaauau

SEQ ID NO: 2198860 - RNA, 22 nt, Human
uuucauugacuaucaaacugaa

SEQ ID NO: 2198861 - RNA, 15 nt, Human
uuucauucuccugcc

SEQ ID NO: 2198862 - RNA, 13 nt, Human
uuucauucuucuc

SEQ ID NO: 2198863 - RNA, 22 nt, Human
uuucauugcugggcuugucugu

SEQ ID NO: 2198864 - RNA, 19 nt, Human
uuucagggagguggcuggg

SEQ ID NO: 2198865 - RNA, 22 nt, Human
uuucagggagguggcuggguuu

SEQ ID NO: 2198866 - RNA, 21 nt, Human
uuucaggggucgucaccaccu

SEQ ID NO: 2198867 - RNA, 22 nt, Human
uuucagggcuaacgaccacagg

SEQ ID NO: 2198868 - RNA, 13 nt, Human
uuucaggugacau

SEQ ID NO: 2198869 - RNA, 22 nt, Human
uuuccucuucuauuuuguaaac

SEQ ID NO: 2198870 - RNA, 21 nt, Human
uuuccucuucuauuuuguaaa

SEQ ID NO: 2198871 - RNA, 22 nt, Human
uuuccucaaaacuucagacaua

SEQ ID NO: 2198872 - RNA, 23 nt, Human
uuuccugacagaaggacucaggu

SEQ ID NO: 2198873 - RNA, 21 nt, Human
uuuccugaaacaacuuggaaa

SEQ ID NO: 2198874 - RNA, 21 nt, Human
uuuccucuuuggucuacacug

SEQ ID NO: 2198875 - RNA, 18 nt, Human
uuuccuagcacacacuuu

SEQ ID NO: 2198876 - RNA, 24 nt, Human
uuuccuacucucaggaucaagaaa

SEQ ID NO: 2198877 - RNA, 22 nt, Human
uuuccaggcugguucggauuug

SEQ ID NO: 2198878 - RNA, 15 nt, Human
uuuccaggcugguuc

SEQ ID NO: 2198879 - RNA, 23 nt, Human
uuuccuagauggcagucacugaa

SEQ ID NO: 2198880 - RNA, 21 nt, Human
uuuccuaguucuguagaaaug

SEQ ID NO: 2198881 - RNA, 23 nt, Human
uuuccuagcccucucacauuuau

SEQ ID NO: 2198882 - RNA, 21 nt, Human
uuuccuagcacacacuuuugg

SEQ ID NO: 2198883 - RNA, 17 nt, Human
uuuccuagcccucucac

SEQ ID NO: 2198884 - RNA, 13 nt, Human
uuucuaagagaag

SEQ ID NO: 2198885 - RNA, 11 nt, Human
uuucuaagaga

SEQ ID NO: 2198886 - RNA, 16 nt, Human
uuucuaagagaaguua

SEQ ID NO: 2198887 - RNA, 19 nt, Human
uuucuaaaggccucuuccu

SEQ ID NO: 2198888 - RNA, 18 nt, Human
uuucuaaaggcuaccuuu

SEQ ID NO: 2198889 - RNA, 22 nt, Human
uuuccugagcuuggccagaagg

SEQ ID NO: 2198890 - RNA, 18 nt, Human
uuuccugagcuuggccag

SEQ ID NO: 2198891 - RNA, 13 nt, Human
uuuccugagcuug

SEQ ID NO: 2198892 - RNA, 20 nt, Human
uuuccugagaccacagagag

SEQ ID NO: 2198893 - RNA, 14 nt, Human
uuucuaaaggcuac

SEQ ID NO: 2198894 - RNA, 14 nt, Human
uuucuaaagcugcc

SEQ ID NO: 2198895 - RNA, 17 nt, Human
uuucuaaagcugccagc

SEQ ID NO: 2198896 - RNA, 12 nt, Human
uuucucuuucuc

SEQ ID NO: 2198897 - RNA, 16 nt, Human
uuucucuuucucuccu

SEQ ID NO: 2198898 - RNA, 14 nt, Human
uuucucuuucuccu

SEQ ID NO: 2198899 - RNA, 19 nt, Human
uuucugagaagguccuuaa

SEQ ID NO: 2198900 - RNA, 16 nt, Human
uuucugagaagguccu

SEQ ID NO: 2198901 - RNA, 16 nt, Human
uuucugagcacacuuu

SEQ ID NO: 2198902 - RNA, 11 nt, Human
uuucugagccc

SEQ ID NO: 2198903 - RNA, 12 nt, Human
uuucugagcccg

SEQ ID NO: 2198904 - RNA, 15 nt, Human
uuucugagcccgggc

SEQ ID NO: 2198905 - RNA, 22 nt, Human
uuucugagaaagacuauucaaa

SEQ ID NO: 2198906 - RNA, 20 nt, Human
uuucuccuuagucuucucau

SEQ ID NO: 2198907 - RNA, 19 nt, Human
uuucuccuuagucuucuca

SEQ ID NO: 2198908 - RNA, 15 nt, Human
uuucuccucccuucc

SEQ ID NO: 2198909 - RNA, 16 nt, Human
uuucuccucccuuccu

SEQ ID NO: 2198910 - RNA, 16 nt, Human
uuucuccuuugauaaa

SEQ ID NO: 2198911 - RNA, 17 nt, Human
uuucucuuacugcaaau

SEQ ID NO: 2198912 - RNA, 17 nt, Human
uuucucuguguuuguuc

SEQ ID NO: 2198913 - RNA, 18 nt, Human
uuucucuguguuuguucc

SEQ ID NO: 2198914 - RNA, 12 nt, Human
uuucucuugggc

SEQ ID NO: 2198915 - RNA, 21 nt, Human
uuucucuugggcugagacugg

SEQ ID NO: 2198916 - RNA, 13 nt, Human
uuucucuugggcu

SEQ ID NO: 2198917 - RNA, 16 nt, Human
uuucucuucauacuuu

SEQ ID NO: 2198918 - RNA, 19 nt, Human
uuucuagcuagaaauauga

SEQ ID NO: 2198919 - RNA, 20 nt, Human
uuucuagcccgaauacaaac

SEQ ID NO: 2198920 - RNA, 20 nt, Human
uuucuagcuagaaauaugau

SEQ ID NO: 2198921 - RNA, 22 nt, Human
uuucuagcuagaaauaugauuu

SEQ ID NO: 2198922 - RNA, 19 nt, Human
uuucuagcuguugagcugu

SEQ ID NO: 2198923 - RNA, 21 nt, Human
uuucuagcuguugagcuguuu

SEQ ID NO: 2198924 - RNA, 19 nt, Human
uuucuagcccgaauacaaa

SEQ ID NO: 2198925 - RNA, 16 nt, Human
uuucuagauuaagaua

SEQ ID NO: 2198926 - RNA, 13 nt, Human
uuucuaauguggu

SEQ ID NO: 2198927 - RNA, 14 nt, Human
uuucuaaugagaua

SEQ ID NO: 2198928 - RNA, 15 nt, Human
uuucuagccagagga

SEQ ID NO: 2198929 - RNA, 14 nt, Human
uuucuccuccaugg

SEQ ID NO: 2198930 - RNA, 15 nt, Human
uuucuccucccagga

SEQ ID NO: 2198931 - RNA, 22 nt, Human
uuucucccucucacugucugag

SEQ ID NO: 2198932 - RNA, 13 nt, Human
uuucucccucugg

SEQ ID NO: 2198933 - RNA, 17 nt, Human
uuucucccuaaacugua

SEQ ID NO: 2198934 - RNA, 13 nt, Human
uuucucccucuca

SEQ ID NO: 2198935 - RNA, 20 nt, Human
uuucucccucucacugucug

SEQ ID NO: 2198936 - RNA, 21 nt, Human
uuucucccucucacugucuga

SEQ ID NO: 2198937 - RNA, 14 nt, Human
uuucuaggaagaau

SEQ ID NO: 2198938 - RNA, 16 nt, Human
uuucuaggaagaauuu

SEQ ID NO: 2198939 - RNA, 21 nt, Human
uuucuaggaagaauuuuaaaa

SEQ ID NO: 2198940 - RNA, 22 nt, Human
uuucuaggaagaauuuuaaaaa

SEQ ID NO: 2198941 - RNA, 22 nt, Human
uuucuccccugcccccaggacu

SEQ ID NO: 2198942 - RNA, 20 nt, Human
uuucuccccugcccccagga

SEQ ID NO: 2198943 - RNA, 23 nt, Human
uuucuccccugcccccaggacug

SEQ ID NO: 2198944 - RNA, 24 nt, Human
uuucuccccugcccccaggacugg

SEQ ID NO: 2198945 - RNA, 14 nt, Human
uuuaauccagaauu

SEQ ID NO: 2198946 - RNA, 21 nt, Human
uuuaauccuucuaguuuccca

SEQ ID NO: 2198947 - RNA, 23 nt, Human
uuuaauccuucuaguuucccaca

SEQ ID NO: 2198948 - RNA, 13 nt, Human
uuuaaucuucagu

SEQ ID NO: 2198949 - RNA, 12 nt, Human
uuuacaagaaaa

SEQ ID NO: 2198950 - RNA, 21 nt, Human
uuuacaagaaaaaaugaauuu

SEQ ID NO: 2198951 - RNA, 19 nt, Human
uuuacaagaaaaaaugaau

SEQ ID NO: 2198952 - RNA, 21 nt, Human
uuuaauccagaauugaccuuu

SEQ ID NO: 2198953 - RNA, 15 nt, Human
uuuaauccccaguaa

SEQ ID NO: 2198954 - RNA, 16 nt, Human
uuuaauccccaguaaa

SEQ ID NO: 2198955 - RNA, 22 nt, Human
uuuaauccccaguaaaauugcc

SEQ ID NO: 2198956 - RNA, 13 nt, Human
uuuaaucaugaaa

SEQ ID NO: 2198957 - RNA, 14 nt, Human
uuuaaucaugaaau

SEQ ID NO: 2198958 - RNA, 19 nt, Human
uuuaaucaugaaauuacuu

SEQ ID NO: 2198959 - RNA, 24 nt, Human
uuuaaucaugaaauuacuuaucau

SEQ ID NO: 2198960 - RNA, 14 nt, Human
uuuaaucauugccu

SEQ ID NO: 2198961 - RNA, 15 nt, Human
uuuaaucauugccug

SEQ ID NO: 2198962 - RNA, 15 nt, Human
uuuacaagccccccc

SEQ ID NO: 2198963 - RNA, 21 nt, Human
uuuacaagcccccccuuccac

SEQ ID NO: 2198964 - RNA, 15 nt, Human
uuuacaaguguauau

SEQ ID NO: 2198965 - RNA, 21 nt, Human
uuuacaaguguauaucagaaa

SEQ ID NO: 2198966 - RNA, 21 nt, Human
uuuacaaucagccacauucua

SEQ ID NO: 2198967 - RNA, 16 nt, Human
uuuacaauaaauaauc

SEQ ID NO: 2198968 - RNA, 23 nt, Human
uuuacaauuguaaaacugaggca

SEQ ID NO: 2198969 - RNA, 18 nt, Human
uuuacaauuuacaaagug

SEQ ID NO: 2198970 - RNA, 16 nt, Human
uuuacaauugaaauga

SEQ ID NO: 2198971 - RNA, 15 nt, Human
uuuacaauugaaaug

SEQ ID NO: 2198972 - RNA, 19 nt, Human
uuuacaauuuuuuaucaug

SEQ ID NO: 2198973 - RNA, 15 nt, Human
uuguauuguuucaau

SEQ ID NO: 2198974 - RNA, 18 nt, Human
uuguauucuuugauguua

SEQ ID NO: 2198975 - RNA, 19 nt, Human
uuguauucuuugauguuaa

SEQ ID NO: 2198976 - RNA, 14 nt, Human
uuguauucucugag

SEQ ID NO: 2198977 - RNA, 16 nt, Human
uuguauucucugagcu

SEQ ID NO: 2198978 - RNA, 15 nt, Human
uuguauucucugagc

SEQ ID NO: 2198979 - RNA, 13 nt, Human
uuguauucuuuga

SEQ ID NO: 2198980 - RNA, 17 nt, Human
uuguauucuuugauguu

SEQ ID NO: 2198981 - RNA, 22 nt, Human
uuguauucucugagcugugcag

SEQ ID NO: 2198982 - RNA, 20 nt, Human
uuguauucucugagcugugc

SEQ ID NO: 2198983 - RNA, 14 nt, Human
uuguauuuuaacuc

SEQ ID NO: 2198984 - RNA, 18 nt, Human
uuguauuuauuccauauu

SEQ ID NO: 2198985 - RNA, 15 nt, Human
uuguauuuauuuagu

SEQ ID NO: 2198986 - RNA, 20 nt, Human
uuguauuuuacuaauaaaau

SEQ ID NO: 2198987 - RNA, 12 nt, Human
uuuaaucaugaa

SEQ ID NO: 2198988 - RNA, 16 nt, Human
uuguauuguuucaauu

SEQ ID NO: 2198989 - RNA, 14 nt, Human
uuguauuuauucaa

SEQ ID NO: 2198990 - RNA, 15 nt, Human
uuguauuuauucaau

SEQ ID NO: 2198991 - RNA, 16 nt, Human
uuguauuuauucaaua

SEQ ID NO: 2198992 - RNA, 20 nt, Human
uuguauuuauucaauaaagu

SEQ ID NO: 2198993 - RNA, 20 nt, Human
uuuagaaacacaacuauauu

SEQ ID NO: 2198994 - RNA, 17 nt, Human
uuuagaagaaguguguc

SEQ ID NO: 2198995 - RNA, 14 nt, Human
uuuagaagacucua

SEQ ID NO: 2198996 - RNA, 15 nt, Human
uuuagaagacucuac

SEQ ID NO: 2198997 - RNA, 19 nt, Human
uuuagaagaagugugucac

SEQ ID NO: 2198998 - RNA, 21 nt, Human
uuuagagaugaauuaaauuua

SEQ ID NO: 2198999 - RNA, 15 nt, Human
uuuagagaggaaaag

SEQ ID NO: 2199000 - RNA, 18 nt, Human
uuuagagaacuguggccg

SEQ ID NO: 2199001 - RNA, 20 nt, Human
uuuagacuuaauagaaacau

SEQ ID NO: 2199002 - RNA, 18 nt, Human
uuuacaugggguuuucaa

SEQ ID NO: 2199003 - RNA, 19 nt, Human
uuuacaauuuacaaagugu

SEQ ID NO: 2199004 - RNA, 15 nt, Human
uuuacauguaguagu

SEQ ID NO: 2199005 - RNA, 13 nt, Human
uuuacauuguaaa

SEQ ID NO: 2199006 - RNA, 15 nt, Human
uuuacuuuguguuca

SEQ ID NO: 2199007 - RNA, 20 nt, Human
uuuacauuguaaauaguauu

SEQ ID NO: 2199008 - RNA, 15 nt, Human
uuuacauuguaaaua

SEQ ID NO: 2199009 - RNA, 13 nt, Human
uuuacuuugaauu

SEQ ID NO: 2199010 - RNA, 15 nt, Human
uuuacuuuuaaacag

SEQ ID NO: 2199011 - RNA, 15 nt, Human
uuuacuuuuaaacug

SEQ ID NO: 2199012 - RNA, 18 nt, Human
uuuacuuuuaaacaguga

SEQ ID NO: 2199013 - RNA, 19 nt, Human
uuuacaugggguuuucaau

SEQ ID NO: 2199014 - RNA, 16 nt, Human
uuuacuuuuaaauguc

SEQ ID NO: 2199015 - RNA, 16 nt, Human
uuuacuuuuaaacugu

SEQ ID NO: 2199016 - RNA, 12 nt, Human
uuuagaaacaca

SEQ ID NO: 2199017 - RNA, 13 nt, Human
uuuauugcuuguu

SEQ ID NO: 2199018 - RNA, 14 nt, Human
uuuauugcuuuaua

SEQ ID NO: 2199019 - RNA, 16 nt, Human
uuuauuggcugagaua

SEQ ID NO: 2199020 - RNA, 17 nt, Human
uuuauugcuugauacuu

SEQ ID NO: 2199021 - RNA, 24 nt, Human
uuuauugcaucuggguagcuguaa

SEQ ID NO: 2199022 - RNA, 23 nt, Human
uuuauugcaucuggguagcugua

SEQ ID NO: 2199023 - RNA, 19 nt, Human
uuuauuccauauucaugua

SEQ ID NO: 2199024 - RNA, 23 nt, Human
uuuauuccagaaugcuguacauc

SEQ ID NO: 2199025 - RNA, 22 nt, Human
uuuauuccagaaugcuguacau

SEQ ID NO: 2199026 - RNA, 19 nt, Human
uuuauuccagaaugcugua

SEQ ID NO: 2199027 - RNA, 18 nt, Human
uuuauuccagaaugcugu

SEQ ID NO: 2199028 - RNA, 17 nt, Human
uuuauucaauuccucug

SEQ ID NO: 2199029 - RNA, 13 nt, Human
uuuauucaauaaa

SEQ ID NO: 2199030 - RNA, 17 nt, Human
uuuauucagcuucauuu

SEQ ID NO: 2199031 - RNA, 19 nt, Human
uuuauucagcuucauuugu

SEQ ID NO: 2199032 - RNA, 21 nt, Human
uuuauucagcuucauuugugu

SEQ ID NO: 2199033 - RNA, 22 nt, Human
uuuauucagcuucauuuguguc

SEQ ID NO: 2199034 - RNA, 17 nt, Human
uuuauuauuuucaccug

SEQ ID NO: 2199035 - RNA, 17 nt, Human
uuuauucaaguuauugu

SEQ ID NO: 2199036 - RNA, 18 nt, Human
uuuaugcaaggaaggaaa

SEQ ID NO: 2199037 - RNA, 17 nt, Human
uuuaugcaaggaaggaa

SEQ ID NO: 2199038 - RNA, 15 nt, Human
uuuaugcaaggaagg

SEQ ID NO: 2199039 - RNA, 14 nt, Human
uuuaugcauauuau

SEQ ID NO: 2199040 - RNA, 17 nt, Human
uuuauuguguuuuuaau

SEQ ID NO: 2199041 - RNA, 20 nt, Human
uuuauuguuaacucuugucu

SEQ ID NO: 2199042 - RNA, 17 nt, Human
uuuauuuauacacuguc

SEQ ID NO: 2199043 - RNA, 21 nt, Human
uuuauuguguuugucauuagc

SEQ ID NO: 2199044 - RNA, 22 nt, Human
uuuauuguguuugucauuagcc

SEQ ID NO: 2199045 - RNA, 15 nt, Human
uuuauuuauacuauu

SEQ ID NO: 2199046 - RNA, 15 nt, Human
uuuauuuaucaguga

SEQ ID NO: 2199047 - RNA, 16 nt, Human
uuuauuguguuuguca

SEQ ID NO: 2199048 - RNA, 17 nt, Human
uuuauuguguuugucau

SEQ ID NO: 2199049 - RNA, 13 nt, Human
uuuauugugaucu

SEQ ID NO: 2199050 - RNA, 22 nt, Human
uuuauuguuuaaaaucauuucu

SEQ ID NO: 2199051 - RNA, 19 nt, Human
uuuauuuaguuccuugagu

SEQ ID NO: 2199052 - RNA, 14 nt, Human
uuuauugucaaagu

SEQ ID NO: 2199053 - RNA, 16 nt, Human
uuuauugucaaagugg

SEQ ID NO: 2199054 - RNA, 16 nt, Human
uuuauuguaacagaca

SEQ ID NO: 2199055 - RNA, 13 nt, Human
uuuauuguauaaa

SEQ ID NO: 2199056 - RNA, 20 nt, Human
uuuauuguaacagacauugu

SEQ ID NO: 2199057 - RNA, 22 nt, Human
uuuauuguaacagacauuguuu

SEQ ID NO: 2199058 - RNA, 13 nt, Human
uuuaugaaaagag

SEQ ID NO: 2199059 - RNA, 18 nt, Human
uuuaugaaagguuuacau

SEQ ID NO: 2199060 - RNA, 19 nt, Human
uuuaugaaagguuuacauu

SEQ ID NO: 2199061 - RNA, 18 nt, Human
uuuaucuuugauucuccu

SEQ ID NO: 2199062 - RNA, 19 nt, Human
uuuaucuuugauucuccuu

SEQ ID NO: 2199063 - RNA, 18 nt, Human
uuuaucuuuauaugaaga

SEQ ID NO: 2199064 - RNA, 16 nt, Human
uuuaugcaaauauuuu

SEQ ID NO: 2199065 - RNA, 14 nt, Human
uuuaugauguauau

SEQ ID NO: 2199066 - RNA, 12 nt, Human
uuuaugauuuaa

SEQ ID NO: 2199067 - RNA, 14 nt, Human
uuuaugauuuaaua

SEQ ID NO: 2199068 - RNA, 18 nt, Human
uuuaugauuuaauaaaau

SEQ ID NO: 2199069 - RNA, 17 nt, Human
uuuaugaaggcaaaaaa

SEQ ID NO: 2199070 - RNA, 22 nt, Human
uuuaugauacuugaaaauuaac

SEQ ID NO: 2199071 - RNA, 22 nt, Human
uuuaugaagaaaaaauacauuu

SEQ ID NO: 2199072 - RNA, 12 nt, Human
uuuaugaagaaa

SEQ ID NO: 2199073 - RNA, 19 nt, Human
uuuaugaagaaaaaauaca

SEQ ID NO: 2199074 - RNA, 18 nt, Human
uuuaugaagaaaaaauac

SEQ ID NO: 2199075 - RNA, 21 nt, Human
uuuaugaaaugguuaagaauu

SEQ ID NO: 2199076 - RNA, 18 nt, Human
uuuagaguagcaugagag

SEQ ID NO: 2199077 - RNA, 16 nt, Human
uuuagagcauugccau

SEQ ID NO: 2199078 - RNA, 16 nt, Human
uuuagaguuagacugu

SEQ ID NO: 2199079 - RNA, 17 nt, Human
uuuagaguuagacuguu

SEQ ID NO: 2199080 - RNA, 14 nt, Human
uuuauaaaacuucu

SEQ ID NO: 2199081 - RNA, 23 nt, Human
uuuauaaaagaauaaaauugcac

SEQ ID NO: 2199082 - RNA, 18 nt, Human
uuuagaguuagacuguug

SEQ ID NO: 2199083 - RNA, 14 nt, Human
uuuauaaacuuuac

SEQ ID NO: 2199084 - RNA, 20 nt, Human
uuuaucuaauaccucugugu

SEQ ID NO: 2199085 - RNA, 16 nt, Human
uuuauaaaccucuaau

SEQ ID NO: 2199086 - RNA, 17 nt, Human
uuuauaaaccucuaauu

SEQ ID NO: 2199087 - RNA, 21 nt, Human
uuuaucgucacugcuuaacuu

SEQ ID NO: 2199088 - RNA, 16 nt, Human
uuuauaaacuuuaccu

SEQ ID NO: 2199089 - RNA, 16 nt, Human
uuuaucgucacugcuu

SEQ ID NO: 2199090 - RNA, 21 nt, Human
uuuucuugccaaugaggucug

SEQ ID NO: 2199091 - RNA, 13 nt, Human
uuuucuuguaauu

SEQ ID NO: 2199092 - RNA, 18 nt, Human
uuuugaaaaauuccuauu

SEQ ID NO: 2199093 - RNA, 13 nt, Human
uuuugaaaaacug

SEQ ID NO: 2199094 - RNA, 18 nt, Human
uuuucuugccucuguccc

SEQ ID NO: 2199095 - RNA, 19 nt, Human
uuuucuugccucugucccc

SEQ ID NO: 2199096 - RNA, 21 nt, Human
uuuucuugccucuguccccuu

SEQ ID NO: 2199097 - RNA, 22 nt, Human
uuuugaaaaauuccuauuguga

SEQ ID NO: 2199098 - RNA, 15 nt, Human
uuuugaaaagcuauu

SEQ ID NO: 2199099 - RNA, 16 nt, Human
uuuugaaaagcuauua

SEQ ID NO: 2199100 - RNA, 23 nt, Human
uuuugaaaagcuauuagccagga

SEQ ID NO: 2199101 - RNA, 22 nt, Human
uuuugaaauauuaaacccugga

SEQ ID NO: 2199102 - RNA, 21 nt, Human
uuuugaaaccaugaagagauu

SEQ ID NO: 2199103 - RNA, 21 nt, Human
uuuuucuggagguugauaacu

SEQ ID NO: 2199104 - RNA, 17 nt, Human
uuuuucugcuuuugaaa

SEQ ID NO: 2199105 - RNA, 14 nt, Human
uuuuucugcuuuug

SEQ ID NO: 2199106 - RNA, 22 nt, Human
uuuuucugcacugagcagaguc

SEQ ID NO: 2199107 - RNA, 23 nt, Human
uuuuucugcacugagcagagucu

SEQ ID NO: 2199108 - RNA, 20 nt, Human
uuuugaaaucuguaucugua

SEQ ID NO: 2199109 - RNA, 13 nt, Human
uuuuucugauugu

SEQ ID NO: 2199110 - RNA, 17 nt, Human
uuuuucugcacugagca

SEQ ID NO: 2199111 - RNA, 14 nt, Human
uuuuucugcacuga

SEQ ID NO: 2199112 - RNA, 15 nt, Human
uuuuuuagaucaaau

SEQ ID NO: 2199113 - RNA, 23 nt, Human
uuuuuuagaaagcauuugaaugc

SEQ ID NO: 2199114 - RNA, 16 nt, Human
uuuuucuucuguauuu

SEQ ID NO: 2199115 - RNA, 20 nt, Human
uuuuuuauacaggaugauga

SEQ ID NO: 2199116 - RNA, 23 nt, Human
uuuuucuuaaauaauaaagauca

SEQ ID NO: 2199117 - RNA, 14 nt, Human
uuuuucuguuauau

SEQ ID NO: 2199118 - RNA, 12 nt, Human
uuuuuuacuaau

SEQ ID NO: 2199119 - RNA, 15 nt, Human
uuuuuuauacacaua

SEQ ID NO: 2199120 - RNA, 16 nt, Human
uuuuuuagaucaaaua

SEQ ID NO: 2199121 - RNA, 13 nt, Human
uuuuuuaugcuaa

SEQ ID NO: 2199122 - RNA, 17 nt, Human
uuuuuuccuucagugcc

SEQ ID NO: 2199123 - RNA, 15 nt, Human
uuuuuucuaagagaa

SEQ ID NO: 2199124 - RNA, 12 nt, Human
uuuuuucuaaga

SEQ ID NO: 2199125 - RNA, 20 nt, Human
uuuuuuauacacuguaauga

SEQ ID NO: 2199126 - RNA, 16 nt, Human
uuuuuuaugcuaauca

SEQ ID NO: 2199127 - RNA, 11 nt, Human
uuuuuucuacc

SEQ ID NO: 2199128 - RNA, 12 nt, Human
uuuuuucugaau

SEQ ID NO: 2199129 - RNA, 11 nt, Human
uuuuuucugag

SEQ ID NO: 2199130 - RNA, 11 nt, Human
uucaauuaaac

SEQ ID NO: 2199131 - RNA, 12 nt, Human
uucaauuaaacg

SEQ ID NO: 2199132 - RNA, 14 nt, Human
uucaauuaaacgga

SEQ ID NO: 2199133 - RNA, 15 nt, Human
uucaauuaaacggau

SEQ ID NO: 2199134 - RNA, 16 nt, Human
uucaauuaaacggauu

SEQ ID NO: 2199135 - RNA, 18 nt, Human
uucaauuaaacggauuau

SEQ ID NO: 2199136 - RNA, 19 nt, Human
uucaauuaaacggauuauu

SEQ ID NO: 2199137 - RNA, 13 nt, Human
uucaauucagugc

SEQ ID NO: 2199138 - RNA, 17 nt, Human
uucaauucaacacuccc

SEQ ID NO: 2199139 - RNA, 19 nt, Human
uucaauucagugcuguacu

SEQ ID NO: 2199140 - RNA, 12 nt, Human
uucaauuccucu

SEQ ID NO: 2199141 - RNA, 13 nt, Human
uucaauuccuggg

SEQ ID NO: 2199142 - RNA, 16 nt, Human
uucaauuccucuggga

SEQ ID NO: 2199143 - RNA, 18 nt, Human
uucaauucucauuuguca

SEQ ID NO: 2199144 - RNA, 23 nt, Human
uucaaugguuugcaaggaagcca

SEQ ID NO: 2199145 - RNA, 23 nt, Human
uucaaugaucuagguuuaacuca

SEQ ID NO: 2199146 - RNA, 21 nt, Human
uucaaugugauucuaaugucu

SEQ ID NO: 2199147 - RNA, 20 nt, Human
uucaaugguuugcaaggaag

SEQ ID NO: 2199148 - RNA, 22 nt, Human
uucaaugguuugcaaggaagcc

SEQ ID NO: 2199149 - RNA, 19 nt, Human
uucaaugaucuagguuuaa

SEQ ID NO: 2199150 - RNA, 22 nt, Human
uucaaugaucuagguuuaacuc

SEQ ID NO: 2199151 - RNA, 16 nt, Human
uucaauggcugcugaa

SEQ ID NO: 2199152 - RNA, 16 nt, Human
uucaaugauaguaaga

SEQ ID NO: 2199153 - RNA, 12 nt, Human
uucaaugaucua

SEQ ID NO: 2199154 - RNA, 15 nt, Human
uucaaugaucuaggu

SEQ ID NO: 2199155 - RNA, 20 nt, Human
uucaaucuguaaacugugua

SEQ ID NO: 2199156 - RNA, 18 nt, Human
uucaaucuguaaacugug

SEQ ID NO: 2199157 - RNA, 17 nt, Human
uucaaucuguaaacugu

SEQ ID NO: 2199158 - RNA, 16 nt, Human
uucaaucuguaaacug

SEQ ID NO: 2199159 - RNA, 23 nt, Human
uucaacagacccccucuagaaau

SEQ ID NO: 2199160 - RNA, 16 nt, Human
uucaacaggagaauuu

SEQ ID NO: 2199161 - RNA, 17 nt, Human
uucaaccauuccccaug

SEQ ID NO: 2199162 - RNA, 20 nt, Human
uucaaccauuccccauggga

SEQ ID NO: 2199163 - RNA, 13 nt, Human
uucaacgcagccc

SEQ ID NO: 2199164 - RNA, 13 nt, Human
uucaacccuggag

SEQ ID NO: 2199165 - RNA, 14 nt, Human
uucaacgcagcccu

SEQ ID NO: 2199166 - RNA, 15 nt, Human
uucaacgcagcccug

SEQ ID NO: 2199167 - RNA, 15 nt, Human
uucaacccuggagag

SEQ ID NO: 2199168 - RNA, 16 nt, Human
uucaaucccaggaugu

SEQ ID NO: 2199169 - RNA, 15 nt, Human
uucaaucuguaaacu

SEQ ID NO: 2199170 - RNA, 14 nt, Human
uucaaucuguaaac

SEQ ID NO: 2199171 - RNA, 20 nt, Human
uucaaucucccgcugcugcu

SEQ ID NO: 2199172 - RNA, 17 nt, Human
uucaaagauucaaaauu

SEQ ID NO: 2199173 - RNA, 23 nt, Human
uucaaauuguaagcaugcacaaa

SEQ ID NO: 2199174 - RNA, 13 nt, Human
uucaaauuucaca

SEQ ID NO: 2199175 - RNA, 23 nt, Human
uucaaagccaaguuuauauacaa

SEQ ID NO: 2199176 - RNA, 21 nt, Human
uucaaagccagcguccuccuc

SEQ ID NO: 2199177 - RNA, 13 nt, Human
uucaaagccagcg

SEQ ID NO: 2199178 - RNA, 23 nt, Human
uucaaagcaccaaaauaagaaaa

SEQ ID NO: 2199179 - RNA, 21 nt, Human
uucaaagcaccaaaauaagaa

SEQ ID NO: 2199180 - RNA, 19 nt, Human
uucaaagcaccaaaauaag

SEQ ID NO: 2199181 - RNA, 21 nt, Human
uuauuuucugguagauagaaa

SEQ ID NO: 2199182 - RNA, 17 nt, Human
uuauuuucuuugaaauu

SEQ ID NO: 2199183 - RNA, 11 nt, Human
uuauuuugaug

SEQ ID NO: 2199184 - RNA, 15 nt, Human
uucaaagcaaauguc

SEQ ID NO: 2199185 - RNA, 13 nt, Human
uucaaagauauuu

SEQ ID NO: 2199186 - RNA, 15 nt, Human
uuauuuuccucccca

SEQ ID NO: 2199187 - RNA, 14 nt, Human
uuauuuuccucccc

SEQ ID NO: 2199188 - RNA, 13 nt, Human
uuauuuuccaaaa

SEQ ID NO: 2199189 - RNA, 16 nt, Human
uuauuuuccuccccag

SEQ ID NO: 2199190 - RNA, 12 nt, Human
uuauuuucuaca

SEQ ID NO: 2199191 - RNA, 12 nt, Human
uuauuuucacug

SEQ ID NO: 2199192 - RNA, 11 nt, Human
uuacuaaagaa

SEQ ID NO: 2199193 - RNA, 18 nt, Human
uuacuaaagaaaauaucu

SEQ ID NO: 2199194 - RNA, 22 nt, Human
uuacuaaagaaaauaucugaaa

SEQ ID NO: 2199195 - RNA, 14 nt, Human
uuauuuucaccugu

SEQ ID NO: 2199196 - RNA, 12 nt, Human
uuauuuucagua

SEQ ID NO: 2199197 - RNA, 14 nt, Human
uuauuuucaguauu

SEQ ID NO: 2199198 - RNA, 13 nt, Human
uuacuaaacauuu

SEQ ID NO: 2199199 - RNA, 16 nt, Human
uuacuaaacauuuugu

SEQ ID NO: 2199200 - RNA, 21 nt, Human
uuacuaaacauuuuguuauug

SEQ ID NO: 2199201 - RNA, 13 nt, Human
uuacgugaguccu

SEQ ID NO: 2199202 - RNA, 14 nt, Human
uuacgugaguccug

SEQ ID NO: 2199203 - RNA, 15 nt, Human
uuacgugagccaggu

SEQ ID NO: 2199204 - RNA, 17 nt, Human
uucaccccaaucccagc

SEQ ID NO: 2199205 - RNA, 18 nt, Human
uucacccagcuaaucugu

SEQ ID NO: 2199206 - RNA, 14 nt, Human
uucaccccacccuu

SEQ ID NO: 2199207 - RNA, 13 nt, Human
uucaccccacccu

SEQ ID NO: 2199208 - RNA, 15 nt, Human
uucacccagacagcu

SEQ ID NO: 2199209 - RNA, 13 nt, Human
uucaauucucaaa

SEQ ID NO: 2199210 - RNA, 16 nt, Human
uucaauuccugggccc

SEQ ID NO: 2199211 - RNA, 14 nt, Human
uucaauuccugggc

SEQ ID NO: 2199212 - RNA, 22 nt, Human
uucaccccagggccugagccug

SEQ ID NO: 2199213 - RNA, 22 nt, Human
uucaccccaguggccacucagc

SEQ ID NO: 2199214 - RNA, 20 nt, Human
uucaccccagggccugagcc

SEQ ID NO: 2199215 - RNA, 17 nt, Human
uucaccccagggccuga

SEQ ID NO: 2199216 - RNA, 19 nt, Human
uucacccccuuuccuggac

SEQ ID NO: 2199217 - RNA, 21 nt, Human
uucaccccaguggccacucag

SEQ ID NO: 2199218 - RNA, 17 nt, Human
uucaccccccacucacc

SEQ ID NO: 2199219 - RNA, 23 nt, Human
uucaccccccacucaccaguguc

SEQ ID NO: 2199220 - RNA, 22 nt, Human
uucaccccccacucaccagugu

SEQ ID NO: 2199221 - RNA, 13 nt, Human
uucacucucugaa

SEQ ID NO: 2199222 - RNA, 12 nt, Human
uucaccccuccc

SEQ ID NO: 2199223 - RNA, 16 nt, Human
uucacccccuuuccug

SEQ ID NO: 2199224 - RNA, 14 nt, Human
uucacucuccuugg

SEQ ID NO: 2199225 - RNA, 14 nt, Human
uucacucuuggagc

SEQ ID NO: 2199226 - RNA, 14 nt, Human
uucacucuuccaga

SEQ ID NO: 2199227 - RNA, 12 nt, Human
uucacucucuga

SEQ ID NO: 2199228 - RNA, 15 nt, Human
uucacucuuccagaa

SEQ ID NO: 2199229 - RNA, 19 nt, Human
uucacucuuggagccugca

SEQ ID NO: 2199230 - RNA, 18 nt, Human
uucacucuuggagccugc

SEQ ID NO: 2199231 - RNA, 10 nt, Human
uucagacccc

SEQ ID NO: 2199232 - RNA, 16 nt, Human
uucacucuuccagaau

SEQ ID NO: 2199233 - RNA, 22 nt, Human
uucacugaagaaaccuucagau

SEQ ID NO: 2199234 - RNA, 13 nt, Human
uucagacucagac

SEQ ID NO: 2199235 - RNA, 12 nt, Human
uucagacucaga

SEQ ID NO: 2199236 - RNA, 15 nt, Human
uucagaccccagcgg

SEQ ID NO: 2199237 - RNA, 13 nt, Human
uucagaccccagc

SEQ ID NO: 2199238 - RNA, 21 nt, Human
uucagacucccauuccugaag

SEQ ID NO: 2199239 - RNA, 20 nt, Human
uucagacucccauuccugaa

SEQ ID NO: 2199240 - RNA, 20 nt, Human
uucagagacucagggcccca

SEQ ID NO: 2199241 - RNA, 15 nt, Human
uucagagacucaggg

SEQ ID NO: 2199242 - RNA, 14 nt, Human
uucagacucagacu

SEQ ID NO: 2199243 - RNA, 19 nt, Human
uucagacuuugcuucccau

SEQ ID NO: 2199244 - RNA, 15 nt, Human
uucagagacuccugc

SEQ ID NO: 2199245 - RNA, 21 nt, Human
uucagagacucagggccccag

SEQ ID NO: 2199246 - RNA, 23 nt, Human
uucagaggcccucgcugccagcu

SEQ ID NO: 2199247 - RNA, 22 nt, Human
uucagaggcccucgcugccagc

SEQ ID NO: 2199248 - RNA, 20 nt, Human
uucacugcauggcucccaca

SEQ ID NO: 2199249 - RNA, 15 nt, Human
uucaggaagcucagg

SEQ ID NO: 2199250 - RNA, 20 nt, Human
uucaggaagcucagggccug

SEQ ID NO: 2199251 - RNA, 17 nt, Human
uucaggaagcucagggc

SEQ ID NO: 2199252 - RNA, 19 nt, Human
uucaggaagcucagggccu

SEQ ID NO: 2199253 - RNA, 12 nt, Human
uucaggagggau

SEQ ID NO: 2199254 - RNA, 16 nt, Human
uucaggagcagccuca

SEQ ID NO: 2199255 - RNA, 20 nt, Human
uucaggagcagccucagaac

SEQ ID NO: 2199256 - RNA, 22 nt, Human
uucaggagcagccucagaacaa

SEQ ID NO: 2199257 - RNA, 21 nt, Human
uucaggacuuaacggcuccag

SEQ ID NO: 2199258 - RNA, 19 nt, Human
uucaggaauguguggccug

SEQ ID NO: 2199259 - RNA, 21 nt, Human
uucaggagagaguugaaccua

SEQ ID NO: 2199260 - RNA, 20 nt, Human
uucaggagagaguugaaccu

SEQ ID NO: 2199261 - RNA, 17 nt, Human
uucaggauacucuguca

SEQ ID NO: 2199262 - RNA, 16 nt, Human
uucaggauacaugugc

SEQ ID NO: 2199263 - RNA, 17 nt, Human
uucaggagucccaagga

SEQ ID NO: 2199264 - RNA, 21 nt, Human
uucaggauacucugucagaug

SEQ ID NO: 2199265 - RNA, 15 nt, Human
uucaggcucuucucc

SEQ ID NO: 2199266 - RNA, 20 nt, Human
uucaggcgauucuccugccu

SEQ ID NO: 2199267 - RNA, 17 nt, Human
uucagcugacuuuucug

SEQ ID NO: 2199268 - RNA, 18 nt, Human
uucagcugcauacaguuu

SEQ ID NO: 2199269 - RNA, 13 nt, Human
uucagcugcccca

SEQ ID NO: 2199270 - RNA, 16 nt, Human
uucaggaagcucaggg

SEQ ID NO: 2199271 - RNA, 24 nt, Human
uucagcucugcaagaauugaagca

SEQ ID NO: 2199272 - RNA, 17 nt, Human
uucagcucugcaagaau

SEQ ID NO: 2199273 - RNA, 17 nt, Human
uucagagggaaaguaaa

SEQ ID NO: 2199274 - RNA, 23 nt, Human
uucagcuccagcucaccagcccc

SEQ ID NO: 2199275 - RNA, 14 nt, Human
uucauuuucugcaa

SEQ ID NO: 2199276 - RNA, 19 nt, Human
uucauuuugagcugaaaug

SEQ ID NO: 2199277 - RNA, 20 nt, Human
uucauuuugagcugaaaugc

SEQ ID NO: 2199278 - RNA, 18 nt, Human
uucauuuucugcaagccu

SEQ ID NO: 2199279 - RNA, 17 nt, Human
uucauuuugaaaaacac

SEQ ID NO: 2199280 - RNA, 13 nt, Human
uucauuuugagcu

SEQ ID NO: 2199281 - RNA, 17 nt, Human
uucauuuugagcugaaa

SEQ ID NO: 2199282 - RNA, 15 nt, Human
uuccacugagggcag

SEQ ID NO: 2199283 - RNA, 15 nt, Human
uuccacugagcucca

SEQ ID NO: 2199284 - RNA, 20 nt, Human
uuccacugagcuccaugugc

SEQ ID NO: 2199285 - RNA, 14 nt, Human
uucauuuuuaauca

SEQ ID NO: 2199286 - RNA, 12 nt, Human
uuccacugagcu

SEQ ID NO: 2199287 - RNA, 13 nt, Human
uuccacugagcuc

SEQ ID NO: 2199288 - RNA, 14 nt, Human
uuccacugagcucc

SEQ ID NO: 2199289 - RNA, 22 nt, Human
uuccacuggacuugagcuuggc

SEQ ID NO: 2199290 - RNA, 12 nt, Human
uuccacuggacu

SEQ ID NO: 2199291 - RNA, 16 nt, Human
uuccacugagggcagu

SEQ ID NO: 2199292 - RNA, 23 nt, Human
uuccacugccugggaugaugcag

SEQ ID NO: 2199293 - RNA, 17 nt, Human
uuccacugcguugucca

SEQ ID NO: 2199294 - RNA, 20 nt, Human
uuccacugucaagaaagagc

SEQ ID NO: 2199295 - RNA, 21 nt, Human
uuccacuuagaaauugcauuu

SEQ ID NO: 2199296 - RNA, 19 nt, Human
uuccacuuauaggaauuga

SEQ ID NO: 2199297 - RNA, 20 nt, Human
uuccacuuuuuuuuguaugu

SEQ ID NO: 2199298 - RNA, 17 nt, Human
uuccagaaaaccccagc

SEQ ID NO: 2199299 - RNA, 18 nt, Human
uuccacuugauuuugcaa

SEQ ID NO: 2199300 - RNA, 12 nt, Human
uuccacuuggcu

SEQ ID NO: 2199301 - RNA, 19 nt, Human
uuccacuuggcuacacagg

SEQ ID NO: 2199302 - RNA, 15 nt, Human
uuccacuuuguucuu

SEQ ID NO: 2199303 - RNA, 21 nt, Human
uuccagaaaaccccagcaucc

SEQ ID NO: 2199304 - RNA, 18 nt, Human
uuccagaaaaccccagca

SEQ ID NO: 2199305 - RNA, 23 nt, Human
uuccacuuuguucuuuaggagau

SEQ ID NO: 2199306 - RNA, 12 nt, Human
uuccagccaggg

SEQ ID NO: 2199307 - RNA, 14 nt, Human
uuccagccccucug

SEQ ID NO: 2199308 - RNA, 15 nt, Human
uuccagccagggcug

SEQ ID NO: 2199309 - RNA, 16 nt, Human
uuccagccagggcugc

SEQ ID NO: 2199310 - RNA, 21 nt, Human
uuccaucccuacccccuaaga

SEQ ID NO: 2199311 - RNA, 15 nt, Human
uuccaucccuacccc

SEQ ID NO: 2199312 - RNA, 16 nt, Human
uuccagccugccacuc

SEQ ID NO: 2199313 - RNA, 23 nt, Human
uuccaucucgccaccccuccuuc

SEQ ID NO: 2199314 - RNA, 14 nt, Human
uuccaucccagagg

SEQ ID NO: 2199315 - RNA, 14 nt, Human
uuccagccugccac

SEQ ID NO: 2199316 - RNA, 12 nt, Human
uuccagccugcc

SEQ ID NO: 2199317 - RNA, 21 nt, Human
uuccagccggcauggcuggga

SEQ ID NO: 2199318 - RNA, 20 nt, Human
uuccagccccucuggucgcu

SEQ ID NO: 2199319 - RNA, 16 nt, Human
uuccagccccucuggu

SEQ ID NO: 2199320 - RNA, 17 nt, Human
uuccagccccucugguc

SEQ ID NO: 2199321 - RNA, 15 nt, Human
uuccaugaaaaugca

SEQ ID NO: 2199322 - RNA, 24 nt, Human
uuccaugaaaaugcaacaacaugu

SEQ ID NO: 2199323 - RNA, 22 nt, Human
uuccaugaaaacguuuuauugu

SEQ ID NO: 2199324 - RNA, 15 nt, Human
uuccaugaaaacguu

SEQ ID NO: 2199325 - RNA, 13 nt, Human
uuccaugaaaacg

SEQ ID NO: 2199326 - RNA, 12 nt, Human
uuccaucugauu

SEQ ID NO: 2199327 - RNA, 18 nt, Human
uuccaucuuuacaaaacu

SEQ ID NO: 2199328 - RNA, 13 nt, Human
uuccaucuuuaca

SEQ ID NO: 2199329 - RNA, 18 nt, Human
uuccaugagaacagcagg

SEQ ID NO: 2199330 - RNA, 20 nt, Human
uuccaugaauguaucaggaa

SEQ ID NO: 2199331 - RNA, 15 nt, Human
uuccaugaauguauc

SEQ ID NO: 2199332 - RNA, 16 nt, Human
uuccaugaaggcagag

SEQ ID NO: 2199333 - RNA, 18 nt, Human
uuccaugaagaccacauc

SEQ ID NO: 2199334 - RNA, 20 nt, Human
uuccaugaaguuugaacuuc

SEQ ID NO: 2199335 - RNA, 12 nt, Human
uuccaugaaugu

SEQ ID NO: 2199336 - RNA, 15 nt, Human
uuccaugaaucgcuu

SEQ ID NO: 2199337 - RNA, 20 nt, Human
uuccaugaaucgcuucucuu

SEQ ID NO: 2199338 - RNA, 17 nt, Human
uuccaugucgccucugc

SEQ ID NO: 2199339 - RNA, 16 nt, Human
uuccaugucgccucug

SEQ ID NO: 2199340 - RNA, 14 nt, Human
uuccaugccugagg

SEQ ID NO: 2199341 - RNA, 15 nt, Human
uuccaugccugaggg

SEQ ID NO: 2199342 - RNA, 18 nt, Human
uuccaugucgccucugca

SEQ ID NO: 2199343 - RNA, 19 nt, Human
uuccaugucgccucugcau

SEQ ID NO: 2199344 - RNA, 17 nt, Human
uuccaugaguccccugu

SEQ ID NO: 2199345 - RNA, 18 nt, Human
uuccaugauucuauuuau

SEQ ID NO: 2199346 - RNA, 18 nt, Human
uuccaugaugcugggauu

SEQ ID NO: 2199347 - RNA, 13 nt, Human
uuccaugccugag

SEQ ID NO: 2199348 - RNA, 17 nt, Human
uuccaugauucuauuua

SEQ ID NO: 2199349 - RNA, 13 nt, Human
uuccaugaugcug

SEQ ID NO: 2199350 - RNA, 13 nt, Human
uucccauuuugga

SEQ ID NO: 2199351 - RNA, 19 nt, Human
uucccauuuugcaaaauuu

SEQ ID NO: 2199352 - RNA, 17 nt, Human
uucccauuuugcaaaau

SEQ ID NO: 2199353 - RNA, 14 nt, Human
uucccauuuugcaa

SEQ ID NO: 2199354 - RNA, 16 nt, Human
uucccaaacgccuccc

SEQ ID NO: 2199355 - RNA, 21 nt, Human
uucccaaaagcccauucauuc

SEQ ID NO: 2199356 - RNA, 11 nt, Human
uucccaaaagc

SEQ ID NO: 2199357 - RNA, 18 nt, Human
uuccccaaccacuucauu

SEQ ID NO: 2199358 - RNA, 19 nt, Human
uuccccaacagugugaagu

SEQ ID NO: 2199359 - RNA, 20 nt, Human
uuccccaacagugugaaguu

SEQ ID NO: 2199360 - RNA, 15 nt, Human
uuccccaaagucuua

SEQ ID NO: 2199361 - RNA, 13 nt, Human
uuccccaacagug

SEQ ID NO: 2199362 - RNA, 15 nt, Human
uuccccaacagugug

SEQ ID NO: 2199363 - RNA, 16 nt, Human
uuccccaacaguguga

SEQ ID NO: 2199364 - RNA, 23 nt, Human
uuccccaacagugugaaguuaga

SEQ ID NO: 2199365 - RNA, 14 nt, Human
uuccccaagacauu

SEQ ID NO: 2199366 - RNA, 13 nt, Human
uuccauuguguga

SEQ ID NO: 2199367 - RNA, 15 nt, Human
uuccaugucggccuc

SEQ ID NO: 2199368 - RNA, 16 nt, Human
uuccaugucggccucu

SEQ ID NO: 2199369 - RNA, 15 nt, Human
uuccauuguuugaaa

SEQ ID NO: 2199370 - RNA, 17 nt, Human
uuccauuguuugaaaca

SEQ ID NO: 2199371 - RNA, 22 nt, Human
uuccauuguuugaaacaaagaa

SEQ ID NO: 2199372 - RNA, 18 nt, Human
uuccauuguuuggagaca

SEQ ID NO: 2199373 - RNA, 20 nt, Human
uuccaugucgccucugcauu

SEQ ID NO: 2199374 - RNA, 21 nt, Human
uuccaugucgccucugcauuc

SEQ ID NO: 2199375 - RNA, 14 nt, Human
uuccauuugugugu

SEQ ID NO: 2199376 - RNA, 17 nt, Human
uuccauuugcaagggaa

SEQ ID NO: 2199377 - RNA, 20 nt, Human
uuccauuguuuggagacauu

SEQ ID NO: 2199378 - RNA, 21 nt, Human
uuccauuguuuggagacauuc

SEQ ID NO: 2199379 - RNA, 13 nt, Human
uuccauuugcaag

SEQ ID NO: 2199380 - RNA, 19 nt, Human
uuccauuuaucuuucuaca

SEQ ID NO: 2199381 - RNA, 16 nt, Human
uucaugaguuuuuccc

SEQ ID NO: 2199382 - RNA, 23 nt, Human
uucaugacuuuuccauguaucua

SEQ ID NO: 2199383 - RNA, 17 nt, Human
uucaugauuucauuuca

SEQ ID NO: 2199384 - RNA, 19 nt, Human
uucauuuaggugaggaagc

SEQ ID NO: 2199385 - RNA, 23 nt, Human
uucaugauuucauuucaacuguu

SEQ ID NO: 2199386 - RNA, 19 nt, Human
uucauuuagucaugugacc

SEQ ID NO: 2199387 - RNA, 13 nt, Human
uucauuuguguca

SEQ ID NO: 2199388 - RNA, 15 nt, Human
uucauuugugucaau

SEQ ID NO: 2199389 - RNA, 21 nt, Human
uucauuuuaacaucugagaaa

SEQ ID NO: 2199390 - RNA, 18 nt, Human
uucauuuuaacaucugag

SEQ ID NO: 2199391 - RNA, 19 nt, Human
uucauuuggaaauaagcug

SEQ ID NO: 2199392 - RNA, 16 nt, Human
uucauuuccuccguca

SEQ ID NO: 2199393 - RNA, 22 nt, Human
uucauuugguucauuaauucua

SEQ ID NO: 2199394 - RNA, 15 nt, Human
uucauuucaacuguu

SEQ ID NO: 2199395 - RNA, 16 nt, Human
uucauuuccucaaaaa

SEQ ID NO: 2199396 - RNA, 13 nt, Human
uucauuuccucaa

SEQ ID NO: 2199397 - RNA, 12 nt, Human
uucauuucauug

SEQ ID NO: 2199398 - RNA, 13 nt, Human
uucauuucauugu

SEQ ID NO: 2199399 - RNA, 15 nt, Human
uucauuucauuguau

SEQ ID NO: 2199400 - RNA, 18 nt, Human
uucaucuauuucugagaa

SEQ ID NO: 2199401 - RNA, 14 nt, Human
uucaucuccaggga

SEQ ID NO: 2199402 - RNA, 17 nt, Human
uucaucuauuucugaga

SEQ ID NO: 2199403 - RNA, 16 nt, Human
uucaucuauuucugag

SEQ ID NO: 2199404 - RNA, 22 nt, Human
uucaucucccaccuagcagcac

SEQ ID NO: 2199405 - RNA, 15 nt, Human
uucaucuccagggag

SEQ ID NO: 2199406 - RNA, 22 nt, Human
uucaucuccagggaguccccuc

SEQ ID NO: 2199407 - RNA, 14 nt, Human
uucaucucucagaa

SEQ ID NO: 2199408 - RNA, 17 nt, Human
uucaucucucagaaggg

SEQ ID NO: 2199409 - RNA, 21 nt, Human
uucaucucucagaagggaggc

SEQ ID NO: 2199410 - RNA, 20 nt, Human
uucaucuuccaacucaaacu

SEQ ID NO: 2199411 - RNA, 11 nt, Human
uucaucuugaa

SEQ ID NO: 2199412 - RNA, 12 nt, Human
uucaucuugaau

SEQ ID NO: 2199413 - RNA, 21 nt, Human
uucaugaacuucgcaucaaaa

SEQ ID NO: 2199414 - RNA, 22 nt, Human
uucaugaacuucgcaucaaaag

SEQ ID NO: 2199415 - RNA, 13 nt, Human
uucaugaaauccu

SEQ ID NO: 2199416 - RNA, 14 nt, Human
uucauaaucuuugc

SEQ ID NO: 2199417 - RNA, 17 nt, Human
uucauaaguauuucaaa

SEQ ID NO: 2199418 - RNA, 20 nt, Human
uucauaaguauuaugucucu

SEQ ID NO: 2199419 - RNA, 19 nt, Human
uucauaaguauuaugucuc

SEQ ID NO: 2199420 - RNA, 17 nt, Human
uucauaacuuucauuaa

SEQ ID NO: 2199421 - RNA, 21 nt, Human
uucaguuuucauuugguucau

SEQ ID NO: 2199422 - RNA, 12 nt, Human
uucauaaguauu

SEQ ID NO: 2199423 - RNA, 14 nt, Human
uucauaagccaauu

SEQ ID NO: 2199424 - RNA, 22 nt, Human
uucauaagccaauuuuucugca

SEQ ID NO: 2199425 - RNA, 12 nt, Human
uucaguuuucag

SEQ ID NO: 2199426 - RNA, 17 nt, Human
uucaguuuuaucuuuaa

SEQ ID NO: 2199427 - RNA, 19 nt, Human
uucaguuuuaccagaugau

SEQ ID NO: 2199428 - RNA, 13 nt, Human
uucaguuuguaua

SEQ ID NO: 2199429 - RNA, 19 nt, Human
uucaguuucaauucagugc

SEQ ID NO: 2199430 - RNA, 23 nt, Human
uucauaagccaauuuuucugcac

SEQ ID NO: 2199431 - RNA, 23 nt, Human
uucaucuauuuuuggcagucuga

SEQ ID NO: 2199432 - RNA, 15 nt, Human
uucaucuaggauuuu

SEQ ID NO: 2199433 - RNA, 13 nt, Human
uucauaaugacuu

SEQ ID NO: 2199434 - RNA, 23 nt, Human
uucauaaugacuuaagcacacuu

SEQ ID NO: 2199435 - RNA, 16 nt, Human
uucaggcugcuuggga

SEQ ID NO: 2199436 - RNA, 13 nt, Human
uucaggcugcuug

SEQ ID NO: 2199437 - RNA, 16 nt, Human
uucaggcucuucuccu

SEQ ID NO: 2199438 - RNA, 23 nt, Human
uucagggaaccguuauuauaauu

SEQ ID NO: 2199439 - RNA, 19 nt, Human
uucagugccuuauggaaca

SEQ ID NO: 2199440 - RNA, 21 nt, Human
uucagugccuuauggaacacu

SEQ ID NO: 2199441 - RNA, 16 nt, Human
uucaguugauuuuaca

SEQ ID NO: 2199442 - RNA, 12 nt, Human
uucaguggagaa

SEQ ID NO: 2199443 - RNA, 24 nt, Human
uucaguggcacgucaucuaguuuu

SEQ ID NO: 2199444 - RNA, 19 nt, Human
uucaguuggcugacuucca

SEQ ID NO: 2199445 - RNA, 13 nt, Human
uucagugcugugg

SEQ ID NO: 2199446 - RNA, 18 nt, Human
uucagggaauuucaggaa

SEQ ID NO: 2199447 - RNA, 21 nt, Human
uucagugcuguggccugggca

SEQ ID NO: 2199448 - RNA, 19 nt, Human
uucagugcuguggccuggg

SEQ ID NO: 2199449 - RNA, 13 nt, Human
uucaguggcagcu

SEQ ID NO: 2199450 - RNA, 18 nt, Human
uuccugcccuuccucagu

SEQ ID NO: 2199451 - RNA, 20 nt, Human
uuccuuccaucccuaccccc

SEQ ID NO: 2199452 - RNA, 12 nt, Human
uuccuucccacc

SEQ ID NO: 2199453 - RNA, 21 nt, Human
uuccuucccacccaucgcugu

SEQ ID NO: 2199454 - RNA, 18 nt, Human
uuccugccgcaacaguuu

SEQ ID NO: 2199455 - RNA, 17 nt, Human
uuccuucauuuccuccg

SEQ ID NO: 2199456 - RNA, 14 nt, Human
uuccuucccuggcu

SEQ ID NO: 2199457 - RNA, 16 nt, Human
uuccuucccugggcug

SEQ ID NO: 2199458 - RNA, 13 nt, Human
uuccuucccuggc

SEQ ID NO: 2199459 - RNA, 20 nt, Human
uuccuucccugggcugugcu

SEQ ID NO: 2199460 - RNA, 21 nt, Human
uuccuucccugggcugugcua

SEQ ID NO: 2199461 - RNA, 12 nt, Human
uuccuucccugg

SEQ ID NO: 2199462 - RNA, 16 nt, Human
uuccuuccuucccugg

SEQ ID NO: 2199463 - RNA, 13 nt, Human
uuccuucugaagu

SEQ ID NO: 2199464 - RNA, 17 nt, Human
uuccuucugugaaagua

SEQ ID NO: 2199465 - RNA, 21 nt, Human
uuccuuucauuuacuguggcu

SEQ ID NO: 2199466 - RNA, 17 nt, Human
uuccuucugccugagcu

SEQ ID NO: 2199467 - RNA, 20 nt, Human
uuccuucugugaaaguacau

SEQ ID NO: 2199468 - RNA, 16 nt, Human
uuccuucucaucugug

SEQ ID NO: 2199469 - RNA, 14 nt, Human
uuccuucucaucug

SEQ ID NO: 2199470 - RNA, 14 nt, Human
uuccuuccuucccu

SEQ ID NO: 2199471 - RNA, 15 nt, Human
uuccuuccuguucug

SEQ ID NO: 2199472 - RNA, 17 nt, Human
uuccuuccucugagccu

SEQ ID NO: 2199473 - RNA, 13 nt, Human
uuccuuccucuga

SEQ ID NO: 2199474 - RNA, 19 nt, Human
uuccuucauucaacccacc

SEQ ID NO: 2199475 - RNA, 23 nt, Human
uuccuucagugccuuauggaaca

SEQ ID NO: 2199476 - RNA, 16 nt, Human
uuccuucagugccuua

SEQ ID NO: 2199477 - RNA, 19 nt, Human
uuccuucagugccuuaugg

SEQ ID NO: 2199478 - RNA, 11 nt, Human
uuccugcccug

SEQ ID NO: 2199479 - RNA, 18 nt, Human
uuccugccccaggccuga

SEQ ID NO: 2199480 - RNA, 15 nt, Human
uuccuccugcucaua

SEQ ID NO: 2199481 - RNA, 13 nt, Human
uuccuccugcuca

SEQ ID NO: 2199482 - RNA, 11 nt, Human
uuccuccugga

SEQ ID NO: 2199483 - RNA, 13 nt, Human
uuccuccuggaaa

SEQ ID NO: 2199484 - RNA, 16 nt, Human
uuccugcccuuccuca

SEQ ID NO: 2199485 - RNA, 17 nt, Human
uuccugcccuuccucag

SEQ ID NO: 2199486 - RNA, 22 nt, Human
uuccugcccugggaggcaguga

SEQ ID NO: 2199487 - RNA, 16 nt, Human
uuccugcccugggagg

SEQ ID NO: 2199488 - RNA, 13 nt, Human
uuccugcccuggg

SEQ ID NO: 2199489 - RNA, 20 nt, Human
uuccuuucauuuacuguggc

SEQ ID NO: 2199490 - RNA, 14 nt, Human
uuccuuuccccagc

SEQ ID NO: 2199491 - RNA, 17 nt, Human
uuccuuuccccagccca

SEQ ID NO: 2199492 - RNA, 15 nt, Human
uuccuuuccccagcc

SEQ ID NO: 2199493 - RNA, 16 nt, Human
uuccuuuccccagccc

SEQ ID NO: 2199494 - RNA, 10 nt, Human
uuccuuucuc

SEQ ID NO: 2199495 - RNA, 12 nt, Human
uuccuuucucac

SEQ ID NO: 2199496 - RNA, 13 nt, Human
uuccuuucucacc

SEQ ID NO: 2199497 - RNA, 14 nt, Human
uuccuuucucaccg

SEQ ID NO: 2199498 - RNA, 12 nt, Human
uuccuuucucag

SEQ ID NO: 2199499 - RNA, 20 nt, Human
uuccuuucuugguucauaaa

SEQ ID NO: 2199500 - RNA, 14 nt, Human
uuccuuugaagagg

SEQ ID NO: 2199501 - RNA, 15 nt, Human
uuccuuugaagagga

SEQ ID NO: 2199502 - RNA, 22 nt, Human
uuccuuugaauccucucucugu

SEQ ID NO: 2199503 - RNA, 19 nt, Human
uucggccuccauccugagg

SEQ ID NO: 2199504 - RNA, 18 nt, Human
uucggccuccauccugag

SEQ ID NO: 2199505 - RNA, 22 nt, Human
uucggccuccauccugaggcuc

SEQ ID NO: 2199506 - RNA, 19 nt, Human
uucuaaaauauaaucaacc

SEQ ID NO: 2199507 - RNA, 23 nt, Human
uucuaaacccaauccaaauggcg

SEQ ID NO: 2199508 - RNA, 19 nt, Human
uucuaaacccaauccaaau

SEQ ID NO: 2199509 - RNA, 18 nt, Human
uucuaaacccaauccaaa

SEQ ID NO: 2199510 - RNA, 22 nt, Human
uucuaaacaagaaucagucuau

SEQ ID NO: 2199511 - RNA, 16 nt, Human
uucuaaacaagauuuu

SEQ ID NO: 2199512 - RNA, 13 nt, Human
uucuaaagaugga

SEQ ID NO: 2199513 - RNA, 16 nt, Human
uucuaaaggcuaccuu

SEQ ID NO: 2199514 - RNA, 15 nt, Human
uucuaauaaaacaaa

SEQ ID NO: 2199515 - RNA, 20 nt, Human
uucuaaaggccucuuccuug

SEQ ID NO: 2199516 - RNA, 18 nt, Human
uucuaaaggcuaccuuug

SEQ ID NO: 2199517 - RNA, 17 nt, Human
uucuaaaggcuaccuuu

SEQ ID NO: 2199518 - RNA, 21 nt, Human
uuccucccucccucuuucccu

SEQ ID NO: 2199519 - RNA, 19 nt, Human
uuccucccucccucuuucc

SEQ ID NO: 2199520 - RNA, 12 nt, Human
uuccucccuccc

SEQ ID NO: 2199521 - RNA, 15 nt, Human
uuccucaucugucca

SEQ ID NO: 2199522 - RNA, 18 nt, Human
uuccucauccaccccauc

SEQ ID NO: 2199523 - RNA, 19 nt, Human
uuccucauccaccccaucc

SEQ ID NO: 2199524 - RNA, 22 nt, Human
uuccucccucccucuuucccuc

SEQ ID NO: 2199525 - RNA, 12 nt, Human
uuccucccuucu

SEQ ID NO: 2199526 - RNA, 11 nt, Human
uuccucccuuc

SEQ ID NO: 2199527 - RNA, 17 nt, Human
uuccuccucccuccugc

SEQ ID NO: 2199528 - RNA, 16 nt, Human
uuccuccuccccacuu

SEQ ID NO: 2199529 - RNA, 15 nt, Human
uuccuccucccuccu

SEQ ID NO: 2199530 - RNA, 18 nt, Human
uuccucccuucugcuacu

SEQ ID NO: 2199531 - RNA, 16 nt, Human
uuccucccuucugcua

SEQ ID NO: 2199532 - RNA, 15 nt, Human
uuccucccuucugcu

SEQ ID NO: 2199533 - RNA, 14 nt, Human
uuccucccuucugc

SEQ ID NO: 2199534 - RNA, 14 nt, Human
uuccuccuccccac

SEQ ID NO: 2199535 - RNA, 23 nt, Human
uuccucauaguaugguggcuggg

SEQ ID NO: 2199536 - RNA, 23 nt, Human
uuccucaguucauccauucuauu

SEQ ID NO: 2199537 - RNA, 17 nt, Human
uuccucaguuacacaaa

SEQ ID NO: 2199538 - RNA, 23 nt, Human
uuccucaguuuaauccuucuagu

SEQ ID NO: 2199539 - RNA, 22 nt, Human
uuccucaggcaaggucuggccu

SEQ ID NO: 2199540 - RNA, 18 nt, Human
uuccuaguuuucuccucc

SEQ ID NO: 2199541 - RNA, 15 nt, Human
uuccuaguuuucucc

SEQ ID NO: 2199542 - RNA, 16 nt, Human
uuccuaguucuguaga

SEQ ID NO: 2199543 - RNA, 17 nt, Human
uuccuaguucuguagaa

SEQ ID NO: 2199544 - RNA, 20 nt, Human
uuccuaguucuguagaaaug

SEQ ID NO: 2199545 - RNA, 18 nt, Human
uuccuagcccucucacau

SEQ ID NO: 2199546 - RNA, 12 nt, Human
uuccuagugaaa

SEQ ID NO: 2199547 - RNA, 20 nt, Human
uuccuagguauaauucacau

SEQ ID NO: 2199548 - RNA, 22 nt, Human
uuccuagccaccgccuccuaca

SEQ ID NO: 2199549 - RNA, 19 nt, Human
uuccuagcacacacuuuug

SEQ ID NO: 2199550 - RNA, 14 nt, Human
uuccuagcccucuc

SEQ ID NO: 2199551 - RNA, 15 nt, Human
uucccuuuccuucca

SEQ ID NO: 2199552 - RNA, 22 nt, Human
uuccuagaaguuacugaaugca

SEQ ID NO: 2199553 - RNA, 19 nt, Human
uucccuuugacgccauccc

SEQ ID NO: 2199554 - RNA, 14 nt, Human
uuccuagccaccgc

SEQ ID NO: 2199555 - RNA, 22 nt, Human
uuccuagauggcagucacugaa

SEQ ID NO: 2199556 - RNA, 19 nt, Human
uuccuagauggcagucacu

SEQ ID NO: 2199557 - RNA, 17 nt, Human
uuccuagcacacacuuu

SEQ ID NO: 2199558 - RNA, 21 nt, Human
uuccuagccaccgccuccuac

SEQ ID NO: 2199559 - RNA, 15 nt, Human
uuccuagccaccgcc

SEQ ID NO: 2199560 - RNA, 15 nt, Human
uucccuuggccucag

SEQ ID NO: 2199561 - RNA, 14 nt, Human
uucccuuggccuca

SEQ ID NO: 2199562 - RNA, 12 nt, Human
uucccuuggccu

SEQ ID NO: 2199563 - RNA, 11 nt, Human
uucccuuggcc

SEQ ID NO: 2199564 - RNA, 16 nt, Human
uucccuuggccucaga

SEQ ID NO: 2199565 - RNA, 15 nt, Human
uuccccagcccaggg

SEQ ID NO: 2199566 - RNA, 18 nt, Human
uucccuugaugaagaagu

SEQ ID NO: 2199567 - RNA, 16 nt, Human
uucccuucaucuggaa

SEQ ID NO: 2199568 - RNA, 15 nt, Human
uucccuucaucugga

SEQ ID NO: 2199569 - RNA, 14 nt, Human
uucccuucaucugg

SEQ ID NO: 2199570 - RNA, 22 nt, Human
uuccccacuugagaauuacccu

SEQ ID NO: 2199571 - RNA, 12 nt, Human
uuccccagagaa

SEQ ID NO: 2199572 - RNA, 11 nt, Human
uuccccagaga

SEQ ID NO: 2199573 - RNA, 22 nt, Human
uuccccaccccagcucaugccc

SEQ ID NO: 2199574 - RNA, 17 nt, Human
uuccccacugacagccu

SEQ ID NO: 2199575 - RNA, 23 nt, Human
uuccccacugacagccucccacc

SEQ ID NO: 2199576 - RNA, 21 nt, Human
uuccccacugacagccuccca

SEQ ID NO: 2199577 - RNA, 18 nt, Human
uuccccacugccugccca

SEQ ID NO: 2199578 - RNA, 14 nt, Human
uuccccacugccug

SEQ ID NO: 2199579 - RNA, 17 nt, Human
uuccccacugcacacac

SEQ ID NO: 2199580 - RNA, 19 nt, Human
uucccuucaguacccucuc

SEQ ID NO: 2199581 - RNA, 22 nt, Human
uucccuucaguacccucucagc

SEQ ID NO: 2199582 - RNA, 23 nt, Human
uucccuucaguacccucucagcu

SEQ ID NO: 2199583 - RNA, 20 nt, Human
uucccuguauuuucuuucuc

SEQ ID NO: 2199584 - RNA, 11 nt, Human
uucccugugcu

SEQ ID NO: 2199585 - RNA, 12 nt, Human
uucccugugcug

SEQ ID NO: 2199586 - RNA, 16 nt, Human
uucccuguauuuucuu

SEQ ID NO: 2199587 - RNA, 12 nt, Human
uuccccagccca

SEQ ID NO: 2199588 - RNA, 22 nt, Human
uuccccagcagggucuuuucau

SEQ ID NO: 2199589 - RNA, 13 nt, Human
uuccccagcccag

SEQ ID NO: 2199590 - RNA, 14 nt, Human
uuccccagcccagg

SEQ ID NO: 2199591 - RNA, 20 nt, Human
uucuccaggucucacgggca

SEQ ID NO: 2199592 - RNA, 20 nt, Human
uucuccauccacaugggagc

SEQ ID NO: 2199593 - RNA, 23 nt, Human
uucuccaugagacacaucuccuc

SEQ ID NO: 2199594 - RNA, 18 nt, Human
uucuccaucuggcagggu

SEQ ID NO: 2199595 - RNA, 19 nt, Human
uucuccaucucucuggccc

SEQ ID NO: 2199596 - RNA, 21 nt, Human
uucuccauccuuucugccucu

SEQ ID NO: 2199597 - RNA, 18 nt, Human
uucuccaggcucuuuggg

SEQ ID NO: 2199598 - RNA, 15 nt, Human
uucuccaucucucug

SEQ ID NO: 2199599 - RNA, 23 nt, Human
uucucccaggccaggcuccuucc

SEQ ID NO: 2199600 - RNA, 14 nt, Human
uucucccaggaagc

SEQ ID NO: 2199601 - RNA, 15 nt, Human
uucucccaggaagcu

SEQ ID NO: 2199602 - RNA, 17 nt, Human
uucucccacuuggccaa

SEQ ID NO: 2199603 - RNA, 12 nt, Human
uucucccaggaa

SEQ ID NO: 2199604 - RNA, 13 nt, Human
uucucccaggaag

SEQ ID NO: 2199605 - RNA, 13 nt, Human
uucucccacacug

SEQ ID NO: 2199606 - RNA, 14 nt, Human
uucuccauuguaaa

SEQ ID NO: 2199607 - RNA, 22 nt, Human
uucuccauggccaccuuuucag

SEQ ID NO: 2199608 - RNA, 11 nt, Human
uucuccaggcu

SEQ ID NO: 2199609 - RNA, 15 nt, Human
uucuccacagcaacc

SEQ ID NO: 2199610 - RNA, 19 nt, Human
uucuccaauaucagugcuc

SEQ ID NO: 2199611 - RNA, 21 nt, Human
uucuccaauaucagugcucga

SEQ ID NO: 2199612 - RNA, 22 nt, Human
uucuccacagcaaccccaggcu

SEQ ID NO: 2199613 - RNA, 13 nt, Human
uucuccacccugc

SEQ ID NO: 2199614 - RNA, 16 nt, Human
uucuccaagcaggaca

SEQ ID NO: 2199615 - RNA, 18 nt, Human
uucucccccugggcucug

SEQ ID NO: 2199616 - RNA, 17 nt, Human
uucucccccugggcucu

SEQ ID NO: 2199617 - RNA, 14 nt, Human
uucucccccugggc

SEQ ID NO: 2199618 - RNA, 20 nt, Human
uucucccccccggggcuggg

SEQ ID NO: 2199619 - RNA, 21 nt, Human
uucucccccccggggcugggu

SEQ ID NO: 2199620 - RNA, 19 nt, Human
uucucccagguaccagcug

SEQ ID NO: 2199621 - RNA, 20 nt, Human
uucucccagguaccagcugc

SEQ ID NO: 2199622 - RNA, 17 nt, Human
uucucccccccggggcu

SEQ ID NO: 2199623 - RNA, 18 nt, Human
uucucuccagccccugga

SEQ ID NO: 2199624 - RNA, 23 nt, Human
uucucccccccggggcuggguug

SEQ ID NO: 2199625 - RNA, 20 nt, Human
uucucucggaguaucuggga

SEQ ID NO: 2199626 - RNA, 15 nt, Human
uucucuccuccccaa

SEQ ID NO: 2199627 - RNA, 17 nt, Human
uucucuccuccccaaau

SEQ ID NO: 2199628 - RNA, 22 nt, Human
uucucuccuguaccucuugagc

SEQ ID NO: 2199629 - RNA, 12 nt, Human
uucucucucacc

SEQ ID NO: 2199630 - RNA, 17 nt, Human
uucucucggcuccccau

SEQ ID NO: 2199631 - RNA, 16 nt, Human
uucucucuccugucca

SEQ ID NO: 2199632 - RNA, 21 nt, Human
uucucucccaggggcuggcuu

SEQ ID NO: 2199633 - RNA, 23 nt, Human
uucucucccaggggcuggcuuca

SEQ ID NO: 2199634 - RNA, 12 nt, Human
uucucuccuccc

SEQ ID NO: 2199635 - RNA, 14 nt, Human
uucucuccucccca

SEQ ID NO: 2199636 - RNA, 23 nt, Human
uucucuccucuccccaugauguu

SEQ ID NO: 2199637 - RNA, 23 nt, Human
uucucugaagaguggguuucaca

SEQ ID NO: 2199638 - RNA, 11 nt, Human
uucucugacuu

SEQ ID NO: 2199639 - RNA, 15 nt, Human
uucucugaagggagg

SEQ ID NO: 2199640 - RNA, 16 nt, Human
uucucugaagggaggu

SEQ ID NO: 2199641 - RNA, 12 nt, Human
uucucugacuuc

SEQ ID NO: 2199642 - RNA, 16 nt, Human
uucucugacuucugcc

SEQ ID NO: 2199643 - RNA, 17 nt, Human
uucucugacuucugccu

SEQ ID NO: 2199644 - RNA, 14 nt, Human
uucucugcuccacc

SEQ ID NO: 2199645 - RNA, 13 nt, Human
uucucugcuccac

SEQ ID NO: 2199646 - RNA, 11 nt, Human
uucucugcucc

SEQ ID NO: 2199647 - RNA, 22 nt, Human
uucucuggaaaggggggagcug

SEQ ID NO: 2199648 - RNA, 15 nt, Human
uucucugcuccacca

SEQ ID NO: 2199649 - RNA, 17 nt, Human
uucucuggagccaaguc

SEQ ID NO: 2199650 - RNA, 15 nt, Human
uucucuggagccaag

SEQ ID NO: 2199651 - RNA, 22 nt, Human
uucucugaguaucuccucgcaa

SEQ ID NO: 2199652 - RNA, 13 nt, Human
uucucugccagug

SEQ ID NO: 2199653 - RNA, 10 nt, Human
uucucugcca

SEQ ID NO: 2199654 - RNA, 12 nt, Human
uucucugccagu

SEQ ID NO: 2199655 - RNA, 12 nt, Human
uucucugucuca

SEQ ID NO: 2199656 - RNA, 17 nt, Human
uucucuguagggaacuc

SEQ ID NO: 2199657 - RNA, 20 nt, Human
uucugacgugccuuuugcac

SEQ ID NO: 2199658 - RNA, 16 nt, Human
uucugacucugagcua

SEQ ID NO: 2199659 - RNA, 15 nt, Human
uucugacucugagcu

SEQ ID NO: 2199660 - RNA, 18 nt, Human
uucugacucgguuucucc

SEQ ID NO: 2199661 - RNA, 19 nt, Human
uucugacucgguuucucca

SEQ ID NO: 2199662 - RNA, 14 nt, Human
uucucuguauagua

SEQ ID NO: 2199663 - RNA, 21 nt, Human
uucugacccaugcugcccugu

SEQ ID NO: 2199664 - RNA, 19 nt, Human
uucucugguaauauugacu

SEQ ID NO: 2199665 - RNA, 16 nt, Human
uucugacccaugcugc

SEQ ID NO: 2199666 - RNA, 18 nt, Human
uucugacccaugcugccc

SEQ ID NO: 2199667 - RNA, 20 nt, Human
uucugacccaugcugcccug

SEQ ID NO: 2199668 - RNA, 13 nt, Human
uucuaaugucuuc

SEQ ID NO: 2199669 - RNA, 23 nt, Human
uucuauaugaauuuaaauauaau

SEQ ID NO: 2199670 - RNA, 19 nt, Human
uucuaauauuuauugcuuu

SEQ ID NO: 2199671 - RNA, 21 nt, Human
uucuaauauuuauugcuuuau

SEQ ID NO: 2199672 - RNA, 18 nt, Human
uucuaauauuuauugcuu

SEQ ID NO: 2199673 - RNA, 22 nt, Human
uucuaauauauuuuuauauuua

SEQ ID NO: 2199674 - RNA, 18 nt, Human
uucuaauagaacucaguu

SEQ ID NO: 2199675 - RNA, 14 nt, Human
uucuaauaguuuua

SEQ ID NO: 2199676 - RNA, 12 nt, Human
uucuaauagaac

SEQ ID NO: 2199677 - RNA, 14 nt, Human
uucuaauagaacuc

SEQ ID NO: 2199678 - RNA, 17 nt, Human
uucuaugacacaugcaa

SEQ ID NO: 2199679 - RNA, 16 nt, Human
uucuaugacacaugca

SEQ ID NO: 2199680 - RNA, 22 nt, Human
uucuaugugacaauuuuguaca

SEQ ID NO: 2199681 - RNA, 15 nt, Human
uucuauguaguuuau

SEQ ID NO: 2199682 - RNA, 14 nt, Human
uucuaucacauauu

SEQ ID NO: 2199683 - RNA, 17 nt, Human
uucuaucacauauuuga

SEQ ID NO: 2199684 - RNA, 13 nt, Human
uucuaucauuuuu

SEQ ID NO: 2199685 - RNA, 18 nt, Human
uucuaucauuuuuguaca

SEQ ID NO: 2199686 - RNA, 17 nt, Human
uucuaucauuuuuguac

SEQ ID NO: 2199687 - RNA, 13 nt, Human
uucuaugagaaaa

SEQ ID NO: 2199688 - RNA, 13 nt, Human
uucuauugaaaaa

SEQ ID NO: 2199689 - RNA, 22 nt, Human
uucuauucaagguggccaaauu

SEQ ID NO: 2199690 - RNA, 20 nt, Human
uucuauuagccagucuuuac

SEQ ID NO: 2199691 - RNA, 17 nt, Human
uucuauuaacuuuaauu

SEQ ID NO: 2199692 - RNA, 17 nt, Human
uucuauugacuucaaug

SEQ ID NO: 2199693 - RNA, 14 nt, Human
uucuauugaaaaau

SEQ ID NO: 2199694 - RNA, 23 nt, Human
uucuauugacuucaaugauagua

SEQ ID NO: 2199695 - RNA, 18 nt, Human
uucuauugcaguuauaga

SEQ ID NO: 2199696 - RNA, 14 nt, Human
uucuauuguacaga

SEQ ID NO: 2199697 - RNA, 15 nt, Human
uucuauuguacagaa

SEQ ID NO: 2199698 - RNA, 14 nt, Human
uucuauuguuacuc

SEQ ID NO: 2199699 - RNA, 17 nt, Human
uucuauuguuacucugg

SEQ ID NO: 2199700 - RNA, 20 nt, Human
uucuccaaacugaagcagcc

SEQ ID NO: 2199701 - RNA, 14 nt, Human
uucuccaaaugaga

SEQ ID NO: 2199702 - RNA, 21 nt, Human
uucucaugccucagccuccug

SEQ ID NO: 2199703 - RNA, 14 nt, Human
uucucaugccucag

SEQ ID NO: 2199704 - RNA, 12 nt, Human
uucucaugccuc

SEQ ID NO: 2199705 - RNA, 11 nt, Human
uucucaugccu

SEQ ID NO: 2199706 - RNA, 15 nt, Human
uucucaucuuucuug

SEQ ID NO: 2199707 - RNA, 18 nt, Human
uucucaucuuucuugauc

SEQ ID NO: 2199708 - RNA, 14 nt, Human
uucucaugauccaa

SEQ ID NO: 2199709 - RNA, 15 nt, Human
uucucauccugcagg

SEQ ID NO: 2199710 - RNA, 21 nt, Human
uucucaaaguuuugaaaagcu

SEQ ID NO: 2199711 - RNA, 22 nt, Human
uucucaaaguuuugaaaagcua

SEQ ID NO: 2199712 - RNA, 12 nt, Human
uucucaaauaaa

SEQ ID NO: 2199713 - RNA, 21 nt, Human
uucucaacaaagcacaguguu

SEQ ID NO: 2199714 - RNA, 15 nt, Human
uucucaaaguuuuga

SEQ ID NO: 2199715 - RNA, 17 nt, Human
uucucaaaguuuugaaa

SEQ ID NO: 2199716 - RNA, 18 nt, Human
uucucaaaguuuugaaaa

SEQ ID NO: 2199717 - RNA, 23 nt, Human
uucucaaacacaguuacacuugu

SEQ ID NO: 2199718 - RNA, 22 nt, Human
uucucaaaccuguuuaaauauu

SEQ ID NO: 2199719 - RNA, 15 nt, Human
uucuauuuauuuacu

SEQ ID NO: 2199720 - RNA, 19 nt, Human
uucuauuuauauguacaug

SEQ ID NO: 2199721 - RNA, 18 nt, Human
uucuauuuauauguacau

SEQ ID NO: 2199722 - RNA, 19 nt, Human
uucuauuucuccuccaugg

SEQ ID NO: 2199723 - RNA, 17 nt, Human
uucuauuucuccuccau

SEQ ID NO: 2199724 - RNA, 19 nt, Human
uucuauuucagugccaaua

SEQ ID NO: 2199725 - RNA, 13 nt, Human
uucuauuuaaugg

SEQ ID NO: 2199726 - RNA, 17 nt, Human
uucuauuguuuauucuu

SEQ ID NO: 2199727 - RNA, 14 nt, Human
uucuauuuaaugga

SEQ ID NO: 2199728 - RNA, 15 nt, Human
uucuauuguuguaca

SEQ ID NO: 2199729 - RNA, 19 nt, Human
uucuauuguuacucugguu

SEQ ID NO: 2199730 - RNA, 22 nt, Human
uucuauuguuacucugguucuu

SEQ ID NO: 2199731 - RNA, 14 nt, Human
uucuauuguuucuu

SEQ ID NO: 2199732 - RNA, 15 nt, Human
uucuauuuuuguaga

SEQ ID NO: 2199733 - RNA, 13 nt, Human
uucucaaacacag

SEQ ID NO: 2199734 - RNA, 21 nt, Human
uucuauuuucauuuucugcaa

SEQ ID NO: 2199735 - RNA, 23 nt, Human
uucuauuuucauuuucugcaagc

SEQ ID NO: 2199736 - RNA, 16 nt, Human
uucuauuuuguaaacu

SEQ ID NO: 2199737 - RNA, 13 nt, Human
uucuauuuuguaa

SEQ ID NO: 2199738 - RNA, 17 nt, Human
uucuauuuucauuuucu

SEQ ID NO: 2199739 - RNA, 20 nt, Human
uucuauuuucauuuucugca

SEQ ID NO: 2199740 - RNA, 15 nt, Human
uucuauuugcugggc

SEQ ID NO: 2199741 - RNA, 16 nt, Human
uucuauuugcugggcu

SEQ ID NO: 2199742 - RNA, 17 nt, Human
uucuauuugcugggcuu

SEQ ID NO: 2199743 - RNA, 18 nt, Human
uucuauuugcugggcuuu

SEQ ID NO: 2199744 - RNA, 12 nt, Human
uucuauuuggaa

SEQ ID NO: 2199745 - RNA, 22 nt, Human
uucuucacuguccuccaagcca

SEQ ID NO: 2199746 - RNA, 17 nt, Human
uucuucagaagacacug

SEQ ID NO: 2199747 - RNA, 14 nt, Human
uucuucagaagaca

SEQ ID NO: 2199748 - RNA, 22 nt, Human
uucuugguugaggaaacaaaca

SEQ ID NO: 2199749 - RNA, 21 nt, Human
uucuucacccagcuaaucugu

SEQ ID NO: 2199750 - RNA, 14 nt, Human
uucuucacccagcu

SEQ ID NO: 2199751 - RNA, 16 nt, Human
uucuugguuuguaaau

SEQ ID NO: 2199752 - RNA, 13 nt, Human
uucuugguuugua

SEQ ID NO: 2199753 - RNA, 23 nt, Human
uucuugguuuguaaauuaacuuu

SEQ ID NO: 2199754 - RNA, 16 nt, Human
uucuugguugaggaaa

SEQ ID NO: 2199755 - RNA, 16 nt, Human
uucuugguuggcuggc

SEQ ID NO: 2199756 - RNA, 21 nt, Human
uucuuguaauuuaaacaggcc

SEQ ID NO: 2199757 - RNA, 20 nt, Human
uucuugguuggcuggccuuc

SEQ ID NO: 2199758 - RNA, 11 nt, Human
uucuuguaauu

SEQ ID NO: 2199759 - RNA, 18 nt, Human
uucuugguuuguaaauua

SEQ ID NO: 2199760 - RNA, 17 nt, Human
uucuugguuuguaaauu

SEQ ID NO: 2199761 - RNA, 23 nt, Human
uucuuauuuaaugaaagacugua

SEQ ID NO: 2199762 - RNA, 19 nt, Human
uucuuauuuaaugaaagac

SEQ ID NO: 2199763 - RNA, 11 nt, Human
uucuguucuuu

SEQ ID NO: 2199764 - RNA, 13 nt, Human
uucuguucugugg

SEQ ID NO: 2199765 - RNA, 16 nt, Human
uucuguucuguggaaa

SEQ ID NO: 2199766 - RNA, 22 nt, Human
uucuucaacaucaauguucauu

SEQ ID NO: 2199767 - RNA, 21 nt, Human
uucuucaacaucaauguucau

SEQ ID NO: 2199768 - RNA, 14 nt, Human
uucuucaacucccu

SEQ ID NO: 2199769 - RNA, 17 nt, Human
uucuucaacaucaaugu

SEQ ID NO: 2199770 - RNA, 19 nt, Human
uucuucaacaggagaauuu

SEQ ID NO: 2199771 - RNA, 16 nt, Human
uucuuauuucaugaaa

SEQ ID NO: 2199772 - RNA, 14 nt, Human
uucuuauuucauga

SEQ ID NO: 2199773 - RNA, 20 nt, Human
uucuguucuguggaaagugu

SEQ ID NO: 2199774 - RNA, 21 nt, Human
uucuguucuguggaaagugua

SEQ ID NO: 2199775 - RNA, 15 nt, Human
uucuuauuucauuuc

SEQ ID NO: 2199776 - RNA, 12 nt, Human
uucuguggcuca

SEQ ID NO: 2199777 - RNA, 16 nt, Human
uucuguggcucacaga

SEQ ID NO: 2199778 - RNA, 23 nt, Human
uucuguggguuucuaaagcugcc

SEQ ID NO: 2199779 - RNA, 17 nt, Human
uucuguccuacucugug

SEQ ID NO: 2199780 - RNA, 19 nt, Human
uucugaggacauuccaaga

SEQ ID NO: 2199781 - RNA, 21 nt, Human
uucuguggaaaguguaaagca

SEQ ID NO: 2199782 - RNA, 22 nt, Human
uucugugggagaauucuuacau

SEQ ID NO: 2199783 - RNA, 22 nt, Human
uucuguggaaaguguaaagcau

SEQ ID NO: 2199784 - RNA, 23 nt, Human
uucuguggaaaguguaaagcauu

SEQ ID NO: 2199785 - RNA, 21 nt, Human
uucuguccgagcuuugaaaau

SEQ ID NO: 2199786 - RNA, 17 nt, Human
uucuguccgagcuuuga

SEQ ID NO: 2199787 - RNA, 23 nt, Human
uucugagcuauuucaucuauuuu

SEQ ID NO: 2199788 - RNA, 16 nt, Human
uucugagcuauuucau

SEQ ID NO: 2199789 - RNA, 21 nt, Human
uucugagcccgggcugccugg

SEQ ID NO: 2199790 - RNA, 19 nt, Human
uucugagcccgggcugccu

SEQ ID NO: 2199791 - RNA, 20 nt, Human
uucugagcccgggcugccug

SEQ ID NO: 2199792 - RNA, 22 nt, Human
uucugacuucauagauuuccuu

SEQ ID NO: 2199793 - RNA, 12 nt, Human
uucugacuugac

SEQ ID NO: 2199794 - RNA, 13 nt, Human
uucugacugcuga

SEQ ID NO: 2199795 - RNA, 15 nt, Human
uucugacuccagugg

SEQ ID NO: 2199796 - RNA, 15 nt, Human
uucugagaaagacua

SEQ ID NO: 2199797 - RNA, 14 nt, Human
uucugagcauuuaa

SEQ ID NO: 2199798 - RNA, 23 nt, Human
uugaaucugauuggacauuuucu

SEQ ID NO: 2199799 - RNA, 14 nt, Human
uugaaucuugucuc

SEQ ID NO: 2199800 - RNA, 20 nt, Human
uugaaucuauuuaaguaaaa

SEQ ID NO: 2199801 - RNA, 15 nt, Human
uugaaucuuuccaau

SEQ ID NO: 2199802 - RNA, 24 nt, Human
uugaaucugauuggacauuuucuu

SEQ ID NO: 2199803 - RNA, 22 nt, Human
uugaaucuugucucaaugcuca

SEQ ID NO: 2199804 - RNA, 23 nt, Human
uugaaucuugucucaaugcucau

SEQ ID NO: 2199805 - RNA, 15 nt, Human
uugaaucuugucuca

SEQ ID NO: 2199806 - RNA, 16 nt, Human
uugaaucuugucucaa

SEQ ID NO: 2199807 - RNA, 17 nt, Human
uugaaucuugucucaau

SEQ ID NO: 2199808 - RNA, 20 nt, Human
uugaaucuugucucaaugcu

SEQ ID NO: 2199809 - RNA, 22 nt, Human
uugaagacacugaaauauacac

SEQ ID NO: 2199810 - RNA, 19 nt, Human
uugaagacuuuucuuucag

SEQ ID NO: 2199811 - RNA, 15 nt, Human
uugaagacacugaaa

SEQ ID NO: 2199812 - RNA, 13 nt, Human
uugaagacacuga

SEQ ID NO: 2199813 - RNA, 17 nt, Human
uugaagacagagcuaca

SEQ ID NO: 2199814 - RNA, 19 nt, Human
uugaacucuucaaucucuu

SEQ ID NO: 2199815 - RNA, 17 nt, Human
uugaaagaaaggacucu

SEQ ID NO: 2199816 - RNA, 16 nt, Human
uugaacugauaaagau

SEQ ID NO: 2199817 - RNA, 16 nt, Human
uugaacugagcuugga

SEQ ID NO: 2199818 - RNA, 15 nt, Human
uugaacugagcuugg

SEQ ID NO: 2199819 - RNA, 15 nt, Human
uugaacugauaguua

SEQ ID NO: 2199820 - RNA, 22 nt, Human
uugaacuuugaccucugcagca

SEQ ID NO: 2199821 - RNA, 15 nt, Human
uugaagaaugaacaa

SEQ ID NO: 2199822 - RNA, 16 nt, Human
uugaagaaugaacaaa

SEQ ID NO: 2199823 - RNA, 19 nt, Human
uugaagaacugcaggcccu

SEQ ID NO: 2199824 - RNA, 16 nt, Human
uugaacuuuuuuccac

SEQ ID NO: 2199825 - RNA, 13 nt, Human
uugaagaaugaac

SEQ ID NO: 2199826 - RNA, 16 nt, Human
uugaagaacugcaggc

SEQ ID NO: 2199827 - RNA, 22 nt, Human
uugaacuuuuuuccacugaagu

SEQ ID NO: 2199828 - RNA, 20 nt, Human
uugaagaacugcaggcccug

SEQ ID NO: 2199829 - RNA, 15 nt, Human
uugaaagaaaauaug

SEQ ID NO: 2199830 - RNA, 23 nt, Human
uugaaacugagaugugaacacau

SEQ ID NO: 2199831 - RNA, 22 nt, Human
uugaaaacacuguucucugccc

SEQ ID NO: 2199832 - RNA, 23 nt, Human
uugaaaaauuccuauugugauuu

SEQ ID NO: 2199833 - RNA, 23 nt, Human
uugaaaagacuccaaagaaaugu

SEQ ID NO: 2199834 - RNA, 22 nt, Human
uugaaaagacuccaaagaaaug

SEQ ID NO: 2199835 - RNA, 18 nt, Human
uugaaaagacuccaaaga

SEQ ID NO: 2199836 - RNA, 16 nt, Human
uugaaaagacuccaaa

SEQ ID NO: 2199837 - RNA, 18 nt, Human
uucuuuauaauucuacuu

SEQ ID NO: 2199838 - RNA, 16 nt, Human
uucuuuauacaacagu

SEQ ID NO: 2199839 - RNA, 18 nt, Human
uucuuuauacaacagugc

SEQ ID NO: 2199840 - RNA, 19 nt, Human
uucuuuauacaacagugcu

SEQ ID NO: 2199841 - RNA, 22 nt, Human
uucuuuauacaacagugcuaaa

SEQ ID NO: 2199842 - RNA, 16 nt, Human
uucuuuauacuguaau

SEQ ID NO: 2199843 - RNA, 14 nt, Human
uucuuuauaaacuu

SEQ ID NO: 2199844 - RNA, 13 nt, Human
uucuuuauaaacu

SEQ ID NO: 2199845 - RNA, 22 nt, Human
uucuuuaggagauuuuaggugu

SEQ ID NO: 2199846 - RNA, 18 nt, Human
uucuuuagagcauugcca

SEQ ID NO: 2199847 - RNA, 14 nt, Human
uucuuuaggagauu

SEQ ID NO: 2199848 - RNA, 15 nt, Human
uucuuuaggagauuu

SEQ ID NO: 2199849 - RNA, 13 nt, Human
uucuuguauuaag

SEQ ID NO: 2199850 - RNA, 12 nt, Human
uucuuguauuaa

SEQ ID NO: 2199851 - RNA, 23 nt, Human
uucuuguaauuuaaacaggccca

SEQ ID NO: 2199852 - RNA, 13 nt, Human
uucuuguaguagu

SEQ ID NO: 2199853 - RNA, 22 nt, Human
uucuuucaagugaaucuaaaag

SEQ ID NO: 2199854 - RNA, 20 nt, Human
uucuuucaagugaaucuaaa

SEQ ID NO: 2199855 - RNA, 21 nt, Human
uugaaaaaugugcaaaacagc

SEQ ID NO: 2199856 - RNA, 13 nt, Human
uugaaaaauuccu

SEQ ID NO: 2199857 - RNA, 15 nt, Human
uugaaaaauuccuau

SEQ ID NO: 2199858 - RNA, 16 nt, Human
uugaaaaauuccuauu

SEQ ID NO: 2199859 - RNA, 20 nt, Human
uugaaaaauuccuauuguga

SEQ ID NO: 2199860 - RNA, 10 nt, Human
uucuuucaag

SEQ ID NO: 2199861 - RNA, 15 nt, Human
uucuuuauacuguaa

SEQ ID NO: 2199862 - RNA, 15 nt, Human
uugaaaaaugcaugu

SEQ ID NO: 2199863 - RNA, 19 nt, Human
uugaaaacacuguucucug

SEQ ID NO: 2199864 - RNA, 21 nt, Human
uugaaaacacuguucucugcc

SEQ ID NO: 2199865 - RNA, 20 nt, Human
uugauuuuugccucuuccag

SEQ ID NO: 2199866 - RNA, 14 nt, Human
uugauuuucuguug

SEQ ID NO: 2199867 - RNA, 16 nt, Human
uugauuuucuguugua

SEQ ID NO: 2199868 - RNA, 18 nt, Human
uugauuuuuaccguuucu

SEQ ID NO: 2199869 - RNA, 17 nt, Human
uugcaaaagacuaauuu

SEQ ID NO: 2199870 - RNA, 17 nt, Human
uugauuucuuuccagag

SEQ ID NO: 2199871 - RNA, 18 nt, Human
uugauuuccguuaaaaua

SEQ ID NO: 2199872 - RNA, 14 nt, Human
uugcaacaggcugg

SEQ ID NO: 2199873 - RNA, 17 nt, Human
uugcaacaggcugggcu

SEQ ID NO: 2199874 - RNA, 11 nt, Human
uugcaaaauuu

SEQ ID NO: 2199875 - RNA, 15 nt, Human
uugcaaaauuuccag

SEQ ID NO: 2199876 - RNA, 19 nt, Human
uugcaaaauagcauuuguu

SEQ ID NO: 2199877 - RNA, 23 nt, Human
uugcaaaauuuccaguaccuuug

SEQ ID NO: 2199878 - RNA, 22 nt, Human
uugcaaaauuuccaguaccuuu

SEQ ID NO: 2199879 - RNA, 21 nt, Human
uugcaaaauuuccaguaccuu

SEQ ID NO: 2199880 - RNA, 16 nt, Human
uugcaaaauuuccagu

SEQ ID NO: 2199881 - RNA, 12 nt, Human
uugcaaacuuua

SEQ ID NO: 2199882 - RNA, 18 nt, Human
uugaggguaauaaacuua

SEQ ID NO: 2199883 - RNA, 19 nt, Human
uugaucuggaacccagacu

SEQ ID NO: 2199884 - RNA, 17 nt, Human
uugaucuggaacccaga

SEQ ID NO: 2199885 - RNA, 16 nt, Human
uugaucuggaacccag

SEQ ID NO: 2199886 - RNA, 15 nt, Human
uugaucuggaaccca

SEQ ID NO: 2199887 - RNA, 21 nt, Human
uugauagcacagacccugccc

SEQ ID NO: 2199888 - RNA, 14 nt, Human
uugaucuggaaccc

SEQ ID NO: 2199889 - RNA, 13 nt, Human
uugaggguaggag

SEQ ID NO: 2199890 - RNA, 15 nt, Human
uugauugucagcuac

SEQ ID NO: 2199891 - RNA, 21 nt, Human
uugauugucagcuacuaauga

SEQ ID NO: 2199892 - RNA, 17 nt, Human
uugauugucagcuacua

SEQ ID NO: 2199893 - RNA, 20 nt, Human
uugauuguucgggugugcaa

SEQ ID NO: 2199894 - RNA, 12 nt, Human
uugauuuaugca

SEQ ID NO: 2199895 - RNA, 19 nt, Human
uugauuuaugcauggaaac

SEQ ID NO: 2199896 - RNA, 12 nt, Human
uugaugaagaag

SEQ ID NO: 2199897 - RNA, 22 nt, Human
uugcagaaacauuuugugguca

SEQ ID NO: 2199898 - RNA, 19 nt, Human
uugcagaacuaaacucauu

SEQ ID NO: 2199899 - RNA, 14 nt, Human
uugcaaccucgcug

SEQ ID NO: 2199900 - RNA, 12 nt, Human
uugcaacuucau

SEQ ID NO: 2199901 - RNA, 21 nt, Human
uugcagaacuaaacucauuua

SEQ ID NO: 2199902 - RNA, 15 nt, Human
uugcaacacacagac

SEQ ID NO: 2199903 - RNA, 12 nt, Human
uugcaaccacug

SEQ ID NO: 2199904 - RNA, 13 nt, Human
uugcaacacacag

SEQ ID NO: 2199905 - RNA, 14 nt, Human
uugcaaccgucugu

SEQ ID NO: 2199906 - RNA, 16 nt, Human
uugcagacaggcaagc

SEQ ID NO: 2199907 - RNA, 20 nt, Human
uugcaguagagucaucucca

SEQ ID NO: 2199908 - RNA, 17 nt, Human
uugcaguagauuuucuu

SEQ ID NO: 2199909 - RNA, 15 nt, Human
uugcagguugcuuug

SEQ ID NO: 2199910 - RNA, 22 nt, Human
uugcaguaaacuuuuaauuaaa

SEQ ID NO: 2199911 - RNA, 18 nt, Human
uugcagguggaacucagu

SEQ ID NO: 2199912 - RNA, 18 nt, Human
uugcagggagcauggcug

SEQ ID NO: 2199913 - RNA, 19 nt, Human
uugcagguggaacucaguc

SEQ ID NO: 2199914 - RNA, 20 nt, Human
uugcagguggaacucaguca

SEQ ID NO: 2199915 - RNA, 22 nt, Human
uugcagacaggcaagcaccucc

SEQ ID NO: 2199916 - RNA, 23 nt, Human
uugcaggagcaguaucaugaagc

SEQ ID NO: 2199917 - RNA, 21 nt, Human
uugcaggcaugcaugugcuug

SEQ ID NO: 2199918 - RNA, 13 nt, Human
uugcagugagcca

SEQ ID NO: 2199919 - RNA, 21 nt, Human
uugcauaauaagcuaaagagg

SEQ ID NO: 2199920 - RNA, 14 nt, Human
uugcauagaauaaa

SEQ ID NO: 2199921 - RNA, 16 nt, Human
uugccacccucaugcu

SEQ ID NO: 2199922 - RNA, 23 nt, Human
uugccaccccacccucccuggag

SEQ ID NO: 2199923 - RNA, 14 nt, Human
uugccacugccucu

SEQ ID NO: 2199924 - RNA, 15 nt, Human
uugccacugccucuu

SEQ ID NO: 2199925 - RNA, 22 nt, Human
uugcauaguaccaaucauuuua

SEQ ID NO: 2199926 - RNA, 13 nt, Human
uugccacccucau

SEQ ID NO: 2199927 - RNA, 21 nt, Human
uugccaccccacccucccugg

SEQ ID NO: 2199928 - RNA, 22 nt, Human
uugccaccccacccucccugga

SEQ ID NO: 2199929 - RNA, 18 nt, Human
uugcauagauucccugag

SEQ ID NO: 2199930 - RNA, 15 nt, Human
uugaggggauuaaua

SEQ ID NO: 2199931 - RNA, 21 nt, Human
uugagggcccagagcaggaag

SEQ ID NO: 2199932 - RNA, 23 nt, Human
uugagggcccagagcaggaagca

SEQ ID NO: 2199933 - RNA, 15 nt, Human
uugaggggcuccugg

SEQ ID NO: 2199934 - RNA, 20 nt, Human
uugaggggauuaauaugaaa

SEQ ID NO: 2199935 - RNA, 16 nt, Human
uugaggggauuaauau

SEQ ID NO: 2199936 - RNA, 16 nt, Human
uugaggggcuccugga

SEQ ID NO: 2199937 - RNA, 22 nt, Human
uugaggggauuaauaugaaaac

SEQ ID NO: 2199938 - RNA, 22 nt, Human
uugaggggcuggccuuccugcc

SEQ ID NO: 2199939 - RNA, 19 nt, Human
uugauagcacagacccugc

SEQ ID NO: 2199940 - RNA, 20 nt, Human
uugauagcacagacccugcc

SEQ ID NO: 2199941 - RNA, 14 nt, Human
uugagggcccagag

SEQ ID NO: 2199942 - RNA, 15 nt, Human
uugagggcccagagc

SEQ ID NO: 2199943 - RNA, 16 nt, Human
uugagggcccagagca

SEQ ID NO: 2199944 - RNA, 19 nt, Human
uugagggcccagagcagga

SEQ ID NO: 2199945 - RNA, 15 nt, Human
uugaggacacugaua

SEQ ID NO: 2199946 - RNA, 14 nt, Human
uugaggacacugau

SEQ ID NO: 2199947 - RNA, 18 nt, Human
uugaggaaacaacagcuu

SEQ ID NO: 2199948 - RNA, 23 nt, Human
uugaggaaaacaagcauucacaa

SEQ ID NO: 2199949 - RNA, 13 nt, Human
uugaggaaaacaa

SEQ ID NO: 2199950 - RNA, 18 nt, Human
uugagcuuagugaaauua

SEQ ID NO: 2199951 - RNA, 14 nt, Human
uugagcuuuccaug

SEQ ID NO: 2199952 - RNA, 21 nt, Human
uugagcuuuccauguugcugc

SEQ ID NO: 2199953 - RNA, 18 nt, Human
uugagcuguuuucccuga

SEQ ID NO: 2199954 - RNA, 21 nt, Human
uugagcuguugccucaguccc

SEQ ID NO: 2199955 - RNA, 12 nt, Human
uugagcuguuuu

SEQ ID NO: 2199956 - RNA, 23 nt, Human
uugacgagugugaagcuuccuug

SEQ ID NO: 2199957 - RNA, 23 nt, Human
uugacgaagucucuuuucuuuag

SEQ ID NO: 2199958 - RNA, 15 nt, Human
uugacggaugauugg

SEQ ID NO: 2199959 - RNA, 20 nt, Human
uugacgccaucccagcccca

SEQ ID NO: 2199960 - RNA, 23 nt, Human
uugacuagaugauggaugccaau

SEQ ID NO: 2199961 - RNA, 20 nt, Human
uugacggaugauuggauuau

SEQ ID NO: 2199962 - RNA, 17 nt, Human
uugacuaucaaacugaa

SEQ ID NO: 2199963 - RNA, 21 nt, Human
uugacuagggauucaggcugc

SEQ ID NO: 2199964 - RNA, 19 nt, Human
uugacuagggauucaggcu

SEQ ID NO: 2199965 - RNA, 12 nt, Human
uugagcugccuu

SEQ ID NO: 2199966 - RNA, 13 nt, Human
uugagcugccuuc

SEQ ID NO: 2199967 - RNA, 14 nt, Human
uugagcugccuucc

SEQ ID NO: 2199968 - RNA, 15 nt, Human
uugagcugccuuccc

SEQ ID NO: 2199969 - RNA, 16 nt, Human
uugagcugccuucccu

SEQ ID NO: 2199970 - RNA, 19 nt, Human
uugagcugccuucccuagc

SEQ ID NO: 2199971 - RNA, 16 nt, Human
uugaaugcuuccugac

SEQ ID NO: 2199972 - RNA, 16 nt, Human
uugaaugcauuuuguu

SEQ ID NO: 2199973 - RNA, 23 nt, Human
uugaaugcauuuuguuugguauu

SEQ ID NO: 2199974 - RNA, 15 nt, Human
uugaaugaaaaauuu

SEQ ID NO: 2199975 - RNA, 12 nt, Human
uugaaugaaaaa

SEQ ID NO: 2199976 - RNA, 18 nt, Human
uugaaugaaaaauuuaag

SEQ ID NO: 2199977 - RNA, 12 nt, Human
uugaaugcauuu

SEQ ID NO: 2199978 - RNA, 13 nt, Human
uugaaugcauuuu

SEQ ID NO: 2199979 - RNA, 15 nt, Human
uugaauggguccauu

SEQ ID NO: 2199980 - RNA, 23 nt, Human
uugaauggucagcguugcauguc

SEQ ID NO: 2199981 - RNA, 16 nt, Human
uugaaugguguuguau

SEQ ID NO: 2199982 - RNA, 18 nt, Human
uugaauguaugcuucaua

SEQ ID NO: 2199983 - RNA, 18 nt, Human
uugaauggccugccuuga

SEQ ID NO: 2199984 - RNA, 15 nt, Human
uugaaugcuuuuuga

SEQ ID NO: 2199985 - RNA, 17 nt, Human
uugaaugcuuuuugaau

SEQ ID NO: 2199986 - RNA, 20 nt, Human
uugaaugcuuuuugaauguu

SEQ ID NO: 2199987 - RNA, 23 nt, Human
uugaaugcuuuuugaauguuauu

SEQ ID NO: 2199988 - RNA, 15 nt, Human
uugaccucaggugau

SEQ ID NO: 2199989 - RNA, 20 nt, Human
uugaaugguguuguaugccu

SEQ ID NO: 2199990 - RNA, 12 nt, Human
uugaaugucuuu

SEQ ID NO: 2199991 - RNA, 16 nt, Human
uugaaugucuuuugaa

SEQ ID NO: 2199992 - RNA, 17 nt, Human
uugaaugucuuuugaau

SEQ ID NO: 2199993 - RNA, 20 nt, Human
uugaccgugaggccagagac

SEQ ID NO: 2199994 - RNA, 21 nt, Human
uugaccgugaggccagagaca

SEQ ID NO: 2199995 - RNA, 13 nt, Human
uugaccugaggcu

SEQ ID NO: 2199996 - RNA, 21 nt, Human
uugaccugccucccuucaugc

SEQ ID NO: 2199997 - RNA, 19 nt, Human
uugaccugaggcugugguc

SEQ ID NO: 2199998 - RNA, 22 nt, Human
uugaccugaggcccuucucucc

SEQ ID NO: 2199999 - RNA, 12 nt, Human
uugaccugaggc

SEQ ID NO: 2200000 - RNA, 19 nt, Human
uugaccugaggcccuucuc

SEQ ID NO: 2200001 - RNA, 15 nt, Human
uugacgccaucccag

SEQ ID NO: 2200002 - RNA, 21 nt, Human
uugaccuuuuauguaguaauu

SEQ ID NO: 2200003 - RNA, 16 nt, Human
uugacgaagucucuuu

SEQ ID NO: 2200004 - RNA, 22 nt, Human
uugacgccaucccagccccaau

SEQ ID NO: 2200005 - RNA, 14 nt, Human
uugacgccauccca

SEQ ID NO: 2200006 - RNA, 22 nt, Human
uugaccugccucccuucaugca

SEQ ID NO: 2200007 - RNA, 23 nt, Human
uugaccugccucccuucaugcau

SEQ ID NO: 2200008 - RNA, 12 nt, Human
uugccugcaggc

SEQ ID NO: 2200009 - RNA, 13 nt, Human
uugccugcagaga

SEQ ID NO: 2200010 - RNA, 15 nt, Human
uugccugcagagaga

SEQ ID NO: 2200011 - RNA, 19 nt, Human
uugccugcagagagaagcc

SEQ ID NO: 2200012 - RNA, 20 nt, Human
uugccugcagagagaagccu

SEQ ID NO: 2200013 - RNA, 22 nt, Human
uugccugcguuuuggaagcucu

SEQ ID NO: 2200014 - RNA, 20 nt, Human
uugccugaaguuggagugag

SEQ ID NO: 2200015 - RNA, 23 nt, Human
uugccugaacauccuuccuuccc

SEQ ID NO: 2200016 - RNA, 16 nt, Human
uugccugauauaaaug

SEQ ID NO: 2200017 - RNA, 19 nt, Human
uugccugaacauccuuccu

SEQ ID NO: 2200018 - RNA, 22 nt, Human
uugccugaacauccuuccuucc

SEQ ID NO: 2200019 - RNA, 19 nt, Human
uugccucuuccagucuucc

SEQ ID NO: 2200020 - RNA, 17 nt, Human
uugccucuuccagucuu

SEQ ID NO: 2200021 - RNA, 14 nt, Human
uugccucugugcug

SEQ ID NO: 2200022 - RNA, 19 nt, Human
uugccucugugcugugugu

SEQ ID NO: 2200023 - RNA, 21 nt, Human
uugcguggaauugugcugagu

SEQ ID NO: 2200024 - RNA, 20 nt, Human
uugcguaugucuguuaccau

SEQ ID NO: 2200025 - RNA, 15 nt, Human
uugcguggacucugc

SEQ ID NO: 2200026 - RNA, 18 nt, Human
uugcguggacucugcaca

SEQ ID NO: 2200027 - RNA, 22 nt, Human
uugcguuccaugaugcugggau

SEQ ID NO: 2200028 - RNA, 15 nt, Human
uugcuaaauguaaca

SEQ ID NO: 2200029 - RNA, 17 nt, Human
uugcguaacuggcugug

SEQ ID NO: 2200030 - RNA, 14 nt, Human
uugcggggggaggg

SEQ ID NO: 2200031 - RNA, 15 nt, Human
uugcggggggaggga

SEQ ID NO: 2200032 - RNA, 18 nt, Human
uugcguaacuggcugugu

SEQ ID NO: 2200033 - RNA, 14 nt, Human
uugcguaugucugu

SEQ ID NO: 2200034 - RNA, 16 nt, Human
uugcguaugucuguua

SEQ ID NO: 2200035 - RNA, 18 nt, Human
uugcguaugucuguuacc

SEQ ID NO: 2200036 - RNA, 15 nt, Human
uugcugauucuugag

SEQ ID NO: 2200037 - RNA, 19 nt, Human
uugcguuagaaugaggagg

SEQ ID NO: 2200038 - RNA, 22 nt, Human
uugcugauggugcaaugaccuu

SEQ ID NO: 2200039 - RNA, 12 nt, Human
uugcuaaaugua

SEQ ID NO: 2200040 - RNA, 20 nt, Human
uugcugauggugcaaugacc

SEQ ID NO: 2200041 - RNA, 15 nt, Human
uugcugcaaaccuga

SEQ ID NO: 2200042 - RNA, 13 nt, Human
uugcugcaaaccu

SEQ ID NO: 2200043 - RNA, 18 nt, Human
uugcugcaguaugaaaau

SEQ ID NO: 2200044 - RNA, 18 nt, Human
uugcugccaaccauaccu

SEQ ID NO: 2200045 - RNA, 21 nt, Human
uugcugccaaccauaccuucc

SEQ ID NO: 2200046 - RNA, 15 nt, Human
uugcugccucaugcu

SEQ ID NO: 2200047 - RNA, 12 nt, Human
uugcugccucau

SEQ ID NO: 2200048 - RNA, 11 nt, Human
uugcugccuca

SEQ ID NO: 2200049 - RNA, 20 nt, Human
uugcugccccaucagugcuc

SEQ ID NO: 2200050 - RNA, 19 nt, Human
uugcugccccaucagugcu

SEQ ID NO: 2200051 - RNA, 16 nt, Human
uugccucugccucuga

SEQ ID NO: 2200052 - RNA, 18 nt, Human
uugccucugccucugaca

SEQ ID NO: 2200053 - RNA, 17 nt, Human
uugccucuguccccuuc

SEQ ID NO: 2200054 - RNA, 18 nt, Human
uugccucuguccccuucu

SEQ ID NO: 2200055 - RNA, 15 nt, Human
uugccucucuguuug

SEQ ID NO: 2200056 - RNA, 22 nt, Human
uugccucggcuccugcugcacc

SEQ ID NO: 2200057 - RNA, 19 nt, Human
uugccucuguccccuucuc

SEQ ID NO: 2200058 - RNA, 20 nt, Human
uugccucuguccccuucucu

SEQ ID NO: 2200059 - RNA, 12 nt, Human
uugccucugugc

SEQ ID NO: 2200060 - RNA, 13 nt, Human
uugccucugugcu

SEQ ID NO: 2200061 - RNA, 11 nt, Human
uugccucugcc

SEQ ID NO: 2200062 - RNA, 14 nt, Human
uugccucugccucu

SEQ ID NO: 2200063 - RNA, 15 nt, Human
uugccuccuguguaa

SEQ ID NO: 2200064 - RNA, 22 nt, Human
uugccuccccauuucccaucug

SEQ ID NO: 2200065 - RNA, 14 nt, Human
uugccucggcuccu

SEQ ID NO: 2200066 - RNA, 15 nt, Human
uugccucggcuccug

SEQ ID NO: 2200067 - RNA, 16 nt, Human
uugccucggcuccugc

SEQ ID NO: 2200068 - RNA, 17 nt, Human
uugccucggcuccugcu

SEQ ID NO: 2200069 - RNA, 18 nt, Human
uugccucggcuccugcug

SEQ ID NO: 2200070 - RNA, 19 nt, Human
uugccucggcuccugcugc

SEQ ID NO: 2200071 - RNA, 20 nt, Human
uugccucggcuccugcugca

SEQ ID NO: 2200072 - RNA, 18 nt, Human
uugccacugccucuuccu

SEQ ID NO: 2200073 - RNA, 13 nt, Human
uugccagucaccc

SEQ ID NO: 2200074 - RNA, 18 nt, Human
uugccagucaccccggcc

SEQ ID NO: 2200075 - RNA, 18 nt, Human
uugccauacuuugucuga

SEQ ID NO: 2200076 - RNA, 22 nt, Human
uugccauacuuugucugaaaaa

SEQ ID NO: 2200077 - RNA, 13 nt, Human
uugccauauugca

SEQ ID NO: 2200078 - RNA, 15 nt, Human
uugccauauugcaca

SEQ ID NO: 2200079 - RNA, 17 nt, Human
uugccauauugcacaug

SEQ ID NO: 2200080 - RNA, 23 nt, Human
uugcccacgcuggagugcaguga

SEQ ID NO: 2200081 - RNA, 23 nt, Human
uugccauauugcacaugucuuaa

SEQ ID NO: 2200082 - RNA, 22 nt, Human
uugccauauugcacaugucuua

SEQ ID NO: 2200083 - RNA, 11 nt, Human
uugcccaggca

SEQ ID NO: 2200084 - RNA, 22 nt, Human
uugcccagagaugccuccaccg

SEQ ID NO: 2200085 - RNA, 22 nt, Human
uugcccagcauuuuacugauuc

SEQ ID NO: 2200086 - RNA, 19 nt, Human
uugcccagagaugccucca

SEQ ID NO: 2200087 - RNA, 18 nt, Human
uugcccagagaugccucc

SEQ ID NO: 2200088 - RNA, 17 nt, Human
uugcccagagaugccuc

SEQ ID NO: 2200089 - RNA, 16 nt, Human
uugcccagagaugccu

SEQ ID NO: 2200090 - RNA, 12 nt, Human
uugcccagagau

SEQ ID NO: 2200091 - RNA, 15 nt, Human
uuggaagaccccacc

SEQ ID NO: 2200092 - RNA, 19 nt, Human
uuggaaggaacguccccug

SEQ ID NO: 2200093 - RNA, 11 nt, Human
uuggaaggaac

SEQ ID NO: 2200094 - RNA, 16 nt, Human
uuggaacucugcuuga

SEQ ID NO: 2200095 - RNA, 16 nt, Human
uuggaaguuuucagga

SEQ ID NO: 2200096 - RNA, 13 nt, Human
uuggaaguuucau

SEQ ID NO: 2200097 - RNA, 16 nt, Human
uuggaaguugcauggc

SEQ ID NO: 2200098 - RNA, 18 nt, Human
uuggacauuuucuucaga

SEQ ID NO: 2200099 - RNA, 18 nt, Human
uuggauuuuugucuugug

SEQ ID NO: 2200100 - RNA, 18 nt, Human
uuggauuguauauugugu

SEQ ID NO: 2200101 - RNA, 14 nt, Human
uuggauuguauauu

SEQ ID NO: 2200102 - RNA, 14 nt, Human
uuggauuguccccg

SEQ ID NO: 2200103 - RNA, 17 nt, Human
uuggcaaaaaggcagga

SEQ ID NO: 2200104 - RNA, 20 nt, Human
uuggcaaacucuccaccaca

SEQ ID NO: 2200105 - RNA, 16 nt, Human
uuggcaaacucuccac

SEQ ID NO: 2200106 - RNA, 20 nt, Human
uuggauuauuuaauaacauu

SEQ ID NO: 2200107 - RNA, 14 nt, Human
uuggauuggggucc

SEQ ID NO: 2200108 - RNA, 15 nt, Human
uuggauucuuaugua

SEQ ID NO: 2200109 - RNA, 17 nt, Human
uuggauucugagagcug

SEQ ID NO: 2200110 - RNA, 15 nt, Human
uuggauucugagagc

SEQ ID NO: 2200111 - RNA, 18 nt, Human
uuggauuauuuaauaaca

SEQ ID NO: 2200112 - RNA, 15 nt, Human
uuggacccgcucugg

SEQ ID NO: 2200113 - RNA, 16 nt, Human
uuggacccgcucugga

SEQ ID NO: 2200114 - RNA, 17 nt, Human
uuggacccgcucuggac

SEQ ID NO: 2200115 - RNA, 19 nt, Human
uuggauuauuuaauaacau

SEQ ID NO: 2200116 - RNA, 21 nt, Human
uuggauuauuuaauaacauua

SEQ ID NO: 2200117 - RNA, 13 nt, Human
uuggaccccagcu

SEQ ID NO: 2200118 - RNA, 14 nt, Human
uuggaccccagcug

SEQ ID NO: 2200119 - RNA, 15 nt, Human
uuggaccccagcugg

SEQ ID NO: 2200120 - RNA, 16 nt, Human
uuggaccccagcuggg

SEQ ID NO: 2200121 - RNA, 17 nt, Human
uuggaccccagcuggga

SEQ ID NO: 2200122 - RNA, 19 nt, Human
uuggaccccagcugggagg

SEQ ID NO: 2200123 - RNA, 20 nt, Human
uuggaccccagcugggaggc

SEQ ID NO: 2200124 - RNA, 22 nt, Human
uuggaccccagcugggaggcaa

SEQ ID NO: 2200125 - RNA, 20 nt, Human
uugcuguagaagauggcacu

SEQ ID NO: 2200126 - RNA, 16 nt, Human
uugcugguugcugugu

SEQ ID NO: 2200127 - RNA, 21 nt, Human
uugcuguaccagcccagaugu

SEQ ID NO: 2200128 - RNA, 15 nt, Human
uugcuggucacugcc

SEQ ID NO: 2200129 - RNA, 14 nt, Human
uugcugguugcugu

SEQ ID NO: 2200130 - RNA, 15 nt, Human
uugcugguugcugug

SEQ ID NO: 2200131 - RNA, 22 nt, Human
uugcugguugcugugugguuug

SEQ ID NO: 2200132 - RNA, 21 nt, Human
uugcugccugaagaacaguaa

SEQ ID NO: 2200133 - RNA, 20 nt, Human
uugcugccacuuuuuaacua

SEQ ID NO: 2200134 - RNA, 20 nt, Human
uugcuggggccgaaagaaca

SEQ ID NO: 2200135 - RNA, 13 nt, Human
uugcuuacaauuu

SEQ ID NO: 2200136 - RNA, 14 nt, Human
uugcuuacaauuuu

SEQ ID NO: 2200137 - RNA, 15 nt, Human
uugcuuacaauuuuu

SEQ ID NO: 2200138 - RNA, 22 nt, Human
uugcuuacaauuuuuuuaauuu

SEQ ID NO: 2200139 - RNA, 23 nt, Human
uugcuuacaauuuuuuuaauuuu

SEQ ID NO: 2200140 - RNA, 13 nt, Human
uugcuuacauuuu

SEQ ID NO: 2200141 - RNA, 18 nt, Human
uugcuuacauuuuuacaa

SEQ ID NO: 2200142 - RNA, 21 nt, Human
uugcuguuuuguucugugguu

SEQ ID NO: 2200143 - RNA, 22 nt, Human
uugcuguuuuccucccuucugc

SEQ ID NO: 2200144 - RNA, 16 nt, Human
uugcuguuuuguucug

SEQ ID NO: 2200145 - RNA, 20 nt, Human
uugcuguuuuccucccuucu

SEQ ID NO: 2200146 - RNA, 19 nt, Human
uugcuguuuuccucccuuc

SEQ ID NO: 2200147 - RNA, 13 nt, Human
uugcuguuuugau

SEQ ID NO: 2200148 - RNA, 18 nt, Human
uugcuguuuuccucccuu

SEQ ID NO: 2200149 - RNA, 16 nt, Human
uugcuguuuuccuccc

SEQ ID NO: 2200150 - RNA, 14 nt, Human
uugcuguuuuccuc

SEQ ID NO: 2200151 - RNA, 11 nt, Human
uugcuguauau

SEQ ID NO: 2200152 - RNA, 23 nt, Human
uugcuguaccagcccagauguuu

SEQ ID NO: 2200153 - RNA, 14 nt, Human
uugcuguacuagag

SEQ ID NO: 2200154 - RNA, 22 nt, Human
uuggaaagcaucaccucaggcc

SEQ ID NO: 2200155 - RNA, 14 nt, Human
uuggaaaggaccag

SEQ ID NO: 2200156 - RNA, 24 nt, Human
uugcuuaggauguuuuucaugaaa

SEQ ID NO: 2200157 - RNA, 22 nt, Human
uuggaaauagaaauuuccagag

SEQ ID NO: 2200158 - RNA, 23 nt, Human
uuggaaauagaaauuuccagaga

SEQ ID NO: 2200159 - RNA, 20 nt, Human
uuggaaagcaucaccucagg

SEQ ID NO: 2200160 - RNA, 21 nt, Human
uuggaaagcagguggcaucuc

SEQ ID NO: 2200161 - RNA, 22 nt, Human
uuggaaagcuccuagcagagag

SEQ ID NO: 2200162 - RNA, 12 nt, Human
uugcuuacuaag

SEQ ID NO: 2200163 - RNA, 23 nt, Human
uugcuuacuuuggaauacauuuc

SEQ ID NO: 2200164 - RNA, 20 nt, Human
uugcuuaggaugugugcaug

SEQ ID NO: 2200165 - RNA, 23 nt, Human
uuggaaagaguaggaagacuuug

SEQ ID NO: 2200166 - RNA, 13 nt, Human
uuggaacagaaug

SEQ ID NO: 2200167 - RNA, 14 nt, Human
uuggaacagaaugu

SEQ ID NO: 2200168 - RNA, 13 nt, Human
uuggaaauauuca

SEQ ID NO: 2200169 - RNA, 12 nt, Human
uugguaaaccuu

SEQ ID NO: 2200170 - RNA, 17 nt, Human
uuggguucauuauugga

SEQ ID NO: 2200171 - RNA, 16 nt, Human
uugguaaauuucccca

SEQ ID NO: 2200172 - RNA, 21 nt, Human
uugguaaauuuccccaacagu

SEQ ID NO: 2200173 - RNA, 16 nt, Human
uugguaaagacuggcu

SEQ ID NO: 2200174 - RNA, 19 nt, Human
uugguaaagacuggcuuuu

SEQ ID NO: 2200175 - RNA, 14 nt, Human
uugguaaaccuuuu

SEQ ID NO: 2200176 - RNA, 20 nt, Human
uuggguguaacaggucuccu

SEQ ID NO: 2200177 - RNA, 19 nt, Human
uuggguguaacaggucucc

SEQ ID NO: 2200178 - RNA, 17 nt, Human
uugggugggcaggaaaa

SEQ ID NO: 2200179 - RNA, 22 nt, Human
uuggguggggggcuucauacac

SEQ ID NO: 2200180 - RNA, 21 nt, Human
uuggguggggggcuucauaca

SEQ ID NO: 2200181 - RNA, 20 nt, Human
uuggguggggggcuucauac

SEQ ID NO: 2200182 - RNA, 16 nt, Human
uuggguggaugccugg

SEQ ID NO: 2200183 - RNA, 19 nt, Human
uuggguggggggcuucaua

SEQ ID NO: 2200184 - RNA, 17 nt, Human
uuggguggggggcuuca

SEQ ID NO: 2200185 - RNA, 16 nt, Human
uugggaaacuuggcuc

SEQ ID NO: 2200186 - RNA, 17 nt, Human
uuggcuuacugcagccu

SEQ ID NO: 2200187 - RNA, 23 nt, Human
uuggcugugucuaaacugcauua

SEQ ID NO: 2200188 - RNA, 22 nt, Human
uuggcuuuggguugcaggaccu

SEQ ID NO: 2200189 - RNA, 17 nt, Human
uugggaggccccacugg

SEQ ID NO: 2200190 - RNA, 23 nt, Human
uugggaggaagcagaauaaagca

SEQ ID NO: 2200191 - RNA, 19 nt, Human
uugggaggaagcagaauaa

SEQ ID NO: 2200192 - RNA, 20 nt, Human
uugggaggaagcagaauaaa

SEQ ID NO: 2200193 - RNA, 21 nt, Human
uugggaggaagcagaauaaag

SEQ ID NO: 2200194 - RNA, 22 nt, Human
uugggaggaagcagaauaaagc

SEQ ID NO: 2200195 - RNA, 12 nt, Human
uugggaggcuga

SEQ ID NO: 2200196 - RNA, 16 nt, Human
uugggaggccauuugu

SEQ ID NO: 2200197 - RNA, 18 nt, Human
uugggaacugaacucacu

SEQ ID NO: 2200198 - RNA, 13 nt, Human
uugggaggaagca

SEQ ID NO: 2200199 - RNA, 14 nt, Human
uugggaggaagcag

SEQ ID NO: 2200200 - RNA, 15 nt, Human
uugggaggaagcaga

SEQ ID NO: 2200201 - RNA, 17 nt, Human
uugggaggaagcagaau

SEQ ID NO: 2200202 - RNA, 18 nt, Human
uugggaggaagcagaaua

SEQ ID NO: 2200203 - RNA, 15 nt, Human
uuggccaaaguguua

SEQ ID NO: 2200204 - RNA, 15 nt, Human
uuggccaagcaggga

SEQ ID NO: 2200205 - RNA, 16 nt, Human
uuggccaagcagggag

SEQ ID NO: 2200206 - RNA, 24 nt, Human
uuggccaaagccaaagcuaggccu

SEQ ID NO: 2200207 - RNA, 14 nt, Human
uuggccaggcuggu

SEQ ID NO: 2200208 - RNA, 14 nt, Human
uuggccacuccgag

SEQ ID NO: 2200209 - RNA, 21 nt, Human
uuggccacuccgagagguggg

SEQ ID NO: 2200210 - RNA, 22 nt, Human
uuggccacuccgagaggugggc

SEQ ID NO: 2200211 - RNA, 21 nt, Human
uuggcaucacagggcagagcc

SEQ ID NO: 2200212 - RNA, 15 nt, Human
uuggcaacagaagca

SEQ ID NO: 2200213 - RNA, 15 nt, Human
uuggcaucagcuggc

SEQ ID NO: 2200214 - RNA, 23 nt, Human
uuggcaaacucuccaccacacgu

SEQ ID NO: 2200215 - RNA, 16 nt, Human
uuggauuuuugacucu

SEQ ID NO: 2200216 - RNA, 16 nt, Human
uuggcaaauuccuagu

SEQ ID NO: 2200217 - RNA, 14 nt, Human
uuggcaacagaagc

SEQ ID NO: 2200218 - RNA, 13 nt, Human
uuggcauucccca

SEQ ID NO: 2200219 - RNA, 16 nt, Human
uuggcauguguauguu

SEQ ID NO: 2200220 - RNA, 13 nt, Human
uuggcugggccca

SEQ ID NO: 2200221 - RNA, 23 nt, Human
uuggcuggaugaaauuuucuaga

SEQ ID NO: 2200222 - RNA, 21 nt, Human
uuggcuggaugaaauuuucua

SEQ ID NO: 2200223 - RNA, 16 nt, Human
uuggcugcuuggccuu

SEQ ID NO: 2200224 - RNA, 20 nt, Human
uuggcuggaugaaauuuucu

SEQ ID NO: 2200225 - RNA, 18 nt, Human
uuggcugggggccucagu

SEQ ID NO: 2200226 - RNA, 15 nt, Human
uuggcugcuuggccu

SEQ ID NO: 2200227 - RNA, 16 nt, Human
uuggcugcugaaggcu

SEQ ID NO: 2200228 - RNA, 18 nt, Human
uuggcugggcccagaagg

SEQ ID NO: 2200229 - RNA, 17 nt, Human
uuggcugggcccagaag

SEQ ID NO: 2200230 - RNA, 16 nt, Human
uuggcugggcccagaa

SEQ ID NO: 2200231 - RNA, 21 nt, Human
uuggcuguagaaggagacaga

SEQ ID NO: 2200232 - RNA, 17 nt, Human
uuggcugugaggccccu

SEQ ID NO: 2200233 - RNA, 14 nt, Human
uuggcugugucuaa

SEQ ID NO: 2200234 - RNA, 15 nt, Human
uuggcugugucuaaa

SEQ ID NO: 2200235 - RNA, 17 nt, Human
uuggcugugucuaaacu

SEQ ID NO: 2200236 - RNA, 18 nt, Human
uuggcugugucuaaacug

SEQ ID NO: 2200237 - RNA, 20 nt, Human
uuggcugugucuaaacugca

SEQ ID NO: 2200238 - RNA, 21 nt, Human
uuggcugugucuaaacugcau

SEQ ID NO: 2200239 - RNA, 21 nt, Human
uuggcugggggccucagugcc

SEQ ID NO: 2200240 - RNA, 22 nt, Human
uuggcugggggccucagugcca

SEQ ID NO: 2200241 - RNA, 22 nt, Human
uuguaaaguguggucccaacag

SEQ ID NO: 2200242 - RNA, 23 nt, Human
uuguaaaguguggucccaacagg

SEQ ID NO: 2200243 - RNA, 18 nt, Human
uuguaaauaaaggaacca

SEQ ID NO: 2200244 - RNA, 13 nt, Human
uuggucccugggg

SEQ ID NO: 2200245 - RNA, 16 nt, Human
uuguaaaggaauuuaa

SEQ ID NO: 2200246 - RNA, 15 nt, Human
uugguccucuugccu

SEQ ID NO: 2200247 - RNA, 22 nt, Human
uugguaaauuuccccaacagug

SEQ ID NO: 2200248 - RNA, 23 nt, Human
uuggucccgugcagcuucugucc

SEQ ID NO: 2200249 - RNA, 13 nt, Human
uugguccugcugc

SEQ ID NO: 2200250 - RNA, 12 nt, Human
uugguccugcug

SEQ ID NO: 2200251 - RNA, 22 nt, Human
uuggucccccuuccauggacuu

SEQ ID NO: 2200252 - RNA, 16 nt, Human
uuggucccccuuccau

SEQ ID NO: 2200253 - RNA, 19 nt, Human
uuguacacaccuuauauuu

SEQ ID NO: 2200254 - RNA, 23 nt, Human
uuguacaauugaacuuaaauaaa

SEQ ID NO: 2200255 - RNA, 14 nt, Human
uuguacaaauaaag

SEQ ID NO: 2200256 - RNA, 19 nt, Human
uuguaaauauuuauguaaa

SEQ ID NO: 2200257 - RNA, 13 nt, Human
uuguacacuuuuu

SEQ ID NO: 2200258 - RNA, 15 nt, Human
uuguacacuuuuuug

SEQ ID NO: 2200259 - RNA, 11 nt, Human
uuguacacuuu

SEQ ID NO: 2200260 - RNA, 12 nt, Human
uuguacagacaa

SEQ ID NO: 2200261 - RNA, 13 nt, Human
uuguacagacaac

SEQ ID NO: 2200262 - RNA, 16 nt, Human
uuguaaauauuuaugu

SEQ ID NO: 2200263 - RNA, 13 nt, Human
uuguaaauauuua

SEQ ID NO: 2200264 - RNA, 12 nt, Human
uuguaaauauuu

SEQ ID NO: 2200265 - RNA, 11 nt, Human
uuguaaaugug

SEQ ID NO: 2200266 - RNA, 18 nt, Human
uuguaaaugugcuuuuaa

SEQ ID NO: 2200267 - RNA, 14 nt, Human
uuguaaaugugcuu

SEQ ID NO: 2200268 - RNA, 16 nt, Human
uuguacaguuuuuauu

SEQ ID NO: 2200269 - RNA, 19 nt, Human
uuguagaauguauuguacc

SEQ ID NO: 2200270 - RNA, 12 nt, Human
uuguacaguuuu

SEQ ID NO: 2200271 - RNA, 13 nt, Human
uuguacaguuuuu

SEQ ID NO: 2200272 - RNA, 19 nt, Human
uuguacagacguaugcuua

SEQ ID NO: 2200273 - RNA, 18 nt, Human
uuguacagacguaugcuu

SEQ ID NO: 2200274 - RNA, 21 nt, Human
uuguacagacguaugcuuauu

SEQ ID NO: 2200275 - RNA, 16 nt, Human
uuguacagcuguuuaa

SEQ ID NO: 2200276 - RNA, 11 nt, Human
uuguacaguuc

SEQ ID NO: 2200277 - RNA, 15 nt, Human
uuguacaguucaguu

SEQ ID NO: 2200278 - RNA, 16 nt, Human
uuguacaguucaguuc

SEQ ID NO: 2200279 - RNA, 11 nt, Human
uuguacaguuu

SEQ ID NO: 2200280 - RNA, 15 nt, Human
uuguacaguuugcug

SEQ ID NO: 2200281 - RNA, 16 nt, Human
uuguacaguuugcugu

SEQ ID NO: 2200282 - RNA, 17 nt, Human
uuguacaguuugcugua

SEQ ID NO: 2200283 - RNA, 20 nt, Human
uuguacaguuugcuguacua

SEQ ID NO: 2200284 - RNA, 18 nt, Human
uuguacaguuuguuuaca

SEQ ID NO: 2200285 - RNA, 20 nt, Human
uuguacaguuuguuuacaca

SEQ ID NO: 2200286 - RNA, 14 nt, Human
uuguagagccaggg

SEQ ID NO: 2200287 - RNA, 15 nt, Human
uuguagagccagggu

SEQ ID NO: 2200288 - RNA, 20 nt, Human
uuguagaauguauuguaccu

SEQ ID NO: 2200289 - RNA, 22 nt, Human
uuguagaauguauuguaccuuu

SEQ ID NO: 2200290 - RNA, 19 nt, Human
uuguaucacaaaucuuaac

SEQ ID NO: 2200291 - RNA, 14 nt, Human
uuguaucucuuuug

SEQ ID NO: 2200292 - RNA, 13 nt, Human
uuguaucucuuuu

SEQ ID NO: 2200293 - RNA, 20 nt, Human
uuguaucucugaagcauguu

SEQ ID NO: 2200294 - RNA, 21 nt, Human
uuguaucucugaagcauguuu

SEQ ID NO: 2200295 - RNA, 13 nt, Human
uuguauuagaugu

SEQ ID NO: 2200296 - RNA, 15 nt, Human
uuguauuagauguuc

SEQ ID NO: 2200297 - RNA, 16 nt, Human
uuguauuagauguucu

SEQ ID NO: 2200298 - RNA, 17 nt, Human
uuguauuagauguucuc

SEQ ID NO: 2200299 - RNA, 14 nt, Human
uuguauucagaguu

SEQ ID NO: 2200300 - RNA, 21 nt, Human
uuguauucucuccuguaccuc

SEQ ID NO: 2200301 - RNA, 21 nt, Human
uuguaucuagugcagcugauu

SEQ ID NO: 2200302 - RNA, 20 nt, Human
uuguaucuagugcagcugau

SEQ ID NO: 2200303 - RNA, 18 nt, Human
uuguaucuagugcagcug

SEQ ID NO: 2200304 - RNA, 17 nt, Human
uuguaucuagugcagcu

SEQ ID NO: 2200305 - RNA, 13 nt, Human
uuguaucuagugc

SEQ ID NO: 2200306 - RNA, 22 nt, Human
uuguaucguauagcuguauuga

SEQ ID NO: 2200307 - RNA, 18 nt, Human
uuguaucguauagcugua

SEQ ID NO: 2200308 - RNA, 20 nt, Human
uuguaucguauagcuguauu

SEQ ID NO: 2200309 - RNA, 14 nt, Human
uuguauuacaaauc

SEQ ID NO: 2200310 - RNA, 19 nt, Human
uuguaucauuugaacaacu

SEQ ID NO: 2200311 - RNA, 22 nt, Human
uuguaucagaggccuauaauga

SEQ ID NO: 2200312 - RNA, 18 nt, Human
uuguaucgauguuaugua

SEQ ID NO: 2200313 - RNA, 21 nt, Human
uuguaucgauguuauguaaaa

SEQ ID NO: 2200314 - RNA, 15 nt, Human
uuguaucguauagcu

SEQ ID NO: 2200315 - RNA, 17 nt, Human
uuguaucguauagcugu

SEQ ID NO: 2200316 - RNA, 15 nt, Human
uuguaucagaggccu

SEQ ID NO: 2200317 - RNA, 21 nt, Human
uuguagaugaaaaagcaugua

SEQ ID NO: 2200318 - RNA, 12 nt, Human
uuguagaugaaa

SEQ ID NO: 2200319 - RNA, 19 nt, Human
uuguagaugaaaaagcaug

SEQ ID NO: 2200320 - RNA, 20 nt, Human
uguggggaucucaggggcug

SEQ ID NO: 2200321 - RNA, 14 nt, Human
ugugggcugugagu

SEQ ID NO: 2200322 - RNA, 13 nt, Human
ugugggcugugag

SEQ ID NO: 2200323 - RNA, 22 nt, Human
ugugggcugcacucugugccca

SEQ ID NO: 2200324 - RNA, 20 nt, Human
ugugggcugcacucugugcc

SEQ ID NO: 2200325 - RNA, 21 nt, Human
ugugggcugcacucugugccc

SEQ ID NO: 2200326 - RNA, 13 nt, Human
ugugggcugcacu

SEQ ID NO: 2200327 - RNA, 14 nt, Human
ugugggcugcacuc

SEQ ID NO: 2200328 - RNA, 16 nt, Human
ugugggcugcacucug

SEQ ID NO: 2200329 - RNA, 19 nt, Human
ugugggaaugcggcaagaa

SEQ ID NO: 2200330 - RNA, 18 nt, Human
ugugggaaugcggcaaga

SEQ ID NO: 2200331 - RNA, 15 nt, Human
ugugggaagggagag

SEQ ID NO: 2200332 - RNA, 15 nt, Human
ugugggaaggccagc

SEQ ID NO: 2200333 - RNA, 12 nt, Human
ugugggaacaga

SEQ ID NO: 2200334 - RNA, 23 nt, Human
ugugggaacgagaggggaagagu

SEQ ID NO: 2200335 - RNA, 12 nt, Human
ugugggaagggg

SEQ ID NO: 2200336 - RNA, 18 nt, Human
uguggcugggggcaggag

SEQ ID NO: 2200337 - RNA, 15 nt, Human
uguggcugggggcag

SEQ ID NO: 2200338 - RNA, 14 nt, Human
uguggcugcuagca

SEQ ID NO: 2200339 - RNA, 22 nt, Human
uguggcugaggaggccuccauc

SEQ ID NO: 2200340 - RNA, 14 nt, Human
uguggcugcagcag

SEQ ID NO: 2200341 - RNA, 14 nt, Human
uguggcuccuuccc

SEQ ID NO: 2200342 - RNA, 15 nt, Human
uguggcuccuuccca

SEQ ID NO: 2200343 - RNA, 20 nt, Human
uguggcuccuaucuguguuu

SEQ ID NO: 2200344 - RNA, 13 nt, Human
uguggcugaggag

SEQ ID NO: 2200345 - RNA, 16 nt, Human
uguggcugaggaggcc

SEQ ID NO: 2200346 - RNA, 21 nt, Human
uguggcugaggaggccuccau

SEQ ID NO: 2200347 - RNA, 15 nt, Human
uguggcugucagcag

SEQ ID NO: 2200348 - RNA, 16 nt, Human
uguggcugcagcagcg

SEQ ID NO: 2200349 - RNA, 21 nt, Human
uguggcugggggcaggagggc

SEQ ID NO: 2200350 - RNA, 21 nt, Human
uguggcugucagcaggaagca

SEQ ID NO: 2200351 - RNA, 19 nt, Human
uguggcugucagcaggaag

SEQ ID NO: 2200352 - RNA, 22 nt, Human
uguggcuucuuaaucuuuucac

SEQ ID NO: 2200353 - RNA, 17 nt, Human
uguggcuuucuuucuuu

SEQ ID NO: 2200354 - RNA, 19 nt, Human
uguggcuuucagccucugg

SEQ ID NO: 2200355 - RNA, 17 nt, Human
uguggcuuucagccucu

SEQ ID NO: 2200356 - RNA, 15 nt, Human
ugugggucaaggaau

SEQ ID NO: 2200357 - RNA, 21 nt, Human
uguggguacagagaggucaag

SEQ ID NO: 2200358 - RNA, 21 nt, Human
ugugggguuuuuggagaaggu

SEQ ID NO: 2200359 - RNA, 22 nt, Human
uguggggugugcacaucucugc

SEQ ID NO: 2200360 - RNA, 15 nt, Human
uguggggugaaaagu

SEQ ID NO: 2200361 - RNA, 16 nt, Human
ugugggggucugugug

SEQ ID NO: 2200362 - RNA, 16 nt, Human
uguggggauuucuccc

SEQ ID NO: 2200363 - RNA, 15 nt, Human
uguggggccagguca

SEQ ID NO: 2200364 - RNA, 12 nt, Human
uguggggccuug

SEQ ID NO: 2200365 - RNA, 13 nt, Human
ugugggggcugca

SEQ ID NO: 2200366 - RNA, 20 nt, Human
uguggggcugguagcucagg

SEQ ID NO: 2200367 - RNA, 23 nt, Human
ugugggggaagagcacagcccuc

SEQ ID NO: 2200368 - RNA, 15 nt, Human
uguggguaccuguau

SEQ ID NO: 2200369 - RNA, 20 nt, Human
uguguacaucccauguaaca

SEQ ID NO: 2200370 - RNA, 23 nt, Human
uguguacaucccauguaacagaa

SEQ ID NO: 2200371 - RNA, 20 nt, Human
ugugggucugugugugugua

SEQ ID NO: 2200372 - RNA, 16 nt, Human
ugugggucugugugug

SEQ ID NO: 2200373 - RNA, 14 nt, Human
ugugggucugugug

SEQ ID NO: 2200374 - RNA, 16 nt, Human
uguguacguggagagg

SEQ ID NO: 2200375 - RNA, 15 nt, Human
uguguacguggagag

SEQ ID NO: 2200376 - RNA, 15 nt, Human
uguguacccaaacgu

SEQ ID NO: 2200377 - RNA, 24 nt, Human
uguguacaucccauguaacagaaa

SEQ ID NO: 2200378 - RNA, 19 nt, Human
uguguacauggcagaguuu

SEQ ID NO: 2200379 - RNA, 15 nt, Human
uguggaaaagaaaca

SEQ ID NO: 2200380 - RNA, 20 nt, Human
uguggaaaagaaacacgcac

SEQ ID NO: 2200381 - RNA, 19 nt, Human
uguggaaaagccaagaggc

SEQ ID NO: 2200382 - RNA, 16 nt, Human
uguggaaaaauauuua

SEQ ID NO: 2200383 - RNA, 14 nt, Human
uguggaaaaauauu

SEQ ID NO: 2200384 - RNA, 16 nt, Human
uguggaaaaaugagag

SEQ ID NO: 2200385 - RNA, 19 nt, Human
uguggaaaaaugagagaag

SEQ ID NO: 2200386 - RNA, 20 nt, Human
uguggaaaaaugagagaagg

SEQ ID NO: 2200387 - RNA, 13 nt, Human
uguggaaaacaga

SEQ ID NO: 2200388 - RNA, 12 nt, Human
uguggaaagccu

SEQ ID NO: 2200389 - RNA, 17 nt, Human
uguggaaaaugaaaauu

SEQ ID NO: 2200390 - RNA, 23 nt, Human
uguggaaaagccaagaggcugca

SEQ ID NO: 2200391 - RNA, 21 nt, Human
uguggaaaagccaagaggcug

SEQ ID NO: 2200392 - RNA, 23 nt, Human
uguggaaagugaauuugaaugaa

SEQ ID NO: 2200393 - RNA, 12 nt, Human
uguggaaagugu

SEQ ID NO: 2200394 - RNA, 22 nt, Human
uguggaaagugaauuugaauga

SEQ ID NO: 2200395 - RNA, 19 nt, Human
uguggaaagugaauuugaa

SEQ ID NO: 2200396 - RNA, 16 nt, Human
uguggaaagugaauuu

SEQ ID NO: 2200397 - RNA, 21 nt, Human
uguggaaagucacaggucaca

SEQ ID NO: 2200398 - RNA, 20 nt, Human
uguggaaagccucugcugcc

SEQ ID NO: 2200399 - RNA, 19 nt, Human
uguggaaagccucugcugc

SEQ ID NO: 2200400 - RNA, 17 nt, Human
uguggaaagccucugcu

SEQ ID NO: 2200401 - RNA, 15 nt, Human
uguggaaagccucug

SEQ ID NO: 2200402 - RNA, 14 nt, Human
uguggaaagccucu

SEQ ID NO: 2200403 - RNA, 14 nt, Human
uguggacacagcuc

SEQ ID NO: 2200404 - RNA, 13 nt, Human
uguggacacagcu

SEQ ID NO: 2200405 - RNA, 21 nt, Human
uguggagaagcggcuggcagc

SEQ ID NO: 2200406 - RNA, 12 nt, Human
uguggagaagcg

SEQ ID NO: 2200407 - RNA, 23 nt, Human
uguggagaaacuguagucucagg

SEQ ID NO: 2200408 - RNA, 16 nt, Human
uguggacuuuguucac

SEQ ID NO: 2200409 - RNA, 13 nt, Human
uguggagaaagga

SEQ ID NO: 2200410 - RNA, 23 nt, Human
uguggagaaauaaaaauaccucu

SEQ ID NO: 2200411 - RNA, 15 nt, Human
uguggcuccccucua

SEQ ID NO: 2200412 - RNA, 19 nt, Human
uguggagaagccacaggcc

SEQ ID NO: 2200413 - RNA, 23 nt, Human
uguggcuccccucuauuuagcau

SEQ ID NO: 2200414 - RNA, 17 nt, Human
uguggcuccuaucugug

SEQ ID NO: 2200415 - RNA, 18 nt, Human
uguggcuccuaucugugu

SEQ ID NO: 2200416 - RNA, 19 nt, Human
uguggcuccuaucuguguu

SEQ ID NO: 2200417 - RNA, 21 nt, Human
uguggcuccuggggguucuuu

SEQ ID NO: 2200418 - RNA, 15 nt, Human
uguggacacagcucu

SEQ ID NO: 2200419 - RNA, 16 nt, Human
uguggacacagcucuu

SEQ ID NO: 2200420 - RNA, 15 nt, Human
uguggacugugaugc

SEQ ID NO: 2200421 - RNA, 14 nt, Human
uguggacugugaug

SEQ ID NO: 2200422 - RNA, 21 nt, Human
uguggaaaguguaaagcauuc

SEQ ID NO: 2200423 - RNA, 21 nt, Human
uguggacuaaaagauauaagu

SEQ ID NO: 2200424 - RNA, 19 nt, Human
uguggaaaguguaaagcau

SEQ ID NO: 2200425 - RNA, 20 nt, Human
uguggaaaguguaaagcauu

SEQ ID NO: 2200426 - RNA, 14 nt, Human
uguggaaaguguaa

SEQ ID NO: 2200427 - RNA, 15 nt, Human
uguggaaaguguaaa

SEQ ID NO: 2200428 - RNA, 16 nt, Human
uguggaaaguguaaag

SEQ ID NO: 2200429 - RNA, 17 nt, Human
uguggaaaguguaaagc

SEQ ID NO: 2200430 - RNA, 19 nt, Human
ugugcauagagccacguau

SEQ ID NO: 2200431 - RNA, 22 nt, Human
ugugcaguucuaguuugcauuc

SEQ ID NO: 2200432 - RNA, 19 nt, Human
ugugcaguucuaguuugca

SEQ ID NO: 2200433 - RNA, 12 nt, Human
ugugcaguguug

SEQ ID NO: 2200434 - RNA, 14 nt, Human
ugugcaguguagcc

SEQ ID NO: 2200435 - RNA, 13 nt, Human
ugugcaguucuag

SEQ ID NO: 2200436 - RNA, 18 nt, Human
ugugcagucacuggaggu

SEQ ID NO: 2200437 - RNA, 17 nt, Human
ugugcaguccugggaug

SEQ ID NO: 2200438 - RNA, 20 nt, Human
ugugcaguccugggaugugg

SEQ ID NO: 2200439 - RNA, 20 nt, Human
ugugcagugaagguugcuga

SEQ ID NO: 2200440 - RNA, 13 nt, Human
ugugcauggguga

SEQ ID NO: 2200441 - RNA, 15 nt, Human
ugugcaugggagcaa

SEQ ID NO: 2200442 - RNA, 13 nt, Human
ugugcauauugua

SEQ ID NO: 2200443 - RNA, 15 nt, Human
ugugcauauuguaca

SEQ ID NO: 2200444 - RNA, 17 nt, Human
ugugcauauuguacacu

SEQ ID NO: 2200445 - RNA, 19 nt, Human
ugugcauauuguacacuuu

SEQ ID NO: 2200446 - RNA, 22 nt, Human
ugugcaugugugcgagugugug

SEQ ID NO: 2200447 - RNA, 23 nt, Human
ugugcauguaugucuuggacacu

SEQ ID NO: 2200448 - RNA, 19 nt, Human
ugugcaugggugaagggag

SEQ ID NO: 2200449 - RNA, 15 nt, Human
ugugcaugguggcac

SEQ ID NO: 2200450 - RNA, 20 nt, Human
ugugcauguaugucuuggac

SEQ ID NO: 2200451 - RNA, 16 nt, Human
ugugccucugggacug

SEQ ID NO: 2200452 - RNA, 15 nt, Human
ugugccucugggacu

SEQ ID NO: 2200453 - RNA, 13 nt, Human
ugugccucuggga

SEQ ID NO: 2200454 - RNA, 13 nt, Human
ugugccucugccu

SEQ ID NO: 2200455 - RNA, 22 nt, Human
ugugcauguguguaagugugug

SEQ ID NO: 2200456 - RNA, 14 nt, Human
ugugccucugccug

SEQ ID NO: 2200457 - RNA, 15 nt, Human
ugugcacaauucugu

SEQ ID NO: 2200458 - RNA, 18 nt, Human
ugugcacaugugugcgug

SEQ ID NO: 2200459 - RNA, 14 nt, Human
ugugcaccaggguu

SEQ ID NO: 2200460 - RNA, 13 nt, Human
ugugcaccagggu

SEQ ID NO: 2200461 - RNA, 14 nt, Human
ugugcacccauggg

SEQ ID NO: 2200462 - RNA, 18 nt, Human
ugugcacccucuauccca

SEQ ID NO: 2200463 - RNA, 16 nt, Human
ugugcacaugcacgug

SEQ ID NO: 2200464 - RNA, 22 nt, Human
ugugcacaugcacgugugugca

SEQ ID NO: 2200465 - RNA, 23 nt, Human
ugugcagacucaauaaaaucaug

SEQ ID NO: 2200466 - RNA, 21 nt, Human
ugugcaccuuaccaacuuucu

SEQ ID NO: 2200467 - RNA, 22 nt, Human
ugugcaccuuaccaacuuucug

SEQ ID NO: 2200468 - RNA, 22 nt, Human
ugugcagccccgccuccaggcc

SEQ ID NO: 2200469 - RNA, 19 nt, Human
ugugcagccgcugagcgag

SEQ ID NO: 2200470 - RNA, 23 nt, Human
ugugcagccccgccuccaggcca

SEQ ID NO: 2200471 - RNA, 17 nt, Human
ugugcagguuuguuaca

SEQ ID NO: 2200472 - RNA, 17 nt, Human
ugugcagucacuggagg

SEQ ID NO: 2200473 - RNA, 23 nt, Human
ugugcagguggggagacugggcu

SEQ ID NO: 2200474 - RNA, 16 nt, Human
ugugcagguggggaga

SEQ ID NO: 2200475 - RNA, 22 nt, Human
ugugcagccuguccugggcugg

SEQ ID NO: 2200476 - RNA, 23 nt, Human
ugugcuaaccacgucugucuuca

SEQ ID NO: 2200477 - RNA, 21 nt, Human
ugugcuaccuggguccuuuuc

SEQ ID NO: 2200478 - RNA, 14 nt, Human
ugugcuacuuugcc

SEQ ID NO: 2200479 - RNA, 17 nt, Human
ugugcuacugauuguuu

SEQ ID NO: 2200480 - RNA, 20 nt, Human
ugugcguguguccaugugug

SEQ ID NO: 2200481 - RNA, 21 nt, Human
ugugcguguguccaugugugu

SEQ ID NO: 2200482 - RNA, 15 nt, Human
ugugcgugcaugugc

SEQ ID NO: 2200483 - RNA, 22 nt, Human
ugugcgugaaacacaccaggcu

SEQ ID NO: 2200484 - RNA, 16 nt, Human
ugugcgugaaacacac

SEQ ID NO: 2200485 - RNA, 15 nt, Human
ugugcgugaaacaca

SEQ ID NO: 2200486 - RNA, 20 nt, Human
ugugcgugcuugaguguguu

SEQ ID NO: 2200487 - RNA, 13 nt, Human
ugugcuuauguuu

SEQ ID NO: 2200488 - RNA, 19 nt, Human
ugugcuucgggcccuuccc

SEQ ID NO: 2200489 - RNA, 22 nt, Human
ugugcuuauguaugagguacaa

SEQ ID NO: 2200490 - RNA, 16 nt, Human
ugugcuuuuaaaugca

SEQ ID NO: 2200491 - RNA, 16 nt, Human
ugugcuuuuccuauuu

SEQ ID NO: 2200492 - RNA, 14 nt, Human
ugugcuuuuccuau

SEQ ID NO: 2200493 - RNA, 15 nt, Human
ugugcuuuucuccaa

SEQ ID NO: 2200494 - RNA, 14 nt, Human
ugugcuucuuucuu

SEQ ID NO: 2200495 - RNA, 21 nt, Human
ugugcuucuuucuuugggaau

SEQ ID NO: 2200496 - RNA, 21 nt, Human
ugugcuucuaauauuuauugc

SEQ ID NO: 2200497 - RNA, 23 nt, Human
ugugcuucuaauauuuauugcuu

SEQ ID NO: 2200498 - RNA, 14 nt, Human
ugugcgugaaacac

SEQ ID NO: 2200499 - RNA, 13 nt, Human
ugugcgugaaaca

SEQ ID NO: 2200500 - RNA, 20 nt, Human
ugugcgugcauguguguuca

SEQ ID NO: 2200501 - RNA, 20 nt, Human
ugugccuggguggacauggc

SEQ ID NO: 2200502 - RNA, 17 nt, Human
ugugccucugggacugg

SEQ ID NO: 2200503 - RNA, 12 nt, Human
ugugccugcagc

SEQ ID NO: 2200504 - RNA, 15 nt, Human
ugugccucugccugu

SEQ ID NO: 2200505 - RNA, 13 nt, Human
ugugccugcagcc

SEQ ID NO: 2200506 - RNA, 15 nt, Human
ugugccugacccuac

SEQ ID NO: 2200507 - RNA, 13 nt, Human
ugugccuggcuca

SEQ ID NO: 2200508 - RNA, 15 nt, Human
ugugccuggcucaga

SEQ ID NO: 2200509 - RNA, 13 nt, Human
ugucugccagggc

SEQ ID NO: 2200510 - RNA, 19 nt, Human
ugucugccagccagcagcc

SEQ ID NO: 2200511 - RNA, 18 nt, Human
ugucugccagccagcagc

SEQ ID NO: 2200512 - RNA, 11 nt, Human
ugucugcccuu

SEQ ID NO: 2200513 - RNA, 16 nt, Human
ugucugcccuucaccc

SEQ ID NO: 2200514 - RNA, 14 nt, Human
ugucugccucuuag

SEQ ID NO: 2200515 - RNA, 15 nt, Human
ugucugccucuuaga

SEQ ID NO: 2200516 - RNA, 21 nt, Human
ugucugcgugguuccuuucuc

SEQ ID NO: 2200517 - RNA, 19 nt, Human
ugucuggcugaggauuuca

SEQ ID NO: 2200518 - RNA, 14 nt, Human
ugucuggcugcaga

SEQ ID NO: 2200519 - RNA, 17 nt, Human
ugucuggcugcagagca

SEQ ID NO: 2200520 - RNA, 16 nt, Human
ugucuggcugcagagc

SEQ ID NO: 2200521 - RNA, 14 nt, Human
ugucucacacuggc

SEQ ID NO: 2200522 - RNA, 17 nt, Human
ugucucaguccaccuga

SEQ ID NO: 2200523 - RNA, 18 nt, Human
ugucugcaggauugauua

SEQ ID NO: 2200524 - RNA, 21 nt, Human
ugucugcauuucgguggcuag

SEQ ID NO: 2200525 - RNA, 13 nt, Human
ugucugcauuucg

SEQ ID NO: 2200526 - RNA, 16 nt, Human
ugucugccagccagca

SEQ ID NO: 2200527 - RNA, 15 nt, Human
ugucugccagccagc

SEQ ID NO: 2200528 - RNA, 16 nt, Human
ugucugccaauuuuug

SEQ ID NO: 2200529 - RNA, 22 nt, Human
ugucucaguccaugaagaugua

SEQ ID NO: 2200530 - RNA, 21 nt, Human
ugucucaguccaugaagaugu

SEQ ID NO: 2200531 - RNA, 19 nt, Human
ugucucaagagggcacugg

SEQ ID NO: 2200532 - RNA, 15 nt, Human
uguccccacacuccu

SEQ ID NO: 2200533 - RNA, 16 nt, Human
uguccccacacuccua

SEQ ID NO: 2200534 - RNA, 18 nt, Human
uguccccaaaccugcaag

SEQ ID NO: 2200535 - RNA, 20 nt, Human
ugucccauuucuaaaggccu

SEQ ID NO: 2200536 - RNA, 19 nt, Human
uguccccaaauccgaaccu

SEQ ID NO: 2200537 - RNA, 14 nt, Human
uguccccaaauccg

SEQ ID NO: 2200538 - RNA, 22 nt, Human
uguccccaaauccgaaccuccu

SEQ ID NO: 2200539 - RNA, 21 nt, Human
uguccccaaauccgaaccucc

SEQ ID NO: 2200540 - RNA, 11 nt, Human
uguccccacac

SEQ ID NO: 2200541 - RNA, 12 nt, Human
uguccccacacu

SEQ ID NO: 2200542 - RNA, 14 nt, Human
uguccccacacucc

SEQ ID NO: 2200543 - RNA, 23 nt, Human
ugucucaagagggcacugguggc

SEQ ID NO: 2200544 - RNA, 14 nt, Human
ugucucaaugcuca

SEQ ID NO: 2200545 - RNA, 15 nt, Human
ugucucaaugcucau

SEQ ID NO: 2200546 - RNA, 20 nt, Human
ugucucaagagggcacuggu

SEQ ID NO: 2200547 - RNA, 21 nt, Human
ugucucaagagggcacuggug

SEQ ID NO: 2200548 - RNA, 16 nt, Human
ugucucaggucccugc

SEQ ID NO: 2200549 - RNA, 17 nt, Human
ugucucaggucccugca

SEQ ID NO: 2200550 - RNA, 16 nt, Human
ugucucaaugcucaua

SEQ ID NO: 2200551 - RNA, 17 nt, Human
ugucucaaugcucauaa

SEQ ID NO: 2200552 - RNA, 19 nt, Human
ugucucaaugcucauaacg

SEQ ID NO: 2200553 - RNA, 22 nt, Human
ugucucaaugcucauaacggau

SEQ ID NO: 2200554 - RNA, 23 nt, Human
ugucuggcugaggauuucaagcc

SEQ ID NO: 2200555 - RNA, 11 nt, Human
ugucugggcug

SEQ ID NO: 2200556 - RNA, 12 nt, Human
ugucugggcuga

SEQ ID NO: 2200557 - RNA, 13 nt, Human
ugucugguggccc

SEQ ID NO: 2200558 - RNA, 14 nt, Human
ugucugguggcccc

SEQ ID NO: 2200559 - RNA, 16 nt, Human
ugucugguggccccgu

SEQ ID NO: 2200560 - RNA, 17 nt, Human
ugucuuuggacccugag

SEQ ID NO: 2200561 - RNA, 18 nt, Human
ugucuuuggacccugagg

SEQ ID NO: 2200562 - RNA, 16 nt, Human
ugucuuuuuucacuac

SEQ ID NO: 2200563 - RNA, 14 nt, Human
ugucuuuuuucuaa

SEQ ID NO: 2200564 - RNA, 19 nt, Human
ugucuuuggacccugaggc

SEQ ID NO: 2200565 - RNA, 22 nt, Human
ugucuuuggacccugaggccca

SEQ ID NO: 2200566 - RNA, 20 nt, Human
ugugaaaaaaaaaaugcuga

SEQ ID NO: 2200567 - RNA, 17 nt, Human
ugugaaaaaaaaaaugc

SEQ ID NO: 2200568 - RNA, 18 nt, Human
ugucuuuuuuuuaaugug

SEQ ID NO: 2200569 - RNA, 21 nt, Human
ugucuuuuuuuuaaugugcug

SEQ ID NO: 2200570 - RNA, 21 nt, Human
ugucuggugguggcaccaucu

SEQ ID NO: 2200571 - RNA, 13 nt, Human
ugugaaacauguu

SEQ ID NO: 2200572 - RNA, 19 nt, Human
ugucaucagaagauaacuu

SEQ ID NO: 2200573 - RNA, 20 nt, Human
ugugaaaccuuuuuuaagau

SEQ ID NO: 2200574 - RNA, 22 nt, Human
ugugaaaccuuuuuuaagauuu

SEQ ID NO: 2200575 - RNA, 19 nt, Human
ugugaaacuggcacugaau

SEQ ID NO: 2200576 - RNA, 13 nt, Human
ugugaaaggaaag

SEQ ID NO: 2200577 - RNA, 14 nt, Human
ugugaaaggaaaga

SEQ ID NO: 2200578 - RNA, 20 nt, Human
ugugaaguuuacauuguaaa

SEQ ID NO: 2200579 - RNA, 14 nt, Human
ugugaaguuuacau

SEQ ID NO: 2200580 - RNA, 21 nt, Human
ugugcaagugugugcaugugu

SEQ ID NO: 2200581 - RNA, 12 nt, Human
ugugcaagugug

SEQ ID NO: 2200582 - RNA, 20 nt, Human
ugugcaagugucugugugca

SEQ ID NO: 2200583 - RNA, 19 nt, Human
ugugcaagugucugugugc

SEQ ID NO: 2200584 - RNA, 15 nt, Human
ugugcaagugucugu

SEQ ID NO: 2200585 - RNA, 16 nt, Human
ugugcaaguguaugca

SEQ ID NO: 2200586 - RNA, 18 nt, Human
ugugcaaguaugugagug

SEQ ID NO: 2200587 - RNA, 17 nt, Human
ugugcaaguaugugagu

SEQ ID NO: 2200588 - RNA, 13 nt, Human
ugugauauaagug

SEQ ID NO: 2200589 - RNA, 14 nt, Human
ugugcaagagaggg

SEQ ID NO: 2200590 - RNA, 18 nt, Human
ugugauaaggaucagaac

SEQ ID NO: 2200591 - RNA, 22 nt, Human
ugugauacccauagcuuccaug

SEQ ID NO: 2200592 - RNA, 14 nt, Human
ugugauagcacuuu

SEQ ID NO: 2200593 - RNA, 17 nt, Human
ugugauagcacuuucua

SEQ ID NO: 2200594 - RNA, 15 nt, Human
ugugauagcacuuuc

SEQ ID NO: 2200595 - RNA, 21 nt, Human
ugugauacaaugcugugcccu

SEQ ID NO: 2200596 - RNA, 23 nt, Human
ugugaguuuaccuuguauacugu

SEQ ID NO: 2200597 - RNA, 21 nt, Human
ugugaguuuaguaaggcugug

SEQ ID NO: 2200598 - RNA, 22 nt, Human
ugugaguuuaccuuguauacug

SEQ ID NO: 2200599 - RNA, 19 nt, Human
ugugaguaagagcuggugu

SEQ ID NO: 2200600 - RNA, 15 nt, Human
ugugaguaagagcug

SEQ ID NO: 2200601 - RNA, 23 nt, Human
ugugaguacuacaguccucccau

SEQ ID NO: 2200602 - RNA, 19 nt, Human
ugugaguacuacaguccuc

SEQ ID NO: 2200603 - RNA, 20 nt, Human
ugugaguacuacaguccucc

SEQ ID NO: 2200604 - RNA, 21 nt, Human
ugugaggugcagagugcccag

SEQ ID NO: 2200605 - RNA, 18 nt, Human
ugugaggggcucucucau

SEQ ID NO: 2200606 - RNA, 18 nt, Human
ugugaguacuacaguccu

SEQ ID NO: 2200607 - RNA, 22 nt, Human
ugugacccagcacugcccaaag

SEQ ID NO: 2200608 - RNA, 17 nt, Human
ugugacccccagcuccg

SEQ ID NO: 2200609 - RNA, 20 nt, Human
ugugacccccagcuccggcc

SEQ ID NO: 2200610 - RNA, 16 nt, Human
ugugacccccagcucc

SEQ ID NO: 2200611 - RNA, 15 nt, Human
ugugacccccagcuc

SEQ ID NO: 2200612 - RNA, 17 nt, Human
ugugacaugcgggcugg

SEQ ID NO: 2200613 - RNA, 18 nt, Human
ugugacauauuaugucuu

SEQ ID NO: 2200614 - RNA, 16 nt, Human
ugugacaggcagcaga

SEQ ID NO: 2200615 - RNA, 18 nt, Human
ugugacagauuauacaga

SEQ ID NO: 2200616 - RNA, 15 nt, Human
ugugacaggcagcag

SEQ ID NO: 2200617 - RNA, 17 nt, Human
ugugacaggcagcagag

SEQ ID NO: 2200618 - RNA, 19 nt, Human
ugugacaauuuuguacaaa

SEQ ID NO: 2200619 - RNA, 17 nt, Human
ugugacacauaugcacc

SEQ ID NO: 2200620 - RNA, 22 nt, Human
ugugacacauaugcaccuugug

SEQ ID NO: 2200621 - RNA, 16 nt, Human
ugugaauggauuggau

SEQ ID NO: 2200622 - RNA, 19 nt, Human
ugugacaugcgggcugggc

SEQ ID NO: 2200623 - RNA, 21 nt, Human
ugugacaugcgggcugggcag

SEQ ID NO: 2200624 - RNA, 16 nt, Human
ugugacauggugccug

SEQ ID NO: 2200625 - RNA, 17 nt, Human
ugugacauggugccuga

SEQ ID NO: 2200626 - RNA, 18 nt, Human
ugugacauggugccugag

SEQ ID NO: 2200627 - RNA, 20 nt, Human
ugugacauggugccugagag

SEQ ID NO: 2200628 - RNA, 14 nt, Human
ugugacauguaaca

SEQ ID NO: 2200629 - RNA, 22 nt, Human
ugugacauggugccugagaggc

SEQ ID NO: 2200630 - RNA, 12 nt, Human
ugugacauguaa

SEQ ID NO: 2200631 - RNA, 17 nt, Human
ugugaccagcacugucu

SEQ ID NO: 2200632 - RNA, 14 nt, Human
ugugaccagcacug

SEQ ID NO: 2200633 - RNA, 19 nt, Human
ugugaccagucugacccuu

SEQ ID NO: 2200634 - RNA, 15 nt, Human
ugugaccagggguga

SEQ ID NO: 2200635 - RNA, 21 nt, Human
ugugacccagauccucacaac

SEQ ID NO: 2200636 - RNA, 17 nt, Human
ugugacccagcacugcc

SEQ ID NO: 2200637 - RNA, 20 nt, Human
ugugacccagcacugcccaa

SEQ ID NO: 2200638 - RNA, 22 nt, Human
ugugaccacugcagaagacagu

SEQ ID NO: 2200639 - RNA, 14 nt, Human
ugugaaucagaccc

SEQ ID NO: 2200640 - RNA, 21 nt, Human
ugugaauauuuccauauggau

SEQ ID NO: 2200641 - RNA, 23 nt, Human
ugugaauauuuccauauggauuu

SEQ ID NO: 2200642 - RNA, 16 nt, Human
ugugaaucauuuuacc

SEQ ID NO: 2200643 - RNA, 12 nt, Human
ugugaauaaauu

SEQ ID NO: 2200644 - RNA, 20 nt, Human
ugugaauauggacucaguuu

SEQ ID NO: 2200645 - RNA, 22 nt, Human
ugugaauagaacucugaaauga

SEQ ID NO: 2200646 - RNA, 18 nt, Human
ugugaaucagacccuacc

SEQ ID NO: 2200647 - RNA, 15 nt, Human
ugugaaucagacccu

SEQ ID NO: 2200648 - RNA, 14 nt, Human
ugugaaugaacacu

SEQ ID NO: 2200649 - RNA, 23 nt, Human
ugugaaugaacacucuuuugcuu

SEQ ID NO: 2200650 - RNA, 17 nt, Human
ugugaaugaacacucuu

SEQ ID NO: 2200651 - RNA, 17 nt, Human
ugugaaugccacugccu

SEQ ID NO: 2200652 - RNA, 21 nt, Human
ugugacaaggauugcuacugu

SEQ ID NO: 2200653 - RNA, 13 nt, Human
ugugaauggauug

SEQ ID NO: 2200654 - RNA, 15 nt, Human
ugugaauggauugga

SEQ ID NO: 2200655 - RNA, 23 nt, Human
ugugaauuucuucacuguugaaa

SEQ ID NO: 2200656 - RNA, 15 nt, Human
uguaaucccagcacu

SEQ ID NO: 2200657 - RNA, 13 nt, Human
uguaaucccagca

SEQ ID NO: 2200658 - RNA, 21 nt, Human
uguaaucauuucuugggcccu

SEQ ID NO: 2200659 - RNA, 17 nt, Human
uguaaucauauaauaaa

SEQ ID NO: 2200660 - RNA, 16 nt, Human
uguaaucccagcacuu

SEQ ID NO: 2200661 - RNA, 23 nt, Human
uguaaucccagcacuuugggagg

SEQ ID NO: 2200662 - RNA, 22 nt, Human
uguaaucccagcacuuugggag

SEQ ID NO: 2200663 - RNA, 16 nt, Human
uguaaucccagcuacu

SEQ ID NO: 2200664 - RNA, 20 nt, Human
uguaaugaaacaccuucucu

SEQ ID NO: 2200665 - RNA, 19 nt, Human
uguaaugaaccgcugaaua

SEQ ID NO: 2200666 - RNA, 14 nt, Human
uguaaucaguuuua

SEQ ID NO: 2200667 - RNA, 15 nt, Human
uguaaucacagcuac

SEQ ID NO: 2200668 - RNA, 23 nt, Human
uguaacugcauugagaacugcau

SEQ ID NO: 2200669 - RNA, 18 nt, Human
uguaacucuaaaagaucc

SEQ ID NO: 2200670 - RNA, 19 nt, Human
uguaacucuaaaagauccu

SEQ ID NO: 2200671 - RNA, 20 nt, Human
uguaacucuaaaagauccuu

SEQ ID NO: 2200672 - RNA, 13 nt, Human
uguaacuccacca

SEQ ID NO: 2200673 - RNA, 12 nt, Human
uguaacucuaaa

SEQ ID NO: 2200674 - RNA, 16 nt, Human
uguaacucuaaaagau

SEQ ID NO: 2200675 - RNA, 17 nt, Human
uguaacucuaaaagauc

SEQ ID NO: 2200676 - RNA, 12 nt, Human
uguaacuccacc

SEQ ID NO: 2200677 - RNA, 21 nt, Human
uguaacuggcaguuuuccauu

SEQ ID NO: 2200678 - RNA, 12 nt, Human
uguaacugcuga

SEQ ID NO: 2200679 - RNA, 23 nt, Human
uguaacugucagccgggcccuga

SEQ ID NO: 2200680 - RNA, 16 nt, Human
uguaaauuuaugugau

SEQ ID NO: 2200681 - RNA, 19 nt, Human
uguaaccucuucagaggcc

SEQ ID NO: 2200682 - RNA, 15 nt, Human
uguaaauuuauguga

SEQ ID NO: 2200683 - RNA, 22 nt, Human
uguaaauugaaucaguauaaac

SEQ ID NO: 2200684 - RNA, 17 nt, Human
uguaaauugaaucagua

SEQ ID NO: 2200685 - RNA, 16 nt, Human
uguaacguugcugugg

SEQ ID NO: 2200686 - RNA, 17 nt, Human
uguaacguugcuguggg

SEQ ID NO: 2200687 - RNA, 18 nt, Human
uguaacguugcuguggga

SEQ ID NO: 2200688 - RNA, 19 nt, Human
uguaacuauaguccagcuu

SEQ ID NO: 2200689 - RNA, 21 nt, Human
uguaacuauaguccagcuuug

SEQ ID NO: 2200690 - RNA, 20 nt, Human
uguaacguugcugugggaac

SEQ ID NO: 2200691 - RNA, 18 nt, Human
uguaacuaggcucagaga

SEQ ID NO: 2200692 - RNA, 21 nt, Human
uguaacuaggcucagagaugu

SEQ ID NO: 2200693 - RNA, 15 nt, Human
uguaaaugcaucugu

SEQ ID NO: 2200694 - RNA, 22 nt, Human
uguaaaugcugucaacuaugau

SEQ ID NO: 2200695 - RNA, 18 nt, Human
uguaaaugcaucuguccu

SEQ ID NO: 2200696 - RNA, 17 nt, Human
uguaaaugguguacaua

SEQ ID NO: 2200697 - RNA, 11 nt, Human
uguaaauguau

SEQ ID NO: 2200698 - RNA, 15 nt, Human
uguaaaugguguaca

SEQ ID NO: 2200699 - RNA, 16 nt, Human
uguaaaugguguacau

SEQ ID NO: 2200700 - RNA, 18 nt, Human
uguaaaugguguacauaa

SEQ ID NO: 2200701 - RNA, 13 nt, Human
uguaaauuaacuu

SEQ ID NO: 2200702 - RNA, 17 nt, Human
uguaaauuaacuuuuau

SEQ ID NO: 2200703 - RNA, 16 nt, Human
uguaaauuaacuuuua

SEQ ID NO: 2200704 - RNA, 15 nt, Human
uguaaauuaacuuuu

SEQ ID NO: 2200705 - RNA, 14 nt, Human
uguaaauuaacuuu

SEQ ID NO: 2200706 - RNA, 17 nt, Human
ugguaggacuguagaaa

SEQ ID NO: 2200707 - RNA, 18 nt, Human
ugguaggacuguagaaaa

SEQ ID NO: 2200708 - RNA, 19 nt, Human
ugguagggggaaaaugugu

SEQ ID NO: 2200709 - RNA, 22 nt, Human
ugguaggaucagcccucauuuu

SEQ ID NO: 2200710 - RNA, 16 nt, Human
ugguaggcauuuccua

SEQ ID NO: 2200711 - RNA, 22 nt, Human
ugguaguacuccugcaaaauuu

SEQ ID NO: 2200712 - RNA, 22 nt, Human
ugguaguaaucacaguuggccu

SEQ ID NO: 2200713 - RNA, 17 nt, Human
ugguagggacuuaaaaa

SEQ ID NO: 2200714 - RNA, 18 nt, Human
ugguaguuaguagcaugu

SEQ ID NO: 2200715 - RNA, 17 nt, Human
ugguaguuaguagcaug

SEQ ID NO: 2200716 - RNA, 20 nt, Human
ugguaguuaguagcauguug

SEQ ID NO: 2200717 - RNA, 21 nt, Human
uguaaacaaaauuuaguuuuu

SEQ ID NO: 2200718 - RNA, 17 nt, Human
uguaaaauuucacuuaa

SEQ ID NO: 2200719 - RNA, 17 nt, Human
uguaaaauguugaauaa

SEQ ID NO: 2200720 - RNA, 14 nt, Human
uguaaaauuguaua

SEQ ID NO: 2200721 - RNA, 20 nt, Human
uguaaaaugugaagugaaug

SEQ ID NO: 2200722 - RNA, 19 nt, Human
uguaaacagugccugcuga

SEQ ID NO: 2200723 - RNA, 17 nt, Human
uguaaacagugccugcu

SEQ ID NO: 2200724 - RNA, 16 nt, Human
uguaaacagugccugc

SEQ ID NO: 2200725 - RNA, 14 nt, Human
uguaaacagugccu

SEQ ID NO: 2200726 - RNA, 12 nt, Human
uguaaacagugc

SEQ ID NO: 2200727 - RNA, 20 nt, Human
uguaaacaggagacaggaag

SEQ ID NO: 2200728 - RNA, 22 nt, Human
uguaaaccacaaggcuguugca

SEQ ID NO: 2200729 - RNA, 13 nt, Human
uguaaaccaaagc

SEQ ID NO: 2200730 - RNA, 14 nt, Human
uguaaaccaaagcc

SEQ ID NO: 2200731 - RNA, 14 nt, Human
uguaaacauguguu

SEQ ID NO: 2200732 - RNA, 22 nt, Human
uguaaacauguguuuuaauucc

SEQ ID NO: 2200733 - RNA, 12 nt, Human
uguaaaccaaag

SEQ ID NO: 2200734 - RNA, 20 nt, Human
uguacucgcuugugcagaaa

SEQ ID NO: 2200735 - RNA, 12 nt, Human
uguacugaaaaa

SEQ ID NO: 2200736 - RNA, 23 nt, Human
uguacucgcuugugcagaaaaca

SEQ ID NO: 2200737 - RNA, 13 nt, Human
uguacucuuccga

SEQ ID NO: 2200738 - RNA, 17 nt, Human
uguacugagccuuguaa

SEQ ID NO: 2200739 - RNA, 14 nt, Human
uguacucuuccgaa

SEQ ID NO: 2200740 - RNA, 20 nt, Human
uguacugaaaaaugguaauu

SEQ ID NO: 2200741 - RNA, 22 nt, Human
uguacugagccuuguaauucua

SEQ ID NO: 2200742 - RNA, 19 nt, Human
uguacugagccuuguaauu

SEQ ID NO: 2200743 - RNA, 20 nt, Human
uguacugagccuuguaauuc

SEQ ID NO: 2200744 - RNA, 22 nt, Human
uguacugauuuuuguaagacaa

SEQ ID NO: 2200745 - RNA, 17 nt, Human
uguagauaauacaguuc

SEQ ID NO: 2200746 - RNA, 21 nt, Human
uguagaguuaagaagcuguug

SEQ ID NO: 2200747 - RNA, 12 nt, Human
uguagaguuaag

SEQ ID NO: 2200748 - RNA, 13 nt, Human
uguagaguuaaga

SEQ ID NO: 2200749 - RNA, 14 nt, Human
uguagaguuaagaa

SEQ ID NO: 2200750 - RNA, 15 nt, Human
uguagaguuaagaag

SEQ ID NO: 2200751 - RNA, 16 nt, Human
uguagaguuaagaagc

SEQ ID NO: 2200752 - RNA, 17 nt, Human
uguagaguuaagaagcu

SEQ ID NO: 2200753 - RNA, 18 nt, Human
uguagaguuaagaagcug

SEQ ID NO: 2200754 - RNA, 19 nt, Human
uguagaguuaagaagcugu

SEQ ID NO: 2200755 - RNA, 12 nt, Human
uguacuacaauu

SEQ ID NO: 2200756 - RNA, 19 nt, Human
uguacuagagaucugguuu

SEQ ID NO: 2200757 - RNA, 18 nt, Human
uguacucaggaggcugag

SEQ ID NO: 2200758 - RNA, 12 nt, Human
uguacuccuccc

SEQ ID NO: 2200759 - RNA, 13 nt, Human
uguacuccuccca

SEQ ID NO: 2200760 - RNA, 16 nt, Human
uguacguuuguaugug

SEQ ID NO: 2200761 - RNA, 15 nt, Human
uguacguggagaggg

SEQ ID NO: 2200762 - RNA, 12 nt, Human
uguacguggaga

SEQ ID NO: 2200763 - RNA, 17 nt, Human
uguaccuggugaccccu

SEQ ID NO: 2200764 - RNA, 17 nt, Human
uguaccuguuccuuaga

SEQ ID NO: 2200765 - RNA, 14 nt, Human
uguacguggagagg

SEQ ID NO: 2200766 - RNA, 19 nt, Human
uguacguuuguaugugugu

SEQ ID NO: 2200767 - RNA, 20 nt, Human
uguacguuuguaugugugua

SEQ ID NO: 2200768 - RNA, 17 nt, Human
uguacgucugacaggca

SEQ ID NO: 2200769 - RNA, 16 nt, Human
uguacgucugacaggc

SEQ ID NO: 2200770 - RNA, 20 nt, Human
uguaaugucaccaccuuccc

SEQ ID NO: 2200771 - RNA, 14 nt, Human
uguacaguagauuu

SEQ ID NO: 2200772 - RNA, 19 nt, Human
uguaaugucaccaccuucc

SEQ ID NO: 2200773 - RNA, 16 nt, Human
uguaaugucaccaccu

SEQ ID NO: 2200774 - RNA, 13 nt, Human
uguaaugucacca

SEQ ID NO: 2200775 - RNA, 20 nt, Human
uguaaugguaucuuaaagug

SEQ ID NO: 2200776 - RNA, 21 nt, Human
uguaaugaaucuaagcagcau

SEQ ID NO: 2200777 - RNA, 20 nt, Human
uguaaugaaucuaagcagca

SEQ ID NO: 2200778 - RNA, 13 nt, Human
uguaaugaucaua

SEQ ID NO: 2200779 - RNA, 23 nt, Human
uguacagucugucaugaacaugu

SEQ ID NO: 2200780 - RNA, 14 nt, Human
uguacagucuugua

SEQ ID NO: 2200781 - RNA, 15 nt, Human
uguacagucuuguau

SEQ ID NO: 2200782 - RNA, 12 nt, Human
uguacagucuug

SEQ ID NO: 2200783 - RNA, 14 nt, Human
uguacagucuguca

SEQ ID NO: 2200784 - RNA, 15 nt, Human
uguacagucugucau

SEQ ID NO: 2200785 - RNA, 16 nt, Human
uguacagucugucaug

SEQ ID NO: 2200786 - RNA, 18 nt, Human
uguacagucugucaugaa

SEQ ID NO: 2200787 - RNA, 20 nt, Human
uguacaguagauuuuccaaa

SEQ ID NO: 2200788 - RNA, 17 nt, Human
uguacaguagauuuucc

SEQ ID NO: 2200789 - RNA, 18 nt, Human
uguacaguagauuuucca

SEQ ID NO: 2200790 - RNA, 21 nt, Human
uguacccaguauucuagguag

SEQ ID NO: 2200791 - RNA, 14 nt, Human
uguaccccccaacc

SEQ ID NO: 2200792 - RNA, 16 nt, Human
uguaccccccaacccc

SEQ ID NO: 2200793 - RNA, 14 nt, Human
uguaccauuugccu

SEQ ID NO: 2200794 - RNA, 15 nt, Human
uguaccgcaauguga

SEQ ID NO: 2200795 - RNA, 20 nt, Human
uguaccccccaaccccugag

SEQ ID NO: 2200796 - RNA, 23 nt, Human
uguaccccccaaccccugaggaa

SEQ ID NO: 2200797 - RNA, 14 nt, Human
uguacccccgccca

SEQ ID NO: 2200798 - RNA, 15 nt, Human
uguacccccgcccag

SEQ ID NO: 2200799 - RNA, 16 nt, Human
uguacccccgcccagg

SEQ ID NO: 2200800 - RNA, 17 nt, Human
uguacccccgcccaggc

SEQ ID NO: 2200801 - RNA, 19 nt, Human
uguacccccgcccaggcug

SEQ ID NO: 2200802 - RNA, 22 nt, Human
uguacccccgcccaggcuggcc

SEQ ID NO: 2200803 - RNA, 16 nt, Human
uguacccuuccuacag

SEQ ID NO: 2200804 - RNA, 18 nt, Human
uguaccugcccccaaucc

SEQ ID NO: 2200805 - RNA, 18 nt, Human
uguaccuggugaccccuu

SEQ ID NO: 2200806 - RNA, 23 nt, Human
uguaccucuugagccuugaacuu

SEQ ID NO: 2200807 - RNA, 14 nt, Human
uguaccucuugagc

SEQ ID NO: 2200808 - RNA, 22 nt, Human
uguaccucuugagccuugaacu

SEQ ID NO: 2200809 - RNA, 23 nt, Human
ugucauaccaggccgccccagcc

SEQ ID NO: 2200810 - RNA, 15 nt, Human
ugucauaagaaugaa

SEQ ID NO: 2200811 - RNA, 14 nt, Human
ugucauaagaauga

SEQ ID NO: 2200812 - RNA, 17 nt, Human
ugucauaagaaugaaua

SEQ ID NO: 2200813 - RNA, 16 nt, Human
ugucauaagaaugaau

SEQ ID NO: 2200814 - RNA, 15 nt, Human
ugucaguggaagaag

SEQ ID NO: 2200815 - RNA, 16 nt, Human
ugucagugcagcccgu

SEQ ID NO: 2200816 - RNA, 13 nt, Human
ugucagugccgcc

SEQ ID NO: 2200817 - RNA, 16 nt, Human
ugucagugccgccgcc

SEQ ID NO: 2200818 - RNA, 23 nt, Human
ugucagugccgccgccucgccca

SEQ ID NO: 2200819 - RNA, 14 nt, Human
ugucagugcagccc

SEQ ID NO: 2200820 - RNA, 22 nt, Human
ugucagucacagccaccccuga

SEQ ID NO: 2200821 - RNA, 18 nt, Human
ugucagucacagccaccc

SEQ ID NO: 2200822 - RNA, 17 nt, Human
ugucagucacagccacc

SEQ ID NO: 2200823 - RNA, 16 nt, Human
ugucagucacagccac

SEQ ID NO: 2200824 - RNA, 12 nt, Human
ugucagugugac

SEQ ID NO: 2200825 - RNA, 20 nt, Human
ugucagugugacugaucucu

SEQ ID NO: 2200826 - RNA, 18 nt, Human
uguauuuguuaaugguuu

SEQ ID NO: 2200827 - RNA, 18 nt, Human
uguauuugugacuaauug

SEQ ID NO: 2200828 - RNA, 20 nt, Human
uguauuugugacuaauugua

SEQ ID NO: 2200829 - RNA, 20 nt, Human
uguauuuguuaaugguuuga

SEQ ID NO: 2200830 - RNA, 14 nt, Human
uguauuugcuuuuu

SEQ ID NO: 2200831 - RNA, 12 nt, Human
uguauuugugac

SEQ ID NO: 2200832 - RNA, 13 nt, Human
uguauuugugacu

SEQ ID NO: 2200833 - RNA, 14 nt, Human
uguauuugugacua

SEQ ID NO: 2200834 - RNA, 15 nt, Human
uguauuugugacuaa

SEQ ID NO: 2200835 - RNA, 16 nt, Human
uguauuugugacuaau

SEQ ID NO: 2200836 - RNA, 22 nt, Human
uguauuugugacuaauuguaua

SEQ ID NO: 2200837 - RNA, 16 nt, Human
ugucacuacucacagu

SEQ ID NO: 2200838 - RNA, 22 nt, Human
ugucacuacucacagucucuuu

SEQ ID NO: 2200839 - RNA, 16 nt, Human
ugucacucauugcuga

SEQ ID NO: 2200840 - RNA, 15 nt, Human
ugucacucauugcug

SEQ ID NO: 2200841 - RNA, 15 nt, Human
ugucacugcaggcac

SEQ ID NO: 2200842 - RNA, 15 nt, Human
ugucagucacagcca

SEQ ID NO: 2200843 - RNA, 14 nt, Human
ugucagucacagcc

SEQ ID NO: 2200844 - RNA, 23 nt, Human
ugucacucauugcugagccucug

SEQ ID NO: 2200845 - RNA, 22 nt, Human
ugucacucauugcugagccucu

SEQ ID NO: 2200846 - RNA, 21 nt, Human
ugucacucauugcugagccuc

SEQ ID NO: 2200847 - RNA, 16 nt, Human
ugucauagaaauuaca

SEQ ID NO: 2200848 - RNA, 15 nt, Human
ugucauagaaauuac

SEQ ID NO: 2200849 - RNA, 22 nt, Human
ugucauauauggggggccaaca

SEQ ID NO: 2200850 - RNA, 20 nt, Human
ugucauauauggggggccaa

SEQ ID NO: 2200851 - RNA, 19 nt, Human
ugucauauauuacuagcau

SEQ ID NO: 2200852 - RNA, 21 nt, Human
ugucauauguaggugucugca

SEQ ID NO: 2200853 - RNA, 18 nt, Human
ugucauauauuacuagca

SEQ ID NO: 2200854 - RNA, 13 nt, Human
ugucauuaaaggu

SEQ ID NO: 2200855 - RNA, 17 nt, Human
ugucauuaaagguauca

SEQ ID NO: 2200856 - RNA, 19 nt, Human
ugucauuaaaauaaauaaa

SEQ ID NO: 2200857 - RNA, 17 nt, Human
ugucaucagaagauaac

SEQ ID NO: 2200858 - RNA, 23 nt, Human
ugucauuaaauggggcucacaaa

SEQ ID NO: 2200859 - RNA, 22 nt, Human
ugucaucaauugaauggucagc

SEQ ID NO: 2200860 - RNA, 15 nt, Human
ugucaucaauugaau

SEQ ID NO: 2200861 - RNA, 13 nt, Human
ugucaucagaacu

SEQ ID NO: 2200862 - RNA, 15 nt, Human
ugucaucagaagaua

SEQ ID NO: 2200863 - RNA, 16 nt, Human
ugucaucagaagauaa

SEQ ID NO: 2200864 - RNA, 20 nt, Human
uguccaugcgcucagggcca

SEQ ID NO: 2200865 - RNA, 22 nt, Human
uguccaugcgcucagggccaug

SEQ ID NO: 2200866 - RNA, 18 nt, Human
ugucauugcuguuguccc

SEQ ID NO: 2200867 - RNA, 19 nt, Human
ugucauuaccagacgguuc

SEQ ID NO: 2200868 - RNA, 21 nt, Human
ugucauuagccugaguagaaa

SEQ ID NO: 2200869 - RNA, 15 nt, Human
ugucauucagaaaaa

SEQ ID NO: 2200870 - RNA, 13 nt, Human
ugucauuagccug

SEQ ID NO: 2200871 - RNA, 14 nt, Human
ugucauuagccuga

SEQ ID NO: 2200872 - RNA, 17 nt, Human
ugucauuagccugagua

SEQ ID NO: 2200873 - RNA, 20 nt, Human
ugucauuagccugaguagaa

SEQ ID NO: 2200874 - RNA, 16 nt, Human
uguccaugugugugca

SEQ ID NO: 2200875 - RNA, 14 nt, Human
uguccauugacaug

SEQ ID NO: 2200876 - RNA, 15 nt, Human
uguccauugacaugu

SEQ ID NO: 2200877 - RNA, 16 nt, Human
uguccauugacaugua

SEQ ID NO: 2200878 - RNA, 15 nt, Human
uguccaugugugugc

SEQ ID NO: 2200879 - RNA, 13 nt, Human
uguccaugugugu

SEQ ID NO: 2200880 - RNA, 12 nt, Human
uguccaugugug

SEQ ID NO: 2200881 - RNA, 20 nt, Human
uguccaugugguucuucaaa

SEQ ID NO: 2200882 - RNA, 17 nt, Human
uguccauuguccaaucc

SEQ ID NO: 2200883 - RNA, 14 nt, Human
uguccauuguccaa

SEQ ID NO: 2200884 - RNA, 18 nt, Human
uguccauugacauguaca

SEQ ID NO: 2200885 - RNA, 19 nt, Human
uguccauugacauguacag

SEQ ID NO: 2200886 - RNA, 20 nt, Human
uguccauugacauguacaga

SEQ ID NO: 2200887 - RNA, 22 nt, Human
uguccauugacauguacagaga

SEQ ID NO: 2200888 - RNA, 20 nt, Human
ugucccacucaagccaagca

SEQ ID NO: 2200889 - RNA, 17 nt, Human
ugucccacucaagccaa

SEQ ID NO: 2200890 - RNA, 15 nt, Human
ugucccacuaucugg

SEQ ID NO: 2200891 - RNA, 16 nt, Human
ugucccacuaucuggg

SEQ ID NO: 2200892 - RNA, 23 nt, Human
ugucccaaaaagaaaggagggga

SEQ ID NO: 2200893 - RNA, 22 nt, Human
ugucccauggacacuccagugc

SEQ ID NO: 2200894 - RNA, 18 nt, Human
ugucccauggacacucca

SEQ ID NO: 2200895 - RNA, 19 nt, Human
ugucccauggacacuccag

SEQ ID NO: 2200896 - RNA, 18 nt, Human
ugucccaugaucccugug

SEQ ID NO: 2200897 - RNA, 21 nt, Human
ugucccaugacccaccccugu

SEQ ID NO: 2200898 - RNA, 17 nt, Human
ugucccauggacacucc

SEQ ID NO: 2200899 - RNA, 16 nt, Human
ugucccaugaucccug

SEQ ID NO: 2200900 - RNA, 17 nt, Human
ugucccaugaucccugu

SEQ ID NO: 2200901 - RNA, 17 nt, Human
ugucccaugacccaccc

SEQ ID NO: 2200902 - RNA, 18 nt, Human
ugucccaugacccacccc

SEQ ID NO: 2200903 - RNA, 19 nt, Human
ugucccaugacccaccccu

SEQ ID NO: 2200904 - RNA, 20 nt, Human
ugucccaugacccaccccug

SEQ ID NO: 2200905 - RNA, 20 nt, Human
ugucccagaggcugccccac

SEQ ID NO: 2200906 - RNA, 16 nt, Human
ugucccagguccucac

SEQ ID NO: 2200907 - RNA, 14 nt, Human
ugucccagguccuc

SEQ ID NO: 2200908 - RNA, 16 nt, Human
ugucccaugacccacc

SEQ ID NO: 2200909 - RNA, 14 nt, Human
ugucccaugaccca

SEQ ID NO: 2200910 - RNA, 17 nt, Human
ugucccagguccucacu

SEQ ID NO: 2200911 - RNA, 15 nt, Human
uguauaauauuuuua

SEQ ID NO: 2200912 - RNA, 20 nt, Human
uguauaauucaaagcaccaa

SEQ ID NO: 2200913 - RNA, 23 nt, Human
uguauaaguggaggcacuuuagg

SEQ ID NO: 2200914 - RNA, 21 nt, Human
uguauaaguggaggcacuuua

SEQ ID NO: 2200915 - RNA, 16 nt, Human
uguauaaguccuugca

SEQ ID NO: 2200916 - RNA, 16 nt, Human
uguauaaguggaggca

SEQ ID NO: 2200917 - RNA, 20 nt, Human
uguauaaguggaggcacuuu

SEQ ID NO: 2200918 - RNA, 19 nt, Human
uguauaaguggaggcacuu

SEQ ID NO: 2200919 - RNA, 19 nt, Human
uguauaaguccuugcaaga

SEQ ID NO: 2200920 - RNA, 17 nt, Human
uguauaaguaagaaaau

SEQ ID NO: 2200921 - RNA, 18 nt, Human
uguauaaguaagaaaaua

SEQ ID NO: 2200922 - RNA, 20 nt, Human
uguauaaguaagaaaauauu

SEQ ID NO: 2200923 - RNA, 20 nt, Human
uguagcaaccuucugcauuc

SEQ ID NO: 2200924 - RNA, 19 nt, Human
uguagcacuuacugguagg

SEQ ID NO: 2200925 - RNA, 15 nt, Human
uguagcacuuacugg

SEQ ID NO: 2200926 - RNA, 20 nt, Human
uguagcaaaacgcauggagu

SEQ ID NO: 2200927 - RNA, 22 nt, Human
uguagcaaaauucuuaaguaug

SEQ ID NO: 2200928 - RNA, 19 nt, Human
uguaucccaugagccucag

SEQ ID NO: 2200929 - RNA, 23 nt, Human
uguaucccaugagccucagcauc

SEQ ID NO: 2200930 - RNA, 20 nt, Human
uguauccccccccuguauag

SEQ ID NO: 2200931 - RNA, 21 nt, Human
uguauccccccccuguauagu

SEQ ID NO: 2200932 - RNA, 16 nt, Human
uguaucccaugagccu

SEQ ID NO: 2200933 - RNA, 22 nt, Human
uguauccccccccuguauaguu

SEQ ID NO: 2200934 - RNA, 20 nt, Human
uguauccugaggcugagaga

SEQ ID NO: 2200935 - RNA, 12 nt, Human
uguauccugggg

SEQ ID NO: 2200936 - RNA, 13 nt, Human
uguauccuggggc

SEQ ID NO: 2200937 - RNA, 14 nt, Human
uguauccuggggcu

SEQ ID NO: 2200938 - RNA, 15 nt, Human
uguauacaugccagu

SEQ ID NO: 2200939 - RNA, 13 nt, Human
uguauaauuguau

SEQ ID NO: 2200940 - RNA, 13 nt, Human
uguauacaugcca

SEQ ID NO: 2200941 - RNA, 15 nt, Human
uguauaauuguaucg

SEQ ID NO: 2200942 - RNA, 16 nt, Human
uguauacaacccuggc

SEQ ID NO: 2200943 - RNA, 18 nt, Human
uguauuuaacagggaggg

SEQ ID NO: 2200944 - RNA, 21 nt, Human
uguauuguaccuuuuaacacc

SEQ ID NO: 2200945 - RNA, 15 nt, Human
uguauuuaauuuuga

SEQ ID NO: 2200946 - RNA, 20 nt, Human
uguauuuacgcuuugauuca

SEQ ID NO: 2200947 - RNA, 16 nt, Human
uguauuuaugugugag

SEQ ID NO: 2200948 - RNA, 21 nt, Human
uguauuuauauuuugugcuau

SEQ ID NO: 2200949 - RNA, 23 nt, Human
uguauuuacgcuuugauucauag

SEQ ID NO: 2200950 - RNA, 21 nt, Human
uguauuuacgcuuugauucau

SEQ ID NO: 2200951 - RNA, 14 nt, Human
uguauuuauaaaua

SEQ ID NO: 2200952 - RNA, 21 nt, Human
uguauuuauaaauauauuuaa

SEQ ID NO: 2200953 - RNA, 19 nt, Human
uguauugcauauauacaua

SEQ ID NO: 2200954 - RNA, 15 nt, Human
uguauugcacauugu

SEQ ID NO: 2200955 - RNA, 19 nt, Human
uguauugcacauuguaaaa

SEQ ID NO: 2200956 - RNA, 15 nt, Human
uguauugaaucaugu

SEQ ID NO: 2200957 - RNA, 20 nt, Human
uguauugaaucauguaguau

SEQ ID NO: 2200958 - RNA, 14 nt, Human
uguauugcacauug

SEQ ID NO: 2200959 - RNA, 16 nt, Human
uguauugaaucaugua

SEQ ID NO: 2200960 - RNA, 23 nt, Human
uguauugaugacaguaguaccaa

SEQ ID NO: 2200961 - RNA, 11 nt, Human
uguauuguacc

SEQ ID NO: 2200962 - RNA, 19 nt, Human
uguauuguaccuuuuaaca

SEQ ID NO: 2200963 - RNA, 19 nt, Human
uguauuguaaacauguguu

SEQ ID NO: 2200964 - RNA, 13 nt, Human
uguauuggccugg

SEQ ID NO: 2200965 - RNA, 15 nt, Human
uguauuguaaacaug

SEQ ID NO: 2200966 - RNA, 14 nt, Human
uguauuggccugga

SEQ ID NO: 2200967 - RNA, 18 nt, Human
uguaugcacgugugcaca

SEQ ID NO: 2200968 - RNA, 12 nt, Human
uguaugcagcua

SEQ ID NO: 2200969 - RNA, 17 nt, Human
uguaugcagcuaucugg

SEQ ID NO: 2200970 - RNA, 14 nt, Human
uguaugcacuuugu

SEQ ID NO: 2200971 - RNA, 22 nt, Human
uguauugaacuuggaaagaaau

SEQ ID NO: 2200972 - RNA, 23 nt, Human
uguauucuuugauguuaacacau

SEQ ID NO: 2200973 - RNA, 18 nt, Human
uguaugcagcuaucuggu

SEQ ID NO: 2200974 - RNA, 17 nt, Human
uguaugcaacaggcacu

SEQ ID NO: 2200975 - RNA, 18 nt, Human
uguaucuaugcauuuucu

SEQ ID NO: 2200976 - RNA, 21 nt, Human
uguaucuagugcagcugauuu

SEQ ID NO: 2200977 - RNA, 19 nt, Human
uguaucuagugcagcugau

SEQ ID NO: 2200978 - RNA, 17 nt, Human
uguaucuagugcagcug

SEQ ID NO: 2200979 - RNA, 15 nt, Human
uguaucuaccucacu

SEQ ID NO: 2200980 - RNA, 22 nt, Human
uguaucguauagcuguauugaa

SEQ ID NO: 2200981 - RNA, 21 nt, Human
uguaucguauagcuguauuga

SEQ ID NO: 2200982 - RNA, 20 nt, Human
uguaucuacaucuuuuuuca

SEQ ID NO: 2200983 - RNA, 16 nt, Human
uguaugauucccagcc

SEQ ID NO: 2200984 - RNA, 18 nt, Human
uguaucggagacagugau

SEQ ID NO: 2200985 - RNA, 19 nt, Human
uguaucguaaccagccaga

SEQ ID NO: 2200986 - RNA, 15 nt, Human
uguaucguauagcug

SEQ ID NO: 2200987 - RNA, 16 nt, Human
uguaucguauagcugu

SEQ ID NO: 2200988 - RNA, 17 nt, Human
uguaucguauagcugua

SEQ ID NO: 2200989 - RNA, 18 nt, Human
uguaucguauagcuguau

SEQ ID NO: 2200990 - RNA, 19 nt, Human
uguaucguauagcuguauu

SEQ ID NO: 2200991 - RNA, 15 nt, Human
uguaucggaugcuuu

SEQ ID NO: 2200992 - RNA, 17 nt, Human
uguaucggagacaguga

SEQ ID NO: 2200993 - RNA, 15 nt, Human
uguaucggagacagu

SEQ ID NO: 2200994 - RNA, 19 nt, Human
uguauccuggggcucccuu

SEQ ID NO: 2200995 - RNA, 15 nt, Human
uguauccuggggcuc

SEQ ID NO: 2200996 - RNA, 18 nt, Human
uguauccuggggcucccu

SEQ ID NO: 2200997 - RNA, 13 nt, Human
uguguauuuaaca

SEQ ID NO: 2200998 - RNA, 15 nt, Human
uguguauuguuccca

SEQ ID NO: 2200999 - RNA, 14 nt, Human
uguguauuguuccc

SEQ ID NO: 2201000 - RNA, 13 nt, Human
uguguauuguucc

SEQ ID NO: 2201001 - RNA, 12 nt, Human
uguguauuguuc

SEQ ID NO: 2201002 - RNA, 18 nt, Human
uguguauuuaacagggag

SEQ ID NO: 2201003 - RNA, 20 nt, Human
uguguauuuaacagggaggg

SEQ ID NO: 2201004 - RNA, 22 nt, Human
uguguauuuaacagggagggga

SEQ ID NO: 2201005 - RNA, 15 nt, Human
ugugucacuggcugc

SEQ ID NO: 2201006 - RNA, 17 nt, Human
ugugucacuggcugccu

SEQ ID NO: 2201007 - RNA, 18 nt, Human
ugugucacuggcugccuc

SEQ ID NO: 2201008 - RNA, 13 nt, Human
ugugucacuggcu

SEQ ID NO: 2201009 - RNA, 16 nt, Human
ugugucaaugggcaau

SEQ ID NO: 2201010 - RNA, 19 nt, Human
uguguauuuccagugcaau

SEQ ID NO: 2201011 - RNA, 15 nt, Human
uguguauuuacgcuu

SEQ ID NO: 2201012 - RNA, 17 nt, Human
ugugugaggagcugcug

SEQ ID NO: 2201013 - RNA, 17 nt, Human
ugugugagcaagcauuu

SEQ ID NO: 2201014 - RNA, 22 nt, Human
ugugugaaugaacacucuuuug

SEQ ID NO: 2201015 - RNA, 18 nt, Human
ugugugaaugaacacucu

SEQ ID NO: 2201016 - RNA, 17 nt, Human
ugugugaaugaacacuc

SEQ ID NO: 2201017 - RNA, 16 nt, Human
ugugugaaugaacacu

SEQ ID NO: 2201018 - RNA, 12 nt, Human
ugugugaaugaa

SEQ ID NO: 2201019 - RNA, 22 nt, Human
ugugucacuggcugccuccacu

SEQ ID NO: 2201020 - RNA, 23 nt, Human
ugugucacuggcugccuccacuc

SEQ ID NO: 2201021 - RNA, 13 nt, Human
uguguagaguuaa

SEQ ID NO: 2201022 - RNA, 16 nt, Human
uguguagacaaauauu

SEQ ID NO: 2201023 - RNA, 21 nt, Human
uguguagacaaauauuuggag

SEQ ID NO: 2201024 - RNA, 16 nt, Human
uguguagaguuaagaa

SEQ ID NO: 2201025 - RNA, 18 nt, Human
uguguagaguuaagaagc

SEQ ID NO: 2201026 - RNA, 19 nt, Human
uguguagaguuaagaagcu

SEQ ID NO: 2201027 - RNA, 16 nt, Human
uguguagggcgggagg

SEQ ID NO: 2201028 - RNA, 21 nt, Human
uguguagaguuaagaagcugu

SEQ ID NO: 2201029 - RNA, 15 nt, Human
uguguauacaugcca

SEQ ID NO: 2201030 - RNA, 21 nt, Human
uguguauagaugcaagauauu

SEQ ID NO: 2201031 - RNA, 23 nt, Human
uguguaugugggggucugugugu

SEQ ID NO: 2201032 - RNA, 14 nt, Human
uguguauuaaaaaa

SEQ ID NO: 2201033 - RNA, 22 nt, Human
uguguauguguacgugugugug

SEQ ID NO: 2201034 - RNA, 14 nt, Human
uguguauuccaaga

SEQ ID NO: 2201035 - RNA, 21 nt, Human
uguguauccauuaucaugugu

SEQ ID NO: 2201036 - RNA, 19 nt, Human
uguguauuaaaaaaaacaa

SEQ ID NO: 2201037 - RNA, 21 nt, Human
uguguauuaaaaaaaacaaaa

SEQ ID NO: 2201038 - RNA, 19 nt, Human
uguguauucauugaaguca

SEQ ID NO: 2201039 - RNA, 16 nt, Human
uguguauccauuauca

SEQ ID NO: 2201040 - RNA, 18 nt, Human
uguguauccauuaucaug

SEQ ID NO: 2201041 - RNA, 19 nt, Human
uguguauccauuaucaugu

SEQ ID NO: 2201042 - RNA, 13 nt, Human
uguguaugugggg

SEQ ID NO: 2201043 - RNA, 14 nt, Human
uguguauguggggg

SEQ ID NO: 2201044 - RNA, 13 nt, Human
uguguuuaugugu

SEQ ID NO: 2201045 - RNA, 22 nt, Human
uguguuuaggaacuacugagga

SEQ ID NO: 2201046 - RNA, 13 nt, Human
uguguuuauuguc

SEQ ID NO: 2201047 - RNA, 15 nt, Human
uguguuuaugugugu

SEQ ID NO: 2201048 - RNA, 12 nt, Human
uguguuuaaaua

SEQ ID NO: 2201049 - RNA, 13 nt, Human
uguguuguugcuu

SEQ ID NO: 2201050 - RNA, 14 nt, Human
uguguuguugcuuu

SEQ ID NO: 2201051 - RNA, 13 nt, Human
uguguuuaaauaa

SEQ ID NO: 2201052 - RNA, 14 nt, Human
uguguuuaaauaaa

SEQ ID NO: 2201053 - RNA, 15 nt, Human
uguguuuaaauaaag

SEQ ID NO: 2201054 - RNA, 20 nt, Human
uguguuuacuuuauguuacu

SEQ ID NO: 2201055 - RNA, 18 nt, Human
uguguuuaaauaaaguau

SEQ ID NO: 2201056 - RNA, 22 nt, Human
uguguuuaaauaaaguaucaug

SEQ ID NO: 2201057 - RNA, 13 nt, Human
uguguugugauag

SEQ ID NO: 2201058 - RNA, 22 nt, Human
uguguguccacgacugucucca

SEQ ID NO: 2201059 - RNA, 23 nt, Human
uguguugugugugggagugugua

SEQ ID NO: 2201060 - RNA, 14 nt, Human
uguguugugugugg

SEQ ID NO: 2201061 - RNA, 13 nt, Human
uguguguaugcua

SEQ ID NO: 2201062 - RNA, 11 nt, Human
uguguguaugu

SEQ ID NO: 2201063 - RNA, 20 nt, Human
ugugugguuugguguguucc

SEQ ID NO: 2201064 - RNA, 14 nt, Human
uguguguauacaug

SEQ ID NO: 2201065 - RNA, 18 nt, Human
ugugugcgagugugugca

SEQ ID NO: 2201066 - RNA, 19 nt, Human
uguguguauguuugcacac

SEQ ID NO: 2201067 - RNA, 14 nt, Human
uguguguaugugua

SEQ ID NO: 2201068 - RNA, 20 nt, Human
ugugugguggguucuuugga

SEQ ID NO: 2201069 - RNA, 19 nt, Human
uguguguccaaaacugccu

SEQ ID NO: 2201070 - RNA, 16 nt, Human
uguguguccaaaacug

SEQ ID NO: 2201071 - RNA, 20 nt, Human
ugugugaggagcugcuggcu

SEQ ID NO: 2201072 - RNA, 13 nt, Human
ugugugcagugaa

SEQ ID NO: 2201073 - RNA, 19 nt, Human
ugugugcagacucaauaaa

SEQ ID NO: 2201074 - RNA, 20 nt, Human
ugugugcaugugugugcuca

SEQ ID NO: 2201075 - RNA, 21 nt, Human
ugugugccauagaguuuaaca

SEQ ID NO: 2201076 - RNA, 23 nt, Human
ugugugccauagaguuuaacaca

SEQ ID NO: 2201077 - RNA, 14 nt, Human
ugugugcaugugug

SEQ ID NO: 2201078 - RNA, 24 nt, Human
ugugugccauagaguuuaacacaa

SEQ ID NO: 2201079 - RNA, 20 nt, Human
uguguuuguucuuuuuauug

SEQ ID NO: 2201080 - RNA, 14 nt, Human
uguguuuguuccua

SEQ ID NO: 2201081 - RNA, 17 nt, Human
uguguuuucauaauaaa

SEQ ID NO: 2201082 - RNA, 13 nt, Human
uguguuuucugaa

SEQ ID NO: 2201083 - RNA, 10 nt, Human
uguguuuguu

SEQ ID NO: 2201084 - RNA, 13 nt, Human
uguguuuguguga

SEQ ID NO: 2201085 - RNA, 11 nt, Human
uguguuugugu

SEQ ID NO: 2201086 - RNA, 15 nt, Human
uguguuuguguauuu

SEQ ID NO: 2201087 - RNA, 19 nt, Human
uguguuugucauuagccug

SEQ ID NO: 2201088 - RNA, 18 nt, Human
uguguuugguucuggggc

SEQ ID NO: 2201089 - RNA, 14 nt, Human
uguguuugucauua

SEQ ID NO: 2201090 - RNA, 17 nt, Human
uguguuugucauuagcc

SEQ ID NO: 2201091 - RNA, 20 nt, Human
uguuaaacuagcauaucugc

SEQ ID NO: 2201092 - RNA, 22 nt, Human
uguuaaacuagcauaucugccu

SEQ ID NO: 2201093 - RNA, 23 nt, Human
uguuaaacuagcauaucugccuu

SEQ ID NO: 2201094 - RNA, 18 nt, Human
uguuaaacuagcauaucu

SEQ ID NO: 2201095 - RNA, 19 nt, Human
uguuaaacuagcauaucug

SEQ ID NO: 2201096 - RNA, 14 nt, Human
uguguuuucugaau

SEQ ID NO: 2201097 - RNA, 23 nt, Human
uguguuuucugaauaacauuugu

SEQ ID NO: 2201098 - RNA, 16 nt, Human
uguuacugucuucagu

SEQ ID NO: 2201099 - RNA, 15 nt, Human
uguuacugucuucag

SEQ ID NO: 2201100 - RNA, 12 nt, Human
uguuacuuaccu

SEQ ID NO: 2201101 - RNA, 15 nt, Human
uguuacuguaauucc

SEQ ID NO: 2201102 - RNA, 14 nt, Human
uguuacuuaccuaa

SEQ ID NO: 2201103 - RNA, 18 nt, Human
uguuacuuaccuaaacag

SEQ ID NO: 2201104 - RNA, 12 nt, Human
uguuacaucaca

SEQ ID NO: 2201105 - RNA, 15 nt, Human
uguuacauuauuauc

SEQ ID NO: 2201106 - RNA, 13 nt, Human
uguuacauuuuua

SEQ ID NO: 2201107 - RNA, 18 nt, Human
uguuaccaugucacugug

SEQ ID NO: 2201108 - RNA, 19 nt, Human
uguuaccaugucacugugg

SEQ ID NO: 2201109 - RNA, 22 nt, Human
uguuacauuuuuaagugcugca

SEQ ID NO: 2201110 - RNA, 18 nt, Human
uguuagaguccaacgugg

SEQ ID NO: 2201111 - RNA, 21 nt, Human
uguuagagguuuuaaagugau

SEQ ID NO: 2201112 - RNA, 22 nt, Human
uguuagagguuuuaaagugauu

SEQ ID NO: 2201113 - RNA, 18 nt, Human
uguuagacucuuacuuuu

SEQ ID NO: 2201114 - RNA, 22 nt, Human
uguuagaggaucccucucugga

SEQ ID NO: 2201115 - RNA, 20 nt, Human
uguuagagguuuuaaaguga

SEQ ID NO: 2201116 - RNA, 19 nt, Human
uguuagaaaauggacacug

SEQ ID NO: 2201117 - RNA, 23 nt, Human
uguuagaguccaacguggggcag

SEQ ID NO: 2201118 - RNA, 21 nt, Human
uguuagauagaauuuccaaua

SEQ ID NO: 2201119 - RNA, 15 nt, Human
uguuaguucccaaca

SEQ ID NO: 2201120 - RNA, 17 nt, Human
uguuaguuauagauguc

SEQ ID NO: 2201121 - RNA, 12 nt, Human
uguuaguuccca

SEQ ID NO: 2201122 - RNA, 13 nt, Human
uguuaguucccaa

SEQ ID NO: 2201123 - RNA, 14 nt, Human
uguuaguucccaac

SEQ ID NO: 2201124 - RNA, 18 nt, Human
uguuauaacucugcacua

SEQ ID NO: 2201125 - RNA, 23 nt, Human
uguuauaacucugcacuacuccu

SEQ ID NO: 2201126 - RNA, 14 nt, Human
uguuauaacuacuc

SEQ ID NO: 2201127 - RNA, 14 nt, Human
uguuauaacucugc

SEQ ID NO: 2201128 - RNA, 15 nt, Human
uguuauaacucugca

SEQ ID NO: 2201129 - RNA, 17 nt, Human
uguuauaacucugcacu

SEQ ID NO: 2201130 - RNA, 12 nt, Human
uguuauaaucuu

SEQ ID NO: 2201131 - RNA, 15 nt, Human
uguucagcuccagcu

SEQ ID NO: 2201132 - RNA, 16 nt, Human
uguucagcuccagcuc

SEQ ID NO: 2201133 - RNA, 11 nt, Human
uguucagcugg

SEQ ID NO: 2201134 - RNA, 18 nt, Human
uguucagcuccagcucac

SEQ ID NO: 2201135 - RNA, 23 nt, Human
uguucaagaccagccugaccaac

SEQ ID NO: 2201136 - RNA, 16 nt, Human
uguucaauguuuaaug

SEQ ID NO: 2201137 - RNA, 16 nt, Human
uguucacagccagacu

SEQ ID NO: 2201138 - RNA, 14 nt, Human
uguucagcuccagc

SEQ ID NO: 2201139 - RNA, 22 nt, Human
uguucacaccuagcgucaguau

SEQ ID NO: 2201140 - RNA, 15 nt, Human
uguucacacucucac

SEQ ID NO: 2201141 - RNA, 16 nt, Human
uguucacacucucaca

SEQ ID NO: 2201142 - RNA, 19 nt, Human
uguucacacucucacaugu

SEQ ID NO: 2201143 - RNA, 22 nt, Human
uguucacacucucacauguuua

SEQ ID NO: 2201144 - RNA, 16 nt, Human
uguucaccaucggcag

SEQ ID NO: 2201145 - RNA, 20 nt, Human
uguucuuuccaaaguacacu

SEQ ID NO: 2201146 - RNA, 17 nt, Human
uguugaaaauguucaga

SEQ ID NO: 2201147 - RNA, 14 nt, Human
uguugaaaauguuc

SEQ ID NO: 2201148 - RNA, 22 nt, Human
uguucuuucuggcuaugcauuu

SEQ ID NO: 2201149 - RNA, 20 nt, Human
uguucuuucuggcuaugcau

SEQ ID NO: 2201150 - RNA, 11 nt, Human
uguugaaagau

SEQ ID NO: 2201151 - RNA, 24 nt, Human
uguugaaagguaauuugagagaaa

SEQ ID NO: 2201152 - RNA, 14 nt, Human
uguugaaauuaugu

SEQ ID NO: 2201153 - RNA, 22 nt, Human
uguugaaaauuauuuuaaacaa

SEQ ID NO: 2201154 - RNA, 15 nt, Human
uguugaaauuaugua

SEQ ID NO: 2201155 - RNA, 16 nt, Human
uguucuuucuggaguc

SEQ ID NO: 2201156 - RNA, 21 nt, Human
uguugaaaauuauuuuaaaca

SEQ ID NO: 2201157 - RNA, 22 nt, Human
uguucugauuagaaaugaccaa

SEQ ID NO: 2201158 - RNA, 23 nt, Human
uguucugcaaaaauauuuauaaa

SEQ ID NO: 2201159 - RNA, 17 nt, Human
uguucugcacacagcac

SEQ ID NO: 2201160 - RNA, 14 nt, Human
uguucuuucuggcu

SEQ ID NO: 2201161 - RNA, 19 nt, Human
uguucugauuagaaaugac

SEQ ID NO: 2201162 - RNA, 16 nt, Human
uguucugauuagaaau

SEQ ID NO: 2201163 - RNA, 14 nt, Human
uguucugauuagaa

SEQ ID NO: 2201164 - RNA, 22 nt, Human
uguucugacauuaacaguuuuc

SEQ ID NO: 2201165 - RNA, 20 nt, Human
uguucugacauuaacaguuu

SEQ ID NO: 2201166 - RNA, 19 nt, Human
uguucugacauuaacaguu

SEQ ID NO: 2201167 - RNA, 15 nt, Human
uguucugauaaugaa

SEQ ID NO: 2201168 - RNA, 18 nt, Human
uguucugacccugcuuca

SEQ ID NO: 2201169 - RNA, 17 nt, Human
uguucugacauuaacag

SEQ ID NO: 2201170 - RNA, 16 nt, Human
uguucugacauuaaca

SEQ ID NO: 2201171 - RNA, 15 nt, Human
uguucugacauuaac

SEQ ID NO: 2201172 - RNA, 13 nt, Human
uguucugacauua

SEQ ID NO: 2201173 - RNA, 15 nt, Human
uguucugaacugugg

SEQ ID NO: 2201174 - RNA, 18 nt, Human
uguucugaauaauuucuu

SEQ ID NO: 2201175 - RNA, 13 nt, Human
uguucugaacugu

SEQ ID NO: 2201176 - RNA, 15 nt, Human
uguucugacccugcu

SEQ ID NO: 2201177 - RNA, 19 nt, Human
uguucucugcccuccaaga

SEQ ID NO: 2201178 - RNA, 23 nt, Human
uguucucuugggaacugaacuca

SEQ ID NO: 2201179 - RNA, 21 nt, Human
uguucauuguaauguuacuga

SEQ ID NO: 2201180 - RNA, 20 nt, Human
uguucauuguaauguuacug

SEQ ID NO: 2201181 - RNA, 19 nt, Human
uguucauuguaauguuacu

SEQ ID NO: 2201182 - RNA, 18 nt, Human
uguucauuguaauguuac

SEQ ID NO: 2201183 - RNA, 16 nt, Human
uguucauuguaauguu

SEQ ID NO: 2201184 - RNA, 14 nt, Human
uguucauuguaaug

SEQ ID NO: 2201185 - RNA, 13 nt, Human
uguucauuguaau

SEQ ID NO: 2201186 - RNA, 23 nt, Human
uguucauuguaauguuacugauc

SEQ ID NO: 2201187 - RNA, 22 nt, Human
uguucauuguaauguuacugau

SEQ ID NO: 2201188 - RNA, 11 nt, Human
uguucauuucc

SEQ ID NO: 2201189 - RNA, 13 nt, Human
uguucauuuccuc

SEQ ID NO: 2201190 - RNA, 22 nt, Human
uguucauuuagauugaaaacuu

SEQ ID NO: 2201191 - RNA, 12 nt, Human
uguucauuguaa

SEQ ID NO: 2201192 - RNA, 22 nt, Human
uguucauuaaagcaugaauggu

SEQ ID NO: 2201193 - RNA, 15 nt, Human
uguucaguguaaaua

SEQ ID NO: 2201194 - RNA, 13 nt, Human
uguucaguguaau

SEQ ID NO: 2201195 - RNA, 15 nt, Human
uguucaguguaauuu

SEQ ID NO: 2201196 - RNA, 17 nt, Human
uguucaguguaauuucu

SEQ ID NO: 2201197 - RNA, 17 nt, Human
uguucagugucccgggc

SEQ ID NO: 2201198 - RNA, 21 nt, Human
uguucaguguaauuucuuugc

SEQ ID NO: 2201199 - RNA, 22 nt, Human
uguucaguguaauuucuuugcc

SEQ ID NO: 2201200 - RNA, 15 nt, Human
uguucaguuacagaa

SEQ ID NO: 2201201 - RNA, 16 nt, Human
uguucaguuacagaaa

SEQ ID NO: 2201202 - RNA, 17 nt, Human
uguucaguuacagaaag

SEQ ID NO: 2201203 - RNA, 18 nt, Human
uguucaguuacagaaagu

SEQ ID NO: 2201204 - RNA, 13 nt, Human
uguucauaaauaa

SEQ ID NO: 2201205 - RNA, 22 nt, Human
uguucuccuagacugacccuga

SEQ ID NO: 2201206 - RNA, 16 nt, Human
uguucuccgucccugc

SEQ ID NO: 2201207 - RNA, 20 nt, Human
uguucucagcucccccuguc

SEQ ID NO: 2201208 - RNA, 17 nt, Human
uguucucagcucccccu

SEQ ID NO: 2201209 - RNA, 18 nt, Human
uguucucagcucccccug

SEQ ID NO: 2201210 - RNA, 21 nt, Human
uguucuauuucagugccaaua

SEQ ID NO: 2201211 - RNA, 14 nt, Human
uguucucagcuccc

SEQ ID NO: 2201212 - RNA, 15 nt, Human
uguucucagcucccc

SEQ ID NO: 2201213 - RNA, 12 nt, Human
uguucuauagcu

SEQ ID NO: 2201214 - RNA, 22 nt, Human
uguucuaguuuucaguuuguau

SEQ ID NO: 2201215 - RNA, 16 nt, Human
uguucuauucaucuca

SEQ ID NO: 2201216 - RNA, 13 nt, Human
uguucucugagga

SEQ ID NO: 2201217 - RNA, 16 nt, Human
uguucucugaggacac

SEQ ID NO: 2201218 - RNA, 18 nt, Human
uguucucugaggacacua

SEQ ID NO: 2201219 - RNA, 12 nt, Human
uguucucugccc

SEQ ID NO: 2201220 - RNA, 14 nt, Human
uguuggccaggcug

SEQ ID NO: 2201221 - RNA, 18 nt, Human
uguuggccaggcugcucu

SEQ ID NO: 2201222 - RNA, 13 nt, Human
uguuggccaggcu

SEQ ID NO: 2201223 - RNA, 12 nt, Human
uguuguuucuuu

SEQ ID NO: 2201224 - RNA, 15 nt, Human
uguuguuucuuucua

SEQ ID NO: 2201225 - RNA, 13 nt, Human
uguuguuuuacua

SEQ ID NO: 2201226 - RNA, 18 nt, Human
uguuguuuuacuaaagaa

SEQ ID NO: 2201227 - RNA, 12 nt, Human
uguuguuugcca

SEQ ID NO: 2201228 - RNA, 13 nt, Human
uguuguuucuuuc

SEQ ID NO: 2201229 - RNA, 14 nt, Human
uguuguuucuuucu

SEQ ID NO: 2201230 - RNA, 12 nt, Human
uguuguuuguau

SEQ ID NO: 2201231 - RNA, 11 nt, Human
uguuguuuugu

SEQ ID NO: 2201232 - RNA, 20 nt, Human
uguuguuuuguuuuaaauac

SEQ ID NO: 2201233 - RNA, 16 nt, Human
uguuuacacacgugca

SEQ ID NO: 2201234 - RNA, 19 nt, Human
uguuuacacucuuuguaag

SEQ ID NO: 2201235 - RNA, 14 nt, Human
uguuuacagaggac

SEQ ID NO: 2201236 - RNA, 17 nt, Human
uguuuacagauccccaa

SEQ ID NO: 2201237 - RNA, 21 nt, Human
uguuuacagaggacaguauuu

SEQ ID NO: 2201238 - RNA, 15 nt, Human
uguuuacaagaaaaa

SEQ ID NO: 2201239 - RNA, 16 nt, Human
uguuuacacucuuugu

SEQ ID NO: 2201240 - RNA, 18 nt, Human
uguuuacacucuuuguaa

SEQ ID NO: 2201241 - RNA, 17 nt, Human
uguuuaauauuuaaaca

SEQ ID NO: 2201242 - RNA, 14 nt, Human
uguuuaauauuuaa

SEQ ID NO: 2201243 - RNA, 15 nt, Human
uguuuaauauuuaaa

SEQ ID NO: 2201244 - RNA, 13 nt, Human
uguuuaaaaucau

SEQ ID NO: 2201245 - RNA, 14 nt, Human
uguuuaaaaucauu

SEQ ID NO: 2201246 - RNA, 14 nt, Human
uguuuaaaaggauu

SEQ ID NO: 2201247 - RNA, 17 nt, Human
uguuggauuuuugucuu

SEQ ID NO: 2201248 - RNA, 17 nt, Human
uguuggauuuauaaaug

SEQ ID NO: 2201249 - RNA, 19 nt, Human
uguuggauuuauaaaugcu

SEQ ID NO: 2201250 - RNA, 23 nt, Human
uguuggauuuauaaaugcuauuu

SEQ ID NO: 2201251 - RNA, 20 nt, Human
uguuggauuuguuuaaaagg

SEQ ID NO: 2201252 - RNA, 20 nt, Human
uguuggauaaaucagugguu

SEQ ID NO: 2201253 - RNA, 19 nt, Human
uguuggauaaaucaguggu

SEQ ID NO: 2201254 - RNA, 11 nt, Human
uguuggaucuu

SEQ ID NO: 2201255 - RNA, 14 nt, Human
uguuggaucuucaa

SEQ ID NO: 2201256 - RNA, 21 nt, Human
uguuggaucuucaauggcuuu

SEQ ID NO: 2201257 - RNA, 11 nt, Human
uguuggccagg

SEQ ID NO: 2201258 - RNA, 13 nt, Human
uguuggaaaagaa

SEQ ID NO: 2201259 - RNA, 14 nt, Human
uguuggagccugca

SEQ ID NO: 2201260 - RNA, 21 nt, Human
uguugcuuuugugaacuuuuu

SEQ ID NO: 2201261 - RNA, 21 nt, Human
uguuggagaagaacugaaauc

SEQ ID NO: 2201262 - RNA, 14 nt, Human
uguugcuuggacua

SEQ ID NO: 2201263 - RNA, 15 nt, Human
uguugcuuacaauuu

SEQ ID NO: 2201264 - RNA, 16 nt, Human
uguugcuuacaauuuu

SEQ ID NO: 2201265 - RNA, 16 nt, Human
uguugcuuagucacuu

SEQ ID NO: 2201266 - RNA, 20 nt, Human
uguugcuuagucacuuauuu

SEQ ID NO: 2201267 - RNA, 14 nt, Human
uguugcugccucau

SEQ ID NO: 2201268 - RNA, 16 nt, Human
uguugcuguugauguu

SEQ ID NO: 2201269 - RNA, 13 nt, Human
uguugcuuacaau

SEQ ID NO: 2201270 - RNA, 14 nt, Human
uguugcuuacaauu

SEQ ID NO: 2201271 - RNA, 17 nt, Human
uguugagccaggccugg

SEQ ID NO: 2201272 - RNA, 18 nt, Human
uguugagaauugugcuca

SEQ ID NO: 2201273 - RNA, 23 nt, Human
uguugagaaucccaaauuugauu

SEQ ID NO: 2201274 - RNA, 21 nt, Human
uguugaaauuauguauguuua

SEQ ID NO: 2201275 - RNA, 22 nt, Human
uguugaaauuauguauguuuac

SEQ ID NO: 2201276 - RNA, 22 nt, Human
uguugauaaauuccacuggacu

SEQ ID NO: 2201277 - RNA, 19 nt, Human
uguugauaaauuccacugg

SEQ ID NO: 2201278 - RNA, 21 nt, Human
uguugagguggucugaauguu

SEQ ID NO: 2201279 - RNA, 20 nt, Human
uguugagguggucugaaugu

SEQ ID NO: 2201280 - RNA, 23 nt, Human
uguugagguggucugaauguucu

SEQ ID NO: 2201281 - RNA, 13 nt, Human
uguugagcuguuu

SEQ ID NO: 2201282 - RNA, 19 nt, Human
uguugagguggucugaaug

SEQ ID NO: 2201283 - RNA, 16 nt, Human
uguugagccuuuuccc

SEQ ID NO: 2201284 - RNA, 18 nt, Human
uguugagccuuuucccuc

SEQ ID NO: 2201285 - RNA, 13 nt, Human
uguugcugccaac

SEQ ID NO: 2201286 - RNA, 14 nt, Human
uguugcugccaacc

SEQ ID NO: 2201287 - RNA, 13 nt, Human
uguugcugccuca

SEQ ID NO: 2201288 - RNA, 14 nt, Human
uguugcugaauagg

SEQ ID NO: 2201289 - RNA, 23 nt, Human
uguugcugaauaggcgaucacaa

SEQ ID NO: 2201290 - RNA, 15 nt, Human
uguuuugguuugcua

SEQ ID NO: 2201291 - RNA, 20 nt, Human
uguuuuggggaugagagggu

SEQ ID NO: 2201292 - RNA, 16 nt, Human
uguuuugguaucuguu

SEQ ID NO: 2201293 - RNA, 22 nt, Human
uguuuugguaucuguucuuuaa

SEQ ID NO: 2201294 - RNA, 20 nt, Human
uguuuuuaugaagaaaaaau

SEQ ID NO: 2201295 - RNA, 13 nt, Human
uguuuuucacauu

SEQ ID NO: 2201296 - RNA, 13 nt, Human
uguuuuucaugaa

SEQ ID NO: 2201297 - RNA, 20 nt, Human
uguuuuaaacauagaaaguu

SEQ ID NO: 2201298 - RNA, 22 nt, Human
uguuuuaaauacgcacuacaug

SEQ ID NO: 2201299 - RNA, 23 nt, Human
uguuuuaaaaugagaaaucuaaa

SEQ ID NO: 2201300 - RNA, 20 nt, Human
uguuuugcuuuuucugacuc

SEQ ID NO: 2201301 - RNA, 18 nt, Human
uguuuuggcugaaauucu

SEQ ID NO: 2201302 - RNA, 23 nt, Human
uguuuuggcugaaauucuccugg

SEQ ID NO: 2201303 - RNA, 16 nt, Human
uguuuugcuuuuucug

SEQ ID NO: 2201304 - RNA, 17 nt, Human
uguuuugcuuuuucuga

SEQ ID NO: 2201305 - RNA, 18 nt, Human
uguuuugcuuuuucugac

SEQ ID NO: 2201306 - RNA, 13 nt, Human
uguuuuugucuua

SEQ ID NO: 2201307 - RNA, 20 nt, Human
uguuuuuccuuguauuuaaa

SEQ ID NO: 2201308 - RNA, 11 nt, Human
uguuuuucauu

SEQ ID NO: 2201309 - RNA, 14 nt, Human
uguuuuucaugaaa

SEQ ID NO: 2201310 - RNA, 20 nt, Human
uuaaaacaauauuguuucua

SEQ ID NO: 2201311 - RNA, 19 nt, Human
uguuuuuugaaaacauggu

SEQ ID NO: 2201312 - RNA, 16 nt, Human
uguuuuuugaaaacau

SEQ ID NO: 2201313 - RNA, 14 nt, Human
uguuuuuugaaaac

SEQ ID NO: 2201314 - RNA, 12 nt, Human
uguuuuuucuaa

SEQ ID NO: 2201315 - RNA, 21 nt, Human
uguuuuuuagaucaaauacuu

SEQ ID NO: 2201316 - RNA, 15 nt, Human
uguuuuuucugccac

SEQ ID NO: 2201317 - RNA, 17 nt, Human
uguuuuuuccugagcuu

SEQ ID NO: 2201318 - RNA, 17 nt, Human
uguuuuuuagaucaaau

SEQ ID NO: 2201319 - RNA, 22 nt, Human
uguuuguuucucccccugggcu

SEQ ID NO: 2201320 - RNA, 12 nt, Human
uguuuuaaaaaa

SEQ ID NO: 2201321 - RNA, 23 nt, Human
uguuuuaaaauaaaaauucugaa

SEQ ID NO: 2201322 - RNA, 20 nt, Human
uguuuuaaaaagaaacaaga

SEQ ID NO: 2201323 - RNA, 12 nt, Human
uguuuuaaaaag

SEQ ID NO: 2201324 - RNA, 17 nt, Human
uguuuguuuccuuuguu

SEQ ID NO: 2201325 - RNA, 18 nt, Human
uguuuuaaaaugagaaau

SEQ ID NO: 2201326 - RNA, 15 nt, Human
uguuucucugcuguu

SEQ ID NO: 2201327 - RNA, 14 nt, Human
uguuucucugcugu

SEQ ID NO: 2201328 - RNA, 13 nt, Human
uguuucucugcug

SEQ ID NO: 2201329 - RNA, 16 nt, Human
uguuuguugucagcug

SEQ ID NO: 2201330 - RNA, 17 nt, Human
uguuuguugucagcuga

SEQ ID NO: 2201331 - RNA, 14 nt, Human
uguuucucuuuccu

SEQ ID NO: 2201332 - RNA, 20 nt, Human
uguuuacagggagccuccug

SEQ ID NO: 2201333 - RNA, 21 nt, Human
uguuuacagggagccuccugc

SEQ ID NO: 2201334 - RNA, 19 nt, Human
uguuucuauugacuucaau

SEQ ID NO: 2201335 - RNA, 15 nt, Human
uguuucuagggaaau

SEQ ID NO: 2201336 - RNA, 23 nt, Human
uguuuacagggagccuccugccc

SEQ ID NO: 2201337 - RNA, 16 nt, Human
uguuucucccccuggg

SEQ ID NO: 2201338 - RNA, 15 nt, Human
uguuucucccccugg

SEQ ID NO: 2201339 - RNA, 22 nt, Human
uguuuacagggagccuccugcc

SEQ ID NO: 2201340 - RNA, 23 nt, Human
uguuucucccccugggcucugcc

SEQ ID NO: 2201341 - RNA, 17 nt, Human
uguuucucccccugggc

SEQ ID NO: 2201342 - RNA, 15 nt, Human
uguuucucccucuca

SEQ ID NO: 2201343 - RNA, 17 nt, Human
uguuucuccuucugaaa

SEQ ID NO: 2201344 - RNA, 20 nt, Human
uguuuccuggcacugcuucc

SEQ ID NO: 2201345 - RNA, 20 nt, Human
uguuuacagcacuacucugu

SEQ ID NO: 2201346 - RNA, 21 nt, Human
uguuuacagcacuacucugug

SEQ ID NO: 2201347 - RNA, 22 nt, Human
uguuuacagcacuacucugugc

SEQ ID NO: 2201348 - RNA, 23 nt, Human
uguuuacagcacuacucugugcc

SEQ ID NO: 2201349 - RNA, 17 nt, Human
uguuuacagggagccuc

SEQ ID NO: 2201350 - RNA, 21 nt, Human
uguuuccuggcacugcuucca

SEQ ID NO: 2201351 - RNA, 22 nt, Human
uguuuccuggcacugcuuccag

SEQ ID NO: 2201352 - RNA, 13 nt, Human
uuaaauggacaga

SEQ ID NO: 2201353 - RNA, 20 nt, Human
uuaaauggaaaaaaugaugu

SEQ ID NO: 2201354 - RNA, 21 nt, Human
uuaaauggguagagaaacacu

SEQ ID NO: 2201355 - RNA, 23 nt, Human
uuaaaugggcuacuuuguccuuu

SEQ ID NO: 2201356 - RNA, 17 nt, Human
uuaaauguaaagauauu

SEQ ID NO: 2201357 - RNA, 13 nt, Human
uuaaauguaaaga

SEQ ID NO: 2201358 - RNA, 17 nt, Human
uuaaaugcccagccccu

SEQ ID NO: 2201359 - RNA, 18 nt, Human
uuaaaugcccagccccuu

SEQ ID NO: 2201360 - RNA, 15 nt, Human
uuaacauucauagag

SEQ ID NO: 2201361 - RNA, 17 nt, Human
uuaacauauuuacuaag

SEQ ID NO: 2201362 - RNA, 16 nt, Human
uuaaauguaaauaauc

SEQ ID NO: 2201363 - RNA, 23 nt, Human
uuaaagcaacugucuauuucugc

SEQ ID NO: 2201364 - RNA, 14 nt, Human
uuaaagcuguuauu

SEQ ID NO: 2201365 - RNA, 15 nt, Human
uuaaauauaauaugc

SEQ ID NO: 2201366 - RNA, 18 nt, Human
uuaaauaggauauuaaca

SEQ ID NO: 2201367 - RNA, 18 nt, Human
uuaaauaguaaaaauaaa

SEQ ID NO: 2201368 - RNA, 12 nt, Human
uuaaauauaauu

SEQ ID NO: 2201369 - RNA, 13 nt, Human
uuaaauauaauuc

SEQ ID NO: 2201370 - RNA, 14 nt, Human
uuaaauauaauucu

SEQ ID NO: 2201371 - RNA, 16 nt, Human
uuaaauauaauucugu

SEQ ID NO: 2201372 - RNA, 17 nt, Human
uuaaauauaauucugua

SEQ ID NO: 2201373 - RNA, 18 nt, Human
uuaaauauaauucuguaa

SEQ ID NO: 2201374 - RNA, 19 nt, Human
uuaaauauaauucuguaaa

SEQ ID NO: 2201375 - RNA, 20 nt, Human
uuaaauauaauucuguaaau

SEQ ID NO: 2201376 - RNA, 16 nt, Human
uuaaaugcaccuggaa

SEQ ID NO: 2201377 - RNA, 18 nt, Human
uuaaaugcaccuggaaua

SEQ ID NO: 2201378 - RNA, 17 nt, Human
uuaaaugcaccuggaau

SEQ ID NO: 2201379 - RNA, 14 nt, Human
uuaaagcaaaggag

SEQ ID NO: 2201380 - RNA, 21 nt, Human
uuaaagauuuaucaaaucagu

SEQ ID NO: 2201381 - RNA, 19 nt, Human
uuaaagcuaaaguaucugu

SEQ ID NO: 2201382 - RNA, 14 nt, Human
uuaaagccuccuca

SEQ ID NO: 2201383 - RNA, 13 nt, Human
uuaaagauguucc

SEQ ID NO: 2201384 - RNA, 14 nt, Human
uuaaagauuuauca

SEQ ID NO: 2201385 - RNA, 17 nt, Human
uuaaagauuuaucaaau

SEQ ID NO: 2201386 - RNA, 18 nt, Human
uuaaagcugccuguaguu

SEQ ID NO: 2201387 - RNA, 17 nt, Human
uuaaagcugccuguagu

SEQ ID NO: 2201388 - RNA, 15 nt, Human
uuaaagcugccugua

SEQ ID NO: 2201389 - RNA, 14 nt, Human
uuaaagcugccugu

SEQ ID NO: 2201390 - RNA, 20 nt, Human
uuaaagcuuauuaaaacuca

SEQ ID NO: 2201391 - RNA, 14 nt, Human
uuaaagacuuuuau

SEQ ID NO: 2201392 - RNA, 20 nt, Human
uuaaacuuaaucuaaaugga

SEQ ID NO: 2201393 - RNA, 14 nt, Human
uuaaagagagguua

SEQ ID NO: 2201394 - RNA, 20 nt, Human
uuaaagagagguuauagagu

SEQ ID NO: 2201395 - RNA, 13 nt, Human
uuaaagagagguu

SEQ ID NO: 2201396 - RNA, 14 nt, Human
uuaaaagacacugu

SEQ ID NO: 2201397 - RNA, 16 nt, Human
uuaaaagacaagacuu

SEQ ID NO: 2201398 - RNA, 17 nt, Human
uuaaaagacaagacuuc

SEQ ID NO: 2201399 - RNA, 21 nt, Human
uuaaaagaaugggcaguuaca

SEQ ID NO: 2201400 - RNA, 22 nt, Human
uuaaaagaaugggcaguuacau

SEQ ID NO: 2201401 - RNA, 12 nt, Human
uuaaaagacaag

SEQ ID NO: 2201402 - RNA, 15 nt, Human
uuaaaagacaagacu

SEQ ID NO: 2201403 - RNA, 18 nt, Human
uuaaaagauaaauauuau

SEQ ID NO: 2201404 - RNA, 18 nt, Human
uuaaacuuaaucuaaaug

SEQ ID NO: 2201405 - RNA, 16 nt, Human
uuaaacuuaaucuaaa

SEQ ID NO: 2201406 - RNA, 14 nt, Human
uuaaaacagacacu

SEQ ID NO: 2201407 - RNA, 21 nt, Human
uuaaaacagacacuggcaugg

SEQ ID NO: 2201408 - RNA, 13 nt, Human
uuaaaagaaugau

SEQ ID NO: 2201409 - RNA, 13 nt, Human
uuaaaacauguaa

SEQ ID NO: 2201410 - RNA, 14 nt, Human
uuaaaacauguaau

SEQ ID NO: 2201411 - RNA, 14 nt, Human
uuaaaaccaaagag

SEQ ID NO: 2201412 - RNA, 13 nt, Human
uuaaaagaauggg

SEQ ID NO: 2201413 - RNA, 20 nt, Human
uuaaaagaaugggcaguuac

SEQ ID NO: 2201414 - RNA, 19 nt, Human
uuaaaagaaugauuaugaa

SEQ ID NO: 2201415 - RNA, 20 nt, Human
uuaccuuuuuauuugcaugu

SEQ ID NO: 2201416 - RNA, 15 nt, Human
uuaccuuuuuugaua

SEQ ID NO: 2201417 - RNA, 17 nt, Human
uuaccuuuuuugauaaa

SEQ ID NO: 2201418 - RNA, 23 nt, Human
uuaccuuuuuugauaaaguuucu

SEQ ID NO: 2201419 - RNA, 22 nt, Human
uuaccuuuuuuauacauaaaca

SEQ ID NO: 2201420 - RNA, 20 nt, Human
uuaccuuuuuuauacauaaa

SEQ ID NO: 2201421 - RNA, 19 nt, Human
uuaccuuuuuuauacauaa

SEQ ID NO: 2201422 - RNA, 16 nt, Human
uuacggacacccccuc

SEQ ID NO: 2201423 - RNA, 12 nt, Human
uuacgugagcca

SEQ ID NO: 2201424 - RNA, 20 nt, Human
uuacgguuuuccagguuuaa

SEQ ID NO: 2201425 - RNA, 20 nt, Human
uuacgcacacguacuuaaau

SEQ ID NO: 2201426 - RNA, 18 nt, Human
uuacgcccaacccuuccc

SEQ ID NO: 2201427 - RNA, 13 nt, Human
uuacgcuuugauu

SEQ ID NO: 2201428 - RNA, 16 nt, Human
uuacgcuuugauucau

SEQ ID NO: 2201429 - RNA, 15 nt, Human
uuacgcuuugauuca

SEQ ID NO: 2201430 - RNA, 22 nt, Human
uuaccagacgguucaccagccu

SEQ ID NO: 2201431 - RNA, 21 nt, Human
uuaccagacgguucaccagcc

SEQ ID NO: 2201432 - RNA, 17 nt, Human
uuaccagaagcuuccau

SEQ ID NO: 2201433 - RNA, 14 nt, Human
uuaccacucaggca

SEQ ID NO: 2201434 - RNA, 12 nt, Human
uuaccacucagg

SEQ ID NO: 2201435 - RNA, 21 nt, Human
uuaccacuuguguuuugcaag

SEQ ID NO: 2201436 - RNA, 14 nt, Human
uuaccagcagagca

SEQ ID NO: 2201437 - RNA, 18 nt, Human
uuaccuuuuuauuugcau

SEQ ID NO: 2201438 - RNA, 15 nt, Human
uuaccuuuuuauuug

SEQ ID NO: 2201439 - RNA, 24 nt, Human
uuaccagauuuuuacacauguauc

SEQ ID NO: 2201440 - RNA, 21 nt, Human
uuaccagauuuuuacacaugu

SEQ ID NO: 2201441 - RNA, 18 nt, Human
uuaccagauaaugcuacu

SEQ ID NO: 2201442 - RNA, 19 nt, Human
uuaccagauaaugcuacuu

SEQ ID NO: 2201443 - RNA, 23 nt, Human
uuacauuuuuaagugcugcauuu

SEQ ID NO: 2201444 - RNA, 22 nt, Human
uuacauuuuuaagugcugcauu

SEQ ID NO: 2201445 - RNA, 21 nt, Human
uuacauuuuuaagugcugcau

SEQ ID NO: 2201446 - RNA, 20 nt, Human
uuacauuuuuaagugcugca

SEQ ID NO: 2201447 - RNA, 18 nt, Human
uuacagagaggagaaaca

SEQ ID NO: 2201448 - RNA, 17 nt, Human
uuacagagaggagaaac

SEQ ID NO: 2201449 - RNA, 14 nt, Human
uuacagagaggaga

SEQ ID NO: 2201450 - RNA, 22 nt, Human
uuacagagaggagaaacacauc

SEQ ID NO: 2201451 - RNA, 20 nt, Human
uuacagagaggagaaacaca

SEQ ID NO: 2201452 - RNA, 16 nt, Human
uuacagaggaaguuau

SEQ ID NO: 2201453 - RNA, 15 nt, Human
uuacagaggacagua

SEQ ID NO: 2201454 - RNA, 17 nt, Human
uuacaaucauugcugaa

SEQ ID NO: 2201455 - RNA, 22 nt, Human
uuacaaucauugcugaaaaugg

SEQ ID NO: 2201456 - RNA, 23 nt, Human
uuacaaucauugcugaaaauggu

SEQ ID NO: 2201457 - RNA, 20 nt, Human
uuacagagacagaaagcaga

SEQ ID NO: 2201458 - RNA, 21 nt, Human
uuacaauaaaacuuugcugcc

SEQ ID NO: 2201459 - RNA, 16 nt, Human
uuacaaguguauauca

SEQ ID NO: 2201460 - RNA, 13 nt, Human
uuaauucauguuu

SEQ ID NO: 2201461 - RNA, 15 nt, Human
uuaauucacucccac

SEQ ID NO: 2201462 - RNA, 14 nt, Human
uuacaaguguauau

SEQ ID NO: 2201463 - RNA, 16 nt, Human
uuaauucaccaaagua

SEQ ID NO: 2201464 - RNA, 22 nt, Human
uuaauucagcacugauuucaca

SEQ ID NO: 2201465 - RNA, 14 nt, Human
uuaauuauuguaca

SEQ ID NO: 2201466 - RNA, 21 nt, Human
uuaauuauuauuuguguuuua

SEQ ID NO: 2201467 - RNA, 23 nt, Human
uuacaauaaaaucuugaaaaugc

SEQ ID NO: 2201468 - RNA, 12 nt, Human
uuacaaucaaag

SEQ ID NO: 2201469 - RNA, 22 nt, Human
uuacauguuuucuuugcuuuaa

SEQ ID NO: 2201470 - RNA, 14 nt, Human
uuacauuaauguua

SEQ ID NO: 2201471 - RNA, 16 nt, Human
uuacauuaauguuaau

SEQ ID NO: 2201472 - RNA, 14 nt, Human
uuacauuuccuaaa

SEQ ID NO: 2201473 - RNA, 14 nt, Human
uuacauuuguauaa

SEQ ID NO: 2201474 - RNA, 15 nt, Human
uuacauuuguauaaa

SEQ ID NO: 2201475 - RNA, 18 nt, Human
uuacauguuuucuuugcu

SEQ ID NO: 2201476 - RNA, 12 nt, Human
uuacauguuuuc

SEQ ID NO: 2201477 - RNA, 17 nt, Human
uuacauguauuauuuca

SEQ ID NO: 2201478 - RNA, 22 nt, Human
uuacaugguuaagguaaaguaa

SEQ ID NO: 2201479 - RNA, 23 nt, Human
uuacagauaguaucuagcaauca

SEQ ID NO: 2201480 - RNA, 12 nt, Human
uuacauggcucu

SEQ ID NO: 2201481 - RNA, 20 nt, Human
uuacagaugaauguauuuau

SEQ ID NO: 2201482 - RNA, 16 nt, Human
uuaauauggggaugca

SEQ ID NO: 2201483 - RNA, 22 nt, Human
uuaauauggggaugcagcauua

SEQ ID NO: 2201484 - RNA, 13 nt, Human
uuaauauggcucu

SEQ ID NO: 2201485 - RNA, 17 nt, Human
uuaauaugaaaacuuau

SEQ ID NO: 2201486 - RNA, 16 nt, Human
uuaauaugaaaacuua

SEQ ID NO: 2201487 - RNA, 15 nt, Human
uuaauaugaaaacuu

SEQ ID NO: 2201488 - RNA, 14 nt, Human
uuaauaugaaaacu

SEQ ID NO: 2201489 - RNA, 12 nt, Human
uuaauaugaaaa

SEQ ID NO: 2201490 - RNA, 23 nt, Human
uuaauauguuaaccucaguguca

SEQ ID NO: 2201491 - RNA, 15 nt, Human
uuaaugccuuuaaag

SEQ ID NO: 2201492 - RNA, 18 nt, Human
uuaaugccuuuaaaguau

SEQ ID NO: 2201493 - RNA, 14 nt, Human
uuaauaguguuaau

SEQ ID NO: 2201494 - RNA, 15 nt, Human
uuaauaguguuaauc

SEQ ID NO: 2201495 - RNA, 16 nt, Human
uuaauaguguuaauca

SEQ ID NO: 2201496 - RNA, 17 nt, Human
uuaauaguguuaaucaa

SEQ ID NO: 2201497 - RNA, 18 nt, Human
uuaauaguguuaaucaau

SEQ ID NO: 2201498 - RNA, 21 nt, Human
uuaauaguguuaaucaauuua

SEQ ID NO: 2201499 - RNA, 20 nt, Human
uuaauagcuuuuauuguaua

SEQ ID NO: 2201500 - RNA, 22 nt, Human
uuaauagcuuuuauuguauaaa

SEQ ID NO: 2201501 - RNA, 15 nt, Human
uuaauaucaucagua

SEQ ID NO: 2201502 - RNA, 19 nt, Human
uuaauaguguuaaucaauu

SEQ ID NO: 2201503 - RNA, 18 nt, Human
uuaauaucaucaguauug

SEQ ID NO: 2201504 - RNA, 22 nt, Human
uuaauauaaaguaguccuguga

SEQ ID NO: 2201505 - RNA, 23 nt, Human
uuaauauaaaguaguccugugaa

SEQ ID NO: 2201506 - RNA, 19 nt, Human
uuaauaucccuacauguau

SEQ ID NO: 2201507 - RNA, 20 nt, Human
uuaauaucccuacauguauu

SEQ ID NO: 2201508 - RNA, 17 nt, Human
uuaaugucacaggcagg

SEQ ID NO: 2201509 - RNA, 22 nt, Human
uuaaugucaauucuugccaaau

SEQ ID NO: 2201510 - RNA, 22 nt, Human
uuaauggacaugagauaauguu

SEQ ID NO: 2201511 - RNA, 23 nt, Human
uuaauggcaaggcagcccugucu

SEQ ID NO: 2201512 - RNA, 22 nt, Human
uuaauggccggcuggaaaugcu

SEQ ID NO: 2201513 - RNA, 14 nt, Human
uuaauggaaauguu

SEQ ID NO: 2201514 - RNA, 18 nt, Human
uuaaugcuuuuauauuuu

SEQ ID NO: 2201515 - RNA, 15 nt, Human
uuaaugcuucuuuca

SEQ ID NO: 2201516 - RNA, 19 nt, Human
uuaauggacaugagauaau

SEQ ID NO: 2201517 - RNA, 18 nt, Human
uuaaugucacaggcaggu

SEQ ID NO: 2201518 - RNA, 16 nt, Human
uuaauuagugcuaagu

SEQ ID NO: 2201519 - RNA, 18 nt, Human
uuaauuagugcuaagugu

SEQ ID NO: 2201520 - RNA, 20 nt, Human
uuaauuagugcuaaguguga

SEQ ID NO: 2201521 - RNA, 14 nt, Human
uuaauuauuauucu

SEQ ID NO: 2201522 - RNA, 17 nt, Human
uuaauuauuauucuuca

SEQ ID NO: 2201523 - RNA, 14 nt, Human
uuaauuauuauuua

SEQ ID NO: 2201524 - RNA, 14 nt, Human
uuaauuauuauuug

SEQ ID NO: 2201525 - RNA, 21 nt, Human
uuaauuagugcuaagugugaa

SEQ ID NO: 2201526 - RNA, 23 nt, Human
uuaauuauaccauggugaauuaa

SEQ ID NO: 2201527 - RNA, 15 nt, Human
uuaauuaucuuuucu

SEQ ID NO: 2201528 - RNA, 22 nt, Human
uuaauuaugccuuuuuugauca

SEQ ID NO: 2201529 - RNA, 18 nt, Human
uuaauagcuuuuauugua

SEQ ID NO: 2201530 - RNA, 18 nt, Human
uuaagggaagaauuccag

SEQ ID NO: 2201531 - RNA, 18 nt, Human
uuaauaauguuucaaaca

SEQ ID NO: 2201532 - RNA, 20 nt, Human
uuaaggauugugauauuuuu

SEQ ID NO: 2201533 - RNA, 15 nt, Human
uuaaggauuuuaugc

SEQ ID NO: 2201534 - RNA, 13 nt, Human
uuaaggauuuuau

SEQ ID NO: 2201535 - RNA, 22 nt, Human
uuaaggaugcuuguacauaaug

SEQ ID NO: 2201536 - RNA, 23 nt, Human
uuaaggcugaggaaaggccagcu

SEQ ID NO: 2201537 - RNA, 20 nt, Human
uuaaggauuuuaugcuuuaa

SEQ ID NO: 2201538 - RNA, 18 nt, Human
uuaaggauuuuaugcuuu

SEQ ID NO: 2201539 - RNA, 16 nt, Human
uuaauaauguuucaaa

SEQ ID NO: 2201540 - RNA, 12 nt, Human
uuaagcuuauuu

SEQ ID NO: 2201541 - RNA, 14 nt, Human
uuaagcuguuucca

SEQ ID NO: 2201542 - RNA, 14 nt, Human
uuaacauucuguaa

SEQ ID NO: 2201543 - RNA, 21 nt, Human
uuaaggaagacaaugugaaaa

SEQ ID NO: 2201544 - RNA, 19 nt, Human
uuaaggacaaaaaugaacu

SEQ ID NO: 2201545 - RNA, 20 nt, Human
uuaaggaaacucuuaucuca

SEQ ID NO: 2201546 - RNA, 12 nt, Human
uuaaggaaacaa

SEQ ID NO: 2201547 - RNA, 14 nt, Human
uuaaggaaacaaua

SEQ ID NO: 2201548 - RNA, 14 nt, Human
uuaaggaaacucuu

SEQ ID NO: 2201549 - RNA, 16 nt, Human
uuaaggaaacucuuau

SEQ ID NO: 2201550 - RNA, 20 nt, Human
uuaaggaugcuuguacauaa

SEQ ID NO: 2201551 - RNA, 19 nt, Human
uuaaggaugcuuguacaua

SEQ ID NO: 2201552 - RNA, 18 nt, Human
uuaaggaugcuuguacau

SEQ ID NO: 2201553 - RNA, 17 nt, Human
uuaaggaugcuuguaca

SEQ ID NO: 2201554 - RNA, 19 nt, Human
ugcguaugucuguuaccau

SEQ ID NO: 2201555 - RNA, 14 nt, Human
ugcguaugucuguu

SEQ ID NO: 2201556 - RNA, 17 nt, Human
ugcguaacuggcugugu

SEQ ID NO: 2201557 - RNA, 23 nt, Human
ugcguacguuuccugagaagugu

SEQ ID NO: 2201558 - RNA, 20 nt, Human
ugcguacguuuccugagaag

SEQ ID NO: 2201559 - RNA, 15 nt, Human
ugcguacguuuccug

SEQ ID NO: 2201560 - RNA, 16 nt, Human
ugcguaacuggcugug

SEQ ID NO: 2201561 - RNA, 21 nt, Human
ugcgguuuguuggaucuucaa

SEQ ID NO: 2201562 - RNA, 15 nt, Human
ugcgugcauaccacu

SEQ ID NO: 2201563 - RNA, 16 nt, Human
ugcguggacucugcac

SEQ ID NO: 2201564 - RNA, 17 nt, Human
ugcguggacucugcaca

SEQ ID NO: 2201565 - RNA, 19 nt, Human
ugcguggcauagcccagac

SEQ ID NO: 2201566 - RNA, 18 nt, Human
ugcguggacucugcacau

SEQ ID NO: 2201567 - RNA, 22 nt, Human
ugcguggacucugcacaugucu

SEQ ID NO: 2201568 - RNA, 13 nt, Human
ugcgugucguggg

SEQ ID NO: 2201569 - RNA, 18 nt, Human
ugcuagaacucccuuuca

SEQ ID NO: 2201570 - RNA, 19 nt, Human
ugcuagaacucccuuucaa

SEQ ID NO: 2201571 - RNA, 20 nt, Human
ugcuagcacuuggagccaag

SEQ ID NO: 2201572 - RNA, 16 nt, Human
ugcuaggaacacuccu

SEQ ID NO: 2201573 - RNA, 17 nt, Human
ugcuaggaacacuccuu

SEQ ID NO: 2201574 - RNA, 19 nt, Human
ugcuaggaacacuccuuca

SEQ ID NO: 2201575 - RNA, 18 nt, Human
ugcuagcacuuggagcca

SEQ ID NO: 2201576 - RNA, 19 nt, Human
ugcuagaugugcaaaugca

SEQ ID NO: 2201577 - RNA, 20 nt, Human
ugcuagaugugcaaaugcaa

SEQ ID NO: 2201578 - RNA, 18 nt, Human
ugcgugugcgugcaugug

SEQ ID NO: 2201579 - RNA, 17 nt, Human
ugcuagacacauuuuua

SEQ ID NO: 2201580 - RNA, 21 nt, Human
ugcuagaacucccuuucaaca

SEQ ID NO: 2201581 - RNA, 20 nt, Human
ugcuagaacucccuuucaac

SEQ ID NO: 2201582 - RNA, 21 nt, Human
ugcucagcuucuccuguguga

SEQ ID NO: 2201583 - RNA, 23 nt, Human
ugcucaggacucagaagccucug

SEQ ID NO: 2201584 - RNA, 17 nt, Human
ugcucaggacucagaag

SEQ ID NO: 2201585 - RNA, 14 nt, Human
ugcucaggacucag

SEQ ID NO: 2201586 - RNA, 14 nt, Human
ugcucaggagcccu

SEQ ID NO: 2201587 - RNA, 20 nt, Human
ugcucagcuucuccugugug

SEQ ID NO: 2201588 - RNA, 15 nt, Human
ugcucagcuucuccu

SEQ ID NO: 2201589 - RNA, 12 nt, Human
ugcucagcuucu

SEQ ID NO: 2201590 - RNA, 20 nt, Human
ugcucagcucugggccauuc

SEQ ID NO: 2201591 - RNA, 18 nt, Human
ugcucagcucugggccau

SEQ ID NO: 2201592 - RNA, 20 nt, Human
ugcuaggugggccagccccu

SEQ ID NO: 2201593 - RNA, 19 nt, Human
ugcuaggugggccagcccc

SEQ ID NO: 2201594 - RNA, 17 nt, Human
ugcuaggugggccagcc

SEQ ID NO: 2201595 - RNA, 15 nt, Human
ugcuaggugggccag

SEQ ID NO: 2201596 - RNA, 16 nt, Human
ugcuagguuaauucca

SEQ ID NO: 2201597 - RNA, 23 nt, Human
ugcuaggugggccagccccuccc

SEQ ID NO: 2201598 - RNA, 21 nt, Human
ugcuaggugggccagccccuc

SEQ ID NO: 2201599 - RNA, 23 nt, Human
ugcuagguuaauuccaauuauau

SEQ ID NO: 2201600 - RNA, 14 nt, Human
ugcuaggugggcca

SEQ ID NO: 2201601 - RNA, 22 nt, Human
ugcuaggucucggacuaagccu

SEQ ID NO: 2201602 - RNA, 14 nt, Human
ugcuaggucucgga

SEQ ID NO: 2201603 - RNA, 21 nt, Human
ugcuagggguuuuaggucucu

SEQ ID NO: 2201604 - RNA, 22 nt, Human
ugcuagggaaacuucccguccc

SEQ ID NO: 2201605 - RNA, 20 nt, Human
ugcuagggguuuuaggucuc

SEQ ID NO: 2201606 - RNA, 21 nt, Human
ugcuaggcgagugccaggacu

SEQ ID NO: 2201607 - RNA, 16 nt, Human
ugcuagcucugagcca

SEQ ID NO: 2201608 - RNA, 18 nt, Human
ugcuagcucugagccagu

SEQ ID NO: 2201609 - RNA, 22 nt, Human
ugcuaggcgagugccaggacuc

SEQ ID NO: 2201610 - RNA, 17 nt, Human
ugcuagggaaacuuccc

SEQ ID NO: 2201611 - RNA, 22 nt, Human
ugcucaucauuccuugagaaaa

SEQ ID NO: 2201612 - RNA, 17 nt, Human
ugcucaucauucucugu

SEQ ID NO: 2201613 - RNA, 15 nt, Human
ugcucaucauucucu

SEQ ID NO: 2201614 - RNA, 23 nt, Human
ugcucaucauucucugucucauc

SEQ ID NO: 2201615 - RNA, 21 nt, Human
ugcucaucauucucugucuca

SEQ ID NO: 2201616 - RNA, 20 nt, Human
ugcucaucauucucugucuc

SEQ ID NO: 2201617 - RNA, 19 nt, Human
ugcucaucauucucugucu

SEQ ID NO: 2201618 - RNA, 11 nt, Human
ugcucauggaa

SEQ ID NO: 2201619 - RNA, 13 nt, Human
ugcucaucugcug

SEQ ID NO: 2201620 - RNA, 14 nt, Human
ugcucaucugcugg

SEQ ID NO: 2201621 - RNA, 15 nt, Human
ugcucaucugcuggu

SEQ ID NO: 2201622 - RNA, 19 nt, Human
ugcuccucuccccagcaag

SEQ ID NO: 2201623 - RNA, 16 nt, Human
ugcucaucugcugguc

SEQ ID NO: 2201624 - RNA, 18 nt, Human
ugcucaucugcugguccg

SEQ ID NO: 2201625 - RNA, 14 nt, Human
ugcuccuggagccu

SEQ ID NO: 2201626 - RNA, 20 nt, Human
ugcuccuggagccuuugaau

SEQ ID NO: 2201627 - RNA, 21 nt, Human
ugcuccuggagccuuugaaua

SEQ ID NO: 2201628 - RNA, 15 nt, Human
ugcugaguugguguu

SEQ ID NO: 2201629 - RNA, 21 nt, Human
ugcugaugaacucuuaaucaa

SEQ ID NO: 2201630 - RNA, 16 nt, Human
ugcugaauuuucacau

SEQ ID NO: 2201631 - RNA, 17 nt, Human
ugcugaauuuucacaug

SEQ ID NO: 2201632 - RNA, 22 nt, Human
ugcugaauuuucacaugaacau

SEQ ID NO: 2201633 - RNA, 23 nt, Human
ugcugaauuuucacaugaacaua

SEQ ID NO: 2201634 - RNA, 14 nt, Human
ugcugaauuuucac

SEQ ID NO: 2201635 - RNA, 20 nt, Human
ugcugaauguugggacugcu

SEQ ID NO: 2201636 - RNA, 18 nt, Human
ugcugaauauacagcagg

SEQ ID NO: 2201637 - RNA, 18 nt, Human
ugcugaauguugggacug

SEQ ID NO: 2201638 - RNA, 15 nt, Human
ugcugacagacacag

SEQ ID NO: 2201639 - RNA, 16 nt, Human
ugcugacagacacagg

SEQ ID NO: 2201640 - RNA, 19 nt, Human
ugcugacagacacaggccc

SEQ ID NO: 2201641 - RNA, 13 nt, Human
ugcugauguucag

SEQ ID NO: 2201642 - RNA, 17 nt, Human
ugcugauguccucacca

SEQ ID NO: 2201643 - RNA, 14 nt, Human
ugcugauguucagu

SEQ ID NO: 2201644 - RNA, 15 nt, Human
ugcugauguucagug

SEQ ID NO: 2201645 - RNA, 16 nt, Human
ugcugauguucagugu

SEQ ID NO: 2201646 - RNA, 17 nt, Human
ugcugauguucagugua

SEQ ID NO: 2201647 - RNA, 18 nt, Human
ugcugauguucaguguaa

SEQ ID NO: 2201648 - RNA, 20 nt, Human
ugcugauguucaguguaauu

SEQ ID NO: 2201649 - RNA, 21 nt, Human
ugcugauguucaguguaauuu

SEQ ID NO: 2201650 - RNA, 20 nt, Human
ugcugauggugcaaugaccu

SEQ ID NO: 2201651 - RNA, 23 nt, Human
ugcugauggugcaaugaccuuuc

SEQ ID NO: 2201652 - RNA, 17 nt, Human
ugcugauucucccguuc

SEQ ID NO: 2201653 - RNA, 23 nt, Human
ugcugauguucaguguaauuucu

SEQ ID NO: 2201654 - RNA, 21 nt, Human
ugcugcagaggggcaggcccu

SEQ ID NO: 2201655 - RNA, 22 nt, Human
ugcugcagaggggcaggcccug

SEQ ID NO: 2201656 - RNA, 22 nt, Human
ugcugcaccaacccagccgcug

SEQ ID NO: 2201657 - RNA, 23 nt, Human
ugcugcagaggggcaggcccugc

SEQ ID NO: 2201658 - RNA, 21 nt, Human
ugcugcaggacuugagaagac

SEQ ID NO: 2201659 - RNA, 15 nt, Human
ugcugcaguugccag

SEQ ID NO: 2201660 - RNA, 16 nt, Human
ugcugcaguugccagu

SEQ ID NO: 2201661 - RNA, 13 nt, Human
ugcugcaggggcu

SEQ ID NO: 2201662 - RNA, 17 nt, Human
ugcugcaggggcucugg

SEQ ID NO: 2201663 - RNA, 18 nt, Human
ugcugcaggggcucugga

SEQ ID NO: 2201664 - RNA, 19 nt, Human
ugcugcaggggcucuggag

SEQ ID NO: 2201665 - RNA, 21 nt, Human
ugcuccuuccaacaggagcug

SEQ ID NO: 2201666 - RNA, 20 nt, Human
ugcuccugggcuacaaggac

SEQ ID NO: 2201667 - RNA, 19 nt, Human
ugcuccuuccaacaggagc

SEQ ID NO: 2201668 - RNA, 19 nt, Human
ugcuccuggcccacugcau

SEQ ID NO: 2201669 - RNA, 14 nt, Human
ugcuccuugggccc

SEQ ID NO: 2201670 - RNA, 12 nt, Human
ugcuccuugggc

SEQ ID NO: 2201671 - RNA, 19 nt, Human
ugcuccuugggcccuuuga

SEQ ID NO: 2201672 - RNA, 18 nt, Human
ugcuccuugggcccuuug

SEQ ID NO: 2201673 - RNA, 16 nt, Human
ugcuccuugggcccuu

SEQ ID NO: 2201674 - RNA, 15 nt, Human
ugcuccuugggcccu

SEQ ID NO: 2201675 - RNA, 15 nt, Human
ugcuccuuguuccua

SEQ ID NO: 2201676 - RNA, 16 nt, Human
ugcucuuucucugcca

SEQ ID NO: 2201677 - RNA, 14 nt, Human
ugcuccuuguuccu

SEQ ID NO: 2201678 - RNA, 21 nt, Human
ugcuccuugggcccuuugagu

SEQ ID NO: 2201679 - RNA, 17 nt, Human
ugcucuuucucugccag

SEQ ID NO: 2201680 - RNA, 18 nt, Human
ugcucuuucucugccagu

SEQ ID NO: 2201681 - RNA, 21 nt, Human
ugcucuuucucugccagugac

SEQ ID NO: 2201682 - RNA, 22 nt, Human
ugcucuuucucugccagugaca

SEQ ID NO: 2201683 - RNA, 23 nt, Human
ugcugaauacagaggcaacugca

SEQ ID NO: 2201684 - RNA, 18 nt, Human
ugcugaauacagaggcaa

SEQ ID NO: 2201685 - RNA, 14 nt, Human
ugcugaaaauggua

SEQ ID NO: 2201686 - RNA, 19 nt, Human
ugcugaaaacuagcucgug

SEQ ID NO: 2201687 - RNA, 17 nt, Human
ugcugaaacaacaaaua

SEQ ID NO: 2201688 - RNA, 13 nt, Human
ugcugaagggacc

SEQ ID NO: 2201689 - RNA, 22 nt, Human
ugcugaagggaccuugaagggu

SEQ ID NO: 2201690 - RNA, 22 nt, Human
ugcugaaugguuuucaaaauaa

SEQ ID NO: 2201691 - RNA, 18 nt, Human
ugcugaaugguuuucaaa

SEQ ID NO: 2201692 - RNA, 17 nt, Human
ugcugaaugguuuucaa

SEQ ID NO: 2201693 - RNA, 22 nt, Human
ugcugaagguggggauugccca

SEQ ID NO: 2201694 - RNA, 11 nt, Human
ugcugaauagg

SEQ ID NO: 2201695 - RNA, 18 nt, Human
ugcugaauaggcgaucac

SEQ ID NO: 2201696 - RNA, 21 nt, Human
ugcugaauaggcgaucacaac

SEQ ID NO: 2201697 - RNA, 17 nt, Human
ugcgcccaguccuucca

SEQ ID NO: 2201698 - RNA, 18 nt, Human
ugcgcccaguccuuccac

SEQ ID NO: 2201699 - RNA, 21 nt, Human
ugcgcccccuccgcccugcca

SEQ ID NO: 2201700 - RNA, 21 nt, Human
ugcgccauugcacuccagccu

SEQ ID NO: 2201701 - RNA, 13 nt, Human
ugcgcccaccccg

SEQ ID NO: 2201702 - RNA, 17 nt, Human
ugcgcccaccccgcucu

SEQ ID NO: 2201703 - RNA, 20 nt, Human
ugcgcccaccccgcucugca

SEQ ID NO: 2201704 - RNA, 18 nt, Human
ugcgccauugcacuccag

SEQ ID NO: 2201705 - RNA, 21 nt, Human
ugcgauucuggauaaagccac

SEQ ID NO: 2201706 - RNA, 19 nt, Human
ugcgauuuugccugugucu

SEQ ID NO: 2201707 - RNA, 17 nt, Human
ugcgccauugcacucca

SEQ ID NO: 2201708 - RNA, 17 nt, Human
ugcgcaggcuggcccug

SEQ ID NO: 2201709 - RNA, 16 nt, Human
ugcgcaggcuggcccu

SEQ ID NO: 2201710 - RNA, 13 nt, Human
ugcgcaggcuggc

SEQ ID NO: 2201711 - RNA, 13 nt, Human
ugcgccuacagga

SEQ ID NO: 2201712 - RNA, 23 nt, Human
ugcgcccccuccgcccugccacu

SEQ ID NO: 2201713 - RNA, 14 nt, Human
ugcgcccugggcuc

SEQ ID NO: 2201714 - RNA, 15 nt, Human
ugcgcccuuaccuuc

SEQ ID NO: 2201715 - RNA, 16 nt, Human
ugcgcccuuaccuucc

SEQ ID NO: 2201716 - RNA, 15 nt, Human
ugcgccgagucuguc

SEQ ID NO: 2201717 - RNA, 23 nt, Human
ugcggugcuaucucccccagccc

SEQ ID NO: 2201718 - RNA, 17 nt, Human
ugcgccgagucugucuc

SEQ ID NO: 2201719 - RNA, 24 nt, Human
ugcgccgagucugucucugucaug

SEQ ID NO: 2201720 - RNA, 21 nt, Human
ugcgguggcucacgccuguaa

SEQ ID NO: 2201721 - RNA, 23 nt, Human
ugccuucuccagacaaaccagaa

SEQ ID NO: 2201722 - RNA, 12 nt, Human
ugccuucugucc

SEQ ID NO: 2201723 - RNA, 17 nt, Human
ugccuucuguccuggug

SEQ ID NO: 2201724 - RNA, 22 nt, Human
ugccuucucaacuccaaacuga

SEQ ID NO: 2201725 - RNA, 22 nt, Human
ugcgcacaaggcugaccaagag

SEQ ID NO: 2201726 - RNA, 13 nt, Human
ugcgauucuggau

SEQ ID NO: 2201727 - RNA, 15 nt, Human
ugcgauucuggauaa

SEQ ID NO: 2201728 - RNA, 23 nt, Human
ugcgauucuggauaaagccacug

SEQ ID NO: 2201729 - RNA, 21 nt, Human
ugccuucuuauucucacucca

SEQ ID NO: 2201730 - RNA, 18 nt, Human
ugccuucuguccuggugu

SEQ ID NO: 2201731 - RNA, 20 nt, Human
ugccuucuguccugguguca

SEQ ID NO: 2201732 - RNA, 13 nt, Human
ugccuucuucacc

SEQ ID NO: 2201733 - RNA, 18 nt, Human
ugcgaucuucagagcagg

SEQ ID NO: 2201734 - RNA, 22 nt, Human
ugcgauggcgugggcugcguga

SEQ ID NO: 2201735 - RNA, 12 nt, Human
ugcgauucugga

SEQ ID NO: 2201736 - RNA, 19 nt, Human
ugccuuccuccugggcccu

SEQ ID NO: 2201737 - RNA, 17 nt, Human
ugccuuccuccugggcc

SEQ ID NO: 2201738 - RNA, 20 nt, Human
ugccuuccuccugggcccuc

SEQ ID NO: 2201739 - RNA, 15 nt, Human
ugccuuccuguuuuu

SEQ ID NO: 2201740 - RNA, 19 nt, Human
ugccuuccuguuuuucaca

SEQ ID NO: 2201741 - RNA, 16 nt, Human
ugccuucccuagcuuu

SEQ ID NO: 2201742 - RNA, 20 nt, Human
ugccuucgcgguggaaggcc

SEQ ID NO: 2201743 - RNA, 12 nt, Human
ugccuuccuugc

SEQ ID NO: 2201744 - RNA, 17 nt, Human
ugccuucucaacuccaa

SEQ ID NO: 2201745 - RNA, 13 nt, Human
ugccuucgcuucu

SEQ ID NO: 2201746 - RNA, 14 nt, Human
ugccuucgcuucuu

SEQ ID NO: 2201747 - RNA, 16 nt, Human
ugccuucgcuucuugc

SEQ ID NO: 2201748 - RNA, 17 nt, Human
ugccuucgcuucuugcc

SEQ ID NO: 2201749 - RNA, 20 nt, Human
ugccuuccacgcugucucca

SEQ ID NO: 2201750 - RNA, 19 nt, Human
ugccuuccacgcugucucc

SEQ ID NO: 2201751 - RNA, 17 nt, Human
ugccuuccacgcugucu

SEQ ID NO: 2201752 - RNA, 14 nt, Human
ugccuuccacgcug

SEQ ID NO: 2201753 - RNA, 22 nt, Human
ugccuuccacgcugucuccaga

SEQ ID NO: 2201754 - RNA, 21 nt, Human
ugccuuccacgcugucuccag

SEQ ID NO: 2201755 - RNA, 23 nt, Human
ugccuuccacgcugucuccagac

SEQ ID NO: 2201756 - RNA, 21 nt, Human
ugccuuccauaauuaugacag

SEQ ID NO: 2201757 - RNA, 17 nt, Human
ugccuuccauaauuaug

SEQ ID NO: 2201758 - RNA, 14 nt, Human
ugccuuccauaauu

SEQ ID NO: 2201759 - RNA, 13 nt, Human
ugccuuccauaau

SEQ ID NO: 2201760 - RNA, 18 nt, Human
ugccuuccagcacccugc

SEQ ID NO: 2201761 - RNA, 16 nt, Human
ugccuuccuccugggc

SEQ ID NO: 2201762 - RNA, 15 nt, Human
ugccuuccuccuggg

SEQ ID NO: 2201763 - RNA, 14 nt, Human
ugccuuccuccugg

SEQ ID NO: 2201764 - RNA, 13 nt, Human
ugccuucccuagc

SEQ ID NO: 2201765 - RNA, 14 nt, Human
ugccuucccuagcu

SEQ ID NO: 2201766 - RNA, 20 nt, Human
ugccuuccaugucggccucu

SEQ ID NO: 2201767 - RNA, 21 nt, Human
ugccuuccaugucggccucua

SEQ ID NO: 2201768 - RNA, 15 nt, Human
ugccuuccccugggc

SEQ ID NO: 2201769 - RNA, 20 nt, Human
ugccuuccccugggcccuga

SEQ ID NO: 2201770 - RNA, 17 nt, Human
ugccuucccuagcuuua

SEQ ID NO: 2201771 - RNA, 13 nt, Human
ugccuucagcucu

SEQ ID NO: 2201772 - RNA, 20 nt, Human
ugccuucaacuaaaaacaaa

SEQ ID NO: 2201773 - RNA, 14 nt, Human
ugccuucaauaaau

SEQ ID NO: 2201774 - RNA, 22 nt, Human
ugccuggccuggcacacaucag

SEQ ID NO: 2201775 - RNA, 16 nt, Human
ugccuuauuaaaguuc

SEQ ID NO: 2201776 - RNA, 23 nt, Human
ugccuuauuagagugucuuucca

SEQ ID NO: 2201777 - RNA, 21 nt, Human
ugccuuauuagagugucuuuc

SEQ ID NO: 2201778 - RNA, 13 nt, Human
ugccuuccacgcu

SEQ ID NO: 2201779 - RNA, 19 nt, Human
ugccuucauuaccuuuuuu

SEQ ID NO: 2201780 - RNA, 12 nt, Human
ugccuucauuug

SEQ ID NO: 2201781 - RNA, 16 nt, Human
ugccuucagauguucu

SEQ ID NO: 2201782 - RNA, 17 nt, Human
ugccuucauuaccuuuu

SEQ ID NO: 2201783 - RNA, 17 nt, Human
ugccuucagcucuacag

SEQ ID NO: 2201784 - RNA, 18 nt, Human
ugccuucagcucuacagc

SEQ ID NO: 2201785 - RNA, 20 nt, Human
ugccuggccaggcagaucug

SEQ ID NO: 2201786 - RNA, 15 nt, Human
ugccuggcaggcugu

SEQ ID NO: 2201787 - RNA, 16 nt, Human
ugccuggccaggcaga

SEQ ID NO: 2201788 - RNA, 14 nt, Human
ugccuggccaggca

SEQ ID NO: 2201789 - RNA, 12 nt, Human
ugccuggccagg

SEQ ID NO: 2201790 - RNA, 23 nt, Human
ugccuggcaggcugucuggccag

SEQ ID NO: 2201791 - RNA, 19 nt, Human
ugccugcacaaacucacca

SEQ ID NO: 2201792 - RNA, 15 nt, Human
ugccugcagagagaa

SEQ ID NO: 2201793 - RNA, 16 nt, Human
ugccugcagagagaag

SEQ ID NO: 2201794 - RNA, 16 nt, Human
ugccuggcccccagcu

SEQ ID NO: 2201795 - RNA, 17 nt, Human
ugccuggcccccugucc

SEQ ID NO: 2201796 - RNA, 16 nt, Human
ugccuggccuggcaca

SEQ ID NO: 2201797 - RNA, 19 nt, Human
ugccuggcccccuguccuc

SEQ ID NO: 2201798 - RNA, 17 nt, Human
ugccuggccuggcacac

SEQ ID NO: 2201799 - RNA, 20 nt, Human
ugccuggccuggcacacauc

SEQ ID NO: 2201800 - RNA, 18 nt, Human
ugccuuauggaacacucu

SEQ ID NO: 2201801 - RNA, 20 nt, Human
ugccuuauggaacacucuga

SEQ ID NO: 2201802 - RNA, 21 nt, Human
ugccuuauggaacacucugag

SEQ ID NO: 2201803 - RNA, 22 nt, Human
ugccuuauggaacacucugaga

SEQ ID NO: 2201804 - RNA, 17 nt, Human
ugccuaggaauucccag

SEQ ID NO: 2201805 - RNA, 12 nt, Human
ugccuacugcau

SEQ ID NO: 2201806 - RNA, 21 nt, Human
ugccuaauaaacauccuucaa

SEQ ID NO: 2201807 - RNA, 18 nt, Human
ugccuaauaaacauccuu

SEQ ID NO: 2201808 - RNA, 17 nt, Human
ugccuaaguggcugcug

SEQ ID NO: 2201809 - RNA, 15 nt, Human
ugccuaaguggcugc

SEQ ID NO: 2201810 - RNA, 14 nt, Human
ugccuaaguggcug

SEQ ID NO: 2201811 - RNA, 18 nt, Human
ugccuagggccuggucca

SEQ ID NO: 2201812 - RNA, 17 nt, Human
ugccuagggccuggucc

SEQ ID NO: 2201813 - RNA, 18 nt, Human
ugccuaggcugaccuuga

SEQ ID NO: 2201814 - RNA, 14 nt, Human
ugccuaggcugacc

SEQ ID NO: 2201815 - RNA, 18 nt, Human
ugccuaggauugugccug

SEQ ID NO: 2201816 - RNA, 17 nt, Human
ugccuccccucuccuuc

SEQ ID NO: 2201817 - RNA, 22 nt, Human
ugcccagaucccagaaggaccu

SEQ ID NO: 2201818 - RNA, 17 nt, Human
ugcccagaucccagaag

SEQ ID NO: 2201819 - RNA, 16 nt, Human
ugcccagaucccagaa

SEQ ID NO: 2201820 - RNA, 11 nt, Human
ugcccagcccc

SEQ ID NO: 2201821 - RNA, 23 nt, Human
ugcccaggcuggcgugcaguggu

SEQ ID NO: 2201822 - RNA, 22 nt, Human
ugcccagggccacucugccucu

SEQ ID NO: 2201823 - RNA, 21 nt, Human
ugcccagggccacucugccuc

SEQ ID NO: 2201824 - RNA, 19 nt, Human
ugcccagggccacucugcc

SEQ ID NO: 2201825 - RNA, 17 nt, Human
ugcccaggcuggucuca

SEQ ID NO: 2201826 - RNA, 16 nt, Human
ugcccagggcucagcc

SEQ ID NO: 2201827 - RNA, 15 nt, Human
ugcccagggcucagc

SEQ ID NO: 2201828 - RNA, 14 nt, Human
ugcccagggcucag

SEQ ID NO: 2201829 - RNA, 11 nt, Human
ugcccagggcu

SEQ ID NO: 2201830 - RNA, 18 nt, Human
ugcccagggcucagccug

SEQ ID NO: 2201831 - RNA, 17 nt, Human
ugcccagggcucagccu

SEQ ID NO: 2201832 - RNA, 19 nt, Human
ugcccagggcucagccugg

SEQ ID NO: 2201833 - RNA, 19 nt, Human
ugccuaaggcugaacuugu

SEQ ID NO: 2201834 - RNA, 14 nt, Human
ugccugcagagaga

SEQ ID NO: 2201835 - RNA, 21 nt, Human
ugccugauucggcugucucag

SEQ ID NO: 2201836 - RNA, 15 nt, Human
ugccugauugccaag

SEQ ID NO: 2201837 - RNA, 20 nt, Human
ugccugauugccaagcucag

SEQ ID NO: 2201838 - RNA, 17 nt, Human
ugccugcacaaacucac

SEQ ID NO: 2201839 - RNA, 15 nt, Human
ugccugauauaaaug

SEQ ID NO: 2201840 - RNA, 22 nt, Human
ugccugauauuucccuccccug

SEQ ID NO: 2201841 - RNA, 18 nt, Human
ugccugauccagccucuc

SEQ ID NO: 2201842 - RNA, 15 nt, Human
ugccugauggaccug

SEQ ID NO: 2201843 - RNA, 18 nt, Human
ugccugauucggcugucu

SEQ ID NO: 2201844 - RNA, 19 nt, Human
ugccugauucggcugucuc

SEQ ID NO: 2201845 - RNA, 20 nt, Human
ugccugauucggcugucuca

SEQ ID NO: 2201846 - RNA, 19 nt, Human
ugccugagucacccaugaa

SEQ ID NO: 2201847 - RNA, 16 nt, Human
ugccugagugccuggc

SEQ ID NO: 2201848 - RNA, 14 nt, Human
ugccugauauaaau

SEQ ID NO: 2201849 - RNA, 14 nt, Human
ugccugagggugga

SEQ ID NO: 2201850 - RNA, 11 nt, Human
ugccugagggu

SEQ ID NO: 2201851 - RNA, 18 nt, Human
ugccugaggguggagacu

SEQ ID NO: 2201852 - RNA, 15 nt, Human
ugccugaggucugua

SEQ ID NO: 2201853 - RNA, 16 nt, Human
ugccugaggucuguac

SEQ ID NO: 2201854 - RNA, 18 nt, Human
ugccugaggucuguacgu

SEQ ID NO: 2201855 - RNA, 19 nt, Human
ugccugaaguuggagugag

SEQ ID NO: 2201856 - RNA, 15 nt, Human
ugccugaauauuugu

SEQ ID NO: 2201857 - RNA, 14 nt, Human
ugccucugugcugu

SEQ ID NO: 2201858 - RNA, 16 nt, Human
ugccucugugcugugu

SEQ ID NO: 2201859 - RNA, 22 nt, Human
ugccugaagucacacagugagu

SEQ ID NO: 2201860 - RNA, 18 nt, Human
ugccugaagucacacagu

SEQ ID NO: 2201861 - RNA, 17 nt, Human
ugccugaagucacacag

SEQ ID NO: 2201862 - RNA, 14 nt, Human
ugccucugggacug

SEQ ID NO: 2201863 - RNA, 13 nt, Human
ugccucugucccc

SEQ ID NO: 2201864 - RNA, 14 nt, Human
ugccucuguccccu

SEQ ID NO: 2201865 - RNA, 15 nt, Human
ugccucuguccccuu

SEQ ID NO: 2201866 - RNA, 11 nt, Human
ugccucugugc

SEQ ID NO: 2201867 - RNA, 12 nt, Human
ugccucugugcu

SEQ ID NO: 2201868 - RNA, 13 nt, Human
ugccucugugcug

SEQ ID NO: 2201869 - RNA, 16 nt, Human
ugccucuguccccuuc

SEQ ID NO: 2201870 - RNA, 17 nt, Human
ugccucuguccccuucu

SEQ ID NO: 2201871 - RNA, 20 nt, Human
ugccucuguccccuucucuc

SEQ ID NO: 2201872 - RNA, 21 nt, Human
ugccucuguccccuucucuca

SEQ ID NO: 2201873 - RNA, 16 nt, Human
ugccuccuuugugagg

SEQ ID NO: 2201874 - RNA, 18 nt, Human
ugccuccccucuccuucc

SEQ ID NO: 2201875 - RNA, 17 nt, Human
ugccuccuuccaccucc

SEQ ID NO: 2201876 - RNA, 19 nt, Human
ugccuccuuccaccucccu

SEQ ID NO: 2201877 - RNA, 17 nt, Human
ugccuccuuugugagga

SEQ ID NO: 2201878 - RNA, 18 nt, Human
ugccuccuuugugaggaa

SEQ ID NO: 2201879 - RNA, 13 nt, Human
ugcagccagccca

SEQ ID NO: 2201880 - RNA, 12 nt, Human
ugcagccagccc

SEQ ID NO: 2201881 - RNA, 13 nt, Human
ugcagccagaccu

SEQ ID NO: 2201882 - RNA, 14 nt, Human
ugcagccagaccua

SEQ ID NO: 2201883 - RNA, 21 nt, Human
ugcagccagaccuauuccucc

SEQ ID NO: 2201884 - RNA, 23 nt, Human
ugcagccagaccuauuccuccug

SEQ ID NO: 2201885 - RNA, 23 nt, Human
ugcagccagcccagcccagcugg

SEQ ID NO: 2201886 - RNA, 21 nt, Human
ugcagccagcccagcccagcu

SEQ ID NO: 2201887 - RNA, 19 nt, Human
ugcagccagcccagcccag

SEQ ID NO: 2201888 - RNA, 17 nt, Human
ugcagccagcccagccc

SEQ ID NO: 2201889 - RNA, 16 nt, Human
ugcagccagcccagcc

SEQ ID NO: 2201890 - RNA, 15 nt, Human
ugcagccagcccagc

SEQ ID NO: 2201891 - RNA, 14 nt, Human
ugcagccagcccag

SEQ ID NO: 2201892 - RNA, 13 nt, Human
ugcagcccaugcc

SEQ ID NO: 2201893 - RNA, 22 nt, Human
ugcagccagcccagcccagcug

SEQ ID NO: 2201894 - RNA, 12 nt, Human
ugcagcccaugc

SEQ ID NO: 2201895 - RNA, 13 nt, Human
ugcagcuuuaaaa

SEQ ID NO: 2201896 - RNA, 16 nt, Human
ugcagcaauaaagcag

SEQ ID NO: 2201897 - RNA, 17 nt, Human
ugcagcauguugcugag

SEQ ID NO: 2201898 - RNA, 20 nt, Human
ugcagaguuuccaaaaccag

SEQ ID NO: 2201899 - RNA, 18 nt, Human
ugcagcauguugcugagg

SEQ ID NO: 2201900 - RNA, 20 nt, Human
ugcagcauguugcugaggag

SEQ ID NO: 2201901 - RNA, 21 nt, Human
ugcagcauguugcugaggagu

SEQ ID NO: 2201902 - RNA, 23 nt, Human
ugcagcauguugcugaggaguga

SEQ ID NO: 2201903 - RNA, 15 nt, Human
ugcagcaauaaagca

SEQ ID NO: 2201904 - RNA, 14 nt, Human
ugcagcaauaaagc

SEQ ID NO: 2201905 - RNA, 14 nt, Human
ugcaggaccucagg

SEQ ID NO: 2201906 - RNA, 16 nt, Human
ugcagcuuuacaugca

SEQ ID NO: 2201907 - RNA, 22 nt, Human
ugcagcuuuaaaaaauuaaucu

SEQ ID NO: 2201908 - RNA, 17 nt, Human
ugcaggaaauggcugug

SEQ ID NO: 2201909 - RNA, 15 nt, Human
ugcagcuuuacaugc

SEQ ID NO: 2201910 - RNA, 16 nt, Human
ugcaggaccucaggug

SEQ ID NO: 2201911 - RNA, 15 nt, Human
ugcaggaccucaggu

SEQ ID NO: 2201912 - RNA, 17 nt, Human
ugcaggaauaaggccuu

SEQ ID NO: 2201913 - RNA, 16 nt, Human
ugcaggaauaaggccu

SEQ ID NO: 2201914 - RNA, 15 nt, Human
ugcaggaccugccug

SEQ ID NO: 2201915 - RNA, 18 nt, Human
ugcaggaccucaggugag

SEQ ID NO: 2201916 - RNA, 15 nt, Human
ugcagagugcccaga

SEQ ID NO: 2201917 - RNA, 14 nt, Human
ugcagagugcccag

SEQ ID NO: 2201918 - RNA, 17 nt, Human
ugcagagucagcagaac

SEQ ID NO: 2201919 - RNA, 17 nt, Human
ugcagaguccugcacag

SEQ ID NO: 2201920 - RNA, 15 nt, Human
ugcagagucagcaga

SEQ ID NO: 2201921 - RNA, 14 nt, Human
ugcagagucagcag

SEQ ID NO: 2201922 - RNA, 13 nt, Human
ugcagagucagca

SEQ ID NO: 2201923 - RNA, 16 nt, Human
ugcagauaaacaguag

SEQ ID NO: 2201924 - RNA, 18 nt, Human
ugcagagugcccagaacu

SEQ ID NO: 2201925 - RNA, 17 nt, Human
ugcagauaaacaguagu

SEQ ID NO: 2201926 - RNA, 15 nt, Human
ugcacuuuguucugg

SEQ ID NO: 2201927 - RNA, 18 nt, Human
ugcacuuuguucuggcuc

SEQ ID NO: 2201928 - RNA, 19 nt, Human
ugcacuuuguucuggcucu

SEQ ID NO: 2201929 - RNA, 20 nt, Human
ugcacuuuguucuggcucuu

SEQ ID NO: 2201930 - RNA, 17 nt, Human
ugcacuuggccucugga

SEQ ID NO: 2201931 - RNA, 15 nt, Human
ugcacuuggccucug

SEQ ID NO: 2201932 - RNA, 14 nt, Human
ugcacuuggccucu

SEQ ID NO: 2201933 - RNA, 16 nt, Human
ugcacuuggcugcaua

SEQ ID NO: 2201934 - RNA, 17 nt, Human
ugcacuugugauuauuu

SEQ ID NO: 2201935 - RNA, 20 nt, Human
ugcacuugugauuauuuauu

SEQ ID NO: 2201936 - RNA, 21 nt, Human
ugcacuugcagacucuacaga

SEQ ID NO: 2201937 - RNA, 16 nt, Human
ugcacuugcagacucu

SEQ ID NO: 2201938 - RNA, 18 nt, Human
ugcaccugcauccguagu

SEQ ID NO: 2201939 - RNA, 18 nt, Human
ugcacggugggccuugcu

SEQ ID NO: 2201940 - RNA, 22 nt, Human
ugcaccugccagccuggcuucu

SEQ ID NO: 2201941 - RNA, 23 nt, Human
ugcacggugggccuugcugggga

SEQ ID NO: 2201942 - RNA, 21 nt, Human
ugcacggugggccuugcuggg

SEQ ID NO: 2201943 - RNA, 16 nt, Human
ugcacguacacacaca

SEQ ID NO: 2201944 - RNA, 16 nt, Human
ugaaggcuggguucug

SEQ ID NO: 2201945 - RNA, 19 nt, Human
ugaagucucugaagugaaa

SEQ ID NO: 2201946 - RNA, 21 nt, Human
ugaagucgucuuaacucacca

SEQ ID NO: 2201947 - RNA, 16 nt, Human
ugaagucguugugagg

SEQ ID NO: 2201948 - RNA, 17 nt, Human
ugaagucguugugaggg

SEQ ID NO: 2201949 - RNA, 11 nt, Human
ugaagucugaa

SEQ ID NO: 2201950 - RNA, 12 nt, Human
ugaagucugaaa

SEQ ID NO: 2201951 - RNA, 13 nt, Human
ugaagucugaaau

SEQ ID NO: 2201952 - RNA, 17 nt, Human
ugaagucuuuguacaga

SEQ ID NO: 2201953 - RNA, 20 nt, Human
ugaagucuuuguacagacaa

SEQ ID NO: 2201954 - RNA, 23 nt, Human
ugcacacuugugugugggcugug

SEQ ID NO: 2201955 - RNA, 14 nt, Human
ugcacacuuugcca

SEQ ID NO: 2201956 - RNA, 22 nt, Human
ugcacacuuugccauauuuuca

SEQ ID NO: 2201957 - RNA, 21 nt, Human
ugcacacuugugugugggcug

SEQ ID NO: 2201958 - RNA, 14 nt, Human
ugaagucugaaauu

SEQ ID NO: 2201959 - RNA, 22 nt, Human
ugaagucuuuguacagacaaca

SEQ ID NO: 2201960 - RNA, 19 nt, Human
ugcacagacgucccuccac

SEQ ID NO: 2201961 - RNA, 12 nt, Human
ugcacagagcuc

SEQ ID NO: 2201962 - RNA, 13 nt, Human
ugcacagagcucu

SEQ ID NO: 2201963 - RNA, 14 nt, Human
ugcacagagcucuc

SEQ ID NO: 2201964 - RNA, 16 nt, Human
ugcacagagcucucca

SEQ ID NO: 2201965 - RNA, 18 nt, Human
ugcacagagcucuccagc

SEQ ID NO: 2201966 - RNA, 20 nt, Human
ugcacagagcucuccagcuc

SEQ ID NO: 2201967 - RNA, 22 nt, Human
ugcacagaguuguuacauuuuu

SEQ ID NO: 2201968 - RNA, 21 nt, Human
ugcacagaguuguuacauuuu

SEQ ID NO: 2201969 - RNA, 23 nt, Human
ugcacagauggauuugccugugc

SEQ ID NO: 2201970 - RNA, 19 nt, Human
ugcacagauggauuugccu

SEQ ID NO: 2201971 - RNA, 19 nt, Human
ugcacagagcucuccagcu

SEQ ID NO: 2201972 - RNA, 23 nt, Human
ugcacagaguuguuacauuuuua

SEQ ID NO: 2201973 - RNA, 17 nt, Human
ugcacagcuaacaugga

SEQ ID NO: 2201974 - RNA, 16 nt, Human
ugcacagcggccccug

SEQ ID NO: 2201975 - RNA, 18 nt, Human
ugcacagcggccccugca

SEQ ID NO: 2201976 - RNA, 17 nt, Human
ugcacagcguccugucc

SEQ ID NO: 2201977 - RNA, 23 nt, Human
ugcacagcuaacauggaaguacu

SEQ ID NO: 2201978 - RNA, 18 nt, Human
ugcacagcuaacauggaa

SEQ ID NO: 2201979 - RNA, 20 nt, Human
ugcacagcuaacauggaagu

SEQ ID NO: 2201980 - RNA, 18 nt, Human
ugcacagugcaucucagc

SEQ ID NO: 2201981 - RNA, 15 nt, Human
ugcacagggcagcug

SEQ ID NO: 2201982 - RNA, 16 nt, Human
ugcacagggcagcugg

SEQ ID NO: 2201983 - RNA, 17 nt, Human
ugcacagggcagcuggg

SEQ ID NO: 2201984 - RNA, 18 nt, Human
ugcacagggcagcugggc

SEQ ID NO: 2201985 - RNA, 12 nt, Human
ugcacagggcag

SEQ ID NO: 2201986 - RNA, 14 nt, Human
ugcacagggagacg

SEQ ID NO: 2201987 - RNA, 16 nt, Human
ugcacagggagacgua

SEQ ID NO: 2201988 - RNA, 19 nt, Human
ugcacagugcaucucagcc

SEQ ID NO: 2201989 - RNA, 20 nt, Human
ugcacagugcaucucagccc

SEQ ID NO: 2201990 - RNA, 15 nt, Human
ugcacauacuugaga

SEQ ID NO: 2201991 - RNA, 22 nt, Human
ugcacauagcuaucaagugugc

SEQ ID NO: 2201992 - RNA, 21 nt, Human
ugcacauacgcaccacaucuc

SEQ ID NO: 2201993 - RNA, 24 nt, Human
ugcacaguuuucuggcuggagccu

SEQ ID NO: 2201994 - RNA, 22 nt, Human
ugcacaguuagcaaacuuugua

SEQ ID NO: 2201995 - RNA, 23 nt, Human
ugcacaguuuucuggcuggagcc

SEQ ID NO: 2201996 - RNA, 19 nt, Human
ugcacauauggacucugca

SEQ ID NO: 2201997 - RNA, 14 nt, Human
ugcacaucucugcu

SEQ ID NO: 2201998 - RNA, 15 nt, Human
ugcacaucucugcuu

SEQ ID NO: 2201999 - RNA, 19 nt, Human
ugcacaucugugucuuguu

SEQ ID NO: 2202000 - RNA, 18 nt, Human
ugcacaucugugucuugu

SEQ ID NO: 2202001 - RNA, 16 nt, Human
ugcacaucugugucuu

SEQ ID NO: 2202002 - RNA, 15 nt, Human
ugcacaucugugucu

SEQ ID NO: 2202003 - RNA, 14 nt, Human
ugcacauauggacu

SEQ ID NO: 2202004 - RNA, 15 nt, Human
ugcacauauggacuc

SEQ ID NO: 2202005 - RNA, 17 nt, Human
ugcacauauggacucug

SEQ ID NO: 2202006 - RNA, 18 nt, Human
ugcacauauggacucugc

SEQ ID NO: 2202007 - RNA, 15 nt, Human
ugcacaucaaaauau

SEQ ID NO: 2202008 - RNA, 20 nt, Human
ugcaccugccagccuggcuu

SEQ ID NO: 2202009 - RNA, 19 nt, Human
ugcaccugccagccuggcu

SEQ ID NO: 2202010 - RNA, 18 nt, Human
ugcaccugccagccuggc

SEQ ID NO: 2202011 - RNA, 17 nt, Human
ugcaccugccagccugg

SEQ ID NO: 2202012 - RNA, 16 nt, Human
ugcaccugccagccug

SEQ ID NO: 2202013 - RNA, 15 nt, Human
ugcaccugccagccu

SEQ ID NO: 2202014 - RNA, 11 nt, Human
ugcaccugcau

SEQ ID NO: 2202015 - RNA, 20 nt, Human
ugcaccuccccccacugcag

SEQ ID NO: 2202016 - RNA, 19 nt, Human
ugcaccuccccccacugca

SEQ ID NO: 2202017 - RNA, 18 nt, Human
ugcaccuccccccacugc

SEQ ID NO: 2202018 - RNA, 17 nt, Human
ugcaccuccccccacug

SEQ ID NO: 2202019 - RNA, 16 nt, Human
ugcaccuccccccacu

SEQ ID NO: 2202020 - RNA, 15 nt, Human
ugcaccuccccccac

SEQ ID NO: 2202021 - RNA, 14 nt, Human
ugcaccucccccca

SEQ ID NO: 2202022 - RNA, 20 nt, Human
ugccaaaaaaagacagggcu

SEQ ID NO: 2202023 - RNA, 17 nt, Human
ugcauuacagagaggag

SEQ ID NO: 2202024 - RNA, 16 nt, Human
ugcauuacagagagga

SEQ ID NO: 2202025 - RNA, 23 nt, Human
ugcauuuuguuugguauuguauu

SEQ ID NO: 2202026 - RNA, 17 nt, Human
ugcauuuuugugaaaug

SEQ ID NO: 2202027 - RNA, 16 nt, Human
ugcauuuuugugaaau

SEQ ID NO: 2202028 - RNA, 14 nt, Human
ugcauuuuugugaa

SEQ ID NO: 2202029 - RNA, 18 nt, Human
ugcauuacagagaggaga

SEQ ID NO: 2202030 - RNA, 19 nt, Human
ugcauuuuugugaaaugaa

SEQ ID NO: 2202031 - RNA, 23 nt, Human
ugccaaccuguaauaaauaugag

SEQ ID NO: 2202032 - RNA, 21 nt, Human
ugccaaccuguaauaaauaug

SEQ ID NO: 2202033 - RNA, 22 nt, Human
ugccaaccuguaauaaauauga

SEQ ID NO: 2202034 - RNA, 16 nt, Human
ugccaaccucuggagc

SEQ ID NO: 2202035 - RNA, 18 nt, Human
ugccaaccuguaauaaau

SEQ ID NO: 2202036 - RNA, 19 nt, Human
ugccaaccuguaauaaaua

SEQ ID NO: 2202037 - RNA, 20 nt, Human
ugccaaccuguaauaaauau

SEQ ID NO: 2202038 - RNA, 21 nt, Human
ugccaacuucuucagagcuga

SEQ ID NO: 2202039 - RNA, 23 nt, Human
ugccaacuguuguaacuaggcuc

SEQ ID NO: 2202040 - RNA, 14 nt, Human
ugccaagacaugau

SEQ ID NO: 2202041 - RNA, 21 nt, Human
ugcauuauauuuauuacugua

SEQ ID NO: 2202042 - RNA, 20 nt, Human
ugcauuauauuuauuacugu

SEQ ID NO: 2202043 - RNA, 15 nt, Human
ugcauuacagagagg

SEQ ID NO: 2202044 - RNA, 12 nt, Human
ugcauuacagag

SEQ ID NO: 2202045 - RNA, 11 nt, Human
ugcauuacaga

SEQ ID NO: 2202046 - RNA, 21 nt, Human
ugcauuaaauucacaaacuuu

SEQ ID NO: 2202047 - RNA, 20 nt, Human
ugcauuaaauucacaaacuu

SEQ ID NO: 2202048 - RNA, 15 nt, Human
ugcauuauauuuauu

SEQ ID NO: 2202049 - RNA, 14 nt, Human
ugcaugugugugcu

SEQ ID NO: 2202050 - RNA, 13 nt, Human
ugcaugugugugc

SEQ ID NO: 2202051 - RNA, 12 nt, Human
ugcaugugugcg

SEQ ID NO: 2202052 - RNA, 11 nt, Human
ugcaugugugu

SEQ ID NO: 2202053 - RNA, 19 nt, Human
ugcauguuacauaagauaa

SEQ ID NO: 2202054 - RNA, 19 nt, Human
ugcauuaaauucacaaacu

SEQ ID NO: 2202055 - RNA, 17 nt, Human
ugcauuaaauucacaaa

SEQ ID NO: 2202056 - RNA, 16 nt, Human
ugcauuaaauucacaa

SEQ ID NO: 2202057 - RNA, 15 nt, Human
ugcauuaaauucaca

SEQ ID NO: 2202058 - RNA, 14 nt, Human
ugcauuaaauucac

SEQ ID NO: 2202059 - RNA, 13 nt, Human
ugcauuaaauuca

SEQ ID NO: 2202060 - RNA, 15 nt, Human
ugcaucguuucaucu

SEQ ID NO: 2202061 - RNA, 18 nt, Human
ugcaucgagucaaaacuc

SEQ ID NO: 2202062 - RNA, 22 nt, Human
ugcaucgagucaaaacucaaau

SEQ ID NO: 2202063 - RNA, 17 nt, Human
ugcaugugacucugaag

SEQ ID NO: 2202064 - RNA, 20 nt, Human
ugcaugugacucugaagcug

SEQ ID NO: 2202065 - RNA, 16 nt, Human
ugcaugugacucugaa

SEQ ID NO: 2202066 - RNA, 15 nt, Human
ugcaugugacucuga

SEQ ID NO: 2202067 - RNA, 14 nt, Human
ugcaugugacucug

SEQ ID NO: 2202068 - RNA, 13 nt, Human
ugcaugugacucu

SEQ ID NO: 2202069 - RNA, 16 nt, Human
ugcauguccuguaaag

SEQ ID NO: 2202070 - RNA, 14 nt, Human
ugcaucguggagac

SEQ ID NO: 2202071 - RNA, 15 nt, Human
ugcaucguggagaca

SEQ ID NO: 2202072 - RNA, 21 nt, Human
ugcaugucgugaccaacuaga

SEQ ID NO: 2202073 - RNA, 12 nt, Human
ugcaugugaaga

SEQ ID NO: 2202074 - RNA, 16 nt, Human
ugcaugugaagaaagg

SEQ ID NO: 2202075 - RNA, 18 nt, Human
ugcauccauuccucaggg

SEQ ID NO: 2202076 - RNA, 17 nt, Human
ugcauccauuccucagg

SEQ ID NO: 2202077 - RNA, 16 nt, Human
ugcauccauuccucag

SEQ ID NO: 2202078 - RNA, 14 nt, Human
ugcauccauuccuc

SEQ ID NO: 2202079 - RNA, 18 nt, Human
ugcauccuccgccucccg

SEQ ID NO: 2202080 - RNA, 21 nt, Human
ugcauccuccgccucccgggu

SEQ ID NO: 2202081 - RNA, 16 nt, Human
ugcauccaaaggugcu

SEQ ID NO: 2202082 - RNA, 18 nt, Human
ugcauccaaaggugcuca

SEQ ID NO: 2202083 - RNA, 13 nt, Human
ugcauccaacucc

SEQ ID NO: 2202084 - RNA, 16 nt, Human
ugcauccaacuccagg

SEQ ID NO: 2202085 - RNA, 17 nt, Human
ugcauccaacuccagga

SEQ ID NO: 2202086 - RNA, 23 nt, Human
ugcaggaguuaaaaagggcaggg

SEQ ID NO: 2202087 - RNA, 16 nt, Human
ugcaggcagccaggcc

SEQ ID NO: 2202088 - RNA, 22 nt, Human
ugcaggagcaguaucaugaagc

SEQ ID NO: 2202089 - RNA, 18 nt, Human
ugcaggacuugagaagac

SEQ ID NO: 2202090 - RNA, 15 nt, Human
ugcaggacuugagaa

SEQ ID NO: 2202091 - RNA, 13 nt, Human
ugcaggacuugag

SEQ ID NO: 2202092 - RNA, 19 nt, Human
ugcaggaccugccuguagc

SEQ ID NO: 2202093 - RNA, 18 nt, Human
ugcaggaccugccuguag

SEQ ID NO: 2202094 - RNA, 17 nt, Human
ugcaggaccugccugua

SEQ ID NO: 2202095 - RNA, 16 nt, Human
ugcaggaccugccugu

SEQ ID NO: 2202096 - RNA, 17 nt, Human
ugcaggcagccaggcca

SEQ ID NO: 2202097 - RNA, 18 nt, Human
ugcaggcagccaggccac

SEQ ID NO: 2202098 - RNA, 19 nt, Human
ugcaggcagccaggccaca

SEQ ID NO: 2202099 - RNA, 22 nt, Human
ugcaucagcugcugaaacaaca

SEQ ID NO: 2202100 - RNA, 18 nt, Human
ugccaguaacgcgucuuc

SEQ ID NO: 2202101 - RNA, 21 nt, Human
ugccaguaacgcgucuuccug

SEQ ID NO: 2202102 - RNA, 24 nt, Human
ugccagguuuuuggucugacccac

SEQ ID NO: 2202103 - RNA, 22 nt, Human
ugccaguaggcucaacuaggga

SEQ ID NO: 2202104 - RNA, 22 nt, Human
ugccaguaacgcgucuuccuga

SEQ ID NO: 2202105 - RNA, 23 nt, Human
ugccaguaacgcgucuuccugag

SEQ ID NO: 2202106 - RNA, 14 nt, Human
ugccagucaccccg

SEQ ID NO: 2202107 - RNA, 11 nt, Human
ugccauccuca

SEQ ID NO: 2202108 - RNA, 19 nt, Human
ugccauccucaaacacugc

SEQ ID NO: 2202109 - RNA, 23 nt, Human
ugccauccucaaacacugcaggc

SEQ ID NO: 2202110 - RNA, 15 nt, Human
ugccaagcacagugc

SEQ ID NO: 2202111 - RNA, 17 nt, Human
ugccacccaccucccug

SEQ ID NO: 2202112 - RNA, 19 nt, Human
ugccacccaccucccugcc

SEQ ID NO: 2202113 - RNA, 18 nt, Human
ugccacccaccucccugc

SEQ ID NO: 2202114 - RNA, 21 nt, Human
ugccacccaccucccugccuc

SEQ ID NO: 2202115 - RNA, 20 nt, Human
ugccacccaccucccugccu

SEQ ID NO: 2202116 - RNA, 22 nt, Human
ugccacccaccucccugccucc

SEQ ID NO: 2202117 - RNA, 12 nt, Human
ugccacccuacc

SEQ ID NO: 2202118 - RNA, 23 nt, Human
ugccaccccacccucccuggagu

SEQ ID NO: 2202119 - RNA, 14 nt, Human
ugccaccccacccu

SEQ ID NO: 2202120 - RNA, 15 nt, Human
ugccaccccacccuc

SEQ ID NO: 2202121 - RNA, 16 nt, Human
ugccaccccacccucc

SEQ ID NO: 2202122 - RNA, 17 nt, Human
ugccaccccacccuccc

SEQ ID NO: 2202123 - RNA, 19 nt, Human
ugccaccccacccucccug

SEQ ID NO: 2202124 - RNA, 20 nt, Human
ugccaccccacccucccugg

SEQ ID NO: 2202125 - RNA, 21 nt, Human
ugccaccccacccucccugga

SEQ ID NO: 2202126 - RNA, 22 nt, Human
ugccaccccacccucccuggag

SEQ ID NO: 2202127 - RNA, 12 nt, Human
ugccagggagcu

SEQ ID NO: 2202128 - RNA, 11 nt, Human
ugccagggagc

SEQ ID NO: 2202129 - RNA, 15 nt, Human
ugccagggagacaga

SEQ ID NO: 2202130 - RNA, 18 nt, Human
ugccagggagacagagcu

SEQ ID NO: 2202131 - RNA, 22 nt, Human
ugccagggcaaugaugaaugag

SEQ ID NO: 2202132 - RNA, 17 nt, Human
ugccagggcaaugauga

SEQ ID NO: 2202133 - RNA, 12 nt, Human
ugccagggcagg

SEQ ID NO: 2202134 - RNA, 11 nt, Human
ugccagggcag

SEQ ID NO: 2202135 - RNA, 11 nt, Human
ugccagggaca

SEQ ID NO: 2202136 - RNA, 22 nt, Human
ugccagggacagaggggguggc

SEQ ID NO: 2202137 - RNA, 18 nt, Human
ugccauggacagaagaag

SEQ ID NO: 2202138 - RNA, 20 nt, Human
ugccauggacagaagaaggc

SEQ ID NO: 2202139 - RNA, 16 nt, Human
ugccaugcagggccuc

SEQ ID NO: 2202140 - RNA, 13 nt, Human
ugccaucuuccca

SEQ ID NO: 2202141 - RNA, 18 nt, Human
ugccaucugugggcacgc

SEQ ID NO: 2202142 - RNA, 16 nt, Human
ugccaucugugggcac

SEQ ID NO: 2202143 - RNA, 22 nt, Human
ugccaucugcgugacaauaaaa

SEQ ID NO: 2202144 - RNA, 23 nt, Human
ugccauggacagaagaaggcagc

SEQ ID NO: 2202145 - RNA, 16 nt, Human
ugccauggaggcacac

SEQ ID NO: 2202146 - RNA, 17 nt, Human
ugccauggaggcacaca

SEQ ID NO: 2202147 - RNA, 18 nt, Human
ugccauggaggcacacag

SEQ ID NO: 2202148 - RNA, 23 nt, Human
ugccauggaggcacacagcugca

SEQ ID NO: 2202149 - RNA, 17 nt, Human
ugccauggcgugucccu

SEQ ID NO: 2202150 - RNA, 18 nt, Human
ugccaugggcuucacugu

SEQ ID NO: 2202151 - RNA, 19 nt, Human
ugccaugggcuucacugua

SEQ ID NO: 2202152 - RNA, 20 nt, Human
ugccaugggcuucacuguau

SEQ ID NO: 2202153 - RNA, 23 nt, Human
ugcccaccaacaucccauugccc

SEQ ID NO: 2202154 - RNA, 17 nt, Human
ugcccaccaacauccca

SEQ ID NO: 2202155 - RNA, 12 nt, Human
ugcccaccccac

SEQ ID NO: 2202156 - RNA, 13 nt, Human
ugcccaccccacc

SEQ ID NO: 2202157 - RNA, 23 nt, Human
ugcccacaucccaggcuucaccc

SEQ ID NO: 2202158 - RNA, 21 nt, Human
ugcccacaggccgcccugcgg

SEQ ID NO: 2202159 - RNA, 22 nt, Human
ugccaugggcuucacuguauaa

SEQ ID NO: 2202160 - RNA, 23 nt, Human
ugccaugggcuucacuguauaaa

SEQ ID NO: 2202161 - RNA, 16 nt, Human
ugcccacaucccaggc

SEQ ID NO: 2202162 - RNA, 19 nt, Human
ugcccacccguggagaugg

SEQ ID NO: 2202163 - RNA, 15 nt, Human
ugcccagaguugcug

SEQ ID NO: 2202164 - RNA, 23 nt, Human
ugcccagagggcccaggcaggcc

SEQ ID NO: 2202165 - RNA, 21 nt, Human
ugcccagagggcccaggcagg

SEQ ID NO: 2202166 - RNA, 20 nt, Human
ugcccagagggcccaggcag

SEQ ID NO: 2202167 - RNA, 10 nt, Human
ugcccagccc

SEQ ID NO: 2202168 - RNA, 20 nt, Human
ugcccacccguggagauggg

SEQ ID NO: 2202169 - RNA, 18 nt, Human
ugcccaccuggccucugc

SEQ ID NO: 2202170 - RNA, 15 nt, Human
ugcccaccuggccuc

SEQ ID NO: 2202171 - RNA, 17 nt, Human
ugcccaccuggccucug

SEQ ID NO: 2202172 - RNA, 16 nt, Human
ugcccaccccaccccc

SEQ ID NO: 2202173 - RNA, 17 nt, Human
ugcccaccccaccccca

SEQ ID NO: 2202174 - RNA, 19 nt, Human
ugcccaccccacccccacc

SEQ ID NO: 2202175 - RNA, 11 nt, Human
ugcccaccccc

SEQ ID NO: 2202176 - RNA, 13 nt, Human
ugcccacccccuc

SEQ ID NO: 2202177 - RNA, 14 nt, Human
ugcccacccccuca

SEQ ID NO: 2202178 - RNA, 15 nt, Human
ugcccacccccucaa

SEQ ID NO: 2202179 - RNA, 18 nt, Human
ugcccacccccucaagcc

SEQ ID NO: 2202180 - RNA, 24 nt, Human
ugcccacccccucaagccaauccc

SEQ ID NO: 2202181 - RNA, 13 nt, Human
ugcccacccccug

SEQ ID NO: 2202182 - RNA, 14 nt, Human
ugcccacccccugc

SEQ ID NO: 2202183 - RNA, 15 nt, Human
ugcccacccccugcc

SEQ ID NO: 2202184 - RNA, 16 nt, Human
ugcccacccccugccc

SEQ ID NO: 2202185 - RNA, 18 nt, Human
ugcccacccccugcccug

SEQ ID NO: 2202186 - RNA, 19 nt, Human
ugcccacccccugcccugc

SEQ ID NO: 2202187 - RNA, 20 nt, Human
ugcccacccccugcccugca

SEQ ID NO: 2202188 - RNA, 24 nt, Human
uggccagagcugggaggcauggcc

SEQ ID NO: 2202189 - RNA, 23 nt, Human
uggccuugcagcacucacacagg

SEQ ID NO: 2202190 - RNA, 20 nt, Human
uggccuuucauauuuuagcu

SEQ ID NO: 2202191 - RNA, 14 nt, Human
uggccagaggcuug

SEQ ID NO: 2202192 - RNA, 20 nt, Human
uggccagagcugggaggcau

SEQ ID NO: 2202193 - RNA, 23 nt, Human
uggccagagcugggaggcauggc

SEQ ID NO: 2202194 - RNA, 14 nt, Human
uggccagagcuggg

SEQ ID NO: 2202195 - RNA, 15 nt, Human
uggccagagcuggga

SEQ ID NO: 2202196 - RNA, 17 nt, Human
uggccagagcugggagg

SEQ ID NO: 2202197 - RNA, 18 nt, Human
uggccagagcugggaggc

SEQ ID NO: 2202198 - RNA, 15 nt, Human
uggccagaugcacca

SEQ ID NO: 2202199 - RNA, 18 nt, Human
uggccuucggccuccauc

SEQ ID NO: 2202200 - RNA, 17 nt, Human
uggccuucggccuccau

SEQ ID NO: 2202201 - RNA, 22 nt, Human
uggcgucugucuucaagggcuu

SEQ ID NO: 2202202 - RNA, 20 nt, Human
uggcgucugucuucaagggc

SEQ ID NO: 2202203 - RNA, 17 nt, Human
uggcgucugucuucaag

SEQ ID NO: 2202204 - RNA, 15 nt, Human
uggcgucugucuuca

SEQ ID NO: 2202205 - RNA, 13 nt, Human
uggcgucugucuu

SEQ ID NO: 2202206 - RNA, 22 nt, Human
uggcgugcaguggugcgaucug

SEQ ID NO: 2202207 - RNA, 15 nt, Human
uggcgcugccccugg

SEQ ID NO: 2202208 - RNA, 14 nt, Human
uggcgcugccccug

SEQ ID NO: 2202209 - RNA, 13 nt, Human
uggcgcuaggcau

SEQ ID NO: 2202210 - RNA, 18 nt, Human
uggcgccgucuccagggg

SEQ ID NO: 2202211 - RNA, 15 nt, Human
uggcgccgucuccag

SEQ ID NO: 2202212 - RNA, 17 nt, Human
uggcgccgucuccaggg

SEQ ID NO: 2202213 - RNA, 15 nt, Human
uggcgcagugccucu

SEQ ID NO: 2202214 - RNA, 17 nt, Human
uggcgcagugccucugg

SEQ ID NO: 2202215 - RNA, 18 nt, Human
uggcgcagugccucuggu

SEQ ID NO: 2202216 - RNA, 13 nt, Human
uggcgcagugccu

SEQ ID NO: 2202217 - RNA, 17 nt, Human
uggcgagaggaggggcc

SEQ ID NO: 2202218 - RNA, 13 nt, Human
uggccuuuuccua

SEQ ID NO: 2202219 - RNA, 16 nt, Human
uggccuuuuccuauuu

SEQ ID NO: 2202220 - RNA, 18 nt, Human
uggcgugucccucucgga

SEQ ID NO: 2202221 - RNA, 20 nt, Human
uggcucagguggggucacuc

SEQ ID NO: 2202222 - RNA, 22 nt, Human
uggcucauauuccugcagccug

SEQ ID NO: 2202223 - RNA, 21 nt, Human
uggcucauauuccugcagccu

SEQ ID NO: 2202224 - RNA, 19 nt, Human
uggcucauauuccugcagc

SEQ ID NO: 2202225 - RNA, 22 nt, Human
uggcucagguggggucacucug

SEQ ID NO: 2202226 - RNA, 23 nt, Human
uggcuccugaggggcaucugccc

SEQ ID NO: 2202227 - RNA, 21 nt, Human
uggcuccugaggggcaucugc

SEQ ID NO: 2202228 - RNA, 20 nt, Human
uggcuccaaacccucgaggc

SEQ ID NO: 2202229 - RNA, 18 nt, Human
uggcuccaaacccucgag

SEQ ID NO: 2202230 - RNA, 16 nt, Human
uggcuccaaacccucg

SEQ ID NO: 2202231 - RNA, 19 nt, Human
uggcuccuucccaucgcug

SEQ ID NO: 2202232 - RNA, 17 nt, Human
uggcuccuucccaucgc

SEQ ID NO: 2202233 - RNA, 18 nt, Human
uggcucgaaucucugugc

SEQ ID NO: 2202234 - RNA, 19 nt, Human
uggcucgaaucucugugcc

SEQ ID NO: 2202235 - RNA, 20 nt, Human
uggcucgaaucucugugccu

SEQ ID NO: 2202236 - RNA, 16 nt, Human
uggcucucagaaggua

SEQ ID NO: 2202237 - RNA, 13 nt, Human
uggcucuccaagu

SEQ ID NO: 2202238 - RNA, 14 nt, Human
uggcucuggagaca

SEQ ID NO: 2202239 - RNA, 19 nt, Human
uggcucucauugacuuccu

SEQ ID NO: 2202240 - RNA, 21 nt, Human
uggcucuggagacagccccag

SEQ ID NO: 2202241 - RNA, 21 nt, Human
uggcucgaaucucugugccuu

SEQ ID NO: 2202242 - RNA, 13 nt, Human
uggcucuuccagg

SEQ ID NO: 2202243 - RNA, 15 nt, Human
uggcucuuccaggcu

SEQ ID NO: 2202244 - RNA, 22 nt, Human
uggcucuggagacagccccaga

SEQ ID NO: 2202245 - RNA, 16 nt, Human
uggcugggcccagaag

SEQ ID NO: 2202246 - RNA, 16 nt, Human
uggcucuuccaggcug

SEQ ID NO: 2202247 - RNA, 17 nt, Human
uggcugggggcaggagg

SEQ ID NO: 2202248 - RNA, 16 nt, Human
uggcugggggcaggag

SEQ ID NO: 2202249 - RNA, 20 nt, Human
uggcuggggccuaucagugu

SEQ ID NO: 2202250 - RNA, 21 nt, Human
uggcuggggccuaucagugug

SEQ ID NO: 2202251 - RNA, 22 nt, Human
uggcuggggccuaucagugugc

SEQ ID NO: 2202252 - RNA, 12 nt, Human
uggcugggggcc

SEQ ID NO: 2202253 - RNA, 23 nt, Human
ugggagcugccuguucagcucca

SEQ ID NO: 2202254 - RNA, 16 nt, Human
ugggagcugaggccac

SEQ ID NO: 2202255 - RNA, 22 nt, Human
ugggagcuccucuccuggagga

SEQ ID NO: 2202256 - RNA, 23 nt, Human
ugggagcuccucuccuggaggau

SEQ ID NO: 2202257 - RNA, 18 nt, Human
ugggagcuccucuccugg

SEQ ID NO: 2202258 - RNA, 19 nt, Human
ugggagcuccucuccugga

SEQ ID NO: 2202259 - RNA, 20 nt, Human
ugggagcuccucuccuggag

SEQ ID NO: 2202260 - RNA, 21 nt, Human
ugggagcuccucuccuggagg

SEQ ID NO: 2202261 - RNA, 23 nt, Human
ugggagccgggucugccucuucu

SEQ ID NO: 2202262 - RNA, 20 nt, Human
ugggagccugcaaacucacu

SEQ ID NO: 2202263 - RNA, 22 nt, Human
ugggagccugcaaacucacugc

SEQ ID NO: 2202264 - RNA, 16 nt, Human
ugggagcuccacucug

SEQ ID NO: 2202265 - RNA, 19 nt, Human
ugggagcuccacucugcuu

SEQ ID NO: 2202266 - RNA, 22 nt, Human
ugggagcuccacucugcuucuc

SEQ ID NO: 2202267 - RNA, 20 nt, Human
ugggagcgugggaggcggga

SEQ ID NO: 2202268 - RNA, 13 nt, Human
ugggagcuccucu

SEQ ID NO: 2202269 - RNA, 14 nt, Human
ugggagcuccucuc

SEQ ID NO: 2202270 - RNA, 15 nt, Human
ugggagcuccucucc

SEQ ID NO: 2202271 - RNA, 16 nt, Human
ugggagcuccucuccu

SEQ ID NO: 2202272 - RNA, 17 nt, Human
ugggagcuccucuccug

SEQ ID NO: 2202273 - RNA, 21 nt, Human
ugggagcagcgguuuggggag

SEQ ID NO: 2202274 - RNA, 23 nt, Human
ugggagcagcccgcugaguggac

SEQ ID NO: 2202275 - RNA, 13 nt, Human
ugggagcaggaga

SEQ ID NO: 2202276 - RNA, 14 nt, Human
ugggagcaggagau

SEQ ID NO: 2202277 - RNA, 22 nt, Human
ugggagcaggagauugagaagg

SEQ ID NO: 2202278 - RNA, 23 nt, Human
ugggagcaggagauugagaagga

SEQ ID NO: 2202279 - RNA, 16 nt, Human
ugggagccccaggguc

SEQ ID NO: 2202280 - RNA, 14 nt, Human
ugggagccccaggg

SEQ ID NO: 2202281 - RNA, 13 nt, Human
ugggagccccagg

SEQ ID NO: 2202282 - RNA, 12 nt, Human
ugggagccaggg

SEQ ID NO: 2202283 - RNA, 23 nt, Human
ugggagccccagggucuucccua

SEQ ID NO: 2202284 - RNA, 22 nt, Human
ugggagccccagggucuucccu

SEQ ID NO: 2202285 - RNA, 18 nt, Human
ugggagccgggucugccu

SEQ ID NO: 2202286 - RNA, 14 nt, Human
ugggagccgggucu

SEQ ID NO: 2202287 - RNA, 16 nt, Human
ugggacagggcauggc

SEQ ID NO: 2202288 - RNA, 22 nt, Human
ugggaauguauuauucugcagc

SEQ ID NO: 2202289 - RNA, 10 nt, Human
ugggaauguu

SEQ ID NO: 2202290 - RNA, 16 nt, Human
ugggacaugggaaagg

SEQ ID NO: 2202291 - RNA, 19 nt, Human
ugggacauuugcucaugga

SEQ ID NO: 2202292 - RNA, 20 nt, Human
ugggacauuugcucauggaa

SEQ ID NO: 2202293 - RNA, 18 nt, Human
ugggacccuuuccuuccu

SEQ ID NO: 2202294 - RNA, 17 nt, Human
ugggacccuuuccuucc

SEQ ID NO: 2202295 - RNA, 14 nt, Human
ugggacccuuuccu

SEQ ID NO: 2202296 - RNA, 13 nt, Human
ugggacccuuucc

SEQ ID NO: 2202297 - RNA, 23 nt, Human
ugggaccgccagauggggccucu

SEQ ID NO: 2202298 - RNA, 19 nt, Human
ugggaccgccagauggggc

SEQ ID NO: 2202299 - RNA, 21 nt, Human
ugggaccgccagauggggccu

SEQ ID NO: 2202300 - RNA, 12 nt, Human
ugggagcacugg

SEQ ID NO: 2202301 - RNA, 13 nt, Human
ugggagcacugga

SEQ ID NO: 2202302 - RNA, 23 nt, Human
ugggagcacuggagugcagggag

SEQ ID NO: 2202303 - RNA, 19 nt, Human
ugggaccacgugagaucau

SEQ ID NO: 2202304 - RNA, 17 nt, Human
ugggaccaaaccuagcc

SEQ ID NO: 2202305 - RNA, 16 nt, Human
ugggaccaaaccuagc

SEQ ID NO: 2202306 - RNA, 15 nt, Human
uggcuuuucacugcu

SEQ ID NO: 2202307 - RNA, 22 nt, Human
ugggaaugaaugucagugugac

SEQ ID NO: 2202308 - RNA, 14 nt, Human
uggcuuuucacugc

SEQ ID NO: 2202309 - RNA, 22 nt, Human
uggcuuuuauuaaugcacuuuc

SEQ ID NO: 2202310 - RNA, 15 nt, Human
ugggaaugagacaua

SEQ ID NO: 2202311 - RNA, 17 nt, Human
ugggaaugaggcuugcu

SEQ ID NO: 2202312 - RNA, 18 nt, Human
ugggaaugaggcuugcug

SEQ ID NO: 2202313 - RNA, 22 nt, Human
ugggaaugaggcuugcugagag

SEQ ID NO: 2202314 - RNA, 14 nt, Human
ugggaaugaggugg

SEQ ID NO: 2202315 - RNA, 17 nt, Human
ugggaaugaggugggag

SEQ ID NO: 2202316 - RNA, 16 nt, Human
ugggaaugcggcaaga

SEQ ID NO: 2202317 - RNA, 21 nt, Human
ugggaauguauuauucugcag

SEQ ID NO: 2202318 - RNA, 18 nt, Human
ugggacagucaccucaug

SEQ ID NO: 2202319 - RNA, 20 nt, Human
ugggacagucaccucaugga

SEQ ID NO: 2202320 - RNA, 21 nt, Human
ugggacagucaccucauggaa

SEQ ID NO: 2202321 - RNA, 14 nt, Human
uggcugggggccuc

SEQ ID NO: 2202322 - RNA, 22 nt, Human
uggcugguuagagguucccuuu

SEQ ID NO: 2202323 - RNA, 15 nt, Human
uggcugggggccuca

SEQ ID NO: 2202324 - RNA, 17 nt, Human
uggcugucagcaggaag

SEQ ID NO: 2202325 - RNA, 12 nt, Human
uggcuguccagu

SEQ ID NO: 2202326 - RNA, 14 nt, Human
uggcugucagcagg

SEQ ID NO: 2202327 - RNA, 17 nt, Human
uggcuguaucuuguuuu

SEQ ID NO: 2202328 - RNA, 20 nt, Human
uggcuguagaaggagacaga

SEQ ID NO: 2202329 - RNA, 18 nt, Human
uggcuguccagugcccau

SEQ ID NO: 2202330 - RNA, 15 nt, Human
uggcuguccagugcc

SEQ ID NO: 2202331 - RNA, 17 nt, Human
uggcuguccagugccca

SEQ ID NO: 2202332 - RNA, 20 nt, Human
uggcuuugugauucaaucug

SEQ ID NO: 2202333 - RNA, 17 nt, Human
uggcuuuuauuaaugca

SEQ ID NO: 2202334 - RNA, 15 nt, Human
uggcuuuuagacaga

SEQ ID NO: 2202335 - RNA, 16 nt, Human
uggcuuuuagacagau

SEQ ID NO: 2202336 - RNA, 20 nt, Human
uggcuuuuauuaaugcacuu

SEQ ID NO: 2202337 - RNA, 21 nt, Human
uggcuuuuauuaaugcacuuu

SEQ ID NO: 2202338 - RNA, 22 nt, Human
uggguccaaauaaaaacuaaau

SEQ ID NO: 2202339 - RNA, 13 nt, Human
uggguccaaauaa

SEQ ID NO: 2202340 - RNA, 14 nt, Human
uggguccaaauaaa

SEQ ID NO: 2202341 - RNA, 16 nt, Human
uggguccaaauaaaaa

SEQ ID NO: 2202342 - RNA, 18 nt, Human
uggguccaaauaaaaacu

SEQ ID NO: 2202343 - RNA, 12 nt, Human
ugggucagucug

SEQ ID NO: 2202344 - RNA, 23 nt, Human
ugggucaguguccaaagcagggu

SEQ ID NO: 2202345 - RNA, 13 nt, Human
ugggucaggcagg

SEQ ID NO: 2202346 - RNA, 13 nt, Human
uggguagcuguaa

SEQ ID NO: 2202347 - RNA, 20 nt, Human
uggggugggccucugguuug

SEQ ID NO: 2202348 - RNA, 22 nt, Human
uggguagcuguaaggcaugaag

SEQ ID NO: 2202349 - RNA, 12 nt, Human
uggguauaaaag

SEQ ID NO: 2202350 - RNA, 18 nt, Human
ugggucaccccuccagga

SEQ ID NO: 2202351 - RNA, 21 nt, Human
ugggguggggggggugcuggg

SEQ ID NO: 2202352 - RNA, 22 nt, Human
ugggguggggggggugcugggc

SEQ ID NO: 2202353 - RNA, 17 nt, Human
uggguagacacacauga

SEQ ID NO: 2202354 - RNA, 16 nt, Human
uggguagacacacaug

SEQ ID NO: 2202355 - RNA, 17 nt, Human
uggggcaggcuggcugg

SEQ ID NO: 2202356 - RNA, 14 nt, Human
uggggcaggcagug

SEQ ID NO: 2202357 - RNA, 12 nt, Human
uggggcaggcag

SEQ ID NO: 2202358 - RNA, 22 nt, Human
uggggcagucaccugcccagau

SEQ ID NO: 2202359 - RNA, 17 nt, Human
uggggcaguagaagguc

SEQ ID NO: 2202360 - RNA, 11 nt, Human
uggggcagugg

SEQ ID NO: 2202361 - RNA, 19 nt, Human
ugggguggggggggugcug

SEQ ID NO: 2202362 - RNA, 17 nt, Human
ugggguggggaccucag

SEQ ID NO: 2202363 - RNA, 11 nt, Human
uggguucauua

SEQ ID NO: 2202364 - RNA, 22 nt, Human
uggguucagaaaugcugccugc

SEQ ID NO: 2202365 - RNA, 20 nt, Human
uggguucauuauuggaauua

SEQ ID NO: 2202366 - RNA, 18 nt, Human
uggguucauuauuggaau

SEQ ID NO: 2202367 - RNA, 16 nt, Human
uggguucauuauugga

SEQ ID NO: 2202368 - RNA, 13 nt, Human
uggguucauuauu

SEQ ID NO: 2202369 - RNA, 21 nt, Human
uggguuccagcaauucuccug

SEQ ID NO: 2202370 - RNA, 20 nt, Human
uggguucccuuuccuuccau

SEQ ID NO: 2202371 - RNA, 21 nt, Human
uggguuccucuuccccacucc

SEQ ID NO: 2202372 - RNA, 13 nt, Human
uggguuccucuuc

SEQ ID NO: 2202373 - RNA, 22 nt, Human
uggguuccuuccucugagccuu

SEQ ID NO: 2202374 - RNA, 21 nt, Human
uggguuccuuccucugagccu

SEQ ID NO: 2202375 - RNA, 22 nt, Human
uggguuucacaagugaaaaaca

SEQ ID NO: 2202376 - RNA, 16 nt, Human
uggguuggugcuucua

SEQ ID NO: 2202377 - RNA, 16 nt, Human
uggguuucauauuucu

SEQ ID NO: 2202378 - RNA, 15 nt, Human
uggguuggugcacag

SEQ ID NO: 2202379 - RNA, 19 nt, Human
uggguuggugcacagugau

SEQ ID NO: 2202380 - RNA, 20 nt, Human
uggguuggugcacagugauu

SEQ ID NO: 2202381 - RNA, 15 nt, Human
uggguuggcgcaccc

SEQ ID NO: 2202382 - RNA, 17 nt, Human
uggguuggcgcacccuc

SEQ ID NO: 2202383 - RNA, 22 nt, Human
uggguuggcgcacccuccccuc

SEQ ID NO: 2202384 - RNA, 23 nt, Human
uggguuggcgcacccuccccucc

SEQ ID NO: 2202385 - RNA, 14 nt, Human
uggguugacuuuca

SEQ ID NO: 2202386 - RNA, 17 nt, Human
uggguucuuuggaagga

SEQ ID NO: 2202387 - RNA, 22 nt, Human
uggguucugccugccagcugca

SEQ ID NO: 2202388 - RNA, 21 nt, Human
uggguucugccugccagcugc

SEQ ID NO: 2202389 - RNA, 23 nt, Human
uggguucuuuggaaggagugaga

SEQ ID NO: 2202390 - RNA, 17 nt, Human
uggguuggaaaacagua

SEQ ID NO: 2202391 - RNA, 21 nt, Human
ugggugucaagagggucugag

SEQ ID NO: 2202392 - RNA, 23 nt, Human
ugggugucaagagggucugagga

SEQ ID NO: 2202393 - RNA, 22 nt, Human
uggguguauuuauuuuccuccc

SEQ ID NO: 2202394 - RNA, 21 nt, Human
uggguccaggggccccuccag

SEQ ID NO: 2202395 - RNA, 17 nt, Human
uggguccaugggcagag

SEQ ID NO: 2202396 - RNA, 14 nt, Human
uggguccaugggca

SEQ ID NO: 2202397 - RNA, 18 nt, Human
uggguccaggggccccuc

SEQ ID NO: 2202398 - RNA, 19 nt, Human
uggguccaggggccccucc

SEQ ID NO: 2202399 - RNA, 21 nt, Human
uggguccaggggaugggaggu

SEQ ID NO: 2202400 - RNA, 20 nt, Human
uggguccaggggaugggagg

SEQ ID NO: 2202401 - RNA, 15 nt, Human
uggguccaggggaug

SEQ ID NO: 2202402 - RNA, 23 nt, Human
uggguucaagcgauucuucugcu

SEQ ID NO: 2202403 - RNA, 14 nt, Human
uggguguggcgcag

SEQ ID NO: 2202404 - RNA, 18 nt, Human
uggguguccaaaggaaga

SEQ ID NO: 2202405 - RNA, 24 nt, Human
uggguucaggggacucagcccuga

SEQ ID NO: 2202406 - RNA, 20 nt, Human
uggguucagaaaugcugccu

SEQ ID NO: 2202407 - RNA, 21 nt, Human
uggguucagaaaugcugccug

SEQ ID NO: 2202408 - RNA, 15 nt, Human
uggguuaugaauauu

SEQ ID NO: 2202409 - RNA, 15 nt, Human
uggguuauucuggag

SEQ ID NO: 2202410 - RNA, 16 nt, Human
uggguuauucuggagu

SEQ ID NO: 2202411 - RNA, 17 nt, Human
uggguuauucuggaguu

SEQ ID NO: 2202412 - RNA, 16 nt, Human
uggguucacugcaacc

SEQ ID NO: 2202413 - RNA, 14 nt, Human
ugggcggggccuug

SEQ ID NO: 2202414 - RNA, 15 nt, Human
ugggcggggccuugc

SEQ ID NO: 2202415 - RNA, 17 nt, Human
ugggcgugagaccugcc

SEQ ID NO: 2202416 - RNA, 19 nt, Human
ugggcgugagaccugcccc

SEQ ID NO: 2202417 - RNA, 18 nt, Human
ugggcgugagaccugccc

SEQ ID NO: 2202418 - RNA, 18 nt, Human
ugggcuucaguggcagcu

SEQ ID NO: 2202419 - RNA, 19 nt, Human
ugggcuucaguggcagcug

SEQ ID NO: 2202420 - RNA, 13 nt, Human
ugggcggcagaga

SEQ ID NO: 2202421 - RNA, 15 nt, Human
ugggcggcagagagg

SEQ ID NO: 2202422 - RNA, 19 nt, Human
ugggcggcagagaggacug

SEQ ID NO: 2202423 - RNA, 12 nt, Human
ugggcggcugag

SEQ ID NO: 2202424 - RNA, 14 nt, Human
ugggcggcugagag

SEQ ID NO: 2202425 - RNA, 15 nt, Human
ugggcggcugagagc

SEQ ID NO: 2202426 - RNA, 16 nt, Human
ugggcggcugagagcc

SEQ ID NO: 2202427 - RNA, 18 nt, Human
ugggcggcugagagcccc

SEQ ID NO: 2202428 - RNA, 21 nt, Human
ugggcggcugagagccccagc

SEQ ID NO: 2202429 - RNA, 13 nt, Human
ugggcgggcagca

SEQ ID NO: 2202430 - RNA, 18 nt, Human
ugggcgggcagcacagca

SEQ ID NO: 2202431 - RNA, 19 nt, Human
ugggcgggcagcacagcaa

SEQ ID NO: 2202432 - RNA, 17 nt, Human
ugggcgcccuggaagcc

SEQ ID NO: 2202433 - RNA, 15 nt, Human
ugggcggcacagccu

SEQ ID NO: 2202434 - RNA, 15 nt, Human
ugggcgcccuggaag

SEQ ID NO: 2202435 - RNA, 16 nt, Human
ugggcgcccuggaagc

SEQ ID NO: 2202436 - RNA, 20 nt, Human
ugggcgcccuggaagccggc

SEQ ID NO: 2202437 - RNA, 20 nt, Human
ugggcuucaguggcagcugc

SEQ ID NO: 2202438 - RNA, 15 nt, Human
ugggcuuggccugcu

SEQ ID NO: 2202439 - RNA, 16 nt, Human
ugggcuuggccugcug

SEQ ID NO: 2202440 - RNA, 16 nt, Human
ugggcggggccuugcg

SEQ ID NO: 2202441 - RNA, 19 nt, Human
ugggcuuggggaccagagc

SEQ ID NO: 2202442 - RNA, 19 nt, Human
ugggcuuggccugcuguga

SEQ ID NO: 2202443 - RNA, 17 nt, Human
ugggcuuggccugcugu

SEQ ID NO: 2202444 - RNA, 18 nt, Human
ugggcuuggccugcugug

SEQ ID NO: 2202445 - RNA, 16 nt, Human
uggggcagcuugaggg

SEQ ID NO: 2202446 - RNA, 21 nt, Human
ugggcuuggggaccagagcug

SEQ ID NO: 2202447 - RNA, 14 nt, Human
ugggccuccugugu

SEQ ID NO: 2202448 - RNA, 22 nt, Human
ugggcauggggugggccucugg

SEQ ID NO: 2202449 - RNA, 16 nt, Human
ugggcaucuguucugg

SEQ ID NO: 2202450 - RNA, 17 nt, Human
ugggcaucuguucuggu

SEQ ID NO: 2202451 - RNA, 21 nt, Human
ugggcauacuaauaaaguaug

SEQ ID NO: 2202452 - RNA, 16 nt, Human
ugggcauagaugcagg

SEQ ID NO: 2202453 - RNA, 22 nt, Human
ugggcauagaugcaggugagcc

SEQ ID NO: 2202454 - RNA, 15 nt, Human
ugggcaucuguucug

SEQ ID NO: 2202455 - RNA, 13 nt, Human
ugggcauggggug

SEQ ID NO: 2202456 - RNA, 15 nt, Human
ugggcaugggguggg

SEQ ID NO: 2202457 - RNA, 20 nt, Human
ugggcauggggugggccucu

SEQ ID NO: 2202458 - RNA, 21 nt, Human
ugggcauggggugggccucug

SEQ ID NO: 2202459 - RNA, 16 nt, Human
ugggccuccugugugu

SEQ ID NO: 2202460 - RNA, 22 nt, Human
ugggccuccugugugugcgccu

SEQ ID NO: 2202461 - RNA, 20 nt, Human
ugggccuccucuguccaggg

SEQ ID NO: 2202462 - RNA, 18 nt, Human
ugggccuccucuguccag

SEQ ID NO: 2202463 - RNA, 18 nt, Human
ugggccuucagggaguga

SEQ ID NO: 2202464 - RNA, 13 nt, Human
ugggccuugcuac

SEQ ID NO: 2202465 - RNA, 12 nt, Human
ugggccuugcug

SEQ ID NO: 2202466 - RNA, 15 nt, Human
ugggccuucagggag

SEQ ID NO: 2202467 - RNA, 14 nt, Human
ugggccuugcuggg

SEQ ID NO: 2202468 - RNA, 15 nt, Human
ugggaggaaauuuga

SEQ ID NO: 2202469 - RNA, 12 nt, Human
ugggaggaagca

SEQ ID NO: 2202470 - RNA, 11 nt, Human
ugggaggaagc

SEQ ID NO: 2202471 - RNA, 20 nt, Human
ugggaggaaaagaaaagagg

SEQ ID NO: 2202472 - RNA, 12 nt, Human
ugggaggaaaag

SEQ ID NO: 2202473 - RNA, 20 nt, Human
ugggagcuugauucucagca

SEQ ID NO: 2202474 - RNA, 16 nt, Human
ugggagcuugggaaug

SEQ ID NO: 2202475 - RNA, 19 nt, Human
ugggagcugguuagaaaug

SEQ ID NO: 2202476 - RNA, 24 nt, Human
ugggagcugccuguucagcuccag

SEQ ID NO: 2202477 - RNA, 17 nt, Human
ugggagcugaaaaauca

SEQ ID NO: 2202478 - RNA, 18 nt, Human
ugggagcugguuagaaau

SEQ ID NO: 2202479 - RNA, 20 nt, Human
ugggagcugguuagaaaugc

SEQ ID NO: 2202480 - RNA, 13 nt, Human
ugggaggaagcag

SEQ ID NO: 2202481 - RNA, 14 nt, Human
ugggaggaagcaga

SEQ ID NO: 2202482 - RNA, 15 nt, Human
ugggaggaagcagaa

SEQ ID NO: 2202483 - RNA, 16 nt, Human
ugggaggaagcagaau

SEQ ID NO: 2202484 - RNA, 17 nt, Human
ugggaggaagcagaaua

SEQ ID NO: 2202485 - RNA, 18 nt, Human
ugggaggaagcagaauaa

SEQ ID NO: 2202486 - RNA, 19 nt, Human
ugggaggaagcagaauaaa

SEQ ID NO: 2202487 - RNA, 24 nt, Human
ugggaggaagcagguugaggggcu

SEQ ID NO: 2202488 - RNA, 19 nt, Human
ugggaggacggugcaaccc

SEQ ID NO: 2202489 - RNA, 20 nt, Human
ugggaggaagcagaauaaag

SEQ ID NO: 2202490 - RNA, 21 nt, Human
ugggaggaagcagaauaaagc

SEQ ID NO: 2202491 - RNA, 22 nt, Human
ugggaggaagcagaauaaagca

SEQ ID NO: 2202492 - RNA, 23 nt, Human
ugggaggaagcagaauaaagcaa

SEQ ID NO: 2202493 - RNA, 15 nt, Human
ugggcaguuacaugc

SEQ ID NO: 2202494 - RNA, 14 nt, Human
ugggaggagggaga

SEQ ID NO: 2202495 - RNA, 20 nt, Human
ugggaggacggugcaaccca

SEQ ID NO: 2202496 - RNA, 13 nt, Human
ugggaggagggag

SEQ ID NO: 2202497 - RNA, 17 nt, Human
ugggcaguuacaugcau

SEQ ID NO: 2202498 - RNA, 18 nt, Human
ugggcaguuuuucuguau

SEQ ID NO: 2202499 - RNA, 22 nt, Human
ugggcaguuuuucuguauuuua

SEQ ID NO: 2202500 - RNA, 16 nt, Human
ugggcauacuaauaaa

SEQ ID NO: 2202501 - RNA, 17 nt, Human
ugcuugaacccaggaga

SEQ ID NO: 2202502 - RNA, 19 nt, Human
ugcuuguucccucucccug

SEQ ID NO: 2202503 - RNA, 16 nt, Human
ugcuuguucccucucc

SEQ ID NO: 2202504 - RNA, 21 nt, Human
ugcuugaaagaaaauaugcau

SEQ ID NO: 2202505 - RNA, 14 nt, Human
ugcuugaaagaaaa

SEQ ID NO: 2202506 - RNA, 18 nt, Human
ugcuuguuaacugagugc

SEQ ID NO: 2202507 - RNA, 19 nt, Human
ugcuucuuucuuugggaau

SEQ ID NO: 2202508 - RNA, 17 nt, Human
ugcuucuuucauuuucu

SEQ ID NO: 2202509 - RNA, 16 nt, Human
ugcuugaaaaaugugc

SEQ ID NO: 2202510 - RNA, 17 nt, Human
ugcuugaaaaaugugca

SEQ ID NO: 2202511 - RNA, 22 nt, Human
ugcuugaaaaaugugcaaaaca

SEQ ID NO: 2202512 - RNA, 23 nt, Human
ugcuucuucuccuauguguaagg

SEQ ID NO: 2202513 - RNA, 15 nt, Human
ugcuucuuucauuuu

SEQ ID NO: 2202514 - RNA, 16 nt, Human
ugcuucuucucaggca

SEQ ID NO: 2202515 - RNA, 21 nt, Human
ugcuucuucuccuauguguaa

SEQ ID NO: 2202516 - RNA, 14 nt, Human
ugcuucuuggaguc

SEQ ID NO: 2202517 - RNA, 14 nt, Human
ugcuuguuggauuu

SEQ ID NO: 2202518 - RNA, 15 nt, Human
ugcuuguugggauuc

SEQ ID NO: 2202519 - RNA, 19 nt, Human
ugcuuguugggauuccuga

SEQ ID NO: 2202520 - RNA, 22 nt, Human
ugcuuguugggauuccugaccc

SEQ ID NO: 2202521 - RNA, 23 nt, Human
ugcuuguuugcucaccuggggug

SEQ ID NO: 2202522 - RNA, 23 nt, Human
ugcuuguugggauuccugaccca

SEQ ID NO: 2202523 - RNA, 14 nt, Human
ugcuuguuuacagc

SEQ ID NO: 2202524 - RNA, 14 nt, Human
ugcuuguuuccuag

SEQ ID NO: 2202525 - RNA, 23 nt, Human
ugcuuuaaaaacuauuuaacuug

SEQ ID NO: 2202526 - RNA, 13 nt, Human
ugcuuuaaaaacu

SEQ ID NO: 2202527 - RNA, 16 nt, Human
ugcuuuaaaaacuauu

SEQ ID NO: 2202528 - RNA, 12 nt, Human
ugcuuuaaacau

SEQ ID NO: 2202529 - RNA, 13 nt, Human
ugcuuuagcuuga

SEQ ID NO: 2202530 - RNA, 22 nt, Human
ugcuuuagcuugaaaaggugac

SEQ ID NO: 2202531 - RNA, 17 nt, Human
ugcuuuaggcucacggc

SEQ ID NO: 2202532 - RNA, 13 nt, Human
ugcuuuaugcuga

SEQ ID NO: 2202533 - RNA, 15 nt, Human
ugcuuuaugccuucu

SEQ ID NO: 2202534 - RNA, 12 nt, Human
ugcuuuauaaau

SEQ ID NO: 2202535 - RNA, 14 nt, Human
ugcuuuauaaauaa

SEQ ID NO: 2202536 - RNA, 19 nt, Human
ugcuuucaucuuggucaca

SEQ ID NO: 2202537 - RNA, 20 nt, Human
ugcuuucagauuaaaauugu

SEQ ID NO: 2202538 - RNA, 14 nt, Human
ugcuuuccaaagcc

SEQ ID NO: 2202539 - RNA, 20 nt, Human
ugcuuuccacaccuggcacu

SEQ ID NO: 2202540 - RNA, 12 nt, Human
ugcuuuccagcu

SEQ ID NO: 2202541 - RNA, 13 nt, Human
ugcuuuccagcuc

SEQ ID NO: 2202542 - RNA, 14 nt, Human
ugcuuuccagcuca

SEQ ID NO: 2202543 - RNA, 17 nt, Human
ugcuuuuuuguuuuggc

SEQ ID NO: 2202544 - RNA, 17 nt, Human
ugcuuuaugcugaaaca

SEQ ID NO: 2202545 - RNA, 15 nt, Human
ugcuuuaugcugaaa

SEQ ID NO: 2202546 - RNA, 14 nt, Human
ugcuuuaugcugaa

SEQ ID NO: 2202547 - RNA, 14 nt, Human
ugcuuuauuccaga

SEQ ID NO: 2202548 - RNA, 17 nt, Human
ugcuuuauuccagaaug

SEQ ID NO: 2202549 - RNA, 15 nt, Human
ugcuuuauuccagaa

SEQ ID NO: 2202550 - RNA, 14 nt, Human
ugcugccuccagaa

SEQ ID NO: 2202551 - RNA, 13 nt, Human
ugcugccucaugc

SEQ ID NO: 2202552 - RNA, 18 nt, Human
ugcuuccagugaggcucu

SEQ ID NO: 2202553 - RNA, 19 nt, Human
ugcugccgccucccagccu

SEQ ID NO: 2202554 - RNA, 17 nt, Human
ugcugccgccucccagc

SEQ ID NO: 2202555 - RNA, 16 nt, Human
ugcugccgccucccag

SEQ ID NO: 2202556 - RNA, 23 nt, Human
ugcugccgccccacccagauggg

SEQ ID NO: 2202557 - RNA, 21 nt, Human
ugcugccgccucccagccugg

SEQ ID NO: 2202558 - RNA, 20 nt, Human
ugcugccgccucccagccug

SEQ ID NO: 2202559 - RNA, 18 nt, Human
ugcugccuaggcugaccu

SEQ ID NO: 2202560 - RNA, 13 nt, Human
ugcugccuaggcu

SEQ ID NO: 2202561 - RNA, 22 nt, Human
ugcugccuccccaacccugccc

SEQ ID NO: 2202562 - RNA, 15 nt, Human
ugcuucgggcccuuc

SEQ ID NO: 2202563 - RNA, 19 nt, Human
ugcugccuccccaacccug

SEQ ID NO: 2202564 - RNA, 18 nt, Human
ugcuucgggcccuuccca

SEQ ID NO: 2202565 - RNA, 17 nt, Human
ugcugccuccccaaccc

SEQ ID NO: 2202566 - RNA, 14 nt, Human
ugcugccuccccaa

SEQ ID NO: 2202567 - RNA, 13 nt, Human
ugcugccucccca

SEQ ID NO: 2202568 - RNA, 12 nt, Human
ugcugccucccc

SEQ ID NO: 2202569 - RNA, 21 nt, Human
ugcuuccagugaggcucugcc

SEQ ID NO: 2202570 - RNA, 19 nt, Human
ugcuuccagugaggcucug

SEQ ID NO: 2202571 - RNA, 20 nt, Human
ugcuuccagugaggcucugc

SEQ ID NO: 2202572 - RNA, 22 nt, Human
ugcuucuaauauuuauugcuuu

SEQ ID NO: 2202573 - RNA, 12 nt, Human
ugcuucucacug

SEQ ID NO: 2202574 - RNA, 14 nt, Human
ugcuucucugacuu

SEQ ID NO: 2202575 - RNA, 17 nt, Human
ugcuucucugacuucug

SEQ ID NO: 2202576 - RNA, 19 nt, Human
ugcuucucugacuucugcc

SEQ ID NO: 2202577 - RNA, 20 nt, Human
ugcuucucugacuucugccu

SEQ ID NO: 2202578 - RNA, 14 nt, Human
ugcuucuucucagg

SEQ ID NO: 2202579 - RNA, 13 nt, Human
ugcuucugggaga

SEQ ID NO: 2202580 - RNA, 16 nt, Human
ugcuucuucagagacu

SEQ ID NO: 2202581 - RNA, 23 nt, Human
ugcuucucugacuucugccugga

SEQ ID NO: 2202582 - RNA, 21 nt, Human
ugcuucucugacuucugccug

SEQ ID NO: 2202583 - RNA, 22 nt, Human
ugcuucucugacuucugccugg

SEQ ID NO: 2202584 - RNA, 14 nt, Human
ugcuucuguuuuau

SEQ ID NO: 2202585 - RNA, 12 nt, Human
uggaacccagac

SEQ ID NO: 2202586 - RNA, 15 nt, Human
uggaacccagacuca

SEQ ID NO: 2202587 - RNA, 14 nt, Human
uggaacccagacuc

SEQ ID NO: 2202588 - RNA, 17 nt, Human
uggaacccagacucaga

SEQ ID NO: 2202589 - RNA, 16 nt, Human
uggaacccagacucag

SEQ ID NO: 2202590 - RNA, 22 nt, Human
uggaacccagacucagacauug

SEQ ID NO: 2202591 - RNA, 16 nt, Human
uggaaaauaaauuauu

SEQ ID NO: 2202592 - RNA, 15 nt, Human
uggaaaauaaauuau

SEQ ID NO: 2202593 - RNA, 23 nt, Human
uggaaaaacaucugaaagccacg

SEQ ID NO: 2202594 - RNA, 20 nt, Human
uggaaaaaccacccccaaau

SEQ ID NO: 2202595 - RNA, 11 nt, Human
uggaaaauaaa

SEQ ID NO: 2202596 - RNA, 15 nt, Human
uggaaaauaaaucaa

SEQ ID NO: 2202597 - RNA, 22 nt, Human
uggaaaaaaugauguucauuua

SEQ ID NO: 2202598 - RNA, 12 nt, Human
uggaaaaaguga

SEQ ID NO: 2202599 - RNA, 17 nt, Human
uggaaaaagugauggag

SEQ ID NO: 2202600 - RNA, 20 nt, Human
uggaaccgcaggaagcugcu

SEQ ID NO: 2202601 - RNA, 16 nt, Human
uggaaccucagccugg

SEQ ID NO: 2202602 - RNA, 15 nt, Human
uggaaccucagccug

SEQ ID NO: 2202603 - RNA, 13 nt, Human
uggaacucugcuu

SEQ ID NO: 2202604 - RNA, 23 nt, Human
uggaaccgcaggaagcugcuccg

SEQ ID NO: 2202605 - RNA, 19 nt, Human
uggaaccgcaggaagcugc

SEQ ID NO: 2202606 - RNA, 17 nt, Human
uggaaccgcaggaagcu

SEQ ID NO: 2202607 - RNA, 16 nt, Human
uggaaccgcaggaagc

SEQ ID NO: 2202608 - RNA, 21 nt, Human
uggaacccuuuuggcccccga

SEQ ID NO: 2202609 - RNA, 19 nt, Human
uggaacccuuuuggccccc

SEQ ID NO: 2202610 - RNA, 18 nt, Human
uggaacccuuuuggcccc

SEQ ID NO: 2202611 - RNA, 14 nt, Human
uggaacucucgagc

SEQ ID NO: 2202612 - RNA, 11 nt, Human
uggaagacagc

SEQ ID NO: 2202613 - RNA, 12 nt, Human
uggaagacagcu

SEQ ID NO: 2202614 - RNA, 16 nt, Human
uggaacuuacauuguu

SEQ ID NO: 2202615 - RNA, 23 nt, Human
uggaacugucucucaugaaccuc

SEQ ID NO: 2202616 - RNA, 13 nt, Human
uggaagacagaga

SEQ ID NO: 2202617 - RNA, 15 nt, Human
uggaaguuuucagga

SEQ ID NO: 2202618 - RNA, 13 nt, Human
uggaaguuuucag

SEQ ID NO: 2202619 - RNA, 15 nt, Human
uggaauacaguguua

SEQ ID NO: 2202620 - RNA, 14 nt, Human
uggaauacaguguu

SEQ ID NO: 2202621 - RNA, 14 nt, Human
uggaauacaugaaa

SEQ ID NO: 2202622 - RNA, 22 nt, Human
uggaauacaguguuauuuucuu

SEQ ID NO: 2202623 - RNA, 14 nt, Human
uggaauacauuucu

SEQ ID NO: 2202624 - RNA, 15 nt, Human
uggaauacaugaaau

SEQ ID NO: 2202625 - RNA, 22 nt, Human
uggaauacuaaaaaucaugaga

SEQ ID NO: 2202626 - RNA, 20 nt, Human
uggaauacuaaaaaucauga

SEQ ID NO: 2202627 - RNA, 18 nt, Human
uggaauacuuuuuguuau

SEQ ID NO: 2202628 - RNA, 13 nt, Human
uggaauacuuuuu

SEQ ID NO: 2202629 - RNA, 12 nt, Human
uggaauacuuuu

SEQ ID NO: 2202630 - RNA, 21 nt, Human
uggaagugugugaucuguggg

SEQ ID NO: 2202631 - RNA, 23 nt, Human
uggaagugugggucugugugugu

SEQ ID NO: 2202632 - RNA, 20 nt, Human
uggaagacagagaccuccug

SEQ ID NO: 2202633 - RNA, 23 nt, Human
uggaagacagagaccuccugccu

SEQ ID NO: 2202634 - RNA, 11 nt, Human
uggaaguugca

SEQ ID NO: 2202635 - RNA, 16 nt, Human
uggaaguugcauggca

SEQ ID NO: 2202636 - RNA, 18 nt, Human
uggaaguugcauggcauc

SEQ ID NO: 2202637 - RNA, 14 nt, Human
uggaagacagcucu

SEQ ID NO: 2202638 - RNA, 21 nt, Human
uggaagugugggucugugugu

SEQ ID NO: 2202639 - RNA, 23 nt, Human
uggaauauuccccuaucucuaga

SEQ ID NO: 2202640 - RNA, 20 nt, Human
uggaauauuguccauugucc

SEQ ID NO: 2202641 - RNA, 15 nt, Human
uggaauauuguccau

SEQ ID NO: 2202642 - RNA, 21 nt, Human
uggaauaguauccuccagguu

SEQ ID NO: 2202643 - RNA, 17 nt, Human
uggaauaguauccucca

SEQ ID NO: 2202644 - RNA, 18 nt, Human
uggaauaguauccuccag

SEQ ID NO: 2202645 - RNA, 19 nt, Human
uggaauaguauccuccagg

SEQ ID NO: 2202646 - RNA, 20 nt, Human
uggaauaguauccuccaggu

SEQ ID NO: 2202647 - RNA, 12 nt, Human
uggaaucuggag

SEQ ID NO: 2202648 - RNA, 19 nt, Human
uggaaucuaccaacuguuu

SEQ ID NO: 2202649 - RNA, 13 nt, Human
uggaaucuggaga

SEQ ID NO: 2202650 - RNA, 23 nt, Human
uggaaucaggaauauuuuccaaa

SEQ ID NO: 2202651 - RNA, 21 nt, Human
uggaaucaggaauauuuucca

SEQ ID NO: 2202652 - RNA, 22 nt, Human
uggaaucaggaauauuuuccaa

SEQ ID NO: 2202653 - RNA, 14 nt, Human
uggaauguaaucaa

SEQ ID NO: 2202654 - RNA, 21 nt, Human
uggaauguggccccugaacaa

SEQ ID NO: 2202655 - RNA, 15 nt, Human
uggaaucuggagagc

SEQ ID NO: 2202656 - RNA, 21 nt, Human
uggaaugguuauaaaagugau

SEQ ID NO: 2202657 - RNA, 18 nt, Human
uggaaucuggagaccagg

SEQ ID NO: 2202658 - RNA, 17 nt, Human
uggaaucuggagaccag

SEQ ID NO: 2202659 - RNA, 20 nt, Human
uggaauuaaccuggugcugg

SEQ ID NO: 2202660 - RNA, 19 nt, Human
uggaauuaaccuggugcug

SEQ ID NO: 2202661 - RNA, 18 nt, Human
uggaauuaaccuggugcu

SEQ ID NO: 2202662 - RNA, 17 nt, Human
uggaauuaaccuggugc

SEQ ID NO: 2202663 - RNA, 16 nt, Human
uggaauuaaccuggug

SEQ ID NO: 2202664 - RNA, 23 nt, Human
uggaauguggccccugaacaaga

SEQ ID NO: 2202665 - RNA, 21 nt, Human
uggaauuaaccuggugcugga

SEQ ID NO: 2202666 - RNA, 15 nt, Human
uggaauuauuuuaaa

SEQ ID NO: 2202667 - RNA, 22 nt, Human
uggauacugcccggggcagcug

SEQ ID NO: 2202668 - RNA, 17 nt, Human
uggauacugcccggggc

SEQ ID NO: 2202669 - RNA, 18 nt, Human
uggauaaugcuguugccu

SEQ ID NO: 2202670 - RNA, 18 nt, Human
uggauacauacaccagca

SEQ ID NO: 2202671 - RNA, 16 nt, Human
uggauaggagccugcu

SEQ ID NO: 2202672 - RNA, 16 nt, Human
uggauauaguuuuacu

SEQ ID NO: 2202673 - RNA, 18 nt, Human
uggaucuucaauggcuuu

SEQ ID NO: 2202674 - RNA, 12 nt, Human
uggauauaaaua

SEQ ID NO: 2202675 - RNA, 13 nt, Human
uggauauaaauau

SEQ ID NO: 2202676 - RNA, 17 nt, Human
uggauauaaauauauau

SEQ ID NO: 2202677 - RNA, 12 nt, Human
uggaugauguuu

SEQ ID NO: 2202678 - RNA, 21 nt, Human
uggaugauggucuucagccuc

SEQ ID NO: 2202679 - RNA, 20 nt, Human
uggaugauggucuucagccu

SEQ ID NO: 2202680 - RNA, 17 nt, Human
uggaugagcccucagaa

SEQ ID NO: 2202681 - RNA, 20 nt, Human
uggaugagacuuccaaaccu

SEQ ID NO: 2202682 - RNA, 20 nt, Human
uggaugaccagaacaagguu

SEQ ID NO: 2202683 - RNA, 15 nt, Human
uggaugagcccucag

SEQ ID NO: 2202684 - RNA, 13 nt, Human
uggaugaccagaa

SEQ ID NO: 2202685 - RNA, 22 nt, Human
uggaugaagauucuccugugcu

SEQ ID NO: 2202686 - RNA, 23 nt, Human
uggaugaagauucuccugugcua

SEQ ID NO: 2202687 - RNA, 14 nt, Human
uggaugaaauuuuc

SEQ ID NO: 2202688 - RNA, 14 nt, Human
uggauauaaauaua

SEQ ID NO: 2202689 - RNA, 15 nt, Human
uggaugaaauuuucu

SEQ ID NO: 2202690 - RNA, 17 nt, Human
uggaugaaauuuucuag

SEQ ID NO: 2202691 - RNA, 18 nt, Human
uggaugaaauuuucuaga

SEQ ID NO: 2202692 - RNA, 19 nt, Human
uggaugaagauucuccugu

SEQ ID NO: 2202693 - RNA, 22 nt, Human
uggaggcacacagcugcagaga

SEQ ID NO: 2202694 - RNA, 14 nt, Human
uggaggcacuuuag

SEQ ID NO: 2202695 - RNA, 22 nt, Human
uggaggcagggccuugcccaga

SEQ ID NO: 2202696 - RNA, 14 nt, Human
uggaggcagggccu

SEQ ID NO: 2202697 - RNA, 13 nt, Human
uggaggcacuuua

SEQ ID NO: 2202698 - RNA, 18 nt, Human
uggaggcacacagcugca

SEQ ID NO: 2202699 - RNA, 19 nt, Human
uggaggcacacagcugcag

SEQ ID NO: 2202700 - RNA, 15 nt, Human
uggagcaaagcugau

SEQ ID NO: 2202701 - RNA, 22 nt, Human
uggagauuugaaggucugcaag

SEQ ID NO: 2202702 - RNA, 15 nt, Human
uggaggccagccagu

SEQ ID NO: 2202703 - RNA, 14 nt, Human
uggaggccagccag

SEQ ID NO: 2202704 - RNA, 22 nt, Human
uggaggcaugugaugagaggaa

SEQ ID NO: 2202705 - RNA, 22 nt, Human
uggaggccauugugugagccua

SEQ ID NO: 2202706 - RNA, 12 nt, Human
uggaggcccagu

SEQ ID NO: 2202707 - RNA, 21 nt, Human
uggaggccgggugcucagggc

SEQ ID NO: 2202708 - RNA, 19 nt, Human
uggaggccgggugcucagg

SEQ ID NO: 2202709 - RNA, 15 nt, Human
uggaggcccaguuca

SEQ ID NO: 2202710 - RNA, 23 nt, Human
uggaggcugucuucucaggcucu

SEQ ID NO: 2202711 - RNA, 13 nt, Human
uggaggcuuccug

SEQ ID NO: 2202712 - RNA, 22 nt, Human
uggaggcugucuucucaggcuc

SEQ ID NO: 2202713 - RNA, 14 nt, Human
uggaggcugucuuc

SEQ ID NO: 2202714 - RNA, 15 nt, Human
uggaggcuuccugcg

SEQ ID NO: 2202715 - RNA, 16 nt, Human
uggaggcuuccugcgu

SEQ ID NO: 2202716 - RNA, 17 nt, Human
uggaggcuuccugcguc

SEQ ID NO: 2202717 - RNA, 13 nt, Human
uggaggcugucuu

SEQ ID NO: 2202718 - RNA, 18 nt, Human
uggagaugggaugcuugc

SEQ ID NO: 2202719 - RNA, 13 nt, Human
uggagaugucuuc

SEQ ID NO: 2202720 - RNA, 16 nt, Human
uggagaugggaugcuu

SEQ ID NO: 2202721 - RNA, 14 nt, Human
uggagaugcagagg

SEQ ID NO: 2202722 - RNA, 13 nt, Human
uggagaugcagag

SEQ ID NO: 2202723 - RNA, 23 nt, Human
uggagaguucaauggcugcugaa

SEQ ID NO: 2202724 - RNA, 19 nt, Human
uggagaguucaauggcugc

SEQ ID NO: 2202725 - RNA, 21 nt, Human
uggagaguucaauggcugcug

SEQ ID NO: 2202726 - RNA, 13 nt, Human
uggagauguuuag

SEQ ID NO: 2202727 - RNA, 11 nt, Human
uggagauguuu

SEQ ID NO: 2202728 - RNA, 19 nt, Human
uggagauuugaaggucugc

SEQ ID NO: 2202729 - RNA, 22 nt, Human
uggagaugucuucguacaguuc

SEQ ID NO: 2202730 - RNA, 23 nt, Human
uggagaugucuucguacaguucu

SEQ ID NO: 2202731 - RNA, 19 nt, Human
uggagauguuuuagaguua

SEQ ID NO: 2202732 - RNA, 20 nt, Human
uggagagugcaacaguagca

SEQ ID NO: 2202733 - RNA, 17 nt, Human
uggagagugcaacagua

SEQ ID NO: 2202734 - RNA, 15 nt, Human
uggagaguaaaaacu

SEQ ID NO: 2202735 - RNA, 21 nt, Human
uggagagggaugaggugcugg

SEQ ID NO: 2202736 - RNA, 22 nt, Human
uggagagguuauaggucacucc

SEQ ID NO: 2202737 - RNA, 13 nt, Human
uggagagggauga

SEQ ID NO: 2202738 - RNA, 19 nt, Human
uggagagggaugaggugcu

SEQ ID NO: 2202739 - RNA, 18 nt, Human
uggagaggcccucuggag

SEQ ID NO: 2202740 - RNA, 23 nt, Human
uggagaggagggaugcugccuga

SEQ ID NO: 2202741 - RNA, 16 nt, Human
uggagaggcccucugg

SEQ ID NO: 2202742 - RNA, 21 nt, Human
uggagaggagggaugcugccu

SEQ ID NO: 2202743 - RNA, 20 nt, Human
uggagaggcccggccucuca

SEQ ID NO: 2202744 - RNA, 18 nt, Human
uggagagccagaaccugg

SEQ ID NO: 2202745 - RNA, 19 nt, Human
uggagagccagaaccugga

SEQ ID NO: 2202746 - RNA, 20 nt, Human
uggagagccagaaccuggag

SEQ ID NO: 2202747 - RNA, 22 nt, Human
uggagaggagggaugcugccug

SEQ ID NO: 2202748 - RNA, 21 nt, Human
uggagagcccggcgccccugc

SEQ ID NO: 2202749 - RNA, 12 nt, Human
uggacaggcaug

SEQ ID NO: 2202750 - RNA, 16 nt, Human
uggacaggcauguucu

SEQ ID NO: 2202751 - RNA, 14 nt, Human
uggacagccccacc

SEQ ID NO: 2202752 - RNA, 17 nt, Human
uggaauuauuuuaaaag

SEQ ID NO: 2202753 - RNA, 13 nt, Human
uggagagagggga

SEQ ID NO: 2202754 - RNA, 12 nt, Human
uggagagagggg

SEQ ID NO: 2202755 - RNA, 23 nt, Human
uggagagaaguuucuggcccugg

SEQ ID NO: 2202756 - RNA, 15 nt, Human
uggagagaaggccuc

SEQ ID NO: 2202757 - RNA, 21 nt, Human
uggagagaaggccucccuagc

SEQ ID NO: 2202758 - RNA, 11 nt, Human
uggagagaagu

SEQ ID NO: 2202759 - RNA, 13 nt, Human
uggagagaaguuu

SEQ ID NO: 2202760 - RNA, 12 nt, Human
uggagagaaggc

SEQ ID NO: 2202761 - RNA, 21 nt, Human
uggagagaaacaauaaagaga

SEQ ID NO: 2202762 - RNA, 22 nt, Human
uggagagaaacaauaaagagau

SEQ ID NO: 2202763 - RNA, 12 nt, Human
uggagagaaaac

SEQ ID NO: 2202764 - RNA, 21 nt, Human
uggagacuuagggcaccaggg

SEQ ID NO: 2202765 - RNA, 17 nt, Human
uggagacugucucaaga

SEQ ID NO: 2202766 - RNA, 16 nt, Human
uggagacuuagggcac

SEQ ID NO: 2202767 - RNA, 21 nt, Human
uggcagaacugagcuccucug

SEQ ID NO: 2202768 - RNA, 20 nt, Human
uggcagaacugagcuccucu

SEQ ID NO: 2202769 - RNA, 16 nt, Human
uggcagaacugagcuc

SEQ ID NO: 2202770 - RNA, 23 nt, Human
uggcagaaagcaaaugugaccug

SEQ ID NO: 2202771 - RNA, 14 nt, Human
uggcagaacugagc

SEQ ID NO: 2202772 - RNA, 13 nt, Human
uggcagaagacac

SEQ ID NO: 2202773 - RNA, 14 nt, Human
uggcagaagacacc

SEQ ID NO: 2202774 - RNA, 18 nt, Human
uggcagaagacaccagag

SEQ ID NO: 2202775 - RNA, 20 nt, Human
uggcagaagacaccagagca

SEQ ID NO: 2202776 - RNA, 22 nt, Human
uggcagaagacaccagagcaga

SEQ ID NO: 2202777 - RNA, 11 nt, Human
uggcacuuuga

SEQ ID NO: 2202778 - RNA, 16 nt, Human
uggcacuuugaagggg

SEQ ID NO: 2202779 - RNA, 16 nt, Human
uggcacuuuuucauuu

SEQ ID NO: 2202780 - RNA, 21 nt, Human
uggcacuuuuucauuugccua

SEQ ID NO: 2202781 - RNA, 14 nt, Human
uggcacuugcaucu

SEQ ID NO: 2202782 - RNA, 16 nt, Human
uggcacuugcaucugu

SEQ ID NO: 2202783 - RNA, 17 nt, Human
uggcacuugcaucugug

SEQ ID NO: 2202784 - RNA, 23 nt, Human
uggcagcugcgguccacccagga

SEQ ID NO: 2202785 - RNA, 21 nt, Human
uggcagaagacaccagagcag

SEQ ID NO: 2202786 - RNA, 20 nt, Human
uggcaggauggccuggccag

SEQ ID NO: 2202787 - RNA, 21 nt, Human
uggcagcugcgguccacccag

SEQ ID NO: 2202788 - RNA, 22 nt, Human
uggcagcugcgguccacccagg

SEQ ID NO: 2202789 - RNA, 19 nt, Human
uggcacugcauacaaucug

SEQ ID NO: 2202790 - RNA, 17 nt, Human
uggcacugagccccccc

SEQ ID NO: 2202791 - RNA, 18 nt, Human
uggcacugagccccccca

SEQ ID NO: 2202792 - RNA, 13 nt, Human
uggcacugccaug

SEQ ID NO: 2202793 - RNA, 12 nt, Human
uggcacugcugu

SEQ ID NO: 2202794 - RNA, 21 nt, Human
uggcacuuagcuaucagaaga

SEQ ID NO: 2202795 - RNA, 18 nt, Human
uggcacugcuuccaguga

SEQ ID NO: 2202796 - RNA, 14 nt, Human
uggcacugcuucca

SEQ ID NO: 2202797 - RNA, 16 nt, Human
uggcacugcuuccagu

SEQ ID NO: 2202798 - RNA, 23 nt, Human
uggaugcagugcucgcuguugcu

SEQ ID NO: 2202799 - RNA, 20 nt, Human
uggaugccaauauuaaaucu

SEQ ID NO: 2202800 - RNA, 20 nt, Human
uggaugcauguuuuccagcu

SEQ ID NO: 2202801 - RNA, 22 nt, Human
uggaugcauguuuuccagcucc

SEQ ID NO: 2202802 - RNA, 15 nt, Human
uggaugcauuucucu

SEQ ID NO: 2202803 - RNA, 21 nt, Human
uggaugccaauauuaaaucug

SEQ ID NO: 2202804 - RNA, 14 nt, Human
uggaugccuggugg

SEQ ID NO: 2202805 - RNA, 16 nt, Human
uggcacugagcccccc

SEQ ID NO: 2202806 - RNA, 13 nt, Human
uggaugccugauu

SEQ ID NO: 2202807 - RNA, 14 nt, Human
uggcagugggagcu

SEQ ID NO: 2202808 - RNA, 15 nt, Human
uggcagugggagcug

SEQ ID NO: 2202809 - RNA, 16 nt, Human
uggcagugggagcugc

SEQ ID NO: 2202810 - RNA, 19 nt, Human
uggcagugggagcugccug

SEQ ID NO: 2202811 - RNA, 12 nt, Human
uggcaggcuggc

SEQ ID NO: 2202812 - RNA, 13 nt, Human
uggcaggcuggcc

SEQ ID NO: 2202813 - RNA, 14 nt, Human
uggcaggcuggcca

SEQ ID NO: 2202814 - RNA, 23 nt, Human
uggcaggcagcgccaagcaaccu

SEQ ID NO: 2202815 - RNA, 15 nt, Human
uggcaggcagcgcca

SEQ ID NO: 2202816 - RNA, 19 nt, Human
uggcaggcagcgccaagca

SEQ ID NO: 2202817 - RNA, 15 nt, Human
uggcaggcuggccag

SEQ ID NO: 2202818 - RNA, 18 nt, Human
uggcaggcuggccagucc

SEQ ID NO: 2202819 - RNA, 23 nt, Human
uggccagagagccuggugcugcu

SEQ ID NO: 2202820 - RNA, 13 nt, Human
uggccagagagcc

SEQ ID NO: 2202821 - RNA, 20 nt, Human
uggccagaagggggccauga

SEQ ID NO: 2202822 - RNA, 19 nt, Human
uggccacugcacagagcuc

SEQ ID NO: 2202823 - RNA, 12 nt, Human
uggccagacaca

SEQ ID NO: 2202824 - RNA, 18 nt, Human
uggccagacacaggcccu

SEQ ID NO: 2202825 - RNA, 13 nt, Human
uggccagacacag

SEQ ID NO: 2202826 - RNA, 14 nt, Human
uggccacugcacag

SEQ ID NO: 2202827 - RNA, 17 nt, Human
uggccacugcacagagc

SEQ ID NO: 2202828 - RNA, 18 nt, Human
uggccacugcacagagcu

SEQ ID NO: 2202829 - RNA, 20 nt, Human
uggccacuccgagagguggg

SEQ ID NO: 2202830 - RNA, 23 nt, Human
uggccacuccgagaggugggcca

SEQ ID NO: 2202831 - RNA, 21 nt, Human
uggccacuugggucuucccug

SEQ ID NO: 2202832 - RNA, 20 nt, Human
uggccacugcacagagcucu

SEQ ID NO: 2202833 - RNA, 16 nt, Human
uggccagaagucaagc

SEQ ID NO: 2202834 - RNA, 20 nt, Human
uggcagugggagcugccugu

SEQ ID NO: 2202835 - RNA, 12 nt, Human
uggcagugguuu

SEQ ID NO: 2202836 - RNA, 22 nt, Human
uggccacuccagaccccuggcu

SEQ ID NO: 2202837 - RNA, 14 nt, Human
uggccacuccgaga

SEQ ID NO: 2202838 - RNA, 18 nt, Human
uggccacuccgagaggug

SEQ ID NO: 2202839 - RNA, 12 nt, Human
ucugugucugug

SEQ ID NO: 2202840 - RNA, 12 nt, Human
ucugugucucuu

SEQ ID NO: 2202841 - RNA, 11 nt, Human
ucugugucucu

SEQ ID NO: 2202842 - RNA, 15 nt, Human
ucugugucuguguuu

SEQ ID NO: 2202843 - RNA, 13 nt, Human
ucugugucugugu

SEQ ID NO: 2202844 - RNA, 12 nt, Human
ucugugucuugu

SEQ ID NO: 2202845 - RNA, 21 nt, Human
ucugugucuuucacagcuccu

SEQ ID NO: 2202846 - RNA, 21 nt, Human
ucuguguguguguaugugggg

SEQ ID NO: 2202847 - RNA, 19 nt, Human
ucuguguguguguaugugg

SEQ ID NO: 2202848 - RNA, 18 nt, Human
ucuguguguguguaugug

SEQ ID NO: 2202849 - RNA, 15 nt, Human
ucuguguguguguau

SEQ ID NO: 2202850 - RNA, 22 nt, Human
ucugugucagguggggcagcuu

SEQ ID NO: 2202851 - RNA, 20 nt, Human
ucugugguuuuccccucccu

SEQ ID NO: 2202852 - RNA, 21 nt, Human
ucugugguuuuccccucccug

SEQ ID NO: 2202853 - RNA, 22 nt, Human
ucugugguuuuccccucccugg

SEQ ID NO: 2202854 - RNA, 23 nt, Human
ucugugguuuuccccucccuggg

SEQ ID NO: 2202855 - RNA, 18 nt, Human
ucuguguccuucccugca

SEQ ID NO: 2202856 - RNA, 14 nt, Human
ucuguguacaaaga

SEQ ID NO: 2202857 - RNA, 11 nt, Human
ucuguguccuu

SEQ ID NO: 2202858 - RNA, 15 nt, Human
ucuguguccuucccu

SEQ ID NO: 2202859 - RNA, 17 nt, Human
ucuguguccuucccugc

SEQ ID NO: 2202860 - RNA, 19 nt, Human
ucugugguuuuccccuccc

SEQ ID NO: 2202861 - RNA, 23 nt, Human
ucuguggguuucuaaagcugcca

SEQ ID NO: 2202862 - RNA, 20 nt, Human
ucugucccuucugucccuca

SEQ ID NO: 2202863 - RNA, 19 nt, Human
ucugucccuucugucccuc

SEQ ID NO: 2202864 - RNA, 15 nt, Human
ucugucccucacagc

SEQ ID NO: 2202865 - RNA, 14 nt, Human
ucugucccucacag

SEQ ID NO: 2202866 - RNA, 17 nt, Human
ucuguacgucugacagg

SEQ ID NO: 2202867 - RNA, 18 nt, Human
ucuguacauagccuauau

SEQ ID NO: 2202868 - RNA, 14 nt, Human
ucuguacauagccu

SEQ ID NO: 2202869 - RNA, 19 nt, Human
ucuguccgagcuuugaaaa

SEQ ID NO: 2202870 - RNA, 23 nt, Human
ucugucccuucugucccucacag

SEQ ID NO: 2202871 - RNA, 22 nt, Human
ucugucccuucugucccucaca

SEQ ID NO: 2202872 - RNA, 20 nt, Human
ucuguccguuuacuccaagg

SEQ ID NO: 2202873 - RNA, 15 nt, Human
ucugucccuuggagc

SEQ ID NO: 2202874 - RNA, 22 nt, Human
ucuguggguuucuaaagcugcc

SEQ ID NO: 2202875 - RNA, 15 nt, Human
ucuguguuuuugaaa

SEQ ID NO: 2202876 - RNA, 14 nt, Human
ucuguguuuugaau

SEQ ID NO: 2202877 - RNA, 13 nt, Human
ucuguguuuuaau

SEQ ID NO: 2202878 - RNA, 16 nt, Human
ucuguguuuuugaaau

SEQ ID NO: 2202879 - RNA, 19 nt, Human
ucuguuaccaugucacugu

SEQ ID NO: 2202880 - RNA, 21 nt, Human
ucuguuaccaugucacugugg

SEQ ID NO: 2202881 - RNA, 20 nt, Human
ucuguguguuuaugugugug

SEQ ID NO: 2202882 - RNA, 19 nt, Human
ucuguguguuuaugugugu

SEQ ID NO: 2202883 - RNA, 14 nt, Human
ucuguguugccaag

SEQ ID NO: 2202884 - RNA, 16 nt, Human
ucuguguugccaagcu

SEQ ID NO: 2202885 - RNA, 21 nt, Human
ucuguguuggcccaagcucuu

SEQ ID NO: 2202886 - RNA, 23 nt, Human
ucuguguuggcccaagcucuugu

SEQ ID NO: 2202887 - RNA, 22 nt, Human
ucuguguguguguauguggggg

SEQ ID NO: 2202888 - RNA, 11 nt, Human
ucugugucuuu

SEQ ID NO: 2202889 - RNA, 16 nt, Human
ucuguguguuuaugug

SEQ ID NO: 2202890 - RNA, 15 nt, Human
ucuguguguuuaugu

SEQ ID NO: 2202891 - RNA, 18 nt, Human
ucuuaaaaaguggaaaaa

SEQ ID NO: 2202892 - RNA, 13 nt, Human
ucuguuuuccuuu

SEQ ID NO: 2202893 - RNA, 16 nt, Human
ucuguuuuccuuucuc

SEQ ID NO: 2202894 - RNA, 17 nt, Human
ucuguuuuccuuucuca

SEQ ID NO: 2202895 - RNA, 12 nt, Human
ucuguucagugu

SEQ ID NO: 2202896 - RNA, 17 nt, Human
ucuguuuuaugacuuca

SEQ ID NO: 2202897 - RNA, 13 nt, Human
ucuguuuuaugac

SEQ ID NO: 2202898 - RNA, 16 nt, Human
ucuguuuuaugacuuc

SEQ ID NO: 2202899 - RNA, 15 nt, Human
ucuguuuuaugacuu

SEQ ID NO: 2202900 - RNA, 22 nt, Human
ucuguuuuauaauuuugugaag

SEQ ID NO: 2202901 - RNA, 13 nt, Human
ucuguucaccuuc

SEQ ID NO: 2202902 - RNA, 19 nt, Human
ucuguucacuuuuccuccc

SEQ ID NO: 2202903 - RNA, 22 nt, Human
ucuguucacuuuuccucccuca

SEQ ID NO: 2202904 - RNA, 21 nt, Human
ucuguucacuuuuccucccuc

SEQ ID NO: 2202905 - RNA, 18 nt, Human
ucuguuauauaaaugguu

SEQ ID NO: 2202906 - RNA, 15 nt, Human
ucuguuauauaaaug

SEQ ID NO: 2202907 - RNA, 15 nt, Human
ucuguuauuaacaaa

SEQ ID NO: 2202908 - RNA, 18 nt, Human
ucuguuauuuagacucau

SEQ ID NO: 2202909 - RNA, 17 nt, Human
ucuguuaugcugugaca

SEQ ID NO: 2202910 - RNA, 18 nt, Human
ucugggaaauaagagaga

SEQ ID NO: 2202911 - RNA, 17 nt, Human
ucugggaaaauacccca

SEQ ID NO: 2202912 - RNA, 23 nt, Human
ucuggcuuucuccgacugcuagg

SEQ ID NO: 2202913 - RNA, 17 nt, Human
ucuggcucuuccaggcu

SEQ ID NO: 2202914 - RNA, 15 nt, Human
ucuggcucuuccagg

SEQ ID NO: 2202915 - RNA, 16 nt, Human
ucuggcucuuccaggc

SEQ ID NO: 2202916 - RNA, 13 nt, Human
ucugggacacagu

SEQ ID NO: 2202917 - RNA, 22 nt, Human
ucugggaaaugagaaggcagcc

SEQ ID NO: 2202918 - RNA, 22 nt, Human
ucugggaaauggcuugaagcca

SEQ ID NO: 2202919 - RNA, 18 nt, Human
ucugggaacugugccuuu

SEQ ID NO: 2202920 - RNA, 14 nt, Human
ucugggaagggaag

SEQ ID NO: 2202921 - RNA, 12 nt, Human
ucugggacacag

SEQ ID NO: 2202922 - RNA, 15 nt, Human
ucuguaaucucguuu

SEQ ID NO: 2202923 - RNA, 20 nt, Human
ucuguaaucucguuucaaaa

SEQ ID NO: 2202924 - RNA, 23 nt, Human
ucuguacagagcccacgccccca

SEQ ID NO: 2202925 - RNA, 15 nt, Human
ucuguaagcugaagu

SEQ ID NO: 2202926 - RNA, 14 nt, Human
ucugguuuugcuau

SEQ ID NO: 2202927 - RNA, 13 nt, Human
ucuguaaaaucuu

SEQ ID NO: 2202928 - RNA, 14 nt, Human
ucuguaaaaucuuu

SEQ ID NO: 2202929 - RNA, 17 nt, Human
ucuguaaaaucuuucuu

SEQ ID NO: 2202930 - RNA, 11 nt, Human
ucuguaaaauc

SEQ ID NO: 2202931 - RNA, 12 nt, Human
ucuguaaaaucu

SEQ ID NO: 2202932 - RNA, 15 nt, Human
ucugguuucaccgag

SEQ ID NO: 2202933 - RNA, 18 nt, Human
ucugguuugacuccgcug

SEQ ID NO: 2202934 - RNA, 22 nt, Human
ucugguuugacuccgcuggagg

SEQ ID NO: 2202935 - RNA, 13 nt, Human
ucugguuuggggc

SEQ ID NO: 2202936 - RNA, 23 nt, Human
ucugguuuggggcgaggcagagg

SEQ ID NO: 2202937 - RNA, 13 nt, Human
ucugguuuuaaca

SEQ ID NO: 2202938 - RNA, 15 nt, Human
ucugguuuuaacaau

SEQ ID NO: 2202939 - RNA, 15 nt, Human
ucugguuuugcuauu

SEQ ID NO: 2202940 - RNA, 16 nt, Human
ucuggcuagaggccag

SEQ ID NO: 2202941 - RNA, 22 nt, Human
ucuggcgacaguuuuccuucuc

SEQ ID NO: 2202942 - RNA, 18 nt, Human
ucuggcgacaguuuuccu

SEQ ID NO: 2202943 - RNA, 14 nt, Human
ucuggccuuuuccu

SEQ ID NO: 2202944 - RNA, 14 nt, Human
ucuggcuaugcauu

SEQ ID NO: 2202945 - RNA, 21 nt, Human
ucuggcuagaggccagcccca

SEQ ID NO: 2202946 - RNA, 17 nt, Human
ucuggcuagaggccagc

SEQ ID NO: 2202947 - RNA, 17 nt, Human
ucuggcuaugcauuuga

SEQ ID NO: 2202948 - RNA, 22 nt, Human
ucuggcuagaggccagccccac

SEQ ID NO: 2202949 - RNA, 13 nt, Human
ucuggcucugucu

SEQ ID NO: 2202950 - RNA, 15 nt, Human
ucuggaggggccccu

SEQ ID NO: 2202951 - RNA, 17 nt, Human
ucuggaggggccccugc

SEQ ID NO: 2202952 - RNA, 23 nt, Human
ucuggaggggccccugcuucucc

SEQ ID NO: 2202953 - RNA, 14 nt, Human
ucuggaggggaggg

SEQ ID NO: 2202954 - RNA, 21 nt, Human
ucuggaggggagggggauccg

SEQ ID NO: 2202955 - RNA, 13 nt, Human
ucuggagcccuug

SEQ ID NO: 2202956 - RNA, 12 nt, Human
ucuggagcccuu

SEQ ID NO: 2202957 - RNA, 20 nt, Human
ucuggagagcuagaaccugg

SEQ ID NO: 2202958 - RNA, 16 nt, Human
ucuggagcccuugggu

SEQ ID NO: 2202959 - RNA, 12 nt, Human
ucuggagacagc

SEQ ID NO: 2202960 - RNA, 20 nt, Human
ucuggagaagcucccaggaa

SEQ ID NO: 2202961 - RNA, 22 nt, Human
ucuggagaagcucccaggaaca

SEQ ID NO: 2202962 - RNA, 18 nt, Human
ucugcacccuccacccug

SEQ ID NO: 2202963 - RNA, 19 nt, Human
ucugcacccuccacccugu

SEQ ID NO: 2202964 - RNA, 21 nt, Human
ucugcacccuccacccugucc

SEQ ID NO: 2202965 - RNA, 19 nt, Human
ucuggagaagcucccagga

SEQ ID NO: 2202966 - RNA, 21 nt, Human
ucugcaccccuucucuccucc

SEQ ID NO: 2202967 - RNA, 22 nt, Human
ucugcaccccuucucuccuccc

SEQ ID NO: 2202968 - RNA, 12 nt, Human
ucugcacccucc

SEQ ID NO: 2202969 - RNA, 13 nt, Human
ucugcacccucca

SEQ ID NO: 2202970 - RNA, 14 nt, Human
ucugcacccuccac

SEQ ID NO: 2202971 - RNA, 15 nt, Human
ucugcacccuccacc

SEQ ID NO: 2202972 - RNA, 16 nt, Human
ucugcacccuccaccc

SEQ ID NO: 2202973 - RNA, 17 nt, Human
ucugcacccuccacccu

SEQ ID NO: 2202974 - RNA, 18 nt, Human
ucugcaccccccugggcu

SEQ ID NO: 2202975 - RNA, 17 nt, Human
ucugcaccccccugggc

SEQ ID NO: 2202976 - RNA, 16 nt, Human
ucugcaccccccuggg

SEQ ID NO: 2202977 - RNA, 15 nt, Human
ucugcaccccuucuc

SEQ ID NO: 2202978 - RNA, 18 nt, Human
ucugcaccccuucucucc

SEQ ID NO: 2202979 - RNA, 19 nt, Human
ucugcaccccuucucuccu

SEQ ID NO: 2202980 - RNA, 20 nt, Human
ucugcaccccuucucuccuc

SEQ ID NO: 2202981 - RNA, 15 nt, Human
ucugcaccccccugg

SEQ ID NO: 2202982 - RNA, 15 nt, Human
ucugcacccaggggu

SEQ ID NO: 2202983 - RNA, 13 nt, Human
ucugcacccaggg

SEQ ID NO: 2202984 - RNA, 21 nt, Human
ucugcacaugucuuguacaug

SEQ ID NO: 2202985 - RNA, 22 nt, Human
ucugcacaugucuuguacaugu

SEQ ID NO: 2202986 - RNA, 23 nt, Human
ucuggagcccacuguacuugcuc

SEQ ID NO: 2202987 - RNA, 13 nt, Human
ucuggagagcuag

SEQ ID NO: 2202988 - RNA, 14 nt, Human
ucuggagagcuaga

SEQ ID NO: 2202989 - RNA, 21 nt, Human
ucuggagaccagggagccuuu

SEQ ID NO: 2202990 - RNA, 12 nt, Human
ucuggagagaaa

SEQ ID NO: 2202991 - RNA, 15 nt, Human
ucuggagagaaacaa

SEQ ID NO: 2202992 - RNA, 20 nt, Human
ucuggagaccagggagccuu

SEQ ID NO: 2202993 - RNA, 19 nt, Human
ucuggagaccagggagccu

SEQ ID NO: 2202994 - RNA, 15 nt, Human
ucuggagaccaggga

SEQ ID NO: 2202995 - RNA, 23 nt, Human
ucuggagaagcucccaggaacaa

SEQ ID NO: 2202996 - RNA, 15 nt, Human
ucuggagacagcccc

SEQ ID NO: 2202997 - RNA, 16 nt, Human
ucuggagacagcccca

SEQ ID NO: 2202998 - RNA, 17 nt, Human
ucuggagacagccccag

SEQ ID NO: 2202999 - RNA, 18 nt, Human
ucuggagacagccccaga

SEQ ID NO: 2203000 - RNA, 20 nt, Human
ucuggagacagccccagagc

SEQ ID NO: 2203001 - RNA, 22 nt, Human
ucuggagacagccccagagcag

SEQ ID NO: 2203002 - RNA, 24 nt, Human
ucuggagacagccccagagcaggg

SEQ ID NO: 2203003 - RNA, 20 nt, Human
ucuugacgagugugaagcuu

SEQ ID NO: 2203004 - RNA, 21 nt, Human
ucuugaccaagcaggaagcuc

SEQ ID NO: 2203005 - RNA, 11 nt, Human
ucuugacccua

SEQ ID NO: 2203006 - RNA, 12 nt, Human
ucuugccucugu

SEQ ID NO: 2203007 - RNA, 22 nt, Human
ucuugccucuguccccuucucu

SEQ ID NO: 2203008 - RNA, 13 nt, Human
ucuugccucugug

SEQ ID NO: 2203009 - RNA, 16 nt, Human
ucuugccucugucccc

SEQ ID NO: 2203010 - RNA, 21 nt, Human
ucuugccucuguccccuucuc

SEQ ID NO: 2203011 - RNA, 14 nt, Human
ucuugccucugugc

SEQ ID NO: 2203012 - RNA, 15 nt, Human
ucuugccucugugcu

SEQ ID NO: 2203013 - RNA, 16 nt, Human
ucuugccucugugcug

SEQ ID NO: 2203014 - RNA, 19 nt, Human
ucuugccucugugcugugu

SEQ ID NO: 2203015 - RNA, 18 nt, Human
ucuugaauuucuaaaaaa

SEQ ID NO: 2203016 - RNA, 20 nt, Human
ucuugacaccagcuguucug

SEQ ID NO: 2203017 - RNA, 21 nt, Human
ucuugacaccagcuguucugu

SEQ ID NO: 2203018 - RNA, 23 nt, Human
ucuugaauuuaauaaucuguagg

SEQ ID NO: 2203019 - RNA, 21 nt, Human
ucuugaauuuaauaaucugua

SEQ ID NO: 2203020 - RNA, 19 nt, Human
ucuugaccaagcaggaagc

SEQ ID NO: 2203021 - RNA, 19 nt, Human
ucuugacauucaaggcauu

SEQ ID NO: 2203022 - RNA, 22 nt, Human
ucuugacaccagcuguucuguc

SEQ ID NO: 2203023 - RNA, 21 nt, Human
ucuugaauuguaaggaaugau

SEQ ID NO: 2203024 - RNA, 14 nt, Human
ucuucuccaggaug

SEQ ID NO: 2203025 - RNA, 13 nt, Human
ucuugaauuuaau

SEQ ID NO: 2203026 - RNA, 15 nt, Human
ucuugaacugagcuu

SEQ ID NO: 2203027 - RNA, 15 nt, Human
ucuucuccaggcugu

SEQ ID NO: 2203028 - RNA, 16 nt, Human
ucuugaacuccuggcc

SEQ ID NO: 2203029 - RNA, 17 nt, Human
ucuugaacuccuggccu

SEQ ID NO: 2203030 - RNA, 18 nt, Human
ucuugaacuccuggccuc

SEQ ID NO: 2203031 - RNA, 13 nt, Human
ucuucuccaggcu

SEQ ID NO: 2203032 - RNA, 14 nt, Human
ucuucuccaggcug

SEQ ID NO: 2203033 - RNA, 12 nt, Human
ucuucuccaggc

SEQ ID NO: 2203034 - RNA, 16 nt, Human
ucuucuccacuggaug

SEQ ID NO: 2203035 - RNA, 21 nt, Human
ucuucucagaaggcaaaugac

SEQ ID NO: 2203036 - RNA, 16 nt, Human
ucuuguauuaaguugu

SEQ ID NO: 2203037 - RNA, 12 nt, Human
ucuugccuucag

SEQ ID NO: 2203038 - RNA, 18 nt, Human
ucuuguauuaaguuguua

SEQ ID NO: 2203039 - RNA, 22 nt, Human
ucuuguauuaaguuguuaauaa

SEQ ID NO: 2203040 - RNA, 22 nt, Human
ucuuguccaugugguucuucaa

SEQ ID NO: 2203041 - RNA, 23 nt, Human
ucuuguccaugugguucuucaaa

SEQ ID NO: 2203042 - RNA, 22 nt, Human
ucuuguauuaagaaugaaauac

SEQ ID NO: 2203043 - RNA, 12 nt, Human
ucuugcucugcu

SEQ ID NO: 2203044 - RNA, 13 nt, Human
ucuugcucugcug

SEQ ID NO: 2203045 - RNA, 11 nt, Human
ucuugcucugc

SEQ ID NO: 2203046 - RNA, 18 nt, Human
ucuuguuuuuuuuuucca

SEQ ID NO: 2203047 - RNA, 21 nt, Human
ucuuguuuuuuuuuuccacuu

SEQ ID NO: 2203048 - RNA, 22 nt, Human
ucuuguuuuuccacuacugcua

SEQ ID NO: 2203049 - RNA, 23 nt, Human
ucuuguccccucuugacccaucu

SEQ ID NO: 2203050 - RNA, 12 nt, Human
ucuugucucugg

SEQ ID NO: 2203051 - RNA, 13 nt, Human
ucuugucucuggg

SEQ ID NO: 2203052 - RNA, 14 nt, Human
ucuugucucugggc

SEQ ID NO: 2203053 - RNA, 15 nt, Human
ucuugucucugggcu

SEQ ID NO: 2203054 - RNA, 21 nt, Human
ucuugugacauauuaugucuu

SEQ ID NO: 2203055 - RNA, 15 nt, Human
ucuugugaaggcagg

SEQ ID NO: 2203056 - RNA, 15 nt, Human
ucuucagggggccag

SEQ ID NO: 2203057 - RNA, 16 nt, Human
ucuucagguggaaaaa

SEQ ID NO: 2203058 - RNA, 21 nt, Human
ucuucaggguccugagauuua

SEQ ID NO: 2203059 - RNA, 19 nt, Human
ucuucagugggagaaaaca

SEQ ID NO: 2203060 - RNA, 14 nt, Human
ucuucagguucuua

SEQ ID NO: 2203061 - RNA, 23 nt, Human
ucuucagguggaaaaacaucuga

SEQ ID NO: 2203062 - RNA, 16 nt, Human
ucuucaguaagccgug

SEQ ID NO: 2203063 - RNA, 24 nt, Human
ucuuccaagcaaaggugaagagac

SEQ ID NO: 2203064 - RNA, 18 nt, Human
ucuuccaagcaaagguga

SEQ ID NO: 2203065 - RNA, 21 nt, Human
ucuuccacaagagcccaggcc

SEQ ID NO: 2203066 - RNA, 23 nt, Human
ucuucuagagccgugaugccucc

SEQ ID NO: 2203067 - RNA, 12 nt, Human
ucuucuaaaugg

SEQ ID NO: 2203068 - RNA, 15 nt, Human
ucuucuaauuucaaa

SEQ ID NO: 2203069 - RNA, 20 nt, Human
ucuucuaauuucaaaaauau

SEQ ID NO: 2203070 - RNA, 22 nt, Human
ucuucuaaacuuccccaucuuc

SEQ ID NO: 2203071 - RNA, 13 nt, Human
ucuucuaaacuuc

SEQ ID NO: 2203072 - RNA, 11 nt, Human
ucuuccagaag

SEQ ID NO: 2203073 - RNA, 16 nt, Human
ucuuccagaaguguga

SEQ ID NO: 2203074 - RNA, 17 nt, Human
ucuuccagaagugugau

SEQ ID NO: 2203075 - RNA, 18 nt, Human
ucuuccagaagugugauu

SEQ ID NO: 2203076 - RNA, 19 nt, Human
ucuuccagaagugugauug

SEQ ID NO: 2203077 - RNA, 20 nt, Human
ucuuccagaagugugauugg

SEQ ID NO: 2203078 - RNA, 13 nt, Human
ucuuccagaaucc

SEQ ID NO: 2203079 - RNA, 14 nt, Human
ucuuccaggcuggg

SEQ ID NO: 2203080 - RNA, 13 nt, Human
ucuucuccacugg

SEQ ID NO: 2203081 - RNA, 23 nt, Human
ucuucucagaaggcaaaugacuu

SEQ ID NO: 2203082 - RNA, 19 nt, Human
ucuucuccacuuucuagcc

SEQ ID NO: 2203083 - RNA, 21 nt, Human
ucuucuccacuuucuagccag

SEQ ID NO: 2203084 - RNA, 16 nt, Human
ucuucuauuuuauucc

SEQ ID NO: 2203085 - RNA, 15 nt, Human
ucuucuauuuuauuc

SEQ ID NO: 2203086 - RNA, 13 nt, Human
ucuucuauuuugu

SEQ ID NO: 2203087 - RNA, 13 nt, Human
ucuucucaagugc

SEQ ID NO: 2203088 - RNA, 15 nt, Human
ucuucucaagugccu

SEQ ID NO: 2203089 - RNA, 16 nt, Human
ucuucucaagugccuu

SEQ ID NO: 2203090 - RNA, 17 nt, Human
ucuucucaagugccuua

SEQ ID NO: 2203091 - RNA, 17 nt, Human
ucuucuagguucuaaaa

SEQ ID NO: 2203092 - RNA, 13 nt, Human
ucuuauagaaagu

SEQ ID NO: 2203093 - RNA, 19 nt, Human
ucuuauagaauauuuauua

SEQ ID NO: 2203094 - RNA, 20 nt, Human
ucuuauagaauauuuauuac

SEQ ID NO: 2203095 - RNA, 13 nt, Human
ucuuauaaauaug

SEQ ID NO: 2203096 - RNA, 14 nt, Human
ucuuauaaauauga

SEQ ID NO: 2203097 - RNA, 21 nt, Human
ucuuauaaauaugaagcucac

SEQ ID NO: 2203098 - RNA, 22 nt, Human
ucuuauagucaauguuucuuuu

SEQ ID NO: 2203099 - RNA, 20 nt, Human
ucuuauauauauuucuuugu

SEQ ID NO: 2203100 - RNA, 14 nt, Human
ucuuaugcaauuuc

SEQ ID NO: 2203101 - RNA, 17 nt, Human
ucuuaugcuuauaauau

SEQ ID NO: 2203102 - RNA, 15 nt, Human
ucuucaguaagccgu

SEQ ID NO: 2203103 - RNA, 15 nt, Human
ucuucagggcacugc

SEQ ID NO: 2203104 - RNA, 13 nt, Human
ucuucagggcacu

SEQ ID NO: 2203105 - RNA, 13 nt, Human
ucuuaugggcugg

SEQ ID NO: 2203106 - RNA, 22 nt, Human
ucuuauggaauugauuugcauu

SEQ ID NO: 2203107 - RNA, 21 nt, Human
ucuuauggaauugauuugcau

SEQ ID NO: 2203108 - RNA, 18 nt, Human
ucuuauggaauugauuug

SEQ ID NO: 2203109 - RNA, 17 nt, Human
ucuuauggaauugauuu

SEQ ID NO: 2203110 - RNA, 15 nt, Human
ucuuauggaauugau

SEQ ID NO: 2203111 - RNA, 14 nt, Human
ucuuauggaauuga

SEQ ID NO: 2203112 - RNA, 14 nt, Human
ucuuauacauuuga

SEQ ID NO: 2203113 - RNA, 15 nt, Human
ucuuauacauuugau

SEQ ID NO: 2203114 - RNA, 20 nt, Human
ucuuaaaauauauuucagau

SEQ ID NO: 2203115 - RNA, 19 nt, Human
ucuuaaaauauauuucaga

SEQ ID NO: 2203116 - RNA, 15 nt, Human
ucuuaguucucacug

SEQ ID NO: 2203117 - RNA, 16 nt, Human
ucuuaguucucacugu

SEQ ID NO: 2203118 - RNA, 16 nt, Human
ucuuaguuuggauucu

SEQ ID NO: 2203119 - RNA, 21 nt, Human
ucuuaguuuggauucuuaugu

SEQ ID NO: 2203120 - RNA, 23 nt, Human
ucuuaguuuggauucuuauguag

SEQ ID NO: 2203121 - RNA, 11 nt, Human
ucuuauaaaua

SEQ ID NO: 2203122 - RNA, 12 nt, Human
ucuuauaaauau

SEQ ID NO: 2203123 - RNA, 20 nt, Human
ucuuaaaacauuaugaguuu

SEQ ID NO: 2203124 - RNA, 13 nt, Human
ucuuaaaaagugg

SEQ ID NO: 2203125 - RNA, 23 nt, Human
ucuuaaaaguugugauuccagau

SEQ ID NO: 2203126 - RNA, 14 nt, Human
ucuuaaaauaacuu

SEQ ID NO: 2203127 - RNA, 15 nt, Human
ucuuaaaauaacuua

SEQ ID NO: 2203128 - RNA, 21 nt, Human
ucuuaaaauaacuuauaucau

SEQ ID NO: 2203129 - RNA, 16 nt, Human
ucuuaguggauguucu

SEQ ID NO: 2203130 - RNA, 14 nt, Human
ucuuagugugugca

SEQ ID NO: 2203131 - RNA, 19 nt, Human
ugaaaugcagagucaauga

SEQ ID NO: 2203132 - RNA, 23 nt, Human
ugaaaugaggucagagccugcag

SEQ ID NO: 2203133 - RNA, 21 nt, Human
ugaaaugaggucagagccugc

SEQ ID NO: 2203134 - RNA, 22 nt, Human
ugaaaugaggucagagccugca

SEQ ID NO: 2203135 - RNA, 19 nt, Human
ugaaaugaggucagagccu

SEQ ID NO: 2203136 - RNA, 20 nt, Human
ugaaaugaggucagagccug

SEQ ID NO: 2203137 - RNA, 20 nt, Human
ugaaaugaaaacauguaaua

SEQ ID NO: 2203138 - RNA, 19 nt, Human
ugaaaugaaaacauguaau

SEQ ID NO: 2203139 - RNA, 14 nt, Human
ugaaaugaaaacau

SEQ ID NO: 2203140 - RNA, 13 nt, Human
ugaaaugaaaaca

SEQ ID NO: 2203141 - RNA, 19 nt, Human
ugaaaugaccucaagaugu

SEQ ID NO: 2203142 - RNA, 16 nt, Human
ugaaaugaauauuuaa

SEQ ID NO: 2203143 - RNA, 16 nt, Human
ugaaaucucagaauuc

SEQ ID NO: 2203144 - RNA, 19 nt, Human
ugaaaucuuacagcugggu

SEQ ID NO: 2203145 - RNA, 19 nt, Human
ugaaaucucagaauuccuu

SEQ ID NO: 2203146 - RNA, 17 nt, Human
ugaaaucuuuuugcuuu

SEQ ID NO: 2203147 - RNA, 22 nt, Human
ugaaauccuggguuuucuuaac

SEQ ID NO: 2203148 - RNA, 14 nt, Human
ugaaauccugcuuc

SEQ ID NO: 2203149 - RNA, 15 nt, Human
ugaaaucauucauuu

SEQ ID NO: 2203150 - RNA, 14 nt, Human
ugaaaggagcccuu

SEQ ID NO: 2203151 - RNA, 15 nt, Human
ugaaagggcccagag

SEQ ID NO: 2203152 - RNA, 16 nt, Human
ugaaagggcccagaga

SEQ ID NO: 2203153 - RNA, 17 nt, Human
ugaaagggcccagagag

SEQ ID NO: 2203154 - RNA, 18 nt, Human
ugaaagggcccagagagg

SEQ ID NO: 2203155 - RNA, 23 nt, Human
ugaaaagaggggaccagaagcca

SEQ ID NO: 2203156 - RNA, 13 nt, Human
ugaaaagaggugu

SEQ ID NO: 2203157 - RNA, 22 nt, Human
ugaaaagacuccaaagaaaugu

SEQ ID NO: 2203158 - RNA, 18 nt, Human
ugaaacccugucucuacu

SEQ ID NO: 2203159 - RNA, 22 nt, Human
ugaaaagaggugugcaagagag

SEQ ID NO: 2203160 - RNA, 16 nt, Human
ugaaaagauaaauuau

SEQ ID NO: 2203161 - RNA, 23 nt, Human
ugaaacccugucucuacuaaaaa

SEQ ID NO: 2203162 - RNA, 22 nt, Human
ugaaagauggcugugccucugc

SEQ ID NO: 2203163 - RNA, 23 nt, Human
ugaaagauggcugugccucugcc

SEQ ID NO: 2203164 - RNA, 21 nt, Human
ugaaagauggcugugccucug

SEQ ID NO: 2203165 - RNA, 21 nt, Human
ugaaaccuuuuuuaagauuuu

SEQ ID NO: 2203166 - RNA, 23 nt, Human
ugaaaccuuuuuuaagauuuuuc

SEQ ID NO: 2203167 - RNA, 17 nt, Human
ugaaaccuuauuuuuuc

SEQ ID NO: 2203168 - RNA, 18 nt, Human
ugaaaccuuauuuuuucc

SEQ ID NO: 2203169 - RNA, 20 nt, Human
ugaaaccuuauuuuuuccca

SEQ ID NO: 2203170 - RNA, 18 nt, Human
ugaaaccuuuagggcagc

SEQ ID NO: 2203171 - RNA, 20 nt, Human
ugaaaccuuuagggcagcuu

SEQ ID NO: 2203172 - RNA, 21 nt, Human
ugaaaccuuuagggcagcuug

SEQ ID NO: 2203173 - RNA, 22 nt, Human
ugaaaccuuuagggcagcuugc

SEQ ID NO: 2203174 - RNA, 16 nt, Human
ugaaaccuuuuuuaag

SEQ ID NO: 2203175 - RNA, 17 nt, Human
ugaaaccuuuuuuaaga

SEQ ID NO: 2203176 - RNA, 18 nt, Human
ugaaaccuuuuuuaagau

SEQ ID NO: 2203177 - RNA, 19 nt, Human
ugaaaccuuuuuuaagauu

SEQ ID NO: 2203178 - RNA, 20 nt, Human
ugaaaccuuuuuuaagauuu

SEQ ID NO: 2203179 - RNA, 11 nt, Human
ugaaagcugug

SEQ ID NO: 2203180 - RNA, 12 nt, Human
ugaaaggaaaga

SEQ ID NO: 2203181 - RNA, 18 nt, Human
ugaaaggaagcuccacug

SEQ ID NO: 2203182 - RNA, 17 nt, Human
ugaaaggaaagaggcuc

SEQ ID NO: 2203183 - RNA, 23 nt, Human
ugaaagcagggacuugaacccau

SEQ ID NO: 2203184 - RNA, 19 nt, Human
ugaaagcagggacuugaac

SEQ ID NO: 2203185 - RNA, 18 nt, Human
ugaaagcagggacuugaa

SEQ ID NO: 2203186 - RNA, 21 nt, Human
ugaaagauucagguauguugc

SEQ ID NO: 2203187 - RNA, 15 nt, Human
ucuuuuguaauuuaa

SEQ ID NO: 2203188 - RNA, 14 nt, Human
ucuuuuuaugcauu

SEQ ID NO: 2203189 - RNA, 13 nt, Human
ucuuuuuauugaa

SEQ ID NO: 2203190 - RNA, 14 nt, Human
ucuuuuuauugaau

SEQ ID NO: 2203191 - RNA, 15 nt, Human
ucuuuuuauugaauc

SEQ ID NO: 2203192 - RNA, 12 nt, Human
ucuuuuucaguu

SEQ ID NO: 2203193 - RNA, 14 nt, Human
ucuuuuucuggacu

SEQ ID NO: 2203194 - RNA, 12 nt, Human
ucuuuuucuucu

SEQ ID NO: 2203195 - RNA, 15 nt, Human
ucuuuuucuucuucc

SEQ ID NO: 2203196 - RNA, 17 nt, Human
ucuuuuucuucuucccu

SEQ ID NO: 2203197 - RNA, 16 nt, Human
ucuuuuugcuuugcuu

SEQ ID NO: 2203198 - RNA, 19 nt, Human
ucuuuuuuaaaugaagaaa

SEQ ID NO: 2203199 - RNA, 19 nt, Human
ucuuuuugacucuugcaau

SEQ ID NO: 2203200 - RNA, 13 nt, Human
ucuuuuugcuguu

SEQ ID NO: 2203201 - RNA, 16 nt, Human
ucuuuuuuagcauaaa

SEQ ID NO: 2203202 - RNA, 15 nt, Human
ucuuuuuuagcauaa

SEQ ID NO: 2203203 - RNA, 13 nt, Human
ucuuuuuuaugug

SEQ ID NO: 2203204 - RNA, 20 nt, Human
ucuuuuuuagcauaaaauuu

SEQ ID NO: 2203205 - RNA, 13 nt, Human
ucuuuuuucaaaa

SEQ ID NO: 2203206 - RNA, 19 nt, Human
ugaaaacguuuuauugugu

SEQ ID NO: 2203207 - RNA, 19 nt, Human
ugaaaacucauuacuuuuc

SEQ ID NO: 2203208 - RNA, 19 nt, Human
ugaaaacuuuaugcuaagu

SEQ ID NO: 2203209 - RNA, 17 nt, Human
ugaaaacuuuucucaga

SEQ ID NO: 2203210 - RNA, 18 nt, Human
ugaaaagacaucaagcac

SEQ ID NO: 2203211 - RNA, 17 nt, Human
ugaaaagacaucaagca

SEQ ID NO: 2203212 - RNA, 19 nt, Human
ugaaaagacuccaaagaaa

SEQ ID NO: 2203213 - RNA, 17 nt, Human
ugaaaagacuccaaaga

SEQ ID NO: 2203214 - RNA, 16 nt, Human
ugaaaagacuccaaag

SEQ ID NO: 2203215 - RNA, 15 nt, Human
ugaaaagacuccaaa

SEQ ID NO: 2203216 - RNA, 21 nt, Human
ucuuucacacuuccaccagcc

SEQ ID NO: 2203217 - RNA, 20 nt, Human
ucuuucacacuuccaccagc

SEQ ID NO: 2203218 - RNA, 14 nt, Human
ucuuucacagcucc

SEQ ID NO: 2203219 - RNA, 15 nt, Human
ucuuucacagcuccu

SEQ ID NO: 2203220 - RNA, 21 nt, Human
ucuuucaagugaaucuaaaag

SEQ ID NO: 2203221 - RNA, 10 nt, Human
ucuuucacau

SEQ ID NO: 2203222 - RNA, 20 nt, Human
ucuuucacagcuccucccac

SEQ ID NO: 2203223 - RNA, 18 nt, Human
ucuuucacagcuccuccc

SEQ ID NO: 2203224 - RNA, 19 nt, Human
ucuuucacagcuccuccca

SEQ ID NO: 2203225 - RNA, 16 nt, Human
ucuuuucuugccucug

SEQ ID NO: 2203226 - RNA, 20 nt, Human
ucuuuucuugccucuguccc

SEQ ID NO: 2203227 - RNA, 23 nt, Human
ucuuuucuuuagagcauugccau

SEQ ID NO: 2203228 - RNA, 16 nt, Human
ucuuuucuuuagagca

SEQ ID NO: 2203229 - RNA, 23 nt, Human
ucuuucacacuuccaccagccug

SEQ ID NO: 2203230 - RNA, 17 nt, Human
ucuuuucucugugcuuc

SEQ ID NO: 2203231 - RNA, 13 nt, Human
ucuuuucucugug

SEQ ID NO: 2203232 - RNA, 19 nt, Human
ucuuuucuggaauguaauc

SEQ ID NO: 2203233 - RNA, 16 nt, Human
ucuuuuuauacuauua

SEQ ID NO: 2203234 - RNA, 22 nt, Human
ucuuuugguaaagacuggcuuu

SEQ ID NO: 2203235 - RNA, 16 nt, Human
ucuuuuggggaaguga

SEQ ID NO: 2203236 - RNA, 20 nt, Human
ucuuuuggggaagugaggaa

SEQ ID NO: 2203237 - RNA, 21 nt, Human
ucuuuugcccuucacaguguu

SEQ ID NO: 2203238 - RNA, 20 nt, Human
ucuuuugacauguggaaagu

SEQ ID NO: 2203239 - RNA, 11 nt, Human
ucuuuugaccu

SEQ ID NO: 2203240 - RNA, 16 nt, Human
ucuuuugauuauguuu

SEQ ID NO: 2203241 - RNA, 13 nt, Human
ucuuuugcuuuug

SEQ ID NO: 2203242 - RNA, 17 nt, Human
ucuuuugcaugaugauc

SEQ ID NO: 2203243 - RNA, 18 nt, Human
ucuuuugcuuuuggcaaa

SEQ ID NO: 2203244 - RNA, 13 nt, Human
ucuuuuggcuucc

SEQ ID NO: 2203245 - RNA, 17 nt, Human
ucuuuugacauguggaa

SEQ ID NO: 2203246 - RNA, 15 nt, Human
ucuuuugacaugugg

SEQ ID NO: 2203247 - RNA, 14 nt, Human
ucuuuugacaugug

SEQ ID NO: 2203248 - RNA, 13 nt, Human
ucuuuugacaugu

SEQ ID NO: 2203249 - RNA, 20 nt, Human
ucuuuugaauccaugcuugg

SEQ ID NO: 2203250 - RNA, 19 nt, Human
ucuuuugaauccaugcuug

SEQ ID NO: 2203251 - RNA, 23 nt, Human
ucuuuugaauauucccaagccca

SEQ ID NO: 2203252 - RNA, 14 nt, Human
ucuuuugaaacaau

SEQ ID NO: 2203253 - RNA, 15 nt, Human
ucuuuugaaacaaua

SEQ ID NO: 2203254 - RNA, 19 nt, Human
ucuuuugccguuauuaaaa

SEQ ID NO: 2203255 - RNA, 17 nt, Human
ucuuuugccguuauuaa

SEQ ID NO: 2203256 - RNA, 21 nt, Human
ugaaggcucgagcaugccugg

SEQ ID NO: 2203257 - RNA, 21 nt, Human
ugaaguccaagcauuuagaug

SEQ ID NO: 2203258 - RNA, 22 nt, Human
ugaaguccaagcauuuagaugu

SEQ ID NO: 2203259 - RNA, 20 nt, Human
ugaaggcucgagcaugccug

SEQ ID NO: 2203260 - RNA, 17 nt, Human
ugaaggcaaaauugcaa

SEQ ID NO: 2203261 - RNA, 16 nt, Human
ugaaggcaaaauugca

SEQ ID NO: 2203262 - RNA, 17 nt, Human
ugaaggaggugagggau

SEQ ID NO: 2203263 - RNA, 20 nt, Human
ugaaggagauuuuccuuccu

SEQ ID NO: 2203264 - RNA, 13 nt, Human
ugaaggaggugag

SEQ ID NO: 2203265 - RNA, 15 nt, Human
ugaaggaugccaaga

SEQ ID NO: 2203266 - RNA, 14 nt, Human
ugaaggcaaaauug

SEQ ID NO: 2203267 - RNA, 21 nt, Human
ugaagagggagaagcaugaaa

SEQ ID NO: 2203268 - RNA, 12 nt, Human
ugaagaggggca

SEQ ID NO: 2203269 - RNA, 13 nt, Human
ugaagaggggcag

SEQ ID NO: 2203270 - RNA, 14 nt, Human
ugaagaggggcagc

SEQ ID NO: 2203271 - RNA, 15 nt, Human
ugaagaggggcagcc

SEQ ID NO: 2203272 - RNA, 16 nt, Human
ugaagaggggcagccc

SEQ ID NO: 2203273 - RNA, 17 nt, Human
ugaagaggggcagcccu

SEQ ID NO: 2203274 - RNA, 18 nt, Human
ugaagaggggcagcccuu

SEQ ID NO: 2203275 - RNA, 17 nt, Human
ugaagagggagaaggga

SEQ ID NO: 2203276 - RNA, 18 nt, Human
ugaagagggagaagcaug

SEQ ID NO: 2203277 - RNA, 23 nt, Human
ugaagaggcgggccagccaggcg

SEQ ID NO: 2203278 - RNA, 18 nt, Human
ugaagaggcgggccagcc

SEQ ID NO: 2203279 - RNA, 19 nt, Human
ugaagaggcgggccagcca

SEQ ID NO: 2203280 - RNA, 20 nt, Human
ugaagaggcgggccagccag

SEQ ID NO: 2203281 - RNA, 21 nt, Human
ugaagaggcgggccagccagg

SEQ ID NO: 2203282 - RNA, 19 nt, Human
ugaagaucguuaguaucua

SEQ ID NO: 2203283 - RNA, 22 nt, Human
ugaagauaucuugaaaugaaag

SEQ ID NO: 2203284 - RNA, 22 nt, Human
ugaagaucauauacgugaaaau

SEQ ID NO: 2203285 - RNA, 21 nt, Human
ugaagauaucuugaaaugaaa

SEQ ID NO: 2203286 - RNA, 16 nt, Human
ugaagauaucuugaaa

SEQ ID NO: 2203287 - RNA, 15 nt, Human
ugaagauauuuuucc

SEQ ID NO: 2203288 - RNA, 23 nt, Human
ugaagauauaacuauugcccagg

SEQ ID NO: 2203289 - RNA, 19 nt, Human
ugaagaggggcagcccuug

SEQ ID NO: 2203290 - RNA, 20 nt, Human
ugaagaggggcagcccuugc

SEQ ID NO: 2203291 - RNA, 16 nt, Human
ugaagaggugagagua

SEQ ID NO: 2203292 - RNA, 15 nt, Human
ugaagaggugagcac

SEQ ID NO: 2203293 - RNA, 16 nt, Human
ugaagaugggaacgca

SEQ ID NO: 2203294 - RNA, 19 nt, Human
ugaagauggcauccuguga

SEQ ID NO: 2203295 - RNA, 21 nt, Human
ugaagauggcauccugugaag

SEQ ID NO: 2203296 - RNA, 21 nt, Human
ugaagaugcugaaacaggaga

SEQ ID NO: 2203297 - RNA, 21 nt, Human
ugaagaugcagcaaaauguga

SEQ ID NO: 2203298 - RNA, 17 nt, Human
ugaagauggcauccugu

SEQ ID NO: 2203299 - RNA, 18 nt, Human
ugaagauggcauccugug

SEQ ID NO: 2203300 - RNA, 12 nt, Human
ugaagaugaaca

SEQ ID NO: 2203301 - RNA, 13 nt, Human
ugaagaugaucau

SEQ ID NO: 2203302 - RNA, 15 nt, Human
ugaagaugcagcuca

SEQ ID NO: 2203303 - RNA, 20 nt, Human
ugaaggagagcccuucauuu

SEQ ID NO: 2203304 - RNA, 22 nt, Human
ugaagauggcauccugugaagu

SEQ ID NO: 2203305 - RNA, 22 nt, Human
ugaaggagaggcaacauccaaa

SEQ ID NO: 2203306 - RNA, 11 nt, Human
ugaaggagccc

SEQ ID NO: 2203307 - RNA, 23 nt, Human
ugaaggagccccauuccugggaa

SEQ ID NO: 2203308 - RNA, 22 nt, Human
ugaaggagccccauuccuggga

SEQ ID NO: 2203309 - RNA, 15 nt, Human
ugaagaggcgggcca

SEQ ID NO: 2203310 - RNA, 16 nt, Human
ugaagaggcgggccag

SEQ ID NO: 2203311 - RNA, 17 nt, Human
ugaagaggcgggccagc

SEQ ID NO: 2203312 - RNA, 18 nt, Human
ugaagaggaucggaggcu

SEQ ID NO: 2203313 - RNA, 22 nt, Human
ugaagaggaaaaugaauaauac

SEQ ID NO: 2203314 - RNA, 13 nt, Human
ugaagaggaaggg

SEQ ID NO: 2203315 - RNA, 24 nt, Human
ugaagagaaccgagcaaagaucaa

SEQ ID NO: 2203316 - RNA, 20 nt, Human
ugaagaggaaaaugaauaau

SEQ ID NO: 2203317 - RNA, 23 nt, Human
ugaagagaaccgagcaaagauca

SEQ ID NO: 2203318 - RNA, 17 nt, Human
ugaagacuuuucuuuca

SEQ ID NO: 2203319 - RNA, 22 nt, Human
ugaagacuuuucuuucagccaa

SEQ ID NO: 2203320 - RNA, 14 nt, Human
ugaagacagaggga

SEQ ID NO: 2203321 - RNA, 14 nt, Human
ugaagacaggacag

SEQ ID NO: 2203322 - RNA, 14 nt, Human
ugaagacaggaugg

SEQ ID NO: 2203323 - RNA, 20 nt, Human
ugaagaccacauccacacac

SEQ ID NO: 2203324 - RNA, 12 nt, Human
ugaagacauaaa

SEQ ID NO: 2203325 - RNA, 14 nt, Human
ugaagacuuuucuu

SEQ ID NO: 2203326 - RNA, 18 nt, Human
ugaagacuggaagcuaau

SEQ ID NO: 2203327 - RNA, 14 nt, Human
ugaacugggaccuu

SEQ ID NO: 2203328 - RNA, 23 nt, Human
ugaacuggacccuguugcuaagc

SEQ ID NO: 2203329 - RNA, 21 nt, Human
ugaacuggacccuguugcuaa

SEQ ID NO: 2203330 - RNA, 22 nt, Human
ugaacuggacccuguugcuaag

SEQ ID NO: 2203331 - RNA, 19 nt, Human
ugaacuggguacuugugga

SEQ ID NO: 2203332 - RNA, 14 nt, Human
ugaacuuggcgcug

SEQ ID NO: 2203333 - RNA, 12 nt, Human
ugaacuugguuc

SEQ ID NO: 2203334 - RNA, 22 nt, Human
ugaacuuguaaaggaauuuaaa

SEQ ID NO: 2203335 - RNA, 14 nt, Human
ugaagacagagcua

SEQ ID NO: 2203336 - RNA, 16 nt, Human
ugaagacagagcuaca

SEQ ID NO: 2203337 - RNA, 14 nt, Human
ugaacugaacucug

SEQ ID NO: 2203338 - RNA, 17 nt, Human
ugaacucuuugaaugac

SEQ ID NO: 2203339 - RNA, 19 nt, Human
ugaacucuuugaaugacaa

SEQ ID NO: 2203340 - RNA, 20 nt, Human
ugaacucuuugaaugacaaa

SEQ ID NO: 2203341 - RNA, 18 nt, Human
ugaacucuucaaucucuu

SEQ ID NO: 2203342 - RNA, 21 nt, Human
ugaacucuuaaucaaauagca

SEQ ID NO: 2203343 - RNA, 12 nt, Human
ugaacucuuaga

SEQ ID NO: 2203344 - RNA, 19 nt, Human
ugaacucuuagaaaugaag

SEQ ID NO: 2203345 - RNA, 20 nt, Human
ugaaccacaucuugcucugc

SEQ ID NO: 2203346 - RNA, 21 nt, Human
ugaaccacaucuugcucugcu

SEQ ID NO: 2203347 - RNA, 15 nt, Human
ugaacucuucaaucu

SEQ ID NO: 2203348 - RNA, 22 nt, Human
ugaaccacaucuugcucugcug

SEQ ID NO: 2203349 - RNA, 12 nt, Human
ugaacugaaguu

SEQ ID NO: 2203350 - RNA, 13 nt, Human
ugaacugaaguuu

SEQ ID NO: 2203351 - RNA, 15 nt, Human
ugaacugaaguuuca

SEQ ID NO: 2203352 - RNA, 17 nt, Human
ugaacugaaguuucaca

SEQ ID NO: 2203353 - RNA, 13 nt, Human
ugaacugacaggc

SEQ ID NO: 2203354 - RNA, 19 nt, Human
ugaacugaacucugacaac

SEQ ID NO: 2203355 - RNA, 17 nt, Human
ugaacugaacucugaca

SEQ ID NO: 2203356 - RNA, 13 nt, Human
ugaacugauaaag

SEQ ID NO: 2203357 - RNA, 15 nt, Human
ugaacugagcuugga

SEQ ID NO: 2203358 - RNA, 12 nt, Human
ugaacugagcuu

SEQ ID NO: 2203359 - RNA, 21 nt, Human
ugaacugauaguuacuguugu

SEQ ID NO: 2203360 - RNA, 23 nt, Human
ugaacugauaguuacuguuguga

SEQ ID NO: 2203361 - RNA, 17 nt, Human
ugaacuggacccuguug

SEQ ID NO: 2203362 - RNA, 18 nt, Human
ugaacuggacccuguugc

SEQ ID NO: 2203363 - RNA, 19 nt, Human
ugaacuggacccuguugcu

SEQ ID NO: 2203364 - RNA, 20 nt, Human
ugaacuggacccuguugcua

SEQ ID NO: 2203365 - RNA, 15 nt, Human
ugaacugauaaagau

SEQ ID NO: 2203366 - RNA, 16 nt, Human
ugaacugagcuuggaa

SEQ ID NO: 2203367 - RNA, 21 nt, Human
ugaacugacaggcagccugga

SEQ ID NO: 2203368 - RNA, 23 nt, Human
ugaacugacaggcagccuggaca

SEQ ID NO: 2203369 - RNA, 18 nt, Human
ugaacugauaguuacugu

SEQ ID NO: 2203370 - RNA, 19 nt, Human
ugaacugauaguuacuguu

SEQ ID NO: 2203371 - RNA, 14 nt, Human
ugaacacucaugcu

SEQ ID NO: 2203372 - RNA, 16 nt, Human
ugaacacucaugcuga

SEQ ID NO: 2203373 - RNA, 23 nt, Human
ugaacacacuguguccuggugcu

SEQ ID NO: 2203374 - RNA, 14 nt, Human
ugaacacaucagcu

SEQ ID NO: 2203375 - RNA, 14 nt, Human
ugaacacacugugu

SEQ ID NO: 2203376 - RNA, 15 nt, Human
ugaacacacuguguc

SEQ ID NO: 2203377 - RNA, 18 nt, Human
ugaacacacuguguccug

SEQ ID NO: 2203378 - RNA, 19 nt, Human
ugaacacaaacuguaaaua

SEQ ID NO: 2203379 - RNA, 16 nt, Human
ugaaaugcuggcauuu

SEQ ID NO: 2203380 - RNA, 15 nt, Human
ugaaaugcugcauuu

SEQ ID NO: 2203381 - RNA, 17 nt, Human
ugaaaugcugcauuuua

SEQ ID NO: 2203382 - RNA, 13 nt, Human
ugaaaugcugcau

SEQ ID NO: 2203383 - RNA, 19 nt, Human
ugaaauggacuuuuguaca

SEQ ID NO: 2203384 - RNA, 18 nt, Human
ugaaaugcaucauucuug

SEQ ID NO: 2203385 - RNA, 16 nt, Human
ugaaaugcucuccuuu

SEQ ID NO: 2203386 - RNA, 17 nt, Human
ugaaaugcucuccuuuc

SEQ ID NO: 2203387 - RNA, 19 nt, Human
ugaacauacuggcugguga

SEQ ID NO: 2203388 - RNA, 18 nt, Human
ugaacacuggcaacaaca

SEQ ID NO: 2203389 - RNA, 20 nt, Human
ugaacagaaaacauucugau

SEQ ID NO: 2203390 - RNA, 22 nt, Human
ugaacacugggggaggggacau

SEQ ID NO: 2203391 - RNA, 17 nt, Human
ugaacacugggggaggg

SEQ ID NO: 2203392 - RNA, 16 nt, Human
ugaacacugggggagg

SEQ ID NO: 2203393 - RNA, 14 nt, Human
ugaacacuggggga

SEQ ID NO: 2203394 - RNA, 23 nt, Human
ugaacacuccaauuaaggauuuu

SEQ ID NO: 2203395 - RNA, 22 nt, Human
ugaacacuccaauuaaggauuu

SEQ ID NO: 2203396 - RNA, 19 nt, Human
ugaacacuccaauuaagga

SEQ ID NO: 2203397 - RNA, 18 nt, Human
ugaacacuccaauuaagg

SEQ ID NO: 2203398 - RNA, 17 nt, Human
ugaacacucaugcugaa

SEQ ID NO: 2203399 - RNA, 18 nt, Human
ugaacacucaugcugaaa

SEQ ID NO: 2203400 - RNA, 13 nt, Human
ugaacauuccaga

SEQ ID NO: 2203401 - RNA, 13 nt, Human
ugaacauguacug

SEQ ID NO: 2203402 - RNA, 17 nt, Human
ugaacauauuguugaaa

SEQ ID NO: 2203403 - RNA, 17 nt, Human
ugaacauccuuccuucc

SEQ ID NO: 2203404 - RNA, 14 nt, Human
ugaacauggacucu

SEQ ID NO: 2203405 - RNA, 18 nt, Human
ugaacauccuuccuuccc

SEQ ID NO: 2203406 - RNA, 20 nt, Human
ugaacauccuuccuucccac

SEQ ID NO: 2203407 - RNA, 14 nt, Human
ugaacauuccagag

SEQ ID NO: 2203408 - RNA, 16 nt, Human
uccuuuuuuauacaca

SEQ ID NO: 2203409 - RNA, 14 nt, Human
uccuuuuuguuauu

SEQ ID NO: 2203410 - RNA, 18 nt, Human
uccuuuuuuauacacaua

SEQ ID NO: 2203411 - RNA, 21 nt, Human
uccuuuuuuuccaucuuuaca

SEQ ID NO: 2203412 - RNA, 14 nt, Human
uccuuuuucuuuau

SEQ ID NO: 2203413 - RNA, 20 nt, Human
uccuuuuucucccucuggau

SEQ ID NO: 2203414 - RNA, 19 nt, Human
uccuuuuucuuuauaaacu

SEQ ID NO: 2203415 - RNA, 13 nt, Human
uccuuuuuguuau

SEQ ID NO: 2203416 - RNA, 14 nt, Human
uccuuuuucucccu

SEQ ID NO: 2203417 - RNA, 15 nt, Human
ucgaguuacagacaa

SEQ ID NO: 2203418 - RNA, 14 nt, Human
ucgauacugcgacu

SEQ ID NO: 2203419 - RNA, 17 nt, Human
ucgauucauauugaaua

SEQ ID NO: 2203420 - RNA, 17 nt, Human
ucgaguuacagacaaag

SEQ ID NO: 2203421 - RNA, 17 nt, Human
uccuugcaccugcaucc

SEQ ID NO: 2203422 - RNA, 20 nt, Human
uccuuggcucccauucacuc

SEQ ID NO: 2203423 - RNA, 14 nt, Human
uccuugggaggaag

SEQ ID NO: 2203424 - RNA, 15 nt, Human
uccuuggcuggugca

SEQ ID NO: 2203425 - RNA, 15 nt, Human
uccuugggaggaagc

SEQ ID NO: 2203426 - RNA, 16 nt, Human
uccuugggaggaagca

SEQ ID NO: 2203427 - RNA, 17 nt, Human
uccuugggaggaagcag

SEQ ID NO: 2203428 - RNA, 18 nt, Human
uccuugggaggaagcaga

SEQ ID NO: 2203429 - RNA, 22 nt, Human
uccuugggaggccccacugggg

SEQ ID NO: 2203430 - RNA, 21 nt, Human
uccuugggaggccccacuggg

SEQ ID NO: 2203431 - RNA, 20 nt, Human
uccuugggaggccccacugg

SEQ ID NO: 2203432 - RNA, 23 nt, Human
uccuugggaggaagcagaauaaa

SEQ ID NO: 2203433 - RNA, 19 nt, Human
uccuugggaggaagcagaa

SEQ ID NO: 2203434 - RNA, 20 nt, Human
uccuugggaggaagcagaau

SEQ ID NO: 2203435 - RNA, 21 nt, Human
uccuugggaggaagcagaaua

SEQ ID NO: 2203436 - RNA, 22 nt, Human
uccuugggaggaagcagaauaa

SEQ ID NO: 2203437 - RNA, 16 nt, Human
uccuugggcccuuuga

SEQ ID NO: 2203438 - RNA, 14 nt, Human
uccuugggcccuuu

SEQ ID NO: 2203439 - RNA, 13 nt, Human
uccuugggcccuu

SEQ ID NO: 2203440 - RNA, 13 nt, Human
uccuugggcacuu

SEQ ID NO: 2203441 - RNA, 17 nt, Human
uccuugggcacuuuuua

SEQ ID NO: 2203442 - RNA, 16 nt, Human
uccuuggggcaggcag

SEQ ID NO: 2203443 - RNA, 15 nt, Human
uccuuggggcaggca

SEQ ID NO: 2203444 - RNA, 14 nt, Human
uccuuggggcaggc

SEQ ID NO: 2203445 - RNA, 14 nt, Human
uccuuuuggaguca

SEQ ID NO: 2203446 - RNA, 23 nt, Human
uccuuuuggagucagacagaugu

SEQ ID NO: 2203447 - RNA, 17 nt, Human
uccuuuuguguacagug

SEQ ID NO: 2203448 - RNA, 13 nt, Human
uccuuuugcuuga

SEQ ID NO: 2203449 - RNA, 18 nt, Human
uccuuuuguguacagugu

SEQ ID NO: 2203450 - RNA, 20 nt, Human
uccuuuuuaaauucaguccu

SEQ ID NO: 2203451 - RNA, 14 nt, Human
ucgcuucccccaua

SEQ ID NO: 2203452 - RNA, 16 nt, Human
ucgcuucauguaacua

SEQ ID NO: 2203453 - RNA, 15 nt, Human
ucgcuguugcugaau

SEQ ID NO: 2203454 - RNA, 17 nt, Human
ucgcuguugcugaauag

SEQ ID NO: 2203455 - RNA, 12 nt, Human
ucgcuguugcug

SEQ ID NO: 2203456 - RNA, 14 nt, Human
ucgcuguugcugaa

SEQ ID NO: 2203457 - RNA, 13 nt, Human
ucgcuguguguua

SEQ ID NO: 2203458 - RNA, 21 nt, Human
ucgcuguguguuaguucccaa

SEQ ID NO: 2203459 - RNA, 19 nt, Human
ucgcuucccccauagccac

SEQ ID NO: 2203460 - RNA, 17 nt, Human
ucgcuucccccauagcc

SEQ ID NO: 2203461 - RNA, 16 nt, Human
ucgcuucccccauagc

SEQ ID NO: 2203462 - RNA, 15 nt, Human
ucgcuucccccauag

SEQ ID NO: 2203463 - RNA, 15 nt, Human
ucgcuuccgcauccu

SEQ ID NO: 2203464 - RNA, 14 nt, Human
ucgcuucuugccuc

SEQ ID NO: 2203465 - RNA, 15 nt, Human
ucgcuucuugccucu

SEQ ID NO: 2203466 - RNA, 16 nt, Human
ucgcuucuugccucug

SEQ ID NO: 2203467 - RNA, 23 nt, Human
ucggaagcagugccuuccauaau

SEQ ID NO: 2203468 - RNA, 22 nt, Human
ucggaagcagugccuuccauaa

SEQ ID NO: 2203469 - RNA, 16 nt, Human
ucggaagcagugccuu

SEQ ID NO: 2203470 - RNA, 15 nt, Human
ucggaagcagugccu

SEQ ID NO: 2203471 - RNA, 19 nt, Human
ucggaaggcuggcugggca

SEQ ID NO: 2203472 - RNA, 10 nt, Human
ucggaccagc

SEQ ID NO: 2203473 - RNA, 17 nt, Human
ucggaccuuucagcugu

SEQ ID NO: 2203474 - RNA, 19 nt, Human
ucggacuaagccuaccugc

SEQ ID NO: 2203475 - RNA, 22 nt, Human
ucggacuaagccuaccugcucu

SEQ ID NO: 2203476 - RNA, 23 nt, Human
ucggacuaagccuaccugcucuc

SEQ ID NO: 2203477 - RNA, 13 nt, Human
ucggaagcagugc

SEQ ID NO: 2203478 - RNA, 22 nt, Human
ucggaacugcaugcugcuggac

SEQ ID NO: 2203479 - RNA, 18 nt, Human
ucggaacugcaugcugcu

SEQ ID NO: 2203480 - RNA, 19 nt, Human
ucggaacccaagcuuagaa

SEQ ID NO: 2203481 - RNA, 20 nt, Human
ucggaacccaagcuuagaac

SEQ ID NO: 2203482 - RNA, 17 nt, Human
ucgcuucuugccucugu

SEQ ID NO: 2203483 - RNA, 12 nt, Human
ucgcccaggaga

SEQ ID NO: 2203484 - RNA, 22 nt, Human
ucgcccaccgcaugcccccucg

SEQ ID NO: 2203485 - RNA, 19 nt, Human
ucgcccaggcuggagugca

SEQ ID NO: 2203486 - RNA, 18 nt, Human
ucgcccaaagccagacag

SEQ ID NO: 2203487 - RNA, 14 nt, Human
ucgcccaccgcaug

SEQ ID NO: 2203488 - RNA, 17 nt, Human
ucgcccaaagccagaca

SEQ ID NO: 2203489 - RNA, 14 nt, Human
ucgccaugccgggg

SEQ ID NO: 2203490 - RNA, 11 nt, Human
ucgcccaggag

SEQ ID NO: 2203491 - RNA, 16 nt, Human
ucgcccaccgcaugcc

SEQ ID NO: 2203492 - RNA, 21 nt, Human
ucgcccaccgcaugcccccuc

SEQ ID NO: 2203493 - RNA, 14 nt, Human
ucgcccaggcugga

SEQ ID NO: 2203494 - RNA, 12 nt, Human
ucgcccaggcug

SEQ ID NO: 2203495 - RNA, 13 nt, Human
ucgcaagcugggu

SEQ ID NO: 2203496 - RNA, 13 nt, Human
ucgcacagucucu

SEQ ID NO: 2203497 - RNA, 14 nt, Human
ucgcacagucucuc

SEQ ID NO: 2203498 - RNA, 21 nt, Human
ucgcaccacuguguauuuaac

SEQ ID NO: 2203499 - RNA, 16 nt, Human
ucgcacagucucucuc

SEQ ID NO: 2203500 - RNA, 16 nt, Human
ucgcaccauucugacu

SEQ ID NO: 2203501 - RNA, 17 nt, Human
ucgcaauguaagacucg

SEQ ID NO: 2203502 - RNA, 15 nt, Human
ucgauuucuccagga

SEQ ID NO: 2203503 - RNA, 13 nt, Human
ucgauuuuguauc

SEQ ID NO: 2203504 - RNA, 17 nt, Human
ucgauuuuguaucugca

SEQ ID NO: 2203505 - RNA, 18 nt, Human
ucgcaccuaccaucaggg

SEQ ID NO: 2203506 - RNA, 12 nt, Human
ucgcaccuacca

SEQ ID NO: 2203507 - RNA, 17 nt, Human
ucgcaccauucugacuc

SEQ ID NO: 2203508 - RNA, 12 nt, Human
ucgcagagaggc

SEQ ID NO: 2203509 - RNA, 14 nt, Human
ucgcagagaggcca

SEQ ID NO: 2203510 - RNA, 19 nt, Human
ucgcagagaggccaggugc

SEQ ID NO: 2203511 - RNA, 21 nt, Human
ucgcagagaggccaggugcag

SEQ ID NO: 2203512 - RNA, 13 nt, Human
ucgccaugccggg

SEQ ID NO: 2203513 - RNA, 14 nt, Human
uccuuaaugauccg

SEQ ID NO: 2203514 - RNA, 17 nt, Human
uccuuaauucacuccca

SEQ ID NO: 2203515 - RNA, 18 nt, Human
uccuuaauucacucccac

SEQ ID NO: 2203516 - RNA, 19 nt, Human
uccuuaauucacucccaca

SEQ ID NO: 2203517 - RNA, 17 nt, Human
uccuuaauccagcugau

SEQ ID NO: 2203518 - RNA, 13 nt, Human
uccugucagugcc

SEQ ID NO: 2203519 - RNA, 14 nt, Human
uccugucagugccg

SEQ ID NO: 2203520 - RNA, 12 nt, Human
uccugucagugc

SEQ ID NO: 2203521 - RNA, 22 nt, Human
uccuuauguauauuuaaaagaa

SEQ ID NO: 2203522 - RNA, 16 nt, Human
uccuucaaagcaaaug

SEQ ID NO: 2203523 - RNA, 14 nt, Human
uccuuaccagcaga

SEQ ID NO: 2203524 - RNA, 22 nt, Human
uccuuacaaguuagaaaacaua

SEQ ID NO: 2203525 - RNA, 21 nt, Human
uccuuacaaguuagaaaacau

SEQ ID NO: 2203526 - RNA, 23 nt, Human
uccuucaagaacucugggcugcu

SEQ ID NO: 2203527 - RNA, 21 nt, Human
uccuucaagaacucugggcug

SEQ ID NO: 2203528 - RNA, 20 nt, Human
uccuucaagaacucugggcu

SEQ ID NO: 2203529 - RNA, 19 nt, Human
uccuucaagaacucugggc

SEQ ID NO: 2203530 - RNA, 23 nt, Human
uccuucaaguuagcucaggaggc

SEQ ID NO: 2203531 - RNA, 20 nt, Human
uccuucaaguuagcucagga

SEQ ID NO: 2203532 - RNA, 19 nt, Human
uccuucaaguuagcucagg

SEQ ID NO: 2203533 - RNA, 18 nt, Human
uccuucaaguuagcucag

SEQ ID NO: 2203534 - RNA, 12 nt, Human
uccuucuguccu

SEQ ID NO: 2203535 - RNA, 19 nt, Human
uccuucuguccuacucugu

SEQ ID NO: 2203536 - RNA, 20 nt, Human
uccuucugugaaaguacauu

SEQ ID NO: 2203537 - RNA, 20 nt, Human
uccuucaagaucauguaccc

SEQ ID NO: 2203538 - RNA, 15 nt, Human
uccuucugccuuuuu

SEQ ID NO: 2203539 - RNA, 14 nt, Human
uccuugcaccugca

SEQ ID NO: 2203540 - RNA, 24 nt, Human
uccuugcaccccucacucuggccu

SEQ ID NO: 2203541 - RNA, 21 nt, Human
uccuugcaccccucacucugg

SEQ ID NO: 2203542 - RNA, 22 nt, Human
uccuugcaccccucacucuggc

SEQ ID NO: 2203543 - RNA, 22 nt, Human
uccuugcacacuccccugcacu

SEQ ID NO: 2203544 - RNA, 14 nt, Human
uccuugcaccccuc

SEQ ID NO: 2203545 - RNA, 15 nt, Human
uccuugcaccccuca

SEQ ID NO: 2203546 - RNA, 20 nt, Human
uccuugcaccccucacucug

SEQ ID NO: 2203547 - RNA, 15 nt, Human
uccuugcaucaauuu

SEQ ID NO: 2203548 - RNA, 22 nt, Human
uccuugauuuuagccuucucug

SEQ ID NO: 2203549 - RNA, 21 nt, Human
uccuugcacacuccccugcac

SEQ ID NO: 2203550 - RNA, 22 nt, Human
uccuucuuucuaguucagcugc

SEQ ID NO: 2203551 - RNA, 23 nt, Human
uccuugauuuuagccuucucugu

SEQ ID NO: 2203552 - RNA, 22 nt, Human
uccuugaucuguauauacaaua

SEQ ID NO: 2203553 - RNA, 16 nt, Human
uccuugaucuguauau

SEQ ID NO: 2203554 - RNA, 12 nt, Human
uccuucugccuu

SEQ ID NO: 2203555 - RNA, 17 nt, Human
uccuucuugccuucaga

SEQ ID NO: 2203556 - RNA, 16 nt, Human
uccuucuuguaguagu

SEQ ID NO: 2203557 - RNA, 20 nt, Human
uccuggucuugagaugucuu

SEQ ID NO: 2203558 - RNA, 21 nt, Human
uccuggugccaauuucaaguu

SEQ ID NO: 2203559 - RNA, 15 nt, Human
uccuggugcucucug

SEQ ID NO: 2203560 - RNA, 14 nt, Human
uccuggugcucucu

SEQ ID NO: 2203561 - RNA, 17 nt, Human
uccuggucuugagaugu

SEQ ID NO: 2203562 - RNA, 20 nt, Human
uccuggugccaauuucaagu

SEQ ID NO: 2203563 - RNA, 16 nt, Human
uccuggccaucccaca

SEQ ID NO: 2203564 - RNA, 15 nt, Human
uccuggccaucccac

SEQ ID NO: 2203565 - RNA, 20 nt, Human
uccuggccaucccacaagug

SEQ ID NO: 2203566 - RNA, 17 nt, Human
uccuggcccacugcauc

SEQ ID NO: 2203567 - RNA, 14 nt, Human
uccuggccauccca

SEQ ID NO: 2203568 - RNA, 11 nt, Human
uccuggccauc

SEQ ID NO: 2203569 - RNA, 20 nt, Human
uccuggcaguuuaaaaaaau

SEQ ID NO: 2203570 - RNA, 17 nt, Human
uccuggcaguuuaaaaa

SEQ ID NO: 2203571 - RNA, 10 nt, Human
ucccucccuu

SEQ ID NO: 2203572 - RNA, 22 nt, Human
uccuggcaugggaaugaauguc

SEQ ID NO: 2203573 - RNA, 19 nt, Human
uccuguaaaugguguacau

SEQ ID NO: 2203574 - RNA, 19 nt, Human
uccuguaaagguuacaagc

SEQ ID NO: 2203575 - RNA, 22 nt, Human
uccuguaaaaaaaaaaaaguua

SEQ ID NO: 2203576 - RNA, 15 nt, Human
uccugguucccguuu

SEQ ID NO: 2203577 - RNA, 21 nt, Human
uccugguucccguuucuccac

SEQ ID NO: 2203578 - RNA, 23 nt, Human
uccugguucccguuucuccaccu

SEQ ID NO: 2203579 - RNA, 14 nt, Human
uccuggugugaagg

SEQ ID NO: 2203580 - RNA, 21 nt, Human
uccuguaguugcguggacucu

SEQ ID NO: 2203581 - RNA, 22 nt, Human
uccuguaguugcguggacucug

SEQ ID NO: 2203582 - RNA, 23 nt, Human
uccuguaguugcguggacucugc

SEQ ID NO: 2203583 - RNA, 13 nt, Human
uccuguauguugu

SEQ ID NO: 2203584 - RNA, 15 nt, Human
uccuguauucacccg

SEQ ID NO: 2203585 - RNA, 15 nt, Human
uccugguguggaaga

SEQ ID NO: 2203586 - RNA, 14 nt, Human
uccuggugucacuu

SEQ ID NO: 2203587 - RNA, 21 nt, Human
uccuggugucacuuacuguuu

SEQ ID NO: 2203588 - RNA, 16 nt, Human
uccuggugcucucugc

SEQ ID NO: 2203589 - RNA, 18 nt, Human
uccuggugcucucugcca

SEQ ID NO: 2203590 - RNA, 19 nt, Human
uccuggugcucucugccac

SEQ ID NO: 2203591 - RNA, 20 nt, Human
uccuggugcucucugccacu

SEQ ID NO: 2203592 - RNA, 16 nt, Human
uccugguggguccagg

SEQ ID NO: 2203593 - RNA, 22 nt, Human
uccugguggguccaggggcccc

SEQ ID NO: 2203594 - RNA, 17 nt, Human
uccugguggguccaggg

SEQ ID NO: 2203595 - RNA, 19 nt, Human
uccugguggguccaggggc

SEQ ID NO: 2203596 - RNA, 14 nt, Human
ucucaaacuccuga

SEQ ID NO: 2203597 - RNA, 23 nt, Human
ucucaaaccuguuuaaauauuuc

SEQ ID NO: 2203598 - RNA, 23 nt, Human
ucucaaaccuugaugugccugug

SEQ ID NO: 2203599 - RNA, 19 nt, Human
ucucaaaccuguuuaaaua

SEQ ID NO: 2203600 - RNA, 23 nt, Human
ucucaaacacaguuacacuugug

SEQ ID NO: 2203601 - RNA, 20 nt, Human
ucucaaaccaagcaaaggaa

SEQ ID NO: 2203602 - RNA, 24 nt, Human
ucuaguauuccagaccugaagaau

SEQ ID NO: 2203603 - RNA, 16 nt, Human
ucuaguccuauucuau

SEQ ID NO: 2203604 - RNA, 19 nt, Human
ucuaguccuauucuauugc

SEQ ID NO: 2203605 - RNA, 13 nt, Human
ucucaaacacagu

SEQ ID NO: 2203606 - RNA, 19 nt, Human
ucucaaacacaguuacacu

SEQ ID NO: 2203607 - RNA, 22 nt, Human
ucucaaacacaguuacacuugu

SEQ ID NO: 2203608 - RNA, 17 nt, Human
ucuagggagagacccuu

SEQ ID NO: 2203609 - RNA, 20 nt, Human
ucuagggaccccuccucccu

SEQ ID NO: 2203610 - RNA, 17 nt, Human
ucuagggaccccuccuc

SEQ ID NO: 2203611 - RNA, 18 nt, Human
ucuagggaccccuccucc

SEQ ID NO: 2203612 - RNA, 19 nt, Human
ucuaggggucaggcuccau

SEQ ID NO: 2203613 - RNA, 18 nt, Human
ucuaggguuauugcauuu

SEQ ID NO: 2203614 - RNA, 22 nt, Human
ucuaguacuugggagaccugua

SEQ ID NO: 2203615 - RNA, 22 nt, Human
ucucaaacucuugaccucaggu

SEQ ID NO: 2203616 - RNA, 13 nt, Human
ucucaaacucuug

SEQ ID NO: 2203617 - RNA, 21 nt, Human
ucucaaacucuugaccucagg

SEQ ID NO: 2203618 - RNA, 13 nt, Human
ucucaaccauccc

SEQ ID NO: 2203619 - RNA, 17 nt, Human
ucucaacccaggagcau

SEQ ID NO: 2203620 - RNA, 17 nt, Human
ucucaaccaccuuucag

SEQ ID NO: 2203621 - RNA, 21 nt, Human
ucucaacccuuuugucugccu

SEQ ID NO: 2203622 - RNA, 23 nt, Human
ucucaacccuuuugucugccucu

SEQ ID NO: 2203623 - RNA, 21 nt, Human
ucucaaccuaccaccccuucc

SEQ ID NO: 2203624 - RNA, 22 nt, Human
ucucaaccuaccaccccuuccu

SEQ ID NO: 2203625 - RNA, 21 nt, Human
ucucaacaaagcacaguguua

SEQ ID NO: 2203626 - RNA, 19 nt, Human
ucucaacaaagcacagugu

SEQ ID NO: 2203627 - RNA, 14 nt, Human
ucucaaacuggggc

SEQ ID NO: 2203628 - RNA, 21 nt, Human
ucucaaauuuggauugcuaau

SEQ ID NO: 2203629 - RNA, 17 nt, Human
ucucacuguugcccagg

SEQ ID NO: 2203630 - RNA, 23 nt, Human
ucucaaccuaccaccccuuccug

SEQ ID NO: 2203631 - RNA, 13 nt, Human
ucucacuugugcc

SEQ ID NO: 2203632 - RNA, 13 nt, Human
ucucacuuguuuc

SEQ ID NO: 2203633 - RNA, 17 nt, Human
ucucacuuuucuccaug

SEQ ID NO: 2203634 - RNA, 15 nt, Human
ucucacuuuucucca

SEQ ID NO: 2203635 - RNA, 20 nt, Human
ucucacuuuucuccaugagu

SEQ ID NO: 2203636 - RNA, 19 nt, Human
ucucagaagguauuccuuu

SEQ ID NO: 2203637 - RNA, 12 nt, Human
ucucagaaucua

SEQ ID NO: 2203638 - RNA, 13 nt, Human
ucucagaagggag

SEQ ID NO: 2203639 - RNA, 14 nt, Human
ucucagaagggagg

SEQ ID NO: 2203640 - RNA, 15 nt, Human
ucucagaagggaggc

SEQ ID NO: 2203641 - RNA, 18 nt, Human
ucucagaagggaggcugg

SEQ ID NO: 2203642 - RNA, 22 nt, Human
ucucagaaggcaaaugacuuug

SEQ ID NO: 2203643 - RNA, 21 nt, Human
ucucagaaggcaaaugacuuu

SEQ ID NO: 2203644 - RNA, 20 nt, Human
ucucagaaggcaaaugacuu

SEQ ID NO: 2203645 - RNA, 19 nt, Human
ucucagaaggcaaaugacu

SEQ ID NO: 2203646 - RNA, 21 nt, Human
ucucagaaucucaaauaacua

SEQ ID NO: 2203647 - RNA, 17 nt, Human
ucucagaaucucaaaua

SEQ ID NO: 2203648 - RNA, 16 nt, Human
ucucagggcuccugcc

SEQ ID NO: 2203649 - RNA, 19 nt, Human
ucucagaaucuacccaaag

SEQ ID NO: 2203650 - RNA, 20 nt, Human
ucucagaaucuacccaaagg

SEQ ID NO: 2203651 - RNA, 17 nt, Human
ucucagggcuccugccu

SEQ ID NO: 2203652 - RNA, 23 nt, Human
ucucagggcuccugccuucuguc

SEQ ID NO: 2203653 - RNA, 17 nt, Human
ucucaggggccagagga

SEQ ID NO: 2203654 - RNA, 20 nt, Human
ucucaggggccagaggaacu

SEQ ID NO: 2203655 - RNA, 16 nt, Human
ucucaggggcuguuug

SEQ ID NO: 2203656 - RNA, 17 nt, Human
ucucaggggcuguuuga

SEQ ID NO: 2203657 - RNA, 15 nt, Human
ucucagggucucugc

SEQ ID NO: 2203658 - RNA, 16 nt, Human
ucucagggucucugcu

SEQ ID NO: 2203659 - RNA, 17 nt, Human
ucucagggucucugcug

SEQ ID NO: 2203660 - RNA, 18 nt, Human
ucucagggucucugcugc

SEQ ID NO: 2203661 - RNA, 20 nt, Human
ucucagggucucugcugccg

SEQ ID NO: 2203662 - RNA, 18 nt, Human
ucucacuguugcccaggc

SEQ ID NO: 2203663 - RNA, 19 nt, Human
ucucacuguugcccaggcu

SEQ ID NO: 2203664 - RNA, 20 nt, Human
ucucacuguugcccaggcug

SEQ ID NO: 2203665 - RNA, 21 nt, Human
ucucacuguugcccaggcugg

SEQ ID NO: 2203666 - RNA, 18 nt, Human
ucucacucugucgcccag

SEQ ID NO: 2203667 - RNA, 22 nt, Human
ucucacucugucgcccagucug

SEQ ID NO: 2203668 - RNA, 16 nt, Human
ucucacucugucgccc

SEQ ID NO: 2203669 - RNA, 17 nt, Human
ucucacucugucgccca

SEQ ID NO: 2203670 - RNA, 15 nt, Human
ucuacacucaucuua

SEQ ID NO: 2203671 - RNA, 17 nt, Human
ucuacacuccagugaga

SEQ ID NO: 2203672 - RNA, 12 nt, Human
ucuacacugugc

SEQ ID NO: 2203673 - RNA, 14 nt, Human
ucuacacugugcug

SEQ ID NO: 2203674 - RNA, 19 nt, Human
ucuacugaggugcuauguu

SEQ ID NO: 2203675 - RNA, 18 nt, Human
ucuacugaggugcuaugu

SEQ ID NO: 2203676 - RNA, 21 nt, Human
ucuacacugugcugagucuga

SEQ ID NO: 2203677 - RNA, 15 nt, Human
ucuacacugugcuga

SEQ ID NO: 2203678 - RNA, 22 nt, Human
ucuagggaaaaaccagcgugug

SEQ ID NO: 2203679 - RNA, 20 nt, Human
ucuagaauguguuuucugaa

SEQ ID NO: 2203680 - RNA, 23 nt, Human
ucuagaagccaagggaaaggggu

SEQ ID NO: 2203681 - RNA, 16 nt, Human
ucuagaaguuguuugu

SEQ ID NO: 2203682 - RNA, 20 nt, Human
ucuagaaguuguuugucauc

SEQ ID NO: 2203683 - RNA, 13 nt, Human
ucuagggaaauga

SEQ ID NO: 2203684 - RNA, 19 nt, Human
ucuagaauuuaucacacuu

SEQ ID NO: 2203685 - RNA, 19 nt, Human
ucuagggaaaaaccagcgu

SEQ ID NO: 2203686 - RNA, 17 nt, Human
ucuagggaaaugaaaga

SEQ ID NO: 2203687 - RNA, 15 nt, Human
ucuagggaccccucc

SEQ ID NO: 2203688 - RNA, 16 nt, Human
ucuagggaccccuccu

SEQ ID NO: 2203689 - RNA, 21 nt, Human
ucuagaacaucccugccagcu

SEQ ID NO: 2203690 - RNA, 17 nt, Human
ucuagaagccaagggaa

SEQ ID NO: 2203691 - RNA, 20 nt, Human
ucuagaagccaagggaaagg

SEQ ID NO: 2203692 - RNA, 21 nt, Human
ucuagaagccaagggaaaggg

SEQ ID NO: 2203693 - RNA, 21 nt, Human
ucuagaagacugucagcuucc

SEQ ID NO: 2203694 - RNA, 20 nt, Human
ucuagaagacugucagcuuc

SEQ ID NO: 2203695 - RNA, 18 nt, Human
ucuagaacuugacccccu

SEQ ID NO: 2203696 - RNA, 20 nt, Human
ucuagaacaucccugccagc

SEQ ID NO: 2203697 - RNA, 19 nt, Human
ucuagaacaucccugccag

SEQ ID NO: 2203698 - RNA, 22 nt, Human
ucuacugaggugcuauguucuu

SEQ ID NO: 2203699 - RNA, 14 nt, Human
ucuacacugugaac

SEQ ID NO: 2203700 - RNA, 13 nt, Human
ucuacacugugaa

SEQ ID NO: 2203701 - RNA, 21 nt, Human
ucuacucuuaaguuucucagc

SEQ ID NO: 2203702 - RNA, 22 nt, Human
ucuacucuuaaguuucucagcu

SEQ ID NO: 2203703 - RNA, 15 nt, Human
ucuacucuuuuuguu

SEQ ID NO: 2203704 - RNA, 17 nt, Human
ucuagaacacaggcaaa

SEQ ID NO: 2203705 - RNA, 15 nt, Human
ucuaacucagaaaca

SEQ ID NO: 2203706 - RNA, 19 nt, Human
ucuaacuagaaaucugcca

SEQ ID NO: 2203707 - RNA, 13 nt, Human
ucuaacucagcaa

SEQ ID NO: 2203708 - RNA, 20 nt, Human
ucuaaccucaucuucuucac

SEQ ID NO: 2203709 - RNA, 18 nt, Human
ucuaaccucaucuucuuc

SEQ ID NO: 2203710 - RNA, 13 nt, Human
ucuaaccucaucu

SEQ ID NO: 2203711 - RNA, 14 nt, Human
ucuaaccugugacc

SEQ ID NO: 2203712 - RNA, 15 nt, Human
ucuaaccugauggca

SEQ ID NO: 2203713 - RNA, 16 nt, Human
ucuaacuucaccauau

SEQ ID NO: 2203714 - RNA, 15 nt, Human
ucuaacuucaccaua

SEQ ID NO: 2203715 - RNA, 22 nt, Human
ucuaacuucaccauauuaccac

SEQ ID NO: 2203716 - RNA, 21 nt, Human
ucuacacuaagagagaaugag

SEQ ID NO: 2203717 - RNA, 16 nt, Human
ucuaaccccaggcccc

SEQ ID NO: 2203718 - RNA, 14 nt, Human
ucuaaauugaauaa

SEQ ID NO: 2203719 - RNA, 15 nt, Human
ucuaaauugaauaau

SEQ ID NO: 2203720 - RNA, 19 nt, Human
ucuaacaaaaaaauauauu

SEQ ID NO: 2203721 - RNA, 23 nt, Human
ucuaacccuaggcaucacaugcu

SEQ ID NO: 2203722 - RNA, 17 nt, Human
ucuaaauugaauaaugg

SEQ ID NO: 2203723 - RNA, 17 nt, Human
ucuaaccccaggccccg

SEQ ID NO: 2203724 - RNA, 14 nt, Human
ucuaacccucccau

SEQ ID NO: 2203725 - RNA, 15 nt, Human
ucuaacccucccaug

SEQ ID NO: 2203726 - RNA, 20 nt, Human
ucuaacccucccauggcacc

SEQ ID NO: 2203727 - RNA, 21 nt, Human
ucuaacccucccauggcaccu

SEQ ID NO: 2203728 - RNA, 22 nt, Human
ucuaaauuugaauguuaagcag

SEQ ID NO: 2203729 - RNA, 23 nt, Human
ucuaaauuugaauguuaagcaga

SEQ ID NO: 2203730 - RNA, 23 nt, Human
ucuaaaugcauauccugagccau

SEQ ID NO: 2203731 - RNA, 14 nt, Human
ucuaaaugcauauc

SEQ ID NO: 2203732 - RNA, 23 nt, Human
ucuaaaugggaaaguauucugua

SEQ ID NO: 2203733 - RNA, 13 nt, Human
ucuaaauugaaua

SEQ ID NO: 2203734 - RNA, 13 nt, Human
ucuaaauuugaau

SEQ ID NO: 2203735 - RNA, 17 nt, Human
ucuaaauuugaauguua

SEQ ID NO: 2203736 - RNA, 13 nt, Human
ucuaaaugaagug

SEQ ID NO: 2203737 - RNA, 22 nt, Human
ucuaaaucuccaaaauaaaacu

SEQ ID NO: 2203738 - RNA, 14 nt, Human
ucuccucuuguaaa

SEQ ID NO: 2203739 - RNA, 15 nt, Human
ucuccucuuguaaau

SEQ ID NO: 2203740 - RNA, 13 nt, Human
ucuccucuuguaa

SEQ ID NO: 2203741 - RNA, 22 nt, Human
ucuccucuugccacugccucuu

SEQ ID NO: 2203742 - RNA, 15 nt, Human
ucucccugacccugu

SEQ ID NO: 2203743 - RNA, 19 nt, Human
ucucccucuggcccugccu

SEQ ID NO: 2203744 - RNA, 15 nt, Human
ucucccucuucucaa

SEQ ID NO: 2203745 - RNA, 21 nt, Human
ucucccucuucucaagugccu

SEQ ID NO: 2203746 - RNA, 22 nt, Human
ucucccucuucucaagugccuu

SEQ ID NO: 2203747 - RNA, 16 nt, Human
ucuccugacccagucc

SEQ ID NO: 2203748 - RNA, 23 nt, Human
ucuccucuuguaaauaaagcccu

SEQ ID NO: 2203749 - RNA, 21 nt, Human
ucuccucuuguaaauaaagcc

SEQ ID NO: 2203750 - RNA, 16 nt, Human
ucuccucuuuuaucuu

SEQ ID NO: 2203751 - RNA, 20 nt, Human
ucucccucuggcccugccuu

SEQ ID NO: 2203752 - RNA, 18 nt, Human
ucucccucuggcccugcc

SEQ ID NO: 2203753 - RNA, 17 nt, Human
ucucccucuggcccugc

SEQ ID NO: 2203754 - RNA, 16 nt, Human
ucucccucuggcccug

SEQ ID NO: 2203755 - RNA, 15 nt, Human
ucucccucuggcccu

SEQ ID NO: 2203756 - RNA, 14 nt, Human
ucucccucuggccc

SEQ ID NO: 2203757 - RNA, 12 nt, Human
ucucccucuggc

SEQ ID NO: 2203758 - RNA, 21 nt, Human
ucucccucuccugccuacuca

SEQ ID NO: 2203759 - RNA, 16 nt, Human
ucucccucuggaucaa

SEQ ID NO: 2203760 - RNA, 18 nt, Human
ucucccucuccugccuac

SEQ ID NO: 2203761 - RNA, 17 nt, Human
ucucccucuccugccua

SEQ ID NO: 2203762 - RNA, 16 nt, Human
ucucccucuccugccu

SEQ ID NO: 2203763 - RNA, 15 nt, Human
ucucccucuccugcc

SEQ ID NO: 2203764 - RNA, 14 nt, Human
ucucccucuccugc

SEQ ID NO: 2203765 - RNA, 23 nt, Human
ucucccucucacugucugagagu

SEQ ID NO: 2203766 - RNA, 12 nt, Human
ucucccucucac

SEQ ID NO: 2203767 - RNA, 17 nt, Human
ucucccucucacugucu

SEQ ID NO: 2203768 - RNA, 23 nt, Human
ucucccucaacaagggagagacc

SEQ ID NO: 2203769 - RNA, 15 nt, Human
ucucccgguucuucc

SEQ ID NO: 2203770 - RNA, 16 nt, Human
ucucccgguucuucca

SEQ ID NO: 2203771 - RNA, 13 nt, Human
ucucccgucaggg

SEQ ID NO: 2203772 - RNA, 20 nt, Human
ucucccgucagggcccaagu

SEQ ID NO: 2203773 - RNA, 22 nt, Human
ucucccgucagggcccaagucc

SEQ ID NO: 2203774 - RNA, 17 nt, Human
ucuccugccuacucacg

SEQ ID NO: 2203775 - RNA, 13 nt, Human
ucuccugccugua

SEQ ID NO: 2203776 - RNA, 20 nt, Human
ucuccugccuguagcaguga

SEQ ID NO: 2203777 - RNA, 22 nt, Human
ucuccugccuguagcagugaga

SEQ ID NO: 2203778 - RNA, 19 nt, Human
ucuccugccucagccuccc

SEQ ID NO: 2203779 - RNA, 20 nt, Human
ucuccugccuuccuccuggg

SEQ ID NO: 2203780 - RNA, 18 nt, Human
ucuccugccuuccuccug

SEQ ID NO: 2203781 - RNA, 17 nt, Human
ucuccugccuuccuccu

SEQ ID NO: 2203782 - RNA, 16 nt, Human
ucuccugccuuccucc

SEQ ID NO: 2203783 - RNA, 15 nt, Human
ucuccugccuacuca

SEQ ID NO: 2203784 - RNA, 14 nt, Human
ucuccugccuacuc

SEQ ID NO: 2203785 - RNA, 12 nt, Human
ucuccugccuac

SEQ ID NO: 2203786 - RNA, 11 nt, Human
ucuccugccua

SEQ ID NO: 2203787 - RNA, 17 nt, Human
ucuccugacccaguccc

SEQ ID NO: 2203788 - RNA, 22 nt, Human
ucuccugccucagccucccaaa

SEQ ID NO: 2203789 - RNA, 12 nt, Human
ucucagguucuc

SEQ ID NO: 2203790 - RNA, 19 nt, Human
ucucagggucucugcugcc

SEQ ID NO: 2203791 - RNA, 15 nt, Human
ucucaggucccugca

SEQ ID NO: 2203792 - RNA, 15 nt, Human
ucucagucaguaauu

SEQ ID NO: 2203793 - RNA, 14 nt, Human
ucucagucaugcau

SEQ ID NO: 2203794 - RNA, 16 nt, Human
ucucagucaugcauaa

SEQ ID NO: 2203795 - RNA, 17 nt, Human
ucucaguacuuuggagg

SEQ ID NO: 2203796 - RNA, 22 nt, Human
ucucagugguuaagauuccuaa

SEQ ID NO: 2203797 - RNA, 21 nt, Human
ucucagugucaaugcagcccc

SEQ ID NO: 2203798 - RNA, 14 nt, Human
ucucccccagcccc

SEQ ID NO: 2203799 - RNA, 18 nt, Human
ucucaguguugagccuuu

SEQ ID NO: 2203800 - RNA, 22 nt, Human
ucucaguguugagccuuuuccc

SEQ ID NO: 2203801 - RNA, 20 nt, Human
ucucaguggcuucaucuguc

SEQ ID NO: 2203802 - RNA, 21 nt, Human
ucucaguuccgauuucccagg

SEQ ID NO: 2203803 - RNA, 15 nt, Human
ucucccccagcccca

SEQ ID NO: 2203804 - RNA, 17 nt, Human
ucucccccagccccauc

SEQ ID NO: 2203805 - RNA, 14 nt, Human
ucucccccugggcu

SEQ ID NO: 2203806 - RNA, 13 nt, Human
ucucccccugggc

SEQ ID NO: 2203807 - RNA, 12 nt, Human
ucucccccuggg

SEQ ID NO: 2203808 - RNA, 20 nt, Human
ucucccccccggggcugggu

SEQ ID NO: 2203809 - RNA, 21 nt, Human
ucucccccccggggcuggguu

SEQ ID NO: 2203810 - RNA, 20 nt, Human
ucuccccugcccccaggacu

SEQ ID NO: 2203811 - RNA, 21 nt, Human
ucuccccugcccccaggacug

SEQ ID NO: 2203812 - RNA, 22 nt, Human
ucuccccugcccccaggacugg

SEQ ID NO: 2203813 - RNA, 23 nt, Human
ucuccccugcccccaggacuggg

SEQ ID NO: 2203814 - RNA, 17 nt, Human
ucuccccugcccugcug

SEQ ID NO: 2203815 - RNA, 15 nt, Human
ucuccccugcccugc

SEQ ID NO: 2203816 - RNA, 14 nt, Human
ucuccccugcccug

SEQ ID NO: 2203817 - RNA, 16 nt, Human
ucuccccugcccccag

SEQ ID NO: 2203818 - RNA, 13 nt, Human
ucucccgcugcug

SEQ ID NO: 2203819 - RNA, 14 nt, Human
ucucccgcugcugc

SEQ ID NO: 2203820 - RNA, 20 nt, Human
ucucccggagguuggguggg

SEQ ID NO: 2203821 - RNA, 15 nt, Human
ucucccgcugcugcu

SEQ ID NO: 2203822 - RNA, 16 nt, Human
ucucccgcugcugcug

SEQ ID NO: 2203823 - RNA, 22 nt, Human
ucucccccagccccauccucug

SEQ ID NO: 2203824 - RNA, 16 nt, Human
ucuccccccccccucc

SEQ ID NO: 2203825 - RNA, 13 nt, Human
ucucccccccggg

SEQ ID NO: 2203826 - RNA, 13 nt, Human
ucucccccagccc

SEQ ID NO: 2203827 - RNA, 18 nt, Human
ucucccccagccccaucc

SEQ ID NO: 2203828 - RNA, 20 nt, Human
ucucccccagccccauccuc

SEQ ID NO: 2203829 - RNA, 16 nt, Human
ucucugagcugugcag

SEQ ID NO: 2203830 - RNA, 16 nt, Human
ucucugagcucugcau

SEQ ID NO: 2203831 - RNA, 15 nt, Human
ucucugagcugugca

SEQ ID NO: 2203832 - RNA, 14 nt, Human
ucucugagcaguga

SEQ ID NO: 2203833 - RNA, 19 nt, Human
ucucugacuucugccugga

SEQ ID NO: 2203834 - RNA, 17 nt, Human
ucucugacuucugccug

SEQ ID NO: 2203835 - RNA, 18 nt, Human
ucucugacuucugccugg

SEQ ID NO: 2203836 - RNA, 13 nt, Human
ucucugaggacac

SEQ ID NO: 2203837 - RNA, 20 nt, Human
ucucugauuuucaaagcuuu

SEQ ID NO: 2203838 - RNA, 19 nt, Human
ucucugauuuucaaagcuu

SEQ ID NO: 2203839 - RNA, 20 nt, Human
ucucucuucugcuccacccu

SEQ ID NO: 2203840 - RNA, 19 nt, Human
ucucucuucugcuccaccc

SEQ ID NO: 2203841 - RNA, 17 nt, Human
ucucucuucugcuccac

SEQ ID NO: 2203842 - RNA, 16 nt, Human
ucucucuucugcucca

SEQ ID NO: 2203843 - RNA, 14 nt, Human
ucucucuucugcuc

SEQ ID NO: 2203844 - RNA, 11 nt, Human
ucucucuucug

SEQ ID NO: 2203845 - RNA, 13 nt, Human
ucucugacuucug

SEQ ID NO: 2203846 - RNA, 14 nt, Human
ucucugacuucugc

SEQ ID NO: 2203847 - RNA, 16 nt, Human
ucucugacuucugccu

SEQ ID NO: 2203848 - RNA, 14 nt, Human
ucucucuucugccu

SEQ ID NO: 2203849 - RNA, 11 nt, Human
ucucucuuucc

SEQ ID NO: 2203850 - RNA, 20 nt, Human
ucucucuacuccuaccucag

SEQ ID NO: 2203851 - RNA, 19 nt, Human
ucucucuacuccuaccuca

SEQ ID NO: 2203852 - RNA, 20 nt, Human
ucucucguaacugguuucau

SEQ ID NO: 2203853 - RNA, 18 nt, Human
ucucucgguuccacgucc

SEQ ID NO: 2203854 - RNA, 23 nt, Human
ucucucgguuccacgucccccug

SEQ ID NO: 2203855 - RNA, 15 nt, Human
ucucucgugaguaua

SEQ ID NO: 2203856 - RNA, 11 nt, Human
ucucucugugg

SEQ ID NO: 2203857 - RNA, 20 nt, Human
ucucucuggggccacacaga

SEQ ID NO: 2203858 - RNA, 17 nt, Human
ucucucugugcugugga

SEQ ID NO: 2203859 - RNA, 21 nt, Human
ucucucugugcuguggaagca

SEQ ID NO: 2203860 - RNA, 22 nt, Human
ucucucuacuccuaccucagcc

SEQ ID NO: 2203861 - RNA, 11 nt, Human
ucucucucacc

SEQ ID NO: 2203862 - RNA, 17 nt, Human
ucucucucaauuuuugg

SEQ ID NO: 2203863 - RNA, 14 nt, Human
ucucuauuuaauau

SEQ ID NO: 2203864 - RNA, 15 nt, Human
ucucuauuuaauauu

SEQ ID NO: 2203865 - RNA, 20 nt, Human
ucucuaucauuuaauaauau

SEQ ID NO: 2203866 - RNA, 22 nt, Human
ucucuaucauuuaauaauauac

SEQ ID NO: 2203867 - RNA, 18 nt, Human
ucucuaucauuaaaguuc

SEQ ID NO: 2203868 - RNA, 23 nt, Human
ucucucggaguaucugggaacug

SEQ ID NO: 2203869 - RNA, 15 nt, Human
ucucucgguuccacg

SEQ ID NO: 2203870 - RNA, 23 nt, Human
ucucucggcuccccauguguccu

SEQ ID NO: 2203871 - RNA, 15 nt, Human
ucucucggcucccca

SEQ ID NO: 2203872 - RNA, 20 nt, Human
ucucucggcuccccaugugu

SEQ ID NO: 2203873 - RNA, 17 nt, Human
ucucuauuuaauauuua

SEQ ID NO: 2203874 - RNA, 17 nt, Human
ucucuagaauuuuaagu

SEQ ID NO: 2203875 - RNA, 13 nt, Human
ucucuagaauuuu

SEQ ID NO: 2203876 - RNA, 21 nt, Human
ucucuacuccuaccucagccu

SEQ ID NO: 2203877 - RNA, 20 nt, Human
ucucuacuccuaccucagcc

SEQ ID NO: 2203878 - RNA, 19 nt, Human
ucucuacuccuaccucagc

SEQ ID NO: 2203879 - RNA, 15 nt, Human
ucucuacaaaaagca

SEQ ID NO: 2203880 - RNA, 20 nt, Human
ucucuacagacuucuccaga

SEQ ID NO: 2203881 - RNA, 13 nt, Human
ucuccuguaccuc

SEQ ID NO: 2203882 - RNA, 22 nt, Human
ucucuagaauuuuaagugcuuu

SEQ ID NO: 2203883 - RNA, 12 nt, Human
ucucuagccacu

SEQ ID NO: 2203884 - RNA, 23 nt, Human
ucucuagcuggugguuucacggu

SEQ ID NO: 2203885 - RNA, 24 nt, Human
ucucuagcuggugguuucacggug

SEQ ID NO: 2203886 - RNA, 16 nt, Human
ucucuauagcaccagg

SEQ ID NO: 2203887 - RNA, 22 nt, Human
ucucuauagcaccagggcucac

SEQ ID NO: 2203888 - RNA, 13 nt, Human
ucucuaucauuaa

SEQ ID NO: 2203889 - RNA, 12 nt, Human
ucucuaucauuu

SEQ ID NO: 2203890 - RNA, 13 nt, Human
ucucuaucauuua

SEQ ID NO: 2203891 - RNA, 14 nt, Human
ucucuaucauuaaa

SEQ ID NO: 2203892 - RNA, 15 nt, Human
ucucuaucauuaaag

SEQ ID NO: 2203893 - RNA, 16 nt, Human
ucucuaucauuaaagu

SEQ ID NO: 2203894 - RNA, 17 nt, Human
ucucuaucauuaaaguu

SEQ ID NO: 2203895 - RNA, 14 nt, Human
ucucuaucauuuaa

SEQ ID NO: 2203896 - RNA, 15 nt, Human
ucucuaucauuuaau

SEQ ID NO: 2203897 - RNA, 16 nt, Human
ucucuaucauuuaaua

SEQ ID NO: 2203898 - RNA, 17 nt, Human
ucucuaucauuuaauaa

SEQ ID NO: 2203899 - RNA, 19 nt, Human
ucucuaguuugauuaaauu

SEQ ID NO: 2203900 - RNA, 18 nt, Human
ucucuaguuugauuaaau

SEQ ID NO: 2203901 - RNA, 13 nt, Human
ucucuaggaaaua

SEQ ID NO: 2203902 - RNA, 19 nt, Human
ucucuaggaaauauuuauu

SEQ ID NO: 2203903 - RNA, 18 nt, Human
ucugagcucugcauuugu

SEQ ID NO: 2203904 - RNA, 15 nt, Human
ucugagcugcucuga

SEQ ID NO: 2203905 - RNA, 17 nt, Human
ucugagcugcucugaau

SEQ ID NO: 2203906 - RNA, 19 nt, Human
ucugagcagugaaugauuc

SEQ ID NO: 2203907 - RNA, 22 nt, Human
ucugagcauuagauuucucauu

SEQ ID NO: 2203908 - RNA, 16 nt, Human
ucugaggaauccagac

SEQ ID NO: 2203909 - RNA, 17 nt, Human
ucugaggaauccagacc

SEQ ID NO: 2203910 - RNA, 20 nt, Human
ucugaggacacuaaccacgc

SEQ ID NO: 2203911 - RNA, 23 nt, Human
ucugaggacacuaaccacgcugg

SEQ ID NO: 2203912 - RNA, 23 nt, Human
ucugauucccaagcucugcuccu

SEQ ID NO: 2203913 - RNA, 15 nt, Human
ucugauuggacauuu

SEQ ID NO: 2203914 - RNA, 16 nt, Human
ucugauuggacauuuu

SEQ ID NO: 2203915 - RNA, 19 nt, Human
ucugauuggacauuuucuu

SEQ ID NO: 2203916 - RNA, 20 nt, Human
ucugauuggacauuuucuuc

SEQ ID NO: 2203917 - RNA, 21 nt, Human
ucugauuggacauuuucuuca

SEQ ID NO: 2203918 - RNA, 23 nt, Human
ucugauuggacauuuucuucaga

SEQ ID NO: 2203919 - RNA, 13 nt, Human
ucugauuggcuca

SEQ ID NO: 2203920 - RNA, 17 nt, Human
ucugauuggcucaccca

SEQ ID NO: 2203921 - RNA, 18 nt, Human
ucugauuggcucacccaa

SEQ ID NO: 2203922 - RNA, 20 nt, Human
ucugauuguaacguugcugu

SEQ ID NO: 2203923 - RNA, 21 nt, Human
ucugauuguaacguugcugug

SEQ ID NO: 2203924 - RNA, 22 nt, Human
ucugauuguaacguugcugugg

SEQ ID NO: 2203925 - RNA, 23 nt, Human
ucugauuguaacguugcuguggg

SEQ ID NO: 2203926 - RNA, 14 nt, Human
ucugcacaagcugc

SEQ ID NO: 2203927 - RNA, 16 nt, Human
ucugcaauuccccucu

SEQ ID NO: 2203928 - RNA, 18 nt, Human
ucugcaauuccccucugc

SEQ ID NO: 2203929 - RNA, 20 nt, Human
ucugcaauuccccucugcug

SEQ ID NO: 2203930 - RNA, 19 nt, Human
ucugcacaagcugcacccu

SEQ ID NO: 2203931 - RNA, 20 nt, Human
ucugcacaugucuuguacau

SEQ ID NO: 2203932 - RNA, 21 nt, Human
ucugcaauuccccucugcugc

SEQ ID NO: 2203933 - RNA, 22 nt, Human
ucugcaauuccccucugcugcu

SEQ ID NO: 2203934 - RNA, 21 nt, Human
ucugaacuuggcgcugccccu

SEQ ID NO: 2203935 - RNA, 20 nt, Human
ucugaacuuggcgcugcccc

SEQ ID NO: 2203936 - RNA, 22 nt, Human
ucugacauuaacaguuuuccau

SEQ ID NO: 2203937 - RNA, 21 nt, Human
ucugacauuaacaguuuucca

SEQ ID NO: 2203938 - RNA, 19 nt, Human
ucugacauuaacaguuuuc

SEQ ID NO: 2203939 - RNA, 18 nt, Human
ucugacauuaacaguuuu

SEQ ID NO: 2203940 - RNA, 23 nt, Human
ucugacauuaacaguuuuccaug

SEQ ID NO: 2203941 - RNA, 13 nt, Human
ucugacauucuca

SEQ ID NO: 2203942 - RNA, 16 nt, Human
ucugacauuaacaguu

SEQ ID NO: 2203943 - RNA, 15 nt, Human
ucugacauuaacagu

SEQ ID NO: 2203944 - RNA, 22 nt, Human
ucugacaugauuccuuccuguu

SEQ ID NO: 2203945 - RNA, 19 nt, Human
ucugacaugauuccuuccu

SEQ ID NO: 2203946 - RNA, 18 nt, Human
ucugacaugauuccuucc

SEQ ID NO: 2203947 - RNA, 16 nt, Human
ucugacaucucugcaa

SEQ ID NO: 2203948 - RNA, 18 nt, Human
ucugaccacacuuccugu

SEQ ID NO: 2203949 - RNA, 13 nt, Human
ucugaccacacuu

SEQ ID NO: 2203950 - RNA, 13 nt, Human
ucugaccacgugc

SEQ ID NO: 2203951 - RNA, 12 nt, Human
ucugaccacacu

SEQ ID NO: 2203952 - RNA, 21 nt, Human
ucugacauucucaggaagccc

SEQ ID NO: 2203953 - RNA, 22 nt, Human
ucugacauucucaggaagcccc

SEQ ID NO: 2203954 - RNA, 22 nt, Human
ucugaccacacuuccuguccag

SEQ ID NO: 2203955 - RNA, 13 nt, Human
ucugaccagcagc

SEQ ID NO: 2203956 - RNA, 11 nt, Human
ucugacccagu

SEQ ID NO: 2203957 - RNA, 16 nt, Human
ucugaccagcagcgcc

SEQ ID NO: 2203958 - RNA, 14 nt, Human
ucugacccaugcug

SEQ ID NO: 2203959 - RNA, 15 nt, Human
ucugacccagugccc

SEQ ID NO: 2203960 - RNA, 14 nt, Human
ucugacccagugcc

SEQ ID NO: 2203961 - RNA, 13 nt, Human
ucugacccagugc

SEQ ID NO: 2203962 - RNA, 14 nt, Human
ucugacccagugag

SEQ ID NO: 2203963 - RNA, 15 nt, Human
ucugacccagugaga

SEQ ID NO: 2203964 - RNA, 20 nt, Human
ucugagauuauuuuaaucua

SEQ ID NO: 2203965 - RNA, 23 nt, Human
ucugacccagugcccccacugac

SEQ ID NO: 2203966 - RNA, 21 nt, Human
ucugacccagugagauuacag

SEQ ID NO: 2203967 - RNA, 22 nt, Human
ucugacccagugcccccacuga

SEQ ID NO: 2203968 - RNA, 19 nt, Human
ucugacccagugcccccac

SEQ ID NO: 2203969 - RNA, 17 nt, Human
ucugagcaagagcuggc

SEQ ID NO: 2203970 - RNA, 15 nt, Human
ucugagcaagagcug

SEQ ID NO: 2203971 - RNA, 16 nt, Human
ucugagcaagagcugg

SEQ ID NO: 2203972 - RNA, 15 nt, Human
ucugagcacacuuua

SEQ ID NO: 2203973 - RNA, 20 nt, Human
ucugagcauuagauuucuca

SEQ ID NO: 2203974 - RNA, 15 nt, Human
ucugacccaugcugc

SEQ ID NO: 2203975 - RNA, 16 nt, Human
ucugacccaugcugcc

SEQ ID NO: 2203976 - RNA, 17 nt, Human
ucugacccaugcugccc

SEQ ID NO: 2203977 - RNA, 18 nt, Human
ucugacccaugcugcccu

SEQ ID NO: 2203978 - RNA, 13 nt, Human
ucucuucucuguu

SEQ ID NO: 2203979 - RNA, 20 nt, Human
ucucuuugaauuuucugugu

SEQ ID NO: 2203980 - RNA, 12 nt, Human
ucucuuccugua

SEQ ID NO: 2203981 - RNA, 13 nt, Human
ucucuucuccacu

SEQ ID NO: 2203982 - RNA, 14 nt, Human
ucucuucuccacug

SEQ ID NO: 2203983 - RNA, 15 nt, Human
ucucuucuccacugg

SEQ ID NO: 2203984 - RNA, 16 nt, Human
ucucuucuccacugga

SEQ ID NO: 2203985 - RNA, 19 nt, Human
ucucuuccuccgaggccag

SEQ ID NO: 2203986 - RNA, 11 nt, Human
ucucuuccuac

SEQ ID NO: 2203987 - RNA, 11 nt, Human
ucucuuccugu

SEQ ID NO: 2203988 - RNA, 11 nt, Human
ucucuucucca

SEQ ID NO: 2203989 - RNA, 20 nt, Human
ucucuuccuuuuaucaguag

SEQ ID NO: 2203990 - RNA, 18 nt, Human
ucucugcaccguacugug

SEQ ID NO: 2203991 - RNA, 11 nt, Human
ucucugcaccc

SEQ ID NO: 2203992 - RNA, 19 nt, Human
ucucugcaaucuucucaga

SEQ ID NO: 2203993 - RNA, 19 nt, Human
ucucugcagccagcccagc

SEQ ID NO: 2203994 - RNA, 18 nt, Human
ucucugcagccagcccag

SEQ ID NO: 2203995 - RNA, 17 nt, Human
ucucugcagccagccca

SEQ ID NO: 2203996 - RNA, 16 nt, Human
ucucugcagccagccc

SEQ ID NO: 2203997 - RNA, 15 nt, Human
ucucugcagccagcc

SEQ ID NO: 2203998 - RNA, 11 nt, Human
ucucugcagcc

SEQ ID NO: 2203999 - RNA, 20 nt, Human
ucucugcagccagcccagcc

SEQ ID NO: 2204000 - RNA, 11 nt, Human
ucucugcaggu

SEQ ID NO: 2204001 - RNA, 14 nt, Human
ucucuucagguucu

SEQ ID NO: 2204002 - RNA, 13 nt, Human
ucucuucagguuc

SEQ ID NO: 2204003 - RNA, 16 nt, Human
ucucuucagguucuua

SEQ ID NO: 2204004 - RNA, 15 nt, Human
ucucuucagguucuu

SEQ ID NO: 2204005 - RNA, 18 nt, Human
ucucuucacagucacauu

SEQ ID NO: 2204006 - RNA, 23 nt, Human
ucucuucagguucuuagugucac

SEQ ID NO: 2204007 - RNA, 14 nt, Human
ucucuucauacuuu

SEQ ID NO: 2204008 - RNA, 17 nt, Human
ucucuuccauaugaccu

SEQ ID NO: 2204009 - RNA, 21 nt, Human
ucucuuccauaugaccucaug

SEQ ID NO: 2204010 - RNA, 13 nt, Human
ucucuuccccucu

SEQ ID NO: 2204011 - RNA, 14 nt, Human
ucucuuccccucuc

SEQ ID NO: 2204012 - RNA, 15 nt, Human
ucucuuccccucuca

SEQ ID NO: 2204013 - RNA, 17 nt, Human
ucucuuccccucucaga

SEQ ID NO: 2204014 - RNA, 17 nt, Human
ucugaaaauuaacacug

SEQ ID NO: 2204015 - RNA, 17 nt, Human
ucucuuuuuggaggugc

SEQ ID NO: 2204016 - RNA, 13 nt, Human
ucugaaaauguga

SEQ ID NO: 2204017 - RNA, 14 nt, Human
ucugaaaauguaug

SEQ ID NO: 2204018 - RNA, 23 nt, Human
ucugaaaauguauguguaaguau

SEQ ID NO: 2204019 - RNA, 18 nt, Human
ucugaaaauuaacacugc

SEQ ID NO: 2204020 - RNA, 19 nt, Human
ucugaaaauuaacacugcu

SEQ ID NO: 2204021 - RNA, 14 nt, Human
ucugaaagccacgu

SEQ ID NO: 2204022 - RNA, 13 nt, Human
ucugaaagggacg

SEQ ID NO: 2204023 - RNA, 21 nt, Human
ucugaaaugugauaaguucuu

SEQ ID NO: 2204024 - RNA, 21 nt, Human
ucugaacucaaacugaggaau

SEQ ID NO: 2204025 - RNA, 17 nt, Human
ucugaacucaaacugag

SEQ ID NO: 2204026 - RNA, 16 nt, Human
ucugaacucaaacuga

SEQ ID NO: 2204027 - RNA, 14 nt, Human
ucugaacucaaacu

SEQ ID NO: 2204028 - RNA, 12 nt, Human
ucugaacucaaa

SEQ ID NO: 2204029 - RNA, 12 nt, Human
ucugaaaucuga

SEQ ID NO: 2204030 - RNA, 16 nt, Human
ucugaaaucugaagac

SEQ ID NO: 2204031 - RNA, 13 nt, Human
ucugaaaugaaga

SEQ ID NO: 2204032 - RNA, 15 nt, Human
ucugaaaucugaaga

SEQ ID NO: 2204033 - RNA, 14 nt, Human
ucugaaaugugaua

SEQ ID NO: 2204034 - RNA, 17 nt, Human
ucucuuuguucuaaaga

SEQ ID NO: 2204035 - RNA, 16 nt, Human
ucucuuugggaauguu

SEQ ID NO: 2204036 - RNA, 15 nt, Human
ucucuuuucaaaaca

SEQ ID NO: 2204037 - RNA, 16 nt, Human
ucucuuuucaaaacau

SEQ ID NO: 2204038 - RNA, 21 nt, Human
ucucuuuguucucagcucccc

SEQ ID NO: 2204039 - RNA, 23 nt, Human
ucucuuuguucucagcucccccu

SEQ ID NO: 2204040 - RNA, 13 nt, Human
ucucuuuguucuc

SEQ ID NO: 2204041 - RNA, 14 nt, Human
ucucuuuguucuca

SEQ ID NO: 2204042 - RNA, 17 nt, Human
ucucuuuguucucagcu

SEQ ID NO: 2204043 - RNA, 19 nt, Human
ucucuuuguucucagcucc

SEQ ID NO: 2204044 - RNA, 23 nt, Human
ucucuuuugaauccaugcuuggg

SEQ ID NO: 2204045 - RNA, 22 nt, Human
ucucuuuugaauccaugcuugg

SEQ ID NO: 2204046 - RNA, 20 nt, Human
ucucuuuugaauccaugcuu

SEQ ID NO: 2204047 - RNA, 20 nt, Human
ucucuuuugaaacaauacuc

SEQ ID NO: 2204048 - RNA, 18 nt, Human
ucucuuuucuuuagagca

SEQ ID NO: 2204049 - RNA, 19 nt, Human
ucucuuuucuuuagagcau

SEQ ID NO: 2204050 - RNA, 20 nt, Human
ucucuuuucuuuagagcauu

SEQ ID NO: 2204051 - RNA, 17 nt, Human
ucucuuuugaaacaaua

SEQ ID NO: 2204052 - RNA, 16 nt, Human
ucucuuuucucuuucu

SEQ ID NO: 2204053 - RNA, 13 nt, Human
ucucuuuucuuua

SEQ ID NO: 2204054 - RNA, 12 nt, Human
ucucuuuucucu

SEQ ID NO: 2204055 - RNA, 16 nt, Human
ucugaaaauguaugug

SEQ ID NO: 2204056 - RNA, 13 nt, Human
ucucuuuuucagu

SEQ ID NO: 2204057 - RNA, 14 nt, Human
ucucuuuuugacuc

SEQ ID NO: 2204058 - RNA, 21 nt, Human
ucucuuuuugacucuugcaau

SEQ ID NO: 2204059 - RNA, 13 nt, Human
ucucuuuuuggag

SEQ ID NO: 2204060 - RNA, 18 nt, Human
ucucuuuuugcuuucgaa

SEQ ID NO: 2204061 - RNA, 15 nt, Human
ucagcagcccuccuc

SEQ ID NO: 2204062 - RNA, 14 nt, Human
ucagcagcccuccu

SEQ ID NO: 2204063 - RNA, 12 nt, Human
ucagcagcccuc

SEQ ID NO: 2204064 - RNA, 18 nt, Human
ucagcagcccuccucacc

SEQ ID NO: 2204065 - RNA, 17 nt, Human
ucagcagcccuccucac

SEQ ID NO: 2204066 - RNA, 16 nt, Human
ucagcagcccuccuca

SEQ ID NO: 2204067 - RNA, 17 nt, Human
ucagcagccucccugaa

SEQ ID NO: 2204068 - RNA, 20 nt, Human
ucagcagcgaccaccccugc

SEQ ID NO: 2204069 - RNA, 22 nt, Human
ucagcagcgaccaccccugccu

SEQ ID NO: 2204070 - RNA, 24 nt, Human
ucagucugauucccaagcucugcu

SEQ ID NO: 2204071 - RNA, 13 nt, Human
ucagucugguggg

SEQ ID NO: 2204072 - RNA, 16 nt, Human
ucagucuggugggagg

SEQ ID NO: 2204073 - RNA, 17 nt, Human
ucagucuggugggagga

SEQ ID NO: 2204074 - RNA, 20 nt, Human
ucaguggggcccauggaugu

SEQ ID NO: 2204075 - RNA, 19 nt, Human
ucagucuggugggaggacg

SEQ ID NO: 2204076 - RNA, 14 nt, Human
ucagcaggaagcaa

SEQ ID NO: 2204077 - RNA, 17 nt, Human
ucagcaggaagcaacga

SEQ ID NO: 2204078 - RNA, 23 nt, Human
ucagcagcgaccaccccugccuc

SEQ ID NO: 2204079 - RNA, 15 nt, Human
ucagucuggcccuuc

SEQ ID NO: 2204080 - RNA, 18 nt, Human
ucaguuacucagcccugg

SEQ ID NO: 2204081 - RNA, 17 nt, Human
ucaguuacucagcccug

SEQ ID NO: 2204082 - RNA, 16 nt, Human
ucaguuacucagcccu

SEQ ID NO: 2204083 - RNA, 15 nt, Human
ucaguuacucagccc

SEQ ID NO: 2204084 - RNA, 13 nt, Human
ucagugucucaca

SEQ ID NO: 2204085 - RNA, 14 nt, Human
ucagugucucacac

SEQ ID NO: 2204086 - RNA, 15 nt, Human
ucagugucucacacu

SEQ ID NO: 2204087 - RNA, 21 nt, Human
ucagugucucacacuggcgua

SEQ ID NO: 2204088 - RNA, 17 nt, Human
ucagugugacugaucuc

SEQ ID NO: 2204089 - RNA, 20 nt, Human
ucagugucauuuaugaaaag

SEQ ID NO: 2204090 - RNA, 22 nt, Human
ucagugucaaauaaacacugug

SEQ ID NO: 2204091 - RNA, 19 nt, Human
ucagugucaaauaaacacu

SEQ ID NO: 2204092 - RNA, 21 nt, Human
ucagugucaaauaaacacugu

SEQ ID NO: 2204093 - RNA, 16 nt, Human
ucaguguccaaagcag

SEQ ID NO: 2204094 - RNA, 13 nt, Human
ucagugucccggg

SEQ ID NO: 2204095 - RNA, 17 nt, Human
ucagugucccgggcccg

SEQ ID NO: 2204096 - RNA, 19 nt, Human
ucaguguccucuugcucaa

SEQ ID NO: 2204097 - RNA, 13 nt, Human
ucagugugacuga

SEQ ID NO: 2204098 - RNA, 11 nt, Human
ucaguguacau

SEQ ID NO: 2204099 - RNA, 18 nt, Human
ucaguguaauuucuuugc

SEQ ID NO: 2204100 - RNA, 19 nt, Human
ucaguguaauuucuuugcc

SEQ ID NO: 2204101 - RNA, 16 nt, Human
ucaguguauuuguauu

SEQ ID NO: 2204102 - RNA, 14 nt, Human
ucagugucaaauaa

SEQ ID NO: 2204103 - RNA, 15 nt, Human
ucagugucaaauaaa

SEQ ID NO: 2204104 - RNA, 17 nt, Human
ucagugucaaauaaaca

SEQ ID NO: 2204105 - RNA, 20 nt, Human
ucagugguuauuuagggaac

SEQ ID NO: 2204106 - RNA, 21 nt, Human
ucagugguccacaucccggga

SEQ ID NO: 2204107 - RNA, 23 nt, Human
ucaguguaaauaguuacuccagu

SEQ ID NO: 2204108 - RNA, 16 nt, Human
ucaguguaagcccugc

SEQ ID NO: 2204109 - RNA, 14 nt, Human
ucaguguaauuucu

SEQ ID NO: 2204110 - RNA, 15 nt, Human
ucaguguaauuucuu

SEQ ID NO: 2204111 - RNA, 23 nt, Human
ucagugguuggcaauuguuucaa

SEQ ID NO: 2204112 - RNA, 16 nt, Human
ucaguugcaauaauac

SEQ ID NO: 2204113 - RNA, 14 nt, Human
ucaguuggcugacu

SEQ ID NO: 2204114 - RNA, 17 nt, Human
ucaguugcaauaauacu

SEQ ID NO: 2204115 - RNA, 18 nt, Human
ucaguuguagaauguauu

SEQ ID NO: 2204116 - RNA, 21 nt, Human
ucaguuguagaauguauugua

SEQ ID NO: 2204117 - RNA, 13 nt, Human
ucauaaugacuua

SEQ ID NO: 2204118 - RNA, 17 nt, Human
ucaguuacucugaaggg

SEQ ID NO: 2204119 - RNA, 16 nt, Human
ucaguuacucugaagg

SEQ ID NO: 2204120 - RNA, 15 nt, Human
ucaguuacucuucag

SEQ ID NO: 2204121 - RNA, 19 nt, Human
ucaguuacucagcccuggg

SEQ ID NO: 2204122 - RNA, 18 nt, Human
ucaguuagagcugacaca

SEQ ID NO: 2204123 - RNA, 22 nt, Human
ucaguuagagcugacacaaacc

SEQ ID NO: 2204124 - RNA, 23 nt, Human
ucaguugagcuucauauaccagc

SEQ ID NO: 2204125 - RNA, 15 nt, Human
ucaguucccuuggcc

SEQ ID NO: 2204126 - RNA, 19 nt, Human
ucaguucucuugauuuuca

SEQ ID NO: 2204127 - RNA, 14 nt, Human
ucaguucccagaau

SEQ ID NO: 2204128 - RNA, 16 nt, Human
ucaguucccagaauca

SEQ ID NO: 2204129 - RNA, 17 nt, Human
ucaguucccagaaucaa

SEQ ID NO: 2204130 - RNA, 18 nt, Human
ucaguucccagaaucaaa

SEQ ID NO: 2204131 - RNA, 20 nt, Human
ucaguucagaaucacuucug

SEQ ID NO: 2204132 - RNA, 14 nt, Human
ucauacacuuccuu

SEQ ID NO: 2204133 - RNA, 13 nt, Human
ucauacccacccc

SEQ ID NO: 2204134 - RNA, 15 nt, Human
ucauaauuauuauuu

SEQ ID NO: 2204135 - RNA, 17 nt, Human
ucaguuguuaguguguc

SEQ ID NO: 2204136 - RNA, 12 nt, Human
ucauaaugugaa

SEQ ID NO: 2204137 - RNA, 22 nt, Human
ucauacaaggcccaggaggcuu

SEQ ID NO: 2204138 - RNA, 13 nt, Human
ucauaaugugaag

SEQ ID NO: 2204139 - RNA, 14 nt, Human
ucauaaugugaagu

SEQ ID NO: 2204140 - RNA, 15 nt, Human
ucauaaugugaagug

SEQ ID NO: 2204141 - RNA, 17 nt, Human
ucauaaugugaaguguu

SEQ ID NO: 2204142 - RNA, 18 nt, Human
ucauaaugugaaguguua

SEQ ID NO: 2204143 - RNA, 19 nt, Human
ucauaaugugaaguguuaa

SEQ ID NO: 2204144 - RNA, 12 nt, Human
ucauaauucuaa

SEQ ID NO: 2204145 - RNA, 16 nt, Human
ucaucucucuuuaaua

SEQ ID NO: 2204146 - RNA, 13 nt, Human
ucaucucuuagcu

SEQ ID NO: 2204147 - RNA, 16 nt, Human
ucaucucucugcccaa

SEQ ID NO: 2204148 - RNA, 14 nt, Human
ucaucucucugccc

SEQ ID NO: 2204149 - RNA, 22 nt, Human
ucauaguacucuuuguagcaaa

SEQ ID NO: 2204150 - RNA, 23 nt, Human
ucaucuccugccuuccuccuggg

SEQ ID NO: 2204151 - RNA, 11 nt, Human
ucaucucuccu

SEQ ID NO: 2204152 - RNA, 15 nt, Human
ucaucucuccuccaa

SEQ ID NO: 2204153 - RNA, 23 nt, Human
ucaucucuccuccaagacacugu

SEQ ID NO: 2204154 - RNA, 14 nt, Human
ucaucucuguccca

SEQ ID NO: 2204155 - RNA, 14 nt, Human
ucaucucuucuuuu

SEQ ID NO: 2204156 - RNA, 14 nt, Human
ucaucucuuagcuc

SEQ ID NO: 2204157 - RNA, 19 nt, Human
ucaucucuuagcuccccuc

SEQ ID NO: 2204158 - RNA, 20 nt, Human
ucaucucuuagcuccccucc

SEQ ID NO: 2204159 - RNA, 21 nt, Human
ucaucucuuagcuccccucca

SEQ ID NO: 2204160 - RNA, 15 nt, Human
ucaucugucaagugg

SEQ ID NO: 2204161 - RNA, 17 nt, Human
ucaucugucccuccggg

SEQ ID NO: 2204162 - RNA, 12 nt, Human
ucaucugucccu

SEQ ID NO: 2204163 - RNA, 16 nt, Human
ucaucugggggagugg

SEQ ID NO: 2204164 - RNA, 18 nt, Human
ucaucugggggaguggaa

SEQ ID NO: 2204165 - RNA, 13 nt, Human
ucaucuguaacuc

SEQ ID NO: 2204166 - RNA, 19 nt, Human
ucaucugggggaguggaau

SEQ ID NO: 2204167 - RNA, 20 nt, Human
ucaucugggggaguggaaua

SEQ ID NO: 2204168 - RNA, 12 nt, Human
ucaucuguguga

SEQ ID NO: 2204169 - RNA, 14 nt, Human
ucaucugugugaaa

SEQ ID NO: 2204170 - RNA, 17 nt, Human
ucaucugugugaaaaug

SEQ ID NO: 2204171 - RNA, 12 nt, Human
ucaucugugcac

SEQ ID NO: 2204172 - RNA, 18 nt, Human
ucaucugucccuccggga

SEQ ID NO: 2204173 - RNA, 17 nt, Human
ucaucuguuuuucuuuu

SEQ ID NO: 2204174 - RNA, 12 nt, Human
ucaucuuacugu

SEQ ID NO: 2204175 - RNA, 13 nt, Human
ucaugccccccuc

SEQ ID NO: 2204176 - RNA, 19 nt, Human
ucaucugugugaaaauggg

SEQ ID NO: 2204177 - RNA, 21 nt, Human
ucauagggucucuucagguuc

SEQ ID NO: 2204178 - RNA, 16 nt, Human
ucauagguauuucaaa

SEQ ID NO: 2204179 - RNA, 18 nt, Human
ucauaggucacuggcucu

SEQ ID NO: 2204180 - RNA, 23 nt, Human
ucauaggucacuggcucuccaag

SEQ ID NO: 2204181 - RNA, 20 nt, Human
ucauagggucucuucagguu

SEQ ID NO: 2204182 - RNA, 18 nt, Human
ucauagggucucuucagg

SEQ ID NO: 2204183 - RNA, 17 nt, Human
ucauagggucucuucag

SEQ ID NO: 2204184 - RNA, 22 nt, Human
ucauaccaggccgccccagccu

SEQ ID NO: 2204185 - RNA, 16 nt, Human
ucauagguugccaaua

SEQ ID NO: 2204186 - RNA, 20 nt, Human
ucauagguugccaauaauac

SEQ ID NO: 2204187 - RNA, 20 nt, Human
ucauaguacucuuuguagca

SEQ ID NO: 2204188 - RNA, 21 nt, Human
ucauaguaacuucuuauggaa

SEQ ID NO: 2204189 - RNA, 22 nt, Human
ucaucuccugccuuccuccugg

SEQ ID NO: 2204190 - RNA, 21 nt, Human
ucaucuccugccuuccuccug

SEQ ID NO: 2204191 - RNA, 18 nt, Human
ucauaguaacuucuuaug

SEQ ID NO: 2204192 - RNA, 16 nt, Human
ucauaguaacuucuua

SEQ ID NO: 2204193 - RNA, 15 nt, Human
ucauaguaacuucuu

SEQ ID NO: 2204194 - RNA, 14 nt, Human
ucauaguaacuucu

SEQ ID NO: 2204195 - RNA, 15 nt, Human
ucauaccaaugaaaa

SEQ ID NO: 2204196 - RNA, 21 nt, Human
ucauacccacccccacccaag

SEQ ID NO: 2204197 - RNA, 20 nt, Human
ucauacccacccccacccaa

SEQ ID NO: 2204198 - RNA, 14 nt, Human
ucauacccaccccc

SEQ ID NO: 2204199 - RNA, 15 nt, Human
ucauacccaccccca

SEQ ID NO: 2204200 - RNA, 18 nt, Human
ucaugccuggcuucgcaa

SEQ ID NO: 2204201 - RNA, 14 nt, Human
ucaugccuguaauc

SEQ ID NO: 2204202 - RNA, 13 nt, Human
ucaugccuggcuu

SEQ ID NO: 2204203 - RNA, 15 nt, Human
ucaugccuggcuucg

SEQ ID NO: 2204204 - RNA, 17 nt, Human
ucaugccuggcuucgca

SEQ ID NO: 2204205 - RNA, 20 nt, Human
ucaugguguaauaagacaua

SEQ ID NO: 2204206 - RNA, 15 nt, Human
ucaugccuguaaucc

SEQ ID NO: 2204207 - RNA, 21 nt, Human
ucaugguguaauaagacauaa

SEQ ID NO: 2204208 - RNA, 22 nt, Human
ucaugcuaauuauauaauauuu

SEQ ID NO: 2204209 - RNA, 15 nt, Human
ucaugcuaucucugu

SEQ ID NO: 2204210 - RNA, 15 nt, Human
ucaugcccuccucuc

SEQ ID NO: 2204211 - RNA, 15 nt, Human
ucaugcccugugcaa

SEQ ID NO: 2204212 - RNA, 14 nt, Human
ucaugcccuccucu

SEQ ID NO: 2204213 - RNA, 13 nt, Human
ucaugcccuccuc

SEQ ID NO: 2204214 - RNA, 16 nt, Human
ucaugccccuggcugg

SEQ ID NO: 2204215 - RNA, 22 nt, Human
ucaugccccccucaaaccuccu

SEQ ID NO: 2204216 - RNA, 15 nt, Human
ucaugcccccuuuca

SEQ ID NO: 2204217 - RNA, 18 nt, Human
ucaugcccccuuucagau

SEQ ID NO: 2204218 - RNA, 21 nt, Human
ucaugcccccuuucagauguc

SEQ ID NO: 2204219 - RNA, 16 nt, Human
ucauguaaacugugca

SEQ ID NO: 2204220 - RNA, 17 nt, Human
ucauguaaacugugcac

SEQ ID NO: 2204221 - RNA, 14 nt, Human
ucauguaaacugug

SEQ ID NO: 2204222 - RNA, 13 nt, Human
ucauguaaacugu

SEQ ID NO: 2204223 - RNA, 22 nt, Human
ucaugguguaauaagacauaac

SEQ ID NO: 2204224 - RNA, 16 nt, Human
ucauguaaauuuugua

SEQ ID NO: 2204225 - RNA, 17 nt, Human
ucauguaaauuuuguau

SEQ ID NO: 2204226 - RNA, 16 nt, Human
ucauuaggugugacug

SEQ ID NO: 2204227 - RNA, 16 nt, Human
ucauuauuugcagaga

SEQ ID NO: 2204228 - RNA, 18 nt, Human
ucauguaagcugaaaaua

SEQ ID NO: 2204229 - RNA, 19 nt, Human
ucauguaagcugaaaauau

SEQ ID NO: 2204230 - RNA, 22 nt, Human
ucauuaggugugacugaauuuc

SEQ ID NO: 2204231 - RNA, 21 nt, Human
ucauuaggugugacugaauuu

SEQ ID NO: 2204232 - RNA, 18 nt, Human
ucauuaggugugacugaa

SEQ ID NO: 2204233 - RNA, 15 nt, Human
ucauguaauccucaa

SEQ ID NO: 2204234 - RNA, 14 nt, Human
uccacuuggucugu

SEQ ID NO: 2204235 - RNA, 17 nt, Human
uccaccugagcugccau

SEQ ID NO: 2204236 - RNA, 23 nt, Human
uccagaaaugucuaaaugcugaa

SEQ ID NO: 2204237 - RNA, 16 nt, Human
uccagaagccucuggc

SEQ ID NO: 2204238 - RNA, 20 nt, Human
uccagaagaauauucaggac

SEQ ID NO: 2204239 - RNA, 21 nt, Human
uccagaagaauauucaggacu

SEQ ID NO: 2204240 - RNA, 16 nt, Human
uccagaagaauauuca

SEQ ID NO: 2204241 - RNA, 17 nt, Human
uccagaagaauauucag

SEQ ID NO: 2204242 - RNA, 18 nt, Human
uccagaagaauauucagg

SEQ ID NO: 2204243 - RNA, 19 nt, Human
uccagaagaauauucagga

SEQ ID NO: 2204244 - RNA, 22 nt, Human
uccagaacucacuggggccuac

SEQ ID NO: 2204245 - RNA, 14 nt, Human
uccaccugagcugc

SEQ ID NO: 2204246 - RNA, 18 nt, Human
uccaccucuucacccccc

SEQ ID NO: 2204247 - RNA, 16 nt, Human
uccaccuccuucucug

SEQ ID NO: 2204248 - RNA, 13 nt, Human
uccaccugccagg

SEQ ID NO: 2204249 - RNA, 13 nt, Human
uccacuuggucug

SEQ ID NO: 2204250 - RNA, 12 nt, Human
uccacuuggucu

SEQ ID NO: 2204251 - RNA, 21 nt, Human
uccagaagggguuuggucugg

SEQ ID NO: 2204252 - RNA, 18 nt, Human
uccagaucugcagucacu

SEQ ID NO: 2204253 - RNA, 22 nt, Human
uccagaagaauauucaggacuu

SEQ ID NO: 2204254 - RNA, 23 nt, Human
uccagccaaagccuccuccagcc

SEQ ID NO: 2204255 - RNA, 14 nt, Human
uccagcaguuuuca

SEQ ID NO: 2204256 - RNA, 12 nt, Human
uccagcagggaa

SEQ ID NO: 2204257 - RNA, 19 nt, Human
uccagaagccucuggcuag

SEQ ID NO: 2204258 - RNA, 18 nt, Human
uccagaagccucuggcua

SEQ ID NO: 2204259 - RNA, 17 nt, Human
uccagaagccucuggcu

SEQ ID NO: 2204260 - RNA, 14 nt, Human
uccagauccuggaa

SEQ ID NO: 2204261 - RNA, 16 nt, Human
uccagauccuggaaau

SEQ ID NO: 2204262 - RNA, 17 nt, Human
uccagauccuggaaauc

SEQ ID NO: 2204263 - RNA, 18 nt, Human
uccaccucgacguuuaca

SEQ ID NO: 2204264 - RNA, 12 nt, Human
uccaccuccuuc

SEQ ID NO: 2204265 - RNA, 13 nt, Human
uccaccuccuucu

SEQ ID NO: 2204266 - RNA, 12 nt, Human
uccaccugccag

SEQ ID NO: 2204267 - RNA, 16 nt, Human
uccaccucagccuugg

SEQ ID NO: 2204268 - RNA, 14 nt, Human
uccaccucagccuu

SEQ ID NO: 2204269 - RNA, 13 nt, Human
uccaccucagccu

SEQ ID NO: 2204270 - RNA, 12 nt, Human
uccaccucagcc

SEQ ID NO: 2204271 - RNA, 11 nt, Human
uccaccucagc

SEQ ID NO: 2204272 - RNA, 16 nt, Human
uccaccucaccccacu

SEQ ID NO: 2204273 - RNA, 21 nt, Human
uccaccuaguggcuguccagu

SEQ ID NO: 2204274 - RNA, 14 nt, Human
uccaccucacccca

SEQ ID NO: 2204275 - RNA, 17 nt, Human
uccaccucagccuugga

SEQ ID NO: 2204276 - RNA, 13 nt, Human
uccaccuccaucu

SEQ ID NO: 2204277 - RNA, 14 nt, Human
uccaccuccaucuu

SEQ ID NO: 2204278 - RNA, 13 nt, Human
uccaccucccucc

SEQ ID NO: 2204279 - RNA, 20 nt, Human
uccacccuuggccugucuca

SEQ ID NO: 2204280 - RNA, 19 nt, Human
uccaccgcugccuaagugg

SEQ ID NO: 2204281 - RNA, 14 nt, Human
uccaccgcugccua

SEQ ID NO: 2204282 - RNA, 22 nt, Human
uccacccugucccccagcucug

SEQ ID NO: 2204283 - RNA, 13 nt, Human
uccaccgcugccu

SEQ ID NO: 2204284 - RNA, 15 nt, Human
uccaccgcugccuaa

SEQ ID NO: 2204285 - RNA, 12 nt, Human
uccaccucaccc

SEQ ID NO: 2204286 - RNA, 17 nt, Human
uccaccuaguggcuguc

SEQ ID NO: 2204287 - RNA, 20 nt, Human
uccaccuaguggcuguccag

SEQ ID NO: 2204288 - RNA, 14 nt, Human
uccaccuacaugag

SEQ ID NO: 2204289 - RNA, 19 nt, Human
uccacccuuggccugucuc

SEQ ID NO: 2204290 - RNA, 17 nt, Human
uccacccuuggccuguc

SEQ ID NO: 2204291 - RNA, 16 nt, Human
uccacccuuggccugu

SEQ ID NO: 2204292 - RNA, 15 nt, Human
uccacccuuggccug

SEQ ID NO: 2204293 - RNA, 14 nt, Human
uccacccuuggccu

SEQ ID NO: 2204294 - RNA, 13 nt, Human
uccacccuuggcc

SEQ ID NO: 2204295 - RNA, 17 nt, Human
uccacccugucccccag

SEQ ID NO: 2204296 - RNA, 18 nt, Human
uccacccugucccccagc

SEQ ID NO: 2204297 - RNA, 20 nt, Human
uccacccugucccccagcuc

SEQ ID NO: 2204298 - RNA, 21 nt, Human
uccacccugucccccagcucu

SEQ ID NO: 2204299 - RNA, 14 nt, Human
uccacaagagccca

SEQ ID NO: 2204300 - RNA, 16 nt, Human
uccacccuguccccca

SEQ ID NO: 2204301 - RNA, 21 nt, Human
uccacaagacagaagcugaag

SEQ ID NO: 2204302 - RNA, 21 nt, Human
uccacaaauuauuaaugaaaa

SEQ ID NO: 2204303 - RNA, 11 nt, Human
uccaagcaaag

SEQ ID NO: 2204304 - RNA, 20 nt, Human
uccaagcauuuagauguaua

SEQ ID NO: 2204305 - RNA, 14 nt, Human
uccacaacacacag

SEQ ID NO: 2204306 - RNA, 14 nt, Human
uccacaaauuauua

SEQ ID NO: 2204307 - RNA, 20 nt, Human
uccacaaauuauuaaugaaa

SEQ ID NO: 2204308 - RNA, 20 nt, Human
uccacaaaauaaccaauccu

SEQ ID NO: 2204309 - RNA, 12 nt, Human
uccacaaaauaa

SEQ ID NO: 2204310 - RNA, 22 nt, Human
uccaauuuucuggaauacauga

SEQ ID NO: 2204311 - RNA, 23 nt, Human
uccaaaggaagucuaggagcugg

SEQ ID NO: 2204312 - RNA, 17 nt, Human
uccaaagccaaugugaa

SEQ ID NO: 2204313 - RNA, 13 nt, Human
uccaaagcagggu

SEQ ID NO: 2204314 - RNA, 18 nt, Human
uccaaacuuggauuuuug

SEQ ID NO: 2204315 - RNA, 15 nt, Human
uccaaagcagacagc

SEQ ID NO: 2204316 - RNA, 14 nt, Human
uccaaagcagacag

SEQ ID NO: 2204317 - RNA, 19 nt, Human
uccaaaggaggcuggcagg

SEQ ID NO: 2204318 - RNA, 15 nt, Human
uccaaaggaggcugg

SEQ ID NO: 2204319 - RNA, 13 nt, Human
uccaaaggaggcu

SEQ ID NO: 2204320 - RNA, 20 nt, Human
uccaagaagcccaggaaagg

SEQ ID NO: 2204321 - RNA, 23 nt, Human
uccaaaggaaucuccaguuuuca

SEQ ID NO: 2204322 - RNA, 21 nt, Human
uccaaaggcauuuuauugcuu

SEQ ID NO: 2204323 - RNA, 21 nt, Human
uccaaaggccauggagagcug

SEQ ID NO: 2204324 - RNA, 22 nt, Human
uccaagaagcccaggaaaggcu

SEQ ID NO: 2204325 - RNA, 19 nt, Human
uccaagaaucuaucugcuu

SEQ ID NO: 2204326 - RNA, 12 nt, Human
uccaagaaugcu

SEQ ID NO: 2204327 - RNA, 13 nt, Human
uccaagaaugcug

SEQ ID NO: 2204328 - RNA, 14 nt, Human
uccaagaaugcuga

SEQ ID NO: 2204329 - RNA, 12 nt, Human
uccaagaaucua

SEQ ID NO: 2204330 - RNA, 18 nt, Human
uccaagaaucuaucugcu

SEQ ID NO: 2204331 - RNA, 18 nt, Human
uccaagacagaauaauga

SEQ ID NO: 2204332 - RNA, 18 nt, Human
uccaagacaguauacagu

SEQ ID NO: 2204333 - RNA, 17 nt, Human
uccaagacaugucuguu

SEQ ID NO: 2204334 - RNA, 15 nt, Human
uccaagaaugcugaa

SEQ ID NO: 2204335 - RNA, 16 nt, Human
uccaagaaugcugaaa

SEQ ID NO: 2204336 - RNA, 17 nt, Human
uccaagaaugcugaaac

SEQ ID NO: 2204337 - RNA, 15 nt, Human
uccaagacacugugg

SEQ ID NO: 2204338 - RNA, 17 nt, Human
uccaagacauugucaau

SEQ ID NO: 2204339 - RNA, 15 nt, Human
uccaagacauuguca

SEQ ID NO: 2204340 - RNA, 11 nt, Human
uccaagacauu

SEQ ID NO: 2204341 - RNA, 22 nt, Human
uccaagacaugucuguucuaca

SEQ ID NO: 2204342 - RNA, 20 nt, Human
uccaagacaugucuguucua

SEQ ID NO: 2204343 - RNA, 16 nt, Human
uccaagacauugucaa

SEQ ID NO: 2204344 - RNA, 19 nt, Human
uccaagaccuguugguucc

SEQ ID NO: 2204345 - RNA, 19 nt, Human
uccaagaccuucuccuuca

SEQ ID NO: 2204346 - RNA, 22 nt, Human
uccaagauauuuuaaaaucugu

SEQ ID NO: 2204347 - RNA, 18 nt, Human
uccaagauauuuuaaaau

SEQ ID NO: 2204348 - RNA, 16 nt, Human
uccaagagucugauga

SEQ ID NO: 2204349 - RNA, 17 nt, Human
uccaagagucugaugau

SEQ ID NO: 2204350 - RNA, 18 nt, Human
uccaagauaccuaaaaga

SEQ ID NO: 2204351 - RNA, 13 nt, Human
uccaagcaaaugu

SEQ ID NO: 2204352 - RNA, 17 nt, Human
uccaagcauuuagaugu

SEQ ID NO: 2204353 - RNA, 23 nt, Human
uccaagcauaccaacacgagcag

SEQ ID NO: 2204354 - RNA, 19 nt, Human
uccaaagcacauugaaaga

SEQ ID NO: 2204355 - RNA, 23 nt, Human
uccaaagaguagaauugcauuga

SEQ ID NO: 2204356 - RNA, 22 nt, Human
uccaaacuuggauuuuugacuc

SEQ ID NO: 2204357 - RNA, 22 nt, Human
uccaaagaguagaauugcauug

SEQ ID NO: 2204358 - RNA, 12 nt, Human
uccaaagaaaug

SEQ ID NO: 2204359 - RNA, 20 nt, Human
uccaaacugccuaagcccuc

SEQ ID NO: 2204360 - RNA, 23 nt, Human
uccaaaaguggccucuuugucua

SEQ ID NO: 2204361 - RNA, 19 nt, Human
uccaaacugaagcagccuc

SEQ ID NO: 2204362 - RNA, 23 nt, Human
uccaaacugacucuuaagaagac

SEQ ID NO: 2204363 - RNA, 19 nt, Human
uccaaacuaccuuccaguu

SEQ ID NO: 2204364 - RNA, 19 nt, Human
uccaaaaguggccucuuug

SEQ ID NO: 2204365 - RNA, 16 nt, Human
uccaaaagcuuuuuau

SEQ ID NO: 2204366 - RNA, 17 nt, Human
uccaaaauaaaacuuuu

SEQ ID NO: 2204367 - RNA, 16 nt, Human
uccaaaauaaaacuuu

SEQ ID NO: 2204368 - RNA, 13 nt, Human
uccaaaagcuuuu

SEQ ID NO: 2204369 - RNA, 22 nt, Human
uccaaaagauugcugaaauuuu

SEQ ID NO: 2204370 - RNA, 20 nt, Human
uccaaaagauugcugaaauu

SEQ ID NO: 2204371 - RNA, 19 nt, Human
uccaaaagauugcugaaau

SEQ ID NO: 2204372 - RNA, 14 nt, Human
ucauucagaaaaaa

SEQ ID NO: 2204373 - RNA, 23 nt, Human
ucauguaaauuuuguaugaaaaa

SEQ ID NO: 2204374 - RNA, 13 nt, Human
ucauucaggaaaa

SEQ ID NO: 2204375 - RNA, 12 nt, Human
ucauucaggaaa

SEQ ID NO: 2204376 - RNA, 13 nt, Human
ucauucagaaaaa

SEQ ID NO: 2204377 - RNA, 15 nt, Human
ucauucaugcuacug

SEQ ID NO: 2204378 - RNA, 15 nt, Human
ucauucauucuuagc

SEQ ID NO: 2204379 - RNA, 16 nt, Human
ucauucauuuauucau

SEQ ID NO: 2204380 - RNA, 16 nt, Human
uccaaaagauugcuga

SEQ ID NO: 2204381 - RNA, 13 nt, Human
ucauuucuugggc

SEQ ID NO: 2204382 - RNA, 14 nt, Human
ucauuucuuugagu

SEQ ID NO: 2204383 - RNA, 22 nt, Human
ucauuucugcaucagcugcuga

SEQ ID NO: 2204384 - RNA, 16 nt, Human
ucauuucugcaucagc

SEQ ID NO: 2204385 - RNA, 15 nt, Human
ucccauuccugaaga

SEQ ID NO: 2204386 - RNA, 17 nt, Human
ucccauuccugaagaac

SEQ ID NO: 2204387 - RNA, 14 nt, Human
ucccauuccugaag

SEQ ID NO: 2204388 - RNA, 13 nt, Human
ucccauuccugaa

SEQ ID NO: 2204389 - RNA, 21 nt, Human
ucccauguagcccccuggccu

SEQ ID NO: 2204390 - RNA, 15 nt, Human
ucccauguagccccc

SEQ ID NO: 2204391 - RNA, 13 nt, Human
ucccauguagccc

SEQ ID NO: 2204392 - RNA, 17 nt, Human
ucccauguaacagaaag

SEQ ID NO: 2204393 - RNA, 18 nt, Human
ucccauguaacagaaagg

SEQ ID NO: 2204394 - RNA, 17 nt, Human
ucccauucacucuucca

SEQ ID NO: 2204395 - RNA, 19 nt, Human
ucccauguaacagaaaggg

SEQ ID NO: 2204396 - RNA, 19 nt, Human
ucccauucacucuuccaga

SEQ ID NO: 2204397 - RNA, 16 nt, Human
uccccagaccugagcu

SEQ ID NO: 2204398 - RNA, 22 nt, Human
uccccagacuccaccaagccug

SEQ ID NO: 2204399 - RNA, 17 nt, Human
uccccagaaaggagacu

SEQ ID NO: 2204400 - RNA, 21 nt, Human
uccccacuuguccgcugggug

SEQ ID NO: 2204401 - RNA, 13 nt, Human
uccccagaccuga

SEQ ID NO: 2204402 - RNA, 13 nt, Human
ucccauugcccug

SEQ ID NO: 2204403 - RNA, 15 nt, Human
ucccauugcccuggu

SEQ ID NO: 2204404 - RNA, 14 nt, Human
ucccauugcccugg

SEQ ID NO: 2204405 - RNA, 16 nt, Human
ucccauugucccucug

SEQ ID NO: 2204406 - RNA, 13 nt, Human
ucccauugucccu

SEQ ID NO: 2204407 - RNA, 22 nt, Human
uccccacuugagaauuacccuu

SEQ ID NO: 2204408 - RNA, 19 nt, Human
uccccacuuguccgcuggg

SEQ ID NO: 2204409 - RNA, 21 nt, Human
ucccaggcucucaacagggga

SEQ ID NO: 2204410 - RNA, 22 nt, Human
ucccaggaugagcaucccagga

SEQ ID NO: 2204411 - RNA, 16 nt, Human
ucccaucuccacuguu

SEQ ID NO: 2204412 - RNA, 13 nt, Human
ucccaucugcacc

SEQ ID NO: 2204413 - RNA, 14 nt, Human
ucccaucucuuccu

SEQ ID NO: 2204414 - RNA, 19 nt, Human
ucccaucugcaccccuucu

SEQ ID NO: 2204415 - RNA, 23 nt, Human
ucccaucucacacaugagcauca

SEQ ID NO: 2204416 - RNA, 16 nt, Human
ucccaggcugagccuc

SEQ ID NO: 2204417 - RNA, 20 nt, Human
ucccaucucacacaugagca

SEQ ID NO: 2204418 - RNA, 12 nt, Human
ucccaugcccug

SEQ ID NO: 2204419 - RNA, 14 nt, Human
ucccauggacacuc

SEQ ID NO: 2204420 - RNA, 15 nt, Human
ucccauggacacucc

SEQ ID NO: 2204421 - RNA, 20 nt, Human
ucccauggacacuccagugc

SEQ ID NO: 2204422 - RNA, 19 nt, Human
ucccaucugggaguccccu

SEQ ID NO: 2204423 - RNA, 23 nt, Human
ucccaucugggaguccccuuuuc

SEQ ID NO: 2204424 - RNA, 13 nt, Human
ucccaucugggag

SEQ ID NO: 2204425 - RNA, 14 nt, Human
ucccaucugggagu

SEQ ID NO: 2204426 - RNA, 17 nt, Human
ucccaucugggaguccc

SEQ ID NO: 2204427 - RNA, 15 nt, Human
ucccauguaacagaa

SEQ ID NO: 2204428 - RNA, 16 nt, Human
ucccauguaacagaaa

SEQ ID NO: 2204429 - RNA, 14 nt, Human
ucccauggggaggg

SEQ ID NO: 2204430 - RNA, 21 nt, Human
ucccauggagccccagccccc

SEQ ID NO: 2204431 - RNA, 18 nt, Human
ucccauggcuuaaugcuu

SEQ ID NO: 2204432 - RNA, 21 nt, Human
ucccauggacacuccagugcc

SEQ ID NO: 2204433 - RNA, 22 nt, Human
ucccauggacacuccagugcca

SEQ ID NO: 2204434 - RNA, 13 nt, Human
ucccauggagccc

SEQ ID NO: 2204435 - RNA, 15 nt, Human
ucccauggagcccca

SEQ ID NO: 2204436 - RNA, 16 nt, Human
ucccauggagccccag

SEQ ID NO: 2204437 - RNA, 17 nt, Human
ucccauggagccccagc

SEQ ID NO: 2204438 - RNA, 18 nt, Human
ucccauggagccccagcc

SEQ ID NO: 2204439 - RNA, 19 nt, Human
ucccauggagccccagccc

SEQ ID NO: 2204440 - RNA, 16 nt, Human
ucccaggaugagcauc

SEQ ID NO: 2204441 - RNA, 17 nt, Human
ucccaggagcugcccag

SEQ ID NO: 2204442 - RNA, 18 nt, Human
ucccaggagcugcccaga

SEQ ID NO: 2204443 - RNA, 23 nt, Human
ucccaggagcugcccagaguugc

SEQ ID NO: 2204444 - RNA, 22 nt, Human
ucccaggaguggaggaggccug

SEQ ID NO: 2204445 - RNA, 22 nt, Human
ucccaggagacaguucaagaaa

SEQ ID NO: 2204446 - RNA, 16 nt, Human
ucccaggagacaguuc

SEQ ID NO: 2204447 - RNA, 20 nt, Human
ucccaggcauuccccaggag

SEQ ID NO: 2204448 - RNA, 21 nt, Human
ucccaggcauuccccaggagg

SEQ ID NO: 2204449 - RNA, 20 nt, Human
ucccaggcgccccuuccccc

SEQ ID NO: 2204450 - RNA, 18 nt, Human
ucccaggcgccccuuccc

SEQ ID NO: 2204451 - RNA, 21 nt, Human
ucccaggcgccccuucccccu

SEQ ID NO: 2204452 - RNA, 15 nt, Human
ucccaggcugagccu

SEQ ID NO: 2204453 - RNA, 22 nt, Human
ucccaggcauuccccaggaggc

SEQ ID NO: 2204454 - RNA, 24 nt, Human
ucccaggaugagcaucccaggauc

SEQ ID NO: 2204455 - RNA, 13 nt, Human
ucccaccucagcc

SEQ ID NO: 2204456 - RNA, 18 nt, Human
ucccaaggaaagccccag

SEQ ID NO: 2204457 - RNA, 22 nt, Human
ucccaagcugggccccagccca

SEQ ID NO: 2204458 - RNA, 20 nt, Human
ucccaaggcugcgucuggag

SEQ ID NO: 2204459 - RNA, 22 nt, Human
ucccaaggcucugagcaaaugu

SEQ ID NO: 2204460 - RNA, 18 nt, Human
ucccaagggauggugccc

SEQ ID NO: 2204461 - RNA, 21 nt, Human
ucccaagggauggugcccugu

SEQ ID NO: 2204462 - RNA, 13 nt, Human
ucccaggacccug

SEQ ID NO: 2204463 - RNA, 17 nt, Human
ucccaccuagcagcacc

SEQ ID NO: 2204464 - RNA, 16 nt, Human
ucccaccuagcagcac

SEQ ID NO: 2204465 - RNA, 16 nt, Human
ucccaggacccugaag

SEQ ID NO: 2204466 - RNA, 14 nt, Human
ucccaggacccuga

SEQ ID NO: 2204467 - RNA, 19 nt, Human
ucccaggacccugaagggg

SEQ ID NO: 2204468 - RNA, 15 nt, Human
ucccaggagacaguu

SEQ ID NO: 2204469 - RNA, 14 nt, Human
ucccaccucagccu

SEQ ID NO: 2204470 - RNA, 15 nt, Human
ucccaccucagccuc

SEQ ID NO: 2204471 - RNA, 16 nt, Human
ucccaagcucagaggc

SEQ ID NO: 2204472 - RNA, 22 nt, Human
ucccaaauuugauugauuugaa

SEQ ID NO: 2204473 - RNA, 20 nt, Human
ucccaaauuugauugauuug

SEQ ID NO: 2204474 - RNA, 16 nt, Human
ucccaacucaccccag

SEQ ID NO: 2204475 - RNA, 14 nt, Human
ucccaacucacccc

SEQ ID NO: 2204476 - RNA, 15 nt, Human
ucccaacucacccca

SEQ ID NO: 2204477 - RNA, 17 nt, Human
uccauguagcaggacug

SEQ ID NO: 2204478 - RNA, 16 nt, Human
ucccaaauuucauacc

SEQ ID NO: 2204479 - RNA, 13 nt, Human
ucccaacucaccc

SEQ ID NO: 2204480 - RNA, 14 nt, Human
ucccaaaugagcca

SEQ ID NO: 2204481 - RNA, 19 nt, Human
ucccaaauuugauugauuu

SEQ ID NO: 2204482 - RNA, 17 nt, Human
ucccaaauuugauugau

SEQ ID NO: 2204483 - RNA, 12 nt, Human
ucccaagcuggg

SEQ ID NO: 2204484 - RNA, 13 nt, Human
ucccaagcugggc

SEQ ID NO: 2204485 - RNA, 14 nt, Human
ucccaagcugggcc

SEQ ID NO: 2204486 - RNA, 15 nt, Human
ucccaagcugggccc

SEQ ID NO: 2204487 - RNA, 16 nt, Human
ucccaagcugggcccc

SEQ ID NO: 2204488 - RNA, 17 nt, Human
ucccaagcucugcuccu

SEQ ID NO: 2204489 - RNA, 13 nt, Human
ucccaaggaaagc

SEQ ID NO: 2204490 - RNA, 12 nt, Human
ucccaaggaaag

SEQ ID NO: 2204491 - RNA, 17 nt, Human
ucccaagcugggcccca

SEQ ID NO: 2204492 - RNA, 18 nt, Human
ucccaagcugggccccag

SEQ ID NO: 2204493 - RNA, 19 nt, Human
ucccaagcugggccccagc

SEQ ID NO: 2204494 - RNA, 21 nt, Human
ucccaagcugggccccagccc

SEQ ID NO: 2204495 - RNA, 22 nt, Human
ucccaaggaaagccccagcacu

SEQ ID NO: 2204496 - RNA, 18 nt, Human
ucccaaggcucugagcaa

SEQ ID NO: 2204497 - RNA, 12 nt, Human
ucccaagcucug

SEQ ID NO: 2204498 - RNA, 13 nt, Human
ucccaagcucugc

SEQ ID NO: 2204499 - RNA, 14 nt, Human
ucccaagcucugcu

SEQ ID NO: 2204500 - RNA, 15 nt, Human
ucccaagcucugcuc

SEQ ID NO: 2204501 - RNA, 20 nt, Human
uccauggcccugcaaaagga

SEQ ID NO: 2204502 - RNA, 14 nt, Human
uccauggauuuugg

SEQ ID NO: 2204503 - RNA, 18 nt, Human
uccaucccuacccccuaa

SEQ ID NO: 2204504 - RNA, 13 nt, Human
uccauggacuuug

SEQ ID NO: 2204505 - RNA, 14 nt, Human
uccauggacuuugu

SEQ ID NO: 2204506 - RNA, 15 nt, Human
uccauggacuuuguu

SEQ ID NO: 2204507 - RNA, 21 nt, Human
ucccaaagugcugggauuaca

SEQ ID NO: 2204508 - RNA, 15 nt, Human
uccauguagcaggac

SEQ ID NO: 2204509 - RNA, 14 nt, Human
uccauguagcagga

SEQ ID NO: 2204510 - RNA, 21 nt, Human
uccauguacuguaguuuuucu

SEQ ID NO: 2204511 - RNA, 20 nt, Human
uccauguacuguaguuuuuc

SEQ ID NO: 2204512 - RNA, 16 nt, Human
uccauguacuguaguu

SEQ ID NO: 2204513 - RNA, 14 nt, Human
uccauguacuguag

SEQ ID NO: 2204514 - RNA, 17 nt, Human
uccaugggggcagggca

SEQ ID NO: 2204515 - RNA, 15 nt, Human
uccaugggggcaggg

SEQ ID NO: 2204516 - RNA, 16 nt, Human
uccauggggaagggau

SEQ ID NO: 2204517 - RNA, 15 nt, Human
uccaugggguaggag

SEQ ID NO: 2204518 - RNA, 13 nt, Human
uccauguacugua

SEQ ID NO: 2204519 - RNA, 12 nt, Human
uccagcuccaac

SEQ ID NO: 2204520 - RNA, 18 nt, Human
uccagcuccaaccugcaa

SEQ ID NO: 2204521 - RNA, 16 nt, Human
uccagcuccaaccugc

SEQ ID NO: 2204522 - RNA, 19 nt, Human
uccagcuccaaccugcaaa

SEQ ID NO: 2204523 - RNA, 22 nt, Human
uccagcuccaagaccuguuggu

SEQ ID NO: 2204524 - RNA, 18 nt, Human
uccagcuccucauccagg

SEQ ID NO: 2204525 - RNA, 23 nt, Human
uccagcucaccagccccagugcc

SEQ ID NO: 2204526 - RNA, 20 nt, Human
uccagcucaccccccacacu

SEQ ID NO: 2204527 - RNA, 21 nt, Human
uccagcucaccccccacacuc

SEQ ID NO: 2204528 - RNA, 14 nt, Human
uccaucccuacccc

SEQ ID NO: 2204529 - RNA, 14 nt, Human
uccaucccaucauc

SEQ ID NO: 2204530 - RNA, 20 nt, Human
uccaucccgaaaaucucucg

SEQ ID NO: 2204531 - RNA, 15 nt, Human
uccaucccaggacac

SEQ ID NO: 2204532 - RNA, 21 nt, Human
uccaucccaggacaccacacc

SEQ ID NO: 2204533 - RNA, 22 nt, Human
uccaucccaggacaccacaccc

SEQ ID NO: 2204534 - RNA, 12 nt, Human
uccaucccagag

SEQ ID NO: 2204535 - RNA, 13 nt, Human
uccaucccagagg

SEQ ID NO: 2204536 - RNA, 16 nt, Human
uccauccaggccauuc

SEQ ID NO: 2204537 - RNA, 16 nt, Human
uccaucauguccccaa

SEQ ID NO: 2204538 - RNA, 15 nt, Human
uccauccacauggga

SEQ ID NO: 2204539 - RNA, 21 nt, Human
uccauccaaggccagguucuc

SEQ ID NO: 2204540 - RNA, 13 nt, Human
uccauccaaggcc

SEQ ID NO: 2204541 - RNA, 23 nt, Human
uccagcuccucauccagggcucu

SEQ ID NO: 2204542 - RNA, 15 nt, Human
uccaucaugucccca

SEQ ID NO: 2204543 - RNA, 24 nt, Human
uccccugcccugguccagggaagc

SEQ ID NO: 2204544 - RNA, 17 nt, Human
uccccugcccuggucca

SEQ ID NO: 2204545 - RNA, 15 nt, Human
uccccugcugcaggg

SEQ ID NO: 2204546 - RNA, 17 nt, Human
uccccugcugcaggggc

SEQ ID NO: 2204547 - RNA, 18 nt, Human
uccccugcugcaggggcu

SEQ ID NO: 2204548 - RNA, 21 nt, Human
uccccugcugcaggggcucug

SEQ ID NO: 2204549 - RNA, 23 nt, Human
uccccugcugcaggggcucugga

SEQ ID NO: 2204550 - RNA, 22 nt, Human
uccccugccccuuuacggacac

SEQ ID NO: 2204551 - RNA, 15 nt, Human
uccccugcccugcug

SEQ ID NO: 2204552 - RNA, 12 nt, Human
uccccugcccug

SEQ ID NO: 2204553 - RNA, 15 nt, Human
uccccugcccugguc

SEQ ID NO: 2204554 - RNA, 13 nt, Human
uccccugcccugg

SEQ ID NO: 2204555 - RNA, 23 nt, Human
uccccugcccugcugccgccucc

SEQ ID NO: 2204556 - RNA, 16 nt, Human
uccccugcccugcugc

SEQ ID NO: 2204557 - RNA, 14 nt, Human
uccccugcugggug

SEQ ID NO: 2204558 - RNA, 15 nt, Human
uccccugcugggugu

SEQ ID NO: 2204559 - RNA, 20 nt, Human
uccccugcuggguguggcgc

SEQ ID NO: 2204560 - RNA, 21 nt, Human
uccccugcuggguguggcgca

SEQ ID NO: 2204561 - RNA, 22 nt, Human
uccccuguagagugggagcuga

SEQ ID NO: 2204562 - RNA, 23 nt, Human
uccccuguccccgcacugggcuu

SEQ ID NO: 2204563 - RNA, 15 nt, Human
uccccuguucacucu

SEQ ID NO: 2204564 - RNA, 12 nt, Human
uccccugugggg

SEQ ID NO: 2204565 - RNA, 20 nt, Human
uccccuguggggaucucagg

SEQ ID NO: 2204566 - RNA, 14 nt, Human
uccccugugcaguc

SEQ ID NO: 2204567 - RNA, 17 nt, Human
uccccuggacugggagg

SEQ ID NO: 2204568 - RNA, 15 nt, Human
uccccugggcccuga

SEQ ID NO: 2204569 - RNA, 19 nt, Human
uccccuggggacagcaagg

SEQ ID NO: 2204570 - RNA, 19 nt, Human
uccccuguagagugggagc

SEQ ID NO: 2204571 - RNA, 15 nt, Human
uccccuggacuggga

SEQ ID NO: 2204572 - RNA, 16 nt, Human
uccccuggacugggag

SEQ ID NO: 2204573 - RNA, 18 nt, Human
uccccuggaacugucucu

SEQ ID NO: 2204574 - RNA, 20 nt, Human
uccccuggaacugucucuca

SEQ ID NO: 2204575 - RNA, 24 nt, Human
uccccugcuggguguggcgcagca

SEQ ID NO: 2204576 - RNA, 13 nt, Human
uccccuucacucc

SEQ ID NO: 2204577 - RNA, 19 nt, Human
uccccuuccaucccagagg

SEQ ID NO: 2204578 - RNA, 18 nt, Human
uccccuuccacugagggc

SEQ ID NO: 2204579 - RNA, 17 nt, Human
uccccuuccacugaggg

SEQ ID NO: 2204580 - RNA, 13 nt, Human
uccccuuccacug

SEQ ID NO: 2204581 - RNA, 13 nt, Human
uccccuucccugc

SEQ ID NO: 2204582 - RNA, 15 nt, Human
uccccuucccugcaa

SEQ ID NO: 2204583 - RNA, 22 nt, Human
uccccuuccuaauuccacagcu

SEQ ID NO: 2204584 - RNA, 21 nt, Human
uccccuuccuaauuccacagc

SEQ ID NO: 2204585 - RNA, 20 nt, Human
ucccuaagccaagggccucu

SEQ ID NO: 2204586 - RNA, 15 nt, Human
ucccuaagccaaggg

SEQ ID NO: 2204587 - RNA, 18 nt, Human
ucccuaaagaaaaaaaau

SEQ ID NO: 2204588 - RNA, 15 nt, Human
uccccuucucaucac

SEQ ID NO: 2204589 - RNA, 16 nt, Human
uccccuuccucacugc

SEQ ID NO: 2204590 - RNA, 19 nt, Human
uccccuucucaucacuccc

SEQ ID NO: 2204591 - RNA, 13 nt, Human
ucccuaaacugua

SEQ ID NO: 2204592 - RNA, 11 nt, Human
ucccuaauaaa

SEQ ID NO: 2204593 - RNA, 12 nt, Human
ucccuaauaaag

SEQ ID NO: 2204594 - RNA, 15 nt, Human
ucccucccucuuucc

SEQ ID NO: 2204595 - RNA, 15 nt, Human
ucccuacuuccugug

SEQ ID NO: 2204596 - RNA, 16 nt, Human
ucccuacuuccuguga

SEQ ID NO: 2204597 - RNA, 17 nt, Human
ucccucccucuuucccu

SEQ ID NO: 2204598 - RNA, 17 nt, Human
ucccuaccucaggcagg

SEQ ID NO: 2204599 - RNA, 15 nt, Human
ucccuaccucaggca

SEQ ID NO: 2204600 - RNA, 15 nt, Human
ucccuacuguaauuu

SEQ ID NO: 2204601 - RNA, 13 nt, Human
ucccuaccucagg

SEQ ID NO: 2204602 - RNA, 13 nt, Human
ucccuaauaaagc

SEQ ID NO: 2204603 - RNA, 20 nt, Human
ucccccucccccacugccau

SEQ ID NO: 2204604 - RNA, 13 nt, Human
ucccccucuggcu

SEQ ID NO: 2204605 - RNA, 12 nt, Human
ucccccucuguc

SEQ ID NO: 2204606 - RNA, 18 nt, Human
ucccccucccccuucucc

SEQ ID NO: 2204607 - RNA, 20 nt, Human
ucccccucccccuucuccca

SEQ ID NO: 2204608 - RNA, 18 nt, Human
ucccccugccagugccuu

SEQ ID NO: 2204609 - RNA, 17 nt, Human
ucccccugccagugccu

SEQ ID NO: 2204610 - RNA, 16 nt, Human
ucccccugccagugcc

SEQ ID NO: 2204611 - RNA, 15 nt, Human
ucccccucuguccag

SEQ ID NO: 2204612 - RNA, 13 nt, Human
ucccccugcccca

SEQ ID NO: 2204613 - RNA, 12 nt, Human
ucccccugcccu

SEQ ID NO: 2204614 - RNA, 15 nt, Human
ucccccugcccucgu

SEQ ID NO: 2204615 - RNA, 20 nt, Human
ucccccugcccucguggcca

SEQ ID NO: 2204616 - RNA, 22 nt, Human
ucccccugcccucguggccagc

SEQ ID NO: 2204617 - RNA, 19 nt, Human
ucccccgccgcuuuucucc

SEQ ID NO: 2204618 - RNA, 22 nt, Human
ucccccgggaggggcccgcuug

SEQ ID NO: 2204619 - RNA, 16 nt, Human
ucccccuccaccugcu

SEQ ID NO: 2204620 - RNA, 17 nt, Human
ucccccucccagggcca

SEQ ID NO: 2204621 - RNA, 19 nt, Human
ucccccucccagggccagg

SEQ ID NO: 2204622 - RNA, 18 nt, Human
ucccccucccagggccag

SEQ ID NO: 2204623 - RNA, 20 nt, Human
ucccccgcaaugugccccca

SEQ ID NO: 2204624 - RNA, 21 nt, Human
ucccccgcaaugugcccccag

SEQ ID NO: 2204625 - RNA, 14 nt, Human
uccccccucaccag

SEQ ID NO: 2204626 - RNA, 14 nt, Human
ucccccgccacucc

SEQ ID NO: 2204627 - RNA, 19 nt, Human
ucccccauccuccccuucc

SEQ ID NO: 2204628 - RNA, 12 nt, Human
uccccccucacc

SEQ ID NO: 2204629 - RNA, 17 nt, Human
ucccccaucucuucugg

SEQ ID NO: 2204630 - RNA, 11 nt, Human
uccccagagaa

SEQ ID NO: 2204631 - RNA, 10 nt, Human
uccccagaga

SEQ ID NO: 2204632 - RNA, 12 nt, Human
uccccagccucu

SEQ ID NO: 2204633 - RNA, 14 nt, Human
uccccagcuguuua

SEQ ID NO: 2204634 - RNA, 22 nt, Human
uccccagcucaccccuggagga

SEQ ID NO: 2204635 - RNA, 23 nt, Human
uccccagccuuugaucagguggg

SEQ ID NO: 2204636 - RNA, 17 nt, Human
uccccagcucaccccug

SEQ ID NO: 2204637 - RNA, 22 nt, Human
uccccagcgucccagucucugg

SEQ ID NO: 2204638 - RNA, 15 nt, Human
uccccagcuguuuau

SEQ ID NO: 2204639 - RNA, 15 nt, Human
ucccccagcccugug

SEQ ID NO: 2204640 - RNA, 14 nt, Human
ucccccagcccugu

SEQ ID NO: 2204641 - RNA, 13 nt, Human
ucccccagcccug

SEQ ID NO: 2204642 - RNA, 12 nt, Human
ucccccagcccu

SEQ ID NO: 2204643 - RNA, 13 nt, Human
uccccaggaggcc

SEQ ID NO: 2204644 - RNA, 21 nt, Human
ucccccauccuccccuucccu

SEQ ID NO: 2204645 - RNA, 18 nt, Human
ucccccauccuccccuuc

SEQ ID NO: 2204646 - RNA, 17 nt, Human
ucccccauccuccccuu

SEQ ID NO: 2204647 - RNA, 15 nt, Human
ucccccauagccacc

SEQ ID NO: 2204648 - RNA, 14 nt, Human
ucccccauagccac

SEQ ID NO: 2204649 - RNA, 17 nt, Human
ucccccagcccugugga

SEQ ID NO: 2204650 - RNA, 16 nt, Human
ucccccagcccugugg

SEQ ID NO: 2204651 - RNA, 12 nt, Human
ucccccagccuc

SEQ ID NO: 2204652 - RNA, 18 nt, Human
ucccccagcucuggugag

SEQ ID NO: 2204653 - RNA, 12 nt, Human
ucccccauagcc

SEQ ID NO: 2204654 - RNA, 13 nt, Human
uccccgccuguuc

SEQ ID NO: 2204655 - RNA, 14 nt, Human
uccccgccuguucc

SEQ ID NO: 2204656 - RNA, 15 nt, Human
uccccugccagggca

SEQ ID NO: 2204657 - RNA, 14 nt, Human
uccccugccagggc

SEQ ID NO: 2204658 - RNA, 12 nt, Human
uccccugccagg

SEQ ID NO: 2204659 - RNA, 19 nt, Human
uccccugccaccaggccac

SEQ ID NO: 2204660 - RNA, 13 nt, Human
uccccugccacca

SEQ ID NO: 2204661 - RNA, 14 nt, Human
uccccugccaccag

SEQ ID NO: 2204662 - RNA, 16 nt, Human
uccccugccaccaggc

SEQ ID NO: 2204663 - RNA, 17 nt, Human
uccccugccaccaggcc

SEQ ID NO: 2204664 - RNA, 13 nt, Human
uccccugccauuu

SEQ ID NO: 2204665 - RNA, 20 nt, Human
uccccugccagggcagggcc

SEQ ID NO: 2204666 - RNA, 23 nt, Human
uccccugcccccagaccuuuuau

SEQ ID NO: 2204667 - RNA, 15 nt, Human
uccccugcccccagg

SEQ ID NO: 2204668 - RNA, 13 nt, Human
uccccugccccca

SEQ ID NO: 2204669 - RNA, 14 nt, Human
uccccugcccccag

SEQ ID NO: 2204670 - RNA, 20 nt, Human
uccccugcccccaggacugg

SEQ ID NO: 2204671 - RNA, 22 nt, Human
uccccugcccccaggacugggc

SEQ ID NO: 2204672 - RNA, 16 nt, Human
uccccugcccccagga

SEQ ID NO: 2204673 - RNA, 17 nt, Human
uccccugcccccaggac

SEQ ID NO: 2204674 - RNA, 18 nt, Human
uccccugcccccaggacu

SEQ ID NO: 2204675 - RNA, 19 nt, Human
uccccugcccccaggacug

SEQ ID NO: 2204676 - RNA, 20 nt, Human
uccccgcacugggcuugggg

SEQ ID NO: 2204677 - RNA, 20 nt, Human
uccccgagggaugaugccac

SEQ ID NO: 2204678 - RNA, 24 nt, Human
uccccgaaacaggcuacucuccuc

SEQ ID NO: 2204679 - RNA, 19 nt, Human
uccccgaaggugcuggagg

SEQ ID NO: 2204680 - RNA, 21 nt, Human
uccccgagggaugaugccaca

SEQ ID NO: 2204681 - RNA, 22 nt, Human
uccccgagggaugaugccacac

SEQ ID NO: 2204682 - RNA, 18 nt, Human
uccccgaguuuccccaga

SEQ ID NO: 2204683 - RNA, 20 nt, Human
uccccgcagugugcacuaag

SEQ ID NO: 2204684 - RNA, 19 nt, Human
uccccgcagugugcacuaa

SEQ ID NO: 2204685 - RNA, 21 nt, Human
uccccgcaccccccaagcugu

SEQ ID NO: 2204686 - RNA, 14 nt, Human
uccccgcacccccc

SEQ ID NO: 2204687 - RNA, 22 nt, Human
uccccgcagugugcacuaaggg

SEQ ID NO: 2204688 - RNA, 21 nt, Human
uccccgcagugugcacuaagg

SEQ ID NO: 2204689 - RNA, 13 nt, Human
uccccgcccuuuu

SEQ ID NO: 2204690 - RNA, 15 nt, Human
uccccgcccuuuuuu

SEQ ID NO: 2204691 - RNA, 19 nt, Human
ucccccuuuucugcauuuu

SEQ ID NO: 2204692 - RNA, 17 nt, Human
ucccccuugccacccca

SEQ ID NO: 2204693 - RNA, 23 nt, Human
ucccccuugccaccccacccucc

SEQ ID NO: 2204694 - RNA, 10 nt, Human
ucccccuucu

SEQ ID NO: 2204695 - RNA, 12 nt, Human
ucccccuucucc

SEQ ID NO: 2204696 - RNA, 13 nt, Human
ucccccuucuccc

SEQ ID NO: 2204697 - RNA, 15 nt, Human
ucccccuucucccac

SEQ ID NO: 2204698 - RNA, 12 nt, Human
ucccccuugcca

SEQ ID NO: 2204699 - RNA, 13 nt, Human
ucccccuugccac

SEQ ID NO: 2204700 - RNA, 14 nt, Human
ucccccuugccacc

SEQ ID NO: 2204701 - RNA, 16 nt, Human
ucccccuugccacccc

SEQ ID NO: 2204702 - RNA, 21 nt, Human
ucccccuuccauggacuuugu

SEQ ID NO: 2204703 - RNA, 19 nt, Human
ucccccugcuuccaccuca

SEQ ID NO: 2204704 - RNA, 23 nt, Human
ucccccugcccucguggccagcc

SEQ ID NO: 2204705 - RNA, 17 nt, Human
ucccccugcuuccaccu

SEQ ID NO: 2204706 - RNA, 21 nt, Human
ucccccuggccaccacccccc

SEQ ID NO: 2204707 - RNA, 23 nt, Human
ucccccuggccaccaccccccac

SEQ ID NO: 2204708 - RNA, 23 nt, Human
ucagagugcaagccccugcucca

SEQ ID NO: 2204709 - RNA, 17 nt, Human
ucagaguggaaugcuuc

SEQ ID NO: 2204710 - RNA, 22 nt, Human
ucagaguugaugguuguacaua

SEQ ID NO: 2204711 - RNA, 15 nt, Human
ucagcaaacucuuuu

SEQ ID NO: 2204712 - RNA, 13 nt, Human
ucagauaacuguu

SEQ ID NO: 2204713 - RNA, 21 nt, Human
ucagaguugcugcaaaccuga

SEQ ID NO: 2204714 - RNA, 15 nt, Human
ucagauaacuguuau

SEQ ID NO: 2204715 - RNA, 16 nt, Human
ucagaguccaggcccc

SEQ ID NO: 2204716 - RNA, 14 nt, Human
ucagaguccaggcc

SEQ ID NO: 2204717 - RNA, 14 nt, Human
ucagagggaggaau

SEQ ID NO: 2204718 - RNA, 17 nt, Human
ucagaguccaggcccca

SEQ ID NO: 2204719 - RNA, 21 nt, Human
ucagagggaaaguaaauauuu

SEQ ID NO: 2204720 - RNA, 16 nt, Human
ucagaggcgcacugug

SEQ ID NO: 2204721 - RNA, 13 nt, Human
ucagaguccaggc

SEQ ID NO: 2204722 - RNA, 15 nt, Human
ucagagcugggaggg

SEQ ID NO: 2204723 - RNA, 14 nt, Human
ucagaggauggcca

SEQ ID NO: 2204724 - RNA, 18 nt, Human
ucagaggauggccagugu

SEQ ID NO: 2204725 - RNA, 19 nt, Human
ucagaggauggccaguguc

SEQ ID NO: 2204726 - RNA, 18 nt, Human
ucagaggcacaaaagggu

SEQ ID NO: 2204727 - RNA, 20 nt, Human
ucagaggauggccagugucu

SEQ ID NO: 2204728 - RNA, 22 nt, Human
ucagaggcccucgcugccagcu

SEQ ID NO: 2204729 - RNA, 15 nt, Human
ucagaggccuauaau

SEQ ID NO: 2204730 - RNA, 20 nt, Human
ucagaggccuauaaugaagc

SEQ ID NO: 2204731 - RNA, 21 nt, Human
ucagaggcccucgcugccagc

SEQ ID NO: 2204732 - RNA, 18 nt, Human
ucagaggcccucgcugcc

SEQ ID NO: 2204733 - RNA, 18 nt, Human
ucagcacgauuucuguuu

SEQ ID NO: 2204734 - RNA, 23 nt, Human
ucagcaaauuaauuggcagcaga

SEQ ID NO: 2204735 - RNA, 21 nt, Human
ucagcaaauuaauuggcagca

SEQ ID NO: 2204736 - RNA, 16 nt, Human
ucagcaacucgcuuua

SEQ ID NO: 2204737 - RNA, 23 nt, Human
ucagcacuugggggaucuguugu

SEQ ID NO: 2204738 - RNA, 14 nt, Human
ucagcacugucccu

SEQ ID NO: 2204739 - RNA, 21 nt, Human
ucagcacugucccuugccuca

SEQ ID NO: 2204740 - RNA, 20 nt, Human
ucagcacugauuucacaaca

SEQ ID NO: 2204741 - RNA, 12 nt, Human
ucagcacugucc

SEQ ID NO: 2204742 - RNA, 13 nt, Human
ucagcacuguccc

SEQ ID NO: 2204743 - RNA, 19 nt, Human
ucagcacgauuucuguuua

SEQ ID NO: 2204744 - RNA, 13 nt, Human
ucagcacaaggcc

SEQ ID NO: 2204745 - RNA, 17 nt, Human
ucagcacugauuucaca

SEQ ID NO: 2204746 - RNA, 14 nt, Human
ucagaccagcucuu

SEQ ID NO: 2204747 - RNA, 14 nt, Human
ucagaccacggcuc

SEQ ID NO: 2204748 - RNA, 20 nt, Human
ucagacauguuuuccgugaa

SEQ ID NO: 2204749 - RNA, 14 nt, Human
ucagacuagugaca

SEQ ID NO: 2204750 - RNA, 19 nt, Human
ucagacucccauuccugaa

SEQ ID NO: 2204751 - RNA, 22 nt, Human
ucagacucccauuccugaagaa

SEQ ID NO: 2204752 - RNA, 21 nt, Human
ucagacucccauuccugaaga

SEQ ID NO: 2204753 - RNA, 22 nt, Human
ucagacauagaauuaacacaug

SEQ ID NO: 2204754 - RNA, 15 nt, Human
ucagacauguuuucc

SEQ ID NO: 2204755 - RNA, 14 nt, Human
ucagacauguuuuc

SEQ ID NO: 2204756 - RNA, 22 nt, Human
ucagacauccauguuuguaaaa

SEQ ID NO: 2204757 - RNA, 14 nt, Human
ucagaaaugcugcc

SEQ ID NO: 2204758 - RNA, 21 nt, Human
ucagacauccauguuuguaaa

SEQ ID NO: 2204759 - RNA, 21 nt, Human
ucagacugcugggacuggcca

SEQ ID NO: 2204760 - RNA, 17 nt, Human
ucagacugcugggacug

SEQ ID NO: 2204761 - RNA, 16 nt, Human
ucagacugcugggacu

SEQ ID NO: 2204762 - RNA, 15 nt, Human
ucagacugcugggac

SEQ ID NO: 2204763 - RNA, 14 nt, Human
ucagacugcuggga

SEQ ID NO: 2204764 - RNA, 13 nt, Human
ucagacugcuggg

SEQ ID NO: 2204765 - RNA, 19 nt, Human
ucagacugaacauguacac

SEQ ID NO: 2204766 - RNA, 14 nt, Human
ucagacugcaugua

SEQ ID NO: 2204767 - RNA, 14 nt, Human
ucagacugaacaug

SEQ ID NO: 2204768 - RNA, 12 nt, Human
ucagaaauaugu

SEQ ID NO: 2204769 - RNA, 15 nt, Human
ucagaaaugcugccu

SEQ ID NO: 2204770 - RNA, 19 nt, Human
ucagacauagaauuaacac

SEQ ID NO: 2204771 - RNA, 19 nt, Human
ucagacagcugccugggau

SEQ ID NO: 2204772 - RNA, 20 nt, Human
ucagacagcugccugggauc

SEQ ID NO: 2204773 - RNA, 15 nt, Human
ucagacagcugccug

SEQ ID NO: 2204774 - RNA, 16 nt, Human
ucagacagcugccugg

SEQ ID NO: 2204775 - RNA, 17 nt, Human
ucagacagcugccuggg

SEQ ID NO: 2204776 - RNA, 18 nt, Human
ucagacagcugccuggga

SEQ ID NO: 2204777 - RNA, 22 nt, Human
ucacucugucgcccagucugga

SEQ ID NO: 2204778 - RNA, 13 nt, Human
ucacucugcugcu

SEQ ID NO: 2204779 - RNA, 14 nt, Human
ucacucugcugcuu

SEQ ID NO: 2204780 - RNA, 13 nt, Human
ucacucuggccuc

SEQ ID NO: 2204781 - RNA, 19 nt, Human
ucacucugucgcccagucu

SEQ ID NO: 2204782 - RNA, 12 nt, Human
ucacucugucgc

SEQ ID NO: 2204783 - RNA, 16 nt, Human
ucacucugucgcccag

SEQ ID NO: 2204784 - RNA, 20 nt, Human
ucacugcuuaacuucacaua

SEQ ID NO: 2204785 - RNA, 18 nt, Human
ucacugcuuaacuucaca

SEQ ID NO: 2204786 - RNA, 17 nt, Human
ucacugcuuaacuucac

SEQ ID NO: 2204787 - RNA, 15 nt, Human
ucacugcuuaacuuc

SEQ ID NO: 2204788 - RNA, 13 nt, Human
ucacuuguacaaa

SEQ ID NO: 2204789 - RNA, 15 nt, Human
ucacuuguacaaaau

SEQ ID NO: 2204790 - RNA, 14 nt, Human
ucacuuguacaaaa

SEQ ID NO: 2204791 - RNA, 14 nt, Human
ucacuggcugccuc

SEQ ID NO: 2204792 - RNA, 15 nt, Human
ucacuggcugccucc

SEQ ID NO: 2204793 - RNA, 17 nt, Human
ucacuggcugccuccac

SEQ ID NO: 2204794 - RNA, 18 nt, Human
ucacuggcugccuccacu

SEQ ID NO: 2204795 - RNA, 20 nt, Human
ucacuggcugccuccacucc

SEQ ID NO: 2204796 - RNA, 20 nt, Human
ucacuugaugugccauuuua

SEQ ID NO: 2204797 - RNA, 17 nt, Human
ucacuugucaauaaaau

SEQ ID NO: 2204798 - RNA, 17 nt, Human
ucacuuguacaaaauaa

SEQ ID NO: 2204799 - RNA, 16 nt, Human
ucacuuguacaaaaua

SEQ ID NO: 2204800 - RNA, 20 nt, Human
ucacuuggugauauguccua

SEQ ID NO: 2204801 - RNA, 14 nt, Human
ucacuggaugaaga

SEQ ID NO: 2204802 - RNA, 19 nt, Human
ucacuggaugaagauucuc

SEQ ID NO: 2204803 - RNA, 16 nt, Human
ucacuggcaaugaaaa

SEQ ID NO: 2204804 - RNA, 21 nt, Human
ucacuggccacaguuguuuga

SEQ ID NO: 2204805 - RNA, 14 nt, Human
ucacucuggccuca

SEQ ID NO: 2204806 - RNA, 17 nt, Human
ucacuggagcccaggag

SEQ ID NO: 2204807 - RNA, 19 nt, Human
ucacuggaguuacauuaau

SEQ ID NO: 2204808 - RNA, 21 nt, Human
ucacuggaguuacauuaaugu

SEQ ID NO: 2204809 - RNA, 22 nt, Human
ucacuggaguuacauuaauguu

SEQ ID NO: 2204810 - RNA, 13 nt, Human
ucacuggaugaaa

SEQ ID NO: 2204811 - RNA, 22 nt, Human
ucacuggcgacacguagcagcu

SEQ ID NO: 2204812 - RNA, 20 nt, Human
ucacuggcgacacguagcag

SEQ ID NO: 2204813 - RNA, 14 nt, Human
ucacuggcucucca

SEQ ID NO: 2204814 - RNA, 15 nt, Human
ucacuggccaucccu

SEQ ID NO: 2204815 - RNA, 11 nt, Human
ucacuggcucu

SEQ ID NO: 2204816 - RNA, 15 nt, Human
ucacuggcucuccaa

SEQ ID NO: 2204817 - RNA, 16 nt, Human
ucacuggcucuccaag

SEQ ID NO: 2204818 - RNA, 17 nt, Human
ucacuggcucuccaagu

SEQ ID NO: 2204819 - RNA, 22 nt, Human
ucacuggcucuccaagugccag

SEQ ID NO: 2204820 - RNA, 19 nt, Human
ucacuggcucuccaagugc

SEQ ID NO: 2204821 - RNA, 20 nt, Human
ucacuggcucuccaagugcc

SEQ ID NO: 2204822 - RNA, 23 nt, Human
ucagaaagugugcuuuaugcuga

SEQ ID NO: 2204823 - RNA, 13 nt, Human
ucagaaauacaga

SEQ ID NO: 2204824 - RNA, 16 nt, Human
ucagaaauacagauuu

SEQ ID NO: 2204825 - RNA, 20 nt, Human
ucagaaauacagauuuugau

SEQ ID NO: 2204826 - RNA, 23 nt, Human
ucagaaagagcaagucuggaucu

SEQ ID NO: 2204827 - RNA, 17 nt, Human
ucagaaagcauuacauu

SEQ ID NO: 2204828 - RNA, 12 nt, Human
ucagaaaggaau

SEQ ID NO: 2204829 - RNA, 14 nt, Human
ucagaaagagcaag

SEQ ID NO: 2204830 - RNA, 14 nt, Human
ucagaaaagggaag

SEQ ID NO: 2204831 - RNA, 19 nt, Human
ucagaaaauauuauguguu

SEQ ID NO: 2204832 - RNA, 20 nt, Human
ucagaaaauauuauguguuu

SEQ ID NO: 2204833 - RNA, 17 nt, Human
ucagaaaaaaauaaaug

SEQ ID NO: 2204834 - RNA, 17 nt, Human
ucacuuuuuuuuuccaa

SEQ ID NO: 2204835 - RNA, 19 nt, Human
ucacuuuuuuuuuccaaaa

SEQ ID NO: 2204836 - RNA, 21 nt, Human
ucacuuuuuuuuuccaaaaaa

SEQ ID NO: 2204837 - RNA, 17 nt, Human
ucagaaaauauuaugug

SEQ ID NO: 2204838 - RNA, 18 nt, Human
ucacuuuugacaaaggca

SEQ ID NO: 2204839 - RNA, 18 nt, Human
ucacuuuuccucccucag

SEQ ID NO: 2204840 - RNA, 13 nt, Human
ucacuuuuccucc

SEQ ID NO: 2204841 - RNA, 16 nt, Human
ucacuuuuuuccacau

SEQ ID NO: 2204842 - RNA, 15 nt, Human
ucacuuuuuuuuucc

SEQ ID NO: 2204843 - RNA, 15 nt, Human
ucacuuuuuuccaca

SEQ ID NO: 2204844 - RNA, 13 nt, Human
ucacuuuuuucca

SEQ ID NO: 2204845 - RNA, 14 nt, Human
ucacuuugcucugg

SEQ ID NO: 2204846 - RNA, 14 nt, Human
ucacuuucucaguu

SEQ ID NO: 2204847 - RNA, 17 nt, Human
ucacuugugcaguguug

SEQ ID NO: 2204848 - RNA, 14 nt, Human
ucacuuucuagauu

SEQ ID NO: 2204849 - RNA, 15 nt, Human
ucacuuugcucuggg

SEQ ID NO: 2204850 - RNA, 17 nt, Human
ucacuuugcucugggug

SEQ ID NO: 2204851 - RNA, 13 nt, Human
ucacuuuuaggga

SEQ ID NO: 2204852 - RNA, 16 nt, Human
ucacuuugcucugggu

SEQ ID NO: 2204853 - RNA, 22 nt, Human
ucacuuuuauuuagcaccaggg

SEQ ID NO: 2204854 - RNA, 12 nt, Human
ucacuuuuauuu

SEQ ID NO: 2204855 - RNA, 12 nt, Human
ucacuuuuccuc

SEQ ID NO: 2204856 - RNA, 22 nt, Human
ucacuuuuagggagagucauau

SEQ ID NO: 2204857 - RNA, 13 nt, Human
ucacuuuucagug

SEQ ID NO: 2204858 - RNA, 14 nt, Human
ucacuuuucaguga

SEQ ID NO: 2204859 - RNA, 16 nt, Human
ucacuuuucagugaug

SEQ ID NO: 2204860 - RNA, 23 nt, Human
ucacuccugagaccccuggccuc

SEQ ID NO: 2204861 - RNA, 21 nt, Human
ucacuccugagaccccuggcc

SEQ ID NO: 2204862 - RNA, 22 nt, Human
ucacuccugagaccccuggccu

SEQ ID NO: 2204863 - RNA, 19 nt, Human
ucacuccugagaccccugg

SEQ ID NO: 2204864 - RNA, 20 nt, Human
ucacuccugagaccccuggc

SEQ ID NO: 2204865 - RNA, 20 nt, Human
ucacgggcaugggcacuccc

SEQ ID NO: 2204866 - RNA, 17 nt, Human
ucacggugccagguuuu

SEQ ID NO: 2204867 - RNA, 11 nt, Human
ucacuccuggg

SEQ ID NO: 2204868 - RNA, 13 nt, Human
ucacuccuggggc

SEQ ID NO: 2204869 - RNA, 12 nt, Human
ucacuccugggg

SEQ ID NO: 2204870 - RNA, 23 nt, Human
ucacggcaggacaacgaggaagc

SEQ ID NO: 2204871 - RNA, 17 nt, Human
ucacgggacuauuucca

SEQ ID NO: 2204872 - RNA, 18 nt, Human
ucacgggcaguagcugug

SEQ ID NO: 2204873 - RNA, 19 nt, Human
ucacgggcaugggcacucc

SEQ ID NO: 2204874 - RNA, 22 nt, Human
ucacgggagauuucuuguugcu

SEQ ID NO: 2204875 - RNA, 18 nt, Human
ucacuccuaccugguaau

SEQ ID NO: 2204876 - RNA, 20 nt, Human
ucacuccuggggccucuugg

SEQ ID NO: 2204877 - RNA, 10 nt, Human
ucacuccugu

SEQ ID NO: 2204878 - RNA, 20 nt, Human
ucacuccuguuacuuaccua

SEQ ID NO: 2204879 - RNA, 13 nt, Human
ucacuccuugaaa

SEQ ID NO: 2204880 - RNA, 15 nt, Human
ucacucgcccccggg

SEQ ID NO: 2204881 - RNA, 14 nt, Human
ucacucggcacccu

SEQ ID NO: 2204882 - RNA, 17 nt, Human
ucacucggcacccugca

SEQ ID NO: 2204883 - RNA, 17 nt, Human
ucacggaagagccuugc

SEQ ID NO: 2204884 - RNA, 16 nt, Human
ucacggaagagccuug

SEQ ID NO: 2204885 - RNA, 14 nt, Human
ucacggaagagccu

SEQ ID NO: 2204886 - RNA, 16 nt, Human
ucacgcuuuccugaau

SEQ ID NO: 2204887 - RNA, 15 nt, Human
ucacgcuuuccugaa

SEQ ID NO: 2204888 - RNA, 14 nt, Human
ucacgcuuuccuga

SEQ ID NO: 2204889 - RNA, 14 nt, Human
ucacgcuucuucuu

SEQ ID NO: 2204890 - RNA, 22 nt, Human
ucacggcaggacaacgaggaag

SEQ ID NO: 2204891 - RNA, 16 nt, Human
ucacggaaguuuucaa

SEQ ID NO: 2204892 - RNA, 15 nt, Human
ucacggaaguuuuca

SEQ ID NO: 2204893 - RNA, 22 nt, Human
ucacgcuuuccugaauccaaac

SEQ ID NO: 2204894 - RNA, 17 nt, Human
ucacgcuuuccugaauc

SEQ ID NO: 2204895 - RNA, 13 nt, Human
ucacggcucacug

SEQ ID NO: 2204896 - RNA, 15 nt, Human
ucacggcucacugca

SEQ ID NO: 2204897 - RNA, 20 nt, Human
ucacggcucacugcagccuc

SEQ ID NO: 2204898 - RNA, 19 nt, Human
ucacucuacuuagcauguc

SEQ ID NO: 2204899 - RNA, 20 nt, Human
ucacucuacuuagcaugucc

SEQ ID NO: 2204900 - RNA, 12 nt, Human
ucacucuccuug

SEQ ID NO: 2204901 - RNA, 14 nt, Human
ucacucuccuuggu

SEQ ID NO: 2204902 - RNA, 15 nt, Human
ucacucucugaagau

SEQ ID NO: 2204903 - RNA, 23 nt, Human
ucacucuccuuggugucgggcau

SEQ ID NO: 2204904 - RNA, 12 nt, Human
ucacucuggcag

SEQ ID NO: 2204905 - RNA, 13 nt, Human
ucacucuggcagc

SEQ ID NO: 2204906 - RNA, 14 nt, Human
ucacucuggcagcu

SEQ ID NO: 2204907 - RNA, 15 nt, Human
ucacucuggcagcuc

SEQ ID NO: 2204908 - RNA, 16 nt, Human
ucacucuggcagcuca

SEQ ID NO: 2204909 - RNA, 17 nt, Human
ucacucuggcagcucag

SEQ ID NO: 2204910 - RNA, 18 nt, Human
ucacucuggcagcucaga

SEQ ID NO: 2204911 - RNA, 19 nt, Human
ucacucuggcagcucagag

SEQ ID NO: 2204912 - RNA, 20 nt, Human
ucacucuggcagcucagaga

SEQ ID NO: 2204913 - RNA, 22 nt, Human
ucacucuggcagcucagagagg

SEQ ID NO: 2204914 - RNA, 23 nt, Human
ucacagggacugaaaaccucucc

SEQ ID NO: 2204915 - RNA, 15 nt, Human
ucacagggcagagcc

SEQ ID NO: 2204916 - RNA, 20 nt, Human
ucacaggcgaggccuggagu

SEQ ID NO: 2204917 - RNA, 19 nt, Human
ucacagggcagagccggga

SEQ ID NO: 2204918 - RNA, 18 nt, Human
ucacagggcagagccggg

SEQ ID NO: 2204919 - RNA, 17 nt, Human
ucacagggccccagaag

SEQ ID NO: 2204920 - RNA, 16 nt, Human
ucacagggccccagaa

SEQ ID NO: 2204921 - RNA, 14 nt, Human
ucacagggccaacu

SEQ ID NO: 2204922 - RNA, 22 nt, Human
ucacagggccaacuugagggcc

SEQ ID NO: 2204923 - RNA, 20 nt, Human
ucacagggcaugccccggcc

SEQ ID NO: 2204924 - RNA, 12 nt, Human
ucacagggccaa

SEQ ID NO: 2204925 - RNA, 15 nt, Human
ucaccuagaaauuga

SEQ ID NO: 2204926 - RNA, 12 nt, Human
ucacaggcaggu

SEQ ID NO: 2204927 - RNA, 15 nt, Human
ucacaggcaggucca

SEQ ID NO: 2204928 - RNA, 19 nt, Human
ucacaggccccaggaaagg

SEQ ID NO: 2204929 - RNA, 18 nt, Human
ucacaggcgaggccugga

SEQ ID NO: 2204930 - RNA, 19 nt, Human
ucacaggcagguccagggu

SEQ ID NO: 2204931 - RNA, 18 nt, Human
ucaccucaggccaggugc

SEQ ID NO: 2204932 - RNA, 22 nt, Human
ucaccuucguuuacuaugccug

SEQ ID NO: 2204933 - RNA, 13 nt, Human
ucaccucaugccc

SEQ ID NO: 2204934 - RNA, 20 nt, Human
ucaccuauuuccauucaaca

SEQ ID NO: 2204935 - RNA, 14 nt, Human
ucaccuuucccauc

SEQ ID NO: 2204936 - RNA, 12 nt, Human
ucaccuuugucc

SEQ ID NO: 2204937 - RNA, 21 nt, Human
ucaccuugcaacacacagaca

SEQ ID NO: 2204938 - RNA, 19 nt, Human
ucaccuugcaacacacaga

SEQ ID NO: 2204939 - RNA, 18 nt, Human
ucaccuugcaacacacag

SEQ ID NO: 2204940 - RNA, 20 nt, Human
ucaccucaugcccacccccu

SEQ ID NO: 2204941 - RNA, 19 nt, Human
ucaccuuggcaccagacac

SEQ ID NO: 2204942 - RNA, 18 nt, Human
ucaccuuggcaccagaca

SEQ ID NO: 2204943 - RNA, 13 nt, Human
ucaccuuuauucu

SEQ ID NO: 2204944 - RNA, 23 nt, Human
ucaccuuggcaccagacacccag

SEQ ID NO: 2204945 - RNA, 20 nt, Human
ucacgccuguaauccuagca

SEQ ID NO: 2204946 - RNA, 16 nt, Human
ucacgccugugcagug

SEQ ID NO: 2204947 - RNA, 13 nt, Human
ucacgccugugca

SEQ ID NO: 2204948 - RNA, 21 nt, Human
ucacgccuguaaucccagcag

SEQ ID NO: 2204949 - RNA, 23 nt, Human
ucacgccuguaaucccagcacuu

SEQ ID NO: 2204950 - RNA, 12 nt, Human
ucacgcuccccg

SEQ ID NO: 2204951 - RNA, 16 nt, Human
ucacgcuccccgccug

SEQ ID NO: 2204952 - RNA, 21 nt, Human
ucacgcuccccgccuguuccc

SEQ ID NO: 2204953 - RNA, 21 nt, Human
ucacgccuaugaucccagcac

SEQ ID NO: 2204954 - RNA, 19 nt, Human
ucacgccuaugaucccagc

SEQ ID NO: 2204955 - RNA, 20 nt, Human
ucacgccuguaaucccagca

SEQ ID NO: 2204956 - RNA, 21 nt, Human
ucacgccuguaaucccagcac

SEQ ID NO: 2204957 - RNA, 19 nt, Human
ucacgccuguaaucccagc

SEQ ID NO: 2204958 - RNA, 19 nt, Human
ucacgccuguaauccuagc

SEQ ID NO: 2204959 - RNA, 22 nt, Human
ucacgccacugcacuccagccu

SEQ ID NO: 2204960 - RNA, 17 nt, Human
ucacgcaccucccaucc

SEQ ID NO: 2204961 - RNA, 16 nt, Human
ucacgccacugcacua

SEQ ID NO: 2204962 - RNA, 13 nt, Human
ucacgccacugca

SEQ ID NO: 2204963 - RNA, 14 nt, Human
ucacgccacugcac

SEQ ID NO: 2204964 - RNA, 22 nt, Human
ucaccuuuguccccaccgcaga

SEQ ID NO: 2204965 - RNA, 16 nt, Human
ucacgcaccucccauc

SEQ ID NO: 2204966 - RNA, 15 nt, Human
ucacgcaccucccau

SEQ ID NO: 2204967 - RNA, 14 nt, Human
ucacgcaccugggu

SEQ ID NO: 2204968 - RNA, 19 nt, Human
ucacgaauauuaugcccag

SEQ ID NO: 2204969 - RNA, 18 nt, Human
ucacgauugucaucagga

SEQ ID NO: 2204970 - RNA, 21 nt, Human
ucacgauugucaucaggagaa

SEQ ID NO: 2204971 - RNA, 20 nt, Human
ucacgaauauuaugcccagu

SEQ ID NO: 2204972 - RNA, 16 nt, Human
ucacgaaguguugcau

SEQ ID NO: 2204973 - RNA, 22 nt, Human
ucacgaaguguugcauggaugu

SEQ ID NO: 2204974 - RNA, 14 nt, Human
ucaccuuugucccc

SEQ ID NO: 2204975 - RNA, 15 nt, Human
ucaccuuugucccca

SEQ ID NO: 2204976 - RNA, 17 nt, Human
ucaccuuuguccccacc

SEQ ID NO: 2204977 - RNA, 18 nt, Human
ucaccuuuguccccaccg

SEQ ID NO: 2204978 - RNA, 16 nt, Human
ucaagcccgcggggac

SEQ ID NO: 2204979 - RNA, 19 nt, Human
ucaagcccaggaggacugc

SEQ ID NO: 2204980 - RNA, 16 nt, Human
ucaagccaagcagcca

SEQ ID NO: 2204981 - RNA, 15 nt, Human
ucaagccaagcagcc

SEQ ID NO: 2204982 - RNA, 13 nt, Human
ucaagcccugcag

SEQ ID NO: 2204983 - RNA, 14 nt, Human
ucaagccucugguc

SEQ ID NO: 2204984 - RNA, 12 nt, Human
ucaagcccugca

SEQ ID NO: 2204985 - RNA, 17 nt, Human
ucaagccaagcagccaa

SEQ ID NO: 2204986 - RNA, 14 nt, Human
ucaagccaagcagc

SEQ ID NO: 2204987 - RNA, 20 nt, Human
ucaagcagucuacccaccuc

SEQ ID NO: 2204988 - RNA, 19 nt, Human
ucaagcagucuacccaccu

SEQ ID NO: 2204989 - RNA, 23 nt, Human
ucaagcagucgugccugugucca

SEQ ID NO: 2204990 - RNA, 19 nt, Human
ucaagcagucgugccugug

SEQ ID NO: 2204991 - RNA, 20 nt, Human
ucaagcagucgugccugugu

SEQ ID NO: 2204992 - RNA, 21 nt, Human
ucaagcagucgugccuguguc

SEQ ID NO: 2204993 - RNA, 22 nt, Human
ucaagcagucgugccugugucc

SEQ ID NO: 2204994 - RNA, 14 nt, Human
ucaagccugccuag

SEQ ID NO: 2204995 - RNA, 15 nt, Human
ucaagcgauucuucu

SEQ ID NO: 2204996 - RNA, 15 nt, Human
ucaagcgauucuccu

SEQ ID NO: 2204997 - RNA, 16 nt, Human
ucaagcgauucuucug

SEQ ID NO: 2204998 - RNA, 16 nt, Human
ucaagcuagaaggcca

SEQ ID NO: 2204999 - RNA, 18 nt, Human
ucaagcuagaaggccaca

SEQ ID NO: 2205000 - RNA, 19 nt, Human
ucaagcuagaaggccacau

SEQ ID NO: 2205001 - RNA, 17 nt, Human
ucaagcgauucuucugc

SEQ ID NO: 2205002 - RNA, 21 nt, Human
ucaagcugugagacaguggga

SEQ ID NO: 2205003 - RNA, 20 nt, Human
ucaaggauccugagccagau

SEQ ID NO: 2205004 - RNA, 22 nt, Human
ucaagugcaugcucucugcagc

SEQ ID NO: 2205005 - RNA, 21 nt, Human
ucaagugcaugcucucugcag

SEQ ID NO: 2205006 - RNA, 20 nt, Human
ucaagugcaugcucucugca

SEQ ID NO: 2205007 - RNA, 19 nt, Human
ucaagugcaugcucucugc

SEQ ID NO: 2205008 - RNA, 22 nt, Human
ucaagugauucuccugccucag

SEQ ID NO: 2205009 - RNA, 18 nt, Human
ucaaggauccugagccag

SEQ ID NO: 2205010 - RNA, 19 nt, Human
ucaaggauccugagccaga

SEQ ID NO: 2205011 - RNA, 20 nt, Human
ucaagcuagaaggccacaug

SEQ ID NO: 2205012 - RNA, 14 nt, Human
ucaagcuccuccuc

SEQ ID NO: 2205013 - RNA, 13 nt, Human
ucaagcuccuccu

SEQ ID NO: 2205014 - RNA, 20 nt, Human
ucaagcuccuccucccugca

SEQ ID NO: 2205015 - RNA, 18 nt, Human
ucaagcuccuccucccug

SEQ ID NO: 2205016 - RNA, 16 nt, Human
ucaagcuccuccuccc

SEQ ID NO: 2205017 - RNA, 15 nt, Human
ucaagcuccuccucc

SEQ ID NO: 2205018 - RNA, 15 nt, Human
ucaacguauuguuuc

SEQ ID NO: 2205019 - RNA, 20 nt, Human
ucaacuaaaaaaaaaaaagu

SEQ ID NO: 2205020 - RNA, 19 nt, Human
ucaacuaaaaaaaaaaaag

SEQ ID NO: 2205021 - RNA, 12 nt, Human
ucaaccuccugg

SEQ ID NO: 2205022 - RNA, 23 nt, Human
ucaacgcuuaaaggugucuuccu

SEQ ID NO: 2205023 - RNA, 20 nt, Human
ucaaccuacuuucauacuga

SEQ ID NO: 2205024 - RNA, 13 nt, Human
ucaaccuccugga

SEQ ID NO: 2205025 - RNA, 13 nt, Human
ucaaccuccuggg

SEQ ID NO: 2205026 - RNA, 14 nt, Human
ucaaccuccugggc

SEQ ID NO: 2205027 - RNA, 19 nt, Human
ucaacucaccuaauguuua

SEQ ID NO: 2205028 - RNA, 16 nt, Human
ucaacucagacuaguu

SEQ ID NO: 2205029 - RNA, 20 nt, Human
ucaacucagacuaguuuagu

SEQ ID NO: 2205030 - RNA, 19 nt, Human
ucaacucauaagacuuugg

SEQ ID NO: 2205031 - RNA, 23 nt, Human
ucaagcagcgaccgcccccuccu

SEQ ID NO: 2205032 - RNA, 15 nt, Human
ucaacucauggagau

SEQ ID NO: 2205033 - RNA, 16 nt, Human
ucaagcagucgugccu

SEQ ID NO: 2205034 - RNA, 17 nt, Human
ucaagcagucgugccug

SEQ ID NO: 2205035 - RNA, 18 nt, Human
ucaagcagucgugccugu

SEQ ID NO: 2205036 - RNA, 16 nt, Human
ucaacucaccuaaugu

SEQ ID NO: 2205037 - RNA, 19 nt, Human
ucaacuccaaacugacucu

SEQ ID NO: 2205038 - RNA, 18 nt, Human
ucaacccuuuugucugcc

SEQ ID NO: 2205039 - RNA, 20 nt, Human
ucaacccuuuugucugccuc

SEQ ID NO: 2205040 - RNA, 21 nt, Human
ucaacccuuuugucugccucu

SEQ ID NO: 2205041 - RNA, 13 nt, Human
ucaaccuaaccac

SEQ ID NO: 2205042 - RNA, 15 nt, Human
ucaaccuaccacccc

SEQ ID NO: 2205043 - RNA, 18 nt, Human
ucaaccuaccaccccuuc

SEQ ID NO: 2205044 - RNA, 20 nt, Human
ucaaccuaccaccccuuccu

SEQ ID NO: 2205045 - RNA, 21 nt, Human
ucaaccuaccaccccuuccug

SEQ ID NO: 2205046 - RNA, 22 nt, Human
ucaaccuaccaccccuuccugu

SEQ ID NO: 2205047 - RNA, 23 nt, Human
ucaaccuaccaccccuuccuguc

SEQ ID NO: 2205048 - RNA, 16 nt, Human
ucaaacuuuacuaugg

SEQ ID NO: 2205049 - RNA, 15 nt, Human
ucaaacugaggaauu

SEQ ID NO: 2205050 - RNA, 23 nt, Human
ucaaacugaaugaaacccccaca

SEQ ID NO: 2205051 - RNA, 22 nt, Human
ucaaacucuugaccucagguga

SEQ ID NO: 2205052 - RNA, 16 nt, Human
ucaaacugaagccaga

SEQ ID NO: 2205053 - RNA, 13 nt, Human
ucaaacuuuacua

SEQ ID NO: 2205054 - RNA, 15 nt, Human
ucaaacuuuacuaug

SEQ ID NO: 2205055 - RNA, 23 nt, Human
ucacacagugggugguggaucug

SEQ ID NO: 2205056 - RNA, 21 nt, Human
ucacacaugagcaucaggcca

SEQ ID NO: 2205057 - RNA, 22 nt, Human
ucacacagugagucgaggacag

SEQ ID NO: 2205058 - RNA, 23 nt, Human
ucacacagugagucgaggacagg

SEQ ID NO: 2205059 - RNA, 11 nt, Human
ucacaggcagg

SEQ ID NO: 2205060 - RNA, 23 nt, Human
ucacaggacagcccuucuuucca

SEQ ID NO: 2205061 - RNA, 19 nt, Human
ucacaggaaguagaggagg

SEQ ID NO: 2205062 - RNA, 14 nt, Human
ucacaggaaguaga

SEQ ID NO: 2205063 - RNA, 19 nt, Human
ucacacaauacaauaaguu

SEQ ID NO: 2205064 - RNA, 10 nt, Human
ucacacacac

SEQ ID NO: 2205065 - RNA, 23 nt, Human
ucacaaugaaaugcucuccuuuc

SEQ ID NO: 2205066 - RNA, 16 nt, Human
ucacaauagaaacuca

SEQ ID NO: 2205067 - RNA, 21 nt, Human
ucacacaguauuacuucugcu

SEQ ID NO: 2205068 - RNA, 22 nt, Human
ucacacaguauuacuucugcua

SEQ ID NO: 2205069 - RNA, 13 nt, Human
ucacacagugagu

SEQ ID NO: 2205070 - RNA, 20 nt, Human
ucacaauaaaaauggcucag

SEQ ID NO: 2205071 - RNA, 20 nt, Human
ucacaaguuguguuugauau

SEQ ID NO: 2205072 - RNA, 19 nt, Human
ucaauuacaggaaguacug

SEQ ID NO: 2205073 - RNA, 13 nt, Human
ucacaauacuguu

SEQ ID NO: 2205074 - RNA, 15 nt, Human
ucacaauaauuuucu

SEQ ID NO: 2205075 - RNA, 16 nt, Human
ucacaauaauuuucua

SEQ ID NO: 2205076 - RNA, 14 nt, Human
ucacaauagaaacu

SEQ ID NO: 2205077 - RNA, 22 nt, Human
ucacaaugaaaugcucuccuuu

SEQ ID NO: 2205078 - RNA, 17 nt, Human
ucaaugguuugcaagga

SEQ ID NO: 2205079 - RNA, 19 nt, Human
ucaaugguuuaacauauaa

SEQ ID NO: 2205080 - RNA, 11 nt, Human
ucaauuaauaa

SEQ ID NO: 2205081 - RNA, 16 nt, Human
ucaauuaaauguaggu

SEQ ID NO: 2205082 - RNA, 14 nt, Human
ucaaugggcaauga

SEQ ID NO: 2205083 - RNA, 18 nt, Human
ucaauggcgcagugccuc

SEQ ID NO: 2205084 - RNA, 22 nt, Human
ucaauggcugcugaagcugccu

SEQ ID NO: 2205085 - RNA, 12 nt, Human
ucaauggcuuuu

SEQ ID NO: 2205086 - RNA, 14 nt, Human
ucaaugggaaauac

SEQ ID NO: 2205087 - RNA, 22 nt, Human
ucaaugggaaauacuacuccug

SEQ ID NO: 2205088 - RNA, 17 nt, Human
ucaaugggcaaugacag

SEQ ID NO: 2205089 - RNA, 13 nt, Human
ucaauuacaggaa

SEQ ID NO: 2205090 - RNA, 18 nt, Human
ucaauuacaggaaguacu

SEQ ID NO: 2205091 - RNA, 18 nt, Human
ucaaugcacugacauugu

SEQ ID NO: 2205092 - RNA, 17 nt, Human
ucaaugcuauaacuaug

SEQ ID NO: 2205093 - RNA, 14 nt, Human
ucaaugcucauaac

SEQ ID NO: 2205094 - RNA, 20 nt, Human
ucaauggauuugaugcuguu

SEQ ID NO: 2205095 - RNA, 12 nt, Human
ucaaugcucaua

SEQ ID NO: 2205096 - RNA, 13 nt, Human
ucaaugcucauaa

SEQ ID NO: 2205097 - RNA, 13 nt, Human
ucaaugcagccag

SEQ ID NO: 2205098 - RNA, 15 nt, Human
ucaaugcagccagac

SEQ ID NO: 2205099 - RNA, 19 nt, Human
ucaaugcagccagaccuau

SEQ ID NO: 2205100 - RNA, 20 nt, Human
ucaauacaguacaggcagca

SEQ ID NO: 2205101 - RNA, 19 nt, Human
ucaauacaguacaggcagc

SEQ ID NO: 2205102 - RNA, 18 nt, Human
ucaauacaguacaggcag

SEQ ID NO: 2205103 - RNA, 17 nt, Human
ucaauacaguacaggca

SEQ ID NO: 2205104 - RNA, 13 nt, Human
ucaauaggaaaaa

SEQ ID NO: 2205105 - RNA, 14 nt, Human
ucaaguuaaaguga

SEQ ID NO: 2205106 - RNA, 21 nt, Human
ucaagugucucaguccaccug

SEQ ID NO: 2205107 - RNA, 16 nt, Human
ucaagugucucagucc

SEQ ID NO: 2205108 - RNA, 15 nt, Human
ucaagugucauaugu

SEQ ID NO: 2205109 - RNA, 15 nt, Human
ucaaguuagcucagg

SEQ ID NO: 2205110 - RNA, 21 nt, Human
ucaaguuauugacaaacucuc

SEQ ID NO: 2205111 - RNA, 18 nt, Human
ucaagugggaucugucac

SEQ ID NO: 2205112 - RNA, 16 nt, Human
ucaaguggggcucgcc

SEQ ID NO: 2205113 - RNA, 18 nt, Human
ucaaguggggcucgccau

SEQ ID NO: 2205114 - RNA, 23 nt, Human
ucaagugcccucuccgagcuggu

SEQ ID NO: 2205115 - RNA, 12 nt, Human
ucaagugccuua

SEQ ID NO: 2205116 - RNA, 14 nt, Human
ucaaugcacugaca

SEQ ID NO: 2205117 - RNA, 13 nt, Human
ucaaugaucuagg

SEQ ID NO: 2205118 - RNA, 15 nt, Human
ucaaugaucuagguu

SEQ ID NO: 2205119 - RNA, 17 nt, Human
ucaaugaucuagguuua

SEQ ID NO: 2205120 - RNA, 19 nt, Human
ucaaugaucuagguuuaac

SEQ ID NO: 2205121 - RNA, 21 nt, Human
ucaaugaucuagguuuaacuc

SEQ ID NO: 2205122 - RNA, 22 nt, Human
ucaaugaucuagguuuaacuca

SEQ ID NO: 2205123 - RNA, 12 nt, Human
ucaaugaucuag

SEQ ID NO: 2205124 - RNA, 14 nt, Human
ucaauaggaaaaac

SEQ ID NO: 2205125 - RNA, 23 nt, Human
uauuuauuaaaugcccagccccu

SEQ ID NO: 2205126 - RNA, 18 nt, Human
uaucugacaucucugcaa

SEQ ID NO: 2205127 - RNA, 20 nt, Human
uaucugaaaauguaugugua

SEQ ID NO: 2205128 - RNA, 23 nt, Human
uaucucuuuugaauccaugcuug

SEQ ID NO: 2205129 - RNA, 21 nt, Human
uaucugaaggagauuuuccuu

SEQ ID NO: 2205130 - RNA, 15 nt, Human
uaucugaaaauguau

SEQ ID NO: 2205131 - RNA, 14 nt, Human
uaucugaaaaugua

SEQ ID NO: 2205132 - RNA, 15 nt, Human
uauuuauuaccucug

SEQ ID NO: 2205133 - RNA, 16 nt, Human
uauuuauuaccucuga

SEQ ID NO: 2205134 - RNA, 13 nt, Human
uauuuauuacugu

SEQ ID NO: 2205135 - RNA, 13 nt, Human
uauuuauuaccuc

SEQ ID NO: 2205136 - RNA, 13 nt, Human
uauuuauuaagau

SEQ ID NO: 2205137 - RNA, 24 nt, Human
uauuuauucagcuucauuuguguc

SEQ ID NO: 2205138 - RNA, 20 nt, Human
uauuuauuccauauucaugu

SEQ ID NO: 2205139 - RNA, 14 nt, Human
uauuuauuacuaug

SEQ ID NO: 2205140 - RNA, 22 nt, Human
uauuuauuguuuauuuaucagu

SEQ ID NO: 2205141 - RNA, 13 nt, Human
uauuuauuuaaaa

SEQ ID NO: 2205142 - RNA, 11 nt, Human
uauuuauuuaa

SEQ ID NO: 2205143 - RNA, 15 nt, Human
uauuuauuuaaaaga

SEQ ID NO: 2205144 - RNA, 16 nt, Human
uauuuauuuaaaagau

SEQ ID NO: 2205145 - RNA, 16 nt, Human
uauuucuaugagaaaa

SEQ ID NO: 2205146 - RNA, 22 nt, Human
uauuucuaugaaauauuauguu

SEQ ID NO: 2205147 - RNA, 16 nt, Human
uauuuauuguuuauuu

SEQ ID NO: 2205148 - RNA, 13 nt, Human
uauuuauugcuuu

SEQ ID NO: 2205149 - RNA, 14 nt, Human
uauuuauugcuuua

SEQ ID NO: 2205150 - RNA, 21 nt, Human
uauuucuaugaaauauuaugu

SEQ ID NO: 2205151 - RNA, 19 nt, Human
uauuucucugauuugcaaa

SEQ ID NO: 2205152 - RNA, 11 nt, Human
uauuucugaga

SEQ ID NO: 2205153 - RNA, 21 nt, Human
uauuucugagaagguccuuaa

SEQ ID NO: 2205154 - RNA, 16 nt, Human
uauuucugagaagguc

SEQ ID NO: 2205155 - RNA, 22 nt, Human
uauuucucagacuuuggaaaau

SEQ ID NO: 2205156 - RNA, 21 nt, Human
uauuucucaacaaagcacagu

SEQ ID NO: 2205157 - RNA, 18 nt, Human
uauuucuauuuccuggaa

SEQ ID NO: 2205158 - RNA, 19 nt, Human
uauuucucaacaaagcaca

SEQ ID NO: 2205159 - RNA, 20 nt, Human
uauuucuuaaacaaauguau

SEQ ID NO: 2205160 - RNA, 22 nt, Human
uauuucugcugaauuuucacau

SEQ ID NO: 2205161 - RNA, 17 nt, Human
uauuucugcauauguug

SEQ ID NO: 2205162 - RNA, 13 nt, Human
uauuucugcugaa

SEQ ID NO: 2205163 - RNA, 19 nt, Human
uauuuauuuaaaagauuca

SEQ ID NO: 2205164 - RNA, 16 nt, Human
uauuucugcugaauuu

SEQ ID NO: 2205165 - RNA, 14 nt, Human
uauuugagaauaua

SEQ ID NO: 2205166 - RNA, 23 nt, Human
uauuucuuacaggcacaaaauga

SEQ ID NO: 2205167 - RNA, 16 nt, Human
uauuucuuauauaugu

SEQ ID NO: 2205168 - RNA, 19 nt, Human
uauuucuuaaaucuaguaa

SEQ ID NO: 2205169 - RNA, 21 nt, Human
uauuucugcugaauuuucaca

SEQ ID NO: 2205170 - RNA, 15 nt, Human
uauuugagaguucua

SEQ ID NO: 2205171 - RNA, 16 nt, Human
uauuugagaguucuaa

SEQ ID NO: 2205172 - RNA, 16 nt, Human
uauuugagacuaguuu

SEQ ID NO: 2205173 - RNA, 19 nt, Human
uauuucuuauauaugugaa

SEQ ID NO: 2205174 - RNA, 18 nt, Human
uauuugagaguucuaaau

SEQ ID NO: 2205175 - RNA, 19 nt, Human
uauuugagaguucuaaauu

SEQ ID NO: 2205176 - RNA, 18 nt, Human
uauuuuaggcagggauuu

SEQ ID NO: 2205177 - RNA, 13 nt, Human
uauuuuacuuuua

SEQ ID NO: 2205178 - RNA, 23 nt, Human
uauuugggccugcuccagaccug

SEQ ID NO: 2205179 - RNA, 14 nt, Human
uauuuuacuuuuau

SEQ ID NO: 2205180 - RNA, 21 nt, Human
uauuuuaggcagggauuugag

SEQ ID NO: 2205181 - RNA, 22 nt, Human
uauuuuaggcagggauuugagg

SEQ ID NO: 2205182 - RNA, 14 nt, Human
uauuuuaguuucug

SEQ ID NO: 2205183 - RNA, 16 nt, Human
uauuuuaguuucuguu

SEQ ID NO: 2205184 - RNA, 18 nt, Human
uauuuuaguuucuguucu

SEQ ID NO: 2205185 - RNA, 20 nt, Human
uauuuuaguuucuguucugu

SEQ ID NO: 2205186 - RNA, 21 nt, Human
uauuuuaguuucuguucugug

SEQ ID NO: 2205187 - RNA, 14 nt, Human
uauuuggaauuuau

SEQ ID NO: 2205188 - RNA, 15 nt, Human
uauuugcuuuuugcu

SEQ ID NO: 2205189 - RNA, 11 nt, Human
uauuuggaauu

SEQ ID NO: 2205190 - RNA, 11 nt, Human
uauuugcuuuu

SEQ ID NO: 2205191 - RNA, 20 nt, Human
uauuuggaauuuauauacaa

SEQ ID NO: 2205192 - RNA, 21 nt, Human
uauuuggaauuuauauacaac

SEQ ID NO: 2205193 - RNA, 14 nt, Human
uauuugggaaguga

SEQ ID NO: 2205194 - RNA, 15 nt, Human
uauuugggaagugaa

SEQ ID NO: 2205195 - RNA, 20 nt, Human
uauuuuuguuucuuccaaag

SEQ ID NO: 2205196 - RNA, 13 nt, Human
uauuuuuuaagua

SEQ ID NO: 2205197 - RNA, 13 nt, Human
uauuuuuuauugu

SEQ ID NO: 2205198 - RNA, 17 nt, Human
uauuuuuuauuguuuuc

SEQ ID NO: 2205199 - RNA, 12 nt, Human
uauuuuuucaga

SEQ ID NO: 2205200 - RNA, 16 nt, Human
uauuuuuuauauauac

SEQ ID NO: 2205201 - RNA, 21 nt, Human
uauuuuuuaaguauuuauaua

SEQ ID NO: 2205202 - RNA, 15 nt, Human
uauuuuuuaaguauu

SEQ ID NO: 2205203 - RNA, 15 nt, Human
uauuuuuuaauuauu

SEQ ID NO: 2205204 - RNA, 12 nt, Human
uauuuuuuaauu

SEQ ID NO: 2205205 - RNA, 14 nt, Human
uauuuucuuugaaa

SEQ ID NO: 2205206 - RNA, 14 nt, Human
uauuuucuuuaaug

SEQ ID NO: 2205207 - RNA, 21 nt, Human
uauuuucaugacuuuuccaug

SEQ ID NO: 2205208 - RNA, 14 nt, Human
uauuuucuguucua

SEQ ID NO: 2205209 - RNA, 16 nt, Human
uauuuucuuuuguaaa

SEQ ID NO: 2205210 - RNA, 16 nt, Human
uauuuugaaugugaag

SEQ ID NO: 2205211 - RNA, 23 nt, Human
uauuuugaaucaauaauauauuu

SEQ ID NO: 2205212 - RNA, 16 nt, Human
uauuuugaaucaauaa

SEQ ID NO: 2205213 - RNA, 22 nt, Human
uauuuugaaucaauaauauauu

SEQ ID NO: 2205214 - RNA, 12 nt, Human
uauuuugaauca

SEQ ID NO: 2205215 - RNA, 13 nt, Human
uauuuugaaucaa

SEQ ID NO: 2205216 - RNA, 15 nt, Human
uauuuugaaucaaua

SEQ ID NO: 2205217 - RNA, 16 nt, Human
uauuuuauacauuaac

SEQ ID NO: 2205218 - RNA, 23 nt, Human
uauuuuaucuuugauucuccuuc

SEQ ID NO: 2205219 - RNA, 15 nt, Human
uauuuuauccucugg

SEQ ID NO: 2205220 - RNA, 14 nt, Human
uauuuuaugcaaau

SEQ ID NO: 2205221 - RNA, 15 nt, Human
uauuuuauguugcau

SEQ ID NO: 2205222 - RNA, 16 nt, Human
uauuuuauguugcaua

SEQ ID NO: 2205223 - RNA, 14 nt, Human
uauuuucaccauuu

SEQ ID NO: 2205224 - RNA, 13 nt, Human
uauuuucaccauu

SEQ ID NO: 2205225 - RNA, 21 nt, Human
uauuuucaaggcccucagcau

SEQ ID NO: 2205226 - RNA, 17 nt, Human
uauuuucaguauuuugg

SEQ ID NO: 2205227 - RNA, 18 nt, Human
uauuuucauacagcauua

SEQ ID NO: 2205228 - RNA, 16 nt, Human
uauuuucaagaaacug

SEQ ID NO: 2205229 - RNA, 13 nt, Human
uauuuucaagaaa

SEQ ID NO: 2205230 - RNA, 21 nt, Human
uauuuucaacgcagcccugcu

SEQ ID NO: 2205231 - RNA, 22 nt, Human
ucaaaccuguuuaaauauuuca

SEQ ID NO: 2205232 - RNA, 14 nt, Human
ucaaacucuuaaaa

SEQ ID NO: 2205233 - RNA, 15 nt, Human
ucaaacgugaaaaug

SEQ ID NO: 2205234 - RNA, 16 nt, Human
ucaaacgugaaaaugc

SEQ ID NO: 2205235 - RNA, 18 nt, Human
ucaaaccuguuuaaauau

SEQ ID NO: 2205236 - RNA, 19 nt, Human
ucaaaccuguuuaaauauu

SEQ ID NO: 2205237 - RNA, 18 nt, Human
ucaaaacggggcagccaa

SEQ ID NO: 2205238 - RNA, 15 nt, Human
ucaaaaccuuuugaa

SEQ ID NO: 2205239 - RNA, 16 nt, Human
ucaaaacuacaaauca

SEQ ID NO: 2205240 - RNA, 20 nt, Human
ucaaaaccuuucaaauauca

SEQ ID NO: 2205241 - RNA, 14 nt, Human
ucaaaacucaaaug

SEQ ID NO: 2205242 - RNA, 22 nt, Human
ucaaaacgguuuuacugcagcu

SEQ ID NO: 2205243 - RNA, 18 nt, Human
ucaaaacucauuuccuau

SEQ ID NO: 2205244 - RNA, 15 nt, Human
ucaaaacucaaaugc

SEQ ID NO: 2205245 - RNA, 17 nt, Human
ucaaaccuguuuaaaua

SEQ ID NO: 2205246 - RNA, 23 nt, Human
ucaaacggccucacuaggcuucu

SEQ ID NO: 2205247 - RNA, 13 nt, Human
ucaaaacugcacu

SEQ ID NO: 2205248 - RNA, 15 nt, Human
ucaaaaacauucuua

SEQ ID NO: 2205249 - RNA, 23 nt, Human
ucaaaaacacaguguuuuuguaa

SEQ ID NO: 2205250 - RNA, 13 nt, Human
ucaaaaacuguau

SEQ ID NO: 2205251 - RNA, 23 nt, Human
uauuuuuuucuaccuugaggucu

SEQ ID NO: 2205252 - RNA, 17 nt, Human
ucaaaaacuuuggaguc

SEQ ID NO: 2205253 - RNA, 22 nt, Human
ucaaaaacuuuggaguccccuc

SEQ ID NO: 2205254 - RNA, 23 nt, Human
ucaaaaagucuacgcucuccuuu

SEQ ID NO: 2205255 - RNA, 12 nt, Human
ucaaaaaguguu

SEQ ID NO: 2205256 - RNA, 14 nt, Human
ucaaaaaguguuua

SEQ ID NO: 2205257 - RNA, 15 nt, Human
ucaaaaaguguuuau

SEQ ID NO: 2205258 - RNA, 19 nt, Human
ucaaaacccaucugggcuc

SEQ ID NO: 2205259 - RNA, 23 nt, Human
ucaaaaaguguuuauuuuucaua

SEQ ID NO: 2205260 - RNA, 19 nt, Human
ucaaaaaguguuuauuuuu

SEQ ID NO: 2205261 - RNA, 13 nt, Human
ucaaaaauauaac

SEQ ID NO: 2205262 - RNA, 15 nt, Human
uauuuuuuucuaccu

SEQ ID NO: 2205263 - RNA, 14 nt, Human
uauuuuuuucuacc

SEQ ID NO: 2205264 - RNA, 13 nt, Human
uauuuuuucagac

SEQ ID NO: 2205265 - RNA, 14 nt, Human
uauuuuuucagacc

SEQ ID NO: 2205266 - RNA, 15 nt, Human
uauuuuuuuacuaau

SEQ ID NO: 2205267 - RNA, 13 nt, Human
ucaaaaaaugagc

SEQ ID NO: 2205268 - RNA, 13 nt, Human
uauuuuuuucuga

SEQ ID NO: 2205269 - RNA, 14 nt, Human
guuuccuucagugc

SEQ ID NO: 2205270 - RNA, 23 nt, Human
guuuccuuucauuuacuguggcu

SEQ ID NO: 2205271 - RNA, 17 nt, Human
guuuccuuucauuuacu

SEQ ID NO: 2205272 - RNA, 20 nt, Human
guuuccuuucauuuacugug

SEQ ID NO: 2205273 - RNA, 20 nt, Human
guuucgugaaguauacugua

SEQ ID NO: 2205274 - RNA, 15 nt, Human
guuucguggggaggu

SEQ ID NO: 2205275 - RNA, 18 nt, Human
guuucgaaguugaugcaa

SEQ ID NO: 2205276 - RNA, 13 nt, Human
guuucgagaagcu

SEQ ID NO: 2205277 - RNA, 21 nt, Human
guuucgagaagcugcucugga

SEQ ID NO: 2205278 - RNA, 23 nt, Human
guuucguggggaggucuaaucua

SEQ ID NO: 2205279 - RNA, 17 nt, Human
guuucgagaagcugcuc

SEQ ID NO: 2205280 - RNA, 14 nt, Human
guuucguuucugua

SEQ ID NO: 2205281 - RNA, 15 nt, Human
guuucguuucuguau

SEQ ID NO: 2205282 - RNA, 16 nt, Human
guuucguuucuguaua

SEQ ID NO: 2205283 - RNA, 20 nt, Human
guuucuaaagcugccagccg

SEQ ID NO: 2205284 - RNA, 19 nt, Human
guuucuuuccugccuucuu

SEQ ID NO: 2205285 - RNA, 21 nt, Human
guuucuuuccugccuucuucu

SEQ ID NO: 2205286 - RNA, 18 nt, Human
guuucuuucuaguggucu

SEQ ID NO: 2205287 - RNA, 16 nt, Human
guuucuaaagcugcca

SEQ ID NO: 2205288 - RNA, 14 nt, Human
guuucuaaagcugc

SEQ ID NO: 2205289 - RNA, 15 nt, Human
guuucuaaagcugcc

SEQ ID NO: 2205290 - RNA, 13 nt, Human
guuugaauauaaa

SEQ ID NO: 2205291 - RNA, 17 nt, Human
guuugaaggaaacaguu

SEQ ID NO: 2205292 - RNA, 17 nt, Human
guuugaaggaggugagg

SEQ ID NO: 2205293 - RNA, 19 nt, Human
guuugaauauaaacacuau

SEQ ID NO: 2205294 - RNA, 17 nt, Human
guuugaauauaaacacu

SEQ ID NO: 2205295 - RNA, 14 nt, Human
guuugaauguuaaa

SEQ ID NO: 2205296 - RNA, 12 nt, Human
guuugaacuuca

SEQ ID NO: 2205297 - RNA, 15 nt, Human
guuugaagccugccc

SEQ ID NO: 2205298 - RNA, 21 nt, Human
guuugaagccugcccuugucu

SEQ ID NO: 2205299 - RNA, 14 nt, Human
guuugaagccugga

SEQ ID NO: 2205300 - RNA, 15 nt, Human
guuugaaggaaacag

SEQ ID NO: 2205301 - RNA, 16 nt, Human
guuugaaggaaacagu

SEQ ID NO: 2205302 - RNA, 16 nt, Human
guuugaaccaagaacu

SEQ ID NO: 2205303 - RNA, 17 nt, Human
guuucuuuguaaugaaa

SEQ ID NO: 2205304 - RNA, 23 nt, Human
guuucuuucuaguggucuuugua

SEQ ID NO: 2205305 - RNA, 14 nt, Human
guuucuuuguaaug

SEQ ID NO: 2205306 - RNA, 17 nt, Human
guuugagauggacacac

SEQ ID NO: 2205307 - RNA, 16 nt, Human
guuugagcucagaccc

SEQ ID NO: 2205308 - RNA, 20 nt, Human
guuugagcucugcagcccag

SEQ ID NO: 2205309 - RNA, 15 nt, Human
guuugagcucagacc

SEQ ID NO: 2205310 - RNA, 13 nt, Human
guuugagcucaga

SEQ ID NO: 2205311 - RNA, 23 nt, Human
guuugaggauauauuuucacuuu

SEQ ID NO: 2205312 - RNA, 18 nt, Human
guuugagcugccuucccu

SEQ ID NO: 2205313 - RNA, 23 nt, Human
guuugagcucugcagcccaggga

SEQ ID NO: 2205314 - RNA, 13 nt, Human
guuugagcugccu

SEQ ID NO: 2205315 - RNA, 14 nt, Human
guuugagcugccuu

SEQ ID NO: 2205316 - RNA, 15 nt, Human
guuugagcugccuuc

SEQ ID NO: 2205317 - RNA, 16 nt, Human
guuugaggcugcagcg

SEQ ID NO: 2205318 - RNA, 16 nt, Human
guuugagguuuuuaag

SEQ ID NO: 2205319 - RNA, 19 nt, Human
guuugagguuuuuaagccu

SEQ ID NO: 2205320 - RNA, 14 nt, Human
guuugguucugggg

SEQ ID NO: 2205321 - RNA, 20 nt, Human
guuugaugcauuaaaagaaa

SEQ ID NO: 2205322 - RNA, 22 nt, Human
guuugauuaaauucuugcaaag

SEQ ID NO: 2205323 - RNA, 19 nt, Human
guuugauuaaauucuugca

SEQ ID NO: 2205324 - RNA, 17 nt, Human
guuugauuaaauucuug

SEQ ID NO: 2205325 - RNA, 18 nt, Human
guuugucugucuucauag

SEQ ID NO: 2205326 - RNA, 15 nt, Human
guuugucugucuuca

SEQ ID NO: 2205327 - RNA, 15 nt, Human
guuugucuucucccc

SEQ ID NO: 2205328 - RNA, 16 nt, Human
guuugucuucucccca

SEQ ID NO: 2205329 - RNA, 17 nt, Human
guuugucuucuccccag

SEQ ID NO: 2205330 - RNA, 14 nt, Human
guuuguggccucag

SEQ ID NO: 2205331 - RNA, 13 nt, Human
guuuguggccuca

SEQ ID NO: 2205332 - RNA, 18 nt, Human
guuuguuccccaagacau

SEQ ID NO: 2205333 - RNA, 12 nt, Human
guuuguggccuc

SEQ ID NO: 2205334 - RNA, 13 nt, Human
guuugugcuucua

SEQ ID NO: 2205335 - RNA, 19 nt, Human
guuuguggaaaaugaaaau

SEQ ID NO: 2205336 - RNA, 17 nt, Human
guuuguaaauuaacuuu

SEQ ID NO: 2205337 - RNA, 13 nt, Human
guuuguaaaacua

SEQ ID NO: 2205338 - RNA, 19 nt, Human
guuuguaaauuaacuuuua

SEQ ID NO: 2205339 - RNA, 23 nt, Human
guuuagcagcagccuuuaaugca

SEQ ID NO: 2205340 - RNA, 20 nt, Human
guuuaggauguugaaaaagu

SEQ ID NO: 2205341 - RNA, 17 nt, Human
guuuacuuuucagggca

SEQ ID NO: 2205342 - RNA, 19 nt, Human
guuuacuuuucagggcauc

SEQ ID NO: 2205343 - RNA, 17 nt, Human
guuuagcagcagccuuu

SEQ ID NO: 2205344 - RNA, 12 nt, Human
guuuagcaaaua

SEQ ID NO: 2205345 - RNA, 16 nt, Human
guuuaguaaucauauu

SEQ ID NO: 2205346 - RNA, 21 nt, Human
guuuaggcugguggcccagga

SEQ ID NO: 2205347 - RNA, 16 nt, Human
guuuaguaaggcugug

SEQ ID NO: 2205348 - RNA, 18 nt, Human
guuuaggcugguggccca

SEQ ID NO: 2205349 - RNA, 16 nt, Human
guuuacuuaaagauuu

SEQ ID NO: 2205350 - RNA, 22 nt, Human
guuuacuuaaagauuuaucaaa

SEQ ID NO: 2205351 - RNA, 18 nt, Human
guuuacuuaucuuaugcc

SEQ ID NO: 2205352 - RNA, 14 nt, Human
guuuacuuaaagau

SEQ ID NO: 2205353 - RNA, 19 nt, Human
gguugggagaaugucagua

SEQ ID NO: 2205354 - RNA, 17 nt, Human
guuuagaaagcuugccc

SEQ ID NO: 2205355 - RNA, 13 nt, Human
guuuagaaagcuu

SEQ ID NO: 2205356 - RNA, 16 nt, Human
gguugcaaggccgcug

SEQ ID NO: 2205357 - RNA, 13 nt, Human
gguugcagggagc

SEQ ID NO: 2205358 - RNA, 21 nt, Human
gguuggccccugcccggcugc

SEQ ID NO: 2205359 - RNA, 15 nt, Human
gguuggcugggccca

SEQ ID NO: 2205360 - RNA, 11 nt, Human
gguuggcuggc

SEQ ID NO: 2205361 - RNA, 19 nt, Human
gguuggcugggcccagaag

SEQ ID NO: 2205362 - RNA, 18 nt, Human
gguuggcgcacccucccc

SEQ ID NO: 2205363 - RNA, 20 nt, Human
gguuggcgcacccuccccuc

SEQ ID NO: 2205364 - RNA, 14 nt, Human
gguugcaaccacug

SEQ ID NO: 2205365 - RNA, 14 nt, Human
gguuggcaguaagg

SEQ ID NO: 2205366 - RNA, 15 nt, Human
gguuggcgcacccuc

SEQ ID NO: 2205367 - RNA, 17 nt, Human
gguuggcgcacccuccc

SEQ ID NO: 2205368 - RNA, 20 nt, Human
guuuccagacuuccuugaga

SEQ ID NO: 2205369 - RNA, 22 nt, Human
guuuccacgaugaaaaacuucc

SEQ ID NO: 2205370 - RNA, 19 nt, Human
guuucauuucuacugugac

SEQ ID NO: 2205371 - RNA, 19 nt, Human
guuuccagacuuccuugag

SEQ ID NO: 2205372 - RNA, 16 nt, Human
guuuccaaccuggagu

SEQ ID NO: 2205373 - RNA, 16 nt, Human
guuuccacagccugca

SEQ ID NO: 2205374 - RNA, 23 nt, Human
guuuccaauguuuagcaaauaca

SEQ ID NO: 2205375 - RNA, 20 nt, Human
guuucauuuagucaugugac

SEQ ID NO: 2205376 - RNA, 21 nt, Human
guuucauuuagucaugugacc

SEQ ID NO: 2205377 - RNA, 20 nt, Human
guuucauugcgaaucuuuuu

SEQ ID NO: 2205378 - RNA, 19 nt, Human
guuucauucuccugccugu

SEQ ID NO: 2205379 - RNA, 19 nt, Human
guuucauuuagucauguga

SEQ ID NO: 2205380 - RNA, 11 nt, Human
guuucauugac

SEQ ID NO: 2205381 - RNA, 10 nt, Human
guuucaggug

SEQ ID NO: 2205382 - RNA, 19 nt, Human
guuucaggauacaugugcc

SEQ ID NO: 2205383 - RNA, 23 nt, Human
guuucaggagagaguugaaccua

SEQ ID NO: 2205384 - RNA, 22 nt, Human
guuucaggagagaguugaaccu

SEQ ID NO: 2205385 - RNA, 18 nt, Human
guuucagcgacuccguug

SEQ ID NO: 2205386 - RNA, 18 nt, Human
guuuaguaaggcugugua

SEQ ID NO: 2205387 - RNA, 16 nt, Human
guuucagauauauauc

SEQ ID NO: 2205388 - RNA, 17 nt, Human
guuucagauauauauca

SEQ ID NO: 2205389 - RNA, 21 nt, Human
guuucagauauauaucauauu

SEQ ID NO: 2205390 - RNA, 18 nt, Human
guuucagaaauguguuau

SEQ ID NO: 2205391 - RNA, 14 nt, Human
guuucagaaaugug

SEQ ID NO: 2205392 - RNA, 16 nt, Human
guuuccugcaggccag

SEQ ID NO: 2205393 - RNA, 22 nt, Human
guuuccugcccugggaggcagu

SEQ ID NO: 2205394 - RNA, 16 nt, Human
guuuccuuauauuaug

SEQ ID NO: 2205395 - RNA, 21 nt, Human
guuuccuggcacugcuuccag

SEQ ID NO: 2205396 - RNA, 22 nt, Human
guuuccuggcacugcuuccagu

SEQ ID NO: 2205397 - RNA, 14 nt, Human
guuuccugcaggcc

SEQ ID NO: 2205398 - RNA, 22 nt, Human
guuuccugaaacaacuuggaaa

SEQ ID NO: 2205399 - RNA, 13 nt, Human
guuucccauaauu

SEQ ID NO: 2205400 - RNA, 17 nt, Human
guuuccugcccugggag

SEQ ID NO: 2205401 - RNA, 13 nt, Human
guuuccugcccug

SEQ ID NO: 2205402 - RNA, 16 nt, Human
guuuccuggcacugcu

SEQ ID NO: 2205403 - RNA, 20 nt, Human
guuuccuggcacugcuucca

SEQ ID NO: 2205404 - RNA, 19 nt, Human
guuuuguggaggagcucag

SEQ ID NO: 2205405 - RNA, 18 nt, Human
guuuugugauguuugucc

SEQ ID NO: 2205406 - RNA, 24 nt, Human
guuuugucaaacuguagaaaugau

SEQ ID NO: 2205407 - RNA, 17 nt, Human
guuuugucaaacuguag

SEQ ID NO: 2205408 - RNA, 14 nt, Human
guuuugucuugaau

SEQ ID NO: 2205409 - RNA, 17 nt, Human
guuuuguuuuaaaauua

SEQ ID NO: 2205410 - RNA, 24 nt, Human
guuuugugacuauauagagauguu

SEQ ID NO: 2205411 - RNA, 19 nt, Human
guuuucucuugagagggug

SEQ ID NO: 2205412 - RNA, 12 nt, Human
guuuucucuuga

SEQ ID NO: 2205413 - RNA, 15 nt, Human
guuuuguauucucug

SEQ ID NO: 2205414 - RNA, 12 nt, Human
guuuuguauucu

SEQ ID NO: 2205415 - RNA, 19 nt, Human
guuuucucucggcucccca

SEQ ID NO: 2205416 - RNA, 17 nt, Human
guuuucugaaaauauaa

SEQ ID NO: 2205417 - RNA, 15 nt, Human
guuuuuaacucaaua

SEQ ID NO: 2205418 - RNA, 18 nt, Human
guuuuuaaauagaguuug

SEQ ID NO: 2205419 - RNA, 19 nt, Human
guuuuuaacucaauauuuu

SEQ ID NO: 2205420 - RNA, 21 nt, Human
guuuuuaccuaccacaguguc

SEQ ID NO: 2205421 - RNA, 23 nt, Human
guuuuuaaauagaguuugcuauu

SEQ ID NO: 2205422 - RNA, 16 nt, Human
guuuuuacuacaguug

SEQ ID NO: 2205423 - RNA, 22 nt, Human
guuuuuaccuaccacagugucu

SEQ ID NO: 2205424 - RNA, 17 nt, Human
guuuuuaccucugucuu

SEQ ID NO: 2205425 - RNA, 13 nt, Human
guuuuuaaaaguu

SEQ ID NO: 2205426 - RNA, 15 nt, Human
guuuuuaaaaguuuc

SEQ ID NO: 2205427 - RNA, 16 nt, Human
guuuuuaaaaguuuca

SEQ ID NO: 2205428 - RNA, 18 nt, Human
guuuuuaaaaguuucaau

SEQ ID NO: 2205429 - RNA, 17 nt, Human
guuuuuaaaauaucuuu

SEQ ID NO: 2205430 - RNA, 18 nt, Human
guuuuuauaaaaaauggu

SEQ ID NO: 2205431 - RNA, 17 nt, Human
guuuuuacuuucuguug

SEQ ID NO: 2205432 - RNA, 14 nt, Human
guuuuuacuccagu

SEQ ID NO: 2205433 - RNA, 19 nt, Human
guuuuuauggcuuuugugc

SEQ ID NO: 2205434 - RNA, 23 nt, Human
guuuuuauggcuuuugugcauua

SEQ ID NO: 2205435 - RNA, 22 nt, Human
guuuuuauggcuuuugugcauu

SEQ ID NO: 2205436 - RNA, 17 nt, Human
guuuuccuuucucaccg

SEQ ID NO: 2205437 - RNA, 19 nt, Human
guuuuccuuugucaucauu

SEQ ID NO: 2205438 - RNA, 19 nt, Human
guuuucgaagcucagccca

SEQ ID NO: 2205439 - RNA, 18 nt, Human
guuuucgaagcucagccc

SEQ ID NO: 2205440 - RNA, 17 nt, Human
guuuucgaagcucagcc

SEQ ID NO: 2205441 - RNA, 23 nt, Human
guuuucgaagcucagcccacccc

SEQ ID NO: 2205442 - RNA, 20 nt, Human
guuuucgaagcucagcccac

SEQ ID NO: 2205443 - RNA, 23 nt, Human
guuuucgcaccuaccaucaggga

SEQ ID NO: 2205444 - RNA, 17 nt, Human
guuuucucucggcuccc

SEQ ID NO: 2205445 - RNA, 21 nt, Human
guuuucuccucccaggaacug

SEQ ID NO: 2205446 - RNA, 18 nt, Human
guuuucuccucccaggaa

SEQ ID NO: 2205447 - RNA, 16 nt, Human
guuuucuccucccagg

SEQ ID NO: 2205448 - RNA, 13 nt, Human
guuuucuccuccc

SEQ ID NO: 2205449 - RNA, 16 nt, Human
guuuuccuuucucacc

SEQ ID NO: 2205450 - RNA, 16 nt, Human
guuuuccacccuggaa

SEQ ID NO: 2205451 - RNA, 14 nt, Human
guuuuccacccugg

SEQ ID NO: 2205452 - RNA, 16 nt, Human
guuuucauuugguuca

SEQ ID NO: 2205453 - RNA, 17 nt, Human
guuuucauuugguucau

SEQ ID NO: 2205454 - RNA, 23 nt, Human
guuuucauggugaaaauguacug

SEQ ID NO: 2205455 - RNA, 21 nt, Human
guuuucauggugaaaauguac

SEQ ID NO: 2205456 - RNA, 22 nt, Human
guuuucauggugaaaauguacu

SEQ ID NO: 2205457 - RNA, 10 nt, Human
guuuucaugg

SEQ ID NO: 2205458 - RNA, 16 nt, Human
guuuucauuaucucaa

SEQ ID NO: 2205459 - RNA, 16 nt, Human
guuuucaguguacaug

SEQ ID NO: 2205460 - RNA, 18 nt, Human
guuuucaggcuagaugua

SEQ ID NO: 2205461 - RNA, 17 nt, Human
guuuucaguguacaugg

SEQ ID NO: 2205462 - RNA, 22 nt, Human
guuuucauaauaaaacuuuaaa

SEQ ID NO: 2205463 - RNA, 14 nt, Human
guuuucaucaagac

SEQ ID NO: 2205464 - RNA, 14 nt, Human
guuuucauaauaaa

SEQ ID NO: 2205465 - RNA, 16 nt, Human
guuuucaguuuguaua

SEQ ID NO: 2205466 - RNA, 19 nt, Human
guuuguuggaucuucaaug

SEQ ID NO: 2205467 - RNA, 16 nt, Human
guuuguugugaggauu

SEQ ID NO: 2205468 - RNA, 20 nt, Human
guuuguuucucccccugggc

SEQ ID NO: 2205469 - RNA, 19 nt, Human
guuuguuucucccccuggg

SEQ ID NO: 2205470 - RNA, 21 nt, Human
guuuguuucucccccugggcu

SEQ ID NO: 2205471 - RNA, 24 nt, Human
guuuucaggaguggguugauuuca

SEQ ID NO: 2205472 - RNA, 18 nt, Human
guuuguuucucccccugg

SEQ ID NO: 2205473 - RNA, 10 nt, Human
guuuguuuca

SEQ ID NO: 2205474 - RNA, 17 nt, Human
uaaaaaaauuuaagugc

SEQ ID NO: 2205475 - RNA, 11 nt, Human
uaaaaaacaac

SEQ ID NO: 2205476 - RNA, 19 nt, Human
uaaaaaacaaagaagacaa

SEQ ID NO: 2205477 - RNA, 14 nt, Human
uaaaaaacaaagaa

SEQ ID NO: 2205478 - RNA, 12 nt, Human
uaaaaaacacug

SEQ ID NO: 2205479 - RNA, 23 nt, Human
uaaaaaacugcugacuguuuucu

SEQ ID NO: 2205480 - RNA, 20 nt, Human
uaaaaaacugcugacuguuu

SEQ ID NO: 2205481 - RNA, 15 nt, Human
uaaaaaagcugugug

SEQ ID NO: 2205482 - RNA, 19 nt, Human
uaaaaaagauauauuaaaa

SEQ ID NO: 2205483 - RNA, 15 nt, Human
uaaaaaacuuguaaa

SEQ ID NO: 2205484 - RNA, 21 nt, Human
uaaaaaacuaucuuuuugcuu

SEQ ID NO: 2205485 - RNA, 16 nt, Human
uaaaaaagaaacauuu

SEQ ID NO: 2205486 - RNA, 22 nt, Human
uaaaaacagcauugcuuucuga

SEQ ID NO: 2205487 - RNA, 20 nt, Human
uaaaaacagcauugcuuucu

SEQ ID NO: 2205488 - RNA, 14 nt, Human
uaaaaaccaagaag

SEQ ID NO: 2205489 - RNA, 17 nt, Human
uaaaaacuauuuaacuu

SEQ ID NO: 2205490 - RNA, 17 nt, Human
uaaaaacugacuccuua

SEQ ID NO: 2205491 - RNA, 16 nt, Human
uaaaaacugacuccuu

SEQ ID NO: 2205492 - RNA, 14 nt, Human
uaaaaacuuugcua

SEQ ID NO: 2205493 - RNA, 11 nt, Human
uaaaaaugcaa

SEQ ID NO: 2205494 - RNA, 17 nt, Human
uaaaaagaaaagauaaa

SEQ ID NO: 2205495 - RNA, 23 nt, Human
uaaaaagaaaagauaaagaugau

SEQ ID NO: 2205496 - RNA, 17 nt, Human
uaaaaacagcauugcuu

SEQ ID NO: 2205497 - RNA, 19 nt, Human
uaaaaacagcauugcuuuc

SEQ ID NO: 2205498 - RNA, 18 nt, Human
uaaaaacagcauugcuuu

SEQ ID NO: 2205499 - RNA, 13 nt, Human
uaaaaaaugucca

SEQ ID NO: 2205500 - RNA, 10 nt, Human
uaaaaacaaa

SEQ ID NO: 2205501 - RNA, 17 nt, Human
uaaaaaauaaucuauuu

SEQ ID NO: 2205502 - RNA, 15 nt, Human
uaaaaaauggaaaga

SEQ ID NO: 2205503 - RNA, 15 nt, Human
uaaaaaauggugccu

SEQ ID NO: 2205504 - RNA, 17 nt, Human
uaaaaaauggugccuga

SEQ ID NO: 2205505 - RNA, 17 nt, Human
uaaaaaaauaaaacauu

SEQ ID NO: 2205506 - RNA, 18 nt, Human
uaaaaaaaggcauuguuu

SEQ ID NO: 2205507 - RNA, 18 nt, Human
uaaaaaaauaaaacauuu

SEQ ID NO: 2205508 - RNA, 19 nt, Human
uaaaaaaauaaaacauuuu

SEQ ID NO: 2205509 - RNA, 13 nt, Human
uaaaaaaaugaca

SEQ ID NO: 2205510 - RNA, 20 nt, Human
uaaaaaaauaauaauaaugu

SEQ ID NO: 2205511 - RNA, 13 nt, Human
uaaaaaaauuggu

SEQ ID NO: 2205512 - RNA, 12 nt, Human
uaaaaaaauuua

SEQ ID NO: 2205513 - RNA, 15 nt, Human
uaaaaaaauuuaagu

SEQ ID NO: 2205514 - RNA, 16 nt, Human
uaaaaaaauuuaagug

SEQ ID NO: 2205515 - RNA, 11 nt, Human
uaaaaaacacu

SEQ ID NO: 2205516 - RNA, 12 nt, Human
uaaaaaaaagaa

SEQ ID NO: 2205517 - RNA, 14 nt, Human
uaaaaaaaagaaaa

SEQ ID NO: 2205518 - RNA, 11 nt, Human
uaaaaaaaaga

SEQ ID NO: 2205519 - RNA, 22 nt, Human
uaaaaaaaacaaaaagaacaaa

SEQ ID NO: 2205520 - RNA, 18 nt, Human
uaaaaaaaaaugccuuug

SEQ ID NO: 2205521 - RNA, 17 nt, Human
uaaaaaaaaaugccuuu

SEQ ID NO: 2205522 - RNA, 13 nt, Human
uaaaaaaaacaaa

SEQ ID NO: 2205523 - RNA, 17 nt, Human
uaaaaaaaacaaaaaga

SEQ ID NO: 2205524 - RNA, 18 nt, Human
uaaaaaaaacaaaaagaa

SEQ ID NO: 2205525 - RNA, 19 nt, Human
uaaaaaaaacaaaaagaac

SEQ ID NO: 2205526 - RNA, 21 nt, Human
uaaaaaaaacaaaaagaacaa

SEQ ID NO: 2205527 - RNA, 17 nt, Human
uaaaaaaaagaaaaaag

SEQ ID NO: 2205528 - RNA, 16 nt, Human
uaaaaaaaagaaaaaa

SEQ ID NO: 2205529 - RNA, 15 nt, Human
uaaaaaaaagaaaaa

SEQ ID NO: 2205530 - RNA, 21 nt, Human
uaaaaaaacaaucauuugcuu

SEQ ID NO: 2205531 - RNA, 14 nt, Human
uaaaaaaaauaguu

SEQ ID NO: 2205532 - RNA, 16 nt, Human
uaaaaaaaauaguuga

SEQ ID NO: 2205533 - RNA, 23 nt, Human
uaaaaaaaauaguugagccagca

SEQ ID NO: 2205534 - RNA, 12 nt, Human
guuuuucaguuu

SEQ ID NO: 2205535 - RNA, 23 nt, Human
guuuuucaauuaaacggauuauu

SEQ ID NO: 2205536 - RNA, 19 nt, Human
uaaaaaaaaagaucuguuu

SEQ ID NO: 2205537 - RNA, 14 nt, Human
uaaaaaaaaaggca

SEQ ID NO: 2205538 - RNA, 16 nt, Human
uaaaaaaaaaggcaua

SEQ ID NO: 2205539 - RNA, 22 nt, Human
uaaaaaaaaaggcauauugcuu

SEQ ID NO: 2205540 - RNA, 15 nt, Human
uaaaaaaaaaugccu

SEQ ID NO: 2205541 - RNA, 16 nt, Human
uaaaaaaaaaugccuu

SEQ ID NO: 2205542 - RNA, 16 nt, Human
guuuuucacauuuucc

SEQ ID NO: 2205543 - RNA, 14 nt, Human
guuuuucacauuuu

SEQ ID NO: 2205544 - RNA, 12 nt, Human
guuuuucacauu

SEQ ID NO: 2205545 - RNA, 13 nt, Human
guuuuucaauuaa

SEQ ID NO: 2205546 - RNA, 14 nt, Human
guuuuucaauuaaa

SEQ ID NO: 2205547 - RNA, 15 nt, Human
guuuuucaauuaaac

SEQ ID NO: 2205548 - RNA, 16 nt, Human
guuuuucaauuaaacg

SEQ ID NO: 2205549 - RNA, 17 nt, Human
guuuuucaauuaaacgg

SEQ ID NO: 2205550 - RNA, 18 nt, Human
guuuuucaauuaaacgga

SEQ ID NO: 2205551 - RNA, 19 nt, Human
guuuuucaauuaaacggau

SEQ ID NO: 2205552 - RNA, 21 nt, Human
guuuuucaauuaaacggauua

SEQ ID NO: 2205553 - RNA, 18 nt, Human
guuuuuauggggcugaac

SEQ ID NO: 2205554 - RNA, 16 nt, Human
guuuuuauggggcuga

SEQ ID NO: 2205555 - RNA, 21 nt, Human
guuuuuaugaagaaaaaauac

SEQ ID NO: 2205556 - RNA, 23 nt, Human
guuuuuauaaaaaauggugccug

SEQ ID NO: 2205557 - RNA, 16 nt, Human
guuuuuauuccuugug

SEQ ID NO: 2205558 - RNA, 14 nt, Human
guuuuuauuaguac

SEQ ID NO: 2205559 - RNA, 12 nt, Human
guuuuucaauua

SEQ ID NO: 2205560 - RNA, 18 nt, Human
uaaaaucuuucuuucuua

SEQ ID NO: 2205561 - RNA, 19 nt, Human
uaaaaucuuucuuucuuag

SEQ ID NO: 2205562 - RNA, 20 nt, Human
uaaaaucuuucuuucuuaga

SEQ ID NO: 2205563 - RNA, 21 nt, Human
uaaaaucuuucuuucuuagaa

SEQ ID NO: 2205564 - RNA, 22 nt, Human
uaaaaucuuucuuucuuagaaa

SEQ ID NO: 2205565 - RNA, 14 nt, Human
uaaaaugaaauuac

SEQ ID NO: 2205566 - RNA, 15 nt, Human
uaaaaucuuuucuau

SEQ ID NO: 2205567 - RNA, 13 nt, Human
uaaaaugagaaau

SEQ ID NO: 2205568 - RNA, 20 nt, Human
uaaaaugagguucaacuguu

SEQ ID NO: 2205569 - RNA, 14 nt, Human
uaaaaugauuguaa

SEQ ID NO: 2205570 - RNA, 15 nt, Human
uaaaaugauuguaaa

SEQ ID NO: 2205571 - RNA, 16 nt, Human
uaaaaugauuguaaaa

SEQ ID NO: 2205572 - RNA, 17 nt, Human
uaaaaugauuguaaaau

SEQ ID NO: 2205573 - RNA, 18 nt, Human
uaaaaugauuguaaaaua

SEQ ID NO: 2205574 - RNA, 20 nt, Human
uaaaaugauuguaaaauagc

SEQ ID NO: 2205575 - RNA, 21 nt, Human
uaaaaugaccaguaauuguga

SEQ ID NO: 2205576 - RNA, 17 nt, Human
uaaaaugaggacauguu

SEQ ID NO: 2205577 - RNA, 15 nt, Human
uaaaaugagaaaucu

SEQ ID NO: 2205578 - RNA, 16 nt, Human
uaaaaugagaaaucua

SEQ ID NO: 2205579 - RNA, 15 nt, Human
uaaaauccucaaucc

SEQ ID NO: 2205580 - RNA, 21 nt, Human
uaaaaucagccaauuauguua

SEQ ID NO: 2205581 - RNA, 22 nt, Human
uaaaaucagccaauuauguuaa

SEQ ID NO: 2205582 - RNA, 19 nt, Human
uaaaauccauacauuugug

SEQ ID NO: 2205583 - RNA, 18 nt, Human
uaaaauccauacauuugu

SEQ ID NO: 2205584 - RNA, 20 nt, Human
uaaaauauuuugaaucaaua

SEQ ID NO: 2205585 - RNA, 17 nt, Human
uaaaauauuuuugaaag

SEQ ID NO: 2205586 - RNA, 13 nt, Human
uaaaaucagccaa

SEQ ID NO: 2205587 - RNA, 14 nt, Human
uaaaaucagccaau

SEQ ID NO: 2205588 - RNA, 15 nt, Human
uaaaaucagccaauu

SEQ ID NO: 2205589 - RNA, 17 nt, Human
uaaaaucagccaauuau

SEQ ID NO: 2205590 - RNA, 13 nt, Human
uaaaauauuuauu

SEQ ID NO: 2205591 - RNA, 14 nt, Human
uaaaauauuuugaa

SEQ ID NO: 2205592 - RNA, 16 nt, Human
uaaaauauuuugaauc

SEQ ID NO: 2205593 - RNA, 13 nt, Human
uaaaauauuuuca

SEQ ID NO: 2205594 - RNA, 18 nt, Human
uaaaagcauaaaugcaaa

SEQ ID NO: 2205595 - RNA, 17 nt, Human
uaaaagcauaaaugcaa

SEQ ID NO: 2205596 - RNA, 14 nt, Human
uaaaaggaaaagca

SEQ ID NO: 2205597 - RNA, 16 nt, Human
uaaaaggaaaagcaaa

SEQ ID NO: 2205598 - RNA, 17 nt, Human
uaaaagggacugagaaa

SEQ ID NO: 2205599 - RNA, 19 nt, Human
uaaaagggacugagaaauu

SEQ ID NO: 2205600 - RNA, 20 nt, Human
uaaaagggacugagaaauuu

SEQ ID NO: 2205601 - RNA, 21 nt, Human
uaaaagggacugagaaauuua

SEQ ID NO: 2205602 - RNA, 15 nt, Human
uaaaagcauaaaugc

SEQ ID NO: 2205603 - RNA, 22 nt, Human
uaaaagauggggucuguaaaau

SEQ ID NO: 2205604 - RNA, 20 nt, Human
uaaaagauggggucuguaaa

SEQ ID NO: 2205605 - RNA, 21 nt, Human
uaaaagauggggucuguaaaa

SEQ ID NO: 2205606 - RNA, 18 nt, Human
uaaaagauggggucugua

SEQ ID NO: 2205607 - RNA, 19 nt, Human
uaaaagauggggucuguaa

SEQ ID NO: 2205608 - RNA, 16 nt, Human
uaaaagaugcaaugua

SEQ ID NO: 2205609 - RNA, 14 nt, Human
uaaaagauccuuuu

SEQ ID NO: 2205610 - RNA, 14 nt, Human
uaaaagaugaaaau

SEQ ID NO: 2205611 - RNA, 13 nt, Human
uaaaagaucgcag

SEQ ID NO: 2205612 - RNA, 22 nt, Human
uaaaagauauaagugcuguaua

SEQ ID NO: 2205613 - RNA, 15 nt, Human
uaaaaaugguuuaaa

SEQ ID NO: 2205614 - RNA, 19 nt, Human
uaaaaauggcucagaugcc

SEQ ID NO: 2205615 - RNA, 17 nt, Human
uaaaaaugggacuucuu

SEQ ID NO: 2205616 - RNA, 18 nt, Human
uaaaaaugggacuucuuu

SEQ ID NO: 2205617 - RNA, 19 nt, Human
uaaaaaugggacuucuuuu

SEQ ID NO: 2205618 - RNA, 20 nt, Human
uaaaaaugggacuucuuuuc

SEQ ID NO: 2205619 - RNA, 23 nt, Human
uaaaaaugggacuucuuuucaca

SEQ ID NO: 2205620 - RNA, 16 nt, Human
uaaaaaugcaaauccu

SEQ ID NO: 2205621 - RNA, 20 nt, Human
uaaaaaugcaaauccuaugu

SEQ ID NO: 2205622 - RNA, 19 nt, Human
uaaaaaugcaaauccuaug

SEQ ID NO: 2205623 - RNA, 19 nt, Human
uaaacaaauguaugauuac

SEQ ID NO: 2205624 - RNA, 17 nt, Human
uaaacaaauucauauuc

SEQ ID NO: 2205625 - RNA, 19 nt, Human
uaaacaaauucauauucug

SEQ ID NO: 2205626 - RNA, 21 nt, Human
uaaacaaauucauauucuguc

SEQ ID NO: 2205627 - RNA, 22 nt, Human
uaaacaaauucauauucugucu

SEQ ID NO: 2205628 - RNA, 18 nt, Human
uaaacaagaccacguuuc

SEQ ID NO: 2205629 - RNA, 12 nt, Human
uaaacaaaugua

SEQ ID NO: 2205630 - RNA, 18 nt, Human
uaaaaugcaacaugugua

SEQ ID NO: 2205631 - RNA, 19 nt, Human
uaaaaugcaugauuuugua

SEQ ID NO: 2205632 - RNA, 16 nt, Human
uaaaaugcaugauuuu

SEQ ID NO: 2205633 - RNA, 21 nt, Human
uaaaaugccucaguguauuug

SEQ ID NO: 2205634 - RNA, 17 nt, Human
uaaaaugccucagugua

SEQ ID NO: 2205635 - RNA, 20 nt, Human
uaaaaugccucaguguauuu

SEQ ID NO: 2205636 - RNA, 17 nt, Human
uaaaaugcaacaugugu

SEQ ID NO: 2205637 - RNA, 20 nt, Human
uaaaaugcaacauguguacu

SEQ ID NO: 2205638 - RNA, 18 nt, Human
uaaaaugauuuuaucugu

SEQ ID NO: 2205639 - RNA, 15 nt, Human
uaaaaugauuuuauc

SEQ ID NO: 2205640 - RNA, 17 nt, Human
uaaaaugauuuuaucug

SEQ ID NO: 2205641 - RNA, 22 nt, Human
uaaaaugauuguaaaauagcuu

SEQ ID NO: 2205642 - RNA, 14 nt, Human
uaaaaugauuuuau

SEQ ID NO: 2205643 - RNA, 18 nt, Human
uaaacaauaucagacuuu

SEQ ID NO: 2205644 - RNA, 21 nt, Human
uaaacaaugcugauuugguga

SEQ ID NO: 2205645 - RNA, 20 nt, Human
uaaacaagauuuuaaagaca

SEQ ID NO: 2205646 - RNA, 21 nt, Human
uaaacaagauuuuaaagacau

SEQ ID NO: 2205647 - RNA, 20 nt, Human
uaaacaagaaucagucuauc

SEQ ID NO: 2205648 - RNA, 15 nt, Human
uaaacaagauuuuaa

SEQ ID NO: 2205649 - RNA, 23 nt, Human
uaaacaagaccacguuucuaaag

SEQ ID NO: 2205650 - RNA, 21 nt, Human
uaaacacucuugaaaaaugca

SEQ ID NO: 2205651 - RNA, 11 nt, Human
uaaacacugug

SEQ ID NO: 2205652 - RNA, 23 nt, Human
uaaacagacuauuuaacuugagg

SEQ ID NO: 2205653 - RNA, 21 nt, Human
uaaacagauauaaauggcugg

SEQ ID NO: 2205654 - RNA, 16 nt, Human
uaaacagauauaaaug

SEQ ID NO: 2205655 - RNA, 12 nt, Human
uaaacagugccu

SEQ ID NO: 2205656 - RNA, 23 nt, Human
uaaacagugagccugaauuuugu

SEQ ID NO: 2205657 - RNA, 20 nt, Human
uaaacagugagccugaauuu

SEQ ID NO: 2205658 - RNA, 20 nt, Human
uaaacagggcaucuccagga

SEQ ID NO: 2205659 - RNA, 18 nt, Human
uaaacagugccugcugaa

SEQ ID NO: 2205660 - RNA, 13 nt, Human
uaaacaguucuug

SEQ ID NO: 2205661 - RNA, 17 nt, Human
uaaacagugccugcuga

SEQ ID NO: 2205662 - RNA, 13 nt, Human
uaaacagugccug

SEQ ID NO: 2205663 - RNA, 18 nt, Human
uaaacaggagacaggaag

SEQ ID NO: 2205664 - RNA, 12 nt, Human
uaaacaggccca

SEQ ID NO: 2205665 - RNA, 13 nt, Human
uaaacaggcccag

SEQ ID NO: 2205666 - RNA, 14 nt, Human
uaaacaggcccagc

SEQ ID NO: 2205667 - RNA, 15 nt, Human
uaaacaggcccagca

SEQ ID NO: 2205668 - RNA, 23 nt, Human
uaaacaggcccagcauugcuggu

SEQ ID NO: 2205669 - RNA, 19 nt, Human
uaaacagggcaucuccagg

SEQ ID NO: 2205670 - RNA, 15 nt, Human
uaaacagauuuuuac

SEQ ID NO: 2205671 - RNA, 18 nt, Human
uaaacagauuuuuacaaa

SEQ ID NO: 2205672 - RNA, 19 nt, Human
uaaacagauuuuuacaaau

SEQ ID NO: 2205673 - RNA, 20 nt, Human
uaaacagauuuuuacaaaug

SEQ ID NO: 2205674 - RNA, 13 nt, Human
uaaacagcagugu

SEQ ID NO: 2205675 - RNA, 17 nt, Human
uaaacagcaguguuccc

SEQ ID NO: 2205676 - RNA, 22 nt, Human
uaaacagcaguguuccccaucu

SEQ ID NO: 2205677 - RNA, 20 nt, Human
uaaacugguauuuuaucuuu

SEQ ID NO: 2205678 - RNA, 23 nt, Human
uaaacugcccccucugcccugcg

SEQ ID NO: 2205679 - RNA, 22 nt, Human
uaaacugcccccucugcccugc

SEQ ID NO: 2205680 - RNA, 15 nt, Human
uaaacauaauucuug

SEQ ID NO: 2205681 - RNA, 20 nt, Human
uaaacauaauucuuguauau

SEQ ID NO: 2205682 - RNA, 17 nt, Human
uaaacauaaauaaauau

SEQ ID NO: 2205683 - RNA, 21 nt, Human
uaaacugcccccucugcccug

SEQ ID NO: 2205684 - RNA, 20 nt, Human
uaaacugcccccucugcccu

SEQ ID NO: 2205685 - RNA, 18 nt, Human
uaaacuuuagaguagcau

SEQ ID NO: 2205686 - RNA, 15 nt, Human
uaaacuuagaauaaa

SEQ ID NO: 2205687 - RNA, 13 nt, Human
uaaacuuucacac

SEQ ID NO: 2205688 - RNA, 12 nt, Human
uaaacuuucaca

SEQ ID NO: 2205689 - RNA, 22 nt, Human
uaaacuuuaccuuuuuuauaca

SEQ ID NO: 2205690 - RNA, 20 nt, Human
uaaacuuuacccaaaaacua

SEQ ID NO: 2205691 - RNA, 16 nt, Human
uaaacuuuaccuuuuu

SEQ ID NO: 2205692 - RNA, 19 nt, Human
uaaacuuaaucuaaaugga

SEQ ID NO: 2205693 - RNA, 18 nt, Human
uaaacuuaaucuaaaugg

SEQ ID NO: 2205694 - RNA, 13 nt, Human
uaaacuuaaucua

SEQ ID NO: 2205695 - RNA, 14 nt, Human
uaaacuuaaucuaa

SEQ ID NO: 2205696 - RNA, 10 nt, Human
uaaauauuua

SEQ ID NO: 2205697 - RNA, 17 nt, Human
uaaauauuuauguagau

SEQ ID NO: 2205698 - RNA, 16 nt, Human
uaaauauuuauguaga

SEQ ID NO: 2205699 - RNA, 21 nt, Human
uaaauauuuacauaugaaauu

SEQ ID NO: 2205700 - RNA, 19 nt, Human
uaaauauuuacauaugaaa

SEQ ID NO: 2205701 - RNA, 18 nt, Human
uaaauauuuacauaugaa

SEQ ID NO: 2205702 - RNA, 17 nt, Human
uaaauauuuacauauga

SEQ ID NO: 2205703 - RNA, 11 nt, Human
uaaauauuuac

SEQ ID NO: 2205704 - RNA, 15 nt, Human
uaaauauuuccuuaa

SEQ ID NO: 2205705 - RNA, 14 nt, Human
uaaauauuuccuua

SEQ ID NO: 2205706 - RNA, 13 nt, Human
uaaauauuuccuu

SEQ ID NO: 2205707 - RNA, 12 nt, Human
uaaauauuuccu

SEQ ID NO: 2205708 - RNA, 14 nt, Human
uaaauauuucaaga

SEQ ID NO: 2205709 - RNA, 12 nt, Human
uaaauauuucaa

SEQ ID NO: 2205710 - RNA, 13 nt, Human
uaaauauuucaag

SEQ ID NO: 2205711 - RNA, 18 nt, Human
uaaauauguuagcaaaga

SEQ ID NO: 2205712 - RNA, 21 nt, Human
uaaauauguuagcaaagaguu

SEQ ID NO: 2205713 - RNA, 21 nt, Human
uaaauaugccucuccuuugua

SEQ ID NO: 2205714 - RNA, 23 nt, Human
uaaauaugccucuccuuuguaua

SEQ ID NO: 2205715 - RNA, 14 nt, Human
uaaauaugcaguga

SEQ ID NO: 2205716 - RNA, 16 nt, Human
uaaauaugcagugaua

SEQ ID NO: 2205717 - RNA, 17 nt, Human
uaaauaugcagugauau

SEQ ID NO: 2205718 - RNA, 19 nt, Human
uaaauaugccucuccuuug

SEQ ID NO: 2205719 - RNA, 13 nt, Human
uaaauauucuaua

SEQ ID NO: 2205720 - RNA, 18 nt, Human
uaaauauguuuuuuagau

SEQ ID NO: 2205721 - RNA, 19 nt, Human
uaaauauucuauuuucauu

SEQ ID NO: 2205722 - RNA, 15 nt, Human
uaaauauucuauaug

SEQ ID NO: 2205723 - RNA, 19 nt, Human
uaaauauucuauaugaauu

SEQ ID NO: 2205724 - RNA, 19 nt, Human
uaaaucagccguguaacca

SEQ ID NO: 2205725 - RNA, 20 nt, Human
uaaaucagacuaugaaguuu

SEQ ID NO: 2205726 - RNA, 14 nt, Human
uaaaucaaugucac

SEQ ID NO: 2205727 - RNA, 13 nt, Human
uaaaucaauaaag

SEQ ID NO: 2205728 - RNA, 23 nt, Human
uaaaucaaugucacuuaaaggcu

SEQ ID NO: 2205729 - RNA, 19 nt, Human
uaaaucaaguuggcuucua

SEQ ID NO: 2205730 - RNA, 22 nt, Human
uaaauauuuuuucuuuucuauu

SEQ ID NO: 2205731 - RNA, 14 nt, Human
uaaaucauuaauac

SEQ ID NO: 2205732 - RNA, 11 nt, Human
uaaaucagugg

SEQ ID NO: 2205733 - RNA, 22 nt, Human
uaaauaucuguacuucuucgau

SEQ ID NO: 2205734 - RNA, 13 nt, Human
uaaauaugcagug

SEQ ID NO: 2205735 - RNA, 19 nt, Human
uaaauaugaagcucaccug

SEQ ID NO: 2205736 - RNA, 18 nt, Human
uaaauaucuucugauuug

SEQ ID NO: 2205737 - RNA, 17 nt, Human
uaaauaucuucugauuu

SEQ ID NO: 2205738 - RNA, 16 nt, Human
uaaauauauuuuaaga

SEQ ID NO: 2205739 - RNA, 22 nt, Human
uaaauauauuuuaagacgaaac

SEQ ID NO: 2205740 - RNA, 21 nt, Human
uaaauauauauauauauaaaa

SEQ ID NO: 2205741 - RNA, 21 nt, Human
uaaauauaucuauauuauugu

SEQ ID NO: 2205742 - RNA, 17 nt, Human
uaaauauauuuaagaua

SEQ ID NO: 2205743 - RNA, 22 nt, Human
uaaauauauuuaagauaauuau

SEQ ID NO: 2205744 - RNA, 18 nt, Human
uaaauauaugcuaagucu

SEQ ID NO: 2205745 - RNA, 19 nt, Human
uaaauaaaagugaucaaua

SEQ ID NO: 2205746 - RNA, 20 nt, Human
uaaauaaaagcagcaucugc

SEQ ID NO: 2205747 - RNA, 19 nt, Human
uaaauaaaagcagcaucug

SEQ ID NO: 2205748 - RNA, 15 nt, Human
uaaauaaaagcagca

SEQ ID NO: 2205749 - RNA, 21 nt, Human
uaaauaaaagaaaaaauaucu

SEQ ID NO: 2205750 - RNA, 14 nt, Human
uaaauaaaagcagc

SEQ ID NO: 2205751 - RNA, 17 nt, Human
uaaauaaaagugaucaa

SEQ ID NO: 2205752 - RNA, 13 nt, Human
uaaauaaaaugac

SEQ ID NO: 2205753 - RNA, 15 nt, Human
uaaauaaaaugacca

SEQ ID NO: 2205754 - RNA, 13 nt, Human
uaaauaaacccuu

SEQ ID NO: 2205755 - RNA, 22 nt, Human
uaaauaaaccucaaaaugucua

SEQ ID NO: 2205756 - RNA, 13 nt, Human
uaaauaaaauuug

SEQ ID NO: 2205757 - RNA, 14 nt, Human
uaaauaaaauuugu

SEQ ID NO: 2205758 - RNA, 20 nt, Human
uaaauaaaauuuguugcaua

SEQ ID NO: 2205759 - RNA, 12 nt, Human
uaaauauauaaa

SEQ ID NO: 2205760 - RNA, 14 nt, Human
uaaauauauaaaaa

SEQ ID NO: 2205761 - RNA, 13 nt, Human
uaaauauauaaau

SEQ ID NO: 2205762 - RNA, 15 nt, Human
uaaauauauaaauau

SEQ ID NO: 2205763 - RNA, 16 nt, Human
uaaauauauaaauaua

SEQ ID NO: 2205764 - RNA, 17 nt, Human
uaaauauauaaauauau

SEQ ID NO: 2205765 - RNA, 11 nt, Human
uaaauauauau

SEQ ID NO: 2205766 - RNA, 13 nt, Human
uaaauauauauaa

SEQ ID NO: 2205767 - RNA, 19 nt, Human
uaaauauauauaaauauau

SEQ ID NO: 2205768 - RNA, 21 nt, Human
uaaauauauauaaauauauau

SEQ ID NO: 2205769 - RNA, 14 nt, Human
uaaauauauauaaa

SEQ ID NO: 2205770 - RNA, 15 nt, Human
uaaauauauauaaac

SEQ ID NO: 2205771 - RNA, 17 nt, Human
uaaauauauauaaaccu

SEQ ID NO: 2205772 - RNA, 18 nt, Human
uaaauauauauaaaccua

SEQ ID NO: 2205773 - RNA, 19 nt, Human
uaaauauauauaaaccuaa

SEQ ID NO: 2205774 - RNA, 17 nt, Human
uaaauauauauaaauau

SEQ ID NO: 2205775 - RNA, 18 nt, Human
uaaauauauauaaauaua

SEQ ID NO: 2205776 - RNA, 22 nt, Human
uaaauaaaacauuuucacacaa

SEQ ID NO: 2205777 - RNA, 21 nt, Human
uaaauaaaacauuuucacaca

SEQ ID NO: 2205778 - RNA, 14 nt, Human
uaaauaaaacccuu

SEQ ID NO: 2205779 - RNA, 13 nt, Human
uaaauaaaagaaa

SEQ ID NO: 2205780 - RNA, 14 nt, Human
uaaauaaaaaugga

SEQ ID NO: 2205781 - RNA, 17 nt, Human
uaaauaaaaauaauccu

SEQ ID NO: 2205782 - RNA, 13 nt, Human
uaaaguuucuguu

SEQ ID NO: 2205783 - RNA, 20 nt, Human
uaaaguugaagcuaagauuu

SEQ ID NO: 2205784 - RNA, 17 nt, Human
uaaaguguccauugaca

SEQ ID NO: 2205785 - RNA, 13 nt, Human
uaaaguuucucag

SEQ ID NO: 2205786 - RNA, 14 nt, Human
uaaaguuucucaga

SEQ ID NO: 2205787 - RNA, 14 nt, Human
uaaaguuuguugaa

SEQ ID NO: 2205788 - RNA, 17 nt, Human
uaaaguuugcuuagaaa

SEQ ID NO: 2205789 - RNA, 14 nt, Human
uaaaguuugcuuag

SEQ ID NO: 2205790 - RNA, 20 nt, Human
uaaaguguauuuuuuuacua

SEQ ID NO: 2205791 - RNA, 21 nt, Human
uaaaguguauuuuuuuacuaa

SEQ ID NO: 2205792 - RNA, 22 nt, Human
uaaaggaugugauuguggaaug

SEQ ID NO: 2205793 - RNA, 16 nt, Human
uaaaggaugugauugu

SEQ ID NO: 2205794 - RNA, 19 nt, Human
uaaaggcaccaucuaauag

SEQ ID NO: 2205795 - RNA, 17 nt, Human
uaaaggauguugguguu

SEQ ID NO: 2205796 - RNA, 23 nt, Human
uaaaguguauuuuuuuacuaaua

SEQ ID NO: 2205797 - RNA, 22 nt, Human
uaaaguguauuuuuuuacuaau

SEQ ID NO: 2205798 - RNA, 14 nt, Human
uaaagcuagaaaug

SEQ ID NO: 2205799 - RNA, 20 nt, Human
uaaagcuaaaaugauuuuau

SEQ ID NO: 2205800 - RNA, 23 nt, Human
uaaagcuaaaaugauuuuaucug

SEQ ID NO: 2205801 - RNA, 19 nt, Human
uaaagcuacugauuuccuu

SEQ ID NO: 2205802 - RNA, 17 nt, Human
uaaagcucgaaaacaau

SEQ ID NO: 2205803 - RNA, 14 nt, Human
uaaaggaauuuaaa

SEQ ID NO: 2205804 - RNA, 19 nt, Human
uaaacuuagaauaaaauug

SEQ ID NO: 2205805 - RNA, 16 nt, Human
uaaaggaguuaagagu

SEQ ID NO: 2205806 - RNA, 22 nt, Human
uaaaggagaaggcaugaaauug

SEQ ID NO: 2205807 - RNA, 20 nt, Human
uaaaggaguuaagaguagca

SEQ ID NO: 2205808 - RNA, 17 nt, Human
uaaaggagaaggcauga

SEQ ID NO: 2205809 - RNA, 18 nt, Human
uaaagcucgaaaacaauu

SEQ ID NO: 2205810 - RNA, 15 nt, Human
uaaagcuagaaauga

SEQ ID NO: 2205811 - RNA, 15 nt, Human
uaaagcuaaaauaac

SEQ ID NO: 2205812 - RNA, 16 nt, Human
uaaagccugcuuuuua

SEQ ID NO: 2205813 - RNA, 13 nt, Human
uaaagcauuuaua

SEQ ID NO: 2205814 - RNA, 21 nt, Human
uaaagccugcuuuuuaagugu

SEQ ID NO: 2205815 - RNA, 20 nt, Human
uaaagccuguauucucaaac

SEQ ID NO: 2205816 - RNA, 12 nt, Human
uaaagcauuuau

SEQ ID NO: 2205817 - RNA, 13 nt, Human
uaaagcaguggac

SEQ ID NO: 2205818 - RNA, 19 nt, Human
uaaagcaguggacaccagg

SEQ ID NO: 2205819 - RNA, 22 nt, Human
uaaagcaugaaugguauggaac

SEQ ID NO: 2205820 - RNA, 23 nt, Human
uaaagcauucaauuuauucaaga

SEQ ID NO: 2205821 - RNA, 12 nt, Human
uaaagcauucca

SEQ ID NO: 2205822 - RNA, 13 nt, Human
uaaagcauuccaa

SEQ ID NO: 2205823 - RNA, 15 nt, Human
uaaagcauuccaaca

SEQ ID NO: 2205824 - RNA, 16 nt, Human
uaaagcauuccaacaa

SEQ ID NO: 2205825 - RNA, 20 nt, Human
uaaacuuuuuucuuacuguc

SEQ ID NO: 2205826 - RNA, 19 nt, Human
uaaccacaaagcacaguuu

SEQ ID NO: 2205827 - RNA, 23 nt, Human
uaaccacaaagcacaguuugaac

SEQ ID NO: 2205828 - RNA, 18 nt, Human
uaaccacaucaauauugu

SEQ ID NO: 2205829 - RNA, 21 nt, Human
uaaccaccuaccuuacaguga

SEQ ID NO: 2205830 - RNA, 22 nt, Human
uaaccacaucaauauugucauu

SEQ ID NO: 2205831 - RNA, 24 nt, Human
uaaccacaucaauauugucauucc

SEQ ID NO: 2205832 - RNA, 14 nt, Human
uaaccagcagaaau

SEQ ID NO: 2205833 - RNA, 13 nt, Human
uaaccacggaaaa

SEQ ID NO: 2205834 - RNA, 15 nt, Human
uaaccagcuguaaca

SEQ ID NO: 2205835 - RNA, 20 nt, Human
uaaccagccagauccucuug

SEQ ID NO: 2205836 - RNA, 20 nt, Human
uaacccuuugguuuuuuucu

SEQ ID NO: 2205837 - RNA, 19 nt, Human
uaaccagcagaaaugccuu

SEQ ID NO: 2205838 - RNA, 16 nt, Human
uaaccagcagaaaugc

SEQ ID NO: 2205839 - RNA, 21 nt, Human
uaaccaaaggugaaggaauau

SEQ ID NO: 2205840 - RNA, 11 nt, Human
uaaccaaaggu

SEQ ID NO: 2205841 - RNA, 17 nt, Human
uaaccaaaggugaagga

SEQ ID NO: 2205842 - RNA, 18 nt, Human
uaaccaaaggugaaggaa

SEQ ID NO: 2205843 - RNA, 12 nt, Human
uaacauuauuua

SEQ ID NO: 2205844 - RNA, 12 nt, Human
uaacauuaccuu

SEQ ID NO: 2205845 - RNA, 13 nt, Human
uaacauuaccuua

SEQ ID NO: 2205846 - RNA, 17 nt, Human
uaacauuaccuuacugu

SEQ ID NO: 2205847 - RNA, 19 nt, Human
uaacauuaccuuacugugg

SEQ ID NO: 2205848 - RNA, 23 nt, Human
uaacaggcucaauauuccugaau

SEQ ID NO: 2205849 - RNA, 22 nt, Human
uaacaggcucaauauuccugaa

SEQ ID NO: 2205850 - RNA, 19 nt, Human
uaacaggcagauacaggaa

SEQ ID NO: 2205851 - RNA, 14 nt, Human
uaacaggcuucugg

SEQ ID NO: 2205852 - RNA, 12 nt, Human
uaacugcaauuu

SEQ ID NO: 2205853 - RNA, 20 nt, Human
uaacugcaauuuuaauugau

SEQ ID NO: 2205854 - RNA, 16 nt, Human
uaacugcauuuuuaga

SEQ ID NO: 2205855 - RNA, 17 nt, Human
uaacugcauugagaacu

SEQ ID NO: 2205856 - RNA, 14 nt, Human
uaacuccagugaag

SEQ ID NO: 2205857 - RNA, 17 nt, Human
uaacugagugccuuuug

SEQ ID NO: 2205858 - RNA, 23 nt, Human
uaacugccaucaagaugagagaa

SEQ ID NO: 2205859 - RNA, 18 nt, Human
uaacugccuuaaaacuuu

SEQ ID NO: 2205860 - RNA, 23 nt, Human
uaacuggcaguuuuccauugguu

SEQ ID NO: 2205861 - RNA, 24 nt, Human
uaacuggcaguuuuccauugguuu

SEQ ID NO: 2205862 - RNA, 13 nt, Human
uaacugguauaga

SEQ ID NO: 2205863 - RNA, 20 nt, Human
uaacuuuuauaaacuuuacc

SEQ ID NO: 2205864 - RNA, 20 nt, Human
uaaccucagugucauuuaug

SEQ ID NO: 2205865 - RNA, 19 nt, Human
uaaccucagugucauuuau

SEQ ID NO: 2205866 - RNA, 14 nt, Human
uaaccucaucuucu

SEQ ID NO: 2205867 - RNA, 15 nt, Human
uaaccucagcucugg

SEQ ID NO: 2205868 - RNA, 16 nt, Human
uaaccucagcucuggg

SEQ ID NO: 2205869 - RNA, 17 nt, Human
uaaccucagcucuggga

SEQ ID NO: 2205870 - RNA, 19 nt, Human
uaaccucagcucugggaga

SEQ ID NO: 2205871 - RNA, 13 nt, Human
uaacucagaucac

SEQ ID NO: 2205872 - RNA, 14 nt, Human
uaacucagaucacu

SEQ ID NO: 2205873 - RNA, 20 nt, Human
uaacucagaucacuacugca

SEQ ID NO: 2205874 - RNA, 22 nt, Human
uaacucagaaacaucaguuacu

SEQ ID NO: 2205875 - RNA, 18 nt, Human
uaaccucaucuucuucac

SEQ ID NO: 2205876 - RNA, 20 nt, Human
uaaccuaugauauuuucugu

SEQ ID NO: 2205877 - RNA, 20 nt, Human
uaaccuauaugauuuauagu

SEQ ID NO: 2205878 - RNA, 22 nt, Human
uaaccuauaugauuuauaguuu

SEQ ID NO: 2205879 - RNA, 22 nt, Human
uaaccuauuuugaaaaauuccu

SEQ ID NO: 2205880 - RNA, 13 nt, Human
uaaccucagcucu

SEQ ID NO: 2205881 - RNA, 14 nt, Human
uaaccucagcucug

SEQ ID NO: 2205882 - RNA, 20 nt, Human
uaaccguccucgagcaacug

SEQ ID NO: 2205883 - RNA, 14 nt, Human
uaacucaucauaaa

SEQ ID NO: 2205884 - RNA, 21 nt, Human
uaacucagaucacuacugcag

SEQ ID NO: 2205885 - RNA, 23 nt, Human
uaacucagaucacuacugcaguc

SEQ ID NO: 2205886 - RNA, 19 nt, Human
uaacucauaccuuuaaagg

SEQ ID NO: 2205887 - RNA, 16 nt, Human
uaacucaucauaaaau

SEQ ID NO: 2205888 - RNA, 15 nt, Human
uaacucaucauaaaa

SEQ ID NO: 2205889 - RNA, 17 nt, Human
uaacucaucauaaaaua

SEQ ID NO: 2205890 - RNA, 14 nt, Human
uaacucaucuguca

SEQ ID NO: 2205891 - RNA, 22 nt, Human
uaacuccaccaacccaucagaa

SEQ ID NO: 2205892 - RNA, 16 nt, Human
uaacuccaccaaccca

SEQ ID NO: 2205893 - RNA, 11 nt, Human
uaacuccacca

SEQ ID NO: 2205894 - RNA, 16 nt, Human
uaacugagugccuuuu

SEQ ID NO: 2205895 - RNA, 23 nt, Human
uaacucauacugugcuggagcca

SEQ ID NO: 2205896 - RNA, 15 nt, Human
uaacucaucugucac

SEQ ID NO: 2205897 - RNA, 13 nt, Human
uaacaauguuaag

SEQ ID NO: 2205898 - RNA, 12 nt, Human
uaacaauguuaa

SEQ ID NO: 2205899 - RNA, 14 nt, Human
uaacaauguuaagg

SEQ ID NO: 2205900 - RNA, 15 nt, Human
uaacaauguuaagga

SEQ ID NO: 2205901 - RNA, 16 nt, Human
uaacaauguuaaggaa

SEQ ID NO: 2205902 - RNA, 19 nt, Human
uaacaauguuaaggaaacu

SEQ ID NO: 2205903 - RNA, 21 nt, Human
uaacaauguuaaggaaacucu

SEQ ID NO: 2205904 - RNA, 22 nt, Human
uaacaauguuaaggaaacucuu

SEQ ID NO: 2205905 - RNA, 23 nt, Human
uaacaauguuaaggaaacucuua

SEQ ID NO: 2205906 - RNA, 14 nt, Human
uaacaauuccucua

SEQ ID NO: 2205907 - RNA, 15 nt, Human
uaacaauugugaagu

SEQ ID NO: 2205908 - RNA, 13 nt, Human
uaacaauuccucu

SEQ ID NO: 2205909 - RNA, 13 nt, Human
uaacaauuuccuu

SEQ ID NO: 2205910 - RNA, 15 nt, Human
uaacaauuuccuuua

SEQ ID NO: 2205911 - RNA, 21 nt, Human
uaacaauuuccuuuauauuua

SEQ ID NO: 2205912 - RNA, 14 nt, Human
uaacaauuucuguc

SEQ ID NO: 2205913 - RNA, 23 nt, Human
uaaauuguccguguucauacauu

SEQ ID NO: 2205914 - RNA, 18 nt, Human
uaaauuguauauucacuu

SEQ ID NO: 2205915 - RNA, 19 nt, Human
uaaauuguauauucacuuu

SEQ ID NO: 2205916 - RNA, 13 nt, Human
uaaauuguauauu

SEQ ID NO: 2205917 - RNA, 14 nt, Human
uaaauuguauauuc

SEQ ID NO: 2205918 - RNA, 17 nt, Human
uaaauuguauauucacu

SEQ ID NO: 2205919 - RNA, 12 nt, Human
uaaauuguuuga

SEQ ID NO: 2205920 - RNA, 15 nt, Human
uaaauugcuccuuga

SEQ ID NO: 2205921 - RNA, 15 nt, Human
uaaauugcuguguau

SEQ ID NO: 2205922 - RNA, 16 nt, Human
uaaauugauguugcug

SEQ ID NO: 2205923 - RNA, 16 nt, Human
uaacaggauuagacag

SEQ ID NO: 2205924 - RNA, 21 nt, Human
uaacaggaagaucuuaaauuu

SEQ ID NO: 2205925 - RNA, 12 nt, Human
uaacagcugugg

SEQ ID NO: 2205926 - RNA, 12 nt, Human
uaacagcugagg

SEQ ID NO: 2205927 - RNA, 15 nt, Human
uaacagcugaggucu

SEQ ID NO: 2205928 - RNA, 19 nt, Human
uaacagcugaauuaucuau

SEQ ID NO: 2205929 - RNA, 15 nt, Human
uaacagcugaauuau

SEQ ID NO: 2205930 - RNA, 12 nt, Human
uaacagcugaau

SEQ ID NO: 2205931 - RNA, 23 nt, Human
uaacagcuccuugggaggaagca

SEQ ID NO: 2205932 - RNA, 14 nt, Human
uaacagcucaggau

SEQ ID NO: 2205933 - RNA, 13 nt, Human
uaacagcucagga

SEQ ID NO: 2205934 - RNA, 11 nt, Human
uaacagcuccu

SEQ ID NO: 2205935 - RNA, 15 nt, Human
uaacagcuccuuggg

SEQ ID NO: 2205936 - RNA, 16 nt, Human
uaacagcuccuuggga

SEQ ID NO: 2205937 - RNA, 17 nt, Human
uaacagcuccuugggag

SEQ ID NO: 2205938 - RNA, 20 nt, Human
uaacagcuccuugggaggaa

SEQ ID NO: 2205939 - RNA, 22 nt, Human
uaacagcuccuugggaggaagc

SEQ ID NO: 2205940 - RNA, 15 nt, Human
uaacagaugcaaugu

SEQ ID NO: 2205941 - RNA, 12 nt, Human
uaacagaugcaa

SEQ ID NO: 2205942 - RNA, 18 nt, Human
uaacagauaagcaagaga

SEQ ID NO: 2205943 - RNA, 11 nt, Human
uaacagacauu

SEQ ID NO: 2205944 - RNA, 14 nt, Human
uaacagacauuguu

SEQ ID NO: 2205945 - RNA, 18 nt, Human
uaacagacauuguuuugc

SEQ ID NO: 2205946 - RNA, 18 nt, Human
uaacagaacagcuucagg

SEQ ID NO: 2205947 - RNA, 19 nt, Human
uaacagaacagcuucaggu

SEQ ID NO: 2205948 - RNA, 20 nt, Human
uaacagaacagcuucagguu

SEQ ID NO: 2205949 - RNA, 21 nt, Human
uaacagaacagcuucagguua

SEQ ID NO: 2205950 - RNA, 22 nt, Human
uaacagaacagcuucagguuau

SEQ ID NO: 2205951 - RNA, 19 nt, Human
uaacagccaggaguguuaa

SEQ ID NO: 2205952 - RNA, 21 nt, Human
uaacagaugcaaugugcuacu

SEQ ID NO: 2205953 - RNA, 22 nt, Human
uaacagauuuugggguuguguu

SEQ ID NO: 2205954 - RNA, 11 nt, Human
uaacacauuau

SEQ ID NO: 2205955 - RNA, 21 nt, Human
uaacacagugccuucaauaaa

SEQ ID NO: 2205956 - RNA, 14 nt, Human
uaacacauguccuu

SEQ ID NO: 2205957 - RNA, 12 nt, Human
uaacagaaaugu

SEQ ID NO: 2205958 - RNA, 12 nt, Human
uaacagaacagc

SEQ ID NO: 2205959 - RNA, 14 nt, Human
uaacagaacagcuu

SEQ ID NO: 2205960 - RNA, 16 nt, Human
uaacagaacagcuuca

SEQ ID NO: 2205961 - RNA, 17 nt, Human
uaacagaacagcuucag

SEQ ID NO: 2205962 - RNA, 15 nt, Human
uaacagaaauguaca

SEQ ID NO: 2205963 - RNA, 14 nt, Human
uaacagaaauguac

SEQ ID NO: 2205964 - RNA, 15 nt, Human
uaacacacagcuccc

SEQ ID NO: 2205965 - RNA, 17 nt, Human
uaacacacagcucccau

SEQ ID NO: 2205966 - RNA, 18 nt, Human
uaacacaaguccugugaa

SEQ ID NO: 2205967 - RNA, 12 nt, Human
uaacacacagcu

SEQ ID NO: 2205968 - RNA, 13 nt, Human
uaacacacagcua

SEQ ID NO: 2205969 - RNA, 14 nt, Human
uaacacacagcucc

SEQ ID NO: 2205970 - RNA, 16 nt, Human
uaacaauuucuguccu

SEQ ID NO: 2205971 - RNA, 22 nt, Human
uaacaauuucuguccuucagau

SEQ ID NO: 2205972 - RNA, 18 nt, Human
uaacaauuuuaaugcuau

SEQ ID NO: 2205973 - RNA, 16 nt, Human
uaacacaagccacaga

SEQ ID NO: 2205974 - RNA, 17 nt, Human
uaacacaagccacagaa

SEQ ID NO: 2205975 - RNA, 17 nt, Human
uaacacaaguccuguga

SEQ ID NO: 2205976 - RNA, 23 nt, Human
uaacacaaguccugugaauuucu

SEQ ID NO: 2205977 - RNA, 17 nt, Human
uaacacagcauguguau

SEQ ID NO: 2205978 - RNA, 19 nt, Human
uaacacagugccuucaaua

SEQ ID NO: 2205979 - RNA, 20 nt, Human
uaacacagugccuucaauaa

SEQ ID NO: 2205980 - RNA, 13 nt, Human
uaacagaaaugua

SEQ ID NO: 2205981 - RNA, 18 nt, Human
uaagaucguucucugccu

SEQ ID NO: 2205982 - RNA, 19 nt, Human
uaagauauuuuucaugauu

SEQ ID NO: 2205983 - RNA, 19 nt, Human
uaagauaugggacauuuuu

SEQ ID NO: 2205984 - RNA, 21 nt, Human
uaagauaugggacauuuuuga

SEQ ID NO: 2205985 - RNA, 14 nt, Human
uaagauauuuuuca

SEQ ID NO: 2205986 - RNA, 15 nt, Human
uaagauauuuuucau

SEQ ID NO: 2205987 - RNA, 17 nt, Human
uaagauauuuuucauga

SEQ ID NO: 2205988 - RNA, 18 nt, Human
uaagauauuuuucaugau

SEQ ID NO: 2205989 - RNA, 13 nt, Human
uaagaguguuuaa

SEQ ID NO: 2205990 - RNA, 21 nt, Human
uaagaguuaguuucuuuggga

SEQ ID NO: 2205991 - RNA, 12 nt, Human
uaagauaauaau

SEQ ID NO: 2205992 - RNA, 14 nt, Human
uaagauaauaauau

SEQ ID NO: 2205993 - RNA, 15 nt, Human
uaagauaauaauaua

SEQ ID NO: 2205994 - RNA, 22 nt, Human
uaagauaauaauauauguuuac

SEQ ID NO: 2205995 - RNA, 12 nt, Human
uaagauaauuau

SEQ ID NO: 2205996 - RNA, 18 nt, Human
uaagauaauaguuuacau

SEQ ID NO: 2205997 - RNA, 23 nt, Human
uaagauaauaguuuacauguagu

SEQ ID NO: 2205998 - RNA, 13 nt, Human
uaagauaauuaua

SEQ ID NO: 2205999 - RNA, 17 nt, Human
uaagauaaaugugcuga

SEQ ID NO: 2206000 - RNA, 16 nt, Human
uaagauaaaugugcug

SEQ ID NO: 2206001 - RNA, 14 nt, Human
uaagauaaaugugc

SEQ ID NO: 2206002 - RNA, 19 nt, Human
uaagagugggggagagcag

SEQ ID NO: 2206003 - RNA, 12 nt, Human
uaagaguguaga

SEQ ID NO: 2206004 - RNA, 13 nt, Human
uaagaguguagaa

SEQ ID NO: 2206005 - RNA, 16 nt, Human
uaagaguguagaagca

SEQ ID NO: 2206006 - RNA, 18 nt, Human
uaagaguguagaagcauu

SEQ ID NO: 2206007 - RNA, 19 nt, Human
uaagaguguagaagcauuc

SEQ ID NO: 2206008 - RNA, 22 nt, Human
uaagaguguagaagcauuccuu

SEQ ID NO: 2206009 - RNA, 23 nt, Human
uaagaguguagaagcauuccuuc

SEQ ID NO: 2206010 - RNA, 21 nt, Human
uaagaguagaaacugcaggga

SEQ ID NO: 2206011 - RNA, 20 nt, Human
uaagagggcacacacugugu

SEQ ID NO: 2206012 - RNA, 18 nt, Human
uaagagugaaaauugucu

SEQ ID NO: 2206013 - RNA, 14 nt, Human
uaagagugcugggc

SEQ ID NO: 2206014 - RNA, 17 nt, Human
uaagagggcacacacug

SEQ ID NO: 2206015 - RNA, 18 nt, Human
uaagagggcacacacugu

SEQ ID NO: 2206016 - RNA, 12 nt, Human
uaagagggaggg

SEQ ID NO: 2206017 - RNA, 22 nt, Human
uaagagggagggagggcuccag

SEQ ID NO: 2206018 - RNA, 23 nt, Human
uaagagggagggagggcuccaga

SEQ ID NO: 2206019 - RNA, 23 nt, Human
uaagagggauuagggagagaaga

SEQ ID NO: 2206020 - RNA, 24 nt, Human
uaagaaagacuaucuaaauguuga

SEQ ID NO: 2206021 - RNA, 19 nt, Human
uaacuuuuauaaacuuuac

SEQ ID NO: 2206022 - RNA, 13 nt, Human
uaacugugaaguu

SEQ ID NO: 2206023 - RNA, 22 nt, Human
uaacuuuuauaaacuuuaccuu

SEQ ID NO: 2206024 - RNA, 21 nt, Human
uaacuuuuauaaacuuuaccu

SEQ ID NO: 2206025 - RNA, 22 nt, Human
uaagaaagugaagcaaaucaga

SEQ ID NO: 2206026 - RNA, 18 nt, Human
uaagaaagugaagcaaau

SEQ ID NO: 2206027 - RNA, 15 nt, Human
uaagaaagugaagca

SEQ ID NO: 2206028 - RNA, 16 nt, Human
uaagaaauacuguaca

SEQ ID NO: 2206029 - RNA, 16 nt, Human
uaagaaauaaaacugu

SEQ ID NO: 2206030 - RNA, 19 nt, Human
uaagaaauaaaacuguuaa

SEQ ID NO: 2206031 - RNA, 22 nt, Human
uaagaaauaaaacuguuaaagu

SEQ ID NO: 2206032 - RNA, 18 nt, Human
uaagaaauacuguacaau

SEQ ID NO: 2206033 - RNA, 19 nt, Human
uaagaaaucaaagagagaa

SEQ ID NO: 2206034 - RNA, 22 nt, Human
uaagaaccuuuugagugccuua

SEQ ID NO: 2206035 - RNA, 12 nt, Human
uaagaagagacu

SEQ ID NO: 2206036 - RNA, 15 nt, Human
uaagaagacaugaac

SEQ ID NO: 2206037 - RNA, 14 nt, Human
uaagaagacaugaa

SEQ ID NO: 2206038 - RNA, 13 nt, Human
uaagaagcuguug

SEQ ID NO: 2206039 - RNA, 15 nt, Human
uaagagagagagaca

SEQ ID NO: 2206040 - RNA, 19 nt, Human
uaagaagagacugggaaga

SEQ ID NO: 2206041 - RNA, 14 nt, Human
uaagaagagacugg

SEQ ID NO: 2206042 - RNA, 13 nt, Human
uaagaagaaacua

SEQ ID NO: 2206043 - RNA, 22 nt, Human
uaagaagaaaauugcugugccu

SEQ ID NO: 2206044 - RNA, 22 nt, Human
uaagaacugcuuucuuucguuu

SEQ ID NO: 2206045 - RNA, 21 nt, Human
uaagaagaaaauugcugugcc

SEQ ID NO: 2206046 - RNA, 19 nt, Human
uaagaacugcuuucuuucg

SEQ ID NO: 2206047 - RNA, 21 nt, Human
uaagaacuacaaacaaaauuu

SEQ ID NO: 2206048 - RNA, 16 nt, Human
uaagagcuagcgcugc

SEQ ID NO: 2206049 - RNA, 22 nt, Human
uaagagccauauaaguuugaag

SEQ ID NO: 2206050 - RNA, 22 nt, Human
uaagagccauuuaggggccacu

SEQ ID NO: 2206051 - RNA, 20 nt, Human
uaagagcuagcgcugccgca

SEQ ID NO: 2206052 - RNA, 18 nt, Human
uaagagcuagcgcugccg

SEQ ID NO: 2206053 - RNA, 19 nt, Human
uaagagcaccuuccucacu

SEQ ID NO: 2206054 - RNA, 20 nt, Human
uaagagcaccuuccucacuu

SEQ ID NO: 2206055 - RNA, 22 nt, Human
uaagagcaccuuccucacuucc

SEQ ID NO: 2206056 - RNA, 15 nt, Human
uaagagcaccuuccu

SEQ ID NO: 2206057 - RNA, 17 nt, Human
uaagagcuggugucuga

SEQ ID NO: 2206058 - RNA, 14 nt, Human
uaagaggcugauaa

SEQ ID NO: 2206059 - RNA, 15 nt, Human
uaagaggcugauaau

SEQ ID NO: 2206060 - RNA, 14 nt, Human
uaagagcugguguc

SEQ ID NO: 2206061 - RNA, 22 nt, Human
uaagaggcagggucucacucug

SEQ ID NO: 2206062 - RNA, 16 nt, Human
uaaggaugggaaggag

SEQ ID NO: 2206063 - RNA, 12 nt, Human
uaaggaugggaa

SEQ ID NO: 2206064 - RNA, 17 nt, Human
uaaggaugucacagggc

SEQ ID NO: 2206065 - RNA, 19 nt, Human
uaaggaugucacagggcca

SEQ ID NO: 2206066 - RNA, 18 nt, Human
uaaggaugggaaggaggg

SEQ ID NO: 2206067 - RNA, 18 nt, Human
uaaggaugcuuguacaua

SEQ ID NO: 2206068 - RNA, 20 nt, Human
uaaggauggagccagcucug

SEQ ID NO: 2206069 - RNA, 19 nt, Human
uaaggauggagccagcucu

SEQ ID NO: 2206070 - RNA, 23 nt, Human
uaagcgaauguguacaaagugua

SEQ ID NO: 2206071 - RNA, 13 nt, Human
uaaggcaugaagg

SEQ ID NO: 2206072 - RNA, 20 nt, Human
uaaggaugucacagggccaa

SEQ ID NO: 2206073 - RNA, 15 nt, Human
uaaggcaaucauggu

SEQ ID NO: 2206074 - RNA, 23 nt, Human
uaaggaugcuuguacauaaugcg

SEQ ID NO: 2206075 - RNA, 22 nt, Human
uaaggaugcuuguacauaaugc

SEQ ID NO: 2206076 - RNA, 21 nt, Human
uaaggaugcuuguacauaaug

SEQ ID NO: 2206077 - RNA, 20 nt, Human
uaaggaugcuuguacauaau

SEQ ID NO: 2206078 - RNA, 15 nt, Human
uaagccuuuccauaa

SEQ ID NO: 2206079 - RNA, 12 nt, Human
uaagccuugucg

SEQ ID NO: 2206080 - RNA, 16 nt, Human
uaagccuuuccauaag

SEQ ID NO: 2206081 - RNA, 21 nt, Human
uaagccuuuggaaacagcucg

SEQ ID NO: 2206082 - RNA, 19 nt, Human
uaaggaugcuuguacauaa

SEQ ID NO: 2206083 - RNA, 21 nt, Human
uaagccuccauuuaguucuuu

SEQ ID NO: 2206084 - RNA, 20 nt, Human
uaagccuccauuuaguucuu

SEQ ID NO: 2206085 - RNA, 19 nt, Human
uaagccuccauuuaguucu

SEQ ID NO: 2206086 - RNA, 17 nt, Human
uaagccuccauuuaguu

SEQ ID NO: 2206087 - RNA, 17 nt, Human
uaagccuuuggaaacag

SEQ ID NO: 2206088 - RNA, 14 nt, Human
uaagccuuuggaaa

SEQ ID NO: 2206089 - RNA, 14 nt, Human
uaagccuccauuua

SEQ ID NO: 2206090 - RNA, 20 nt, Human
uaagccucauauuuaaagac

SEQ ID NO: 2206091 - RNA, 17 nt, Human
uaagccaucuugguaaa

SEQ ID NO: 2206092 - RNA, 20 nt, Human
uaagccacuuaaaauguuca

SEQ ID NO: 2206093 - RNA, 16 nt, Human
uaagccacaagaaauu

SEQ ID NO: 2206094 - RNA, 21 nt, Human
uaagccagacaucaacagaua

SEQ ID NO: 2206095 - RNA, 20 nt, Human
uaagccagacaucaacagau

SEQ ID NO: 2206096 - RNA, 17 nt, Human
uaagcauuguuugcuua

SEQ ID NO: 2206097 - RNA, 15 nt, Human
uaagcauuguuugcu

SEQ ID NO: 2206098 - RNA, 12 nt, Human
uaagcauuguuu

SEQ ID NO: 2206099 - RNA, 18 nt, Human
uaagcauuggguggguaa

SEQ ID NO: 2206100 - RNA, 20 nt, Human
uaagcauuccaacuaucuca

SEQ ID NO: 2206101 - RNA, 16 nt, Human
uaagcauuccaacuau

SEQ ID NO: 2206102 - RNA, 18 nt, Human
uaagcauuccaacuaucu

SEQ ID NO: 2206103 - RNA, 21 nt, Human
uaagcauuguuugcuuauugu

SEQ ID NO: 2206104 - RNA, 20 nt, Human
uaagcauuguuugcuuauug

SEQ ID NO: 2206105 - RNA, 19 nt, Human
uaagcauuguuugcuuauu

SEQ ID NO: 2206106 - RNA, 18 nt, Human
uaagcauuguuugcuuau

SEQ ID NO: 2206107 - RNA, 23 nt, Human
uaagcauuguuugcuuauuguuc

SEQ ID NO: 2206108 - RNA, 14 nt, Human
uaagccaagggccu

SEQ ID NO: 2206109 - RNA, 15 nt, Human
uaagccaauuuuucu

SEQ ID NO: 2206110 - RNA, 10 nt, Human
uaagccaagg

SEQ ID NO: 2206111 - RNA, 13 nt, Human
uaagccagacauc

SEQ ID NO: 2206112 - RNA, 19 nt, Human
uaagccacuuaaaauguuc

SEQ ID NO: 2206113 - RNA, 17 nt, Human
uaagccacuuaaaaugu

SEQ ID NO: 2206114 - RNA, 18 nt, Human
uaagccaauuuuucugca

SEQ ID NO: 2206115 - RNA, 19 nt, Human
uaagccaauuuuucugcac

SEQ ID NO: 2206116 - RNA, 22 nt, Human
uaagccacaagaaauuugauuu

SEQ ID NO: 2206117 - RNA, 19 nt, Human
uaagcauuaccacucaggc

SEQ ID NO: 2206118 - RNA, 21 nt, Human
uaagcauuaccacucaggcau

SEQ ID NO: 2206119 - RNA, 18 nt, Human
uaagcauuaccacucagg

SEQ ID NO: 2206120 - RNA, 15 nt, Human
uaagcaugcacaaau

SEQ ID NO: 2206121 - RNA, 16 nt, Human
uaagcaucaaacucuu

SEQ ID NO: 2206122 - RNA, 15 nt, Human
uaagcaucaaacucu

SEQ ID NO: 2206123 - RNA, 13 nt, Human
uaagaucucagug

SEQ ID NO: 2206124 - RNA, 19 nt, Human
uaagaucucagugguuaag

SEQ ID NO: 2206125 - RNA, 15 nt, Human
uaagaugacauugcu

SEQ ID NO: 2206126 - RNA, 20 nt, Human
uaauuuguaguguuggagaa

SEQ ID NO: 2206127 - RNA, 14 nt, Human
uaauuguuguuucu

SEQ ID NO: 2206128 - RNA, 15 nt, Human
uaauuguuguuucuu

SEQ ID NO: 2206129 - RNA, 18 nt, Human
uaauuugugauacaaugc

SEQ ID NO: 2206130 - RNA, 15 nt, Human
uaauuugugauacaa

SEQ ID NO: 2206131 - RNA, 14 nt, Human
uaauuugugauaca

SEQ ID NO: 2206132 - RNA, 23 nt, Human
uaauuuguaguguuggagaagaa

SEQ ID NO: 2206133 - RNA, 21 nt, Human
uaauuuguacauauguaaaau

SEQ ID NO: 2206134 - RNA, 13 nt, Human
uaauuuguaucug

SEQ ID NO: 2206135 - RNA, 14 nt, Human
uaauuuuaaccaaa

SEQ ID NO: 2206136 - RNA, 14 nt, Human
uaauuuuaaacaaa

SEQ ID NO: 2206137 - RNA, 22 nt, Human
uaauuugugauacaaugcugug

SEQ ID NO: 2206138 - RNA, 19 nt, Human
uaauuugugauacaaugcu

SEQ ID NO: 2206139 - RNA, 19 nt, Human
uaauuuuagugacagcucu

SEQ ID NO: 2206140 - RNA, 23 nt, Human
uaauuuuaaccaaaacaugucuc

SEQ ID NO: 2206141 - RNA, 12 nt, Human
uaauuuuaauau

SEQ ID NO: 2206142 - RNA, 13 nt, Human
uaauuuuaaauaa

SEQ ID NO: 2206143 - RNA, 22 nt, Human
uaauuuuaaccaaaacaugucu

SEQ ID NO: 2206144 - RNA, 13 nt, Human
uaauuuuaagaaa

SEQ ID NO: 2206145 - RNA, 18 nt, Human
uaauuuuaugaaugucuu

SEQ ID NO: 2206146 - RNA, 17 nt, Human
uaauuuuccuaauaaag

SEQ ID NO: 2206147 - RNA, 21 nt, Human
uaauuuucuagauuuucuacu

SEQ ID NO: 2206148 - RNA, 19 nt, Human
uaauugauuucaagaccuu

SEQ ID NO: 2206149 - RNA, 11 nt, Human
uaauugcacuc

SEQ ID NO: 2206150 - RNA, 14 nt, Human
uaauugauuucaag

SEQ ID NO: 2206151 - RNA, 19 nt, Human
uaauugaucaaauucauuu

SEQ ID NO: 2206152 - RNA, 12 nt, Human
uaauugcauuca

SEQ ID NO: 2206153 - RNA, 13 nt, Human
uaauugcauucau

SEQ ID NO: 2206154 - RNA, 22 nt, Human
uaauugcauucaucuuguguuu

SEQ ID NO: 2206155 - RNA, 15 nt, Human
uaauugcuuacauuu

SEQ ID NO: 2206156 - RNA, 16 nt, Human
uaauugcuuacauuuu

SEQ ID NO: 2206157 - RNA, 21 nt, Human
uaauugcuuacauuuuuacaa

SEQ ID NO: 2206158 - RNA, 23 nt, Human
uaauugcuuacauuuuuacaaua

SEQ ID NO: 2206159 - RNA, 15 nt, Human
uaauuggcagcagau

SEQ ID NO: 2206160 - RNA, 12 nt, Human
uaauuggcagca

SEQ ID NO: 2206161 - RNA, 14 nt, Human
uaauuggcagcaga

SEQ ID NO: 2206162 - RNA, 18 nt, Human
uaauugguccgaucuuug

SEQ ID NO: 2206163 - RNA, 12 nt, Human
uaauugcuuuga

SEQ ID NO: 2206164 - RNA, 20 nt, Human
uaauuggaagaaauuccugu

SEQ ID NO: 2206165 - RNA, 21 nt, Human
uaauuggaagaaauuccugua

SEQ ID NO: 2206166 - RNA, 22 nt, Human
uaauuggaaaggcagcucuaaa

SEQ ID NO: 2206167 - RNA, 20 nt, Human
uaauuguuaagauaugaugu

SEQ ID NO: 2206168 - RNA, 22 nt, Human
uaauuguucauuuugagcugaa

SEQ ID NO: 2206169 - RNA, 16 nt, Human
uaauuguugcuaaucu

SEQ ID NO: 2206170 - RNA, 16 nt, Human
uaauuguauaacaggu

SEQ ID NO: 2206171 - RNA, 17 nt, Human
uaauuguauaacagguu

SEQ ID NO: 2206172 - RNA, 18 nt, Human
uaauuguauaacagguua

SEQ ID NO: 2206173 - RNA, 13 nt, Human
uaauuguaucgua

SEQ ID NO: 2206174 - RNA, 15 nt, Human
uaauuguaucguaua

SEQ ID NO: 2206175 - RNA, 19 nt, Human
uaauuguaucguauagcug

SEQ ID NO: 2206176 - RNA, 20 nt, Human
uaauuguaucguauagcugu

SEQ ID NO: 2206177 - RNA, 21 nt, Human
uaauuguaucguauagcugua

SEQ ID NO: 2206178 - RNA, 23 nt, Human
uaauuguaucguauagcuguauu

SEQ ID NO: 2206179 - RNA, 21 nt, Human
uaauugugaaaaaguuaaaca

SEQ ID NO: 2206180 - RNA, 21 nt, Human
uaauuaaauaaaaaucugugg

SEQ ID NO: 2206181 - RNA, 12 nt, Human
uaauuaaagugu

SEQ ID NO: 2206182 - RNA, 16 nt, Human
uaauuaaaguguccau

SEQ ID NO: 2206183 - RNA, 18 nt, Human
uaauguuuaugagccaga

SEQ ID NO: 2206184 - RNA, 13 nt, Human
uaauuaaaugcuc

SEQ ID NO: 2206185 - RNA, 22 nt, Human
uaauuaaauaaaucauuaauac

SEQ ID NO: 2206186 - RNA, 23 nt, Human
uaauuaaauuuugaguucuacau

SEQ ID NO: 2206187 - RNA, 17 nt, Human
uaauuaaaacacaacau

SEQ ID NO: 2206188 - RNA, 20 nt, Human
uaauuaaaagaauauuuuaa

SEQ ID NO: 2206189 - RNA, 15 nt, Human
uaauuaaucaugaau

SEQ ID NO: 2206190 - RNA, 21 nt, Human
uaauuaaucaugaauguguaa

SEQ ID NO: 2206191 - RNA, 17 nt, Human
uaauuaaugaaauaucu

SEQ ID NO: 2206192 - RNA, 21 nt, Human
uaaugcauguuaggaaaauuu

SEQ ID NO: 2206193 - RNA, 22 nt, Human
uaaugccggugagaauaagaga

SEQ ID NO: 2206194 - RNA, 21 nt, Human
uaaugccuuacucuucuugaa

SEQ ID NO: 2206195 - RNA, 22 nt, Human
uaaugccuuuaaaguaugaauc

SEQ ID NO: 2206196 - RNA, 15 nt, Human
uaaugccuuacucuu

SEQ ID NO: 2206197 - RNA, 22 nt, Human
uaaugcgcaggcuggcccugcc

SEQ ID NO: 2206198 - RNA, 19 nt, Human
uaaugcgcaggcuggcccu

SEQ ID NO: 2206199 - RNA, 14 nt, Human
uaaugcgugcauac

SEQ ID NO: 2206200 - RNA, 22 nt, Human
uaauguuuaugagccagacaaa

SEQ ID NO: 2206201 - RNA, 17 nt, Human
uaauguuuaugagccag

SEQ ID NO: 2206202 - RNA, 16 nt, Human
uaauguuuaugagcca

SEQ ID NO: 2206203 - RNA, 15 nt, Human
uaauguuuaugagcc

SEQ ID NO: 2206204 - RNA, 15 nt, Human
uaauguuucaaacau

SEQ ID NO: 2206205 - RNA, 23 nt, Human
uaaugcgcaggcuggcccugccc

SEQ ID NO: 2206206 - RNA, 14 nt, Human
uaauguuucaaaca

SEQ ID NO: 2206207 - RNA, 20 nt, Human
uaauucuucaccuuaggaau

SEQ ID NO: 2206208 - RNA, 16 nt, Human
uaauucuuguauauua

SEQ ID NO: 2206209 - RNA, 15 nt, Human
uaauucuuguauauu

SEQ ID NO: 2206210 - RNA, 19 nt, Human
uaauucuuugaccuguugg

SEQ ID NO: 2206211 - RNA, 20 nt, Human
uaauugacaggauuauugga

SEQ ID NO: 2206212 - RNA, 22 nt, Human
uaauugacaggauuauuggaaa

SEQ ID NO: 2206213 - RNA, 18 nt, Human
uaauugaucaaauucauu

SEQ ID NO: 2206214 - RNA, 10 nt, Human
uaauucugua

SEQ ID NO: 2206215 - RNA, 12 nt, Human
uaauucuguaaa

SEQ ID NO: 2206216 - RNA, 13 nt, Human
uaauucuguaaau

SEQ ID NO: 2206217 - RNA, 15 nt, Human
uaauucuguaaaugu

SEQ ID NO: 2206218 - RNA, 12 nt, Human
uaauucuguaca

SEQ ID NO: 2206219 - RNA, 16 nt, Human
uaauucucuuucaaag

SEQ ID NO: 2206220 - RNA, 13 nt, Human
uaauucucuugaa

SEQ ID NO: 2206221 - RNA, 17 nt, Human
uaauucuguacugauuu

SEQ ID NO: 2206222 - RNA, 23 nt, Human
uaauucuguacugauuuuuguaa

SEQ ID NO: 2206223 - RNA, 14 nt, Human
uaauucuguacaua

SEQ ID NO: 2206224 - RNA, 21 nt, Human
uaauucuguacauagccuaua

SEQ ID NO: 2206225 - RNA, 14 nt, Human
uaauucuguacuga

SEQ ID NO: 2206226 - RNA, 15 nt, Human
uaauucuguacugau

SEQ ID NO: 2206227 - RNA, 18 nt, Human
uaauucuuagcucauucu

SEQ ID NO: 2206228 - RNA, 12 nt, Human
uaauuagagcag

SEQ ID NO: 2206229 - RNA, 12 nt, Human
uaauucucuuga

SEQ ID NO: 2206230 - RNA, 17 nt, Human
uaauuacauauuugcau

SEQ ID NO: 2206231 - RNA, 16 nt, Human
uaauuaccaaccuguu

SEQ ID NO: 2206232 - RNA, 21 nt, Human
uaauuaccaaccuguuaccua

SEQ ID NO: 2206233 - RNA, 17 nt, Human
uaauuaccaaccuguua

SEQ ID NO: 2206234 - RNA, 21 nt, Human
uaauuaaugaaauaucuguau

SEQ ID NO: 2206235 - RNA, 19 nt, Human
uaauuaaugaaauaucugu

SEQ ID NO: 2206236 - RNA, 20 nt, Human
uaauuaaugaaauaucugua

SEQ ID NO: 2206237 - RNA, 20 nt, Human
uaauauauuuguguauuuaa

SEQ ID NO: 2206238 - RNA, 13 nt, Human
uaauauauuuucu

SEQ ID NO: 2206239 - RNA, 19 nt, Human
uaauauauuuguguauuua

SEQ ID NO: 2206240 - RNA, 14 nt, Human
uaauauauugcugc

SEQ ID NO: 2206241 - RNA, 16 nt, Human
uaauauggggaugcag

SEQ ID NO: 2206242 - RNA, 20 nt, Human
uaauauguuaaccucagugu

SEQ ID NO: 2206243 - RNA, 21 nt, Human
uaauauguuaaccucaguguc

SEQ ID NO: 2206244 - RNA, 17 nt, Human
uaauauggguucuuuuu

SEQ ID NO: 2206245 - RNA, 22 nt, Human
uaauauauuuuuauauuuaguu

SEQ ID NO: 2206246 - RNA, 19 nt, Human
uaauaugggcauuguaguu

SEQ ID NO: 2206247 - RNA, 20 nt, Human
uaauaugggcauuguaguua

SEQ ID NO: 2206248 - RNA, 17 nt, Human
uaauauauuuucuguuu

SEQ ID NO: 2206249 - RNA, 21 nt, Human
uaauauauuuucuguuuucuu

SEQ ID NO: 2206250 - RNA, 14 nt, Human
uaauauauguuuac

SEQ ID NO: 2206251 - RNA, 12 nt, Human
uaauauauugcu

SEQ ID NO: 2206252 - RNA, 17 nt, Human
uaauauaucccagaaau

SEQ ID NO: 2206253 - RNA, 13 nt, Human
uaauauauguuua

SEQ ID NO: 2206254 - RNA, 17 nt, Human
uaauauauaucugcugu

SEQ ID NO: 2206255 - RNA, 22 nt, Human
uaauauaaguuucuuugcuuca

SEQ ID NO: 2206256 - RNA, 16 nt, Human
uaauauacuauauuua

SEQ ID NO: 2206257 - RNA, 13 nt, Human
uaauauacuugug

SEQ ID NO: 2206258 - RNA, 15 nt, Human
uaauauacuugugga

SEQ ID NO: 2206259 - RNA, 17 nt, Human
uaauauacuuguggacu

SEQ ID NO: 2206260 - RNA, 21 nt, Human
uaauauacuuguggacuaaaa

SEQ ID NO: 2206261 - RNA, 16 nt, Human
uaaucggcccacagcu

SEQ ID NO: 2206262 - RNA, 15 nt, Human
uaaucggcccacagc

SEQ ID NO: 2206263 - RNA, 18 nt, Human
uaaucgcuuaaagauguu

SEQ ID NO: 2206264 - RNA, 16 nt, Human
uaaucgaccugccucg

SEQ ID NO: 2206265 - RNA, 16 nt, Human
uaaucguuaugugugu

SEQ ID NO: 2206266 - RNA, 15 nt, Human
uaaucguuaugugug

SEQ ID NO: 2206267 - RNA, 22 nt, Human
uaaucggcccacagcucccacc

SEQ ID NO: 2206268 - RNA, 16 nt, Human
uaaucguguccccuau

SEQ ID NO: 2206269 - RNA, 14 nt, Human
uaaucgaccugccu

SEQ ID NO: 2206270 - RNA, 13 nt, Human
uaaucgaccugcc

SEQ ID NO: 2206271 - RNA, 20 nt, Human
uaauccuucuaguuucccac

SEQ ID NO: 2206272 - RNA, 23 nt, Human
uaauauguuaaccucagugucau

SEQ ID NO: 2206273 - RNA, 14 nt, Human
uaauauuaaaaaua

SEQ ID NO: 2206274 - RNA, 18 nt, Human
uaauauuaaaaauaugga

SEQ ID NO: 2206275 - RNA, 19 nt, Human
uaauccuucuaguuuccca

SEQ ID NO: 2206276 - RNA, 21 nt, Human
uaauccuucuaguuucccaca

SEQ ID NO: 2206277 - RNA, 23 nt, Human
uaauccucucaaccaccuuucag

SEQ ID NO: 2206278 - RNA, 22 nt, Human
uaauauuaaaaauauggaacuu

SEQ ID NO: 2206279 - RNA, 22 nt, Human
uaaugaugaugggaauugugug

SEQ ID NO: 2206280 - RNA, 20 nt, Human
uaaucuucaguuuuaucuuu

SEQ ID NO: 2206281 - RNA, 19 nt, Human
uaaugauaaguaaaugcua

SEQ ID NO: 2206282 - RNA, 21 nt, Human
uaaucuuauuagggagaaaau

SEQ ID NO: 2206283 - RNA, 13 nt, Human
uaaucuuauuagg

SEQ ID NO: 2206284 - RNA, 16 nt, Human
uaaucuucaguuuuau

SEQ ID NO: 2206285 - RNA, 13 nt, Human
uaaucuucaguuu

SEQ ID NO: 2206286 - RNA, 17 nt, Human
uaaugcauguuaggaaa

SEQ ID NO: 2206287 - RNA, 16 nt, Human
uaaugcauguuaggaa

SEQ ID NO: 2206288 - RNA, 22 nt, Human
uaaugcaucuagauuauggagc

SEQ ID NO: 2206289 - RNA, 19 nt, Human
uaaugccacuaaauugaca

SEQ ID NO: 2206290 - RNA, 17 nt, Human
uaaugaugucguuugaa

SEQ ID NO: 2206291 - RNA, 23 nt, Human
uaaugaugucguuugaaucacag

SEQ ID NO: 2206292 - RNA, 11 nt, Human
uaaugauguuu

SEQ ID NO: 2206293 - RNA, 12 nt, Human
uaaugcacuuuc

SEQ ID NO: 2206294 - RNA, 13 nt, Human
uaaugcacuuucu

SEQ ID NO: 2206295 - RNA, 14 nt, Human
uaaugcacuuucua

SEQ ID NO: 2206296 - RNA, 20 nt, Human
uaaucugauggcuucuccag

SEQ ID NO: 2206297 - RNA, 13 nt, Human
uaaucuguguaca

SEQ ID NO: 2206298 - RNA, 16 nt, Human
uaaucucguuucaaaa

SEQ ID NO: 2206299 - RNA, 17 nt, Human
uaaucucguuucaaaaa

SEQ ID NO: 2206300 - RNA, 20 nt, Human
uaaucuuaggggagagcuuu

SEQ ID NO: 2206301 - RNA, 19 nt, Human
uaaucuuaggggagagcuu

SEQ ID NO: 2206302 - RNA, 21 nt, Human
uaaucugauggcuucuccagg

SEQ ID NO: 2206303 - RNA, 14 nt, Human
uaaucuguguacaa

SEQ ID NO: 2206304 - RNA, 19 nt, Human
uaaucuguguacaaagaaa

SEQ ID NO: 2206305 - RNA, 18 nt, Human
uaaucuccucuuuuaucu

SEQ ID NO: 2206306 - RNA, 15 nt, Human
uaaucucguuucaaa

SEQ ID NO: 2206307 - RNA, 13 nt, Human
uaaucuccacagu

SEQ ID NO: 2206308 - RNA, 22 nt, Human
uaaucuauuggguucauuauug

SEQ ID NO: 2206309 - RNA, 20 nt, Human
uaaucuauuggguucauuau

SEQ ID NO: 2206310 - RNA, 17 nt, Human
uaaucuauuucuaugag

SEQ ID NO: 2206311 - RNA, 19 nt, Human
uaaucuauuucuaugagaa

SEQ ID NO: 2206312 - RNA, 19 nt, Human
uaaucucguuucaaaaaca

SEQ ID NO: 2206313 - RNA, 19 nt, Human
uaaucuauuggguucauua

SEQ ID NO: 2206314 - RNA, 19 nt, Human
uaaucguuauguguguaua

SEQ ID NO: 2206315 - RNA, 18 nt, Human
uaaucguuauguguguau

SEQ ID NO: 2206316 - RNA, 17 nt, Human
uaaucguuaugugugua

SEQ ID NO: 2206317 - RNA, 18 nt, Human
uaaucuauuggguucauu

SEQ ID NO: 2206318 - RNA, 11 nt, Human
uaaucuaaaug

SEQ ID NO: 2206319 - RNA, 15 nt, Human
uaauacacacaguua

SEQ ID NO: 2206320 - RNA, 22 nt, Human
uaauacaacauguagcugaguu

SEQ ID NO: 2206321 - RNA, 21 nt, Human
uaauaguucagguaacaggca

SEQ ID NO: 2206322 - RNA, 19 nt, Human
uaauaguuuacauguagua

SEQ ID NO: 2206323 - RNA, 14 nt, Human
uaauauaaaguugg

SEQ ID NO: 2206324 - RNA, 19 nt, Human
uaauauaaaguuggaugcg

SEQ ID NO: 2206325 - RNA, 21 nt, Human
uaauauaaaguaguccuguga

SEQ ID NO: 2206326 - RNA, 21 nt, Human
uaauauaaaaagcuuccauga

SEQ ID NO: 2206327 - RNA, 16 nt, Human
uaauauaacugccuua

SEQ ID NO: 2206328 - RNA, 21 nt, Human
uaauauaacugccuuaaaacu

SEQ ID NO: 2206329 - RNA, 22 nt, Human
uaauauaacugccuuaaaacuu

SEQ ID NO: 2206330 - RNA, 23 nt, Human
uaauauaacugccuuaaaacuuu

SEQ ID NO: 2206331 - RNA, 18 nt, Human
uaauauaagaagcuuuca

SEQ ID NO: 2206332 - RNA, 22 nt, Human
uaauauaagaagcuuucaguau

SEQ ID NO: 2206333 - RNA, 13 nt, Human
uaauaauauacuu

SEQ ID NO: 2206334 - RNA, 14 nt, Human
uaauaauauacuug

SEQ ID NO: 2206335 - RNA, 14 nt, Human
uaauaauaauguuu

SEQ ID NO: 2206336 - RNA, 16 nt, Human
uaauaauauacuugug

SEQ ID NO: 2206337 - RNA, 19 nt, Human
uaauaauauacuuguggac

SEQ ID NO: 2206338 - RNA, 15 nt, Human
uaauaauguuucaaa

SEQ ID NO: 2206339 - RNA, 21 nt, Human
uaauaauauacuuguggacua

SEQ ID NO: 2206340 - RNA, 17 nt, Human
uaauaauuauuauuaaa

SEQ ID NO: 2206341 - RNA, 13 nt, Human
uaauaaagacagg

SEQ ID NO: 2206342 - RNA, 19 nt, Human
uaauaaacuuuuuuuugag

SEQ ID NO: 2206343 - RNA, 21 nt, Human
uaauaaacuuuuuuuugagaa

SEQ ID NO: 2206344 - RNA, 13 nt, Human
uaaguggcugcug

SEQ ID NO: 2206345 - RNA, 20 nt, Human
uaagugggguugcaaccacu

SEQ ID NO: 2206346 - RNA, 21 nt, Human
uaagugggguugcaaccacug

SEQ ID NO: 2206347 - RNA, 17 nt, Human
uaauaaacuuuaauaua

SEQ ID NO: 2206348 - RNA, 18 nt, Human
uaauaaacuuagaauaaa

SEQ ID NO: 2206349 - RNA, 23 nt, Human
uaauaaacuuagaauaaaauugu

SEQ ID NO: 2206350 - RNA, 15 nt, Human
uaagugcuuuguaau

SEQ ID NO: 2206351 - RNA, 13 nt, Human
uaagugcuuugua

SEQ ID NO: 2206352 - RNA, 23 nt, Human
uaagugcuguauaaaaucagcca

SEQ ID NO: 2206353 - RNA, 19 nt, Human
uaaguggaggcacuuuagg

SEQ ID NO: 2206354 - RNA, 17 nt, Human
uaaguggaggcacuuua

SEQ ID NO: 2206355 - RNA, 16 nt, Human
uaaguggaggcacuuu

SEQ ID NO: 2206356 - RNA, 15 nt, Human
uaaguggaggcacuu

SEQ ID NO: 2206357 - RNA, 20 nt, Human
uaagugguacuaacuuuccu

SEQ ID NO: 2206358 - RNA, 20 nt, Human
uaaggccgaagaaggguccu

SEQ ID NO: 2206359 - RNA, 16 nt, Human
uaaggccgaagaaggg

SEQ ID NO: 2206360 - RNA, 15 nt, Human
uaaggcaugaaggau

SEQ ID NO: 2206361 - RNA, 19 nt, Human
uaaggccauuauuguacuu

SEQ ID NO: 2206362 - RNA, 16 nt, Human
uaaggcguggagcugc

SEQ ID NO: 2206363 - RNA, 17 nt, Human
uaaggcguggagcugcc

SEQ ID NO: 2206364 - RNA, 15 nt, Human
uaagugcuguauaaa

SEQ ID NO: 2206365 - RNA, 17 nt, Human
uaagugcuguauaaaau

SEQ ID NO: 2206366 - RNA, 20 nt, Human
uaaggcguggagcugccuga

SEQ ID NO: 2206367 - RNA, 14 nt, Human
uaagugcuguauaa

SEQ ID NO: 2206368 - RNA, 18 nt, Human
uaagugcuguauaaaauc

SEQ ID NO: 2206369 - RNA, 19 nt, Human
uaagugcuguauaaaauca

SEQ ID NO: 2206370 - RNA, 20 nt, Human
uaagugcuguauaaaaucag

SEQ ID NO: 2206371 - RNA, 22 nt, Human
uaagugcuguauaaaaucagcc

SEQ ID NO: 2206372 - RNA, 16 nt, Human
uaauaaagaugcucuu

SEQ ID NO: 2206373 - RNA, 14 nt, Human
uaauaaagaugcuc

SEQ ID NO: 2206374 - RNA, 17 nt, Human
uaauaaagaucauguaa

SEQ ID NO: 2206375 - RNA, 16 nt, Human
uaauaaagaucaugua

SEQ ID NO: 2206376 - RNA, 11 nt, Human
uaauaaagcug

SEQ ID NO: 2206377 - RNA, 15 nt, Human
uaauaaauucagaua

SEQ ID NO: 2206378 - RNA, 16 nt, Human
uaauaaauuauuuauu

SEQ ID NO: 2206379 - RNA, 17 nt, Human
uaauaaauguacauuaa

SEQ ID NO: 2206380 - RNA, 19 nt, Human
uaauaaauguacauuaauu

SEQ ID NO: 2206381 - RNA, 15 nt, Human
uaauaaaucugguag

SEQ ID NO: 2206382 - RNA, 15 nt, Human
uaauaaagcuacuga

SEQ ID NO: 2206383 - RNA, 16 nt, Human
uaauaaagcuacugau

SEQ ID NO: 2206384 - RNA, 17 nt, Human
uaauaaagaugcucuuu

SEQ ID NO: 2206385 - RNA, 12 nt, Human
uaauaacauuac

SEQ ID NO: 2206386 - RNA, 15 nt, Human
uaauaacauuaccuu

SEQ ID NO: 2206387 - RNA, 20 nt, Human
uaauaacauuaccuuacugu

SEQ ID NO: 2206388 - RNA, 13 nt, Human
uaauaaauucaga

SEQ ID NO: 2206389 - RNA, 17 nt, Human
uaauaacagugcauauu

SEQ ID NO: 2206390 - RNA, 21 nt, Human
uaauaacauuaccuuacugug

SEQ ID NO: 2206391 - RNA, 15 nt, Human
uaauaacugugaagu

SEQ ID NO: 2206392 - RNA, 15 nt, Human
uaauaagguugaaca

SEQ ID NO: 2206393 - RNA, 19 nt, Human
uacuugggaagcugaggcg

SEQ ID NO: 2206394 - RNA, 21 nt, Human
uacuugggagaccuguaauca

SEQ ID NO: 2206395 - RNA, 17 nt, Human
uacuugggaagcugagg

SEQ ID NO: 2206396 - RNA, 18 nt, Human
uacuugcuggcucucaga

SEQ ID NO: 2206397 - RNA, 20 nt, Human
uacuugcucuugaugccugg

SEQ ID NO: 2206398 - RNA, 12 nt, Human
uacuugggaggc

SEQ ID NO: 2206399 - RNA, 23 nt, Human
uacuugggagaccuguaaucaua

SEQ ID NO: 2206400 - RNA, 19 nt, Human
uacuugggccauagcuccu

SEQ ID NO: 2206401 - RNA, 22 nt, Human
uacuuuaagcacuacauaaacu

SEQ ID NO: 2206402 - RNA, 19 nt, Human
uacuuguggacacagcucu

SEQ ID NO: 2206403 - RNA, 15 nt, Human
uacuuguggacacag

SEQ ID NO: 2206404 - RNA, 18 nt, Human
uacuuguggacacagcuc

SEQ ID NO: 2206405 - RNA, 23 nt, Human
uacuugccuuauuagagugucuu

SEQ ID NO: 2206406 - RNA, 21 nt, Human
uacuugcucuugaugccuggc

SEQ ID NO: 2206407 - RNA, 14 nt, Human
uacuugaccuccua

SEQ ID NO: 2206408 - RNA, 17 nt, Human
uacuuaccauaugugcu

SEQ ID NO: 2206409 - RNA, 16 nt, Human
uacuuaccuaaacaga

SEQ ID NO: 2206410 - RNA, 19 nt, Human
uacuuacaugcauuacugc

SEQ ID NO: 2206411 - RNA, 22 nt, Human
uacuuaccuaaacagauauaaa

SEQ ID NO: 2206412 - RNA, 16 nt, Human
uacuuagaggaaauaa

SEQ ID NO: 2206413 - RNA, 23 nt, Human
uacuuacaugcauuacugcaugc

SEQ ID NO: 2206414 - RNA, 15 nt, Human
uacuuaauccaaugg

SEQ ID NO: 2206415 - RNA, 18 nt, Human
uacuuaauuccuuucuca

SEQ ID NO: 2206416 - RNA, 13 nt, Human
uacuuaauuucuu

SEQ ID NO: 2206417 - RNA, 15 nt, Human
uacuuagcagcuauc

SEQ ID NO: 2206418 - RNA, 18 nt, Human
uacuuagcaaaguuuuac

SEQ ID NO: 2206419 - RNA, 22 nt, Human
uacuugaagggccagagccagg

SEQ ID NO: 2206420 - RNA, 21 nt, Human
uacuugaagggccagagccag

SEQ ID NO: 2206421 - RNA, 14 nt, Human
uacuguguguguga

SEQ ID NO: 2206422 - RNA, 18 nt, Human
uacugugugugugaauga

SEQ ID NO: 2206423 - RNA, 17 nt, Human
uacugugugugugaaug

SEQ ID NO: 2206424 - RNA, 21 nt, Human
uacugugugugugaaugaaca

SEQ ID NO: 2206425 - RNA, 19 nt, Human
uacugugugugugaaugaa

SEQ ID NO: 2206426 - RNA, 15 nt, Human
uacuguggcuucuua

SEQ ID NO: 2206427 - RNA, 23 nt, Human
uacuguguacagaauucugcuac

SEQ ID NO: 2206428 - RNA, 22 nt, Human
uacuguguacagaauucugcua

SEQ ID NO: 2206429 - RNA, 19 nt, Human
uacuuaauaaauucagaua

SEQ ID NO: 2206430 - RNA, 17 nt, Human
uacuuaauaaauucaga

SEQ ID NO: 2206431 - RNA, 14 nt, Human
uacuuaauaaauuc

SEQ ID NO: 2206432 - RNA, 17 nt, Human
uacuguuguccuauggg

SEQ ID NO: 2206433 - RNA, 14 nt, Human
uacuguugugaccu

SEQ ID NO: 2206434 - RNA, 16 nt, Human
uacuguucugugucuu

SEQ ID NO: 2206435 - RNA, 18 nt, Human
uacuguucucuucuugaa

SEQ ID NO: 2206436 - RNA, 12 nt, Human
uacuguucucuu

SEQ ID NO: 2206437 - RNA, 14 nt, Human
uacuguucuguguc

SEQ ID NO: 2206438 - RNA, 17 nt, Human
uacuguucugugucuuu

SEQ ID NO: 2206439 - RNA, 12 nt, Human
uacuguauuuga

SEQ ID NO: 2206440 - RNA, 23 nt, Human
uacuguauuuuguauuguuucaa

SEQ ID NO: 2206441 - RNA, 17 nt, Human
uacuguauuuuguauug

SEQ ID NO: 2206442 - RNA, 22 nt, Human
uacuguauuuuuaccuuuuucc

SEQ ID NO: 2206443 - RNA, 18 nt, Human
uacugucaaaauaauuuu

SEQ ID NO: 2206444 - RNA, 19 nt, Human
uacugucaaaauaauuuua

SEQ ID NO: 2206445 - RNA, 21 nt, Human
uacuguaucaugacaaagacu

SEQ ID NO: 2206446 - RNA, 14 nt, Human
uacugauuguuuca

SEQ ID NO: 2206447 - RNA, 19 nt, Human
uacugcagcuuuacaugca

SEQ ID NO: 2206448 - RNA, 22 nt, Human
uacugcagcuuuacaugcaauu

SEQ ID NO: 2206449 - RNA, 23 nt, Human
uacugcagcuuuacaugcaauuu

SEQ ID NO: 2206450 - RNA, 10 nt, Human
uacugcaggg

SEQ ID NO: 2206451 - RNA, 12 nt, Human
uacugcagggcc

SEQ ID NO: 2206452 - RNA, 14 nt, Human
uacugcagggccag

SEQ ID NO: 2206453 - RNA, 15 nt, Human
uacugcauacuuuuu

SEQ ID NO: 2206454 - RNA, 13 nt, Human
uacugcauacuuu

SEQ ID NO: 2206455 - RNA, 16 nt, Human
uacugcagggccagga

SEQ ID NO: 2206456 - RNA, 18 nt, Human
uacugcagggccaggacu

SEQ ID NO: 2206457 - RNA, 19 nt, Human
uacugcagggccaggacug

SEQ ID NO: 2206458 - RNA, 17 nt, Human
uacugcauaugaaagga

SEQ ID NO: 2206459 - RNA, 22 nt, Human
uacugcauacuuuuuaaaugua

SEQ ID NO: 2206460 - RNA, 21 nt, Human
uacugcauacuuuuuaaaugu

SEQ ID NO: 2206461 - RNA, 18 nt, Human
uacugcauacuuuuuaaa

SEQ ID NO: 2206462 - RNA, 17 nt, Human
uacugcauacuuuuuaa

SEQ ID NO: 2206463 - RNA, 14 nt, Human
uagaacaucccugc

SEQ ID NO: 2206464 - RNA, 18 nt, Human
uagaacaucccugccagc

SEQ ID NO: 2206465 - RNA, 22 nt, Human
uagaacauggagagcuagaacc

SEQ ID NO: 2206466 - RNA, 16 nt, Human
uagaaccaagaagggc

SEQ ID NO: 2206467 - RNA, 17 nt, Human
uagaaccaagaagggcu

SEQ ID NO: 2206468 - RNA, 23 nt, Human
uagaaccaagaagggcuagaacc

SEQ ID NO: 2206469 - RNA, 23 nt, Human
uagaacagagaaagaggaagcuu

SEQ ID NO: 2206470 - RNA, 17 nt, Human
uagaacagauaaucagu

SEQ ID NO: 2206471 - RNA, 18 nt, Human
uagaaauuagcuguguga

SEQ ID NO: 2206472 - RNA, 14 nt, Human
uagaaauuuccaga

SEQ ID NO: 2206473 - RNA, 23 nt, Human
uagaaauuuauuuccuaguucug

SEQ ID NO: 2206474 - RNA, 19 nt, Human
uagaaauuacacccaaaga

SEQ ID NO: 2206475 - RNA, 22 nt, Human
uagaaauuaccagaguuguucu

SEQ ID NO: 2206476 - RNA, 22 nt, Human
uagaaauuuuucagaugcuucu

SEQ ID NO: 2206477 - RNA, 19 nt, Human
uagaaauuuuucagaugcu

SEQ ID NO: 2206478 - RNA, 15 nt, Human
uagaaauuuccagag

SEQ ID NO: 2206479 - RNA, 16 nt, Human
uagaaauuuccagaga

SEQ ID NO: 2206480 - RNA, 16 nt, Human
uagaacaaaggacaga

SEQ ID NO: 2206481 - RNA, 20 nt, Human
uagaacaaaggacagaguau

SEQ ID NO: 2206482 - RNA, 14 nt, Human
uagaacacagaaag

SEQ ID NO: 2206483 - RNA, 15 nt, Human
uagaacacaggcaaa

SEQ ID NO: 2206484 - RNA, 15 nt, Human
uagaacacagaaagc

SEQ ID NO: 2206485 - RNA, 18 nt, Human
uagaaaugaccaauauua

SEQ ID NO: 2206486 - RNA, 19 nt, Human
uagaaaugaugauguggaa

SEQ ID NO: 2206487 - RNA, 15 nt, Human
uagaaaugguuguau

SEQ ID NO: 2206488 - RNA, 12 nt, Human
uagaaaucauuu

SEQ ID NO: 2206489 - RNA, 22 nt, Human
uagaaauagcuccguggagcag

SEQ ID NO: 2206490 - RNA, 14 nt, Human
uagaaauaugauuu

SEQ ID NO: 2206491 - RNA, 16 nt, Human
uagaaaugguuguauu

SEQ ID NO: 2206492 - RNA, 17 nt, Human
uagaaaugguuguauua

SEQ ID NO: 2206493 - RNA, 19 nt, Human
uagaaaugguuguauuaga

SEQ ID NO: 2206494 - RNA, 20 nt, Human
uagaaaugguuguauuagau

SEQ ID NO: 2206495 - RNA, 23 nt, Human
uagaaaugguuguauuagauguu

SEQ ID NO: 2206496 - RNA, 19 nt, Human
uagaaauguaacuuuugua

SEQ ID NO: 2206497 - RNA, 23 nt, Human
uagaaauaucugaaaauguaugu

SEQ ID NO: 2206498 - RNA, 21 nt, Human
uagaaauaucugaaaauguau

SEQ ID NO: 2206499 - RNA, 20 nt, Human
uagaaauaucugaaaaugua

SEQ ID NO: 2206500 - RNA, 15 nt, Human
uagaaauauaauuga

SEQ ID NO: 2206501 - RNA, 15 nt, Human
uagaaaggggcccag

SEQ ID NO: 2206502 - RNA, 19 nt, Human
uagaaauaaaggaugugau

SEQ ID NO: 2206503 - RNA, 20 nt, Human
uagaaaguucaaaaagucua

SEQ ID NO: 2206504 - RNA, 15 nt, Human
uagaaauaauaugca

SEQ ID NO: 2206505 - RNA, 16 nt, Human
uagaaauaagugguua

SEQ ID NO: 2206506 - RNA, 22 nt, Human
uagaaauaagugguuauuucuc

SEQ ID NO: 2206507 - RNA, 16 nt, Human
uagaaauaauaugcau

SEQ ID NO: 2206508 - RNA, 23 nt, Human
uagaaauaagugguuauuucuca

SEQ ID NO: 2206509 - RNA, 21 nt, Human
uagaaauagcuccguggagca

SEQ ID NO: 2206510 - RNA, 16 nt, Human
uagaaauaaauagcua

SEQ ID NO: 2206511 - RNA, 11 nt, Human
uagaaauaagu

SEQ ID NO: 2206512 - RNA, 12 nt, Human
uagaaauaagug

SEQ ID NO: 2206513 - RNA, 19 nt, Human
uagaaauaaauagcuauau

SEQ ID NO: 2206514 - RNA, 20 nt, Human
uagaaauaaaggaugugauu

SEQ ID NO: 2206515 - RNA, 22 nt, Human
uagaaagccaaaucaaaauaug

SEQ ID NO: 2206516 - RNA, 15 nt, Human
uagaaagcaggggcu

SEQ ID NO: 2206517 - RNA, 23 nt, Human
uagaaagccuguuccccucacug

SEQ ID NO: 2206518 - RNA, 13 nt, Human
uagaaaggccuuu

SEQ ID NO: 2206519 - RNA, 14 nt, Human
uagaaaggccuuua

SEQ ID NO: 2206520 - RNA, 15 nt, Human
uagaaaggccuuuaa

SEQ ID NO: 2206521 - RNA, 16 nt, Human
uagaaaggccuuuaaa

SEQ ID NO: 2206522 - RNA, 15 nt, Human
uagaaagcauuugaa

SEQ ID NO: 2206523 - RNA, 16 nt, Human
uagaaagcauuugaau

SEQ ID NO: 2206524 - RNA, 17 nt, Human
uagaaagcauuugaaug

SEQ ID NO: 2206525 - RNA, 18 nt, Human
uagaaagcauuugaaugc

SEQ ID NO: 2206526 - RNA, 19 nt, Human
uagaaagcauuugaaugca

SEQ ID NO: 2206527 - RNA, 20 nt, Human
uagaaagcauuugaaugcau

SEQ ID NO: 2206528 - RNA, 21 nt, Human
uagaaagcauuugaaugcauu

SEQ ID NO: 2206529 - RNA, 22 nt, Human
uagaaagcauuugaaugcauuu

SEQ ID NO: 2206530 - RNA, 17 nt, Human
uagaaagacagagcugg

SEQ ID NO: 2206531 - RNA, 21 nt, Human
uagaaagaagcccaauauuau

SEQ ID NO: 2206532 - RNA, 23 nt, Human
uagaaagaagcccaauauuauaa

SEQ ID NO: 2206533 - RNA, 15 nt, Human
uagaaagaagaugaa

SEQ ID NO: 2206534 - RNA, 14 nt, Human
uagaaagaagccca

SEQ ID NO: 2206535 - RNA, 15 nt, Human
uagaaacuuccaaau

SEQ ID NO: 2206536 - RNA, 13 nt, Human
uagaaagcauuug

SEQ ID NO: 2206537 - RNA, 14 nt, Human
uagaaagcauuuga

SEQ ID NO: 2206538 - RNA, 14 nt, Human
uagaaagcaggggc

SEQ ID NO: 2206539 - RNA, 22 nt, Human
uagaaagcaggggcuacaagag

SEQ ID NO: 2206540 - RNA, 15 nt, Human
uacuuuaccaccccc

SEQ ID NO: 2206541 - RNA, 19 nt, Human
uacuuuaccacccccacac

SEQ ID NO: 2206542 - RNA, 16 nt, Human
uacuuuacucauuuuu

SEQ ID NO: 2206543 - RNA, 17 nt, Human
uacuuuauguuacuaca

SEQ ID NO: 2206544 - RNA, 20 nt, Human
uacuuuauguuacuacaugc

SEQ ID NO: 2206545 - RNA, 20 nt, Human
uacuuuauuuauacacuguc

SEQ ID NO: 2206546 - RNA, 20 nt, Human
uacuuucauccugacucugc

SEQ ID NO: 2206547 - RNA, 18 nt, Human
uacugaucaugcauuguu

SEQ ID NO: 2206548 - RNA, 18 nt, Human
uacugauucacugcaugg

SEQ ID NO: 2206549 - RNA, 23 nt, Human
uacugauguuccuagugaaagag

SEQ ID NO: 2206550 - RNA, 17 nt, Human
uacugaucaugcauugu

SEQ ID NO: 2206551 - RNA, 16 nt, Human
uacugaucaugcauug

SEQ ID NO: 2206552 - RNA, 16 nt, Human
uacugauauauuuuac

SEQ ID NO: 2206553 - RNA, 14 nt, Human
uacugauauauuuu

SEQ ID NO: 2206554 - RNA, 16 nt, Human
uacugaguuacauugu

SEQ ID NO: 2206555 - RNA, 16 nt, Human
uacugauaaagaaaga

SEQ ID NO: 2206556 - RNA, 22 nt, Human
uacugaggccuaaaaguaaaca

SEQ ID NO: 2206557 - RNA, 23 nt, Human
uacugagggaccaacugggccca

SEQ ID NO: 2206558 - RNA, 18 nt, Human
uacugagcuucucuguga

SEQ ID NO: 2206559 - RNA, 14 nt, Human
uacugagcuucucu

SEQ ID NO: 2206560 - RNA, 17 nt, Human
uacugagcuucucugug

SEQ ID NO: 2206561 - RNA, 19 nt, Human
uacugagccuuguaauucu

SEQ ID NO: 2206562 - RNA, 23 nt, Human
uacugagccuuguaauucuaaau

SEQ ID NO: 2206563 - RNA, 15 nt, Human
uacugaggugcuaug

SEQ ID NO: 2206564 - RNA, 15 nt, Human
uacugagccuuguaa

SEQ ID NO: 2206565 - RNA, 18 nt, Human
uacugagccuuguaauuc

SEQ ID NO: 2206566 - RNA, 17 nt, Human
uacuccucuuuacacug

SEQ ID NO: 2206567 - RNA, 14 nt, Human
uacuccucugcagu

SEQ ID NO: 2206568 - RNA, 16 nt, Human
uacuccucugcagugc

SEQ ID NO: 2206569 - RNA, 21 nt, Human
uacuccucugcagugccuugg

SEQ ID NO: 2206570 - RNA, 22 nt, Human
uacuccucugcagugccuuggg

SEQ ID NO: 2206571 - RNA, 11 nt, Human
uacucaugugu

SEQ ID NO: 2206572 - RNA, 12 nt, Human
uacuccucugca

SEQ ID NO: 2206573 - RNA, 13 nt, Human
uacuccucugcag

SEQ ID NO: 2206574 - RNA, 22 nt, Human
uacuccugcaaaauuuuauagc

SEQ ID NO: 2206575 - RNA, 17 nt, Human
uacuccuguaauuccua

SEQ ID NO: 2206576 - RNA, 19 nt, Human
uacuccuguaauuccuacc

SEQ ID NO: 2206577 - RNA, 22 nt, Human
uacuccuguaauuccuaccucc

SEQ ID NO: 2206578 - RNA, 17 nt, Human
uacuccugcaaaauuuu

SEQ ID NO: 2206579 - RNA, 16 nt, Human
uacuccugcaaaauuu

SEQ ID NO: 2206580 - RNA, 14 nt, Human
uacuccugcaaaau

SEQ ID NO: 2206581 - RNA, 12 nt, Human
uacuccugcaaa

SEQ ID NO: 2206582 - RNA, 12 nt, Human
uacucccaucug

SEQ ID NO: 2206583 - RNA, 14 nt, Human
uacucccaucugug

SEQ ID NO: 2206584 - RNA, 16 nt, Human
uacucccaucugugaa

SEQ ID NO: 2206585 - RNA, 17 nt, Human
uacucccaucugugaaa

SEQ ID NO: 2206586 - RNA, 18 nt, Human
uacuacaugugggagcuu

SEQ ID NO: 2206587 - RNA, 17 nt, Human
uacuacaucgcccucca

SEQ ID NO: 2206588 - RNA, 13 nt, Human
uacuacaugcacu

SEQ ID NO: 2206589 - RNA, 14 nt, Human
uacuaccuugaaaa

SEQ ID NO: 2206590 - RNA, 13 nt, Human
uacuaccuugaaa

SEQ ID NO: 2206591 - RNA, 20 nt, Human
uacuacaguccucccaucuc

SEQ ID NO: 2206592 - RNA, 20 nt, Human
uacuacaguuuguuaguaug

SEQ ID NO: 2206593 - RNA, 15 nt, Human
uacucacagucucuu

SEQ ID NO: 2206594 - RNA, 20 nt, Human
uacuaccuugaaaauaagaa

SEQ ID NO: 2206595 - RNA, 16 nt, Human
uacuaccuugaaaaua

SEQ ID NO: 2206596 - RNA, 12 nt, Human
uacucaccucac

SEQ ID NO: 2206597 - RNA, 18 nt, Human
uacuacuagaugucuuua

SEQ ID NO: 2206598 - RNA, 17 nt, Human
uacuacuagaugucuuu

SEQ ID NO: 2206599 - RNA, 21 nt, Human
uacucacagucucuuuaaucu

SEQ ID NO: 2206600 - RNA, 20 nt, Human
uacucacuuucuagauuaag

SEQ ID NO: 2206601 - RNA, 14 nt, Human
uacucaccucaccc

SEQ ID NO: 2206602 - RNA, 16 nt, Human
uacucagcccugggcc

SEQ ID NO: 2206603 - RNA, 15 nt, Human
uacucagcccugggc

SEQ ID NO: 2206604 - RNA, 14 nt, Human
uacucagcccuggg

SEQ ID NO: 2206605 - RNA, 13 nt, Human
uacucagcccugg

SEQ ID NO: 2206606 - RNA, 12 nt, Human
uacucagcccug

SEQ ID NO: 2206607 - RNA, 23 nt, Human
uacucagcagcccuccucacccc

SEQ ID NO: 2206608 - RNA, 20 nt, Human
uacucagcagcccuccucac

SEQ ID NO: 2206609 - RNA, 19 nt, Human
uacucagcagcccuccuca

SEQ ID NO: 2206610 - RNA, 23 nt, Human
uacucagcccugggccccaccac

SEQ ID NO: 2206611 - RNA, 22 nt, Human
uacucagcccugggccccacca

SEQ ID NO: 2206612 - RNA, 13 nt, Human
uacucaggaagaa

SEQ ID NO: 2206613 - RNA, 22 nt, Human
uacucaggaggcugaggcagaa

SEQ ID NO: 2206614 - RNA, 12 nt, Human
uacucaggaggc

SEQ ID NO: 2206615 - RNA, 14 nt, Human
uacucaggaagaac

SEQ ID NO: 2206616 - RNA, 17 nt, Human
uacucaugaucuuguga

SEQ ID NO: 2206617 - RNA, 16 nt, Human
uacucaugaucuugug

SEQ ID NO: 2206618 - RNA, 23 nt, Human
uacucauauauaucuaucuuaua

SEQ ID NO: 2206619 - RNA, 17 nt, Human
uacucauccuuguauaa

SEQ ID NO: 2206620 - RNA, 21 nt, Human
uacucauauauaucuaucuua

SEQ ID NO: 2206621 - RNA, 19 nt, Human
uacucauauauaucuaucu

SEQ ID NO: 2206622 - RNA, 20 nt, Human
uacucauaaugugaaguguu

SEQ ID NO: 2206623 - RNA, 21 nt, Human
uacucauaaugugaaguguua

SEQ ID NO: 2206624 - RNA, 15 nt, Human
uacucaggaggcuga

SEQ ID NO: 2206625 - RNA, 14 nt, Human
uacucauaauguga

SEQ ID NO: 2206626 - RNA, 15 nt, Human
uacucauaaugugaa

SEQ ID NO: 2206627 - RNA, 19 nt, Human
uacucauaaugugaagugu

SEQ ID NO: 2206628 - RNA, 17 nt, Human
uacucagaagccugagg

SEQ ID NO: 2206629 - RNA, 16 nt, Human
uacucagaagccugag

SEQ ID NO: 2206630 - RNA, 19 nt, Human
uacucagaagccugaggcu

SEQ ID NO: 2206631 - RNA, 14 nt, Human
uacucagaauuaag

SEQ ID NO: 2206632 - RNA, 16 nt, Human
uacucagaauucucua

SEQ ID NO: 2206633 - RNA, 18 nt, Human
uacucagcagcccuccuc

SEQ ID NO: 2206634 - RNA, 17 nt, Human
uacucagcagcccuccu

SEQ ID NO: 2206635 - RNA, 16 nt, Human
uacucagcagcccucc

SEQ ID NO: 2206636 - RNA, 15 nt, Human
uacucagcagcccuc

SEQ ID NO: 2206637 - RNA, 14 nt, Human
uacucagcagcccu

SEQ ID NO: 2206638 - RNA, 22 nt, Human
uacucagaauucucuaguuuga

SEQ ID NO: 2206639 - RNA, 14 nt, Human
uacgaauacuuuug

SEQ ID NO: 2206640 - RNA, 22 nt, Human
uaccuuuuuuauacauaaacaa

SEQ ID NO: 2206641 - RNA, 23 nt, Human
uaccuuuguucccaaauuucaua

SEQ ID NO: 2206642 - RNA, 17 nt, Human
uacgacuuuauuuucug

SEQ ID NO: 2206643 - RNA, 14 nt, Human
uacuaacuaaacuc

SEQ ID NO: 2206644 - RNA, 15 nt, Human
uacgacuuuauuuuc

SEQ ID NO: 2206645 - RNA, 14 nt, Human
uacgacuuuauuuu

SEQ ID NO: 2206646 - RNA, 15 nt, Human
uacuaacuaaacucu

SEQ ID NO: 2206647 - RNA, 19 nt, Human
uacuaaccagcagaaaugc

SEQ ID NO: 2206648 - RNA, 18 nt, Human
uacuaaccagcagaaaug

SEQ ID NO: 2206649 - RNA, 17 nt, Human
uacuaaccagcagaaau

SEQ ID NO: 2206650 - RNA, 18 nt, Human
uacuacacauucaauaag

SEQ ID NO: 2206651 - RNA, 18 nt, Human
uacuacaaaauuugaaau

SEQ ID NO: 2206652 - RNA, 13 nt, Human
uacuacaaaauuu

SEQ ID NO: 2206653 - RNA, 12 nt, Human
uacuacaguccu

SEQ ID NO: 2206654 - RNA, 17 nt, Human
uacuacaguccucccau

SEQ ID NO: 2206655 - RNA, 22 nt, Human
uacuaauaaaauuuaaaagucu

SEQ ID NO: 2206656 - RNA, 17 nt, Human
uacuaauagacaauuua

SEQ ID NO: 2206657 - RNA, 15 nt, Human
uacuaauagacaauu

SEQ ID NO: 2206658 - RNA, 16 nt, Human
uaccuuuaugguuucu

SEQ ID NO: 2206659 - RNA, 14 nt, Human
uaccuuuaugguuu

SEQ ID NO: 2206660 - RNA, 12 nt, Human
uaccuuugucac

SEQ ID NO: 2206661 - RNA, 18 nt, Human
uaccuuuuuuauacauaa

SEQ ID NO: 2206662 - RNA, 20 nt, Human
uaccuuuuuuauacauaaac

SEQ ID NO: 2206663 - RNA, 19 nt, Human
uaccuuuuuuauacauaaa

SEQ ID NO: 2206664 - RNA, 18 nt, Human
uaccuugugacccagcac

SEQ ID NO: 2206665 - RNA, 20 nt, Human
uaccuuguauacuguaggca

SEQ ID NO: 2206666 - RNA, 14 nt, Human
uaccuuguauacug

SEQ ID NO: 2206667 - RNA, 16 nt, Human
uaccuuguauacugua

SEQ ID NO: 2206668 - RNA, 22 nt, Human
uaccuugguucccccacugauc

SEQ ID NO: 2206669 - RNA, 13 nt, Human
uaccuugguuccc

SEQ ID NO: 2206670 - RNA, 19 nt, Human
uaccuuugacaaagguaaa

SEQ ID NO: 2206671 - RNA, 20 nt, Human
uaccuuuguauucucuccug

SEQ ID NO: 2206672 - RNA, 21 nt, Human
uacccauucguggugaucaau

SEQ ID NO: 2206673 - RNA, 22 nt, Human
uacccauccccgcagugugcac

SEQ ID NO: 2206674 - RNA, 18 nt, Human
uacccaugacuuuauaug

SEQ ID NO: 2206675 - RNA, 14 nt, Human
uaccuuccuucccu

SEQ ID NO: 2206676 - RNA, 15 nt, Human
uaccuuccuucccug

SEQ ID NO: 2206677 - RNA, 16 nt, Human
uaccuuccuucccugg

SEQ ID NO: 2206678 - RNA, 18 nt, Human
uaccuugaacacuggggg

SEQ ID NO: 2206679 - RNA, 22 nt, Human
uaccuugaaaauaagaauagaa

SEQ ID NO: 2206680 - RNA, 14 nt, Human
uaccuucucccuca

SEQ ID NO: 2206681 - RNA, 14 nt, Human
uaccuucuguaguu

SEQ ID NO: 2206682 - RNA, 15 nt, Human
uaccuugaggucuuu

SEQ ID NO: 2206683 - RNA, 22 nt, Human
uaccuucucccucauuucagga

SEQ ID NO: 2206684 - RNA, 15 nt, Human
uacccaccucagccu

SEQ ID NO: 2206685 - RNA, 14 nt, Human
uacccaccucagcc

SEQ ID NO: 2206686 - RNA, 21 nt, Human
uacccacguucucacacccac

SEQ ID NO: 2206687 - RNA, 16 nt, Human
uacccagggccugcag

SEQ ID NO: 2206688 - RNA, 22 nt, Human
uacccaguaacucaucugucac

SEQ ID NO: 2206689 - RNA, 19 nt, Human
uacccaguaacucaucugu

SEQ ID NO: 2206690 - RNA, 17 nt, Human
uacccauccccgcagug

SEQ ID NO: 2206691 - RNA, 15 nt, Human
uacccauauccccuc

SEQ ID NO: 2206692 - RNA, 12 nt, Human
uacccauauccc

SEQ ID NO: 2206693 - RNA, 22 nt, Human
uacccaucccauaugccugggc

SEQ ID NO: 2206694 - RNA, 15 nt, Human
uaccaaucauuuuaa

SEQ ID NO: 2206695 - RNA, 19 nt, Human
uaccaaucauuuuaauuau

SEQ ID NO: 2206696 - RNA, 20 nt, Human
uaccaaucauuuuaauuauu

SEQ ID NO: 2206697 - RNA, 22 nt, Human
uaccaaucauuuuaauuauuau

SEQ ID NO: 2206698 - RNA, 13 nt, Human
uaccaaugaaaaa

SEQ ID NO: 2206699 - RNA, 17 nt, Human
uaccaaugaaaaaaugu

SEQ ID NO: 2206700 - RNA, 15 nt, Human
uaccaaugaaaaaau

SEQ ID NO: 2206701 - RNA, 13 nt, Human
uaccaaugcaugc

SEQ ID NO: 2206702 - RNA, 13 nt, Human
uaccaaugcugca

SEQ ID NO: 2206703 - RNA, 11 nt, Human
uaccaaugcau

SEQ ID NO: 2206704 - RNA, 12 nt, Human
uaccaaugcaug

SEQ ID NO: 2206705 - RNA, 14 nt, Human
uaccaaugcaugca

SEQ ID NO: 2206706 - RNA, 13 nt, Human
uaccacagacaua

SEQ ID NO: 2206707 - RNA, 16 nt, Human
uaccaaguuucaggua

SEQ ID NO: 2206708 - RNA, 21 nt, Human
uaccaaguuucagguauuaag

SEQ ID NO: 2206709 - RNA, 14 nt, Human
uaccaacuuucugu

SEQ ID NO: 2206710 - RNA, 15 nt, Human
uaccaacuuucugua

SEQ ID NO: 2206711 - RNA, 17 nt, Human
uaccaacuuucuguaaa

SEQ ID NO: 2206712 - RNA, 19 nt, Human
uaccaacuuucuguaaacu

SEQ ID NO: 2206713 - RNA, 22 nt, Human
uaccaauagauuccccauugcc

SEQ ID NO: 2206714 - RNA, 23 nt, Human
uaccauuuugggguacccacugc

SEQ ID NO: 2206715 - RNA, 20 nt, Human
uaccauuuuuuaaggaaaca

SEQ ID NO: 2206716 - RNA, 21 nt, Human
uaccauuuauacaaauuagaa

SEQ ID NO: 2206717 - RNA, 16 nt, Human
uaccauuucagagagg

SEQ ID NO: 2206718 - RNA, 15 nt, Human
uaccauuugccuccc

SEQ ID NO: 2206719 - RNA, 18 nt, Human
uaccauuuauacaaauua

SEQ ID NO: 2206720 - RNA, 17 nt, Human
uaccauuuauacaaauu

SEQ ID NO: 2206721 - RNA, 15 nt, Human
uaccauuuauacaaa

SEQ ID NO: 2206722 - RNA, 14 nt, Human
uaccauuuauacaa

SEQ ID NO: 2206723 - RNA, 15 nt, Human
uaccauuucagagag

SEQ ID NO: 2206724 - RNA, 12 nt, Human
uaccauuucaga

SEQ ID NO: 2206725 - RNA, 14 nt, Human
uaccacagugucug

SEQ ID NO: 2206726 - RNA, 19 nt, Human
uaccaaugcuuuuaucaaa

SEQ ID NO: 2206727 - RNA, 12 nt, Human
uaccacagcagc

SEQ ID NO: 2206728 - RNA, 15 nt, Human
uaccaccacgcccgg

SEQ ID NO: 2206729 - RNA, 23 nt, Human
uaccacaggaaccacaagacugc

SEQ ID NO: 2206730 - RNA, 13 nt, Human
uaccacagugucu

SEQ ID NO: 2206731 - RNA, 20 nt, Human
uacccacguucucacaccca

SEQ ID NO: 2206732 - RNA, 11 nt, Human
uacccacugcu

SEQ ID NO: 2206733 - RNA, 12 nt, Human
uacccacugcuc

SEQ ID NO: 2206734 - RNA, 13 nt, Human
uacccacugcucu

SEQ ID NO: 2206735 - RNA, 14 nt, Human
uacccacugcucug

SEQ ID NO: 2206736 - RNA, 16 nt, Human
uacccagcgagcccug

SEQ ID NO: 2206737 - RNA, 18 nt, Human
uacccagcgagcccuggu

SEQ ID NO: 2206738 - RNA, 22 nt, Human
uacccaggugcuaggaacacuc

SEQ ID NO: 2206739 - RNA, 12 nt, Human
uacccaccccca

SEQ ID NO: 2206740 - RNA, 15 nt, Human
uacccacccccaccc

SEQ ID NO: 2206741 - RNA, 17 nt, Human
uacccaaauccucucca

SEQ ID NO: 2206742 - RNA, 13 nt, Human
uacccaaccacuc

SEQ ID NO: 2206743 - RNA, 21 nt, Human
uacccaaccacucaaauuaau

SEQ ID NO: 2206744 - RNA, 12 nt, Human
uacccaagcaaa

SEQ ID NO: 2206745 - RNA, 11 nt, Human
uacccaaagga

SEQ ID NO: 2206746 - RNA, 22 nt, Human
uacccaaaggauacuguaacac

SEQ ID NO: 2206747 - RNA, 21 nt, Human
uaccauuuuuuaaggaaacaa

SEQ ID NO: 2206748 - RNA, 23 nt, Human
uacccacccccacccaagggccu

SEQ ID NO: 2206749 - RNA, 18 nt, Human
uacccacaccucugccag

SEQ ID NO: 2206750 - RNA, 17 nt, Human
uacccacaccucugcca

SEQ ID NO: 2206751 - RNA, 19 nt, Human
uacccacaccucugccaga

SEQ ID NO: 2206752 - RNA, 17 nt, Human
uacccacccccacccaa

SEQ ID NO: 2206753 - RNA, 19 nt, Human
uacccacccccacccaagg

SEQ ID NO: 2206754 - RNA, 17 nt, Human
uaccaaaugcuuuaaaa

SEQ ID NO: 2206755 - RNA, 18 nt, Human
uaccaaaccgccagcgaa

SEQ ID NO: 2206756 - RNA, 12 nt, Human
uaccaaccuguu

SEQ ID NO: 2206757 - RNA, 20 nt, Human
uaccaaaugcuuuaaaaacu

SEQ ID NO: 2206758 - RNA, 20 nt, Human
uaccaacuguuuagggcccu

SEQ ID NO: 2206759 - RNA, 13 nt, Human
uaccaacuuucug

SEQ ID NO: 2206760 - RNA, 23 nt, Human
uaccaaaauuauuucagaaaugu

SEQ ID NO: 2206761 - RNA, 16 nt, Human
uaccaacacgagcagg

SEQ ID NO: 2206762 - RNA, 17 nt, Human
uaccaaaauuauuucag

SEQ ID NO: 2206763 - RNA, 18 nt, Human
uaccaaaauuauuucaga

SEQ ID NO: 2206764 - RNA, 14 nt, Human
uacauuuuauauua

SEQ ID NO: 2206765 - RNA, 14 nt, Human
uacaugauucauuu

SEQ ID NO: 2206766 - RNA, 16 nt, Human
uacaugcaauuuauua

SEQ ID NO: 2206767 - RNA, 19 nt, Human
uacaugcaauuuauuaaaa

SEQ ID NO: 2206768 - RNA, 15 nt, Human
uacaugauucauuuu

SEQ ID NO: 2206769 - RNA, 22 nt, Human
uacaugagguacugagagugaa

SEQ ID NO: 2206770 - RNA, 21 nt, Human
uacaugagguacugagaguga

SEQ ID NO: 2206771 - RNA, 17 nt, Human
uacauuuguauaaaaua

SEQ ID NO: 2206772 - RNA, 11 nt, Human
uacauuugugu

SEQ ID NO: 2206773 - RNA, 16 nt, Human
uacauuuguauaaaau

SEQ ID NO: 2206774 - RNA, 23 nt, Human
uacauuuggagacacaacuauuu

SEQ ID NO: 2206775 - RNA, 20 nt, Human
uacaugcaauuuauuaaaau

SEQ ID NO: 2206776 - RNA, 19 nt, Human
uacauaagauaaaugugcu

SEQ ID NO: 2206777 - RNA, 18 nt, Human
uacauaagauaaaugugc

SEQ ID NO: 2206778 - RNA, 18 nt, Human
uacaguuccuagguauaa

SEQ ID NO: 2206779 - RNA, 12 nt, Human
uacaguucaguu

SEQ ID NO: 2206780 - RNA, 19 nt, Human
uacaguguuauuuucuuug

SEQ ID NO: 2206781 - RNA, 14 nt, Human
uacaguguucuguu

SEQ ID NO: 2206782 - RNA, 15 nt, Human
uacaguguucuguuu

SEQ ID NO: 2206783 - RNA, 16 nt, Human
uacaguguuauuuucu

SEQ ID NO: 2206784 - RNA, 19 nt, Human
uacaguuacucagaauucu

SEQ ID NO: 2206785 - RNA, 13 nt, Human
uacaguuaaguuu

SEQ ID NO: 2206786 - RNA, 23 nt, Human
uacaguuacucagaauucucuag

SEQ ID NO: 2206787 - RNA, 18 nt, Human
uacaugaauugcauuuua

SEQ ID NO: 2206788 - RNA, 15 nt, Human
uacaucuuucacauu

SEQ ID NO: 2206789 - RNA, 14 nt, Human
uacaucuuucacau

SEQ ID NO: 2206790 - RNA, 14 nt, Human
uacaucuucugccu

SEQ ID NO: 2206791 - RNA, 17 nt, Human
uacaucuucugccuuag

SEQ ID NO: 2206792 - RNA, 19 nt, Human
uacaugacucagcauaccu

SEQ ID NO: 2206793 - RNA, 17 nt, Human
uacaugagaacaaacag

SEQ ID NO: 2206794 - RNA, 21 nt, Human
uacaugacauuuauuuuucau

SEQ ID NO: 2206795 - RNA, 16 nt, Human
uacaugacauuuauuu

SEQ ID NO: 2206796 - RNA, 16 nt, Human
uacaugagaaggaacu

SEQ ID NO: 2206797 - RNA, 18 nt, Human
uacaugagaacaaacaga

SEQ ID NO: 2206798 - RNA, 15 nt, Human
uacaucgcccuccac

SEQ ID NO: 2206799 - RNA, 15 nt, Human
uacauccucaugcag

SEQ ID NO: 2206800 - RNA, 14 nt, Human
uacaucgcccucca

SEQ ID NO: 2206801 - RNA, 19 nt, Human
uacaucuauuuuggauugu

SEQ ID NO: 2206802 - RNA, 18 nt, Human
uacaucuauuuuggauug

SEQ ID NO: 2206803 - RNA, 23 nt, Human
uacaucuauuuuggauuguauau

SEQ ID NO: 2206804 - RNA, 22 nt, Human
uacaucuauuuuggauuguaua

SEQ ID NO: 2206805 - RNA, 20 nt, Human
uacaucuauuuuggauugua

SEQ ID NO: 2206806 - RNA, 22 nt, Human
uacauaagauaaaugugcugaa

SEQ ID NO: 2206807 - RNA, 15 nt, Human
uacauaaguaauuca

SEQ ID NO: 2206808 - RNA, 22 nt, Human
uacaguucaguuccucuuugca

SEQ ID NO: 2206809 - RNA, 22 nt, Human
uacauaagcggcguaaguuuaa

SEQ ID NO: 2206810 - RNA, 22 nt, Human
uacauccucaugcagccgugau

SEQ ID NO: 2206811 - RNA, 18 nt, Human
uacacaccuuauauuuac

SEQ ID NO: 2206812 - RNA, 17 nt, Human
uacacacugcauguuug

SEQ ID NO: 2206813 - RNA, 17 nt, Human
uacacaccuaagggaca

SEQ ID NO: 2206814 - RNA, 22 nt, Human
uacacaccuaagggacauguuu

SEQ ID NO: 2206815 - RNA, 23 nt, Human
uacacacacacacacagccacac

SEQ ID NO: 2206816 - RNA, 22 nt, Human
uacacacacacacacagccaca

SEQ ID NO: 2206817 - RNA, 21 nt, Human
uacacacacacgcgugcacac

SEQ ID NO: 2206818 - RNA, 15 nt, Human
uacacacacauacac

SEQ ID NO: 2206819 - RNA, 17 nt, Human
uacacaaugguuuucuu

SEQ ID NO: 2206820 - RNA, 15 nt, Human
uacacaaguaaacau

SEQ ID NO: 2206821 - RNA, 16 nt, Human
uacacaaguaaacauu

SEQ ID NO: 2206822 - RNA, 21 nt, Human
uacacaaugguuuucuugugu

SEQ ID NO: 2206823 - RNA, 23 nt, Human
uacacaaugguuuucuugugugu

SEQ ID NO: 2206824 - RNA, 12 nt, Human
uacacugugaac

SEQ ID NO: 2206825 - RNA, 16 nt, Human
uacacuguauuuguau

SEQ ID NO: 2206826 - RNA, 21 nt, Human
uacacugguuugagcuuagug

SEQ ID NO: 2206827 - RNA, 22 nt, Human
uacacuggaggagagaagaaug

SEQ ID NO: 2206828 - RNA, 19 nt, Human
uacacuggaggagagaaga

SEQ ID NO: 2206829 - RNA, 21 nt, Human
uacacuggaggagagaagaau

SEQ ID NO: 2206830 - RNA, 14 nt, Human
uacacuguuucaaa

SEQ ID NO: 2206831 - RNA, 16 nt, Human
uacacugugcugaguc

SEQ ID NO: 2206832 - RNA, 22 nt, Human
uacacacugcauguuugugauu

SEQ ID NO: 2206833 - RNA, 22 nt, Human
uacacagaucacagcuucagcc

SEQ ID NO: 2206834 - RNA, 18 nt, Human
uacacagaaauacaguua

SEQ ID NO: 2206835 - RNA, 18 nt, Human
uacacagagcaggacugc

SEQ ID NO: 2206836 - RNA, 23 nt, Human
uaauuuucuucaugcaaugacau

SEQ ID NO: 2206837 - RNA, 14 nt, Human
uaauuuucuucaug

SEQ ID NO: 2206838 - RNA, 12 nt, Human
uaauuuucuacc

SEQ ID NO: 2206839 - RNA, 15 nt, Human
uaauuuugaauaaau

SEQ ID NO: 2206840 - RNA, 12 nt, Human
uaauuuugacac

SEQ ID NO: 2206841 - RNA, 21 nt, Human
uaauuuugacacuauaucugu

SEQ ID NO: 2206842 - RNA, 13 nt, Human
uaauuuugaaaaa

SEQ ID NO: 2206843 - RNA, 17 nt, Human
uaauuuugaaaaacugc

SEQ ID NO: 2206844 - RNA, 14 nt, Human
uaauuuuguauuuu

SEQ ID NO: 2206845 - RNA, 13 nt, Human
uaauuuuguauuu

SEQ ID NO: 2206846 - RNA, 21 nt, Human
uaauuuuguauuuuccaagug

SEQ ID NO: 2206847 - RNA, 15 nt, Human
uaauuuuguauuuuc

SEQ ID NO: 2206848 - RNA, 18 nt, Human
uaauuuuguauuuuccaa

SEQ ID NO: 2206849 - RNA, 14 nt, Human
uaauuuugguugua

SEQ ID NO: 2206850 - RNA, 17 nt, Human
uaauuuugguuguauuc

SEQ ID NO: 2206851 - RNA, 18 nt, Human
uaauuuugguuguauucu

SEQ ID NO: 2206852 - RNA, 21 nt, Human
uaauuuugguuguauucuuug

SEQ ID NO: 2206853 - RNA, 22 nt, Human
uaauuuugguuguauucuuuga

SEQ ID NO: 2206854 - RNA, 24 nt, Human
uacaagaugaaggagaggcaacau

SEQ ID NO: 2206855 - RNA, 23 nt, Human
uacaagagcagccuguggcaucu

SEQ ID NO: 2206856 - RNA, 20 nt, Human
uacaagagcagccuguggca

SEQ ID NO: 2206857 - RNA, 19 nt, Human
uacaagagcuuaacagugu

SEQ ID NO: 2206858 - RNA, 19 nt, Human
uacaagagcagccuguggc

SEQ ID NO: 2206859 - RNA, 16 nt, Human
uacaagagcagccugu

SEQ ID NO: 2206860 - RNA, 15 nt, Human
uacaagacacaguga

SEQ ID NO: 2206861 - RNA, 14 nt, Human
uacacaaguaaaca

SEQ ID NO: 2206862 - RNA, 23 nt, Human
uacacaaaacaaaugccacacau

SEQ ID NO: 2206863 - RNA, 21 nt, Human
uacaauuuuuuuaauuuugua

SEQ ID NO: 2206864 - RNA, 22 nt, Human
uacaauuuuuuuaauuuuguau

SEQ ID NO: 2206865 - RNA, 23 nt, Human
uacaauuuuuuaucaugcauguc

SEQ ID NO: 2206866 - RNA, 13 nt, Human
uacaagauuagaa

SEQ ID NO: 2206867 - RNA, 20 nt, Human
uacaauuuuuuuaauuuugu

SEQ ID NO: 2206868 - RNA, 17 nt, Human
uacaauuuuuuaucaug

SEQ ID NO: 2206869 - RNA, 21 nt, Human
uacaagauuagaagcugaaaa

SEQ ID NO: 2206870 - RNA, 13 nt, Human
uacaguguacagu

SEQ ID NO: 2206871 - RNA, 21 nt, Human
uacagugguuuuauacugaag

SEQ ID NO: 2206872 - RNA, 15 nt, Human
uacaggcagcacaga

SEQ ID NO: 2206873 - RNA, 19 nt, Human
uacaggcaccgagaauguu

SEQ ID NO: 2206874 - RNA, 14 nt, Human
uacaggcaccgaga

SEQ ID NO: 2206875 - RNA, 23 nt, Human
uacaggauuugaacucagaucug

SEQ ID NO: 2206876 - RNA, 20 nt, Human
uacaggauuugaacucagau

SEQ ID NO: 2206877 - RNA, 14 nt, Human
uacaggcacaaaau

SEQ ID NO: 2206878 - RNA, 22 nt, Human
uacaguguacagucuuguauua

SEQ ID NO: 2206879 - RNA, 20 nt, Human
uacaggcaccgagaauguug

SEQ ID NO: 2206880 - RNA, 22 nt, Human
uacagugguuuuauacugaagg

SEQ ID NO: 2206881 - RNA, 15 nt, Human
uacaguguacagucu

SEQ ID NO: 2206882 - RNA, 16 nt, Human
uacaguguacagucuu

SEQ ID NO: 2206883 - RNA, 21 nt, Human
uacaggaagcaccccaugcca

SEQ ID NO: 2206884 - RNA, 19 nt, Human
uacagcuuugaucccugac

SEQ ID NO: 2206885 - RNA, 20 nt, Human
uacagcuuugugacuguaua

SEQ ID NO: 2206886 - RNA, 22 nt, Human
uacagcuuugugacuguauaua

SEQ ID NO: 2206887 - RNA, 19 nt, Human
uacaggaaaagcugcugac

SEQ ID NO: 2206888 - RNA, 16 nt, Human
uacaggcacccaccau

SEQ ID NO: 2206889 - RNA, 14 nt, Human
uacaggauuugaaa

SEQ ID NO: 2206890 - RNA, 18 nt, Human
uacagccaaagauaaucu

SEQ ID NO: 2206891 - RNA, 22 nt, Human
uacagccaaagauaaucucuca

SEQ ID NO: 2206892 - RNA, 17 nt, Human
uacagcacuacucugug

SEQ ID NO: 2206893 - RNA, 16 nt, Human
uacagcauuacaaauu

SEQ ID NO: 2206894 - RNA, 21 nt, Human
uacagcauuacaaauugcuua

SEQ ID NO: 2206895 - RNA, 22 nt, Human
uacagcauuacaaauugcuuac

SEQ ID NO: 2206896 - RNA, 19 nt, Human
uacagcacuacucugugcc

SEQ ID NO: 2206897 - RNA, 22 nt, Human
uacagcuugaccgugaggccag

SEQ ID NO: 2206898 - RNA, 17 nt, Human
uacagcccaccuggcuu

SEQ ID NO: 2206899 - RNA, 21 nt, Human
uacagcuugaccgugaggcca

SEQ ID NO: 2206900 - RNA, 18 nt, Human
uacagcuuucaugauuag

SEQ ID NO: 2206901 - RNA, 19 nt, Human
uacagccccuuuuucauau

SEQ ID NO: 2206902 - RNA, 14 nt, Human
uacagcgagaggca

SEQ ID NO: 2206903 - RNA, 23 nt, Human
uacagcuugaccgugaggccaga

SEQ ID NO: 2206904 - RNA, 17 nt, Human
uacaggaaaagcugcug

SEQ ID NO: 2206905 - RNA, 18 nt, Human
uacaggaaaagcugcuga

SEQ ID NO: 2206906 - RNA, 18 nt, Human
uacagaaauuagccgggc

SEQ ID NO: 2206907 - RNA, 24 nt, Human
uacagaaaguggugcucaguugua

SEQ ID NO: 2206908 - RNA, 22 nt, Human
uacagaaaguggugcucaguug

SEQ ID NO: 2206909 - RNA, 19 nt, Human
uacagaacacgcuuucaca

SEQ ID NO: 2206910 - RNA, 17 nt, Human
uacagaaauuagccggg

SEQ ID NO: 2206911 - RNA, 14 nt, Human
uacagaaagcugcc

SEQ ID NO: 2206912 - RNA, 10 nt, Human
uacagaaagu

SEQ ID NO: 2206913 - RNA, 20 nt, Human
uacagaaaguggugcucagu

SEQ ID NO: 2206914 - RNA, 23 nt, Human
uacagaacccauuccauuuaucu

SEQ ID NO: 2206915 - RNA, 19 nt, Human
uacagaacucuuucaaaac

SEQ ID NO: 2206916 - RNA, 17 nt, Human
uacagaacucuuucaaa

SEQ ID NO: 2206917 - RNA, 16 nt, Human
uacagaacucuuucaa

SEQ ID NO: 2206918 - RNA, 18 nt, Human
uacagaauucugcuaccu

SEQ ID NO: 2206919 - RNA, 21 nt, Human
uacagaauucugcuaccucac

SEQ ID NO: 2206920 - RNA, 13 nt, Human
uacagaauuuuau

SEQ ID NO: 2206921 - RNA, 24 nt, Human
uacagcaaggagauuuacaacugg

SEQ ID NO: 2206922 - RNA, 14 nt, Human
uacagcacuacucu

SEQ ID NO: 2206923 - RNA, 20 nt, Human
uacagaauugugucugcagg

SEQ ID NO: 2206924 - RNA, 15 nt, Human
uacagcacuacucug

SEQ ID NO: 2206925 - RNA, 18 nt, Human
uacagaauugugucugca

SEQ ID NO: 2206926 - RNA, 19 nt, Human
uacagaauugugucugcag

SEQ ID NO: 2206927 - RNA, 21 nt, Human
uacagaauugugucugcagga

SEQ ID NO: 2206928 - RNA, 21 nt, Human
uacagaaagauggaugugcuu

SEQ ID NO: 2206929 - RNA, 13 nt, Human
uacagaaagcugc

SEQ ID NO: 2206930 - RNA, 18 nt, Human
uacacuuuuuuggggaua

SEQ ID NO: 2206931 - RNA, 13 nt, Human
uacacuuuaugca

SEQ ID NO: 2206932 - RNA, 22 nt, Human
uacacugggagaggugccagca

SEQ ID NO: 2206933 - RNA, 21 nt, Human
uacacuuuaugccggaugugc

SEQ ID NO: 2206934 - RNA, 22 nt, Human
uacacuuuaugccggaugugcu

SEQ ID NO: 2206935 - RNA, 23 nt, Human
uacacuuuaugccggaugugcuu

SEQ ID NO: 2206936 - RNA, 19 nt, Human
uacacuguuucaaacuuua

SEQ ID NO: 2206937 - RNA, 18 nt, Human
uacacuguuucaaacuuu

SEQ ID NO: 2206938 - RNA, 17 nt, Human
uacacuguuucaaacuu

SEQ ID NO: 2206939 - RNA, 12 nt, Human
uagcccaggaga

SEQ ID NO: 2206940 - RNA, 13 nt, Human
uagcccaggagag

SEQ ID NO: 2206941 - RNA, 14 nt, Human
uagcccaggagaga

SEQ ID NO: 2206942 - RNA, 15 nt, Human
uagcccaggagagag

SEQ ID NO: 2206943 - RNA, 16 nt, Human
uagcccaggagagaga

SEQ ID NO: 2206944 - RNA, 15 nt, Human
uagcccacucugcuc

SEQ ID NO: 2206945 - RNA, 23 nt, Human
uagcccacacuugagaggaugaa

SEQ ID NO: 2206946 - RNA, 18 nt, Human
uagcccaaugaaaugaau

SEQ ID NO: 2206947 - RNA, 19 nt, Human
uagcccagguccucugaua

SEQ ID NO: 2206948 - RNA, 22 nt, Human
uagcccaggagagagaaagcca

SEQ ID NO: 2206949 - RNA, 17 nt, Human
uagcccaggagagagaa

SEQ ID NO: 2206950 - RNA, 18 nt, Human
uagcccaggagagagaaa

SEQ ID NO: 2206951 - RNA, 12 nt, Human
uagcccaucccu

SEQ ID NO: 2206952 - RNA, 14 nt, Human
uagcccaucccugc

SEQ ID NO: 2206953 - RNA, 15 nt, Human
uagcccaucccugcc

SEQ ID NO: 2206954 - RNA, 16 nt, Human
uagcccaucccugccu

SEQ ID NO: 2206955 - RNA, 17 nt, Human
uagcccaucccugccug

SEQ ID NO: 2206956 - RNA, 18 nt, Human
uagcccaucccugccugg

SEQ ID NO: 2206957 - RNA, 20 nt, Human
uagcccaucccugccugguc

SEQ ID NO: 2206958 - RNA, 21 nt, Human
uagcccaucccugccugguca

SEQ ID NO: 2206959 - RNA, 22 nt, Human
uagccauuccugguacccagcc

SEQ ID NO: 2206960 - RNA, 18 nt, Human
uagccauuccugguaccc

SEQ ID NO: 2206961 - RNA, 19 nt, Human
uagccauuccugguaccca

SEQ ID NO: 2206962 - RNA, 21 nt, Human
uagcauacauuuauaauguuu

SEQ ID NO: 2206963 - RNA, 13 nt, Human
uagccaugggacc

SEQ ID NO: 2206964 - RNA, 14 nt, Human
uagccaugggacca

SEQ ID NO: 2206965 - RNA, 14 nt, Human
uagcccaaaaccaa

SEQ ID NO: 2206966 - RNA, 22 nt, Human
uagcaggugguccugagaccug

SEQ ID NO: 2206967 - RNA, 15 nt, Human
uagcauacauuuaua

SEQ ID NO: 2206968 - RNA, 13 nt, Human
uagccaugaccuu

SEQ ID NO: 2206969 - RNA, 17 nt, Human
uagccuauauuuacagu

SEQ ID NO: 2206970 - RNA, 14 nt, Human
uagccgaccucagc

SEQ ID NO: 2206971 - RNA, 15 nt, Human
uagccgaccucagcc

SEQ ID NO: 2206972 - RNA, 13 nt, Human
uagccgaccucag

SEQ ID NO: 2206973 - RNA, 15 nt, Human
uagcccuuucugugu

SEQ ID NO: 2206974 - RNA, 17 nt, Human
uagcccuuucugugugc

SEQ ID NO: 2206975 - RNA, 13 nt, Human
uagcccuuucugu

SEQ ID NO: 2206976 - RNA, 14 nt, Human
uagcccuuucugug

SEQ ID NO: 2206977 - RNA, 13 nt, Human
uagccucccugaa

SEQ ID NO: 2206978 - RNA, 17 nt, Human
uagccuccugaccugag

SEQ ID NO: 2206979 - RNA, 15 nt, Human
uagccugaguagaaa

SEQ ID NO: 2206980 - RNA, 12 nt, Human
uagccucccuga

SEQ ID NO: 2206981 - RNA, 22 nt, Human
uagcccauggacuucacauaag

SEQ ID NO: 2206982 - RNA, 16 nt, Human
uagccccacaggaggu

SEQ ID NO: 2206983 - RNA, 14 nt, Human
uagcccgccugcca

SEQ ID NO: 2206984 - RNA, 15 nt, Human
uagcccgccugccag

SEQ ID NO: 2206985 - RNA, 16 nt, Human
uagcccgccugccagu

SEQ ID NO: 2206986 - RNA, 19 nt, Human
uagcccgccugccaguccu

SEQ ID NO: 2206987 - RNA, 18 nt, Human
uagcccuggccagaggcu

SEQ ID NO: 2206988 - RNA, 16 nt, Human
uagcccuggccagagg

SEQ ID NO: 2206989 - RNA, 18 nt, Human
uagcccucacccuggggc

SEQ ID NO: 2206990 - RNA, 20 nt, Human
uagcccgccugccaguccua

SEQ ID NO: 2206991 - RNA, 11 nt, Human
uagcugggacu

SEQ ID NO: 2206992 - RNA, 15 nt, Human
uagcugcuacaaaga

SEQ ID NO: 2206993 - RNA, 16 nt, Human
uagcugcuacaaagaa

SEQ ID NO: 2206994 - RNA, 19 nt, Human
uagcugcuacaaagaagac

SEQ ID NO: 2206995 - RNA, 20 nt, Human
uagcugcuacaaagaagaca

SEQ ID NO: 2206996 - RNA, 23 nt, Human
uagcugcuacaaagaagacaugu

SEQ ID NO: 2206997 - RNA, 21 nt, Human
uagcugcuacaaagaagacau

SEQ ID NO: 2206998 - RNA, 19 nt, Human
uagcuggaacuacaggcuc

SEQ ID NO: 2206999 - RNA, 20 nt, Human
uagcucuuaauuguucauuu

SEQ ID NO: 2207000 - RNA, 12 nt, Human
uagcugcuacaa

SEQ ID NO: 2207001 - RNA, 13 nt, Human
uagcugcuacaaa

SEQ ID NO: 2207002 - RNA, 18 nt, Human
uagcugggacuacaggug

SEQ ID NO: 2207003 - RNA, 22 nt, Human
uagcugggagaaagagagagcu

SEQ ID NO: 2207004 - RNA, 20 nt, Human
uagcugggacuacaggcacc

SEQ ID NO: 2207005 - RNA, 21 nt, Human
uagcucuaggagggcuggcaa

SEQ ID NO: 2207006 - RNA, 17 nt, Human
uagcucuauguuuacaa

SEQ ID NO: 2207007 - RNA, 17 nt, Human
uagcucugagccaguuc

SEQ ID NO: 2207008 - RNA, 20 nt, Human
uagcuccuguggccccaccc

SEQ ID NO: 2207009 - RNA, 22 nt, Human
uagcuccuguggccccacccug

SEQ ID NO: 2207010 - RNA, 12 nt, Human
uagcuccugugg

SEQ ID NO: 2207011 - RNA, 13 nt, Human
uagcuccuguggc

SEQ ID NO: 2207012 - RNA, 14 nt, Human
uagcuccuguggcc

SEQ ID NO: 2207013 - RNA, 16 nt, Human
uagcuccuguggcccc

SEQ ID NO: 2207014 - RNA, 20 nt, Human
uagcuccacacccucuccca

SEQ ID NO: 2207015 - RNA, 19 nt, Human
uagccuccuucgcaggcau

SEQ ID NO: 2207016 - RNA, 20 nt, Human
uagccucgccgucugugaau

SEQ ID NO: 2207017 - RNA, 21 nt, Human
uagcuccccgcuucugccugc

SEQ ID NO: 2207018 - RNA, 14 nt, Human
uagcuccccuccaa

SEQ ID NO: 2207019 - RNA, 14 nt, Human
uagcucccuguucu

SEQ ID NO: 2207020 - RNA, 13 nt, Human
uagcuccccuccu

SEQ ID NO: 2207021 - RNA, 14 nt, Human
uagcuccccuccuc

SEQ ID NO: 2207022 - RNA, 15 nt, Human
uagcuccccuccucu

SEQ ID NO: 2207023 - RNA, 20 nt, Human
uagcuccccuccucuccccu

SEQ ID NO: 2207024 - RNA, 17 nt, Human
uagccugccucuucucu

SEQ ID NO: 2207025 - RNA, 22 nt, Human
uagcucauucuccuuguguuac

SEQ ID NO: 2207026 - RNA, 14 nt, Human
uaggccaugaaaaa

SEQ ID NO: 2207027 - RNA, 14 nt, Human
uaggccucagccag

SEQ ID NO: 2207028 - RNA, 20 nt, Human
uaggccaugaaaaaaaugau

SEQ ID NO: 2207029 - RNA, 13 nt, Human
uaggccuggccag

SEQ ID NO: 2207030 - RNA, 14 nt, Human
uaggccuggccaga

SEQ ID NO: 2207031 - RNA, 18 nt, Human
uaggccucagccagagaa

SEQ ID NO: 2207032 - RNA, 16 nt, Human
uaggccucagccagag

SEQ ID NO: 2207033 - RNA, 22 nt, Human
uaggccucagccagagaagcua

SEQ ID NO: 2207034 - RNA, 14 nt, Human
uaggccuggcacag

SEQ ID NO: 2207035 - RNA, 17 nt, Human
uaggccuggcacagugu

SEQ ID NO: 2207036 - RNA, 12 nt, Human
uaggaauaaaua

SEQ ID NO: 2207037 - RNA, 19 nt, Human
uaggccaaauuuguagugc

SEQ ID NO: 2207038 - RNA, 15 nt, Human
uaggccacuccucca

SEQ ID NO: 2207039 - RNA, 14 nt, Human
uaggccacuccucc

SEQ ID NO: 2207040 - RNA, 13 nt, Human
uaggccacuccuc

SEQ ID NO: 2207041 - RNA, 17 nt, Human
uaggccguuccuucaaa

SEQ ID NO: 2207042 - RNA, 13 nt, Human
uaggccaugggac

SEQ ID NO: 2207043 - RNA, 15 nt, Human
uaggaagguuaaugu

SEQ ID NO: 2207044 - RNA, 15 nt, Human
uaggaagggaccaag

SEQ ID NO: 2207045 - RNA, 18 nt, Human
uaggaagggaccaaggca

SEQ ID NO: 2207046 - RNA, 17 nt, Human
uaggaaguguaacagcu

SEQ ID NO: 2207047 - RNA, 16 nt, Human
uaggaaguaaauuaua

SEQ ID NO: 2207048 - RNA, 21 nt, Human
uaggaaguguaacagcugagg

SEQ ID NO: 2207049 - RNA, 20 nt, Human
uaggaaguguaacagcugag

SEQ ID NO: 2207050 - RNA, 19 nt, Human
uaggaaguguaacagcuga

SEQ ID NO: 2207051 - RNA, 18 nt, Human
uaggaaguguaacagcug

SEQ ID NO: 2207052 - RNA, 22 nt, Human
uaggaaguguaacagcugaggu

SEQ ID NO: 2207053 - RNA, 14 nt, Human
uaggaauuguguuu

SEQ ID NO: 2207054 - RNA, 20 nt, Human
uaggaauugacccacaagaa

SEQ ID NO: 2207055 - RNA, 23 nt, Human
uaggaauugacccacaagaaaug

SEQ ID NO: 2207056 - RNA, 13 nt, Human
uaggaagaauuuu

SEQ ID NO: 2207057 - RNA, 15 nt, Human
uaggaagaauuuuaa

SEQ ID NO: 2207058 - RNA, 17 nt, Human
uaggaagaauuuuaaaa

SEQ ID NO: 2207059 - RNA, 13 nt, Human
uaggaagacuuug

SEQ ID NO: 2207060 - RNA, 14 nt, Human
uaggaagacuuugg

SEQ ID NO: 2207061 - RNA, 15 nt, Human
uaggaagacuuugga

SEQ ID NO: 2207062 - RNA, 14 nt, Human
uaggaagagaaacc

SEQ ID NO: 2207063 - RNA, 18 nt, Human
uaggaagaauuuuaaaaa

SEQ ID NO: 2207064 - RNA, 21 nt, Human
uaggaagaauuuuaaaaauga

SEQ ID NO: 2207065 - RNA, 15 nt, Human
uaggaagagaaacca

SEQ ID NO: 2207066 - RNA, 19 nt, Human
uaggaagagaaaccaggga

SEQ ID NO: 2207067 - RNA, 22 nt, Human
uaggaagaauuuuaaaaaugaa

SEQ ID NO: 2207068 - RNA, 22 nt, Human
uaggaagaguagcauuucauuc

SEQ ID NO: 2207069 - RNA, 16 nt, Human
uaggaagacuuuggaa

SEQ ID NO: 2207070 - RNA, 17 nt, Human
uaggaagacuuuggaaa

SEQ ID NO: 2207071 - RNA, 16 nt, Human
uaggaacauaugaaaa

SEQ ID NO: 2207072 - RNA, 20 nt, Human
uaggaacgguaaauuucugu

SEQ ID NO: 2207073 - RNA, 19 nt, Human
uaggaaaugaaugugugug

SEQ ID NO: 2207074 - RNA, 17 nt, Human
uaggaacacuccuucac

SEQ ID NO: 2207075 - RNA, 21 nt, Human
uaggaacuuaaauaaugugaa

SEQ ID NO: 2207076 - RNA, 18 nt, Human
uaggaacugcugggcuug

SEQ ID NO: 2207077 - RNA, 15 nt, Human
uaggaacugcugggc

SEQ ID NO: 2207078 - RNA, 13 nt, Human
uaggaacacuccu

SEQ ID NO: 2207079 - RNA, 14 nt, Human
uaggaacacuccuu

SEQ ID NO: 2207080 - RNA, 23 nt, Human
uaggaaauggcuuugugauucaa

SEQ ID NO: 2207081 - RNA, 22 nt, Human
uaggaaauggcuuugugauuca

SEQ ID NO: 2207082 - RNA, 18 nt, Human
uaggaaaugaaugugugu

SEQ ID NO: 2207083 - RNA, 15 nt, Human
uagcugggauuacag

SEQ ID NO: 2207084 - RNA, 18 nt, Human
uagcugggggugggccag

SEQ ID NO: 2207085 - RNA, 23 nt, Human
uagauguucucuaucauuuaaua

SEQ ID NO: 2207086 - RNA, 20 nt, Human
uagauucuacauauucuuua

SEQ ID NO: 2207087 - RNA, 18 nt, Human
uagauuaagagauggguu

SEQ ID NO: 2207088 - RNA, 16 nt, Human
uagauuguuaaaauaa

SEQ ID NO: 2207089 - RNA, 18 nt, Human
uagauugaaaacuuuucu

SEQ ID NO: 2207090 - RNA, 20 nt, Human
uagauugaaaacuuuucuca

SEQ ID NO: 2207091 - RNA, 21 nt, Human
uagauugaaaacuuuucucag

SEQ ID NO: 2207092 - RNA, 21 nt, Human
uagauugagaaguuuuguaca

SEQ ID NO: 2207093 - RNA, 23 nt, Human
uagauugaaaacuuuucucagau

SEQ ID NO: 2207094 - RNA, 16 nt, Human
uagcacuuugggaggc

SEQ ID NO: 2207095 - RNA, 11 nt, Human
uagcagacagg

SEQ ID NO: 2207096 - RNA, 23 nt, Human
uagcagaagguugcaccuccccc

SEQ ID NO: 2207097 - RNA, 17 nt, Human
uagcagguaccacugau

SEQ ID NO: 2207098 - RNA, 15 nt, Human
uagcaggugguccug

SEQ ID NO: 2207099 - RNA, 14 nt, Human
uagcagggaaaaua

SEQ ID NO: 2207100 - RNA, 21 nt, Human
uagcagggaaaauauauaucu

SEQ ID NO: 2207101 - RNA, 23 nt, Human
uagcaggugguccugagaccuga

SEQ ID NO: 2207102 - RNA, 20 nt, Human
uagcagggcauggcugggaa

SEQ ID NO: 2207103 - RNA, 18 nt, Human
uagcagauuuuaauuuug

SEQ ID NO: 2207104 - RNA, 19 nt, Human
uagcagcaccguucugugc

SEQ ID NO: 2207105 - RNA, 20 nt, Human
uagcagcaccguucugugca

SEQ ID NO: 2207106 - RNA, 20 nt, Human
uagcagcagccuuuaaugca

SEQ ID NO: 2207107 - RNA, 14 nt, Human
uagcagauuuuaau

SEQ ID NO: 2207108 - RNA, 20 nt, Human
uagcagauuuuaauuuugaa

SEQ ID NO: 2207109 - RNA, 19 nt, Human
uagcagacaggccccguga

SEQ ID NO: 2207110 - RNA, 13 nt, Human
uagcagacaggcc

SEQ ID NO: 2207111 - RNA, 15 nt, Human
uagcagacaguguuu

SEQ ID NO: 2207112 - RNA, 18 nt, Human
uagcagagagacuuucag

SEQ ID NO: 2207113 - RNA, 19 nt, Human
uagcagagaaugaaagggc

SEQ ID NO: 2207114 - RNA, 23 nt, Human
uagcagagaaugaaagggcccag

SEQ ID NO: 2207115 - RNA, 23 nt, Human
uagaugucccuuucuuggccagu

SEQ ID NO: 2207116 - RNA, 21 nt, Human
uagaugucuagguacuucagg

SEQ ID NO: 2207117 - RNA, 22 nt, Human
uagaugucccuuucuuggccag

SEQ ID NO: 2207118 - RNA, 21 nt, Human
uagaugucccuuucuuggcca

SEQ ID NO: 2207119 - RNA, 18 nt, Human
uagaugucccuuucuugg

SEQ ID NO: 2207120 - RNA, 20 nt, Human
uagauguauguacuucaugc

SEQ ID NO: 2207121 - RNA, 23 nt, Human
uagauguagauaaacucagaaau

SEQ ID NO: 2207122 - RNA, 16 nt, Human
uagauguauguacuuc

SEQ ID NO: 2207123 - RNA, 22 nt, Human
uagaugugcauuuuugugaaau

SEQ ID NO: 2207124 - RNA, 21 nt, Human
uagaugugauuuaauaguguu

SEQ ID NO: 2207125 - RNA, 23 nt, Human
uagaugugauuuaauaguguuaa

SEQ ID NO: 2207126 - RNA, 11 nt, Human
uagaugugugg

SEQ ID NO: 2207127 - RNA, 21 nt, Human
uagaugucuuuaggcagcagc

SEQ ID NO: 2207128 - RNA, 13 nt, Human
uagaugugauuua

SEQ ID NO: 2207129 - RNA, 15 nt, Human
uagaugugauuuaau

SEQ ID NO: 2207130 - RNA, 19 nt, Human
uagaugugauuuaauagug

SEQ ID NO: 2207131 - RNA, 18 nt, Human
uagauguuccaguaaucu

SEQ ID NO: 2207132 - RNA, 17 nt, Human
uagauguucagauugcu

SEQ ID NO: 2207133 - RNA, 22 nt, Human
uagauguucagauugcuuugau

SEQ ID NO: 2207134 - RNA, 21 nt, Human
uagauguucuaagucuuucca

SEQ ID NO: 2207135 - RNA, 14 nt, Human
uagauguucucuau

SEQ ID NO: 2207136 - RNA, 18 nt, Human
uagauguucucuaucauu

SEQ ID NO: 2207137 - RNA, 19 nt, Human
uagauguucucuaucauuu

SEQ ID NO: 2207138 - RNA, 21 nt, Human
uagauguucucuaucauuuaa

SEQ ID NO: 2207139 - RNA, 22 nt, Human
uagauguucucuaucauuuaau

SEQ ID NO: 2207140 - RNA, 19 nt, Human
uagaugguuugagccugag

SEQ ID NO: 2207141 - RNA, 15 nt, Human
uagauggugcugaga

SEQ ID NO: 2207142 - RNA, 14 nt, Human
uagauggugcugag

SEQ ID NO: 2207143 - RNA, 14 nt, Human
uagauggugaaauu

SEQ ID NO: 2207144 - RNA, 15 nt, Human
uagauggugaaauuu

SEQ ID NO: 2207145 - RNA, 21 nt, Human
uagaugggagggaggcucagg

SEQ ID NO: 2207146 - RNA, 23 nt, Human
uagaugggaaugaagcuugugua

SEQ ID NO: 2207147 - RNA, 20 nt, Human
uagaugggcauggggugggc

SEQ ID NO: 2207148 - RNA, 16 nt, Human
uagaugggucuggcug

SEQ ID NO: 2207149 - RNA, 20 nt, Human
uagaugggucuggcugagcu

SEQ ID NO: 2207150 - RNA, 22 nt, Human
uagaugggucuggcugagcuga

SEQ ID NO: 2207151 - RNA, 20 nt, Human
uagauguagauaaacucaga

SEQ ID NO: 2207152 - RNA, 19 nt, Human
uagauggugcugagaagcu

SEQ ID NO: 2207153 - RNA, 16 nt, Human
uagauggugcugagaa

SEQ ID NO: 2207154 - RNA, 12 nt, Human
uagauguauaua

SEQ ID NO: 2207155 - RNA, 15 nt, Human
uagauaaacucagaa

SEQ ID NO: 2207156 - RNA, 18 nt, Human
uagauaaauaaauauaug

SEQ ID NO: 2207157 - RNA, 23 nt, Human
uagauaacaagaccucagugccu

SEQ ID NO: 2207158 - RNA, 18 nt, Human
uagauaauacaccacuac

SEQ ID NO: 2207159 - RNA, 18 nt, Human
uagauacaugcuuuuuaa

SEQ ID NO: 2207160 - RNA, 17 nt, Human
uagaugggaaugaagcu

SEQ ID NO: 2207161 - RNA, 18 nt, Human
uagaugggaaugaagcuu

SEQ ID NO: 2207162 - RNA, 19 nt, Human
uagaugggaaugaagcuug

SEQ ID NO: 2207163 - RNA, 22 nt, Human
uagaugggaaugaagcuugugu

SEQ ID NO: 2207164 - RNA, 13 nt, Human
uagaguuuaacac

SEQ ID NO: 2207165 - RNA, 12 nt, Human
uagaguuuaaca

SEQ ID NO: 2207166 - RNA, 12 nt, Human
uagauaaacuca

SEQ ID NO: 2207167 - RNA, 17 nt, Human
uagaguuugcuauuaga

SEQ ID NO: 2207168 - RNA, 17 nt, Human
uagaguuuagcuggaaa

SEQ ID NO: 2207169 - RNA, 18 nt, Human
uagaguuuagcuggaaaa

SEQ ID NO: 2207170 - RNA, 19 nt, Human
uagaguccaacguggggca

SEQ ID NO: 2207171 - RNA, 22 nt, Human
uagaguccaacguggggcagca

SEQ ID NO: 2207172 - RNA, 23 nt, Human
uagagucaucuccaucagcugua

SEQ ID NO: 2207173 - RNA, 22 nt, Human
uagagucaucuccaucagcugu

SEQ ID NO: 2207174 - RNA, 21 nt, Human
uagagucaucuccaucagcug

SEQ ID NO: 2207175 - RNA, 21 nt, Human
uagaguagaagauuugaugcu

SEQ ID NO: 2207176 - RNA, 14 nt, Human
uagagucagccuuc

SEQ ID NO: 2207177 - RNA, 13 nt, Human
uagagucagccuu

SEQ ID NO: 2207178 - RNA, 14 nt, Human
uagaguauaugcac

SEQ ID NO: 2207179 - RNA, 19 nt, Human
uagaguagaagauuugaug

SEQ ID NO: 2207180 - RNA, 16 nt, Human
uagagguuuuguuguu

SEQ ID NO: 2207181 - RNA, 15 nt, Human
uagagguuuuaaagu

SEQ ID NO: 2207182 - RNA, 19 nt, Human
uagagguuuuaaagugauu

SEQ ID NO: 2207183 - RNA, 19 nt, Human
uagagguuuuguuguuuua

SEQ ID NO: 2207184 - RNA, 21 nt, Human
uagagguucaaagauauuuug

SEQ ID NO: 2207185 - RNA, 16 nt, Human
uagagguucaaagaua

SEQ ID NO: 2207186 - RNA, 19 nt, Human
uagagguucaaagauauuu

SEQ ID NO: 2207187 - RNA, 19 nt, Human
uagagagggagaagaaguc

SEQ ID NO: 2207188 - RNA, 16 nt, Human
uagagagggagaagaa

SEQ ID NO: 2207189 - RNA, 13 nt, Human
uagagaggaaaag

SEQ ID NO: 2207190 - RNA, 13 nt, Human
uagagagcuauuu

SEQ ID NO: 2207191 - RNA, 16 nt, Human
uagagaacuguggccg

SEQ ID NO: 2207192 - RNA, 19 nt, Human
uagagacgggguuucacca

SEQ ID NO: 2207193 - RNA, 16 nt, Human
uagagagagaccacuu

SEQ ID NO: 2207194 - RNA, 15 nt, Human
uagaaccacuaugaa

SEQ ID NO: 2207195 - RNA, 20 nt, Human
uagaaccaccaacaagcaag

SEQ ID NO: 2207196 - RNA, 22 nt, Human
uagaaccaccaacaagcaagcu

SEQ ID NO: 2207197 - RNA, 12 nt, Human
uagaaccaggca

SEQ ID NO: 2207198 - RNA, 16 nt, Human
uagaaccacuaugaag

SEQ ID NO: 2207199 - RNA, 22 nt, Human
uagaacccggcaggcuagaacc

SEQ ID NO: 2207200 - RNA, 23 nt, Human
uagaaccaggcaacuugggaacu

SEQ ID NO: 2207201 - RNA, 13 nt, Human
uagaaccuagaag

SEQ ID NO: 2207202 - RNA, 14 nt, Human
uagaaccuagaagg

SEQ ID NO: 2207203 - RNA, 16 nt, Human
uagaaccuagaagggc

SEQ ID NO: 2207204 - RNA, 17 nt, Human
uagaaccuagaagggcu

SEQ ID NO: 2207205 - RNA, 23 nt, Human
uagaaccuagaagggcuagaacc

SEQ ID NO: 2207206 - RNA, 23 nt, Human
uagaaccuagagaagcuaaaacc

SEQ ID NO: 2207207 - RNA, 14 nt, Human
uagacccucucaag

SEQ ID NO: 2207208 - RNA, 13 nt, Human
uagaccucagccu

SEQ ID NO: 2207209 - RNA, 12 nt, Human
uagaccucagcc

SEQ ID NO: 2207210 - RNA, 11 nt, Human
uagaccucagc

SEQ ID NO: 2207211 - RNA, 22 nt, Human
uagaccuagggaggaccuuauc

SEQ ID NO: 2207212 - RNA, 19 nt, Human
uagaccuagggaggaccuu

SEQ ID NO: 2207213 - RNA, 12 nt, Human
uagacccugggu

SEQ ID NO: 2207214 - RNA, 16 nt, Human
uagacccugggugggc

SEQ ID NO: 2207215 - RNA, 20 nt, Human
uagacccugggugggcucug

SEQ ID NO: 2207216 - RNA, 20 nt, Human
uagaccucagccugugcugc

SEQ ID NO: 2207217 - RNA, 16 nt, Human
uagaccucagccugug

SEQ ID NO: 2207218 - RNA, 15 nt, Human
uagaccucagccugu

SEQ ID NO: 2207219 - RNA, 14 nt, Human
uagaccucagccug

SEQ ID NO: 2207220 - RNA, 22 nt, Human
uagaccucagccugugcugccc

SEQ ID NO: 2207221 - RNA, 21 nt, Human
uagaccucagccugugcugcc

SEQ ID NO: 2207222 - RNA, 11 nt, Human
uagacuuucug

SEQ ID NO: 2207223 - RNA, 12 nt, Human
uagacuuucugu

SEQ ID NO: 2207224 - RNA, 16 nt, Human
uagagaacgcagcccu

SEQ ID NO: 2207225 - RNA, 17 nt, Human
uagagaacgcagcccua

SEQ ID NO: 2207226 - RNA, 19 nt, Human
uagagaacgcagcccuaga

SEQ ID NO: 2207227 - RNA, 18 nt, Human
uagacuugugcugaucgu

SEQ ID NO: 2207228 - RNA, 15 nt, Human
uagacuugaaauacu

SEQ ID NO: 2207229 - RNA, 16 nt, Human
uauauuuguguauuua

SEQ ID NO: 2207230 - RNA, 14 nt, Human
uauauuucuuuguu

SEQ ID NO: 2207231 - RNA, 20 nt, Human
uauauuuguguauuuaacag

SEQ ID NO: 2207232 - RNA, 13 nt, Human
uauauuuuaagaa

SEQ ID NO: 2207233 - RNA, 13 nt, Human
uauauuuuaagac

SEQ ID NO: 2207234 - RNA, 14 nt, Human
uauauuuuaauuug

SEQ ID NO: 2207235 - RNA, 16 nt, Human
uauauuuuacaauuuu

SEQ ID NO: 2207236 - RNA, 14 nt, Human
uauauuuuaagacg

SEQ ID NO: 2207237 - RNA, 13 nt, Human
uauauuugaaaua

SEQ ID NO: 2207238 - RNA, 23 nt, Human
uauauuugugauagcacuuucua

SEQ ID NO: 2207239 - RNA, 22 nt, Human
uauauuugugauagcacuuucu

SEQ ID NO: 2207240 - RNA, 14 nt, Human
uauauuugaaauau

SEQ ID NO: 2207241 - RNA, 16 nt, Human
uauauuucacuauuuu

SEQ ID NO: 2207242 - RNA, 21 nt, Human
uauauuucccugaaggaacca

SEQ ID NO: 2207243 - RNA, 12 nt, Human
uauauguaugug

SEQ ID NO: 2207244 - RNA, 20 nt, Human
uauauuuauuacuguaagaa

SEQ ID NO: 2207245 - RNA, 23 nt, Human
uauauuuauuacuguaagaaaau

SEQ ID NO: 2207246 - RNA, 16 nt, Human
uauauggcaagaaagc

SEQ ID NO: 2207247 - RNA, 16 nt, Human
uauaugccaugaugga

SEQ ID NO: 2207248 - RNA, 18 nt, Human
uauauggcagaguuguaa

SEQ ID NO: 2207249 - RNA, 19 nt, Human
uauauggcagaguuguaaa

SEQ ID NO: 2207250 - RNA, 20 nt, Human
uauauggcagaguuguaaau

SEQ ID NO: 2207251 - RNA, 22 nt, Human
uauauggcagaguuguaaauau

SEQ ID NO: 2207252 - RNA, 17 nt, Human
uauauggccucaagauc

SEQ ID NO: 2207253 - RNA, 23 nt, Human
uauauggcagaguuguaaauaua

SEQ ID NO: 2207254 - RNA, 12 nt, Human
uauauguacaug

SEQ ID NO: 2207255 - RNA, 13 nt, Human
uauauguacuugu

SEQ ID NO: 2207256 - RNA, 19 nt, Human
uauauguacuugucaaaga

SEQ ID NO: 2207257 - RNA, 21 nt, Human
uauaugcacuuauaauuuucc

SEQ ID NO: 2207258 - RNA, 22 nt, Human
uauauggaugauucagaaauug

SEQ ID NO: 2207259 - RNA, 19 nt, Human
uauaugaggacuugugucu

SEQ ID NO: 2207260 - RNA, 13 nt, Human
uauaugauggggg

SEQ ID NO: 2207261 - RNA, 21 nt, Human
uauauagauuauaacuugucu

SEQ ID NO: 2207262 - RNA, 15 nt, Human
uauaugauuuauagu

SEQ ID NO: 2207263 - RNA, 16 nt, Human
uauaugauuuauaguu

SEQ ID NO: 2207264 - RNA, 21 nt, Human
uauaugauuuauaguuuguac

SEQ ID NO: 2207265 - RNA, 13 nt, Human
uauauagagaugu

SEQ ID NO: 2207266 - RNA, 14 nt, Human
uauauagagauguu

SEQ ID NO: 2207267 - RNA, 16 nt, Human
uauauagagauguuuu

SEQ ID NO: 2207268 - RNA, 19 nt, Human
uauauagagauguuuuuaa

SEQ ID NO: 2207269 - RNA, 22 nt, Human
uauaugaauuuaaauauaauuc

SEQ ID NO: 2207270 - RNA, 15 nt, Human
uauauacauauauau

SEQ ID NO: 2207271 - RNA, 20 nt, Human
uauauacaaccugcuugggu

SEQ ID NO: 2207272 - RNA, 14 nt, Human
uauauacaguaacu

SEQ ID NO: 2207273 - RNA, 17 nt, Human
uauauacaguaacuuua

SEQ ID NO: 2207274 - RNA, 22 nt, Human
uauauacaguaacuuuaugugu

SEQ ID NO: 2207275 - RNA, 22 nt, Human
uauauacaauaacauaauuugu

SEQ ID NO: 2207276 - RNA, 18 nt, Human
uauauacgcaucuauaaa

SEQ ID NO: 2207277 - RNA, 20 nt, Human
uauauacccguacaacgugu

SEQ ID NO: 2207278 - RNA, 21 nt, Human
uauauacauuuaugaauuaaa

SEQ ID NO: 2207279 - RNA, 23 nt, Human
uauauacaguaacuuuaugugua

SEQ ID NO: 2207280 - RNA, 22 nt, Human
uauacuuaaauggaaaaaauga

SEQ ID NO: 2207281 - RNA, 17 nt, Human
uauacuuguggacuaaa

SEQ ID NO: 2207282 - RNA, 21 nt, Human
uauacuuguggacuaaaagau

SEQ ID NO: 2207283 - RNA, 16 nt, Human
uauacuguacuuaaua

SEQ ID NO: 2207284 - RNA, 15 nt, Human
uauacuguaauuuag

SEQ ID NO: 2207285 - RNA, 22 nt, Human
uauacuguaaagaaagagagaa

SEQ ID NO: 2207286 - RNA, 14 nt, Human
uauacuguaauuua

SEQ ID NO: 2207287 - RNA, 13 nt, Human
uauacuguauuaa

SEQ ID NO: 2207288 - RNA, 17 nt, Human
uauacuguauuaagagu

SEQ ID NO: 2207289 - RNA, 17 nt, Human
uauacucuuuuuucaug

SEQ ID NO: 2207290 - RNA, 23 nt, Human
uauacuguaaagaaagagagaaa

SEQ ID NO: 2207291 - RNA, 22 nt, Human
uauacuguaauuuaguuauuga

SEQ ID NO: 2207292 - RNA, 23 nt, Human
uauauaauacugacugagaauau

SEQ ID NO: 2207293 - RNA, 23 nt, Human
uauauaaguguacauaugugcug

SEQ ID NO: 2207294 - RNA, 15 nt, Human
uauauaaugguuuca

SEQ ID NO: 2207295 - RNA, 22 nt, Human
uauacuuguggacuaaaagaua

SEQ ID NO: 2207296 - RNA, 23 nt, Human
uauacuuguggacuaaaagauau

SEQ ID NO: 2207297 - RNA, 19 nt, Human
uauauaaguguacauaugu

SEQ ID NO: 2207298 - RNA, 22 nt, Human
uauauaauuacauauuugcaua

SEQ ID NO: 2207299 - RNA, 14 nt, Human
uauauaauucugua

SEQ ID NO: 2207300 - RNA, 16 nt, Human
uauauaauucuguaca

SEQ ID NO: 2207301 - RNA, 17 nt, Human
uauauaauucuguacau

SEQ ID NO: 2207302 - RNA, 19 nt, Human
uauauaaugguuucaaaga

SEQ ID NO: 2207303 - RNA, 17 nt, Human
uauauacaauaacauaa

SEQ ID NO: 2207304 - RNA, 16 nt, Human
uauauacaauaacaua

SEQ ID NO: 2207305 - RNA, 19 nt, Human
uauauacaaccugcuuggg

SEQ ID NO: 2207306 - RNA, 21 nt, Human
uauauuuuauacauuaacuuc

SEQ ID NO: 2207307 - RNA, 20 nt, Human
uauauuuuuauauuuaguua

SEQ ID NO: 2207308 - RNA, 15 nt, Human
uauauuuuucacagu

SEQ ID NO: 2207309 - RNA, 18 nt, Human
uauauuuuuauauuuagu

SEQ ID NO: 2207310 - RNA, 18 nt, Human
uauauuuuugguugucaa

SEQ ID NO: 2207311 - RNA, 19 nt, Human
uauauuuuugguugucaau

SEQ ID NO: 2207312 - RNA, 12 nt, Human
uauauuuuuguc

SEQ ID NO: 2207313 - RNA, 19 nt, Human
uauauuuuuuguuaaauga

SEQ ID NO: 2207314 - RNA, 17 nt, Human
uaucaggugcugccauc

SEQ ID NO: 2207315 - RNA, 15 nt, Human
uaucaggucucccac

SEQ ID NO: 2207316 - RNA, 23 nt, Human
uaucaggucucccacgugggaga

SEQ ID NO: 2207317 - RNA, 16 nt, Human
uaucaggugcccaucc

SEQ ID NO: 2207318 - RNA, 23 nt, Human
uaucaggugcccaucccuggaag

SEQ ID NO: 2207319 - RNA, 14 nt, Human
uaucagucucugag

SEQ ID NO: 2207320 - RNA, 13 nt, Human
uaucagccugagu

SEQ ID NO: 2207321 - RNA, 19 nt, Human
uaucagccugagucuccug

SEQ ID NO: 2207322 - RNA, 11 nt, Human
uaucagccugu

SEQ ID NO: 2207323 - RNA, 13 nt, Human
uaucagccugucu

SEQ ID NO: 2207324 - RNA, 19 nt, Human
uaucagccugucucuucca

SEQ ID NO: 2207325 - RNA, 22 nt, Human
uaucagccugucucuuccauau

SEQ ID NO: 2207326 - RNA, 19 nt, Human
uaucagcggccccuugacu

SEQ ID NO: 2207327 - RNA, 14 nt, Human
uaucagcuucagaa

SEQ ID NO: 2207328 - RNA, 21 nt, Human
uaucaggacccagaggaaggg

SEQ ID NO: 2207329 - RNA, 20 nt, Human
uaucaggacccagaggaagg

SEQ ID NO: 2207330 - RNA, 20 nt, Human
uaucagcggccccuugacuc

SEQ ID NO: 2207331 - RNA, 21 nt, Human
uaucaguugagcuucauauac

SEQ ID NO: 2207332 - RNA, 20 nt, Human
uaucaguuacucagcccugg

SEQ ID NO: 2207333 - RNA, 19 nt, Human
uaucaguuacucagcccug

SEQ ID NO: 2207334 - RNA, 18 nt, Human
uaucaguuacucagcccu

SEQ ID NO: 2207335 - RNA, 17 nt, Human
uaucaguuacucagccc

SEQ ID NO: 2207336 - RNA, 16 nt, Human
uaucaguuacucagcc

SEQ ID NO: 2207337 - RNA, 17 nt, Human
uaucagugugcccccca

SEQ ID NO: 2207338 - RNA, 21 nt, Human
uaucaguuacucagcccuggg

SEQ ID NO: 2207339 - RNA, 14 nt, Human
uaucaguugcaaua

SEQ ID NO: 2207340 - RNA, 21 nt, Human
uaucaguugcaauaauacuuc

SEQ ID NO: 2207341 - RNA, 22 nt, Human
uaucaucaguauugaagcauuu

SEQ ID NO: 2207342 - RNA, 15 nt, Human
uaucaguugcaauaa

SEQ ID NO: 2207343 - RNA, 17 nt, Human
uaucagugacagaguuc

SEQ ID NO: 2207344 - RNA, 16 nt, Human
uaucagugacagaguu

SEQ ID NO: 2207345 - RNA, 15 nt, Human
uaucagugacagagu

SEQ ID NO: 2207346 - RNA, 22 nt, Human
uaucagugacagaguucacuau

SEQ ID NO: 2207347 - RNA, 20 nt, Human
uaucagugacagaguucacu

SEQ ID NO: 2207348 - RNA, 23 nt, Human
uaucagugcucgagacacaguga

SEQ ID NO: 2207349 - RNA, 15 nt, Human
uaucaguuacucagc

SEQ ID NO: 2207350 - RNA, 17 nt, Human
uaucaguguaagcccug

SEQ ID NO: 2207351 - RNA, 13 nt, Human
uaucagugugccc

SEQ ID NO: 2207352 - RNA, 15 nt, Human
uaucagugugccccc

SEQ ID NO: 2207353 - RNA, 16 nt, Human
uaucaugucaaacgug

SEQ ID NO: 2207354 - RNA, 16 nt, Human
uaucaugacaaagacu

SEQ ID NO: 2207355 - RNA, 11 nt, Human
uaucaugaagc

SEQ ID NO: 2207356 - RNA, 19 nt, Human
uaucaucuggauaggagcc

SEQ ID NO: 2207357 - RNA, 16 nt, Human
uaucauccacauuguu

SEQ ID NO: 2207358 - RNA, 17 nt, Human
uaucauccacauuguuu

SEQ ID NO: 2207359 - RNA, 22 nt, Human
uaucauccacauuguuuuaaaa

SEQ ID NO: 2207360 - RNA, 22 nt, Human
uauccugcuucugauaugcagu

SEQ ID NO: 2207361 - RNA, 16 nt, Human
uauccugccucagccc

SEQ ID NO: 2207362 - RNA, 20 nt, Human
uauccugccucagcccgcca

SEQ ID NO: 2207363 - RNA, 10 nt, Human
uauccugggg

SEQ ID NO: 2207364 - RNA, 22 nt, Human
uauccugggggacccaauguag

SEQ ID NO: 2207365 - RNA, 19 nt, Human
uauccugugacauguaaca

SEQ ID NO: 2207366 - RNA, 14 nt, Human
uaucgaaauaacaa

SEQ ID NO: 2207367 - RNA, 22 nt, Human
uauccuggggcucccuucaucu

SEQ ID NO: 2207368 - RNA, 11 nt, Human
uauccugccuc

SEQ ID NO: 2207369 - RNA, 12 nt, Human
uauccugccuca

SEQ ID NO: 2207370 - RNA, 15 nt, Human
uauccugccucagcc

SEQ ID NO: 2207371 - RNA, 18 nt, Human
uauccugccaaaaucauu

SEQ ID NO: 2207372 - RNA, 17 nt, Human
uaucauguguaaucaau

SEQ ID NO: 2207373 - RNA, 19 nt, Human
uaucauguguaaucaauaa

SEQ ID NO: 2207374 - RNA, 21 nt, Human
uaucaugucaaacgugaaaau

SEQ ID NO: 2207375 - RNA, 11 nt, Human
uaucaugugua

SEQ ID NO: 2207376 - RNA, 13 nt, Human
uaucauguguaau

SEQ ID NO: 2207377 - RNA, 14 nt, Human
uaucauguguaauc

SEQ ID NO: 2207378 - RNA, 17 nt, Human
uaucaugugaaaucauu

SEQ ID NO: 2207379 - RNA, 22 nt, Human
uaucaugugaaaucauucauuu

SEQ ID NO: 2207380 - RNA, 22 nt, Human
uaucucuuuugaauccaugcuu

SEQ ID NO: 2207381 - RNA, 23 nt, Human
uaucuaaacuggauucacagcuc

SEQ ID NO: 2207382 - RNA, 14 nt, Human
uaucgggaacagug

SEQ ID NO: 2207383 - RNA, 14 nt, Human
uaucuaaaagaaau

SEQ ID NO: 2207384 - RNA, 15 nt, Human
uaucuaaauguugaa

SEQ ID NO: 2207385 - RNA, 15 nt, Human
uaucggaagcagugc

SEQ ID NO: 2207386 - RNA, 14 nt, Human
uaucggaagcagug

SEQ ID NO: 2207387 - RNA, 18 nt, Human
uaucgcuucauguaacua

SEQ ID NO: 2207388 - RNA, 16 nt, Human
uaucggagacagugau

SEQ ID NO: 2207389 - RNA, 19 nt, Human
uaucgucacugcuuaacuu

SEQ ID NO: 2207390 - RNA, 16 nt, Human
uaucgaucucuuauuu

SEQ ID NO: 2207391 - RNA, 19 nt, Human
uaucgauguuauguaaaag

SEQ ID NO: 2207392 - RNA, 20 nt, Human
uaucgcaccacuguguauuu

SEQ ID NO: 2207393 - RNA, 23 nt, Human
uaucgacuuguuuuugcacaugu

SEQ ID NO: 2207394 - RNA, 20 nt, Human
uaucgaaauaacaauguuaa

SEQ ID NO: 2207395 - RNA, 21 nt, Human
uaucgaaauaacaauguuaag

SEQ ID NO: 2207396 - RNA, 15 nt, Human
uaucgaaauaacaau

SEQ ID NO: 2207397 - RNA, 16 nt, Human
uaucgaaauaacaaug

SEQ ID NO: 2207398 - RNA, 18 nt, Human
uaucgaaauaacaauguu

SEQ ID NO: 2207399 - RNA, 19 nt, Human
uaucgaaauaacaauguua

SEQ ID NO: 2207400 - RNA, 17 nt, Human
uauaaauuuuuuuuguu

SEQ ID NO: 2207401 - RNA, 16 nt, Human
uauaaauuuauuuacu

SEQ ID NO: 2207402 - RNA, 15 nt, Human
uauaaauuuauuuac

SEQ ID NO: 2207403 - RNA, 21 nt, Human
uauaaauuuuuuuuguuucau

SEQ ID NO: 2207404 - RNA, 16 nt, Human
uauaaaucaaugucac

SEQ ID NO: 2207405 - RNA, 20 nt, Human
uauaaaucaaugucacuuaa

SEQ ID NO: 2207406 - RNA, 19 nt, Human
uauaaaucgcuuuugauaa

SEQ ID NO: 2207407 - RNA, 18 nt, Human
uauaaaucgcuuuugaua

SEQ ID NO: 2207408 - RNA, 14 nt, Human
uauaaauuuauuua

SEQ ID NO: 2207409 - RNA, 21 nt, Human
uauaaauuccucuuugcuuug

SEQ ID NO: 2207410 - RNA, 18 nt, Human
uauaaugaaugaaacauu

SEQ ID NO: 2207411 - RNA, 22 nt, Human
uauaaauuuauuuacugcuagu

SEQ ID NO: 2207412 - RNA, 20 nt, Human
uauaaugaaugaaacauuuu

SEQ ID NO: 2207413 - RNA, 23 nt, Human
uauaaugaagcuuuauacgugua

SEQ ID NO: 2207414 - RNA, 14 nt, Human
uauaaugaagcuuu

SEQ ID NO: 2207415 - RNA, 14 nt, Human
uauaaugaggauga

SEQ ID NO: 2207416 - RNA, 17 nt, Human
uaguuuuaguugcagaa

SEQ ID NO: 2207417 - RNA, 16 nt, Human
uaguuuuaguugcaga

SEQ ID NO: 2207418 - RNA, 14 nt, Human
uaguuuuaguugca

SEQ ID NO: 2207419 - RNA, 22 nt, Human
uaguuuuacuuuuaaacugugu

SEQ ID NO: 2207420 - RNA, 20 nt, Human
uaguuuuacuuuuaaacugu

SEQ ID NO: 2207421 - RNA, 15 nt, Human
uaguuuuauaugcuu

SEQ ID NO: 2207422 - RNA, 19 nt, Human
uauaaauaggagaggauga

SEQ ID NO: 2207423 - RNA, 10 nt, Human
uauaaauaua

SEQ ID NO: 2207424 - RNA, 12 nt, Human
uauaaauauaua

SEQ ID NO: 2207425 - RNA, 15 nt, Human
uauaaaucaauguca

SEQ ID NO: 2207426 - RNA, 10 nt, Human
uauaaauaug

SEQ ID NO: 2207427 - RNA, 15 nt, Human
uauaaauauauuuaa

SEQ ID NO: 2207428 - RNA, 14 nt, Human
uauaaauauauaua

SEQ ID NO: 2207429 - RNA, 13 nt, Human
uauaaauauauau

SEQ ID NO: 2207430 - RNA, 17 nt, Human
uauaaauauauauaaau

SEQ ID NO: 2207431 - RNA, 19 nt, Human
uauaaauauauauaaauau

SEQ ID NO: 2207432 - RNA, 21 nt, Human
uauaaauauauauaaauauau

SEQ ID NO: 2207433 - RNA, 22 nt, Human
uauaaauauauauaaauauaua

SEQ ID NO: 2207434 - RNA, 23 nt, Human
uauaaauauauauaaauauauau

SEQ ID NO: 2207435 - RNA, 14 nt, Human
uaguuuuacuuuua

SEQ ID NO: 2207436 - RNA, 19 nt, Human
uaguuuguguguugucucu

SEQ ID NO: 2207437 - RNA, 23 nt, Human
uaguuuuaaaaaaauaaaacauu

SEQ ID NO: 2207438 - RNA, 13 nt, Human
uaguuugguucac

SEQ ID NO: 2207439 - RNA, 17 nt, Human
uaguuuguacaugcauu

SEQ ID NO: 2207440 - RNA, 14 nt, Human
uaguuuguauaacu

SEQ ID NO: 2207441 - RNA, 17 nt, Human
uaguuuguauaacuucu

SEQ ID NO: 2207442 - RNA, 18 nt, Human
uaguuuguauaacuucuu

SEQ ID NO: 2207443 - RNA, 18 nt, Human
uaguuugcauuccugaua

SEQ ID NO: 2207444 - RNA, 11 nt, Human
uaguuuggauu

SEQ ID NO: 2207445 - RNA, 21 nt, Human
uaguuugauuauucaguguca

SEQ ID NO: 2207446 - RNA, 11 nt, Human
uaguuugcauu

SEQ ID NO: 2207447 - RNA, 17 nt, Human
uaguuugcauuccugau

SEQ ID NO: 2207448 - RNA, 18 nt, Human
uaguuucuguucugugga

SEQ ID NO: 2207449 - RNA, 17 nt, Human
uauaauucuacuuugag

SEQ ID NO: 2207450 - RNA, 23 nt, Human
uauaaugguuucaaagauucaaa

SEQ ID NO: 2207451 - RNA, 16 nt, Human
uauaaugguuucaaag

SEQ ID NO: 2207452 - RNA, 17 nt, Human
uauaaugguuucaaaga

SEQ ID NO: 2207453 - RNA, 18 nt, Human
uauaaugguuucaaagau

SEQ ID NO: 2207454 - RNA, 19 nt, Human
uauaaugguuucaaagauu

SEQ ID NO: 2207455 - RNA, 20 nt, Human
uauaauucacauuguauuca

SEQ ID NO: 2207456 - RNA, 20 nt, Human
uauaauguaagcucuacuga

SEQ ID NO: 2207457 - RNA, 19 nt, Human
uauaauguaagcucuacug

SEQ ID NO: 2207458 - RNA, 14 nt, Human
uauaauguaagcuc

SEQ ID NO: 2207459 - RNA, 16 nt, Human
uauaauggaguuaacg

SEQ ID NO: 2207460 - RNA, 15 nt, Human
uauaaugguugacug

SEQ ID NO: 2207461 - RNA, 18 nt, Human
uauaaugaaugagagaau

SEQ ID NO: 2207462 - RNA, 19 nt, Human
uauacccguacaacguguc

SEQ ID NO: 2207463 - RNA, 17 nt, Human
uauacccccugcaaagc

SEQ ID NO: 2207464 - RNA, 23 nt, Human
uauacccaugaacuuaaaaugaa

SEQ ID NO: 2207465 - RNA, 12 nt, Human
uauaccugauuu

SEQ ID NO: 2207466 - RNA, 13 nt, Human
uauaauucccuau

SEQ ID NO: 2207467 - RNA, 13 nt, Human
uauaauucuguaa

SEQ ID NO: 2207468 - RNA, 12 nt, Human
uauaauucugua

SEQ ID NO: 2207469 - RNA, 20 nt, Human
uauacucuuauagacaacau

SEQ ID NO: 2207470 - RNA, 18 nt, Human
uauacucuagaugaaguu

SEQ ID NO: 2207471 - RNA, 22 nt, Human
uauacucuuucuguauauacuu

SEQ ID NO: 2207472 - RNA, 19 nt, Human
uauacucuuucuguauaua

SEQ ID NO: 2207473 - RNA, 17 nt, Human
uauacucuuucuguaua

SEQ ID NO: 2207474 - RNA, 16 nt, Human
uauacucuuucuguau

SEQ ID NO: 2207475 - RNA, 16 nt, Human
uauacuauauuuaugg

SEQ ID NO: 2207476 - RNA, 17 nt, Human
uauacucacuuucuaga

SEQ ID NO: 2207477 - RNA, 22 nt, Human
uauaccugggcauacuaauaaa

SEQ ID NO: 2207478 - RNA, 13 nt, Human
uauaccugugccu

SEQ ID NO: 2207479 - RNA, 20 nt, Human
uauaccugauuuuuuuuccu

SEQ ID NO: 2207480 - RNA, 14 nt, Human
uauaccugugccuc

SEQ ID NO: 2207481 - RNA, 15 nt, Human
uaguuuacuauuuua

SEQ ID NO: 2207482 - RNA, 22 nt, Human
uaguuuaccugaauaaauggua

SEQ ID NO: 2207483 - RNA, 18 nt, Human
uaguuucagauauauauc

SEQ ID NO: 2207484 - RNA, 21 nt, Human
uaguuguaccgcaaugugacu

SEQ ID NO: 2207485 - RNA, 17 nt, Human
uaguugugggugggaga

SEQ ID NO: 2207486 - RNA, 18 nt, Human
uaguugugaccuuagugu

SEQ ID NO: 2207487 - RNA, 22 nt, Human
uaguugugaccuuaguguuucu

SEQ ID NO: 2207488 - RNA, 17 nt, Human
uaguugucuuuccuggc

SEQ ID NO: 2207489 - RNA, 12 nt, Human
uaguuugcaguu

SEQ ID NO: 2207490 - RNA, 23 nt, Human
uaguuugauuaaauucuugcaaa

SEQ ID NO: 2207491 - RNA, 14 nt, Human
uaguuucuguucug

SEQ ID NO: 2207492 - RNA, 15 nt, Human
uaguuucuguucugu

SEQ ID NO: 2207493 - RNA, 16 nt, Human
uaguuucuguucugug

SEQ ID NO: 2207494 - RNA, 17 nt, Human
uaguuucuguucugugg

SEQ ID NO: 2207495 - RNA, 13 nt, Human
uaguuucuccaag

SEQ ID NO: 2207496 - RNA, 15 nt, Human
uaguggauguucuga

SEQ ID NO: 2207497 - RNA, 15 nt, Human
uaguggauggaaggg

SEQ ID NO: 2207498 - RNA, 11 nt, Human
uaguguaaaau

SEQ ID NO: 2207499 - RNA, 19 nt, Human
uaguggucuuuguaagagu

SEQ ID NO: 2207500 - RNA, 21 nt, Human
uaguggucuuuguaagagugu

SEQ ID NO: 2207501 - RNA, 18 nt, Human
uaguggauggaaggggcu

SEQ ID NO: 2207502 - RNA, 17 nt, Human
uaguggauuacugccau

SEQ ID NO: 2207503 - RNA, 15 nt, Human
uaguugcuccgccuc

SEQ ID NO: 2207504 - RNA, 17 nt, Human
uagugucacuuaccuag

SEQ ID NO: 2207505 - RNA, 16 nt, Human
uaguugcuccgccucu

SEQ ID NO: 2207506 - RNA, 15 nt, Human
uaguugguguucaaa

SEQ ID NO: 2207507 - RNA, 13 nt, Human
uaguugcuugccu

SEQ ID NO: 2207508 - RNA, 20 nt, Human
uaguguaggucagcgugcuu

SEQ ID NO: 2207509 - RNA, 23 nt, Human
uaguggucuuuguaagaguguag

SEQ ID NO: 2207510 - RNA, 13 nt, Human
uaguguaaaauaa

SEQ ID NO: 2207511 - RNA, 19 nt, Human
uaguguaaaauaagaauga

SEQ ID NO: 2207512 - RNA, 22 nt, Human
uaguguaaaauaagaaugauuu

SEQ ID NO: 2207513 - RNA, 21 nt, Human
uaggcgggcggucagggguuc

SEQ ID NO: 2207514 - RNA, 16 nt, Human
uaggcgggaaggaggg

SEQ ID NO: 2207515 - RNA, 23 nt, Human
uaggcgaucacaacgugcauugu

SEQ ID NO: 2207516 - RNA, 13 nt, Human
uaggcgaucacaa

SEQ ID NO: 2207517 - RNA, 14 nt, Human
uaggcgagugccag

SEQ ID NO: 2207518 - RNA, 18 nt, Human
uaggcgagugccaggacu

SEQ ID NO: 2207519 - RNA, 15 nt, Human
uaggcuacaauuuuc

SEQ ID NO: 2207520 - RNA, 20 nt, Human
uaggcuacaauuuucuccca

SEQ ID NO: 2207521 - RNA, 13 nt, Human
uagugaugguucc

SEQ ID NO: 2207522 - RNA, 21 nt, Human
uagucacauggccuaugcaca

SEQ ID NO: 2207523 - RNA, 15 nt, Human
uagucaagcuccucc

SEQ ID NO: 2207524 - RNA, 14 nt, Human
uagucaagcuccuc

SEQ ID NO: 2207525 - RNA, 13 nt, Human
uagucaagcuccu

SEQ ID NO: 2207526 - RNA, 15 nt, Human
uagucaagauugugu

SEQ ID NO: 2207527 - RNA, 23 nt, Human
uagucaagaaaaauuauuguaua

SEQ ID NO: 2207528 - RNA, 18 nt, Human
uagucaaauugugugaaa

SEQ ID NO: 2207529 - RNA, 19 nt, Human
uagugcucgcuuucuaugu

SEQ ID NO: 2207530 - RNA, 13 nt, Human
uagugcugcugaa

SEQ ID NO: 2207531 - RNA, 22 nt, Human
uagugcugcugaagaugaauca

SEQ ID NO: 2207532 - RNA, 12 nt, Human
uagugcugugaa

SEQ ID NO: 2207533 - RNA, 21 nt, Human
uagugcuuaaaaaucauugau

SEQ ID NO: 2207534 - RNA, 17 nt, Human
uagugcugugaaaaaaa

SEQ ID NO: 2207535 - RNA, 16 nt, Human
uagugcugugaaaaaa

SEQ ID NO: 2207536 - RNA, 13 nt, Human
uagugcugugaaa

SEQ ID NO: 2207537 - RNA, 23 nt, Human
uagugcuuuccuuuuuuaaaaau

SEQ ID NO: 2207538 - RNA, 14 nt, Human
uagugaugguuccc

SEQ ID NO: 2207539 - RNA, 18 nt, Human
uagugaugguuccccugu

SEQ ID NO: 2207540 - RNA, 15 nt, Human
uagugcuaaguguga

SEQ ID NO: 2207541 - RNA, 17 nt, Human
uagugcuaagugugaac

SEQ ID NO: 2207542 - RNA, 18 nt, Human
uagugcuaagugugaacu

SEQ ID NO: 2207543 - RNA, 19 nt, Human
uagugcuaagugugaacug

SEQ ID NO: 2207544 - RNA, 14 nt, Human
uagugcuaagugug

SEQ ID NO: 2207545 - RNA, 16 nt, Human
uagucacacguggucu

SEQ ID NO: 2207546 - RNA, 14 nt, Human
uagugcaaaucaua

SEQ ID NO: 2207547 - RNA, 10 nt, Human
ggagacuaga

SEQ ID NO: 2207548 - RNA, 22 nt, Human
ggagacguacguaucagcggcc

SEQ ID NO: 2207549 - RNA, 20 nt, Human
ggagaccgggguauccuggg

SEQ ID NO: 2207550 - RNA, 21 nt, Human
ggagagcuagcagcagggagg

SEQ ID NO: 2207551 - RNA, 17 nt, Human
ggagagcuagcagcagg

SEQ ID NO: 2207552 - RNA, 19 nt, Human
ggagacuagauugccuuug

SEQ ID NO: 2207553 - RNA, 14 nt, Human
ggagacuagauugc

SEQ ID NO: 2207554 - RNA, 22 nt, Human
ggagacuagauuuaugaauaca

SEQ ID NO: 2207555 - RNA, 16 nt, Human
ggagacuaagcccugu

SEQ ID NO: 2207556 - RNA, 17 nt, Human
ggagacuaucagcccaa

SEQ ID NO: 2207557 - RNA, 13 nt, Human
ggagagcuggagc

SEQ ID NO: 2207558 - RNA, 17 nt, Human
ggagagcuggagccugg

SEQ ID NO: 2207559 - RNA, 18 nt, Human
ggagagcuggagccuggu

SEQ ID NO: 2207560 - RNA, 22 nt, Human
ggagagcuggagccuggugccc

SEQ ID NO: 2207561 - RNA, 18 nt, Human
ggagagcuggugcccgga

SEQ ID NO: 2207562 - RNA, 17 nt, Human
ggagagcuggugcccgg

SEQ ID NO: 2207563 - RNA, 15 nt, Human
ggagagcuggugccc

SEQ ID NO: 2207564 - RNA, 13 nt, Human
ggagagggagguc

SEQ ID NO: 2207565 - RNA, 21 nt, Human
ggagagggaugaggugcuggg

SEQ ID NO: 2207566 - RNA, 14 nt, Human
ggagagggaugagg

SEQ ID NO: 2207567 - RNA, 17 nt, Human
ggagagggaggucacug

SEQ ID NO: 2207568 - RNA, 11 nt, Human
ggacuggguuu

SEQ ID NO: 2207569 - RNA, 15 nt, Human
ggacugggggccaga

SEQ ID NO: 2207570 - RNA, 13 nt, Human
ggacuggguuugg

SEQ ID NO: 2207571 - RNA, 18 nt, Human
ggacuggguuuggacccc

SEQ ID NO: 2207572 - RNA, 23 nt, Human
ggacugggccacuucuggguggg

SEQ ID NO: 2207573 - RNA, 17 nt, Human
ggacuggggauguggga

SEQ ID NO: 2207574 - RNA, 23 nt, Human
ggacuggggaugugggagggagc

SEQ ID NO: 2207575 - RNA, 18 nt, Human
ggacugcuaaauaaaauu

SEQ ID NO: 2207576 - RNA, 19 nt, Human
ggacugcuaaauaaaauuu

SEQ ID NO: 2207577 - RNA, 11 nt, Human
ggacugggagg

SEQ ID NO: 2207578 - RNA, 12 nt, Human
ggacugggaggu

SEQ ID NO: 2207579 - RNA, 21 nt, Human
ggacugccccgugcagacugg

SEQ ID NO: 2207580 - RNA, 21 nt, Human
ggacugccagucccccugccc

SEQ ID NO: 2207581 - RNA, 18 nt, Human
ggacugccccgugcagac

SEQ ID NO: 2207582 - RNA, 20 nt, Human
ggacugccuugaauaucccc

SEQ ID NO: 2207583 - RNA, 18 nt, Human
ggacuguagggagggcgg

SEQ ID NO: 2207584 - RNA, 20 nt, Human
ggacuguagggagggcggca

SEQ ID NO: 2207585 - RNA, 15 nt, Human
ggacuguauuuguga

SEQ ID NO: 2207586 - RNA, 21 nt, Human
ggacuggguuuggaccccagc

SEQ ID NO: 2207587 - RNA, 23 nt, Human
ggacuggguuuggaccccagcug

SEQ ID NO: 2207588 - RNA, 24 nt, Human
ggacuggguuuggaccccagcugg

SEQ ID NO: 2207589 - RNA, 20 nt, Human
ggacugucuuucagauacau

SEQ ID NO: 2207590 - RNA, 15 nt, Human
ggacugucauagaaa

SEQ ID NO: 2207591 - RNA, 21 nt, Human
ggagaccccuuggggagcagg

SEQ ID NO: 2207592 - RNA, 20 nt, Human
ggagcaaaaucgaugcagug

SEQ ID NO: 2207593 - RNA, 16 nt, Human
ggagauuuuccuuccu

SEQ ID NO: 2207594 - RNA, 16 nt, Human
ggagcaaacucugcug

SEQ ID NO: 2207595 - RNA, 16 nt, Human
ggagauuuuagguguu

SEQ ID NO: 2207596 - RNA, 19 nt, Human
ggagauuuuagguguugau

SEQ ID NO: 2207597 - RNA, 17 nt, Human
ggagauuuuccuuccua

SEQ ID NO: 2207598 - RNA, 21 nt, Human
ggagccccuucugcucagcuc

SEQ ID NO: 2207599 - RNA, 19 nt, Human
ggagccccuucugcucagc

SEQ ID NO: 2207600 - RNA, 18 nt, Human
ggagccccuucugcucag

SEQ ID NO: 2207601 - RNA, 14 nt, Human
ggagcaaaggcuga

SEQ ID NO: 2207602 - RNA, 18 nt, Human
ggagcccgcacccccacc

SEQ ID NO: 2207603 - RNA, 16 nt, Human
ggagcccgcaccccca

SEQ ID NO: 2207604 - RNA, 14 nt, Human
ggagcccgcacccc

SEQ ID NO: 2207605 - RNA, 21 nt, Human
ggagcccgcacccccacccuu

SEQ ID NO: 2207606 - RNA, 20 nt, Human
ggagcccgcacccccacccu

SEQ ID NO: 2207607 - RNA, 16 nt, Human
ggagcccgucucagug

SEQ ID NO: 2207608 - RNA, 12 nt, Human
ggagcccuggga

SEQ ID NO: 2207609 - RNA, 22 nt, Human
ggagcccuuaucugugcucagg

SEQ ID NO: 2207610 - RNA, 20 nt, Human
ggagcccuuaucugugcuca

SEQ ID NO: 2207611 - RNA, 13 nt, Human
ggagcccugggag

SEQ ID NO: 2207612 - RNA, 16 nt, Human
ggagauguagcaaaac

SEQ ID NO: 2207613 - RNA, 18 nt, Human
ggagaugggccuuuugga

SEQ ID NO: 2207614 - RNA, 19 nt, Human
ggagauggaggaaagugau

SEQ ID NO: 2207615 - RNA, 12 nt, Human
ggagaugucuuc

SEQ ID NO: 2207616 - RNA, 13 nt, Human
ggagaugucuucg

SEQ ID NO: 2207617 - RNA, 14 nt, Human
ggagauucagacug

SEQ ID NO: 2207618 - RNA, 22 nt, Human
ggagaugucuucguacaguucu

SEQ ID NO: 2207619 - RNA, 14 nt, Human
ggagaugucuucgu

SEQ ID NO: 2207620 - RNA, 17 nt, Human
ggagauuggacggccug

SEQ ID NO: 2207621 - RNA, 20 nt, Human
ggagauugagaaggagagaa

SEQ ID NO: 2207622 - RNA, 21 nt, Human
ggagauugagaaggagagaaa

SEQ ID NO: 2207623 - RNA, 14 nt, Human
ggagauugagaagg

SEQ ID NO: 2207624 - RNA, 16 nt, Human
ggagauugagaaggag

SEQ ID NO: 2207625 - RNA, 17 nt, Human
ggagauugagaaggaga

SEQ ID NO: 2207626 - RNA, 20 nt, Human
ggagauuuacaacuggggga

SEQ ID NO: 2207627 - RNA, 14 nt, Human
ggagaggggcagaa

SEQ ID NO: 2207628 - RNA, 24 nt, Human
ggagagggaugaggugcugggagg

SEQ ID NO: 2207629 - RNA, 22 nt, Human
ggagaggggaagggccagucug

SEQ ID NO: 2207630 - RNA, 18 nt, Human
ggagaggggaagggccag

SEQ ID NO: 2207631 - RNA, 15 nt, Human
ggagaggggcacagg

SEQ ID NO: 2207632 - RNA, 18 nt, Human
ggagagggucuggagaag

SEQ ID NO: 2207633 - RNA, 17 nt, Human
ggagagggucuggagaa

SEQ ID NO: 2207634 - RNA, 14 nt, Human
ggagagggucugga

SEQ ID NO: 2207635 - RNA, 21 nt, Human
ggagagggucuggagaagcag

SEQ ID NO: 2207636 - RNA, 20 nt, Human
ggagagggucuggagaagca

SEQ ID NO: 2207637 - RNA, 15 nt, Human
ggagaugcuccuugg

SEQ ID NO: 2207638 - RNA, 20 nt, Human
ggagauggaaguugcaguga

SEQ ID NO: 2207639 - RNA, 13 nt, Human
ggagauggaguuc

SEQ ID NO: 2207640 - RNA, 22 nt, Human
ggaccugccuccugccugcccc

SEQ ID NO: 2207641 - RNA, 14 nt, Human
ggaccugccuguag

SEQ ID NO: 2207642 - RNA, 19 nt, Human
ggaccugccuccugccugc

SEQ ID NO: 2207643 - RNA, 14 nt, Human
ggaccuggcugcca

SEQ ID NO: 2207644 - RNA, 15 nt, Human
ggaccugccuguagc

SEQ ID NO: 2207645 - RNA, 23 nt, Human
ggaccugccuccugccugccccu

SEQ ID NO: 2207646 - RNA, 17 nt, Human
ggaccucugcucugagg

SEQ ID NO: 2207647 - RNA, 17 nt, Human
ggaccugagucugcuau

SEQ ID NO: 2207648 - RNA, 14 nt, Human
ggaccugccaggca

SEQ ID NO: 2207649 - RNA, 16 nt, Human
ggaccugccaggcagg

SEQ ID NO: 2207650 - RNA, 17 nt, Human
ggaccugccaggcaggg

SEQ ID NO: 2207651 - RNA, 22 nt, Human
ggaccuuaucugugcgugaaac

SEQ ID NO: 2207652 - RNA, 15 nt, Human
ggaccuuaucugugc

SEQ ID NO: 2207653 - RNA, 21 nt, Human
ggaccuuaggccuuccucucu

SEQ ID NO: 2207654 - RNA, 18 nt, Human
ggaccuuaggccuuccuc

SEQ ID NO: 2207655 - RNA, 17 nt, Human
ggaccuggugcugccuc

SEQ ID NO: 2207656 - RNA, 17 nt, Human
ggaccugguacccuccu

SEQ ID NO: 2207657 - RNA, 15 nt, Human
ggacuccucugucca

SEQ ID NO: 2207658 - RNA, 15 nt, Human
ggaccuuccugccac

SEQ ID NO: 2207659 - RNA, 12 nt, Human
ggaccuuccugc

SEQ ID NO: 2207660 - RNA, 13 nt, Human
ggaccuuccugcc

SEQ ID NO: 2207661 - RNA, 14 nt, Human
ggacuccucugucc

SEQ ID NO: 2207662 - RNA, 12 nt, Human
ggacuccucugu

SEQ ID NO: 2207663 - RNA, 13 nt, Human
ggacucugaggcu

SEQ ID NO: 2207664 - RNA, 11 nt, Human
ggacucugagg

SEQ ID NO: 2207665 - RNA, 21 nt, Human
ggacucugaggcucuuucugg

SEQ ID NO: 2207666 - RNA, 13 nt, Human
ggacucugcacau

SEQ ID NO: 2207667 - RNA, 21 nt, Human
ggacucugcacaugucuugua

SEQ ID NO: 2207668 - RNA, 15 nt, Human
ggacucugcacauga

SEQ ID NO: 2207669 - RNA, 20 nt, Human
ggacucugcacaugucuugu

SEQ ID NO: 2207670 - RNA, 18 nt, Human
ggacucucagucucugag

SEQ ID NO: 2207671 - RNA, 17 nt, Human
ggacucucagucucuga

SEQ ID NO: 2207672 - RNA, 17 nt, Human
ggacucugaagccucug

SEQ ID NO: 2207673 - RNA, 19 nt, Human
ggacucugaagccucuggg

SEQ ID NO: 2207674 - RNA, 21 nt, Human
ggacucucagucucugagcag

SEQ ID NO: 2207675 - RNA, 20 nt, Human
ggacucucagucucugagca

SEQ ID NO: 2207676 - RNA, 11 nt, Human
ggacucugccu

SEQ ID NO: 2207677 - RNA, 17 nt, Human
ggacucugggguuuuua

SEQ ID NO: 2207678 - RNA, 22 nt, Human
ggacugcacagcguccugucca

SEQ ID NO: 2207679 - RNA, 23 nt, Human
ggacugcacagcguccuguccac

SEQ ID NO: 2207680 - RNA, 16 nt, Human
ggacucuugcucuuuc

SEQ ID NO: 2207681 - RNA, 18 nt, Human
ggacucuugcucuuucua

SEQ ID NO: 2207682 - RNA, 22 nt, Human
ggacugcaagcagggcucugcc

SEQ ID NO: 2207683 - RNA, 15 nt, Human
ggaccucucccaggg

SEQ ID NO: 2207684 - RNA, 14 nt, Human
ggaccucucccagg

SEQ ID NO: 2207685 - RNA, 12 nt, Human
ggaccucuccca

SEQ ID NO: 2207686 - RNA, 12 nt, Human
ggaccucugcuc

SEQ ID NO: 2207687 - RNA, 13 nt, Human
ggaccucugcucu

SEQ ID NO: 2207688 - RNA, 14 nt, Human
ggaccucugcucug

SEQ ID NO: 2207689 - RNA, 16 nt, Human
ggaccucugcucugag

SEQ ID NO: 2207690 - RNA, 19 nt, Human
ggacccaucacgccugugc

SEQ ID NO: 2207691 - RNA, 22 nt, Human
ggacccaugaguuggggucugg

SEQ ID NO: 2207692 - RNA, 14 nt, Human
ggacccagggauga

SEQ ID NO: 2207693 - RNA, 15 nt, Human
ggaccaggacucccu

SEQ ID NO: 2207694 - RNA, 17 nt, Human
ggaccaggacaggacca

SEQ ID NO: 2207695 - RNA, 11 nt, Human
ggaccaggacu

SEQ ID NO: 2207696 - RNA, 17 nt, Human
ggaccaggacucccucc

SEQ ID NO: 2207697 - RNA, 21 nt, Human
ggaccaggacuauagcccagg

SEQ ID NO: 2207698 - RNA, 21 nt, Human
ggacccagaggaaggggccag

SEQ ID NO: 2207699 - RNA, 16 nt, Human
ggacccagacccagug

SEQ ID NO: 2207700 - RNA, 17 nt, Human
ggacccagacccagugg

SEQ ID NO: 2207701 - RNA, 14 nt, Human
ggacccagacccag

SEQ ID NO: 2207702 - RNA, 20 nt, Human
ggaaggaggguuagggaggg

SEQ ID NO: 2207703 - RNA, 13 nt, Human
ggaaggagugaga

SEQ ID NO: 2207704 - RNA, 13 nt, Human
ggaaggagggagg

SEQ ID NO: 2207705 - RNA, 18 nt, Human
ggaccagcucaggacaga

SEQ ID NO: 2207706 - RNA, 16 nt, Human
ggaccagcucaggaca

SEQ ID NO: 2207707 - RNA, 14 nt, Human
ggaccaggacagga

SEQ ID NO: 2207708 - RNA, 22 nt, Human
ggaccagcuuuucccaaaagcc

SEQ ID NO: 2207709 - RNA, 17 nt, Human
ggaccagcuuuucccaa

SEQ ID NO: 2207710 - RNA, 15 nt, Human
ggaccagcuuuuccc

SEQ ID NO: 2207711 - RNA, 22 nt, Human
ggaccagcuggggcguggggag

SEQ ID NO: 2207712 - RNA, 12 nt, Human
ggaccagcuggg

SEQ ID NO: 2207713 - RNA, 19 nt, Human
ggaccagcuggggcguggg

SEQ ID NO: 2207714 - RNA, 22 nt, Human
ggaccagcucaggacagaugcc

SEQ ID NO: 2207715 - RNA, 19 nt, Human
ggaccagcucaggacagau

SEQ ID NO: 2207716 - RNA, 17 nt, Human
ggaaggagagccugcug

SEQ ID NO: 2207717 - RNA, 16 nt, Human
ggaaggagagccugcu

SEQ ID NO: 2207718 - RNA, 15 nt, Human
ggaaggagagccugc

SEQ ID NO: 2207719 - RNA, 14 nt, Human
ggaaggagagccug

SEQ ID NO: 2207720 - RNA, 20 nt, Human
ggaagccagcaggcucucag

SEQ ID NO: 2207721 - RNA, 20 nt, Human
ggaggaucuuuugaacccag

SEQ ID NO: 2207722 - RNA, 13 nt, Human
ggaggauggagag

SEQ ID NO: 2207723 - RNA, 12 nt, Human
ggaggauggaga

SEQ ID NO: 2207724 - RNA, 22 nt, Human
ggaggaucacuggagcccagga

SEQ ID NO: 2207725 - RNA, 17 nt, Human
ggaggaggugccaacag

SEQ ID NO: 2207726 - RNA, 21 nt, Human
ggaggaucucuugagccuggg

SEQ ID NO: 2207727 - RNA, 17 nt, Human
ggaggaucucuugagcc

SEQ ID NO: 2207728 - RNA, 23 nt, Human
ggaggaucacuugaguccagaag

SEQ ID NO: 2207729 - RNA, 19 nt, Human
ggagggaauugaggucugc

SEQ ID NO: 2207730 - RNA, 17 nt, Human
ggagggaauugaggucu

SEQ ID NO: 2207731 - RNA, 15 nt, Human
ggagggaauugaggu

SEQ ID NO: 2207732 - RNA, 21 nt, Human
ggagggaaugaaccuggaggg

SEQ ID NO: 2207733 - RNA, 13 nt, Human
ggagggacauggc

SEQ ID NO: 2207734 - RNA, 22 nt, Human
ggagggacaaguggacucaggg

SEQ ID NO: 2207735 - RNA, 21 nt, Human
ggaggauggagagaggggaau

SEQ ID NO: 2207736 - RNA, 14 nt, Human
ggaggauggagaga

SEQ ID NO: 2207737 - RNA, 13 nt, Human
ggaggaugggcuc

SEQ ID NO: 2207738 - RNA, 15 nt, Human
ggaggauguucuggg

SEQ ID NO: 2207739 - RNA, 13 nt, Human
ggagggagaugga

SEQ ID NO: 2207740 - RNA, 13 nt, Human
ggagggagaggga

SEQ ID NO: 2207741 - RNA, 16 nt, Human
ggagggagcagacagg

SEQ ID NO: 2207742 - RNA, 16 nt, Human
ggagggaggcucaggu

SEQ ID NO: 2207743 - RNA, 15 nt, Human
ggagggaggcucagg

SEQ ID NO: 2207744 - RNA, 12 nt, Human
ggagggagggcu

SEQ ID NO: 2207745 - RNA, 12 nt, Human
ggagggauuugg

SEQ ID NO: 2207746 - RNA, 20 nt, Human
ggagggauuggccgcuuggc

SEQ ID NO: 2207747 - RNA, 21 nt, Human
ggagggcaagggccaugcuga

SEQ ID NO: 2207748 - RNA, 16 nt, Human
ggagggcagcagaagg

SEQ ID NO: 2207749 - RNA, 23 nt, Human
ggagggcaagggccaugcugaag

SEQ ID NO: 2207750 - RNA, 21 nt, Human
ggagggcacauuccuugccug

SEQ ID NO: 2207751 - RNA, 12 nt, Human
ggagggcuccag

SEQ ID NO: 2207752 - RNA, 13 nt, Human
ggagggcuccaga

SEQ ID NO: 2207753 - RNA, 17 nt, Human
ggagggcagcagggcua

SEQ ID NO: 2207754 - RNA, 16 nt, Human
ggagggcagcagggcu

SEQ ID NO: 2207755 - RNA, 15 nt, Human
ggagggcagcagggc

SEQ ID NO: 2207756 - RNA, 13 nt, Human
ggagggcagcagg

SEQ ID NO: 2207757 - RNA, 23 nt, Human
ggagggcuagaaccuggcagguu

SEQ ID NO: 2207758 - RNA, 21 nt, Human
ggaggaucacuggagcccagg

SEQ ID NO: 2207759 - RNA, 20 nt, Human
ggaggaucacuggagcccag

SEQ ID NO: 2207760 - RNA, 19 nt, Human
ggaggaucacuggagccca

SEQ ID NO: 2207761 - RNA, 17 nt, Human
ggaggaucacuggagcc

SEQ ID NO: 2207762 - RNA, 16 nt, Human
ggaggaucacuggagc

SEQ ID NO: 2207763 - RNA, 23 nt, Human
ggaggagguuuaggucaagaaga

SEQ ID NO: 2207764 - RNA, 20 nt, Human
ggaggagguggcagcccugu

SEQ ID NO: 2207765 - RNA, 15 nt, Human
ggaggaggugccaac

SEQ ID NO: 2207766 - RNA, 19 nt, Human
ggaggagggcggggggcac

SEQ ID NO: 2207767 - RNA, 12 nt, Human
ggaggagggaga

SEQ ID NO: 2207768 - RNA, 13 nt, Human
ggaggagggagag

SEQ ID NO: 2207769 - RNA, 17 nt, Human
ggaggagcuugggggau

SEQ ID NO: 2207770 - RNA, 13 nt, Human
ggaggaggaaggc

SEQ ID NO: 2207771 - RNA, 15 nt, Human
ggaggaggaaggcaa

SEQ ID NO: 2207772 - RNA, 17 nt, Human
ggaggagcagugcaggc

SEQ ID NO: 2207773 - RNA, 13 nt, Human
ggaggagagaaga

SEQ ID NO: 2207774 - RNA, 12 nt, Human
ggaggagcaggg

SEQ ID NO: 2207775 - RNA, 14 nt, Human
ggaggaggaggcaa

SEQ ID NO: 2207776 - RNA, 13 nt, Human
ggaggaggaggca

SEQ ID NO: 2207777 - RNA, 13 nt, Human
ggaggaggccacc

SEQ ID NO: 2207778 - RNA, 14 nt, Human
ggaggaggccaccu

SEQ ID NO: 2207779 - RNA, 15 nt, Human
ggaggaggccaccuc

SEQ ID NO: 2207780 - RNA, 16 nt, Human
ggaggaggccaccucu

SEQ ID NO: 2207781 - RNA, 19 nt, Human
ggaggaggccaccucucca

SEQ ID NO: 2207782 - RNA, 22 nt, Human
ggaggaggccaccucuccaagg

SEQ ID NO: 2207783 - RNA, 12 nt, Human
ggaggaggccug

SEQ ID NO: 2207784 - RNA, 22 nt, Human
ggaggaggccugggggcaggga

SEQ ID NO: 2207785 - RNA, 13 nt, Human
ggagcccuugggu

SEQ ID NO: 2207786 - RNA, 21 nt, Human
ggagccgagaucacgccacug

SEQ ID NO: 2207787 - RNA, 13 nt, Human
ggagccgcagcag

SEQ ID NO: 2207788 - RNA, 21 nt, Human
ggagccgaggccuaccccgca

SEQ ID NO: 2207789 - RNA, 19 nt, Human
ggaggacgcucucuggccu

SEQ ID NO: 2207790 - RNA, 13 nt, Human
ggagccgcuggca

SEQ ID NO: 2207791 - RNA, 14 nt, Human
ggagccgcuggcag

SEQ ID NO: 2207792 - RNA, 20 nt, Human
ggagccgcuggcagaaggga

SEQ ID NO: 2207793 - RNA, 21 nt, Human
ggagccgggaaagaagagccg

SEQ ID NO: 2207794 - RNA, 12 nt, Human
ggaggagcaaag

SEQ ID NO: 2207795 - RNA, 13 nt, Human
ggaggagaaugag

SEQ ID NO: 2207796 - RNA, 17 nt, Human
ggaggagcaaaggcuga

SEQ ID NO: 2207797 - RNA, 21 nt, Human
ggaggacugccccgugcagac

SEQ ID NO: 2207798 - RNA, 21 nt, Human
ggaggacuagaaccuggaggg

SEQ ID NO: 2207799 - RNA, 22 nt, Human
ggaggacuagaaccuggagggc

SEQ ID NO: 2207800 - RNA, 16 nt, Human
ggaggacuagaaccug

SEQ ID NO: 2207801 - RNA, 19 nt, Human
ggaggacuagaaccuggag

SEQ ID NO: 2207802 - RNA, 21 nt, Human
ggaggacgcucucuggccuuc

SEQ ID NO: 2207803 - RNA, 20 nt, Human
ggaggacgcucucuggccuu

SEQ ID NO: 2207804 - RNA, 15 nt, Human
ggagugagaugccug

SEQ ID NO: 2207805 - RNA, 22 nt, Human
ggagugaagaggggcagcccuu

SEQ ID NO: 2207806 - RNA, 23 nt, Human
ggagugaagaggggcagcccuug

SEQ ID NO: 2207807 - RNA, 17 nt, Human
ggagugaagaggggcag

SEQ ID NO: 2207808 - RNA, 18 nt, Human
ggagugaagaggggcagc

SEQ ID NO: 2207809 - RNA, 19 nt, Human
ggagugaagaggggcagcc

SEQ ID NO: 2207810 - RNA, 20 nt, Human
ggagugaagaggggcagccc

SEQ ID NO: 2207811 - RNA, 12 nt, Human
ggagugagcugg

SEQ ID NO: 2207812 - RNA, 14 nt, Human
ggagugagcugguu

SEQ ID NO: 2207813 - RNA, 21 nt, Human
ggagugaguugauagcacaga

SEQ ID NO: 2207814 - RNA, 17 nt, Human
ggagugacagaggcagc

SEQ ID NO: 2207815 - RNA, 18 nt, Human
ggagugacagaggcagcc

SEQ ID NO: 2207816 - RNA, 19 nt, Human
ggagugacagaggcagccc

SEQ ID NO: 2207817 - RNA, 21 nt, Human
ggagugacagaggcagcccca

SEQ ID NO: 2207818 - RNA, 21 nt, Human
ggagugaguguggcuccccuc

SEQ ID NO: 2207819 - RNA, 21 nt, Human
ggagugaggaaggcaggaaga

SEQ ID NO: 2207820 - RNA, 21 nt, Human
ggagugaggaauaguugagcc

SEQ ID NO: 2207821 - RNA, 18 nt, Human
ggauagaugcuggcccag

SEQ ID NO: 2207822 - RNA, 13 nt, Human
ggauagaugugug

SEQ ID NO: 2207823 - RNA, 20 nt, Human
ggauagaugcuggcccaggg

SEQ ID NO: 2207824 - RNA, 19 nt, Human
ggauagaugcuggcccagg

SEQ ID NO: 2207825 - RNA, 15 nt, Human
ggauagaugugugga

SEQ ID NO: 2207826 - RNA, 14 nt, Human
ggauagaugugugg

SEQ ID NO: 2207827 - RNA, 21 nt, Human
ggauagaugcuggcccagggc

SEQ ID NO: 2207828 - RNA, 23 nt, Human
ggagugaggaauaguugagcccc

SEQ ID NO: 2207829 - RNA, 13 nt, Human
ggauagcauuuuu

SEQ ID NO: 2207830 - RNA, 18 nt, Human
ggauaggaaaaaugagua

SEQ ID NO: 2207831 - RNA, 14 nt, Human
ggauaggagccugc

SEQ ID NO: 2207832 - RNA, 15 nt, Human
ggauaggagccugcu

SEQ ID NO: 2207833 - RNA, 19 nt, Human
ggaucacuggagcccagga

SEQ ID NO: 2207834 - RNA, 18 nt, Human
ggaucacuggagcccagg

SEQ ID NO: 2207835 - RNA, 17 nt, Human
ggaucacuggagcccag

SEQ ID NO: 2207836 - RNA, 14 nt, Human
ggaucacuggagcc

SEQ ID NO: 2207837 - RNA, 16 nt, Human
ggaucagaacagcaga

SEQ ID NO: 2207838 - RNA, 17 nt, Human
ggaucagaacagcagag

SEQ ID NO: 2207839 - RNA, 14 nt, Human
ggaucagaaauaca

SEQ ID NO: 2207840 - RNA, 16 nt, Human
ggaucagaaauacaga

SEQ ID NO: 2207841 - RNA, 13 nt, Human
ggaucacuggagc

SEQ ID NO: 2207842 - RNA, 17 nt, Human
ggaucacagggccccag

SEQ ID NO: 2207843 - RNA, 14 nt, Human
ggaucacagggccc

SEQ ID NO: 2207844 - RNA, 13 nt, Human
ggaucacagggcc

SEQ ID NO: 2207845 - RNA, 17 nt, Human
ggauaggagccugcugg

SEQ ID NO: 2207846 - RNA, 21 nt, Human
ggauaggaguucacuucaucu

SEQ ID NO: 2207847 - RNA, 16 nt, Human
ggaucacagccucuga

SEQ ID NO: 2207848 - RNA, 11 nt, Human
ggagugacaga

SEQ ID NO: 2207849 - RNA, 16 nt, Human
ggagugacagaggcag

SEQ ID NO: 2207850 - RNA, 21 nt, Human
ggagugaaaccuuuagggcag

SEQ ID NO: 2207851 - RNA, 22 nt, Human
ggagugaaaccuuuagggcagc

SEQ ID NO: 2207852 - RNA, 23 nt, Human
ggagugaaaccuuuagggcagcu

SEQ ID NO: 2207853 - RNA, 12 nt, Human
ggagugaagagg

SEQ ID NO: 2207854 - RNA, 15 nt, Human
ggagugaagaggggc

SEQ ID NO: 2207855 - RNA, 16 nt, Human
ggagugaagaggggca

SEQ ID NO: 2207856 - RNA, 15 nt, Human
ggagucugaagcaga

SEQ ID NO: 2207857 - RNA, 14 nt, Human
ggagucugaagcag

SEQ ID NO: 2207858 - RNA, 16 nt, Human
ggagucccgucaggac

SEQ ID NO: 2207859 - RNA, 21 nt, Human
ggagucuccagugguugcugu

SEQ ID NO: 2207860 - RNA, 22 nt, Human
ggagucguggggugugcuggga

SEQ ID NO: 2207861 - RNA, 24 nt, Human
ggagucguggggugugcugggagc

SEQ ID NO: 2207862 - RNA, 20 nt, Human
ggagucccaccuuggcugca

SEQ ID NO: 2207863 - RNA, 21 nt, Human
ggagucccaccuuggcugcag

SEQ ID NO: 2207864 - RNA, 21 nt, Human
ggaggggacuauuuaugaagg

SEQ ID NO: 2207865 - RNA, 20 nt, Human
ggaggggacuauuuaugaag

SEQ ID NO: 2207866 - RNA, 13 nt, Human
ggaggggacgcug

SEQ ID NO: 2207867 - RNA, 20 nt, Human
ggagggcuggaaucuggaga

SEQ ID NO: 2207868 - RNA, 22 nt, Human
ggagggcugucaucugugcacu

SEQ ID NO: 2207869 - RNA, 14 nt, Human
ggagggcuggaauc

SEQ ID NO: 2207870 - RNA, 16 nt, Human
ggagggcuggaaucug

SEQ ID NO: 2207871 - RNA, 23 nt, Human
ggagucaucucaaccauccccuc

SEQ ID NO: 2207872 - RNA, 17 nt, Human
ggagucaucucaaccau

SEQ ID NO: 2207873 - RNA, 15 nt, Human
ggaguccacucccag

SEQ ID NO: 2207874 - RNA, 16 nt, Human
ggaguccacuuuguuu

SEQ ID NO: 2207875 - RNA, 17 nt, Human
ggagucccaaggaaagc

SEQ ID NO: 2207876 - RNA, 16 nt, Human
ggagucccaaggaaag

SEQ ID NO: 2207877 - RNA, 19 nt, Human
ggaguccacucccagugcu

SEQ ID NO: 2207878 - RNA, 21 nt, Human
ggaguccaggccauggaggca

SEQ ID NO: 2207879 - RNA, 17 nt, Human
ggagggcuccagacaca

SEQ ID NO: 2207880 - RNA, 22 nt, Human
ggagggcuagaaucuggagagc

SEQ ID NO: 2207881 - RNA, 19 nt, Human
ggagggcuagaacuggaga

SEQ ID NO: 2207882 - RNA, 20 nt, Human
ggagggcuagaaucuggaga

SEQ ID NO: 2207883 - RNA, 14 nt, Human
ggagggcuccagac

SEQ ID NO: 2207884 - RNA, 15 nt, Human
ggagggcuccagaca

SEQ ID NO: 2207885 - RNA, 12 nt, Human
ggcagagcagag

SEQ ID NO: 2207886 - RNA, 17 nt, Human
ggcaccuauaaaacagg

SEQ ID NO: 2207887 - RNA, 16 nt, Human
ggcaccugcagguugg

SEQ ID NO: 2207888 - RNA, 20 nt, Human
ggcaccugcagguugggcca

SEQ ID NO: 2207889 - RNA, 23 nt, Human
ggcaccuccuacgucaaacauga

SEQ ID NO: 2207890 - RNA, 22 nt, Human
ggcaccuauagucccagcuacu

SEQ ID NO: 2207891 - RNA, 19 nt, Human
ggcaccuauagucccagcu

SEQ ID NO: 2207892 - RNA, 18 nt, Human
ggcaccuauagucccagc

SEQ ID NO: 2207893 - RNA, 22 nt, Human
ggcaccuaauccaggcagaucc

SEQ ID NO: 2207894 - RNA, 20 nt, Human
ggcacccccuggagagaagu

SEQ ID NO: 2207895 - RNA, 19 nt, Human
ggcaccucacaggccccag

SEQ ID NO: 2207896 - RNA, 16 nt, Human
ggcaccucacaggccc

SEQ ID NO: 2207897 - RNA, 20 nt, Human
ggcagagcagagaccauccc

SEQ ID NO: 2207898 - RNA, 15 nt, Human
ggcagagcagagacc

SEQ ID NO: 2207899 - RNA, 16 nt, Human
ggcagagcagagacca

SEQ ID NO: 2207900 - RNA, 22 nt, Human
ggcaagucccugacucucugug

SEQ ID NO: 2207901 - RNA, 23 nt, Human
ggcaagucccugacucucuguga

SEQ ID NO: 2207902 - RNA, 13 nt, Human
ggcaagugauuga

SEQ ID NO: 2207903 - RNA, 16 nt, Human
ggcaaggcugucaauu

SEQ ID NO: 2207904 - RNA, 19 nt, Human
ggcaagggccaugcugaag

SEQ ID NO: 2207905 - RNA, 14 nt, Human
ggcaaggcugugcu

SEQ ID NO: 2207906 - RNA, 21 nt, Human
ggcaagggccaugcugaaggg

SEQ ID NO: 2207907 - RNA, 22 nt, Human
ggcaacuuuccuuguuccccau

SEQ ID NO: 2207908 - RNA, 13 nt, Human
ggcaaggcugugc

SEQ ID NO: 2207909 - RNA, 17 nt, Human
ggcacccggccccugcu

SEQ ID NO: 2207910 - RNA, 14 nt, Human
ggcacccccuggag

SEQ ID NO: 2207911 - RNA, 15 nt, Human
ggcacccccuggaga

SEQ ID NO: 2207912 - RNA, 16 nt, Human
ggcacccccuggagag

SEQ ID NO: 2207913 - RNA, 19 nt, Human
ggcaccuaauccaggcaga

SEQ ID NO: 2207914 - RNA, 18 nt, Human
ggcaccuaauccaggcag

SEQ ID NO: 2207915 - RNA, 17 nt, Human
ggcaccuaauccaggca

SEQ ID NO: 2207916 - RNA, 18 nt, Human
ggcacccccuggagagaa

SEQ ID NO: 2207917 - RNA, 19 nt, Human
ggcacccccuggagagaag

SEQ ID NO: 2207918 - RNA, 15 nt, Human
ggcacccggccccug

SEQ ID NO: 2207919 - RNA, 16 nt, Human
ggcacccggccccugc

SEQ ID NO: 2207920 - RNA, 23 nt, Human
ggcaacugaggcagacagcagcu

SEQ ID NO: 2207921 - RNA, 20 nt, Human
ggcaacugaggcagacagca

SEQ ID NO: 2207922 - RNA, 19 nt, Human
ggcaacugaggcagacagc

SEQ ID NO: 2207923 - RNA, 19 nt, Human
ggcaacugcauuggcuuug

SEQ ID NO: 2207924 - RNA, 18 nt, Human
ggcaacuugggaacuaga

SEQ ID NO: 2207925 - RNA, 23 nt, Human
ggcaacuugggaacuagacuccc

SEQ ID NO: 2207926 - RNA, 15 nt, Human
ggcaaggcugucaau

SEQ ID NO: 2207927 - RNA, 15 nt, Human
ggcaacugaggcaga

SEQ ID NO: 2207928 - RNA, 14 nt, Human
ggcaacugaggcag

SEQ ID NO: 2207929 - RNA, 13 nt, Human
ggcaacugaggca

SEQ ID NO: 2207930 - RNA, 18 nt, Human
ggcaacugcauuggcuuu

SEQ ID NO: 2207931 - RNA, 19 nt, Human
ggcaaccuugucucuaugc

SEQ ID NO: 2207932 - RNA, 15 nt, Human
ggcaaccuugucucu

SEQ ID NO: 2207933 - RNA, 21 nt, Human
ggaucagucugauucccaagc

SEQ ID NO: 2207934 - RNA, 21 nt, Human
ggaucagaugaacucuuagaa

SEQ ID NO: 2207935 - RNA, 19 nt, Human
ggaucagcccucauuuugu

SEQ ID NO: 2207936 - RNA, 12 nt, Human
ggaucagaauag

SEQ ID NO: 2207937 - RNA, 16 nt, Human
ggaucagauugcaugu

SEQ ID NO: 2207938 - RNA, 16 nt, Human
ggaucagaugaacucu

SEQ ID NO: 2207939 - RNA, 19 nt, Human
ggcaacccccagccugcua

SEQ ID NO: 2207940 - RNA, 23 nt, Human
ggaucccaccccauuuucugugg

SEQ ID NO: 2207941 - RNA, 13 nt, Human
ggauccagaaggg

SEQ ID NO: 2207942 - RNA, 14 nt, Human
ggauccacaccugg

SEQ ID NO: 2207943 - RNA, 15 nt, Human
ggauccacaccuggu

SEQ ID NO: 2207944 - RNA, 19 nt, Human
ggaucaucugccgugccug

SEQ ID NO: 2207945 - RNA, 21 nt, Human
ggaucaugguguaauaagaca

SEQ ID NO: 2207946 - RNA, 16 nt, Human
ggaucaugguguaaua

SEQ ID NO: 2207947 - RNA, 19 nt, Human
ggaucaugguguaauaaga

SEQ ID NO: 2207948 - RNA, 21 nt, Human
ggcagcuugaggguugggcug

SEQ ID NO: 2207949 - RNA, 19 nt, Human
ggcagcugcgguccaccca

SEQ ID NO: 2207950 - RNA, 22 nt, Human
ggcagcucaccucucccuugga

SEQ ID NO: 2207951 - RNA, 18 nt, Human
ggcagcucaccucucccu

SEQ ID NO: 2207952 - RNA, 21 nt, Human
ggcagcucaccucucccuugg

SEQ ID NO: 2207953 - RNA, 16 nt, Human
ggcaggugaccuucug

SEQ ID NO: 2207954 - RNA, 21 nt, Human
ggcaggugccaugucugggaa

SEQ ID NO: 2207955 - RNA, 22 nt, Human
ggcaggugccaugucugggaac

SEQ ID NO: 2207956 - RNA, 13 nt, Human
ggcaggugccucc

SEQ ID NO: 2207957 - RNA, 14 nt, Human
ggcaggugccucca

SEQ ID NO: 2207958 - RNA, 21 nt, Human
ggcaggugccuccaggugugc

SEQ ID NO: 2207959 - RNA, 15 nt, Human
ggcaggugccuccag

SEQ ID NO: 2207960 - RNA, 16 nt, Human
ggcaggugccuccagg

SEQ ID NO: 2207961 - RNA, 18 nt, Human
ggcaggugccuccaggug

SEQ ID NO: 2207962 - RNA, 20 nt, Human
ggcaggugccuccaggugug

SEQ ID NO: 2207963 - RNA, 23 nt, Human
ggcaggucuugaacuccuggccu

SEQ ID NO: 2207964 - RNA, 19 nt, Human
ggcagguccccagacucca

SEQ ID NO: 2207965 - RNA, 14 nt, Human
ggcagguccccaga

SEQ ID NO: 2207966 - RNA, 16 nt, Human
ggcaggaaggagagcc

SEQ ID NO: 2207967 - RNA, 15 nt, Human
ggcaggaaggagagc

SEQ ID NO: 2207968 - RNA, 11 nt, Human
ggcaggaaaag

SEQ ID NO: 2207969 - RNA, 21 nt, Human
ggcagcuuuaaccauuaaaac

SEQ ID NO: 2207970 - RNA, 13 nt, Human
ggcagcuugcccc

SEQ ID NO: 2207971 - RNA, 15 nt, Human
ggcagcuugccccgg

SEQ ID NO: 2207972 - RNA, 18 nt, Human
ggcagcuugccccggccc

SEQ ID NO: 2207973 - RNA, 13 nt, Human
ggcagguccaggg

SEQ ID NO: 2207974 - RNA, 23 nt, Human
ggcaggaaggagagccugcugca

SEQ ID NO: 2207975 - RNA, 14 nt, Human
ggcaggaaggcuga

SEQ ID NO: 2207976 - RNA, 18 nt, Human
ggcagaucugugccccau

SEQ ID NO: 2207977 - RNA, 17 nt, Human
ggcagaucugugcccca

SEQ ID NO: 2207978 - RNA, 16 nt, Human
ggcagaucugugcccc

SEQ ID NO: 2207979 - RNA, 15 nt, Human
ggcagaucugugccc

SEQ ID NO: 2207980 - RNA, 18 nt, Human
ggcagaucaccagagguc

SEQ ID NO: 2207981 - RNA, 14 nt, Human
ggcagauccaggac

SEQ ID NO: 2207982 - RNA, 16 nt, Human
ggcagauccaggacua

SEQ ID NO: 2207983 - RNA, 13 nt, Human
ggcagauugaaaa

SEQ ID NO: 2207984 - RNA, 20 nt, Human
ggcagaucugugccccaugc

SEQ ID NO: 2207985 - RNA, 24 nt, Human
ggcagauuuagugaaagcuagaga

SEQ ID NO: 2207986 - RNA, 14 nt, Human
ggcagcacagagac

SEQ ID NO: 2207987 - RNA, 21 nt, Human
ggcagcacagagacccccgga

SEQ ID NO: 2207988 - RNA, 21 nt, Human
ggcagcaccugucuccuuuca

SEQ ID NO: 2207989 - RNA, 18 nt, Human
ggcagcagaagggggugg

SEQ ID NO: 2207990 - RNA, 10 nt, Human
ggcagcagau

SEQ ID NO: 2207991 - RNA, 19 nt, Human
ggcagaggcuggaggcagg

SEQ ID NO: 2207992 - RNA, 13 nt, Human
ggcagaggcugga

SEQ ID NO: 2207993 - RNA, 12 nt, Human
ggcagaggcugg

SEQ ID NO: 2207994 - RNA, 15 nt, Human
ggcagaggacagauc

SEQ ID NO: 2207995 - RNA, 13 nt, Human
ggcagagcuucuu

SEQ ID NO: 2207996 - RNA, 17 nt, Human
ggcagagcuuggacugg

SEQ ID NO: 2207997 - RNA, 21 nt, Human
ggcagagcuuggacuggaugc

SEQ ID NO: 2207998 - RNA, 17 nt, Human
ggcagaggaaagcaaag

SEQ ID NO: 2207999 - RNA, 20 nt, Human
ggcagauaaucagccucuua

SEQ ID NO: 2208000 - RNA, 19 nt, Human
ggcagauaaucagccucuu

SEQ ID NO: 2208001 - RNA, 18 nt, Human
ggcagauaaucagccucu

SEQ ID NO: 2208002 - RNA, 15 nt, Human
ggcagauaaucagcc

SEQ ID NO: 2208003 - RNA, 23 nt, Human
ggcagauacaggaaaagcugcug

SEQ ID NO: 2208004 - RNA, 23 nt, Human
ggcagaguugaagacagagcuac

SEQ ID NO: 2208005 - RNA, 14 nt, Human
ggcagaguuguaaa

SEQ ID NO: 2208006 - RNA, 15 nt, Human
ggcagaguuguaaau

SEQ ID NO: 2208007 - RNA, 16 nt, Human
ggcagaguuguaaaua

SEQ ID NO: 2208008 - RNA, 17 nt, Human
ggcagaguuguaaauau

SEQ ID NO: 2208009 - RNA, 18 nt, Human
ggcagaguuguaaauaua

SEQ ID NO: 2208010 - RNA, 22 nt, Human
ggcagaguuguaaauauauaaa

SEQ ID NO: 2208011 - RNA, 23 nt, Human
ggcagaguuguaaauauauaaau

SEQ ID NO: 2208012 - RNA, 21 nt, Human
ggcagaguuuguguguugucu

SEQ ID NO: 2208013 - RNA, 14 nt, Human
ggccccgccgccug

SEQ ID NO: 2208014 - RNA, 18 nt, Human
ggccccgaggacccagac

SEQ ID NO: 2208015 - RNA, 19 nt, Human
ggccccgaggacccagacc

SEQ ID NO: 2208016 - RNA, 15 nt, Human
ggccccgccgccugg

SEQ ID NO: 2208017 - RNA, 18 nt, Human
ggccccgccgccugguac

SEQ ID NO: 2208018 - RNA, 17 nt, Human
ggcccccuggucucugg

SEQ ID NO: 2208019 - RNA, 14 nt, Human
ggcccccuguccuc

SEQ ID NO: 2208020 - RNA, 18 nt, Human
ggcccccuggucucuggu

SEQ ID NO: 2208021 - RNA, 17 nt, Human
ggccccgaggacccaga

SEQ ID NO: 2208022 - RNA, 19 nt, Human
ggccccgcuuguccagcgc

SEQ ID NO: 2208023 - RNA, 13 nt, Human
ggccccggcccca

SEQ ID NO: 2208024 - RNA, 21 nt, Human
ggccccgcuuguccagcgccu

SEQ ID NO: 2208025 - RNA, 14 nt, Human
ggccccggccccag

SEQ ID NO: 2208026 - RNA, 16 nt, Human
ggccccggccccagcc

SEQ ID NO: 2208027 - RNA, 17 nt, Human
ggccccggccccagcca

SEQ ID NO: 2208028 - RNA, 18 nt, Human
ggccccggccccagccag

SEQ ID NO: 2208029 - RNA, 21 nt, Human
ggccccggccccagccagagu

SEQ ID NO: 2208030 - RNA, 18 nt, Human
ggccccguuucugguggu

SEQ ID NO: 2208031 - RNA, 19 nt, Human
ggccccucacccugccuua

SEQ ID NO: 2208032 - RNA, 15 nt, Human
ggcccccgagcuggg

SEQ ID NO: 2208033 - RNA, 13 nt, Human
ggcccccgagcug

SEQ ID NO: 2208034 - RNA, 20 nt, Human
ggccccccuccuugcucugc

SEQ ID NO: 2208035 - RNA, 15 nt, Human
ggcccccuccaucgg

SEQ ID NO: 2208036 - RNA, 12 nt, Human
ggcccccagcug

SEQ ID NO: 2208037 - RNA, 19 nt, Human
ggcccccagagcgccccuc

SEQ ID NO: 2208038 - RNA, 23 nt, Human
ggcccccagcccagggcuccugc

SEQ ID NO: 2208039 - RNA, 15 nt, Human
ggcccccagcugugg

SEQ ID NO: 2208040 - RNA, 14 nt, Human
ggcccccaucucau

SEQ ID NO: 2208041 - RNA, 21 nt, Human
ggcccccaucucaugccccug

SEQ ID NO: 2208042 - RNA, 15 nt, Human
ggcccccaucucaug

SEQ ID NO: 2208043 - RNA, 17 nt, Human
ggccccccuccuugcuc

SEQ ID NO: 2208044 - RNA, 13 nt, Human
ggccauggcagaa

SEQ ID NO: 2208045 - RNA, 16 nt, Human
ggccaggcugcucuug

SEQ ID NO: 2208046 - RNA, 21 nt, Human
ggccaggccaccuccagaaac

SEQ ID NO: 2208047 - RNA, 22 nt, Human
ggccauggagagcuggagccug

SEQ ID NO: 2208048 - RNA, 13 nt, Human
ggccaugggccuc

SEQ ID NO: 2208049 - RNA, 22 nt, Human
ggccaugggacagggaggacgc

SEQ ID NO: 2208050 - RNA, 15 nt, Human
ggcccccacuugccu

SEQ ID NO: 2208051 - RNA, 16 nt, Human
ggcccccacuugccuc

SEQ ID NO: 2208052 - RNA, 18 nt, Human
ggcccccacuugccucuu

SEQ ID NO: 2208053 - RNA, 12 nt, Human
ggcccccagagc

SEQ ID NO: 2208054 - RNA, 15 nt, Human
ggcccccagagcgcc

SEQ ID NO: 2208055 - RNA, 16 nt, Human
ggcccccagagcgccc

SEQ ID NO: 2208056 - RNA, 17 nt, Human
ggcccccagagcgcccc

SEQ ID NO: 2208057 - RNA, 14 nt, Human
ggcccccagcccag

SEQ ID NO: 2208058 - RNA, 17 nt, Human
ggcccccagcccagggc

SEQ ID NO: 2208059 - RNA, 18 nt, Human
ggcccccagcccagggcu

SEQ ID NO: 2208060 - RNA, 20 nt, Human
ggcccccagcccagggcucc

SEQ ID NO: 2208061 - RNA, 12 nt, Human
ggccccucugcc

SEQ ID NO: 2208062 - RNA, 14 nt, Human
ggccccucugccca

SEQ ID NO: 2208063 - RNA, 14 nt, Human
ggccccucugaccu

SEQ ID NO: 2208064 - RNA, 15 nt, Human
ggccccucugcccag

SEQ ID NO: 2208065 - RNA, 16 nt, Human
ggccccucugcccagc

SEQ ID NO: 2208066 - RNA, 17 nt, Human
ggccccucugcccagcu

SEQ ID NO: 2208067 - RNA, 19 nt, Human
ggccccucugcccagcuug

SEQ ID NO: 2208068 - RNA, 17 nt, Human
ggccccuccagcuugug

SEQ ID NO: 2208069 - RNA, 22 nt, Human
ggccccuauguaguccgugcug

SEQ ID NO: 2208070 - RNA, 22 nt, Human
ggccccucacccugccuuaucu

SEQ ID NO: 2208071 - RNA, 23 nt, Human
ggccccucaucugcucagcagcu

SEQ ID NO: 2208072 - RNA, 12 nt, Human
ggccccuccagc

SEQ ID NO: 2208073 - RNA, 22 nt, Human
ggccccucccacacacacccac

SEQ ID NO: 2208074 - RNA, 16 nt, Human
ggccccucaggguccc

SEQ ID NO: 2208075 - RNA, 19 nt, Human
ggccccucagggucccugg

SEQ ID NO: 2208076 - RNA, 20 nt, Human
ggccccucagggucccuggu

SEQ ID NO: 2208077 - RNA, 21 nt, Human
ggccccucagggucccuggug

SEQ ID NO: 2208078 - RNA, 17 nt, Human
ggccccugccacccugg

SEQ ID NO: 2208079 - RNA, 18 nt, Human
ggccccugccacccuggg

SEQ ID NO: 2208080 - RNA, 13 nt, Human
ggccccugcccgg

SEQ ID NO: 2208081 - RNA, 19 nt, Human
ggccccugccagacccccu

SEQ ID NO: 2208082 - RNA, 17 nt, Human
ggccccugccagacccc

SEQ ID NO: 2208083 - RNA, 13 nt, Human
ggccccugccacc

SEQ ID NO: 2208084 - RNA, 16 nt, Human
ggccccugccacccug

SEQ ID NO: 2208085 - RNA, 12 nt, Human
ggccccugccac

SEQ ID NO: 2208086 - RNA, 21 nt, Human
ggccccugagaucucugcagg

SEQ ID NO: 2208087 - RNA, 17 nt, Human
ggccccugagaucucug

SEQ ID NO: 2208088 - RNA, 17 nt, Human
ggccaggccagcugccu

SEQ ID NO: 2208089 - RNA, 15 nt, Human
ggccaggccagcugc

SEQ ID NO: 2208090 - RNA, 11 nt, Human
ggccaggcagg

SEQ ID NO: 2208091 - RNA, 15 nt, Human
ggccaggccaccagg

SEQ ID NO: 2208092 - RNA, 16 nt, Human
ggccaggccaccagga

SEQ ID NO: 2208093 - RNA, 17 nt, Human
ggccaggccaccaggau

SEQ ID NO: 2208094 - RNA, 11 nt, Human
ggccaggcugg

SEQ ID NO: 2208095 - RNA, 18 nt, Human
ggccaggcugggucgccc

SEQ ID NO: 2208096 - RNA, 22 nt, Human
ggccaggcugggucgcccugga

SEQ ID NO: 2208097 - RNA, 20 nt, Human
ggccaggaguuugagaccag

SEQ ID NO: 2208098 - RNA, 15 nt, Human
ggccaggagcucuuc

SEQ ID NO: 2208099 - RNA, 15 nt, Human
ggccaggcagaucug

SEQ ID NO: 2208100 - RNA, 16 nt, Human
ggccaggauggagggg

SEQ ID NO: 2208101 - RNA, 22 nt, Human
ggccaggcagaucugugcccca

SEQ ID NO: 2208102 - RNA, 11 nt, Human
ggccaggccac

SEQ ID NO: 2208103 - RNA, 12 nt, Human
ggccaggcaggu

SEQ ID NO: 2208104 - RNA, 14 nt, Human
ggccaggccagagg

SEQ ID NO: 2208105 - RNA, 16 nt, Human
ggccaggccagaggga

SEQ ID NO: 2208106 - RNA, 16 nt, Human
ggccacugugaagaga

SEQ ID NO: 2208107 - RNA, 14 nt, Human
ggccaggagccucc

SEQ ID NO: 2208108 - RNA, 13 nt, Human
ggccaggagcucu

SEQ ID NO: 2208109 - RNA, 18 nt, Human
ggccacugcacagagcuc

SEQ ID NO: 2208110 - RNA, 18 nt, Human
ggccacuggccaucucca

SEQ ID NO: 2208111 - RNA, 19 nt, Human
ggccaggaguuugagacca

SEQ ID NO: 2208112 - RNA, 16 nt, Human
ggccaggagccuccug

SEQ ID NO: 2208113 - RNA, 21 nt, Human
ggccacucugccucugccugc

SEQ ID NO: 2208114 - RNA, 20 nt, Human
ggccacucugccucugccug

SEQ ID NO: 2208115 - RNA, 16 nt, Human
ggccacucugccucug

SEQ ID NO: 2208116 - RNA, 23 nt, Human
ggccaccugcccccuucucccac

SEQ ID NO: 2208117 - RNA, 14 nt, Human
ggccaccuuuucag

SEQ ID NO: 2208118 - RNA, 22 nt, Human
ggccacucugccucugccugca

SEQ ID NO: 2208119 - RNA, 14 nt, Human
ggccacugaagaua

SEQ ID NO: 2208120 - RNA, 15 nt, Human
ggccacugcacagag

SEQ ID NO: 2208121 - RNA, 19 nt, Human
ggccacugcacagagcucu

SEQ ID NO: 2208122 - RNA, 11 nt, Human
ggccacuguga

SEQ ID NO: 2208123 - RNA, 12 nt, Human
ggccaaguucuu

SEQ ID NO: 2208124 - RNA, 20 nt, Human
ggccaagugcaggcuggcac

SEQ ID NO: 2208125 - RNA, 15 nt, Human
ggcauuccccaggag

SEQ ID NO: 2208126 - RNA, 16 nt, Human
ggccacaagacccuug

SEQ ID NO: 2208127 - RNA, 17 nt, Human
ggccacaagacccuugu

SEQ ID NO: 2208128 - RNA, 22 nt, Human
ggccaccugcccccuucuccca

SEQ ID NO: 2208129 - RNA, 14 nt, Human
ggccaccugccccc

SEQ ID NO: 2208130 - RNA, 22 nt, Human
ggccacacuauuaccaugagaa

SEQ ID NO: 2208131 - RNA, 21 nt, Human
ggccacacuauuaccaugaga

SEQ ID NO: 2208132 - RNA, 23 nt, Human
ggcauuccagcuccuccgugcuu

SEQ ID NO: 2208133 - RNA, 16 nt, Human
ggccaccugcggugcu

SEQ ID NO: 2208134 - RNA, 22 nt, Human
ggccaccugcggugcuaucucc

SEQ ID NO: 2208135 - RNA, 21 nt, Human
ggcagucuggaggggcauggc

SEQ ID NO: 2208136 - RNA, 16 nt, Human
ggcagucuggaggggc

SEQ ID NO: 2208137 - RNA, 14 nt, Human
ggcagucuggaggg

SEQ ID NO: 2208138 - RNA, 13 nt, Human
ggcagucuggagg

SEQ ID NO: 2208139 - RNA, 16 nt, Human
ggcagguuagaaccua

SEQ ID NO: 2208140 - RNA, 20 nt, Human
ggcagguuagaaccuagaag

SEQ ID NO: 2208141 - RNA, 19 nt, Human
ggcagucugaauuuuuaaa

SEQ ID NO: 2208142 - RNA, 22 nt, Human
ggcagucgggggcuggccuagg

SEQ ID NO: 2208143 - RNA, 23 nt, Human
ggcagucgggggcuggccuagga

SEQ ID NO: 2208144 - RNA, 17 nt, Human
ggcaggugggagcuuga

SEQ ID NO: 2208145 - RNA, 16 nt, Human
ggcaggugggagcuug

SEQ ID NO: 2208146 - RNA, 12 nt, Human
ggcaggugggag

SEQ ID NO: 2208147 - RNA, 23 nt, Human
ggcagguggaggugucaggcugc

SEQ ID NO: 2208148 - RNA, 14 nt, Human
ggcaggugguggca

SEQ ID NO: 2208149 - RNA, 17 nt, Human
ggcaggugguggcacug

SEQ ID NO: 2208150 - RNA, 21 nt, Human
ggcaggugguggcacugagcc

SEQ ID NO: 2208151 - RNA, 22 nt, Human
ggcaggugguggcacugagccc

SEQ ID NO: 2208152 - RNA, 15 nt, Human
ggcagguuggugggg

SEQ ID NO: 2208153 - RNA, 18 nt, Human
ggcagugaugcuggaugc

SEQ ID NO: 2208154 - RNA, 16 nt, Human
ggcagugccagggcag

SEQ ID NO: 2208155 - RNA, 14 nt, Human
ggcagugccagggc

SEQ ID NO: 2208156 - RNA, 20 nt, Human
ggcauuauguccacugugua

SEQ ID NO: 2208157 - RNA, 20 nt, Human
ggcauuagaauuauuuaaac

SEQ ID NO: 2208158 - RNA, 17 nt, Human
ggcauuagaauuauuua

SEQ ID NO: 2208159 - RNA, 19 nt, Human
ggcauuagaauuauuuaaa

SEQ ID NO: 2208160 - RNA, 23 nt, Human
ggcauguucucugaggacacuaa

SEQ ID NO: 2208161 - RNA, 21 nt, Human
ggcagugagggagggcuguca

SEQ ID NO: 2208162 - RNA, 16 nt, Human
ggcagugagggagggc

SEQ ID NO: 2208163 - RNA, 15 nt, Human
ggcagugagugagcc

SEQ ID NO: 2208164 - RNA, 16 nt, Human
ggcagugagugagccu

SEQ ID NO: 2208165 - RNA, 18 nt, Human
ggcagugagugagccugg

SEQ ID NO: 2208166 - RNA, 19 nt, Human
ggcagugagugagccuggc

SEQ ID NO: 2208167 - RNA, 20 nt, Human
gcugucaaaacaaguuuuuc

SEQ ID NO: 2208168 - RNA, 14 nt, Human
gcugguuagaaaug

SEQ ID NO: 2208169 - RNA, 18 nt, Human
gcugucaaguuccuuugg

SEQ ID NO: 2208170 - RNA, 16 nt, Human
gcugucaauuacagga

SEQ ID NO: 2208171 - RNA, 22 nt, Human
gcugguucaggguuggccccug

SEQ ID NO: 2208172 - RNA, 22 nt, Human
gcuguauuuuaaaagaaugauu

SEQ ID NO: 2208173 - RNA, 15 nt, Human
gcugguucaggguug

SEQ ID NO: 2208174 - RNA, 21 nt, Human
gcugguuagagguucccuuug

SEQ ID NO: 2208175 - RNA, 19 nt, Human
gcugguguccugaccaccc

SEQ ID NO: 2208176 - RNA, 22 nt, Human
gcugguguccugaccacccucc

SEQ ID NO: 2208177 - RNA, 12 nt, Human
gcuggugggagg

SEQ ID NO: 2208178 - RNA, 13 nt, Human
gcuggugggaggg

SEQ ID NO: 2208179 - RNA, 21 nt, Human
gcuggugggaagcgucugucc

SEQ ID NO: 2208180 - RNA, 15 nt, Human
gcugguggcucccgg

SEQ ID NO: 2208181 - RNA, 15 nt, Human
gcugguggcccagga

SEQ ID NO: 2208182 - RNA, 14 nt, Human
gcugguggcccagg

SEQ ID NO: 2208183 - RNA, 16 nt, Human
gcuggugucaccugaa

SEQ ID NO: 2208184 - RNA, 18 nt, Human
gcuggugucaccugaaga

SEQ ID NO: 2208185 - RNA, 12 nt, Human
gcuggugguuuc

SEQ ID NO: 2208186 - RNA, 14 nt, Human
gcuggugggagggg

SEQ ID NO: 2208187 - RNA, 13 nt, Human
gcuggugguuuca

SEQ ID NO: 2208188 - RNA, 15 nt, Human
gcugguguccugacc

SEQ ID NO: 2208189 - RNA, 16 nt, Human
gcugguguccugacca

SEQ ID NO: 2208190 - RNA, 17 nt, Human
gcugguguccugaccac

SEQ ID NO: 2208191 - RNA, 18 nt, Human
gcugguguccugaccacc

SEQ ID NO: 2208192 - RNA, 13 nt, Human
gcugguggcccag

SEQ ID NO: 2208193 - RNA, 12 nt, Human
gcugguggccca

SEQ ID NO: 2208194 - RNA, 17 nt, Human
gcuggugcuguggccag

SEQ ID NO: 2208195 - RNA, 19 nt, Human
gcuggugcuguggccaggg

SEQ ID NO: 2208196 - RNA, 15 nt, Human
gcuggugcuguggcc

SEQ ID NO: 2208197 - RNA, 20 nt, Human
gcuggucccacucaguccau

SEQ ID NO: 2208198 - RNA, 14 nt, Human
gcugucccugucac

SEQ ID NO: 2208199 - RNA, 13 nt, Human
gcugucccucacu

SEQ ID NO: 2208200 - RNA, 16 nt, Human
gcugucccucccccuu

SEQ ID NO: 2208201 - RNA, 22 nt, Human
gcugucccuuacgugaguccug

SEQ ID NO: 2208202 - RNA, 21 nt, Human
gcugucccuuacgugaguccu

SEQ ID NO: 2208203 - RNA, 19 nt, Human
gcugucccuuacgugaguc

SEQ ID NO: 2208204 - RNA, 13 nt, Human
gcugucacaggcg

SEQ ID NO: 2208205 - RNA, 15 nt, Human
gcugucccucccccu

SEQ ID NO: 2208206 - RNA, 17 nt, Human
gcugucaauuacaggaa

SEQ ID NO: 2208207 - RNA, 19 nt, Human
gcugucaauuacaggaagu

SEQ ID NO: 2208208 - RNA, 22 nt, Human
gcugucaauuacaggaaguacu

SEQ ID NO: 2208209 - RNA, 23 nt, Human
gcugucaauuacaggaaguacug

SEQ ID NO: 2208210 - RNA, 18 nt, Human
gcugucccugucaccaag

SEQ ID NO: 2208211 - RNA, 15 nt, Human
gcugucccugucacc

SEQ ID NO: 2208212 - RNA, 17 nt, Human
gcugucugaucugugcu

SEQ ID NO: 2208213 - RNA, 18 nt, Human
gcugucugaucugugcuu

SEQ ID NO: 2208214 - RNA, 22 nt, Human
gcugucugaucugugcuuucca

SEQ ID NO: 2208215 - RNA, 17 nt, Human
gcugucuccauguuuga

SEQ ID NO: 2208216 - RNA, 22 nt, Human
gcugucuucucaggcucugccc

SEQ ID NO: 2208217 - RNA, 20 nt, Human
gcugucuucucaggcucugc

SEQ ID NO: 2208218 - RNA, 13 nt, Human
gcugucuggccag

SEQ ID NO: 2208219 - RNA, 19 nt, Human
gcugucugaucugugcuuu

SEQ ID NO: 2208220 - RNA, 17 nt, Human
gcugucuggccaggccu

SEQ ID NO: 2208221 - RNA, 21 nt, Human
gcuguguccuugcaccugcau

SEQ ID NO: 2208222 - RNA, 20 nt, Human
gcuguguccuugcaccugca

SEQ ID NO: 2208223 - RNA, 19 nt, Human
gcuguguccuugcaccugc

SEQ ID NO: 2208224 - RNA, 18 nt, Human
gcuguguccuugcaccug

SEQ ID NO: 2208225 - RNA, 14 nt, Human
gcuguguccuugca

SEQ ID NO: 2208226 - RNA, 19 nt, Human
gcuguguaaaguuagucua

SEQ ID NO: 2208227 - RNA, 17 nt, Human
gcuguguaaaguuaguc

SEQ ID NO: 2208228 - RNA, 18 nt, Human
gcuguguaaaguuagucu

SEQ ID NO: 2208229 - RNA, 22 nt, Human
gcuguguacacugacaccuuug

SEQ ID NO: 2208230 - RNA, 14 nt, Human
gcuguguaucugau

SEQ ID NO: 2208231 - RNA, 12 nt, Human
gcuguguaaagu

SEQ ID NO: 2208232 - RNA, 11 nt, Human
gcuguguaaag

SEQ ID NO: 2208233 - RNA, 13 nt, Human
gcuguguaaaguu

SEQ ID NO: 2208234 - RNA, 14 nt, Human
gcuguguaaaguua

SEQ ID NO: 2208235 - RNA, 15 nt, Human
gcuguguaaaguuag

SEQ ID NO: 2208236 - RNA, 16 nt, Human
gcuguguaaaguuagu

SEQ ID NO: 2208237 - RNA, 23 nt, Human
gcugggggaagaagcucucuccu

SEQ ID NO: 2208238 - RNA, 19 nt, Human
gcuggggccugauggggag

SEQ ID NO: 2208239 - RNA, 12 nt, Human
gcuggggccuga

SEQ ID NO: 2208240 - RNA, 15 nt, Human
gcuggggccugaugg

SEQ ID NO: 2208241 - RNA, 17 nt, Human
gcuggggcguggggagg

SEQ ID NO: 2208242 - RNA, 12 nt, Human
gcuggggccagu

SEQ ID NO: 2208243 - RNA, 20 nt, Human
gcuggggccuaucagugugc

SEQ ID NO: 2208244 - RNA, 21 nt, Human
gcuggggccuaucagugugcc

SEQ ID NO: 2208245 - RNA, 17 nt, Human
gcugggcuggggccuga

SEQ ID NO: 2208246 - RNA, 12 nt, Human
gcugggcugggu

SEQ ID NO: 2208247 - RNA, 14 nt, Human
gcugggcugggugc

SEQ ID NO: 2208248 - RNA, 15 nt, Human
gcugggcugggugcg

SEQ ID NO: 2208249 - RNA, 18 nt, Human
gcugggcuucaguggcag

SEQ ID NO: 2208250 - RNA, 19 nt, Human
gcugggcuucaguggcagc

SEQ ID NO: 2208251 - RNA, 16 nt, Human
gcuggggccaggcugg

SEQ ID NO: 2208252 - RNA, 19 nt, Human
gcuggggccaggcuggguc

SEQ ID NO: 2208253 - RNA, 13 nt, Human
gcugggggccuca

SEQ ID NO: 2208254 - RNA, 18 nt, Human
gcugggggugggccaggc

SEQ ID NO: 2208255 - RNA, 15 nt, Human
gcugggggugggcca

SEQ ID NO: 2208256 - RNA, 19 nt, Human
gcugggggugggccaggcu

SEQ ID NO: 2208257 - RNA, 15 nt, Human
gcuggucccacucag

SEQ ID NO: 2208258 - RNA, 19 nt, Human
gcuggucccacucagucca

SEQ ID NO: 2208259 - RNA, 19 nt, Human
gcugggggccucagugcca

SEQ ID NO: 2208260 - RNA, 20 nt, Human
gcugggggccucagugccac

SEQ ID NO: 2208261 - RNA, 23 nt, Human
gcugggggccaugagcuccagac

SEQ ID NO: 2208262 - RNA, 16 nt, Human
gcugggggccaugagc

SEQ ID NO: 2208263 - RNA, 23 nt, Human
gcugggggcaggagggcccuacc

SEQ ID NO: 2208264 - RNA, 20 nt, Human
gcugggggcaggagggcccu

SEQ ID NO: 2208265 - RNA, 13 nt, Human
gcugggggcagga

SEQ ID NO: 2208266 - RNA, 18 nt, Human
gcuggggcguggggaggg

SEQ ID NO: 2208267 - RNA, 19 nt, Human
gcuggggcguggggagggc

SEQ ID NO: 2208268 - RNA, 15 nt, Human
gcuggggcugaccuu

SEQ ID NO: 2208269 - RNA, 16 nt, Human
gcugggacuggccagg

SEQ ID NO: 2208270 - RNA, 15 nt, Human
gcugggacuggccag

SEQ ID NO: 2208271 - RNA, 17 nt, Human
gcugggacugagccagu

SEQ ID NO: 2208272 - RNA, 13 nt, Human
gcugggagcucca

SEQ ID NO: 2208273 - RNA, 14 nt, Human
gcugggagcuccac

SEQ ID NO: 2208274 - RNA, 16 nt, Human
gcugggagcuccacuc

SEQ ID NO: 2208275 - RNA, 18 nt, Human
gcugggagcuccacucug

SEQ ID NO: 2208276 - RNA, 19 nt, Human
gcugggagagccuuccagg

SEQ ID NO: 2208277 - RNA, 22 nt, Human
gcugggagagccuuccaggggu

SEQ ID NO: 2208278 - RNA, 12 nt, Human
gcugggagagcc

SEQ ID NO: 2208279 - RNA, 13 nt, Human
gcugggagagccu

SEQ ID NO: 2208280 - RNA, 17 nt, Human
gcugggagagccuucca

SEQ ID NO: 2208281 - RNA, 18 nt, Human
gcugggagagccuuccag

SEQ ID NO: 2208282 - RNA, 16 nt, Human
gcugggagcucugcag

SEQ ID NO: 2208283 - RNA, 22 nt, Human
gcugggagcuccacucugcuuc

SEQ ID NO: 2208284 - RNA, 13 nt, Human
gcugggagcugaa

SEQ ID NO: 2208285 - RNA, 15 nt, Human
gcugggagcucugca

SEQ ID NO: 2208286 - RNA, 20 nt, Human
gcugggagcuccacucugcu

SEQ ID NO: 2208287 - RNA, 21 nt, Human
gcugggagcuccacucugcuu

SEQ ID NO: 2208288 - RNA, 21 nt, Human
gcugggaugauuggagggggg

SEQ ID NO: 2208289 - RNA, 16 nt, Human
gcugggaggagggaga

SEQ ID NO: 2208290 - RNA, 17 nt, Human
gcugggaggagggagag

SEQ ID NO: 2208291 - RNA, 17 nt, Human
gcugggcuucaguggca

SEQ ID NO: 2208292 - RNA, 21 nt, Human
gcugggauuacaggcuccugc

SEQ ID NO: 2208293 - RNA, 14 nt, Human
gcugggcuggggcc

SEQ ID NO: 2208294 - RNA, 18 nt, Human
gcugggaggagggagagg

SEQ ID NO: 2208295 - RNA, 22 nt, Human
gcugggaggagggagagggagg

SEQ ID NO: 2208296 - RNA, 15 nt, Human
gcugggcuggggccu

SEQ ID NO: 2208297 - RNA, 20 nt, Human
gcugggauuacaggcuccug

SEQ ID NO: 2208298 - RNA, 19 nt, Human
gcugggauuacaggcuccu

SEQ ID NO: 2208299 - RNA, 18 nt, Human
gcugggauuacaggcgug

SEQ ID NO: 2208300 - RNA, 17 nt, Human
gcugggauuacaggcgu

SEQ ID NO: 2208301 - RNA, 18 nt, Human
gcugcccuguaccccagc

SEQ ID NO: 2208302 - RNA, 23 nt, Human
gcugcccuggugcugccacacuu

SEQ ID NO: 2208303 - RNA, 17 nt, Human
gcugccgaccagagccc

SEQ ID NO: 2208304 - RNA, 16 nt, Human
gcugccgaccagagcc

SEQ ID NO: 2208305 - RNA, 17 nt, Human
gcugcccuuucugggca

SEQ ID NO: 2208306 - RNA, 12 nt, Human
gcugcccuguga

SEQ ID NO: 2208307 - RNA, 14 nt, Human
gcugcccugugagu

SEQ ID NO: 2208308 - RNA, 14 nt, Human
gcugccgcacccca

SEQ ID NO: 2208309 - RNA, 14 nt, Human
gcugccuuggcuca

SEQ ID NO: 2208310 - RNA, 16 nt, Human
gcugccuuggcucaga

SEQ ID NO: 2208311 - RNA, 19 nt, Human
gcugccuuggcucagacau

SEQ ID NO: 2208312 - RNA, 17 nt, Human
gcugccuuggcucagac

SEQ ID NO: 2208313 - RNA, 23 nt, Human
gcugccuuggcucagacauguuu

SEQ ID NO: 2208314 - RNA, 21 nt, Human
gcugccuuggcucagacaugu

SEQ ID NO: 2208315 - RNA, 20 nt, Human
gcugccuuuagucgcugagg

SEQ ID NO: 2208316 - RNA, 15 nt, Human
gcugcgcccugggcu

SEQ ID NO: 2208317 - RNA, 16 nt, Human
gcugcgguccacccag

SEQ ID NO: 2208318 - RNA, 16 nt, Human
gcugcgcccugggcuc

SEQ ID NO: 2208319 - RNA, 19 nt, Human
gcugcgcccuuaccuuccc

SEQ ID NO: 2208320 - RNA, 15 nt, Human
gcugcgcuugcuuuu

SEQ ID NO: 2208321 - RNA, 16 nt, Human
gcugcgcuugcuuuuc

SEQ ID NO: 2208322 - RNA, 23 nt, Human
gcuagcagaaaucuagaagacug

SEQ ID NO: 2208323 - RNA, 17 nt, Human
gcuagcacuuggagcca

SEQ ID NO: 2208324 - RNA, 22 nt, Human
gcuagcagcagggagggcuucu

SEQ ID NO: 2208325 - RNA, 18 nt, Human
gcugcccuggugcugcca

SEQ ID NO: 2208326 - RNA, 19 nt, Human
gcugcccuggugcugccac

SEQ ID NO: 2208327 - RNA, 20 nt, Human
gcugcccuggugcugccaca

SEQ ID NO: 2208328 - RNA, 22 nt, Human
gcugcccuggugcugccacacu

SEQ ID NO: 2208329 - RNA, 11 nt, Human
gcugcccugug

SEQ ID NO: 2208330 - RNA, 18 nt, Human
gcuagauguauguacuuc

SEQ ID NO: 2208331 - RNA, 20 nt, Human
gcuagaggccagccccaccc

SEQ ID NO: 2208332 - RNA, 19 nt, Human
gcuagaggccagccccacc

SEQ ID NO: 2208333 - RNA, 18 nt, Human
gcuagaggccagccccac

SEQ ID NO: 2208334 - RNA, 21 nt, Human
gcuagaggccagccccaccca

SEQ ID NO: 2208335 - RNA, 21 nt, Human
gcugcucagggaaaagcagcu

SEQ ID NO: 2208336 - RNA, 19 nt, Human
gcugcucaucugauuuuug

SEQ ID NO: 2208337 - RNA, 13 nt, Human
gcugcuucaagga

SEQ ID NO: 2208338 - RNA, 20 nt, Human
gcugcucagggaaaagcagc

SEQ ID NO: 2208339 - RNA, 21 nt, Human
gcugcucacuaccuccucagg

SEQ ID NO: 2208340 - RNA, 23 nt, Human
gcugcucacuaccuccucaggga

SEQ ID NO: 2208341 - RNA, 16 nt, Human
gcugcuauagccuggg

SEQ ID NO: 2208342 - RNA, 15 nt, Human
gcugcuauagccugg

SEQ ID NO: 2208343 - RNA, 23 nt, Human
gcugcuagcacuuggagccaagg

SEQ ID NO: 2208344 - RNA, 20 nt, Human
gcugcuagcacuuggagcca

SEQ ID NO: 2208345 - RNA, 17 nt, Human
gcugcuauagccugggg

SEQ ID NO: 2208346 - RNA, 19 nt, Human
gcugcuagcacuuggagcc

SEQ ID NO: 2208347 - RNA, 16 nt, Human
gcugcuagagccagca

SEQ ID NO: 2208348 - RNA, 19 nt, Human
gcugcgguccacccaggag

SEQ ID NO: 2208349 - RNA, 17 nt, Human
gcugcgguccacccagg

SEQ ID NO: 2208350 - RNA, 18 nt, Human
gcugcgguccacccagga

SEQ ID NO: 2208351 - RNA, 23 nt, Human
gcugcuucccucugccugucccu

SEQ ID NO: 2208352 - RNA, 22 nt, Human
gcugcuucccucugccuguccc

SEQ ID NO: 2208353 - RNA, 21 nt, Human
gcugcuucccucugccugucc

SEQ ID NO: 2208354 - RNA, 20 nt, Human
gcugcuucccucugccuguc

SEQ ID NO: 2208355 - RNA, 15 nt, Human
gcugcuucccucugc

SEQ ID NO: 2208356 - RNA, 14 nt, Human
gcugcuucccucug

SEQ ID NO: 2208357 - RNA, 12 nt, Human
gcugcuucccuc

SEQ ID NO: 2208358 - RNA, 13 nt, Human
gcugcuuccuccu

SEQ ID NO: 2208359 - RNA, 14 nt, Human
gcugcuuccuccug

SEQ ID NO: 2208360 - RNA, 15 nt, Human
gcugcuuccuccugg

SEQ ID NO: 2208361 - RNA, 16 nt, Human
gcugcuuccuccugga

SEQ ID NO: 2208362 - RNA, 16 nt, Human
gcugcuugggcuucau

SEQ ID NO: 2208363 - RNA, 17 nt, Human
gcugcuuccuccuggaa

SEQ ID NO: 2208364 - RNA, 21 nt, Human
gcugcuucucccacuuggcca

SEQ ID NO: 2208365 - RNA, 23 nt, Human
gcugcuucaaggauccugagcca

SEQ ID NO: 2208366 - RNA, 18 nt, Human
gcugcuuagacauaacaa

SEQ ID NO: 2208367 - RNA, 20 nt, Human
gcugcuuagaauccaaacuu

SEQ ID NO: 2208368 - RNA, 21 nt, Human
gcugcuucaaggauccugagc

SEQ ID NO: 2208369 - RNA, 22 nt, Human
gcugcuucaaggauccugagcc

SEQ ID NO: 2208370 - RNA, 13 nt, Human
gcuggccccgccg

SEQ ID NO: 2208371 - RNA, 20 nt, Human
gcuggcccagggcccagagc

SEQ ID NO: 2208372 - RNA, 22 nt, Human
gcuggccccgccgccugguacu

SEQ ID NO: 2208373 - RNA, 23 nt, Human
gcuggccccgccgccugguacuc

SEQ ID NO: 2208374 - RNA, 24 nt, Human
gcuggccccgccgccugguacuca

SEQ ID NO: 2208375 - RNA, 12 nt, Human
gcuggccccuca

SEQ ID NO: 2208376 - RNA, 11 nt, Human
gcuggccccuc

SEQ ID NO: 2208377 - RNA, 23 nt, Human
gcuggccccucaccugggcaccu

SEQ ID NO: 2208378 - RNA, 19 nt, Human
gcuggccccucaccugggc

SEQ ID NO: 2208379 - RNA, 14 nt, Human
gcuggccccucacc

SEQ ID NO: 2208380 - RNA, 19 nt, Human
gcuggcccagggcccagag

SEQ ID NO: 2208381 - RNA, 18 nt, Human
gcuggcccagggcccaga

SEQ ID NO: 2208382 - RNA, 21 nt, Human
gcuggcccagggcccagagcc

SEQ ID NO: 2208383 - RNA, 16 nt, Human
gcuggauuacaggcau

SEQ ID NO: 2208384 - RNA, 19 nt, Human
gcuggcaaagacagaagcc

SEQ ID NO: 2208385 - RNA, 15 nt, Human
gcuggcaaagacaga

SEQ ID NO: 2208386 - RNA, 22 nt, Human
gcuggaugucugccaauuuuug

SEQ ID NO: 2208387 - RNA, 22 nt, Human
gcuggauuggguuaugaauauu

SEQ ID NO: 2208388 - RNA, 16 nt, Human
gcuggcccagcccugc

SEQ ID NO: 2208389 - RNA, 17 nt, Human
gcuggcccagcccugcu

SEQ ID NO: 2208390 - RNA, 19 nt, Human
gcuggcccagcccugcugg

SEQ ID NO: 2208391 - RNA, 15 nt, Human
gcuggcaaagguggc

SEQ ID NO: 2208392 - RNA, 20 nt, Human
gcuggcaaagguggcucucc

SEQ ID NO: 2208393 - RNA, 17 nt, Human
gcuggcccagggcccag

SEQ ID NO: 2208394 - RNA, 16 nt, Human
gcuggcccagggccca

SEQ ID NO: 2208395 - RNA, 15 nt, Human
gcuggcccagggccc

SEQ ID NO: 2208396 - RNA, 13 nt, Human
gcuggcccagggc

SEQ ID NO: 2208397 - RNA, 20 nt, Human
gcuggcccagcccugcuggc

SEQ ID NO: 2208398 - RNA, 13 nt, Human
gcuggcccagccg

SEQ ID NO: 2208399 - RNA, 16 nt, Human
gcuggcccagccggcc

SEQ ID NO: 2208400 - RNA, 17 nt, Human
gcuggcccagccggccu

SEQ ID NO: 2208401 - RNA, 18 nt, Human
gcuggcccagccggccuc

SEQ ID NO: 2208402 - RNA, 19 nt, Human
gcuggcccagccggccucu

SEQ ID NO: 2208403 - RNA, 20 nt, Human
gcuggcccagccggccucuc

SEQ ID NO: 2208404 - RNA, 23 nt, Human
gcuggcccagccggccucucugg

SEQ ID NO: 2208405 - RNA, 16 nt, Human
gcuggaccuugaacug

SEQ ID NO: 2208406 - RNA, 21 nt, Human
gcugcuucuuaaccccaguaa

SEQ ID NO: 2208407 - RNA, 12 nt, Human
gcugcuugcccc

SEQ ID NO: 2208408 - RNA, 22 nt, Human
gcugcuugcccccaugcuggcg

SEQ ID NO: 2208409 - RNA, 18 nt, Human
gcuggaccuugaacuggg

SEQ ID NO: 2208410 - RNA, 17 nt, Human
gcugcuugggcuucauc

SEQ ID NO: 2208411 - RNA, 22 nt, Human
gcugcuugggcuucauccuccu

SEQ ID NO: 2208412 - RNA, 22 nt, Human
gcuggaugcuccuuccaacagg

SEQ ID NO: 2208413 - RNA, 14 nt, Human
gcuggauggagccc

SEQ ID NO: 2208414 - RNA, 21 nt, Human
gcuggaugcuccuuccaacag

SEQ ID NO: 2208415 - RNA, 16 nt, Human
gcuggauggagcccag

SEQ ID NO: 2208416 - RNA, 18 nt, Human
gcuggauggagcccaggc

SEQ ID NO: 2208417 - RNA, 18 nt, Human
gcuggaugucugccaauu

SEQ ID NO: 2208418 - RNA, 21 nt, Human
gcuggaugucugccaauuuuu

SEQ ID NO: 2208419 - RNA, 13 nt, Human
gcugcuuggccuu

SEQ ID NO: 2208420 - RNA, 20 nt, Human
gcuggaugagacuuccaaac

SEQ ID NO: 2208421 - RNA, 20 nt, Human
gcuggaugagaauuugagug

SEQ ID NO: 2208422 - RNA, 15 nt, Human
gcuggaugauggucu

SEQ ID NO: 2208423 - RNA, 21 nt, Human
gcuggaccuugaacuggguac

SEQ ID NO: 2208424 - RNA, 22 nt, Human
gcuggaccuugaacuggguacu

SEQ ID NO: 2208425 - RNA, 21 nt, Human
gcuggccucccaaaugagcca

SEQ ID NO: 2208426 - RNA, 22 nt, Human
gcuggccucccaaaugagccau

SEQ ID NO: 2208427 - RNA, 18 nt, Human
gcuggccgugggccuggg

SEQ ID NO: 2208428 - RNA, 17 nt, Human
gcuggccgggagccuga

SEQ ID NO: 2208429 - RNA, 20 nt, Human
gcuggccccucaccugggca

SEQ ID NO: 2208430 - RNA, 17 nt, Human
gcuggcccgugacagac

SEQ ID NO: 2208431 - RNA, 19 nt, Human
gcuggcccgugacagacuc

SEQ ID NO: 2208432 - RNA, 22 nt, Human
gcuggcccgugacagacuccug

SEQ ID NO: 2208433 - RNA, 12 nt, Human
gcuggcccugcc

SEQ ID NO: 2208434 - RNA, 22 nt, Human
gcuggccggagcaaacucugcu

SEQ ID NO: 2208435 - RNA, 13 nt, Human
gcuggccgggacc

SEQ ID NO: 2208436 - RNA, 20 nt, Human
gcugggacaugggaaagggg

SEQ ID NO: 2208437 - RNA, 15 nt, Human
gcuggccuggaucuc

SEQ ID NO: 2208438 - RNA, 17 nt, Human
gcugggacguggcucag

SEQ ID NO: 2208439 - RNA, 20 nt, Human
gcugggacguggcucagcca

SEQ ID NO: 2208440 - RNA, 19 nt, Human
gcugggacguggcucagcc

SEQ ID NO: 2208441 - RNA, 12 nt, Human
gcuggccuggau

SEQ ID NO: 2208442 - RNA, 14 nt, Human
gcuggccuggaucu

SEQ ID NO: 2208443 - RNA, 18 nt, Human
gcuggccucuggcucuca

SEQ ID NO: 2208444 - RNA, 23 nt, Human
gcuggccucuggcucucaugggg

SEQ ID NO: 2208445 - RNA, 14 nt, Human
gcugggacuggcca

SEQ ID NO: 2208446 - RNA, 14 nt, Human
gcugggacugagcc

SEQ ID NO: 2208447 - RNA, 15 nt, Human
gcugggacugagcca

SEQ ID NO: 2208448 - RNA, 22 nt, Human
gcugggacucagccuucagaca

SEQ ID NO: 2208449 - RNA, 23 nt, Human
gcugggacucagccuucagacag

SEQ ID NO: 2208450 - RNA, 14 nt, Human
gcugggacucagcc

SEQ ID NO: 2208451 - RNA, 15 nt, Human
gcugggacucagccu

SEQ ID NO: 2208452 - RNA, 16 nt, Human
gcugggacucagccuu

SEQ ID NO: 2208453 - RNA, 19 nt, Human
gcugggacucagccuucag

SEQ ID NO: 2208454 - RNA, 19 nt, Human
gcugggacuacagguguga

SEQ ID NO: 2208455 - RNA, 12 nt, Human
gcugggacucag

SEQ ID NO: 2208456 - RNA, 22 nt, Human
gcugggacguggcucagccagc

SEQ ID NO: 2208457 - RNA, 21 nt, Human
gcugggacguggcucagccag

SEQ ID NO: 2208458 - RNA, 13 nt, Human
gcugggacuacag

SEQ ID NO: 2208459 - RNA, 18 nt, Human
gcugggacuacaggcacc

SEQ ID NO: 2208460 - RNA, 19 nt, Human
gcugggacuacaggcaccc

SEQ ID NO: 2208461 - RNA, 20 nt, Human
gcugggacuacaggcaccca

SEQ ID NO: 2208462 - RNA, 22 nt, Human
ggaagaucuuaaauuuugugau

SEQ ID NO: 2208463 - RNA, 23 nt, Human
ggaagaucuuaaauuuugugaua

SEQ ID NO: 2208464 - RNA, 18 nt, Human
ggaagaugggggcaagaa

SEQ ID NO: 2208465 - RNA, 12 nt, Human
ggaagauccugc

SEQ ID NO: 2208466 - RNA, 22 nt, Human
ggaagauccugcggguggggcu

SEQ ID NO: 2208467 - RNA, 18 nt, Human
ggaagauuuuaaauucac

SEQ ID NO: 2208468 - RNA, 19 nt, Human
ggaagaugggggcaagaag

SEQ ID NO: 2208469 - RNA, 20 nt, Human
ggaagaugggggcaagaaga

SEQ ID NO: 2208470 - RNA, 22 nt, Human
ggaagaugggggcaagaagauc

SEQ ID NO: 2208471 - RNA, 17 nt, Human
ggaagcacagcuucauu

SEQ ID NO: 2208472 - RNA, 13 nt, Human
ggaagcacaugcc

SEQ ID NO: 2208473 - RNA, 14 nt, Human
ggaagcacaugccu

SEQ ID NO: 2208474 - RNA, 15 nt, Human
ggaagcacaugccuc

SEQ ID NO: 2208475 - RNA, 17 nt, Human
ggaagcacaugccucuc

SEQ ID NO: 2208476 - RNA, 15 nt, Human
ggaacuccuggaaau

SEQ ID NO: 2208477 - RNA, 23 nt, Human
ggaagagaggaguucaaugaucu

SEQ ID NO: 2208478 - RNA, 22 nt, Human
ggaacucauuccugccugucuc

SEQ ID NO: 2208479 - RNA, 13 nt, Human
ggaacucccagca

SEQ ID NO: 2208480 - RNA, 22 nt, Human
ggaacucccagcaacacaagcu

SEQ ID NO: 2208481 - RNA, 14 nt, Human
ggaagagcaggcac

SEQ ID NO: 2208482 - RNA, 15 nt, Human
ggaagagcaggcaca

SEQ ID NO: 2208483 - RNA, 21 nt, Human
ggaagagcaggcacauggagg

SEQ ID NO: 2208484 - RNA, 19 nt, Human
ggaagagcagaacggagcc

SEQ ID NO: 2208485 - RNA, 18 nt, Human
ggaagagcacagcccucc

SEQ ID NO: 2208486 - RNA, 19 nt, Human
ggaagagcacagcccuccc

SEQ ID NO: 2208487 - RNA, 22 nt, Human
ggaagagaggaguucaaugauc

SEQ ID NO: 2208488 - RNA, 14 nt, Human
ggaagagcacagcc

SEQ ID NO: 2208489 - RNA, 16 nt, Human
ggaagagcacagcccu

SEQ ID NO: 2208490 - RNA, 17 nt, Human
ggaagagcacagcccuc

SEQ ID NO: 2208491 - RNA, 13 nt, Human
ggaagagccuugc

SEQ ID NO: 2208492 - RNA, 15 nt, Human
ggaagagggacagau

SEQ ID NO: 2208493 - RNA, 21 nt, Human
ggaagauaggcucugcacaga

SEQ ID NO: 2208494 - RNA, 17 nt, Human
ggaagauaggcucugca

SEQ ID NO: 2208495 - RNA, 18 nt, Human
ggaagauaggcucugcac

SEQ ID NO: 2208496 - RNA, 19 nt, Human
ggaagaguguacugggggu

SEQ ID NO: 2208497 - RNA, 20 nt, Human
ggaagaggggacaggucccu

SEQ ID NO: 2208498 - RNA, 16 nt, Human
ggaagaguguacuggg

SEQ ID NO: 2208499 - RNA, 15 nt, Human
ggaagaguguacugg

SEQ ID NO: 2208500 - RNA, 14 nt, Human
ggaagaggggacag

SEQ ID NO: 2208501 - RNA, 21 nt, Human
ggaagcauguaggagaaucca

SEQ ID NO: 2208502 - RNA, 20 nt, Human
ggaagcauguaggagaaucc

SEQ ID NO: 2208503 - RNA, 17 nt, Human
ggaagcauguaggagaa

SEQ ID NO: 2208504 - RNA, 20 nt, Human
ggaagcauauuguuauuaua

SEQ ID NO: 2208505 - RNA, 20 nt, Human
ggaagcauucagagagcagc

SEQ ID NO: 2208506 - RNA, 16 nt, Human
ggaagcauucagagag

SEQ ID NO: 2208507 - RNA, 18 nt, Human
ggaagcauucagagagca

SEQ ID NO: 2208508 - RNA, 14 nt, Human
ggaagccaaagagu

SEQ ID NO: 2208509 - RNA, 18 nt, Human
ggaagccaacuuggcuuu

SEQ ID NO: 2208510 - RNA, 22 nt, Human
ggaagccaaaccucugugagca

SEQ ID NO: 2208511 - RNA, 22 nt, Human
ggaagccaaaauguaggcuuag

SEQ ID NO: 2208512 - RNA, 13 nt, Human
ggaagccagcagg

SEQ ID NO: 2208513 - RNA, 14 nt, Human
ggaagccagcaggc

SEQ ID NO: 2208514 - RNA, 15 nt, Human
ggaagccagcaggcu

SEQ ID NO: 2208515 - RNA, 16 nt, Human
ggaagccagcaggcuc

SEQ ID NO: 2208516 - RNA, 17 nt, Human
ggaagccagcaggcucu

SEQ ID NO: 2208517 - RNA, 18 nt, Human
ggaagccagcaggcucuc

SEQ ID NO: 2208518 - RNA, 15 nt, Human
ggaagcaccccaugc

SEQ ID NO: 2208519 - RNA, 13 nt, Human
ggaagcaccccau

SEQ ID NO: 2208520 - RNA, 22 nt, Human
ggaagcaccccaugccaaagcu

SEQ ID NO: 2208521 - RNA, 23 nt, Human
ggaagcacaugccucucucaggc

SEQ ID NO: 2208522 - RNA, 21 nt, Human
ggaagcacaugccucucucag

SEQ ID NO: 2208523 - RNA, 22 nt, Human
ggaagcacaugccucucucagg

SEQ ID NO: 2208524 - RNA, 11 nt, Human
ggaagcagugc

SEQ ID NO: 2208525 - RNA, 13 nt, Human
ggaagcagcuuuc

SEQ ID NO: 2208526 - RNA, 12 nt, Human
ggaagcagugcc

SEQ ID NO: 2208527 - RNA, 21 nt, Human
ggaagcagugccuuccauaau

SEQ ID NO: 2208528 - RNA, 20 nt, Human
ggaagcagugccuuccauaa

SEQ ID NO: 2208529 - RNA, 19 nt, Human
ggaagcagugccuuccaua

SEQ ID NO: 2208530 - RNA, 22 nt, Human
ggaagcagauacauaugagugu

SEQ ID NO: 2208531 - RNA, 19 nt, Human
ggaagcagaauaaagcaau

SEQ ID NO: 2208532 - RNA, 20 nt, Human
ggaagcagaauaaagcaauu

SEQ ID NO: 2208533 - RNA, 21 nt, Human
ggaagcagaauaaagcaauuu

SEQ ID NO: 2208534 - RNA, 22 nt, Human
ggaagcagaauaaagcaauuuu

SEQ ID NO: 2208535 - RNA, 23 nt, Human
ggaagcacauguuuauuuauucu

SEQ ID NO: 2208536 - RNA, 12 nt, Human
ggaagcagaaua

SEQ ID NO: 2208537 - RNA, 13 nt, Human
ggaagcagaauaa

SEQ ID NO: 2208538 - RNA, 14 nt, Human
ggaagcagaauaaa

SEQ ID NO: 2208539 - RNA, 15 nt, Human
ggaagcagaauaaag

SEQ ID NO: 2208540 - RNA, 16 nt, Human
ggaagcagaauaaagc

SEQ ID NO: 2208541 - RNA, 17 nt, Human
ggaagcagaauaaagca

SEQ ID NO: 2208542 - RNA, 18 nt, Human
ggaagcagaauaaagcaa

SEQ ID NO: 2208543 - RNA, 18 nt, Human
ggaaccgcaggaagcugc

SEQ ID NO: 2208544 - RNA, 16 nt, Human
ggaaccgcaggaagcu

SEQ ID NO: 2208545 - RNA, 15 nt, Human
ggaaccgcaggaagc

SEQ ID NO: 2208546 - RNA, 17 nt, Human
ggaaccgcaggaagcug

SEQ ID NO: 2208547 - RNA, 12 nt, Human
ggaaccucacuc

SEQ ID NO: 2208548 - RNA, 18 nt, Human
ggaaccucacucuugcca

SEQ ID NO: 2208549 - RNA, 13 nt, Human
ggaaccucagccu

SEQ ID NO: 2208550 - RNA, 12 nt, Human
ggaaccucagcc

SEQ ID NO: 2208551 - RNA, 24 nt, Human
ggaacccuuacaguaggagcccag

SEQ ID NO: 2208552 - RNA, 20 nt, Human
ggaacagcuaugggagcccc

SEQ ID NO: 2208553 - RNA, 21 nt, Human
ggaaccccggggugcccacag

SEQ ID NO: 2208554 - RNA, 19 nt, Human
ggaacagcuaugggagccc

SEQ ID NO: 2208555 - RNA, 16 nt, Human
ggaaaucaaauaugca

SEQ ID NO: 2208556 - RNA, 19 nt, Human
ggaacagacuggaagcaca

SEQ ID NO: 2208557 - RNA, 20 nt, Human
ggaacagacuggaagcacag

SEQ ID NO: 2208558 - RNA, 20 nt, Human
ggaacgguaaauuucugugg

SEQ ID NO: 2208559 - RNA, 18 nt, Human
ggaacgggguccuucaag

SEQ ID NO: 2208560 - RNA, 22 nt, Human
ggaaccucagccuggccagaca

SEQ ID NO: 2208561 - RNA, 23 nt, Human
ggaaccucagccuggccagacac

SEQ ID NO: 2208562 - RNA, 21 nt, Human
ggaaccucagccuggccagac

SEQ ID NO: 2208563 - RNA, 20 nt, Human
ggaaccucagccuggccaga

SEQ ID NO: 2208564 - RNA, 19 nt, Human
ggaaccucagccuggccag

SEQ ID NO: 2208565 - RNA, 16 nt, Human
ggaaccucagccuggc

SEQ ID NO: 2208566 - RNA, 15 nt, Human
ggaaccucagccugg

SEQ ID NO: 2208567 - RNA, 14 nt, Human
ggaaccucagccug

SEQ ID NO: 2208568 - RNA, 11 nt, Human
ggaacucccag

SEQ ID NO: 2208569 - RNA, 21 nt, Human
ggaacucauuccugccugucu

SEQ ID NO: 2208570 - RNA, 20 nt, Human
ggaacucagauccagggaca

SEQ ID NO: 2208571 - RNA, 19 nt, Human
ggaacucagauccagggac

SEQ ID NO: 2208572 - RNA, 17 nt, Human
ggaacucagauccaggg

SEQ ID NO: 2208573 - RNA, 16 nt, Human
ggaacucagauccagg

SEQ ID NO: 2208574 - RNA, 15 nt, Human
ggaacucagauccag

SEQ ID NO: 2208575 - RNA, 13 nt, Human
ggaacucagaucc

SEQ ID NO: 2208576 - RNA, 22 nt, Human
ggaacuagagggauacacugaa

SEQ ID NO: 2208577 - RNA, 17 nt, Human
ggaacucaccuggggcu

SEQ ID NO: 2208578 - RNA, 21 nt, Human
ggaacuagagggauacacuga

SEQ ID NO: 2208579 - RNA, 17 nt, Human
ggaacgugacugcccca

SEQ ID NO: 2208580 - RNA, 23 nt, Human
ggaacuagacucccaagcuggac

SEQ ID NO: 2208581 - RNA, 16 nt, Human
ggaacgugacugcccc

SEQ ID NO: 2208582 - RNA, 21 nt, Human
ggaaccucacucuugccaacc

SEQ ID NO: 2208583 - RNA, 20 nt, Human
ggaaaggggucggcugacca

SEQ ID NO: 2208584 - RNA, 15 nt, Human
ggaaagggugcugcu

SEQ ID NO: 2208585 - RNA, 20 nt, Human
ggaaagggugcugcuucccu

SEQ ID NO: 2208586 - RNA, 15 nt, Human
ggaaaaucagccugc

SEQ ID NO: 2208587 - RNA, 22 nt, Human
ggaaagugaauuugaaugaaaa

SEQ ID NO: 2208588 - RNA, 19 nt, Human
ggaaagugaauuugaauga

SEQ ID NO: 2208589 - RNA, 18 nt, Human
ggaaagugaauuugaaug

SEQ ID NO: 2208590 - RNA, 14 nt, Human
ggaaagugaauuug

SEQ ID NO: 2208591 - RNA, 13 nt, Human
ggaaagugaauuu

SEQ ID NO: 2208592 - RNA, 21 nt, Human
ggaaagucauuggcuuuaucc

SEQ ID NO: 2208593 - RNA, 16 nt, Human
ggaaagucauuggcuu

SEQ ID NO: 2208594 - RNA, 14 nt, Human
ggaaaauaaauuau

SEQ ID NO: 2208595 - RNA, 13 nt, Human
ggaaaauacccca

SEQ ID NO: 2208596 - RNA, 22 nt, Human
ggaaaauaccccaucauucaug

SEQ ID NO: 2208597 - RNA, 22 nt, Human
ggaaaagagcgcaucaggccug

SEQ ID NO: 2208598 - RNA, 18 nt, Human
ggaaaagaauacagaaag

SEQ ID NO: 2208599 - RNA, 14 nt, Human
ggaaaagaauacag

SEQ ID NO: 2208600 - RNA, 21 nt, Human
ggaaaagagauggccugagaa

SEQ ID NO: 2208601 - RNA, 17 nt, Human
ggaacagacuggaagca

SEQ ID NO: 2208602 - RNA, 17 nt, Human
ggaaauauugcuggggu

SEQ ID NO: 2208603 - RNA, 17 nt, Human
ggaaaguguaaagcauu

SEQ ID NO: 2208604 - RNA, 17 nt, Human
ggaaauauuuagcaaau

SEQ ID NO: 2208605 - RNA, 20 nt, Human
ggaaauauuuagcaaauaau

SEQ ID NO: 2208606 - RNA, 17 nt, Human
ggaaauauuuauuuuaa

SEQ ID NO: 2208607 - RNA, 18 nt, Human
ggaaauauuuauuuuaau

SEQ ID NO: 2208608 - RNA, 13 nt, Human
ggaaaguguaaag

SEQ ID NO: 2208609 - RNA, 14 nt, Human
ggaaaguguaaagc

SEQ ID NO: 2208610 - RNA, 15 nt, Human
ggaaaguguaaagca

SEQ ID NO: 2208611 - RNA, 16 nt, Human
ggaaaguguaaagcau

SEQ ID NO: 2208612 - RNA, 12 nt, Human
ggaaauauuuau

SEQ ID NO: 2208613 - RNA, 13 nt, Human
ggaaauauuuauu

SEQ ID NO: 2208614 - RNA, 15 nt, Human
ggaaauauuuauuuu

SEQ ID NO: 2208615 - RNA, 22 nt, Human
gcuuugggaauguuuuuagcug

SEQ ID NO: 2208616 - RNA, 13 nt, Human
gcuuuggcuucuu

SEQ ID NO: 2208617 - RNA, 14 nt, Human
gcuuugggcugccc

SEQ ID NO: 2208618 - RNA, 17 nt, Human
gcuuuggauuugacauu

SEQ ID NO: 2208619 - RNA, 17 nt, Human
gcuuuggaccuaaucca

SEQ ID NO: 2208620 - RNA, 22 nt, Human
gcuuuggaccuaaauggccuca

SEQ ID NO: 2208621 - RNA, 17 nt, Human
gcuuuauuuuuuaagua

SEQ ID NO: 2208622 - RNA, 13 nt, Human
gcuuuauuuuuua

SEQ ID NO: 2208623 - RNA, 13 nt, Human
gcuuuauucuuca

SEQ ID NO: 2208624 - RNA, 22 nt, Human
gcuuuauucuucagauacaaac

SEQ ID NO: 2208625 - RNA, 15 nt, Human
gcuuuauguaauaau

SEQ ID NO: 2208626 - RNA, 14 nt, Human
gcuuuaugcugaaa

SEQ ID NO: 2208627 - RNA, 13 nt, Human
gcuuuaugcugaa

SEQ ID NO: 2208628 - RNA, 17 nt, Human
gcuuuauuccagaaugc

SEQ ID NO: 2208629 - RNA, 20 nt, Human
gcuuuauggguguuaauuga

SEQ ID NO: 2208630 - RNA, 21 nt, Human
gcuuuaauuuuuuuaaccaaa

SEQ ID NO: 2208631 - RNA, 20 nt, Human
gcuuuauccucuuuagaguu

SEQ ID NO: 2208632 - RNA, 15 nt, Human
gcuuuauccucuuua

SEQ ID NO: 2208633 - RNA, 16 nt, Human
gcuuuauccucuuuag

SEQ ID NO: 2208634 - RNA, 17 nt, Human
gcuuuauccucuuuaga

SEQ ID NO: 2208635 - RNA, 19 nt, Human
gcuuuauccucuuuagagu

SEQ ID NO: 2208636 - RNA, 12 nt, Human
gcuuuacaugca

SEQ ID NO: 2208637 - RNA, 23 nt, Human
gcuuuacugucaaaauaauuuua

SEQ ID NO: 2208638 - RNA, 13 nt, Human
gcuuggccugcug

SEQ ID NO: 2208639 - RNA, 23 nt, Human
gcuuuaauaucaucaguauugaa

SEQ ID NO: 2208640 - RNA, 22 nt, Human
gcuuuaauaucaucaguauuga

SEQ ID NO: 2208641 - RNA, 20 nt, Human
gcuuuaauaucaucaguauu

SEQ ID NO: 2208642 - RNA, 18 nt, Human
gcuuggccagaagggggc

SEQ ID NO: 2208643 - RNA, 13 nt, Human
gcuuggcagcuga

SEQ ID NO: 2208644 - RNA, 13 nt, Human
gcuuggccagaag

SEQ ID NO: 2208645 - RNA, 18 nt, Human
gcuuggagcagaggggcu

SEQ ID NO: 2208646 - RNA, 16 nt, Human
gcuuggagcagagggg

SEQ ID NO: 2208647 - RNA, 14 nt, Human
gcuuggcacaugac

SEQ ID NO: 2208648 - RNA, 13 nt, Human
gcuuggcagccga

SEQ ID NO: 2208649 - RNA, 21 nt, Human
gcuuuuacugaagccuuucuu

SEQ ID NO: 2208650 - RNA, 19 nt, Human
ggaaaaaauguuggauuua

SEQ ID NO: 2208651 - RNA, 13 nt, Human
gcuuuuagacaga

SEQ ID NO: 2208652 - RNA, 14 nt, Human
gcuuuuacuuaaac

SEQ ID NO: 2208653 - RNA, 20 nt, Human
ggaaaaaauaacaaugaaag

SEQ ID NO: 2208654 - RNA, 15 nt, Human
gcuuugggcugcccu

SEQ ID NO: 2208655 - RNA, 16 nt, Human
gcuuugggcugcccug

SEQ ID NO: 2208656 - RNA, 17 nt, Human
gcuuuuaaaaaaaaaua

SEQ ID NO: 2208657 - RNA, 20 nt, Human
gcuuuuaccaugccccugag

SEQ ID NO: 2208658 - RNA, 15 nt, Human
gcuuuuaccaugccc

SEQ ID NO: 2208659 - RNA, 11 nt, Human
ggaaaaauauu

SEQ ID NO: 2208660 - RNA, 21 nt, Human
ggaaaacugagacucagacag

SEQ ID NO: 2208661 - RNA, 16 nt, Human
ggaaaacugacagagg

SEQ ID NO: 2208662 - RNA, 15 nt, Human
ggaaaaauagccugc

SEQ ID NO: 2208663 - RNA, 22 nt, Human
ggaaaaccaagccguggcuucc

SEQ ID NO: 2208664 - RNA, 19 nt, Human
ggaaaaaccacccccaaau

SEQ ID NO: 2208665 - RNA, 21 nt, Human
ggaaaaacaucugaaagccac

SEQ ID NO: 2208666 - RNA, 13 nt, Human
ggaaaaacacaag

SEQ ID NO: 2208667 - RNA, 14 nt, Human
ggaaaaacugauuu

SEQ ID NO: 2208668 - RNA, 16 nt, Human
ggaaaaagcacaagaa

SEQ ID NO: 2208669 - RNA, 17 nt, Human
ggaaaaagcacaagaag

SEQ ID NO: 2208670 - RNA, 13 nt, Human
ggaaaaauagccu

SEQ ID NO: 2208671 - RNA, 22 nt, Human
gcuguucacccacagggcuaag

SEQ ID NO: 2208672 - RNA, 23 nt, Human
gcuguguccuugcaccugcaucc

SEQ ID NO: 2208673 - RNA, 21 nt, Human
gcuuccagugaggcucugccc

SEQ ID NO: 2208674 - RNA, 19 nt, Human
gcuuccagugaggcucugc

SEQ ID NO: 2208675 - RNA, 20 nt, Human
gcuuccagugaggcucugcc

SEQ ID NO: 2208676 - RNA, 18 nt, Human
gcuuccagugaggcucug

SEQ ID NO: 2208677 - RNA, 23 nt, Human
gcuguucacagccagacuggcac

SEQ ID NO: 2208678 - RNA, 16 nt, Human
gcuguucacagccaga

SEQ ID NO: 2208679 - RNA, 15 nt, Human
gcuguucacagccag

SEQ ID NO: 2208680 - RNA, 15 nt, Human
gcuucugguacucuc

SEQ ID NO: 2208681 - RNA, 16 nt, Human
gcuucugguacucucc

SEQ ID NO: 2208682 - RNA, 19 nt, Human
gcuucucugugaacgauuu

SEQ ID NO: 2208683 - RNA, 16 nt, Human
gcuucucucucaccag

SEQ ID NO: 2208684 - RNA, 22 nt, Human
gcuggugguuucacggugccag

SEQ ID NO: 2208685 - RNA, 21 nt, Human
gcuucucugacuucugccugg

SEQ ID NO: 2208686 - RNA, 22 nt, Human
gcuucucugacuucugccugga

SEQ ID NO: 2208687 - RNA, 16 nt, Human
gcuucucucuguggga

SEQ ID NO: 2208688 - RNA, 13 nt, Human
gcuucucugacuu

SEQ ID NO: 2208689 - RNA, 14 nt, Human
gcuucucucugugg

SEQ ID NO: 2208690 - RNA, 13 nt, Human
gcuucucucucac

SEQ ID NO: 2208691 - RNA, 14 nt, Human
gcuucucucucacc

SEQ ID NO: 2208692 - RNA, 14 nt, Human
gcuucucugacuuc

SEQ ID NO: 2208693 - RNA, 17 nt, Human
gcuucucugacuucugc

SEQ ID NO: 2208694 - RNA, 18 nt, Human
gcuucucugacuucugcc

SEQ ID NO: 2208695 - RNA, 20 nt, Human
gcuucucugacuucugccug

SEQ ID NO: 2208696 - RNA, 20 nt, Human
gcuguucacccacagggcua

SEQ ID NO: 2208697 - RNA, 12 nt, Human
gcuucuauccca

SEQ ID NO: 2208698 - RNA, 14 nt, Human
gcuucucuacagac

SEQ ID NO: 2208699 - RNA, 15 nt, Human
gcuucuccuguguga

SEQ ID NO: 2208700 - RNA, 12 nt, Human
gcuucucucuca

SEQ ID NO: 2208701 - RNA, 12 nt, Human
gcuucuccugac

SEQ ID NO: 2208702 - RNA, 24 nt, Human
gcuucuccgccagccuccucugga

SEQ ID NO: 2208703 - RNA, 14 nt, Human
gcuucuccugaccc

SEQ ID NO: 2208704 - RNA, 16 nt, Human
gcuucuauuagccagu

SEQ ID NO: 2208705 - RNA, 20 nt, Human
gcuucuaucccaggaggugg

SEQ ID NO: 2208706 - RNA, 14 nt, Human
gcuucuaucccagg

SEQ ID NO: 2208707 - RNA, 18 nt, Human
gcuucuaucccaggaggu

SEQ ID NO: 2208708 - RNA, 15 nt, Human
gcuugccacagcucu

SEQ ID NO: 2208709 - RNA, 16 nt, Human
gcuugccacagagcgg

SEQ ID NO: 2208710 - RNA, 12 nt, Human
gcuugccccggc

SEQ ID NO: 2208711 - RNA, 14 nt, Human
gcuugccccggccc

SEQ ID NO: 2208712 - RNA, 19 nt, Human
gcuugcccuggugccucac

SEQ ID NO: 2208713 - RNA, 17 nt, Human
gcuugcccuggugccuc

SEQ ID NO: 2208714 - RNA, 14 nt, Human
gcuuggaggaagga

SEQ ID NO: 2208715 - RNA, 15 nt, Human
gcuuggaggaaggaa

SEQ ID NO: 2208716 - RNA, 13 nt, Human
gcuuggaggaagg

SEQ ID NO: 2208717 - RNA, 18 nt, Human
gcuugcccuguuaaaaga

SEQ ID NO: 2208718 - RNA, 22 nt, Human
gcuugaggguugggcugguguc

SEQ ID NO: 2208719 - RNA, 16 nt, Human
gcuucuguugcugccu

SEQ ID NO: 2208720 - RNA, 19 nt, Human
gcuucuggugaccuuccaa

SEQ ID NO: 2208721 - RNA, 23 nt, Human
gcuucugucuuauuugaaggcca

SEQ ID NO: 2208722 - RNA, 17 nt, Human
gcuucugguacucuccu

SEQ ID NO: 2208723 - RNA, 18 nt, Human
gcuucugguacucuccua

SEQ ID NO: 2208724 - RNA, 19 nt, Human
gcuucugguacucuccuag

SEQ ID NO: 2208725 - RNA, 19 nt, Human
gcuugaguuuggggaaugc

SEQ ID NO: 2208726 - RNA, 14 nt, Human
gcuugauucugcag

SEQ ID NO: 2208727 - RNA, 23 nt, Human
gcuugcaaguauguuuuagcaug

SEQ ID NO: 2208728 - RNA, 14 nt, Human
gcuugauuuuugcc

SEQ ID NO: 2208729 - RNA, 22 nt, Human
gcuugcagagaugaggccgcca

SEQ ID NO: 2208730 - RNA, 15 nt, Human
gcuugcauaauaagc

SEQ ID NO: 2208731 - RNA, 14 nt, Human
gcuugccacagagc

SEQ ID NO: 2208732 - RNA, 23 nt, Human
gcuugcauaauaagcuaaagagg

SEQ ID NO: 2208733 - RNA, 19 nt, Human
gcuugcagugagccgagau

SEQ ID NO: 2208734 - RNA, 19 nt, Human
gcuugcacuuuguaacaug

SEQ ID NO: 2208735 - RNA, 22 nt, Human
gcuugcacuuuguaacauguuu

SEQ ID NO: 2208736 - RNA, 21 nt, Human
gcuugcaguagauuuucuuua

SEQ ID NO: 2208737 - RNA, 15 nt, Human
ggcugauggaguaaa

SEQ ID NO: 2208738 - RNA, 19 nt, Human
ggcugauaauuccaguggu

SEQ ID NO: 2208739 - RNA, 21 nt, Human
ggcugaugccaaguuguuuga

SEQ ID NO: 2208740 - RNA, 23 nt, Human
ggcugagucaugaucucccugcc

SEQ ID NO: 2208741 - RNA, 22 nt, Human
ggcugagucaugaucucccugc

SEQ ID NO: 2208742 - RNA, 23 nt, Human
ggcugagguuccucugccugccc

SEQ ID NO: 2208743 - RNA, 14 nt, Human
ggcugagguuccuc

SEQ ID NO: 2208744 - RNA, 16 nt, Human
ggcugagguuccucug

SEQ ID NO: 2208745 - RNA, 17 nt, Human
ggcugagguuccucugc

SEQ ID NO: 2208746 - RNA, 18 nt, Human
ggcugagguuccucugcc

SEQ ID NO: 2208747 - RNA, 19 nt, Human
ggcugagguuccucugccu

SEQ ID NO: 2208748 - RNA, 20 nt, Human
ggcugagguuccucugccug

SEQ ID NO: 2208749 - RNA, 21 nt, Human
ggcugagguuccucugccugc

SEQ ID NO: 2208750 - RNA, 22 nt, Human
ggcugagguuccucugccugcc

SEQ ID NO: 2208751 - RNA, 22 nt, Human
ggcugcaaaggguaucaggugc

SEQ ID NO: 2208752 - RNA, 23 nt, Human
ggcugcaaaggguaucaggugcu

SEQ ID NO: 2208753 - RNA, 18 nt, Human
ggcugcaaaggguaucag

SEQ ID NO: 2208754 - RNA, 22 nt, Human
ggcugaugccaaguuguuugag

SEQ ID NO: 2208755 - RNA, 18 nt, Human
ggcugaugucaauuucug

SEQ ID NO: 2208756 - RNA, 22 nt, Human
ggcugaugucaauuucuguguu

SEQ ID NO: 2208757 - RNA, 24 nt, Human
ggcugaugucaauuucuguguugc

SEQ ID NO: 2208758 - RNA, 24 nt, Human
ggcugcaaaggguaucaggugcug

SEQ ID NO: 2208759 - RNA, 17 nt, Human
ggcugcaccggcuggcc

SEQ ID NO: 2208760 - RNA, 18 nt, Human
ggcugcaccggcuggccu

SEQ ID NO: 2208761 - RNA, 19 nt, Human
ggcugcaccggcuggccug

SEQ ID NO: 2208762 - RNA, 22 nt, Human
ggcugcagccaggccacuggcc

SEQ ID NO: 2208763 - RNA, 21 nt, Human
ggcugcagcauguugcugagg

SEQ ID NO: 2208764 - RNA, 22 nt, Human
ggcugcagcagcgguggccucu

SEQ ID NO: 2208765 - RNA, 12 nt, Human
ggcugcagcaug

SEQ ID NO: 2208766 - RNA, 16 nt, Human
ggcugcagccaggcca

SEQ ID NO: 2208767 - RNA, 19 nt, Human
ggcugcagaggccagaggc

SEQ ID NO: 2208768 - RNA, 13 nt, Human
ggcugcagcagcg

SEQ ID NO: 2208769 - RNA, 20 nt, Human
ggcugcagcagcgguggccu

SEQ ID NO: 2208770 - RNA, 22 nt, Human
ggcugcaagguuuaggcuggug

SEQ ID NO: 2208771 - RNA, 15 nt, Human
ggcugcacucugugc

SEQ ID NO: 2208772 - RNA, 16 nt, Human
ggcugcacucugugcc

SEQ ID NO: 2208773 - RNA, 17 nt, Human
ggcugcacucugugccc

SEQ ID NO: 2208774 - RNA, 18 nt, Human
ggcugcacucugugccca

SEQ ID NO: 2208775 - RNA, 19 nt, Human
ggcugcacucugugcccau

SEQ ID NO: 2208776 - RNA, 13 nt, Human
ggcugcagaggcc

SEQ ID NO: 2208777 - RNA, 20 nt, Human
ggcugcacucugugcccaug

SEQ ID NO: 2208778 - RNA, 21 nt, Human
ggcugcacucugugcccaugg

SEQ ID NO: 2208779 - RNA, 16 nt, Human
ggcugcagaggccaga

SEQ ID NO: 2208780 - RNA, 18 nt, Human
ggcugcagaggccagagg

SEQ ID NO: 2208781 - RNA, 20 nt, Human
ggccccugcccggcugcgga

SEQ ID NO: 2208782 - RNA, 17 nt, Human
ggcucugccucccauca

SEQ ID NO: 2208783 - RNA, 16 nt, Human
ggccccugcccggcug

SEQ ID NO: 2208784 - RNA, 17 nt, Human
ggccccugcccggcugc

SEQ ID NO: 2208785 - RNA, 13 nt, Human
ggcucuggagccc

SEQ ID NO: 2208786 - RNA, 14 nt, Human
ggcucuggagccca

SEQ ID NO: 2208787 - RNA, 20 nt, Human
ggccccugccagacccccug

SEQ ID NO: 2208788 - RNA, 19 nt, Human
ggcucugcuggccggagca

SEQ ID NO: 2208789 - RNA, 17 nt, Human
ggccccugcauccccuu

SEQ ID NO: 2208790 - RNA, 12 nt, Human
ggcucuggagac

SEQ ID NO: 2208791 - RNA, 15 nt, Human
ggcucuggagacagc

SEQ ID NO: 2208792 - RNA, 16 nt, Human
ggcucuggagacagcc

SEQ ID NO: 2208793 - RNA, 17 nt, Human
ggcucuggagacagccc

SEQ ID NO: 2208794 - RNA, 19 nt, Human
ggcucuggagacagcccca

SEQ ID NO: 2208795 - RNA, 21 nt, Human
ggcucuggagacagccccaga

SEQ ID NO: 2208796 - RNA, 14 nt, Human
ggcucuggagagaa

SEQ ID NO: 2208797 - RNA, 21 nt, Human
ggcugagacuggauacugccc

SEQ ID NO: 2208798 - RNA, 15 nt, Human
ggcugagagaguggc

SEQ ID NO: 2208799 - RNA, 17 nt, Human
ggcugagagaguggcau

SEQ ID NO: 2208800 - RNA, 14 nt, Human
ggcugagagcccca

SEQ ID NO: 2208801 - RNA, 13 nt, Human
ggcugagacugga

SEQ ID NO: 2208802 - RNA, 15 nt, Human
ggcucuggagagaaa

SEQ ID NO: 2208803 - RNA, 12 nt, Human
ggcugagacugg

SEQ ID NO: 2208804 - RNA, 15 nt, Human
ggcugagauaugaac

SEQ ID NO: 2208805 - RNA, 20 nt, Human
ggcugagagccccagcugac

SEQ ID NO: 2208806 - RNA, 13 nt, Human
ggcugagccccua

SEQ ID NO: 2208807 - RNA, 16 nt, Human
ggcugagagccccagc

SEQ ID NO: 2208808 - RNA, 17 nt, Human
ggcugagagccccagcu

SEQ ID NO: 2208809 - RNA, 18 nt, Human
ggcugagagccccagcug

SEQ ID NO: 2208810 - RNA, 19 nt, Human
ggcugagagccccagcuga

SEQ ID NO: 2208811 - RNA, 14 nt, Human
ggcugagcccuggc

SEQ ID NO: 2208812 - RNA, 13 nt, Human
ggcugagcccugg

SEQ ID NO: 2208813 - RNA, 12 nt, Human
ggcugagcccug

SEQ ID NO: 2208814 - RNA, 16 nt, Human
ggcugagccccuaccc

SEQ ID NO: 2208815 - RNA, 18 nt, Human
ggcugagccccuacccca

SEQ ID NO: 2208816 - RNA, 16 nt, Human
ggcugagcccuggcag

SEQ ID NO: 2208817 - RNA, 15 nt, Human
ggcugagcccuggca

SEQ ID NO: 2208818 - RNA, 15 nt, Human
ggcugagccuggcug

SEQ ID NO: 2208819 - RNA, 22 nt, Human
ggcugagggauggacugaugcu

SEQ ID NO: 2208820 - RNA, 23 nt, Human
ggcugagggauggacugaugcuu

SEQ ID NO: 2208821 - RNA, 16 nt, Human
ggcugagggagccugg

SEQ ID NO: 2208822 - RNA, 20 nt, Human
ggcugagcucucugugggcu

SEQ ID NO: 2208823 - RNA, 15 nt, Human
ggcugagcucucugu

SEQ ID NO: 2208824 - RNA, 22 nt, Human
ggcugagccccuaccccacacc

SEQ ID NO: 2208825 - RNA, 19 nt, Human
ggcugagcggaugcaucug

SEQ ID NO: 2208826 - RNA, 15 nt, Human
ggcugaggugggagg

SEQ ID NO: 2208827 - RNA, 13 nt, Human
ggcugagguggga

SEQ ID NO: 2208828 - RNA, 13 nt, Human
ggcugggcagcug

SEQ ID NO: 2208829 - RNA, 14 nt, Human
ggcugggcagcugu

SEQ ID NO: 2208830 - RNA, 13 nt, Human
ggcugggcagcua

SEQ ID NO: 2208831 - RNA, 15 nt, Human
ggcuggacguggugg

SEQ ID NO: 2208832 - RNA, 12 nt, Human
ggcugggcagcu

SEQ ID NO: 2208833 - RNA, 22 nt, Human
ggcuggaccuauguccuaagga

SEQ ID NO: 2208834 - RNA, 18 nt, Human
ggcugggagagccuucca

SEQ ID NO: 2208835 - RNA, 15 nt, Human
ggcugggcagaggaa

SEQ ID NO: 2208836 - RNA, 19 nt, Human
ggcugggcagaggaaagca

SEQ ID NO: 2208837 - RNA, 13 nt, Human
ggcugggcagagg

SEQ ID NO: 2208838 - RNA, 14 nt, Human
ggcugggcagagga

SEQ ID NO: 2208839 - RNA, 20 nt, Human
ggcugggagagccuuccagg

SEQ ID NO: 2208840 - RNA, 23 nt, Human
ggcugggagagccuuccaggggu

SEQ ID NO: 2208841 - RNA, 13 nt, Human
ggcuggaaucugg

SEQ ID NO: 2208842 - RNA, 19 nt, Human
ggcuggaagauccugcggg

SEQ ID NO: 2208843 - RNA, 14 nt, Human
ggcuggaaucugga

SEQ ID NO: 2208844 - RNA, 16 nt, Human
ggcuggaaucuggaga

SEQ ID NO: 2208845 - RNA, 18 nt, Human
ggcuggaaucuggagagc

SEQ ID NO: 2208846 - RNA, 19 nt, Human
ggcuggaaucuggagagcu

SEQ ID NO: 2208847 - RNA, 23 nt, Human
ggcuggaacagauucacacuguc

SEQ ID NO: 2208848 - RNA, 15 nt, Human
ggcuggaagauccug

SEQ ID NO: 2208849 - RNA, 22 nt, Human
ggcuggaagauccugcgggugg

SEQ ID NO: 2208850 - RNA, 19 nt, Human
ggcugggagagccuuccag

SEQ ID NO: 2208851 - RNA, 20 nt, Human
ggcuggaaucuggagagcua

SEQ ID NO: 2208852 - RNA, 16 nt, Human
ggcuggaccuaugucc

SEQ ID NO: 2208853 - RNA, 23 nt, Human
ggcugcuucaaggauccugagcc

SEQ ID NO: 2208854 - RNA, 14 nt, Human
ggcugcuuagaauc

SEQ ID NO: 2208855 - RNA, 17 nt, Human
ggcugcugugugccuuc

SEQ ID NO: 2208856 - RNA, 13 nt, Human
ggcugcuuccucc

SEQ ID NO: 2208857 - RNA, 15 nt, Human
ggcugcuuuccaaag

SEQ ID NO: 2208858 - RNA, 19 nt, Human
ggcugcuuccuccuggaaa

SEQ ID NO: 2208859 - RNA, 14 nt, Human
ggcugcuuggccuu

SEQ ID NO: 2208860 - RNA, 22 nt, Human
ggcuggaacagauucacacugu

SEQ ID NO: 2208861 - RNA, 15 nt, Human
ggcugcuuccuccug

SEQ ID NO: 2208862 - RNA, 16 nt, Human
ggcugcuuccuccugg

SEQ ID NO: 2208863 - RNA, 17 nt, Human
ggcugcuuccuccugga

SEQ ID NO: 2208864 - RNA, 18 nt, Human
ggcugcuuccuccuggaa

SEQ ID NO: 2208865 - RNA, 16 nt, Human
ggcugcuggaggaaaa

SEQ ID NO: 2208866 - RNA, 13 nt, Human
ggcugcuggccug

SEQ ID NO: 2208867 - RNA, 15 nt, Human
ggcugcuggaggaaa

SEQ ID NO: 2208868 - RNA, 14 nt, Human
ggcugcuggaggaa

SEQ ID NO: 2208869 - RNA, 13 nt, Human
ggcugcuggagga

SEQ ID NO: 2208870 - RNA, 12 nt, Human
ggcugcuggagg

SEQ ID NO: 2208871 - RNA, 15 nt, Human
ggcugcugugugccu

SEQ ID NO: 2208872 - RNA, 14 nt, Human
ggcugcuggcgccu

SEQ ID NO: 2208873 - RNA, 18 nt, Human
ggcugcuggcgccucugc

SEQ ID NO: 2208874 - RNA, 19 nt, Human
ggcugcuggcgccucugca

SEQ ID NO: 2208875 - RNA, 18 nt, Human
ggcugcugcccccacccc

SEQ ID NO: 2208876 - RNA, 10 nt, Human
ggcugcugcc

SEQ ID NO: 2208877 - RNA, 11 nt, Human
ggcugcugccc

SEQ ID NO: 2208878 - RNA, 12 nt, Human
ggcugcugccca

SEQ ID NO: 2208879 - RNA, 14 nt, Human
ggcugcugcccagg

SEQ ID NO: 2208880 - RNA, 13 nt, Human
ggcugcugccccc

SEQ ID NO: 2208881 - RNA, 17 nt, Human
ggcugcugcccccaccc

SEQ ID NO: 2208882 - RNA, 11 nt, Human
ggcugcuucaa

SEQ ID NO: 2208883 - RNA, 12 nt, Human
ggcugcuucaag

SEQ ID NO: 2208884 - RNA, 14 nt, Human
ggcugcuucaagga

SEQ ID NO: 2208885 - RNA, 22 nt, Human
ggcugcuucaaggauccugagc

SEQ ID NO: 2208886 - RNA, 21 nt, Human
ggcugcugaccuccacagcuu

SEQ ID NO: 2208887 - RNA, 16 nt, Human
ggcugcugaccuccac

SEQ ID NO: 2208888 - RNA, 18 nt, Human
ggcugcugaaggcucgag

SEQ ID NO: 2208889 - RNA, 15 nt, Human
ggcugcugaaggcuc

SEQ ID NO: 2208890 - RNA, 17 nt, Human
ggcugcugaaggcucga

SEQ ID NO: 2208891 - RNA, 12 nt, Human
ggcugcagggag

SEQ ID NO: 2208892 - RNA, 13 nt, Human
ggcugcagggagu

SEQ ID NO: 2208893 - RNA, 14 nt, Human
ggcugcugaaggcu

SEQ ID NO: 2208894 - RNA, 23 nt, Human
gggaccucucccagggucccugg

SEQ ID NO: 2208895 - RNA, 16 nt, Human
gggaccucucccaggg

SEQ ID NO: 2208896 - RNA, 12 nt, Human
gggaccucuccc

SEQ ID NO: 2208897 - RNA, 19 nt, Human
gggacguggcucagccagc

SEQ ID NO: 2208898 - RNA, 22 nt, Human
gggaccuccccugaggcucagg

SEQ ID NO: 2208899 - RNA, 20 nt, Human
gggacguggcucagccagca

SEQ ID NO: 2208900 - RNA, 22 nt, Human
gggacguggcucagccagcacu

SEQ ID NO: 2208901 - RNA, 17 nt, Human
gggacuacaggcaccca

SEQ ID NO: 2208902 - RNA, 16 nt, Human
gggacucaaugcacug

SEQ ID NO: 2208903 - RNA, 18 nt, Human
gggaccgguacagaaagg

SEQ ID NO: 2208904 - RNA, 23 nt, Human
gggaccgccagauggggccucug

SEQ ID NO: 2208905 - RNA, 12 nt, Human
gggaccucaggc

SEQ ID NO: 2208906 - RNA, 13 nt, Human
gggaccucaggcc

SEQ ID NO: 2208907 - RNA, 15 nt, Human
gggaccucaggccug

SEQ ID NO: 2208908 - RNA, 18 nt, Human
gggaauugugugauguuu

SEQ ID NO: 2208909 - RNA, 12 nt, Human
gggaauuuccuc

SEQ ID NO: 2208910 - RNA, 13 nt, Human
gggaauuuccucu

SEQ ID NO: 2208911 - RNA, 18 nt, Human
gggacaaaacccaccuug

SEQ ID NO: 2208912 - RNA, 23 nt, Human
gggacaaggacuaggguccuggg

SEQ ID NO: 2208913 - RNA, 15 nt, Human
gggaauggcagcugc

SEQ ID NO: 2208914 - RNA, 21 nt, Human
gggaauguauuauucugcagc

SEQ ID NO: 2208915 - RNA, 22 nt, Human
gggaauugaggucugcucggcc

SEQ ID NO: 2208916 - RNA, 14 nt, Human
gggaauugugugau

SEQ ID NO: 2208917 - RNA, 20 nt, Human
gggaauguauuauucugcag

SEQ ID NO: 2208918 - RNA, 21 nt, Human
gggaauguaacugcugaaaac

SEQ ID NO: 2208919 - RNA, 17 nt, Human
gggaauuucuucaacuc

SEQ ID NO: 2208920 - RNA, 16 nt, Human
gggacccuuuccuucc

SEQ ID NO: 2208921 - RNA, 23 nt, Human
gggacccugugacauggugccug

SEQ ID NO: 2208922 - RNA, 20 nt, Human
gggacccuaagacuccucgg

SEQ ID NO: 2208923 - RNA, 13 nt, Human
gggaccccuccuc

SEQ ID NO: 2208924 - RNA, 14 nt, Human
gggaccccugagcu

SEQ ID NO: 2208925 - RNA, 20 nt, Human
gggaccccuggugguucacu

SEQ ID NO: 2208926 - RNA, 18 nt, Human
gggacaaguggacucagg

SEQ ID NO: 2208927 - RNA, 20 nt, Human
gggaccccgagccuggcucc

SEQ ID NO: 2208928 - RNA, 18 nt, Human
gggaccccgagccuggcu

SEQ ID NO: 2208929 - RNA, 18 nt, Human
gggaaggggacccccgcc

SEQ ID NO: 2208930 - RNA, 16 nt, Human
gggaagggccagucug

SEQ ID NO: 2208931 - RNA, 22 nt, Human
gggaagggccagucugggcugc

SEQ ID NO: 2208932 - RNA, 17 nt, Human
gggaagggggcugggac

SEQ ID NO: 2208933 - RNA, 14 nt, Human
gggaagggggcugg

SEQ ID NO: 2208934 - RNA, 16 nt, Human
gggaagggggcuggga

SEQ ID NO: 2208935 - RNA, 16 nt, Human
gggaauggcacagccc

SEQ ID NO: 2208936 - RNA, 22 nt, Human
gggaauggcacagcccaaagaa

SEQ ID NO: 2208937 - RNA, 21 nt, Human
gggaaugaggcuugcugagag

SEQ ID NO: 2208938 - RNA, 17 nt, Human
gggaaugccugagugcc

SEQ ID NO: 2208939 - RNA, 21 nt, Human
gggaaugccugagugccuggc

SEQ ID NO: 2208940 - RNA, 14 nt, Human
gggaaugaaccugg

SEQ ID NO: 2208941 - RNA, 16 nt, Human
gggaaugaaccuggag

SEQ ID NO: 2208942 - RNA, 14 nt, Human
gggaaugaagcuug

SEQ ID NO: 2208943 - RNA, 24 nt, Human
gggaaugaagcuuguguauccauu

SEQ ID NO: 2208944 - RNA, 14 nt, Human
gggaaugaggcuug

SEQ ID NO: 2208945 - RNA, 20 nt, Human
gggaaugaggcuugcugaga

SEQ ID NO: 2208946 - RNA, 12 nt, Human
gggaaggucacc

SEQ ID NO: 2208947 - RNA, 21 nt, Human
gggaaggugggguccuggagc

SEQ ID NO: 2208948 - RNA, 14 nt, Human
gggaaguccccagg

SEQ ID NO: 2208949 - RNA, 19 nt, Human
gggaaggucaccagcacca

SEQ ID NO: 2208950 - RNA, 23 nt, Human
gggaaguccccgaguuuccccag

SEQ ID NO: 2208951 - RNA, 12 nt, Human
ggcuuucuggag

SEQ ID NO: 2208952 - RNA, 12 nt, Human
gggaaggccagc

SEQ ID NO: 2208953 - RNA, 22 nt, Human
gggaaggcagggagggccuggg

SEQ ID NO: 2208954 - RNA, 16 nt, Human
gggaagggagagcggg

SEQ ID NO: 2208955 - RNA, 13 nt, Human
gggaagggagagc

SEQ ID NO: 2208956 - RNA, 12 nt, Human
gggaagggccag

SEQ ID NO: 2208957 - RNA, 13 nt, Human
gggaagggccagu

SEQ ID NO: 2208958 - RNA, 19 nt, Human
gggaaggccccacagacaa

SEQ ID NO: 2208959 - RNA, 14 nt, Human
gggaagggacacac

SEQ ID NO: 2208960 - RNA, 23 nt, Human
gggaaggauacaaaagcauguga

SEQ ID NO: 2208961 - RNA, 21 nt, Human
gggaaggauacaaaagcaugu

SEQ ID NO: 2208962 - RNA, 14 nt, Human
ggcuuuugugcauu

SEQ ID NO: 2208963 - RNA, 19 nt, Human
ggcuuaagaaaucuaguau

SEQ ID NO: 2208964 - RNA, 16 nt, Human
ggcuuaaugcuucuuu

SEQ ID NO: 2208965 - RNA, 12 nt, Human
ggcuuaauguuu

SEQ ID NO: 2208966 - RNA, 14 nt, Human
ggcuuaauguuuau

SEQ ID NO: 2208967 - RNA, 16 nt, Human
ggcuuaauguuuauuc

SEQ ID NO: 2208968 - RNA, 15 nt, Human
ggcuuaaaacaacac

SEQ ID NO: 2208969 - RNA, 13 nt, Human
ggcugggcuucag

SEQ ID NO: 2208970 - RNA, 17 nt, Human
ggcugggcuucaguggc

SEQ ID NO: 2208971 - RNA, 14 nt, Human
ggcugggcccagaa

SEQ ID NO: 2208972 - RNA, 17 nt, Human
ggcugggcucccuuccc

SEQ ID NO: 2208973 - RNA, 18 nt, Human
ggcugggcucccuuccca

SEQ ID NO: 2208974 - RNA, 12 nt, Human
ggcugggcuuca

SEQ ID NO: 2208975 - RNA, 13 nt, Human
ggcuuacacccac

SEQ ID NO: 2208976 - RNA, 17 nt, Human
ggcuuacacguggagga

SEQ ID NO: 2208977 - RNA, 22 nt, Human
ggcuuacuacaugugggagcuu

SEQ ID NO: 2208978 - RNA, 21 nt, Human
ggcuuagucacugagacagcc

SEQ ID NO: 2208979 - RNA, 22 nt, Human
ggcuuaguuuguguguugucuc

SEQ ID NO: 2208980 - RNA, 16 nt, Human
ggcuuauccagcuggu

SEQ ID NO: 2208981 - RNA, 22 nt, Human
ggcuucaaccuugagacagcuu

SEQ ID NO: 2208982 - RNA, 12 nt, Human
ggcuugaagcca

SEQ ID NO: 2208983 - RNA, 13 nt, Human
ggcuugaagccaa

SEQ ID NO: 2208984 - RNA, 15 nt, Human
ggcuugaagccaaag

SEQ ID NO: 2208985 - RNA, 20 nt, Human
ggcuugagcccccgcgccca

SEQ ID NO: 2208986 - RNA, 21 nt, Human
ggcuugagaaauauggacacu

SEQ ID NO: 2208987 - RNA, 20 nt, Human
ggcuugaagccaaagaaaaa

SEQ ID NO: 2208988 - RNA, 19 nt, Human
ggcuuuucacugcuggcug

SEQ ID NO: 2208989 - RNA, 22 nt, Human
ggcuuuucacugcuggcugccu

SEQ ID NO: 2208990 - RNA, 15 nt, Human
ggcuuuucucagcug

SEQ ID NO: 2208991 - RNA, 14 nt, Human
ggcuuuucucagcu

SEQ ID NO: 2208992 - RNA, 10 nt, Human
ggcuuuugug

SEQ ID NO: 2208993 - RNA, 14 nt, Human
ggcuuuucacugcu

SEQ ID NO: 2208994 - RNA, 13 nt, Human
ggcuuuucacugc

SEQ ID NO: 2208995 - RNA, 16 nt, Human
ggcuuucccuuaucaa

SEQ ID NO: 2208996 - RNA, 15 nt, Human
ggcuuuucacugcug

SEQ ID NO: 2208997 - RNA, 17 nt, Human
ggcuuuucacugcuggc

SEQ ID NO: 2208998 - RNA, 11 nt, Human
ggcuuucaugu

SEQ ID NO: 2208999 - RNA, 22 nt, Human
ggcuuucauuauuaguacugcu

SEQ ID NO: 2209000 - RNA, 15 nt, Human
ggcuuguaacuccac

SEQ ID NO: 2209001 - RNA, 15 nt, Human
ggcuuggggcuuccu

SEQ ID NO: 2209002 - RNA, 18 nt, Human
ggcuuguaacuccaccaa

SEQ ID NO: 2209003 - RNA, 17 nt, Human
ggcuuguaacuccacca

SEQ ID NO: 2209004 - RNA, 17 nt, Human
ggcuugucagagcuggg

SEQ ID NO: 2209005 - RNA, 16 nt, Human
ggcuugucagagcugg

SEQ ID NO: 2209006 - RNA, 15 nt, Human
ggcuugucagagcug

SEQ ID NO: 2209007 - RNA, 16 nt, Human
ggcuuguguguuucac

SEQ ID NO: 2209008 - RNA, 13 nt, Human
ggcuuuagacacu

SEQ ID NO: 2209009 - RNA, 14 nt, Human
ggcuuuauccucuu

SEQ ID NO: 2209010 - RNA, 15 nt, Human
ggcuuuauccucuuu

SEQ ID NO: 2209011 - RNA, 18 nt, Human
ggcuuuauccucuuuaga

SEQ ID NO: 2209012 - RNA, 20 nt, Human
ggcuuuauccucuuuagagu

SEQ ID NO: 2209013 - RNA, 21 nt, Human
ggcuuuauccucuuuagaguu

SEQ ID NO: 2209014 - RNA, 23 nt, Human
ggcuugcaaguauguuuuagcau

SEQ ID NO: 2209015 - RNA, 16 nt, Human
ggcuugaagccaaaga

SEQ ID NO: 2209016 - RNA, 22 nt, Human
ggcuuggggcucacacaccugu

SEQ ID NO: 2209017 - RNA, 19 nt, Human
ggcuuggggaccagagcug

SEQ ID NO: 2209018 - RNA, 21 nt, Human
ggcuuggggaccagagcugcc

SEQ ID NO: 2209019 - RNA, 22 nt, Human
ggcuugaguuuaaauuguaaua

SEQ ID NO: 2209020 - RNA, 20 nt, Human
gggcagggcaucuccugugc

SEQ ID NO: 2209021 - RNA, 14 nt, Human
gggcagggcaugac

SEQ ID NO: 2209022 - RNA, 11 nt, Human
gggcagagcag

SEQ ID NO: 2209023 - RNA, 19 nt, Human
gggcagaagggagaaggau

SEQ ID NO: 2209024 - RNA, 16 nt, Human
gggcagaagggagaag

SEQ ID NO: 2209025 - RNA, 18 nt, Human
gggcagaagggagaagga

SEQ ID NO: 2209026 - RNA, 12 nt, Human
gggcagagcaga

SEQ ID NO: 2209027 - RNA, 17 nt, Human
gggcaggugggagcuug

SEQ ID NO: 2209028 - RNA, 16 nt, Human
gggcaggugguggcac

SEQ ID NO: 2209029 - RNA, 18 nt, Human
gggcaggugguggcacug

SEQ ID NO: 2209030 - RNA, 13 nt, Human
gggcaggugggag

SEQ ID NO: 2209031 - RNA, 14 nt, Human
gggcagggugaccc

SEQ ID NO: 2209032 - RNA, 17 nt, Human
gggcagguugguggggg

SEQ ID NO: 2209033 - RNA, 22 nt, Human
gggcaggugguggcacugagcc

SEQ ID NO: 2209034 - RNA, 20 nt, Human
gggcaguagaaggucggagg

SEQ ID NO: 2209035 - RNA, 22 nt, Human
gggcagaacagccgcuccuguc

SEQ ID NO: 2209036 - RNA, 22 nt, Human
gggcagaacacuaaccugaccg

SEQ ID NO: 2209037 - RNA, 14 nt, Human
gggcagaagggaga

SEQ ID NO: 2209038 - RNA, 15 nt, Human
gggcagaaaguggcc

SEQ ID NO: 2209039 - RNA, 14 nt, Human
gggcagaacacuaa

SEQ ID NO: 2209040 - RNA, 22 nt, Human
gggcacuuuuuaauucaccaaa

SEQ ID NO: 2209041 - RNA, 23 nt, Human
gggcacuuuuuaauucaccaaag

SEQ ID NO: 2209042 - RNA, 18 nt, Human
gggcagaaggaagacuuc

SEQ ID NO: 2209043 - RNA, 17 nt, Human
gggcacuucacagagug

SEQ ID NO: 2209044 - RNA, 18 nt, Human
gggcacuucacagagugu

SEQ ID NO: 2209045 - RNA, 14 nt, Human
gggcacuucacaga

SEQ ID NO: 2209046 - RNA, 15 nt, Human
gggcacuucacagag

SEQ ID NO: 2209047 - RNA, 16 nt, Human
gggcacuucacagagu

SEQ ID NO: 2209048 - RNA, 14 nt, Human
gggcagaaggaaga

SEQ ID NO: 2209049 - RNA, 20 nt, Human
gggcacucagaagacacuga

SEQ ID NO: 2209050 - RNA, 18 nt, Human
gggcaccuggggaguggg

SEQ ID NO: 2209051 - RNA, 17 nt, Human
gggcacgcugugggcag

SEQ ID NO: 2209052 - RNA, 18 nt, Human
gggcacgcugugggcagg

SEQ ID NO: 2209053 - RNA, 13 nt, Human
gggcacugguggc

SEQ ID NO: 2209054 - RNA, 16 nt, Human
gggcacugguggcccg

SEQ ID NO: 2209055 - RNA, 13 nt, Human
gggcacugcuggg

SEQ ID NO: 2209056 - RNA, 14 nt, Human
gggcacugcugggu

SEQ ID NO: 2209057 - RNA, 16 nt, Human
gggcacugcugggugg

SEQ ID NO: 2209058 - RNA, 20 nt, Human
gggcacugcuggguggccca

SEQ ID NO: 2209059 - RNA, 21 nt, Human
gggcacugcuggguggcccau

SEQ ID NO: 2209060 - RNA, 22 nt, Human
gggcacugcuggguggcccauc

SEQ ID NO: 2209061 - RNA, 14 nt, Human
gggcacuggagcug

SEQ ID NO: 2209062 - RNA, 12 nt, Human
gggcacccaccc

SEQ ID NO: 2209063 - RNA, 19 nt, Human
gggcaccuauagucccagc

SEQ ID NO: 2209064 - RNA, 14 nt, Human
gggcaccggggccu

SEQ ID NO: 2209065 - RNA, 16 nt, Human
gggcacucagaagaca

SEQ ID NO: 2209066 - RNA, 19 nt, Human
gggcacucagaagacacug

SEQ ID NO: 2209067 - RNA, 16 nt, Human
gggcacagggucucua

SEQ ID NO: 2209068 - RNA, 13 nt, Human
gggcacagggucu

SEQ ID NO: 2209069 - RNA, 23 nt, Human
gggcacaugcugagucucccaag

SEQ ID NO: 2209070 - RNA, 20 nt, Human
gggcacaugcugagucuccc

SEQ ID NO: 2209071 - RNA, 22 nt, Human
gggcacaugcugagucucccaa

SEQ ID NO: 2209072 - RNA, 18 nt, Human
gggcaccagggguuucuc

SEQ ID NO: 2209073 - RNA, 20 nt, Human
gggcaccagggguuucucgc

SEQ ID NO: 2209074 - RNA, 19 nt, Human
gggcacacgccucccacug

SEQ ID NO: 2209075 - RNA, 18 nt, Human
gggcacagaaaauggaag

SEQ ID NO: 2209076 - RNA, 15 nt, Human
gggcacacgccuccc

SEQ ID NO: 2209077 - RNA, 12 nt, Human
gggcacacacug

SEQ ID NO: 2209078 - RNA, 13 nt, Human
gggcacacacugu

SEQ ID NO: 2209079 - RNA, 23 nt, Human
gggcacaccgggcacucagaaga

SEQ ID NO: 2209080 - RNA, 20 nt, Human
gggcacagaaaauggaagac

SEQ ID NO: 2209081 - RNA, 21 nt, Human
gggcacagaaaauggaagaca

SEQ ID NO: 2209082 - RNA, 16 nt, Human
gggaguuaagaccugg

SEQ ID NO: 2209083 - RNA, 15 nt, Human
gggaguuaagaccug

SEQ ID NO: 2209084 - RNA, 21 nt, Human
gggagugggacagagucuggg

SEQ ID NO: 2209085 - RNA, 19 nt, Human
gggagugagacagaaguaa

SEQ ID NO: 2209086 - RNA, 11 nt, Human
gggagugugua

SEQ ID NO: 2209087 - RNA, 22 nt, Human
gggaguugucaagucucugcug

SEQ ID NO: 2209088 - RNA, 21 nt, Human
gggaguuucuuuccugccuuc

SEQ ID NO: 2209089 - RNA, 20 nt, Human
gggaguucgagaccaaccug

SEQ ID NO: 2209090 - RNA, 23 nt, Human
gggaguuaagaccuggcagcucu

SEQ ID NO: 2209091 - RNA, 20 nt, Human
gggaguuaagaccuggcagc

SEQ ID NO: 2209092 - RNA, 17 nt, Human
gggaguuaagaccuggc

SEQ ID NO: 2209093 - RNA, 14 nt, Human
gggagguggcuggg

SEQ ID NO: 2209094 - RNA, 23 nt, Human
gggagguggaagaagggagaaga

SEQ ID NO: 2209095 - RNA, 18 nt, Human
gggagugacagaggcagc

SEQ ID NO: 2209096 - RNA, 11 nt, Human
gggagugagcu

SEQ ID NO: 2209097 - RNA, 14 nt, Human
gggagugagcuggu

SEQ ID NO: 2209098 - RNA, 19 nt, Human
gggacugaaaaccucuccu

SEQ ID NO: 2209099 - RNA, 18 nt, Human
gggacugaaaaccucucc

SEQ ID NO: 2209100 - RNA, 18 nt, Human
gggacugaagccaaaguu

SEQ ID NO: 2209101 - RNA, 15 nt, Human
gggacugaagccaaa

SEQ ID NO: 2209102 - RNA, 15 nt, Human
gggaggucgagguag

SEQ ID NO: 2209103 - RNA, 16 nt, Human
gggaggugaccccagg

SEQ ID NO: 2209104 - RNA, 16 nt, Human
gggaggucgagguagg

SEQ ID NO: 2209105 - RNA, 17 nt, Human
gggaggugggauccucc

SEQ ID NO: 2209106 - RNA, 15 nt, Human
gggacuaugaauggg

SEQ ID NO: 2209107 - RNA, 17 nt, Human
gggacucagcccugagg

SEQ ID NO: 2209108 - RNA, 22 nt, Human
gggacucagccuucagacagag

SEQ ID NO: 2209109 - RNA, 16 nt, Human
gggacucagcccugag

SEQ ID NO: 2209110 - RNA, 15 nt, Human
gggacuagccccugu

SEQ ID NO: 2209111 - RNA, 20 nt, Human
gggacucugaagccucuggg

SEQ ID NO: 2209112 - RNA, 19 nt, Human
gggacucugaagccucugg

SEQ ID NO: 2209113 - RNA, 13 nt, Human
gggacugagaaau

SEQ ID NO: 2209114 - RNA, 21 nt, Human
gggcaagaagaucacgcuccc

SEQ ID NO: 2209115 - RNA, 13 nt, Human
gggcaaggagacc

SEQ ID NO: 2209116 - RNA, 13 nt, Human
gggcaagggccau

SEQ ID NO: 2209117 - RNA, 20 nt, Human
gggcaagaagaucacgcucc

SEQ ID NO: 2209118 - RNA, 11 nt, Human
gggaugaaaga

SEQ ID NO: 2209119 - RNA, 15 nt, Human
gggaugaaagagaag

SEQ ID NO: 2209120 - RNA, 17 nt, Human
gggaucugugcccagag

SEQ ID NO: 2209121 - RNA, 18 nt, Human
gggaucuugcauucccag

SEQ ID NO: 2209122 - RNA, 23 nt, Human
gggaucugguccuacccaucccc

SEQ ID NO: 2209123 - RNA, 19 nt, Human
gggaucugguccuacccau

SEQ ID NO: 2209124 - RNA, 24 nt, Human
gggcaagucccugacucucuguga

SEQ ID NO: 2209125 - RNA, 20 nt, Human
gggcaacccccagccugcua

SEQ ID NO: 2209126 - RNA, 18 nt, Human
gggcaacccuggugacca

SEQ ID NO: 2209127 - RNA, 23 nt, Human
gggauccuggaguucugguuccu

SEQ ID NO: 2209128 - RNA, 20 nt, Human
gggaucccucccccccaugc

SEQ ID NO: 2209129 - RNA, 17 nt, Human
gggauccgacugcuuug

SEQ ID NO: 2209130 - RNA, 14 nt, Human
gggaucucaggggc

SEQ ID NO: 2209131 - RNA, 15 nt, Human
gggaucugccccucc

SEQ ID NO: 2209132 - RNA, 14 nt, Human
gggaucacagggcc

SEQ ID NO: 2209133 - RNA, 13 nt, Human
gggaucacagaga

SEQ ID NO: 2209134 - RNA, 22 nt, Human
gggaucacagagacauuccucc

SEQ ID NO: 2209135 - RNA, 22 nt, Human
gggaucaaccagcuaagaaaag

SEQ ID NO: 2209136 - RNA, 13 nt, Human
gggaucacaaggu

SEQ ID NO: 2209137 - RNA, 12 nt, Human
gggauaugcuua

SEQ ID NO: 2209138 - RNA, 16 nt, Human
gggauauaggagagga

SEQ ID NO: 2209139 - RNA, 15 nt, Human
gggauccuccaggug

SEQ ID NO: 2209140 - RNA, 16 nt, Human
gggauccuccaggugc

SEQ ID NO: 2209141 - RNA, 15 nt, Human
gggauauaggagagg

SEQ ID NO: 2209142 - RNA, 16 nt, Human
gggauagcacugagca

SEQ ID NO: 2209143 - RNA, 14 nt, Human
gggauagaugugug

SEQ ID NO: 2209144 - RNA, 21 nt, Human
gggauaugauuuaaaucagcc

SEQ ID NO: 2209145 - RNA, 23 nt, Human
gggaguucgagaccaaccugacc

SEQ ID NO: 2209146 - RNA, 13 nt, Human
gggauacaugcuc

SEQ ID NO: 2209147 - RNA, 15 nt, Human
gggauacaugcucuu

SEQ ID NO: 2209148 - RNA, 13 nt, Human
gggauacugcagg

SEQ ID NO: 2209149 - RNA, 13 nt, Human
gggauagaugugu

SEQ ID NO: 2209150 - RNA, 13 nt, Human
gggauagagagag

SEQ ID NO: 2209151 - RNA, 19 nt, Human
gggccaccuccccaggccg

SEQ ID NO: 2209152 - RNA, 22 nt, Human
gggccaccuccccaggccgugg

SEQ ID NO: 2209153 - RNA, 14 nt, Human
gggccacgugccag

SEQ ID NO: 2209154 - RNA, 15 nt, Human
gggccaccuccccag

SEQ ID NO: 2209155 - RNA, 16 nt, Human
gggccaccuccccagg

SEQ ID NO: 2209156 - RNA, 17 nt, Human
gggccaccuccccaggc

SEQ ID NO: 2209157 - RNA, 19 nt, Human
gggccacagggcgagacuc

SEQ ID NO: 2209158 - RNA, 19 nt, Human
gggccacaugggaggcuca

SEQ ID NO: 2209159 - RNA, 23 nt, Human
gggccacagagaaaguacuucuc

SEQ ID NO: 2209160 - RNA, 15 nt, Human
gggccacacagaaac

SEQ ID NO: 2209161 - RNA, 13 nt, Human
gggccaaggacug

SEQ ID NO: 2209162 - RNA, 17 nt, Human
gggccaagacuuggcaa

SEQ ID NO: 2209163 - RNA, 16 nt, Human
gggccacagagaaagu

SEQ ID NO: 2209164 - RNA, 16 nt, Human
gggccaacaccaggga

SEQ ID NO: 2209165 - RNA, 22 nt, Human
gggccaacuugagggcccagag

SEQ ID NO: 2209166 - RNA, 15 nt, Human
gggccaacaccaggg

SEQ ID NO: 2209167 - RNA, 11 nt, Human
gggccaacacc

SEQ ID NO: 2209168 - RNA, 13 nt, Human
gggccaagaaaga

SEQ ID NO: 2209169 - RNA, 23 nt, Human
gggccaacuugagggcccagagc

SEQ ID NO: 2209170 - RNA, 13 nt, Human
gggccaagcccag

SEQ ID NO: 2209171 - RNA, 14 nt, Human
gggcauugcuuucc

SEQ ID NO: 2209172 - RNA, 23 nt, Human
gggcauugauggggaaggaggcu

SEQ ID NO: 2209173 - RNA, 18 nt, Human
gggcauugauggggaagg

SEQ ID NO: 2209174 - RNA, 14 nt, Human
gggcccagauucua

SEQ ID NO: 2209175 - RNA, 13 nt, Human
gggcccagaucug

SEQ ID NO: 2209176 - RNA, 11 nt, Human
gggcccagccc

SEQ ID NO: 2209177 - RNA, 12 nt, Human
gggcccagcccc

SEQ ID NO: 2209178 - RNA, 13 nt, Human
gggcccagccccc

SEQ ID NO: 2209179 - RNA, 19 nt, Human
gggcccagagcccagcucc

SEQ ID NO: 2209180 - RNA, 17 nt, Human
gggcccagagcccagcu

SEQ ID NO: 2209181 - RNA, 20 nt, Human
gggcccagagcccagcucca

SEQ ID NO: 2209182 - RNA, 14 nt, Human
gggcccagagcagg

SEQ ID NO: 2209183 - RNA, 16 nt, Human
gggcccagagcccagc

SEQ ID NO: 2209184 - RNA, 15 nt, Human
gggcccagagcccag

SEQ ID NO: 2209185 - RNA, 13 nt, Human
gggcccagagccc

SEQ ID NO: 2209186 - RNA, 12 nt, Human
gggcccagagcc

SEQ ID NO: 2209187 - RNA, 11 nt, Human
gggcccagagc

SEQ ID NO: 2209188 - RNA, 22 nt, Human
gggcccaccuggccaccugagg

SEQ ID NO: 2209189 - RNA, 12 nt, Human
gggcccagagca

SEQ ID NO: 2209190 - RNA, 15 nt, Human
gggcccaccuggcca

SEQ ID NO: 2209191 - RNA, 16 nt, Human
gggcccaccuggccac

SEQ ID NO: 2209192 - RNA, 18 nt, Human
gggcccaccuggccaccu

SEQ ID NO: 2209193 - RNA, 19 nt, Human
gggcccaccuggccaccug

SEQ ID NO: 2209194 - RNA, 23 nt, Human
gggcccaagacagaugccccaga

SEQ ID NO: 2209195 - RNA, 18 nt, Human
gggcccaaggcggccccu

SEQ ID NO: 2209196 - RNA, 19 nt, Human
gggcccaaggcggccccuc

SEQ ID NO: 2209197 - RNA, 19 nt, Human
gggcccaagacagaugccc

SEQ ID NO: 2209198 - RNA, 16 nt, Human
gggccacucugccucu

SEQ ID NO: 2209199 - RNA, 15 nt, Human
gggccacucugccuc

SEQ ID NO: 2209200 - RNA, 19 nt, Human
gggccacgugccaggcccg

SEQ ID NO: 2209201 - RNA, 18 nt, Human
gggccacgugccaggccc

SEQ ID NO: 2209202 - RNA, 17 nt, Human
gggcccagagagggugg

SEQ ID NO: 2209203 - RNA, 20 nt, Human
gggcccaagucccuguuuuc

SEQ ID NO: 2209204 - RNA, 12 nt, Human
gggcccacaccc

SEQ ID NO: 2209205 - RNA, 10 nt, Human
gggcccaccu

SEQ ID NO: 2209206 - RNA, 13 nt, Human
gggcccaccuggc

SEQ ID NO: 2209207 - RNA, 14 nt, Human
gggcccaccuggcc

SEQ ID NO: 2209208 - RNA, 17 nt, Human
gggcagucuggaggggc

SEQ ID NO: 2209209 - RNA, 14 nt, Human
gggcagucuggagg

SEQ ID NO: 2209210 - RNA, 17 nt, Human
gggcagucauuauccag

SEQ ID NO: 2209211 - RNA, 15 nt, Human
gggcagucuggaggg

SEQ ID NO: 2209212 - RNA, 18 nt, Human
gggcagugggucccagau

SEQ ID NO: 2209213 - RNA, 20 nt, Human
gggcagugguguggagaagc

SEQ ID NO: 2209214 - RNA, 21 nt, Human
gggcagugguaagcucuggcu

SEQ ID NO: 2209215 - RNA, 22 nt, Human
gggcagugguaagcucuggcuu

SEQ ID NO: 2209216 - RNA, 13 nt, Human
gggcaucaugcau

SEQ ID NO: 2209217 - RNA, 13 nt, Human
gggcauccucagg

SEQ ID NO: 2209218 - RNA, 14 nt, Human
gggcaucuccagga

SEQ ID NO: 2209219 - RNA, 15 nt, Human
gggcauacuaauaaa

SEQ ID NO: 2209220 - RNA, 22 nt, Human
gggcauagaugcaggugagccc

SEQ ID NO: 2209221 - RNA, 17 nt, Human
gggcauauccaccaccu

SEQ ID NO: 2209222 - RNA, 17 nt, Human
gggcaugcuggggcaag

SEQ ID NO: 2209223 - RNA, 14 nt, Human
gggcaugcuggggc

SEQ ID NO: 2209224 - RNA, 20 nt, Human
gggcaugccccggccaccuc

SEQ ID NO: 2209225 - RNA, 22 nt, Human
gggcaugccccggccaccucug

SEQ ID NO: 2209226 - RNA, 23 nt, Human
gggcaugccccggccaccucugc

SEQ ID NO: 2209227 - RNA, 20 nt, Human
gggcaucugccccuccccca

SEQ ID NO: 2209228 - RNA, 16 nt, Human
gggcaugccccggcca

SEQ ID NO: 2209229 - RNA, 19 nt, Human
gggcaucugccccuccccc

SEQ ID NO: 2209230 - RNA, 17 nt, Human
gggcaucugccccuccc

SEQ ID NO: 2209231 - RNA, 14 nt, Human
gggcaucugccccu

SEQ ID NO: 2209232 - RNA, 12 nt, Human
gggcaugacacg

SEQ ID NO: 2209233 - RNA, 22 nt, Human
gggcauggacguucggggcaug

SEQ ID NO: 2209234 - RNA, 20 nt, Human
gggcauggacguucggggca

SEQ ID NO: 2209235 - RNA, 15 nt, Human
gggcauggccaggug

SEQ ID NO: 2209236 - RNA, 17 nt, Human
gggcauggccagguggc

SEQ ID NO: 2209237 - RNA, 20 nt, Human
gggcauggccagguggccac

SEQ ID NO: 2209238 - RNA, 16 nt, Human
gggcauggccagcagc

SEQ ID NO: 2209239 - RNA, 15 nt, Human
gggcauggggugggc

SEQ ID NO: 2209240 - RNA, 17 nt, Human
gggcauggggugggccu

SEQ ID NO: 2209241 - RNA, 20 nt, Human
gggcauggggugggccucug

SEQ ID NO: 2209242 - RNA, 18 nt, Human
gggcauguauuggccugg

SEQ ID NO: 2209243 - RNA, 21 nt, Human
gggcauggggugggccucugg

SEQ ID NO: 2209244 - RNA, 22 nt, Human
gggcauguauuggccuggaggu

SEQ ID NO: 2209245 - RNA, 19 nt, Human
gggcauguauuggccugga

SEQ ID NO: 2209246 - RNA, 20 nt, Human
gggcauguauuggccuggag

SEQ ID NO: 2209247 - RNA, 21 nt, Human
gggcauguauuggccuggagg

SEQ ID NO: 2209248 - RNA, 12 nt, Human
gggccccucugc

SEQ ID NO: 2209249 - RNA, 13 nt, Human
gggccccugccag

SEQ ID NO: 2209250 - RNA, 15 nt, Human
gggccccucugccca

SEQ ID NO: 2209251 - RNA, 16 nt, Human
gggccccucugcccag

SEQ ID NO: 2209252 - RNA, 17 nt, Human
gggccccucugcccagc

SEQ ID NO: 2209253 - RNA, 13 nt, Human
gggccccugccuc

SEQ ID NO: 2209254 - RNA, 15 nt, Human
gggccccugccucuc

SEQ ID NO: 2209255 - RNA, 17 nt, Human
gggccccugccucucug

SEQ ID NO: 2209256 - RNA, 18 nt, Human
gggccccugccucucugc

SEQ ID NO: 2209257 - RNA, 19 nt, Human
gggccccugccucucugca

SEQ ID NO: 2209258 - RNA, 21 nt, Human
gggccccugccucucugcagg

SEQ ID NO: 2209259 - RNA, 13 nt, Human
gggccccuccagc

SEQ ID NO: 2209260 - RNA, 21 nt, Human
gggccccucaucgcguccucc

SEQ ID NO: 2209261 - RNA, 14 nt, Human
gggccccuccagcu

SEQ ID NO: 2209262 - RNA, 15 nt, Human
gggccccuccagcuu

SEQ ID NO: 2209263 - RNA, 17 nt, Human
gggccccucacccugcc

SEQ ID NO: 2209264 - RNA, 19 nt, Human
gggccccucacccugccuu

SEQ ID NO: 2209265 - RNA, 21 nt, Human
gggccccccuccuugcucugc

SEQ ID NO: 2209266 - RNA, 19 nt, Human
gggccccagucagccucuc

SEQ ID NO: 2209267 - RNA, 15 nt, Human
gggccccccuccuug

SEQ ID NO: 2209268 - RNA, 17 nt, Human
gggccccccuccuugcu

SEQ ID NO: 2209269 - RNA, 19 nt, Human
gggccccccuccuugcucu

SEQ ID NO: 2209270 - RNA, 23 nt, Human
gggcccccagcgagagucccugc

SEQ ID NO: 2209271 - RNA, 17 nt, Human
gggccccagucagccuc

SEQ ID NO: 2209272 - RNA, 18 nt, Human
gggccccagucagccucu

SEQ ID NO: 2209273 - RNA, 14 nt, Human
gggcccccaucuca

SEQ ID NO: 2209274 - RNA, 12 nt, Human
gggccccagccc

SEQ ID NO: 2209275 - RNA, 13 nt, Human
gggccccagccca

SEQ ID NO: 2209276 - RNA, 14 nt, Human
gggccccagcccac

SEQ ID NO: 2209277 - RNA, 16 nt, Human
gggccccagcccaccc

SEQ ID NO: 2209278 - RNA, 18 nt, Human
gggccccagcccacccuc

SEQ ID NO: 2209279 - RNA, 17 nt, Human
gggccccagcccacccu

SEQ ID NO: 2209280 - RNA, 14 nt, Human
gggccccagucagc

SEQ ID NO: 2209281 - RNA, 13 nt, Human
gggcccaggcagg

SEQ ID NO: 2209282 - RNA, 24 nt, Human
gggcccaggaccagcuggggcgug

SEQ ID NO: 2209283 - RNA, 14 nt, Human
gggcccaggcaaau

SEQ ID NO: 2209284 - RNA, 16 nt, Human
gggcccaggaccagcu

SEQ ID NO: 2209285 - RNA, 17 nt, Human
gggcccaggaccagcug

SEQ ID NO: 2209286 - RNA, 18 nt, Human
gggcccaggaccagcugg

SEQ ID NO: 2209287 - RNA, 19 nt, Human
gggcccaggaccagcuggg

SEQ ID NO: 2209288 - RNA, 18 nt, Human
gggcccagcccccacagu

SEQ ID NO: 2209289 - RNA, 22 nt, Human
gggcccagcccccacagugcug

SEQ ID NO: 2209290 - RNA, 12 nt, Human
gggcccagcugg

SEQ ID NO: 2209291 - RNA, 15 nt, Human
gggcccagcugggcu

SEQ ID NO: 2209292 - RNA, 16 nt, Human
gggcccagcugggcuc

SEQ ID NO: 2209293 - RNA, 21 nt, Human
gggcccagcugggcucugcca

SEQ ID NO: 2209294 - RNA, 9 nt, Human
gggcccagg

SEQ ID NO: 2209295 - RNA, 14 nt, Human
gggcccaggaccag

SEQ ID NO: 2209296 - RNA, 22 nt, Human
gggccccaaacgggcugcccug

SEQ ID NO: 2209297 - RNA, 20 nt, Human
gggcccaggccaucuuccag

SEQ ID NO: 2209298 - RNA, 11 nt, Human
gggcccaggga

SEQ ID NO: 2209299 - RNA, 18 nt, Human
gggcccagggacaccagc

SEQ ID NO: 2209300 - RNA, 22 nt, Human
gggcccagggacaccagccagg

SEQ ID NO: 2209301 - RNA, 15 nt, Human
gggccccaccaccua

SEQ ID NO: 2209302 - RNA, 18 nt, Human
gggccccagaaggcaggg

SEQ ID NO: 2209303 - RNA, 14 nt, Human
gggccccagaggcu

SEQ ID NO: 2209304 - RNA, 13 nt, Human
gggcccugggcug

SEQ ID NO: 2209305 - RNA, 15 nt, Human
gggcccugggcugga

SEQ ID NO: 2209306 - RNA, 13 nt, Human
gggccuggccuga

SEQ ID NO: 2209307 - RNA, 15 nt, Human
gggcccugcagaggg

SEQ ID NO: 2209308 - RNA, 13 nt, Human
gggcccugccucc

SEQ ID NO: 2209309 - RNA, 23 nt, Human
gggcccgccuggcagaacugagc

SEQ ID NO: 2209310 - RNA, 18 nt, Human
gggcccugagcugagggc

SEQ ID NO: 2209311 - RNA, 18 nt, Human
gggcccugcaccugugca

SEQ ID NO: 2209312 - RNA, 19 nt, Human
gggcccugcaccugugcag

SEQ ID NO: 2209313 - RNA, 22 nt, Human
gggcccugagcucgguggaccc

SEQ ID NO: 2209314 - RNA, 13 nt, Human
gggcccugagcuc

SEQ ID NO: 2209315 - RNA, 20 nt, Human
gggcccgccuggcagaacug

SEQ ID NO: 2209316 - RNA, 16 nt, Human
gggcccgccuggcaga

SEQ ID NO: 2209317 - RNA, 18 nt, Human
gggccccuuuuuacuccc

SEQ ID NO: 2209318 - RNA, 12 nt, Human
gggcccugagcu

SEQ ID NO: 2209319 - RNA, 22 nt, Human
gggccccugccucucugcaggu

SEQ ID NO: 2209320 - RNA, 22 nt, Human
gggccccucugcccagcuuggg

SEQ ID NO: 2209321 - RNA, 23 nt, Human
gggccccucugcccagcuugggc

SEQ ID NO: 2209322 - RNA, 21 nt, Human
gggccccugcuucuccagccu

SEQ ID NO: 2209323 - RNA, 19 nt, Human
gggccccugcuucuccagc

SEQ ID NO: 2209324 - RNA, 14 nt, Human
gggccccugggcuu

SEQ ID NO: 2209325 - RNA, 21 nt, Human
gggccccugggcuuggccugc

SEQ ID NO: 2209326 - RNA, 23 nt, Human
gggccccugggcuuggccugcug

SEQ ID NO: 2209327 - RNA, 14 nt, Human
gggcccugggcugg

SEQ ID NO: 2209328 - RNA, 14 nt, Human
gggccuggccugag

SEQ ID NO: 2209329 - RNA, 18 nt, Human
gggccuggccugagcugg

SEQ ID NO: 2209330 - RNA, 17 nt, Human
gggccuggcucaggugg

SEQ ID NO: 2209331 - RNA, 13 nt, Human
gggccuggcuccc

SEQ ID NO: 2209332 - RNA, 14 nt, Human
ggggagggugacag

SEQ ID NO: 2209333 - RNA, 20 nt, Human
ggggauucuuccaucugauu

SEQ ID NO: 2209334 - RNA, 15 nt, Human
ggggauuucucccag

SEQ ID NO: 2209335 - RNA, 14 nt, Human
ggggauuucuccca

SEQ ID NO: 2209336 - RNA, 21 nt, Human
ggggauuuccagccagggcug

SEQ ID NO: 2209337 - RNA, 18 nt, Human
ggggaggggcugugggcg

SEQ ID NO: 2209338 - RNA, 22 nt, Human
ggggagggguugccacaggccu

SEQ ID NO: 2209339 - RNA, 15 nt, Human
ggggagggggauccg

SEQ ID NO: 2209340 - RNA, 13 nt, Human
ggggaggggcgcu

SEQ ID NO: 2209341 - RNA, 16 nt, Human
ggggaggggcgcuggc

SEQ ID NO: 2209342 - RNA, 20 nt, Human
ggggaggggcgcuggcccag

SEQ ID NO: 2209343 - RNA, 15 nt, Human
ggggagggauucugg

SEQ ID NO: 2209344 - RNA, 21 nt, Human
ggggagggccguaccccaccc

SEQ ID NO: 2209345 - RNA, 21 nt, Human
ggggaaaaucagccugcucca

SEQ ID NO: 2209346 - RNA, 15 nt, Human
ggggaaaagagauga

SEQ ID NO: 2209347 - RNA, 21 nt, Human
ggggaggccaagugcaggcug

SEQ ID NO: 2209348 - RNA, 13 nt, Human
ggggaggccaagu

SEQ ID NO: 2209349 - RNA, 14 nt, Human
ggggaggcagccgg

SEQ ID NO: 2209350 - RNA, 19 nt, Human
ggggaggaucacuggagcc

SEQ ID NO: 2209351 - RNA, 22 nt, Human
ggggaggcggacguuccagccg

SEQ ID NO: 2209352 - RNA, 14 nt, Human
ggggagggauucug

SEQ ID NO: 2209353 - RNA, 19 nt, Human
ggggaaaaucagccugcuc

SEQ ID NO: 2209354 - RNA, 17 nt, Human
ggggaaaaucagccugc

SEQ ID NO: 2209355 - RNA, 16 nt, Human
ggggaaaaucagccug

SEQ ID NO: 2209356 - RNA, 15 nt, Human
gggcuuucuggagag

SEQ ID NO: 2209357 - RNA, 14 nt, Human
gggcuuucuggaga

SEQ ID NO: 2209358 - RNA, 16 nt, Human
gggccuggucccuggg

SEQ ID NO: 2209359 - RNA, 23 nt, Human
gggcuuguugcuguugauguuuu

SEQ ID NO: 2209360 - RNA, 22 nt, Human
gggcuuggggaccagagcugcc

SEQ ID NO: 2209361 - RNA, 11 nt, Human
gggccugggcc

SEQ ID NO: 2209362 - RNA, 20 nt, Human
ggggcaucugccccuccccc

SEQ ID NO: 2209363 - RNA, 14 nt, Human
ggggcaucugcccc

SEQ ID NO: 2209364 - RNA, 13 nt, Human
ggggcaguggcaa

SEQ ID NO: 2209365 - RNA, 17 nt, Human
ggggcagaacagccgcu

SEQ ID NO: 2209366 - RNA, 21 nt, Human
ggggcgcucgcuuccgcaucc

SEQ ID NO: 2209367 - RNA, 13 nt, Human
ggggcgcuggccc

SEQ ID NO: 2209368 - RNA, 14 nt, Human
ggggcgcuggccca

SEQ ID NO: 2209369 - RNA, 15 nt, Human
ggggcgcuggcccag

SEQ ID NO: 2209370 - RNA, 17 nt, Human
ggggcgcuggcccagcc

SEQ ID NO: 2209371 - RNA, 18 nt, Human
ggggcgcuggcccagccg

SEQ ID NO: 2209372 - RNA, 23 nt, Human
ggggcgcuggcccagccggccuc

SEQ ID NO: 2209373 - RNA, 17 nt, Human
ggggcagucuggagggg

SEQ ID NO: 2209374 - RNA, 13 nt, Human
ggggcagaacagc

SEQ ID NO: 2209375 - RNA, 22 nt, Human
ggggcaagaagaucacgcuccc

SEQ ID NO: 2209376 - RNA, 21 nt, Human
ggggcacaugcugagucuccc

SEQ ID NO: 2209377 - RNA, 17 nt, Human
ggggcacugcaggggcc

SEQ ID NO: 2209378 - RNA, 16 nt, Human
ggggcaacccugguga

SEQ ID NO: 2209379 - RNA, 13 nt, Human
ggggcuccuggaa

SEQ ID NO: 2209380 - RNA, 12 nt, Human
ggggcuccugga

SEQ ID NO: 2209381 - RNA, 11 nt, Human
ggggcuccugg

SEQ ID NO: 2209382 - RNA, 13 nt, Human
ggggcucccgccc

SEQ ID NO: 2209383 - RNA, 21 nt, Human
ggggcuagaaccuagagaagc

SEQ ID NO: 2209384 - RNA, 14 nt, Human
ggggcuagaaccua

SEQ ID NO: 2209385 - RNA, 16 nt, Human
ggggcuacaagaggga

SEQ ID NO: 2209386 - RNA, 17 nt, Human
ggggcuacaagagggaa

SEQ ID NO: 2209387 - RNA, 18 nt, Human
ggggcgucuguucccccu

SEQ ID NO: 2209388 - RNA, 15 nt, Human
ggggcguggggaggg

SEQ ID NO: 2209389 - RNA, 20 nt, Human
ggggcgucuguucccccuuc

SEQ ID NO: 2209390 - RNA, 14 nt, Human
ggggcuacaagagg

SEQ ID NO: 2209391 - RNA, 15 nt, Human
ggggcuacaagaggg

SEQ ID NO: 2209392 - RNA, 13 nt, Human
ggggcucuggaga

SEQ ID NO: 2209393 - RNA, 16 nt, Human
ggggcucucagcucag

SEQ ID NO: 2209394 - RNA, 20 nt, Human
ggggcucucagcucagcgcc

SEQ ID NO: 2209395 - RNA, 21 nt, Human
ggggcuccuggaaaggcucag

SEQ ID NO: 2209396 - RNA, 21 nt, Human
ggggcuccuuucuccagccag

SEQ ID NO: 2209397 - RNA, 22 nt, Human
ggggcuccuuucuccagccagc

SEQ ID NO: 2209398 - RNA, 15 nt, Human
ggggcucgccaugcc

SEQ ID NO: 2209399 - RNA, 12 nt, Human
ggggcucuggga

SEQ ID NO: 2209400 - RNA, 14 nt, Human
ggggcucuucucau

SEQ ID NO: 2209401 - RNA, 24 nt, Human
ggggcucucauguuuucaacugcc

SEQ ID NO: 2209402 - RNA, 14 nt, Human
ggggcucuggagag

SEQ ID NO: 2209403 - RNA, 16 nt, Human
ggggcucuggagagaa

SEQ ID NO: 2209404 - RNA, 17 nt, Human
ggggcucuggagagaaa

SEQ ID NO: 2209405 - RNA, 17 nt, Human
ggggcugaggugggagg

SEQ ID NO: 2209406 - RNA, 19 nt, Human
ggggcugaggugggaggau

SEQ ID NO: 2209407 - RNA, 12 nt, Human
ggggcugcaccg

SEQ ID NO: 2209408 - RNA, 21 nt, Human
ggggcugcaccggcuggccug

SEQ ID NO: 2209409 - RNA, 22 nt, Human
ggggcugcaccggcuggccugg

SEQ ID NO: 2209410 - RNA, 18 nt, Human
ggggcugaacggggagaa

SEQ ID NO: 2209411 - RNA, 18 nt, Human
ggggcucuggagagaaac

SEQ ID NO: 2209412 - RNA, 20 nt, Human
ggggcugaccuuccucgcag

SEQ ID NO: 2209413 - RNA, 23 nt, Human
ggggcugaccuuccucgcagaga

SEQ ID NO: 2209414 - RNA, 18 nt, Human
gggggacagggcuggccc

SEQ ID NO: 2209415 - RNA, 22 nt, Human
gggggacagggcuggcccagcc

SEQ ID NO: 2209416 - RNA, 23 nt, Human
ggggcugcaccggcuggccuggc

SEQ ID NO: 2209417 - RNA, 22 nt, Human
gggggaggugggauccuccagg

SEQ ID NO: 2209418 - RNA, 21 nt, Human
gggggacuuacaugauucauu

SEQ ID NO: 2209419 - RNA, 16 nt, Human
gggggacuagccccug

SEQ ID NO: 2209420 - RNA, 15 nt, Human
ggggugggagagguc

SEQ ID NO: 2209421 - RNA, 13 nt, Human
ggggugggccagg

SEQ ID NO: 2209422 - RNA, 20 nt, Human
ggggugcuuuuauagaggcu

SEQ ID NO: 2209423 - RNA, 17 nt, Human
gggguggaggcuuccug

SEQ ID NO: 2209424 - RNA, 17 nt, Human
gggguggggaccucagg

SEQ ID NO: 2209425 - RNA, 20 nt, Human
gggguggggggggugcuggg

SEQ ID NO: 2209426 - RNA, 17 nt, Human
ggggugggccaggcuga

SEQ ID NO: 2209427 - RNA, 14 nt, Human
ggggugggccaggc

SEQ ID NO: 2209428 - RNA, 14 nt, Human
ggggugggccucug

SEQ ID NO: 2209429 - RNA, 15 nt, Human
ggggugggccucugg

SEQ ID NO: 2209430 - RNA, 15 nt, Human
gggguggguauaaaa

SEQ ID NO: 2209431 - RNA, 18 nt, Human
gggguggggguggaggcu

SEQ ID NO: 2209432 - RNA, 22 nt, Human
gggggagucugaagcagaugca

SEQ ID NO: 2209433 - RNA, 17 nt, Human
gggggagucugaagcag

SEQ ID NO: 2209434 - RNA, 13 nt, Human
gggggaguggaau

SEQ ID NO: 2209435 - RNA, 12 nt, Human
gggggauaugaa

SEQ ID NO: 2209436 - RNA, 22 nt, Human
gggggagccccuucugcucagc

SEQ ID NO: 2209437 - RNA, 23 nt, Human
gggggacagggcuggcccagccc

SEQ ID NO: 2209438 - RNA, 18 nt, Human
ggggugcugggccccugc

SEQ ID NO: 2209439 - RNA, 12 nt, Human
gggguggccucc

SEQ ID NO: 2209440 - RNA, 12 nt, Human
gggucugaggaa

SEQ ID NO: 2209441 - RNA, 21 nt, Human
gggucugaggaauccagaccc

SEQ ID NO: 2209442 - RNA, 20 nt, Human
gggucucccucuccugccua

SEQ ID NO: 2209443 - RNA, 15 nt, Human
gggucucuagugcug

SEQ ID NO: 2209444 - RNA, 20 nt, Human
gggucucuagugcugugaaa

SEQ ID NO: 2209445 - RNA, 12 nt, Human
gggucucugcug

SEQ ID NO: 2209446 - RNA, 13 nt, Human
gggucucugcugc

SEQ ID NO: 2209447 - RNA, 14 nt, Human
gggucucugcugcc

SEQ ID NO: 2209448 - RNA, 15 nt, Human
gggucucugcugccg

SEQ ID NO: 2209449 - RNA, 18 nt, Human
gggucucugcugccgccc

SEQ ID NO: 2209450 - RNA, 20 nt, Human
gggucuggaguugaucugga

SEQ ID NO: 2209451 - RNA, 22 nt, Human
gggucugcucuuucucugccag

SEQ ID NO: 2209452 - RNA, 20 nt, Human
gggucugcucuuucucugcc

SEQ ID NO: 2209453 - RNA, 21 nt, Human
gggucugcucuuucucugcca

SEQ ID NO: 2209454 - RNA, 21 nt, Human
gggucugagucauggccgggu

SEQ ID NO: 2209455 - RNA, 20 nt, Human
gggucugccaccauccugcu

SEQ ID NO: 2209456 - RNA, 19 nt, Human
gggucugcucuuucucugc

SEQ ID NO: 2209457 - RNA, 22 nt, Human
gggucuggcagccucccaucca

SEQ ID NO: 2209458 - RNA, 22 nt, Human
gggucuggaguugaucuggaac

SEQ ID NO: 2209459 - RNA, 15 nt, Human
gggucuggcugagcu

SEQ ID NO: 2209460 - RNA, 13 nt, Human
gggucuguaaaau

SEQ ID NO: 2209461 - RNA, 14 nt, Human
gggucuguaaaauc

SEQ ID NO: 2209462 - RNA, 21 nt, Human
gggucuggucuccucagccuc

SEQ ID NO: 2209463 - RNA, 13 nt, Human
gggguuggcuggg

SEQ ID NO: 2209464 - RNA, 15 nt, Human
gggguuaucucugug

SEQ ID NO: 2209465 - RNA, 21 nt, Human
gggguugggauugggggcugg

SEQ ID NO: 2209466 - RNA, 22 nt, Human
gggguugggauugggggcuggu

SEQ ID NO: 2209467 - RNA, 17 nt, Human
gggguugugaggccugg

SEQ ID NO: 2209468 - RNA, 15 nt, Human
gggguuguguuguca

SEQ ID NO: 2209469 - RNA, 21 nt, Human
gggguguguuccaacugcccc

SEQ ID NO: 2209470 - RNA, 16 nt, Human
gggguggggucaugcc

SEQ ID NO: 2209471 - RNA, 19 nt, Human
gggguguggcuccuuccca

SEQ ID NO: 2209472 - RNA, 14 nt, Human
ggguaaggugccuu

SEQ ID NO: 2209473 - RNA, 13 nt, Human
ggguaaggugccu

SEQ ID NO: 2209474 - RNA, 13 nt, Human
ggguaaacugugg

SEQ ID NO: 2209475 - RNA, 22 nt, Human
ggguaaaauuccuuagcuuaga

SEQ ID NO: 2209476 - RNA, 23 nt, Human
gggguuuucgaagcucagcccac

SEQ ID NO: 2209477 - RNA, 19 nt, Human
gggucucccucuccugccu

SEQ ID NO: 2209478 - RNA, 18 nt, Human
gggucucccucuccugcc

SEQ ID NO: 2209479 - RNA, 16 nt, Human
gggucucccucuccug

SEQ ID NO: 2209480 - RNA, 15 nt, Human
gggucucccucuccu

SEQ ID NO: 2209481 - RNA, 15 nt, Human
gggucucccuggagu

SEQ ID NO: 2209482 - RNA, 19 nt, Human
gggucuccaggaggagacu

SEQ ID NO: 2209483 - RNA, 18 nt, Human
gggucuccaggaggagac

SEQ ID NO: 2209484 - RNA, 21 nt, Human
ggguaauaaacuuagaauaaa

SEQ ID NO: 2209485 - RNA, 14 nt, Human
gggucucacucugu

SEQ ID NO: 2209486 - RNA, 17 nt, Human
ggguaagugagagaggg

SEQ ID NO: 2209487 - RNA, 21 nt, Human
ggguuggagcaguagcuggag

SEQ ID NO: 2209488 - RNA, 20 nt, Human
ggguugccacaggccucccu

SEQ ID NO: 2209489 - RNA, 18 nt, Human
ggguugccacaggccucc

SEQ ID NO: 2209490 - RNA, 21 nt, Human
ggguugagcagggauccuggu

SEQ ID NO: 2209491 - RNA, 19 nt, Human
ggguugccacaggccuccc

SEQ ID NO: 2209492 - RNA, 12 nt, Human
ggguugaaaauu

SEQ ID NO: 2209493 - RNA, 23 nt, Human
ggguugaaaauucaaaaaguguu

SEQ ID NO: 2209494 - RNA, 12 nt, Human
ggguugagggga

SEQ ID NO: 2209495 - RNA, 19 nt, Human
ggguucuuucuuccucugc

SEQ ID NO: 2209496 - RNA, 18 nt, Human
ggguucguggaaagggug

SEQ ID NO: 2209497 - RNA, 16 nt, Human
ggguucuuuggaagga

SEQ ID NO: 2209498 - RNA, 19 nt, Human
ggguucuuuggaaggagug

SEQ ID NO: 2209499 - RNA, 17 nt, Human
ggguucuuucuuccucu

SEQ ID NO: 2209500 - RNA, 16 nt, Human
ggguucuuucuuccuc

SEQ ID NO: 2209501 - RNA, 17 nt, Human
ggguucauuauuggaau

SEQ ID NO: 2209502 - RNA, 13 nt, Human
ggguucauuauug

SEQ ID NO: 2209503 - RNA, 22 nt, Human
ggguucauaggucacuggcucu

SEQ ID NO: 2209504 - RNA, 22 nt, Human
ggguucagccccuccucugcca

SEQ ID NO: 2209505 - RNA, 19 nt, Human
ggguucauaggucacuggc

SEQ ID NO: 2209506 - RNA, 20 nt, Human
ggguucauaggucacuggcu

SEQ ID NO: 2209507 - RNA, 21 nt, Human
ggguucauaggucacuggcuc

SEQ ID NO: 2209508 - RNA, 19 nt, Human
ggguuccuuccucugagcc

SEQ ID NO: 2209509 - RNA, 11 nt, Human
ggguuccugca

SEQ ID NO: 2209510 - RNA, 14 nt, Human
ggguuccucuuccc

SEQ ID NO: 2209511 - RNA, 21 nt, Human
ggguuccuuccucugagccuu

SEQ ID NO: 2209512 - RNA, 20 nt, Human
ggguuccuuccucugagccu

SEQ ID NO: 2209513 - RNA, 12 nt, Human
ggguucuaccca

SEQ ID NO: 2209514 - RNA, 20 nt, Human
ggguucaccugggcugaggc

SEQ ID NO: 2209515 - RNA, 13 nt, Human
ggguuaucucugu

SEQ ID NO: 2209516 - RNA, 14 nt, Human
ggguuaugaauauu

SEQ ID NO: 2209517 - RNA, 23 nt, Human
ggguucaagcgauucuucugcuu

SEQ ID NO: 2209518 - RNA, 13 nt, Human
ggguucaggggac

SEQ ID NO: 2209519 - RNA, 21 nt, Human
ggguucagccccuccucugcc

SEQ ID NO: 2209520 - RNA, 20 nt, Human
ggguucagccccuccucugc

SEQ ID NO: 2209521 - RNA, 19 nt, Human
ggguucagccccuccucug

SEQ ID NO: 2209522 - RNA, 17 nt, Human
ggguucagccccuccuc

SEQ ID NO: 2209523 - RNA, 16 nt, Human
ggguucagccccuccu

SEQ ID NO: 2209524 - RNA, 13 nt, Human
ggguucagccccu

SEQ ID NO: 2209525 - RNA, 19 nt, Human
ggguucagagacucagggc

SEQ ID NO: 2209526 - RNA, 20 nt, Human
ggguucagaaaugcugccug

SEQ ID NO: 2209527 - RNA, 21 nt, Human
ggguucagaaaugcugccugc

SEQ ID NO: 2209528 - RNA, 16 nt, Human
ggguucaaaaugucug

SEQ ID NO: 2209529 - RNA, 19 nt, Human
ggguucagaaaugcugccu

SEQ ID NO: 2209530 - RNA, 22 nt, Human
ggguguguguuugugugagaga

SEQ ID NO: 2209531 - RNA, 14 nt, Human
ggguguguguuugu

SEQ ID NO: 2209532 - RNA, 17 nt, Human
gggugcugggccccugc

SEQ ID NO: 2209533 - RNA, 22 nt, Human
ggguucaagcgauucuucugcu

SEQ ID NO: 2209534 - RNA, 22 nt, Human
ggguuaagaaaagagauauuuu

SEQ ID NO: 2209535 - RNA, 18 nt, Human
gggugcugggaggaggga

SEQ ID NO: 2209536 - RNA, 16 nt, Human
ggguuaagaagacuuu

SEQ ID NO: 2209537 - RNA, 17 nt, Human
gggugaagugaagacaa

SEQ ID NO: 2209538 - RNA, 14 nt, Human
gggugaagggagag

SEQ ID NO: 2209539 - RNA, 13 nt, Human
gggugaagggaga

SEQ ID NO: 2209540 - RNA, 23 nt, Human
gggugaauaauaaaaguauauau

SEQ ID NO: 2209541 - RNA, 13 nt, Human
gggugacaagaua

SEQ ID NO: 2209542 - RNA, 21 nt, Human
gggugacaagauagagagcua

SEQ ID NO: 2209543 - RNA, 19 nt, Human
gggugacagagcaagugag

SEQ ID NO: 2209544 - RNA, 20 nt, Human
gggucuucagggggccaggu

SEQ ID NO: 2209545 - RNA, 21 nt, Human
gggucuguaaaaucuuucuuu

SEQ ID NO: 2209546 - RNA, 15 nt, Human
gggucugugucucuu

SEQ ID NO: 2209547 - RNA, 15 nt, Human
gggucuguaaaaucu

SEQ ID NO: 2209548 - RNA, 16 nt, Human
gggucuguaaaaucuu

SEQ ID NO: 2209549 - RNA, 17 nt, Human
gggucuguaaaaucuuu

SEQ ID NO: 2209550 - RNA, 20 nt, Human
gggucuguaaaaucuuucuu

SEQ ID NO: 2209551 - RNA, 19 nt, Human
gggugaagagaaccgagca

SEQ ID NO: 2209552 - RNA, 20 nt, Human
gggugaacaaagcagccacg

SEQ ID NO: 2209553 - RNA, 21 nt, Human
gggucuuuucaucugggaaag

SEQ ID NO: 2209554 - RNA, 23 nt, Human
gggucuucccuaccucaggcagg

SEQ ID NO: 2209555 - RNA, 20 nt, Human
gggucuugguuccagccugc

SEQ ID NO: 2209556 - RNA, 12 nt, Human
gggugccgccug

SEQ ID NO: 2209557 - RNA, 15 nt, Human
gggugcccccuccuc

SEQ ID NO: 2209558 - RNA, 14 nt, Human
gggugccgccugcc

SEQ ID NO: 2209559 - RNA, 21 nt, Human
gggugccccccuugccagaca

SEQ ID NO: 2209560 - RNA, 18 nt, Human
gggugcccaagcucagaa

SEQ ID NO: 2209561 - RNA, 12 nt, Human
gggugcccccuc

SEQ ID NO: 2209562 - RNA, 23 nt, Human
gggugcaguaucaugcccugugc

SEQ ID NO: 2209563 - RNA, 19 nt, Human
gggugcuggcugcccagac

SEQ ID NO: 2209564 - RNA, 15 nt, Human
gggugcugggaggag

SEQ ID NO: 2209565 - RNA, 23 nt, Human
gggugcugcuucccucugccugu

SEQ ID NO: 2209566 - RNA, 21 nt, Human
gggugcugcuucccucugccu

SEQ ID NO: 2209567 - RNA, 16 nt, Human
gggugcucccuaccac

SEQ ID NO: 2209568 - RNA, 19 nt, Human
gggugcgaccccaucugcc

SEQ ID NO: 2209569 - RNA, 21 nt, Human
gggugcgaccccaucugccca

SEQ ID NO: 2209570 - RNA, 22 nt, Human
gggugcgaccccaucugcccag

SEQ ID NO: 2209571 - RNA, 15 nt, Human
gggugaggaccacuc

SEQ ID NO: 2209572 - RNA, 20 nt, Human
gggugagaugcuggagaaga

SEQ ID NO: 2209573 - RNA, 15 nt, Human
gggugagaugcugga

SEQ ID NO: 2209574 - RNA, 18 nt, Human
gggugagaugcuggagaa

SEQ ID NO: 2209575 - RNA, 17 nt, Human
gggugagaacaaccaaa

SEQ ID NO: 2209576 - RNA, 18 nt, Human
gggugaggaccacuccug

SEQ ID NO: 2209577 - RNA, 19 nt, Human
gggugaguccauucuccca

SEQ ID NO: 2209578 - RNA, 17 nt, Human
gggugagggucccaugu

SEQ ID NO: 2209579 - RNA, 15 nt, Human
gggugaggagcuggg

SEQ ID NO: 2209580 - RNA, 14 nt, Human
gggugaggagcugg

SEQ ID NO: 2209581 - RNA, 18 nt, Human
gggugauauggacagcag

SEQ ID NO: 2209582 - RNA, 16 nt, Human
gggugauuucagagag

SEQ ID NO: 2209583 - RNA, 16 nt, Human
gggugaugccagguuc

SEQ ID NO: 2209584 - RNA, 22 nt, Human
gggugauuucagagagggcaga

SEQ ID NO: 2209585 - RNA, 16 nt, Human
gguacccaauucaauu

SEQ ID NO: 2209586 - RNA, 15 nt, Human
gguaccagcugcgcu

SEQ ID NO: 2209587 - RNA, 20 nt, Human
gguaccaggucuccuccacc

SEQ ID NO: 2209588 - RNA, 12 nt, Human
gguaccagcugc

SEQ ID NO: 2209589 - RNA, 14 nt, Human
gguaccagcugcgc

SEQ ID NO: 2209590 - RNA, 11 nt, Human
gguacccacug

SEQ ID NO: 2209591 - RNA, 16 nt, Human
gguacuucuugaaggu

SEQ ID NO: 2209592 - RNA, 15 nt, Human
gguacuucuugaagg

SEQ ID NO: 2209593 - RNA, 13 nt, Human
gguacccacugcu

SEQ ID NO: 2209594 - RNA, 22 nt, Human
gguagaaauaucugaaaaugua

SEQ ID NO: 2209595 - RNA, 19 nt, Human
gguacuucuugaaggugcu

SEQ ID NO: 2209596 - RNA, 16 nt, Human
gguacuugucauuucg

SEQ ID NO: 2209597 - RNA, 16 nt, Human
gguacuuguggacaca

SEQ ID NO: 2209598 - RNA, 17 nt, Human
gguacuuguggacacag

SEQ ID NO: 2209599 - RNA, 11 nt, Human
gguagaacaca

SEQ ID NO: 2209600 - RNA, 19 nt, Human
gguagagauucauuauuuu

SEQ ID NO: 2209601 - RNA, 23 nt, Human
gguagaguuugaaggaggugagg

SEQ ID NO: 2209602 - RNA, 17 nt, Human
gguagaggaugaggaaa

SEQ ID NO: 2209603 - RNA, 15 nt, Human
gguagagcugaucca

SEQ ID NO: 2209604 - RNA, 17 nt, Human
gguagagcugauccaga

SEQ ID NO: 2209605 - RNA, 21 nt, Human
gguagagcugauccagagcac

SEQ ID NO: 2209606 - RNA, 23 nt, Human
gguagagcugauccagagcacag

SEQ ID NO: 2209607 - RNA, 23 nt, Human
gguagaaauaucugaaaauguau

SEQ ID NO: 2209608 - RNA, 22 nt, Human
gguagaagcccuucuaccuucc

SEQ ID NO: 2209609 - RNA, 18 nt, Human
gguagaucacgagaucaa

SEQ ID NO: 2209610 - RNA, 12 nt, Human
gguagauguuca

SEQ ID NO: 2209611 - RNA, 14 nt, Human
gguagauguucaga

SEQ ID NO: 2209612 - RNA, 16 nt, Human
gguagccagcacacag

SEQ ID NO: 2209613 - RNA, 13 nt, Human
gguagccagcaca

SEQ ID NO: 2209614 - RNA, 12 nt, Human
gguagcagcugg

SEQ ID NO: 2209615 - RNA, 13 nt, Human
gguagcagcugga

SEQ ID NO: 2209616 - RNA, 14 nt, Human
gguagcagcuggac

SEQ ID NO: 2209617 - RNA, 14 nt, Human
gguauuuauaauau

SEQ ID NO: 2209618 - RNA, 23 nt, Human
gguauuguauuuauucaauaaag

SEQ ID NO: 2209619 - RNA, 20 nt, Human
gguauuguauuuauucaaua

SEQ ID NO: 2209620 - RNA, 22 nt, Human
gguauuguauuuauucaauaaa

SEQ ID NO: 2209621 - RNA, 16 nt, Human
gguagccaucauggau

SEQ ID NO: 2209622 - RNA, 21 nt, Human
gguagccagcacacagggcag

SEQ ID NO: 2209623 - RNA, 19 nt, Human
gguauuguauuuauucaau

SEQ ID NO: 2209624 - RNA, 14 nt, Human
gguagccaggggga

SEQ ID NO: 2209625 - RNA, 12 nt, Human
gguagccauccc

SEQ ID NO: 2209626 - RNA, 22 nt, Human
ggucaggagaggggcagaacag

SEQ ID NO: 2209627 - RNA, 22 nt, Human
ggucagcuugcugcccuaggcu

SEQ ID NO: 2209628 - RNA, 20 nt, Human
ggucagagacugcuguguuu

SEQ ID NO: 2209629 - RNA, 21 nt, Human
ggucaggaguuagaggccagc

SEQ ID NO: 2209630 - RNA, 22 nt, Human
ggucaggaaggaugagcauuua

SEQ ID NO: 2209631 - RNA, 21 nt, Human
ggucaggaguuccuaaccagc

SEQ ID NO: 2209632 - RNA, 13 nt, Human
ggucaggcagggu

SEQ ID NO: 2209633 - RNA, 17 nt, Human
ggucacuggcucuccaa

SEQ ID NO: 2209634 - RNA, 11 nt, Human
ggucagagccu

SEQ ID NO: 2209635 - RNA, 16 nt, Human
ggucaggccacggcag

SEQ ID NO: 2209636 - RNA, 22 nt, Human
ggucaggaguuagaggccagcc

SEQ ID NO: 2209637 - RNA, 17 nt, Human
ggucagggaccaaggac

SEQ ID NO: 2209638 - RNA, 19 nt, Human
ggucagguguucaagacca

SEQ ID NO: 2209639 - RNA, 13 nt, Human
ggucaggcuccau

SEQ ID NO: 2209640 - RNA, 15 nt, Human
ggucccaccccacac

SEQ ID NO: 2209641 - RNA, 16 nt, Human
ggucccaccccacaca

SEQ ID NO: 2209642 - RNA, 15 nt, Human
ggucacugccaugga

SEQ ID NO: 2209643 - RNA, 12 nt, Human
ggucacugcugu

SEQ ID NO: 2209644 - RNA, 13 nt, Human
ggucacugcuguc

SEQ ID NO: 2209645 - RNA, 14 nt, Human
ggucacugcuguca

SEQ ID NO: 2209646 - RNA, 13 nt, Human
ggucacuggaaag

SEQ ID NO: 2209647 - RNA, 15 nt, Human
ggucacuggaaaggg

SEQ ID NO: 2209648 - RNA, 13 nt, Human
ggucacuggaacu

SEQ ID NO: 2209649 - RNA, 13 nt, Human
ggucacuggcucu

SEQ ID NO: 2209650 - RNA, 16 nt, Human
ggucacuggcucucca

SEQ ID NO: 2209651 - RNA, 18 nt, Human
ggucacuggcucuccaag

SEQ ID NO: 2209652 - RNA, 13 nt, Human
ggucacuccuggg

SEQ ID NO: 2209653 - RNA, 15 nt, Human
ggucaccaugaaacu

SEQ ID NO: 2209654 - RNA, 16 nt, Human
ggucaccagcuccucc

SEQ ID NO: 2209655 - RNA, 17 nt, Human
ggucacauucaggaaga

SEQ ID NO: 2209656 - RNA, 21 nt, Human
ggucacauucaggaagaugaa

SEQ ID NO: 2209657 - RNA, 14 nt, Human
ggucaccaugaaac

SEQ ID NO: 2209658 - RNA, 21 nt, Human
ggucacagcggagguguggag

SEQ ID NO: 2209659 - RNA, 23 nt, Human
ggucaacaucuuuuacauucugc

SEQ ID NO: 2209660 - RNA, 19 nt, Human
ggucaacauggugaaaccc

SEQ ID NO: 2209661 - RNA, 16 nt, Human
ggucacaggacucugc

SEQ ID NO: 2209662 - RNA, 18 nt, Human
ggucacaggacucugccu

SEQ ID NO: 2209663 - RNA, 20 nt, Human
ggucaacagagaaggcagga

SEQ ID NO: 2209664 - RNA, 14 nt, Human
ggucaacagagaag

SEQ ID NO: 2209665 - RNA, 18 nt, Human
ggucaacagcuaugcugg

SEQ ID NO: 2209666 - RNA, 20 nt, Human
gguauuuucccccuuuucug

SEQ ID NO: 2209667 - RNA, 22 nt, Human
ggucaaaccgcacucacccaug

SEQ ID NO: 2209668 - RNA, 22 nt, Human
gguauuuuaggcagggauuuga

SEQ ID NO: 2209669 - RNA, 18 nt, Human
gguauuuuugcccugagu

SEQ ID NO: 2209670 - RNA, 20 nt, Human
gguggugcugggacugagcc

SEQ ID NO: 2209671 - RNA, 22 nt, Human
gguggucuguuggcaggcuggc

SEQ ID NO: 2209672 - RNA, 16 nt, Human
gguggucuguuggcag

SEQ ID NO: 2209673 - RNA, 21 nt, Human
gguggucuguuggcaggcugg

SEQ ID NO: 2209674 - RNA, 16 nt, Human
gguggugaccucugcc

SEQ ID NO: 2209675 - RNA, 22 nt, Human
gguggucugcucgggcccaggc

SEQ ID NO: 2209676 - RNA, 23 nt, Human
gguggugcugggacugagccagu

SEQ ID NO: 2209677 - RNA, 13 nt, Human
ggugguggagcca

SEQ ID NO: 2209678 - RNA, 14 nt, Human
ggugguggaucugu

SEQ ID NO: 2209679 - RNA, 20 nt, Human
gguggugggaaccaugaaga

SEQ ID NO: 2209680 - RNA, 21 nt, Human
ggugguggaucuguccaagga

SEQ ID NO: 2209681 - RNA, 17 nt, Human
ggugguggcacugagcc

SEQ ID NO: 2209682 - RNA, 13 nt, Human
ggugguggggagg

SEQ ID NO: 2209683 - RNA, 14 nt, Human
ggugguggggaggg

SEQ ID NO: 2209684 - RNA, 18 nt, Human
gguggucugcaggcaggg

SEQ ID NO: 2209685 - RNA, 17 nt, Human
gguggucugcaggcagg

SEQ ID NO: 2209686 - RNA, 16 nt, Human
gguggucugcaggcag

SEQ ID NO: 2209687 - RNA, 19 nt, Human
gguggucugaauguucuga

SEQ ID NO: 2209688 - RNA, 13 nt, Human
gguggucugcucg

SEQ ID NO: 2209689 - RNA, 14 nt, Human
gguggucugcucgg

SEQ ID NO: 2209690 - RNA, 19 nt, Human
gguggucugcucgggccca

SEQ ID NO: 2209691 - RNA, 20 nt, Human
gguggucugcucgggcccag

SEQ ID NO: 2209692 - RNA, 18 nt, Human
gguggucugaauguucug

SEQ ID NO: 2209693 - RNA, 15 nt, Human
gguggucugaauguu

SEQ ID NO: 2209694 - RNA, 17 nt, Human
ggugguccugagaccug

SEQ ID NO: 2209695 - RNA, 18 nt, Human
ggugguccugagaccuga

SEQ ID NO: 2209696 - RNA, 19 nt, Human
ggugguccugacucaacau

SEQ ID NO: 2209697 - RNA, 14 nt, Human
gguggucaggcgua

SEQ ID NO: 2209698 - RNA, 14 nt, Human
gguggugaccucug

SEQ ID NO: 2209699 - RNA, 15 nt, Human
gguggugaccucugc

SEQ ID NO: 2209700 - RNA, 23 nt, Human
gguggcugacccagucccugggg

SEQ ID NO: 2209701 - RNA, 22 nt, Human
gguggcugacccagucccuggg

SEQ ID NO: 2209702 - RNA, 21 nt, Human
gguggcugacccagucccugg

SEQ ID NO: 2209703 - RNA, 19 nt, Human
gguggcugacccagucccu

SEQ ID NO: 2209704 - RNA, 22 nt, Human
gguggcuggagacgggugggcg

SEQ ID NO: 2209705 - RNA, 23 nt, Human
gguggggucaugcccuccucucc

SEQ ID NO: 2209706 - RNA, 14 nt, Human
ggugggguccugga

SEQ ID NO: 2209707 - RNA, 23 nt, Human
ggugggguccuggagcagaccac

SEQ ID NO: 2209708 - RNA, 18 nt, Human
gguggcugacccaguccc

SEQ ID NO: 2209709 - RNA, 15 nt, Human
gguggcugacccagu

SEQ ID NO: 2209710 - RNA, 13 nt, Human
gguggcugaccca

SEQ ID NO: 2209711 - RNA, 19 nt, Human
gguggcucacgccuguaau

SEQ ID NO: 2209712 - RNA, 17 nt, Human
gguggcucaugccugua

SEQ ID NO: 2209713 - RNA, 20 nt, Human
gguggcucccggagggcccu

SEQ ID NO: 2209714 - RNA, 17 nt, Human
gguggcuagucagagag

SEQ ID NO: 2209715 - RNA, 16 nt, Human
gguggcuagucagaga

SEQ ID NO: 2209716 - RNA, 15 nt, Human
gguggcuagucagag

SEQ ID NO: 2209717 - RNA, 23 nt, Human
gguggcuagucaagcuccuccuc

SEQ ID NO: 2209718 - RNA, 22 nt, Human
gguggcuagucaagcuccuccu

SEQ ID NO: 2209719 - RNA, 21 nt, Human
gguggcuagucaagcuccucc

SEQ ID NO: 2209720 - RNA, 20 nt, Human
gguggguccaugggcagagc

SEQ ID NO: 2209721 - RNA, 17 nt, Human
gguggguccaugggcag

SEQ ID NO: 2209722 - RNA, 20 nt, Human
gguggguccaggggccccuc

SEQ ID NO: 2209723 - RNA, 14 nt, Human
gguggguccauggg

SEQ ID NO: 2209724 - RNA, 10 nt, Human
ggugggucca

SEQ ID NO: 2209725 - RNA, 14 nt, Human
gguggguauaaaag

SEQ ID NO: 2209726 - RNA, 14 nt, Human
ggugguaugugugu

SEQ ID NO: 2209727 - RNA, 22 nt, Human
ggugguaccaggucuccuccac

SEQ ID NO: 2209728 - RNA, 19 nt, Human
gguggucacuggaacucag

SEQ ID NO: 2209729 - RNA, 16 nt, Human
ggugguacccucugga

SEQ ID NO: 2209730 - RNA, 15 nt, Human
ggugguaccaggucu

SEQ ID NO: 2209731 - RNA, 16 nt, Human
ggugguaccaggucuc

SEQ ID NO: 2209732 - RNA, 16 nt, Human
gguggguuuucuuccc

SEQ ID NO: 2209733 - RNA, 19 nt, Human
gguggguucuuuggaagga

SEQ ID NO: 2209734 - RNA, 17 nt, Human
gguggguuuucuuccca

SEQ ID NO: 2209735 - RNA, 14 nt, Human
ggugguaacccugg

SEQ ID NO: 2209736 - RNA, 16 nt, Human
ggugggugguggggag

SEQ ID NO: 2209737 - RNA, 14 nt, Human
gguggguggugggg

SEQ ID NO: 2209738 - RNA, 14 nt, Human
gguguaauaagaca

SEQ ID NO: 2209739 - RNA, 23 nt, Human
ggugguugcuguuuuccucccuu

SEQ ID NO: 2209740 - RNA, 21 nt, Human
ggugguugcuguuuuccuccc

SEQ ID NO: 2209741 - RNA, 21 nt, Human
gguggugucuccaacccccca

SEQ ID NO: 2209742 - RNA, 18 nt, Human
gguguaauaagacauaac

SEQ ID NO: 2209743 - RNA, 15 nt, Human
gguguaauaagacau

SEQ ID NO: 2209744 - RNA, 16 nt, Human
gguguaauaagacaua

SEQ ID NO: 2209745 - RNA, 18 nt, Human
ggugguuuucuguucuuu

SEQ ID NO: 2209746 - RNA, 15 nt, Human
ggugguuuucuguuc

SEQ ID NO: 2209747 - RNA, 21 nt, Human
ggugguuauggagaggguguc

SEQ ID NO: 2209748 - RNA, 23 nt, Human
ggugguucacucuuggagccugc

SEQ ID NO: 2209749 - RNA, 22 nt, Human
ggugguucacucuuggagccug

SEQ ID NO: 2209750 - RNA, 18 nt, Human
ggugguuucagaaaugug

SEQ ID NO: 2209751 - RNA, 17 nt, Human
ggugguuucagaaaugu

SEQ ID NO: 2209752 - RNA, 19 nt, Human
ggugucaccugaagacuca

SEQ ID NO: 2209753 - RNA, 15 nt, Human
ggugucacuuacugu

SEQ ID NO: 2209754 - RNA, 23 nt, Human
ggugucacuuacuguuucuguca

SEQ ID NO: 2209755 - RNA, 17 nt, Human
ggugucacuuacuguuu

SEQ ID NO: 2209756 - RNA, 19 nt, Human
ggugucacuuacuguuucu

SEQ ID NO: 2209757 - RNA, 13 nt, Human
ggugucaggcugc

SEQ ID NO: 2209758 - RNA, 17 nt, Human
ggugucaggcugcuggc

SEQ ID NO: 2209759 - RNA, 20 nt, Human
ggugucaggcugcuggcgcc

SEQ ID NO: 2209760 - RNA, 23 nt, Human
gguguauuuauuuuccuccccag

SEQ ID NO: 2209761 - RNA, 22 nt, Human
gguguauuuauuuuccucccca

SEQ ID NO: 2209762 - RNA, 17 nt, Human
gguguauuuauuuuccu

SEQ ID NO: 2209763 - RNA, 19 nt, Human
ggugucaagagggucugag

SEQ ID NO: 2209764 - RNA, 17 nt, Human
ggugucaagagggucug

SEQ ID NO: 2209765 - RNA, 16 nt, Human
gguguaugguucugug

SEQ ID NO: 2209766 - RNA, 11 nt, Human
gguuaaaacug

SEQ ID NO: 2209767 - RNA, 13 nt, Human
gguuaaaacuguc

SEQ ID NO: 2209768 - RNA, 20 nt, Human
gguguccugaccacccuccc

SEQ ID NO: 2209769 - RNA, 17 nt, Human
gguguccugaccacccu

SEQ ID NO: 2209770 - RNA, 18 nt, Human
gguguccugaccacccuc

SEQ ID NO: 2209771 - RNA, 23 nt, Human
gguuaaaaaaaggcauuguuuga

SEQ ID NO: 2209772 - RNA, 17 nt, Human
gguguccuuucccucca

SEQ ID NO: 2209773 - RNA, 12 nt, Human
gguguccugacc

SEQ ID NO: 2209774 - RNA, 13 nt, Human
gguguccugacca

SEQ ID NO: 2209775 - RNA, 14 nt, Human
gguguccugaccac

SEQ ID NO: 2209776 - RNA, 19 nt, Human
gguuacaacagauuuguga

SEQ ID NO: 2209777 - RNA, 21 nt, Human
gguuacaacagauuugugaac

SEQ ID NO: 2209778 - RNA, 13 nt, Human
gguuaauaaguuu

SEQ ID NO: 2209779 - RNA, 14 nt, Human
gguuacaacagauu

SEQ ID NO: 2209780 - RNA, 13 nt, Human
gguuacaacagau

SEQ ID NO: 2209781 - RNA, 21 nt, Human
gguuacccaguuagcucucaa

SEQ ID NO: 2209782 - RNA, 22 nt, Human
gguuaaggcugaggaaaggcca

SEQ ID NO: 2209783 - RNA, 16 nt, Human
gguuaagcccugaggg

SEQ ID NO: 2209784 - RNA, 15 nt, Human
gguuaaggcugagga

SEQ ID NO: 2209785 - RNA, 21 nt, Human
gguuaagcauuaccacucagg

SEQ ID NO: 2209786 - RNA, 17 nt, Human
gguuaaucuuuccugau

SEQ ID NO: 2209787 - RNA, 23 nt, Human
gguuaagucuguuuuaugacuuc

SEQ ID NO: 2209788 - RNA, 16 nt, Human
gguuaagucuguuuua

SEQ ID NO: 2209789 - RNA, 13 nt, Human
gguuaagucuguu

SEQ ID NO: 2209790 - RNA, 13 nt, Human
gguuauggagagg

SEQ ID NO: 2209791 - RNA, 14 nt, Human
gguuaucucugugu

SEQ ID NO: 2209792 - RNA, 18 nt, Human
gguuaucaaaaauuucau

SEQ ID NO: 2209793 - RNA, 17 nt, Human
gguuaucgaaauaacaa

SEQ ID NO: 2209794 - RNA, 16 nt, Human
gguuaggauuuaacag

SEQ ID NO: 2209795 - RNA, 14 nt, Human
gguuauaaaaguga

SEQ ID NO: 2209796 - RNA, 21 nt, Human
gguuauauuuuacuacugugg

SEQ ID NO: 2209797 - RNA, 22 nt, Human
gguuaguggauggaaggggcug

SEQ ID NO: 2209798 - RNA, 21 nt, Human
gguuaguggauggaaggggcu

SEQ ID NO: 2209799 - RNA, 15 nt, Human
gguuagggaggggua

SEQ ID NO: 2209800 - RNA, 13 nt, Human
gguuagggagggg

SEQ ID NO: 2209801 - RNA, 20 nt, Human
gguuaggaguucgagaccag

SEQ ID NO: 2209802 - RNA, 16 nt, Human
gguuagggaaaacauu

SEQ ID NO: 2209803 - RNA, 17 nt, Human
gguuaggcauuguggga

SEQ ID NO: 2209804 - RNA, 23 nt, Human
gguuacaaucauugcugaaaaug

SEQ ID NO: 2209805 - RNA, 16 nt, Human
gguuaccaagaagccu

SEQ ID NO: 2209806 - RNA, 23 nt, Human
gguuauuuuaguuucuguucugu

SEQ ID NO: 2209807 - RNA, 18 nt, Human
gguuauuuauuuaaaugu

SEQ ID NO: 2209808 - RNA, 24 nt, Human
gguuauuucucaacaaagcacagu

SEQ ID NO: 2209809 - RNA, 17 nt, Human
gguuauuuuaguuucug

SEQ ID NO: 2209810 - RNA, 19 nt, Human
gguuauuuuaguuucuguu

SEQ ID NO: 2209811 - RNA, 13 nt, Human
gguucaaagauau

SEQ ID NO: 2209812 - RNA, 20 nt, Human
gguuauugaaaauaugaugu

SEQ ID NO: 2209813 - RNA, 15 nt, Human
gguuaucugucccag

SEQ ID NO: 2209814 - RNA, 23 nt, Human
gguuaucgaaauaacaauguuaa

SEQ ID NO: 2209815 - RNA, 13 nt, Human
gguuaugaauauu

SEQ ID NO: 2209816 - RNA, 20 nt, Human
gguuauuuagggaacugcuu

SEQ ID NO: 2209817 - RNA, 14 nt, Human
gguuauuuauuuaa

SEQ ID NO: 2209818 - RNA, 13 nt, Human
gguuauuucucug

SEQ ID NO: 2209819 - RNA, 15 nt, Human
gguucacuaaagcag

SEQ ID NO: 2209820 - RNA, 20 nt, Human
gguucacgugcagcucaagg

SEQ ID NO: 2209821 - RNA, 22 nt, Human
gguucacgccuguaaucccagc

SEQ ID NO: 2209822 - RNA, 21 nt, Human
gguucacgccuguaaucccag

SEQ ID NO: 2209823 - RNA, 15 nt, Human
gguucaccagccucu

SEQ ID NO: 2209824 - RNA, 20 nt, Human
gguucacucuuggagccugc

SEQ ID NO: 2209825 - RNA, 19 nt, Human
gguucacucuuggagccug

SEQ ID NO: 2209826 - RNA, 14 nt, Human
gguucaccagccuc

SEQ ID NO: 2209827 - RNA, 13 nt, Human
gguucaccagccu

SEQ ID NO: 2209828 - RNA, 12 nt, Human
gguucaccagcc

SEQ ID NO: 2209829 - RNA, 22 nt, Human
gguucacaggcgaggccuggag

SEQ ID NO: 2209830 - RNA, 21 nt, Human
gguucaaagauauuuugcuuu

SEQ ID NO: 2209831 - RNA, 16 nt, Human
gguucuuagugucacu

SEQ ID NO: 2209832 - RNA, 18 nt, Human
gguucuuaguucucacug

SEQ ID NO: 2209833 - RNA, 13 nt, Human
gguucuucccuuu

SEQ ID NO: 2209834 - RNA, 23 nt, Human
gguucacucuuggagccugcaga

SEQ ID NO: 2209835 - RNA, 21 nt, Human
gguucacucuuggagccugca

SEQ ID NO: 2209836 - RNA, 14 nt, Human
gguucuuucuuccu

SEQ ID NO: 2209837 - RNA, 16 nt, Human
gguucuuucuuccucu

SEQ ID NO: 2209838 - RNA, 14 nt, Human
gguucuuguauuaa

SEQ ID NO: 2209839 - RNA, 17 nt, Human
gguucuugguagagauu

SEQ ID NO: 2209840 - RNA, 22 nt, Human
gguucuuguauuaagaaugaaa

SEQ ID NO: 2209841 - RNA, 19 nt, Human
gguugagguggaagcccuc

SEQ ID NO: 2209842 - RNA, 23 nt, Human
gguugagguccagcccuggcuga

SEQ ID NO: 2209843 - RNA, 17 nt, Human
gguugauaacuuugcuu

SEQ ID NO: 2209844 - RNA, 19 nt, Human
gguugauaacuuugcuugc

SEQ ID NO: 2209845 - RNA, 22 nt, Human
gguugauaguuuaccugaauaa

SEQ ID NO: 2209846 - RNA, 14 nt, Human
gguugaucacacuc

SEQ ID NO: 2209847 - RNA, 13 nt, Human
gguugagguuuca

SEQ ID NO: 2209848 - RNA, 19 nt, Human
gguugaggggcuccuggaa

SEQ ID NO: 2209849 - RNA, 21 nt, Human
gguugagguccagcccuggcu

SEQ ID NO: 2209850 - RNA, 18 nt, Human
gguugaggggcuccugga

SEQ ID NO: 2209851 - RNA, 11 nt, Human
gguugaggaaa

SEQ ID NO: 2209852 - RNA, 13 nt, Human
gguugagaaauga

SEQ ID NO: 2209853 - RNA, 16 nt, Human
gguugacuuucaggua

SEQ ID NO: 2209854 - RNA, 16 nt, Human
ggugagaugcagcugg

SEQ ID NO: 2209855 - RNA, 14 nt, Human
ggugagaugcugga

SEQ ID NO: 2209856 - RNA, 17 nt, Human
ggugagaugcuggagaa

SEQ ID NO: 2209857 - RNA, 21 nt, Human
ggugagaugcuggagaagaga

SEQ ID NO: 2209858 - RNA, 22 nt, Human
ggugagaugcuggagaagagag

SEQ ID NO: 2209859 - RNA, 23 nt, Human
ggugagaugcuggagaagagagg

SEQ ID NO: 2209860 - RNA, 16 nt, Human
ggugagaggggaacag

SEQ ID NO: 2209861 - RNA, 15 nt, Human
ggugagaagcagagg

SEQ ID NO: 2209862 - RNA, 12 nt, Human
ggugagagcugc

SEQ ID NO: 2209863 - RNA, 14 nt, Human
ggugcgaccccauc

SEQ ID NO: 2209864 - RNA, 23 nt, Human
ggugccuucuuauucucacucca

SEQ ID NO: 2209865 - RNA, 19 nt, Human
ggugccugugaggcagggg

SEQ ID NO: 2209866 - RNA, 18 nt, Human
ggugccugugaggcaggg

SEQ ID NO: 2209867 - RNA, 17 nt, Human
ggugccugugaggcagg

SEQ ID NO: 2209868 - RNA, 23 nt, Human
ggugccuggguggggcugcuccu

SEQ ID NO: 2209869 - RNA, 17 nt, Human
ggugccugucccacccc

SEQ ID NO: 2209870 - RNA, 22 nt, Human
ggugccuggguggggcugcucc

SEQ ID NO: 2209871 - RNA, 19 nt, Human
ggugccuggguggggcugc

SEQ ID NO: 2209872 - RNA, 13 nt, Human
ggugccuguccca

SEQ ID NO: 2209873 - RNA, 18 nt, Human
ggugccuggguggggcug

SEQ ID NO: 2209874 - RNA, 21 nt, Human
ggugccugauucggcugucuc

SEQ ID NO: 2209875 - RNA, 14 nt, Human
ggugccugaggucu

SEQ ID NO: 2209876 - RNA, 18 nt, Human
ggugccugauucggcugu

SEQ ID NO: 2209877 - RNA, 19 nt, Human
ggugccugagaggcaggca

SEQ ID NO: 2209878 - RNA, 18 nt, Human
ggugaggaccacuccugu

SEQ ID NO: 2209879 - RNA, 22 nt, Human
ggugagcccauggcccucccag

SEQ ID NO: 2209880 - RNA, 18 nt, Human
ggugagcagacugguggg

SEQ ID NO: 2209881 - RNA, 19 nt, Human
ggugagcagaaguggagcu

SEQ ID NO: 2209882 - RNA, 14 nt, Human
ggugagcaaccagu

SEQ ID NO: 2209883 - RNA, 23 nt, Human
ggugagcacggccaacaaagcug

SEQ ID NO: 2209884 - RNA, 15 nt, Human
ggugaggaccacucc

SEQ ID NO: 2209885 - RNA, 19 nt, Human
ggugagcccauggcccucc

SEQ ID NO: 2209886 - RNA, 21 nt, Human
ggugccugugaggcaggggcg

SEQ ID NO: 2209887 - RNA, 19 nt, Human
ggugcgaccccaucugccc

SEQ ID NO: 2209888 - RNA, 22 nt, Human
ggugcuacacccuuuuccagcu

SEQ ID NO: 2209889 - RNA, 21 nt, Human
ggugcgaccccaucugcccag

SEQ ID NO: 2209890 - RNA, 22 nt, Human
ggugcgaccccaucugcccagg

SEQ ID NO: 2209891 - RNA, 15 nt, Human
ggugcuacgccugca

SEQ ID NO: 2209892 - RNA, 23 nt, Human
ggugcuacacccuuuuccagcug

SEQ ID NO: 2209893 - RNA, 23 nt, Human
ggugcuacaaaaacacagcaagg

SEQ ID NO: 2209894 - RNA, 16 nt, Human
ggugcuaucuccccca

SEQ ID NO: 2209895 - RNA, 17 nt, Human
ggugcuaucucccccag

SEQ ID NO: 2209896 - RNA, 19 nt, Human
ggugcuaucucccccagcc

SEQ ID NO: 2209897 - RNA, 20 nt, Human
ggugcuaucucccccagccc

SEQ ID NO: 2209898 - RNA, 17 nt, Human
gguggccaugccucagc

SEQ ID NO: 2209899 - RNA, 20 nt, Human
gguggccaugccucagcccu

SEQ ID NO: 2209900 - RNA, 12 nt, Human
gguggccucggg

SEQ ID NO: 2209901 - RNA, 22 nt, Human
gguggccucgggacaccugccc

SEQ ID NO: 2209902 - RNA, 23 nt, Human
gguggccucccaacucaccccag

SEQ ID NO: 2209903 - RNA, 20 nt, Human
gguggcuagucaagcuccuc

SEQ ID NO: 2209904 - RNA, 19 nt, Human
gguggcgggcaccuauagu

SEQ ID NO: 2209905 - RNA, 21 nt, Human
gguggcgggcgccuguaaucc

SEQ ID NO: 2209906 - RNA, 21 nt, Human
gguggcgacucuauagacucu

SEQ ID NO: 2209907 - RNA, 23 nt, Human
gguggccucuccuuguggccugg

SEQ ID NO: 2209908 - RNA, 10 nt, Human
gguggccaug

SEQ ID NO: 2209909 - RNA, 23 nt, Human
gguggccacuccagaccccuggc

SEQ ID NO: 2209910 - RNA, 22 nt, Human
gguggccucccaacucacccca

SEQ ID NO: 2209911 - RNA, 17 nt, Human
gguggcaucccaguggc

SEQ ID NO: 2209912 - RNA, 20 nt, Human
gguggccacuccagaccccu

SEQ ID NO: 2209913 - RNA, 21 nt, Human
gguggccacuccagaccccug

SEQ ID NO: 2209914 - RNA, 22 nt, Human
gguggccacuccagaccccugg

SEQ ID NO: 2209915 - RNA, 13 nt, Human
ggugcugagaagc

SEQ ID NO: 2209916 - RNA, 21 nt, Human
ggugcugacuucaucucccac

SEQ ID NO: 2209917 - RNA, 15 nt, Human
ggugcugccauccag

SEQ ID NO: 2209918 - RNA, 17 nt, Human
ggugcuauaggcuggag

SEQ ID NO: 2209919 - RNA, 19 nt, Human
ggugcuauaggcuggagaa

SEQ ID NO: 2209920 - RNA, 21 nt, Human
ggugcuauaggcuggagaagc

SEQ ID NO: 2209921 - RNA, 20 nt, Human
ggugcugacggccagggaga

SEQ ID NO: 2209922 - RNA, 17 nt, Human
ggugcugacggccaggg

SEQ ID NO: 2209923 - RNA, 16 nt, Human
ggugcugacggccagg

SEQ ID NO: 2209924 - RNA, 15 nt, Human
ggugcugacggccag

SEQ ID NO: 2209925 - RNA, 21 nt, Human
ggugcugccauccagguucag

SEQ ID NO: 2209926 - RNA, 19 nt, Human
gguggcagugggagcugcc

SEQ ID NO: 2209927 - RNA, 22 nt, Human
gguggcagugggagcugccugu

SEQ ID NO: 2209928 - RNA, 15 nt, Human
gguggcauacgccug

SEQ ID NO: 2209929 - RNA, 13 nt, Human
gguggcaucccag

SEQ ID NO: 2209930 - RNA, 12 nt, Human
ggugacaguggc

SEQ ID NO: 2209931 - RNA, 22 nt, Human
ggucugcucgggcccaggccau

SEQ ID NO: 2209932 - RNA, 14 nt, Human
ggugacaugugaaa

SEQ ID NO: 2209933 - RNA, 19 nt, Human
ggucugcucuuucucugcc

SEQ ID NO: 2209934 - RNA, 20 nt, Human
ggucugcucuuucucugcca

SEQ ID NO: 2209935 - RNA, 21 nt, Human
ggugacagagugagacucugu

SEQ ID NO: 2209936 - RNA, 17 nt, Human
ggucugcucgggcccag

SEQ ID NO: 2209937 - RNA, 18 nt, Human
ggucugcucgggcccagg

SEQ ID NO: 2209938 - RNA, 19 nt, Human
ggucugcucgggcccaggc

SEQ ID NO: 2209939 - RNA, 16 nt, Human
ggucugcucuuucucu

SEQ ID NO: 2209940 - RNA, 18 nt, Human
ggucugcucuuucucugc

SEQ ID NO: 2209941 - RNA, 23 nt, Human
ggucugcaggcagggcugacucu

SEQ ID NO: 2209942 - RNA, 14 nt, Human
ggucugcaggcagg

SEQ ID NO: 2209943 - RNA, 12 nt, Human
ggucugccacca

SEQ ID NO: 2209944 - RNA, 13 nt, Human
ggucugcaggcag

SEQ ID NO: 2209945 - RNA, 20 nt, Human
ggucugcaagucagaggaug

SEQ ID NO: 2209946 - RNA, 17 nt, Human
ggucugcaagucagagg

SEQ ID NO: 2209947 - RNA, 19 nt, Human
ggucugcaagucagaggau

SEQ ID NO: 2209948 - RNA, 23 nt, Human
ggucugccucuucugggagggca

SEQ ID NO: 2209949 - RNA, 16 nt, Human
ggucugcucgggccca

SEQ ID NO: 2209950 - RNA, 14 nt, Human
ggucugacccacug

SEQ ID NO: 2209951 - RNA, 22 nt, Human
ggucugaauguucugacauuaa

SEQ ID NO: 2209952 - RNA, 20 nt, Human
ggucugagucauggccgggu

SEQ ID NO: 2209953 - RNA, 21 nt, Human
ggucugaauguucugacauua

SEQ ID NO: 2209954 - RNA, 17 nt, Human
ggucugaauguucugac

SEQ ID NO: 2209955 - RNA, 14 nt, Human
ggucugcaagucag

SEQ ID NO: 2209956 - RNA, 15 nt, Human
ggucugcaagucaga

SEQ ID NO: 2209957 - RNA, 16 nt, Human
ggucugcaagucagag

SEQ ID NO: 2209958 - RNA, 15 nt, Human
ggugaccuucuggga

SEQ ID NO: 2209959 - RNA, 18 nt, Human
ggugacgccugcccuccc

SEQ ID NO: 2209960 - RNA, 23 nt, Human
ggugacugcgaucuucagagcag

SEQ ID NO: 2209961 - RNA, 19 nt, Human
ggugacugggcccugccuc

SEQ ID NO: 2209962 - RNA, 12 nt, Human
ggugagaacucu

SEQ ID NO: 2209963 - RNA, 21 nt, Human
ggugaccucugccugaaguca

SEQ ID NO: 2209964 - RNA, 19 nt, Human
ggugaccuuccaagagccu

SEQ ID NO: 2209965 - RNA, 21 nt, Human
ggugaccuuccaagagccuga

SEQ ID NO: 2209966 - RNA, 20 nt, Human
ggugaccuuccaagagccug

SEQ ID NO: 2209967 - RNA, 22 nt, Human
ggugaccagcaccaucucuccu

SEQ ID NO: 2209968 - RNA, 15 nt, Human
ggugacaugugaaac

SEQ ID NO: 2209969 - RNA, 18 nt, Human
ggugacaugugaaaccuu

SEQ ID NO: 2209970 - RNA, 21 nt, Human
ggugaccaaaauccccuucuc

SEQ ID NO: 2209971 - RNA, 17 nt, Human
ggucucaaacuccugac

SEQ ID NO: 2209972 - RNA, 15 nt, Human
ggucuauugucugua

SEQ ID NO: 2209973 - RNA, 17 nt, Human
ggucuauugucuguauu

SEQ ID NO: 2209974 - RNA, 18 nt, Human
ggucucacaguguugccc

SEQ ID NO: 2209975 - RNA, 23 nt, Human
ggucucaaacuccugggcucagg

SEQ ID NO: 2209976 - RNA, 21 nt, Human
ggucucaaacuccugggcuca

SEQ ID NO: 2209977 - RNA, 19 nt, Human
ggucuauugucuguauuug

SEQ ID NO: 2209978 - RNA, 12 nt, Human
ggucuauuucua

SEQ ID NO: 2209979 - RNA, 17 nt, Human
ggucccaccccacacac

SEQ ID NO: 2209980 - RNA, 14 nt, Human
ggucccaccccaca

SEQ ID NO: 2209981 - RNA, 20 nt, Human
ggucucacaguguugcccag

SEQ ID NO: 2209982 - RNA, 19 nt, Human
ggucucacaguguugccca

SEQ ID NO: 2209983 - RNA, 21 nt, Human
ggucucacaguguugcccagg

SEQ ID NO: 2209984 - RNA, 22 nt, Human
ggucucacucugucgcccaguc

SEQ ID NO: 2209985 - RNA, 23 nt, Human
ggucucacucugucgcccagucu

SEQ ID NO: 2209986 - RNA, 14 nt, Human
ggucugaauguucu

SEQ ID NO: 2209987 - RNA, 12 nt, Human
ggucugaauguu

SEQ ID NO: 2209988 - RNA, 11 nt, Human
ggucugaaugu

SEQ ID NO: 2209989 - RNA, 13 nt, Human
ggucugaaaugga

SEQ ID NO: 2209990 - RNA, 12 nt, Human
ggucugaaaugg

SEQ ID NO: 2209991 - RNA, 15 nt, Human
ggucucuugagggag

SEQ ID NO: 2209992 - RNA, 21 nt, Human
ggucucuugagggagcuuagc

SEQ ID NO: 2209993 - RNA, 20 nt, Human
ggucucuuacuuuccuuucc

SEQ ID NO: 2209994 - RNA, 19 nt, Human
ggucucugccggcucuuuc

SEQ ID NO: 2209995 - RNA, 12 nt, Human
ggucucugcugc

SEQ ID NO: 2209996 - RNA, 13 nt, Human
ggucucugcugcc

SEQ ID NO: 2209997 - RNA, 14 nt, Human
ggucucugcugccg

SEQ ID NO: 2209998 - RNA, 10 nt, Human
ggucucuggu

SEQ ID NO: 2209999 - RNA, 19 nt, Human
ggucucucucucucuacaa

SEQ ID NO: 2210000 - RNA, 18 nt, Human
ggucucuaggcuggggaa

SEQ ID NO: 2210001 - RNA, 15 nt, Human
ggucucccucuccug

SEQ ID NO: 2210002 - RNA, 22 nt, Human
ggucucgcugaugcugggcugg

SEQ ID NO: 2210003 - RNA, 14 nt, Human
ggucucccucuccu

SEQ ID NO: 2210004 - RNA, 16 nt, Human
ggucucccacguggga

SEQ ID NO: 2210005 - RNA, 18 nt, Human
ggucucaggcugguggga

SEQ ID NO: 2210006 - RNA, 20 nt, Human
ggucucagcagcgaccaccc

SEQ ID NO: 2210007 - RNA, 20 nt, Human
ggucucgcuuuguugcccag

SEQ ID NO: 2210008 - RNA, 19 nt, Human
ggucucgcuuuguugccca

SEQ ID NO: 2210009 - RNA, 21 nt, Human
ggucucgcuuuguugcccagg

SEQ ID NO: 2210010 - RNA, 23 nt, Human
ggucucgcugaugcugggcuggg

SEQ ID NO: 2210011 - RNA, 19 nt, Human
ggucucuagugcugugaaa

SEQ ID NO: 2210012 - RNA, 16 nt, Human
ggucucuagugcugug

SEQ ID NO: 2210013 - RNA, 15 nt, Human
ggucucuaggcuggg

SEQ ID NO: 2210014 - RNA, 16 nt, Human
ggucucuaggcugggg

SEQ ID NO: 2210015 - RNA, 17 nt, Human
ggucucuaggcugggga

SEQ ID NO: 2210016 - RNA, 19 nt, Human
gccuucggacaacucaguc

SEQ ID NO: 2210017 - RNA, 15 nt, Human
gccuugggcugcucc

SEQ ID NO: 2210018 - RNA, 14 nt, Human
gccuugggcugcuc

SEQ ID NO: 2210019 - RNA, 19 nt, Human
gccuucggccuccauccug

SEQ ID NO: 2210020 - RNA, 20 nt, Human
gccuuggcuguuggcaguga

SEQ ID NO: 2210021 - RNA, 22 nt, Human
gccuucgcuucuugccucugug

SEQ ID NO: 2210022 - RNA, 20 nt, Human
gccuucgcuucuugccucug

SEQ ID NO: 2210023 - RNA, 21 nt, Human
gccuucgcuucuugccucugu

SEQ ID NO: 2210024 - RNA, 22 nt, Human
gccuugggcugcuccucauggu

SEQ ID NO: 2210025 - RNA, 18 nt, Human
gccuuggggaauuuccuc

SEQ ID NO: 2210026 - RNA, 19 nt, Human
gccuuggggaauuuccucu

SEQ ID NO: 2210027 - RNA, 18 nt, Human
gccuugggcugcuccuca

SEQ ID NO: 2210028 - RNA, 16 nt, Human
gccuugggcugcuccu

SEQ ID NO: 2210029 - RNA, 18 nt, Human
gccuuggggcugaugcag

SEQ ID NO: 2210030 - RNA, 15 nt, Human
gccuuuaaaguauga

SEQ ID NO: 2210031 - RNA, 18 nt, Human
gccuuuaaaguaugaauc

SEQ ID NO: 2210032 - RNA, 17 nt, Human
gccuuuaaaucugugau

SEQ ID NO: 2210033 - RNA, 21 nt, Human
gccuuuaaaauuuuuuuagaa

SEQ ID NO: 2210034 - RNA, 21 nt, Human
gccuuuagugaucacagcagc

SEQ ID NO: 2210035 - RNA, 22 nt, Human
gccuuuagugaucacagcagcu

SEQ ID NO: 2210036 - RNA, 19 nt, Human
gccuuuagugaucacagca

SEQ ID NO: 2210037 - RNA, 19 nt, Human
gccuuuaaaucugugauga

SEQ ID NO: 2210038 - RNA, 23 nt, Human
gccuucccccucccagggccagg

SEQ ID NO: 2210039 - RNA, 18 nt, Human
gccuucccccucccaggg

SEQ ID NO: 2210040 - RNA, 17 nt, Human
gccuuccccagccucuu

SEQ ID NO: 2210041 - RNA, 16 nt, Human
gccuuccccagccucu

SEQ ID NO: 2210042 - RNA, 15 nt, Human
gccuuccccagccuc

SEQ ID NO: 2210043 - RNA, 14 nt, Human
gccuuccccagccu

SEQ ID NO: 2210044 - RNA, 20 nt, Human
gccuuccaugucggccucua

SEQ ID NO: 2210045 - RNA, 16 nt, Human
gccuuccccuugccca

SEQ ID NO: 2210046 - RNA, 14 nt, Human
gccuuccccugggc

SEQ ID NO: 2210047 - RNA, 22 nt, Human
gccuucgcgguggaaggcccga

SEQ ID NO: 2210048 - RNA, 17 nt, Human
gccuucgcuucuugccu

SEQ ID NO: 2210049 - RNA, 18 nt, Human
gccuucggccuccauccu

SEQ ID NO: 2210050 - RNA, 20 nt, Human
gccuucacuccggugugccu

SEQ ID NO: 2210051 - RNA, 23 nt, Human
gccuucagacagagaggacugua

SEQ ID NO: 2210052 - RNA, 13 nt, Human
gccuucagcucua

SEQ ID NO: 2210053 - RNA, 16 nt, Human
gccuucagauguucuc

SEQ ID NO: 2210054 - RNA, 17 nt, Human
gccuucagaaccaucca

SEQ ID NO: 2210055 - RNA, 21 nt, Human
gccuuccauaauuaugacagu

SEQ ID NO: 2210056 - RNA, 17 nt, Human
gccuuccaugucggccu

SEQ ID NO: 2210057 - RNA, 18 nt, Human
gccuuccaugucggccuc

SEQ ID NO: 2210058 - RNA, 19 nt, Human
gccuuccaugucggccucu

SEQ ID NO: 2210059 - RNA, 16 nt, Human
gccuuccauaauuaug

SEQ ID NO: 2210060 - RNA, 15 nt, Human
gccuuccauaauuau

SEQ ID NO: 2210061 - RNA, 14 nt, Human
gccuuccauaauua

SEQ ID NO: 2210062 - RNA, 13 nt, Human
gccuuccauaauu

SEQ ID NO: 2210063 - RNA, 16 nt, Human
gccuucagcucuacag

SEQ ID NO: 2210064 - RNA, 14 nt, Human
gccuuuugcacccc

SEQ ID NO: 2210065 - RNA, 15 nt, Human
gccuuuugcaccccu

SEQ ID NO: 2210066 - RNA, 16 nt, Human
gccuuuugcaccccuc

SEQ ID NO: 2210067 - RNA, 17 nt, Human
gccuuuugcaccccucc

SEQ ID NO: 2210068 - RNA, 18 nt, Human
gccuuuugcaccccuccc

SEQ ID NO: 2210069 - RNA, 19 nt, Human
gccuuuugcaccccuccca

SEQ ID NO: 2210070 - RNA, 14 nt, Human
gccuuuucuagccc

SEQ ID NO: 2210071 - RNA, 13 nt, Human
gccuuuucccucu

SEQ ID NO: 2210072 - RNA, 20 nt, Human
gccuuuucccucuuuggcuc

SEQ ID NO: 2210073 - RNA, 16 nt, Human
gccuuuuauuucuuaa

SEQ ID NO: 2210074 - RNA, 14 nt, Human
gccuuuuauagcua

SEQ ID NO: 2210075 - RNA, 18 nt, Human
gccuuuuauaaaccucua

SEQ ID NO: 2210076 - RNA, 22 nt, Human
gccuuuauuguguuugucauua

SEQ ID NO: 2210077 - RNA, 23 nt, Human
gccuuuauuguguuugucauuag

SEQ ID NO: 2210078 - RNA, 14 nt, Human
gccuuuauuguguu

SEQ ID NO: 2210079 - RNA, 20 nt, Human
gccuuuauuguguuugucau

SEQ ID NO: 2210080 - RNA, 13 nt, Human
gccuuuauugugu

SEQ ID NO: 2210081 - RNA, 14 nt, Human
gccuuuaugguuuc

SEQ ID NO: 2210082 - RNA, 16 nt, Human
gcgacauagcccaucc

SEQ ID NO: 2210083 - RNA, 17 nt, Human
gcgacauagcccauccc

SEQ ID NO: 2210084 - RNA, 15 nt, Human
gcgaccaccccugcc

SEQ ID NO: 2210085 - RNA, 18 nt, Human
gcgacauagcccaucccu

SEQ ID NO: 2210086 - RNA, 21 nt, Human
gcgacauagcccaucccugcc

SEQ ID NO: 2210087 - RNA, 19 nt, Human
gcgaccaccccugccucca

SEQ ID NO: 2210088 - RNA, 16 nt, Human
gcgaccaccccugccu

SEQ ID NO: 2210089 - RNA, 14 nt, Human
gcgaccccaucugc

SEQ ID NO: 2210090 - RNA, 15 nt, Human
gcgaccccaucugcc

SEQ ID NO: 2210091 - RNA, 16 nt, Human
gcgaccccaucugccc

SEQ ID NO: 2210092 - RNA, 17 nt, Human
gcgaccccaucugccca

SEQ ID NO: 2210093 - RNA, 18 nt, Human
gcgaccccaucugcccag

SEQ ID NO: 2210094 - RNA, 13 nt, Human
gcgaccgcccccu

SEQ ID NO: 2210095 - RNA, 14 nt, Human
gcgaccgcccccuc

SEQ ID NO: 2210096 - RNA, 19 nt, Human
gcgaccccaucugcccagg

SEQ ID NO: 2210097 - RNA, 20 nt, Human
gcgaccccaucugcccagga

SEQ ID NO: 2210098 - RNA, 17 nt, Human
gcgaccccgucacagcc

SEQ ID NO: 2210099 - RNA, 15 nt, Human
gcgaccgcccccucc

SEQ ID NO: 2210100 - RNA, 23 nt, Human
gcgaccucuccaucuucagcuuc

SEQ ID NO: 2210101 - RNA, 15 nt, Human
gcgaccuuccucauc

SEQ ID NO: 2210102 - RNA, 22 nt, Human
gcgaccuuccucauccacccca

SEQ ID NO: 2210103 - RNA, 22 nt, Human
gcgacagugagacucugucuca

SEQ ID NO: 2210104 - RNA, 20 nt, Human
gccuuuugcaccccucccau

SEQ ID NO: 2210105 - RNA, 15 nt, Human
gccuguaaucccagc

SEQ ID NO: 2210106 - RNA, 18 nt, Human
gccuguaaucccagcagu

SEQ ID NO: 2210107 - RNA, 17 nt, Human
gccuguaaucccagcag

SEQ ID NO: 2210108 - RNA, 19 nt, Human
gccuguaaucccagcacuu

SEQ ID NO: 2210109 - RNA, 20 nt, Human
gccuguaaucccagcacuuu

SEQ ID NO: 2210110 - RNA, 17 nt, Human
gccuguaaucccagcac

SEQ ID NO: 2210111 - RNA, 16 nt, Human
gccuguaaucccagca

SEQ ID NO: 2210112 - RNA, 18 nt, Human
gccuguaaucccagcacu

SEQ ID NO: 2210113 - RNA, 14 nt, Human
gccuguccagccug

SEQ ID NO: 2210114 - RNA, 13 nt, Human
gccuguccagccu

SEQ ID NO: 2210115 - RNA, 12 nt, Human
gccuguccagcc

SEQ ID NO: 2210116 - RNA, 18 nt, Human
gccuguaaucacagcuac

SEQ ID NO: 2210117 - RNA, 16 nt, Human
gccugguggcagcugc

SEQ ID NO: 2210118 - RNA, 17 nt, Human
gccugguggcagcugcg

SEQ ID NO: 2210119 - RNA, 22 nt, Human
gccuggagauccuccugcagac

SEQ ID NO: 2210120 - RNA, 13 nt, Human
gccuggagaagcu

SEQ ID NO: 2210121 - RNA, 17 nt, Human
gccuggagauccuccug

SEQ ID NO: 2210122 - RNA, 18 nt, Human
gccuggagauccuccugc

SEQ ID NO: 2210123 - RNA, 19 nt, Human
gccuggagauccuccugca

SEQ ID NO: 2210124 - RNA, 20 nt, Human
gccuggagauccuccugcag

SEQ ID NO: 2210125 - RNA, 15 nt, Human
gccugguggcagcug

SEQ ID NO: 2210126 - RNA, 11 nt, Human
gccuggaccug

SEQ ID NO: 2210127 - RNA, 14 nt, Human
gccuggaccugccu

SEQ ID NO: 2210128 - RNA, 15 nt, Human
gccuggaccugccuc

SEQ ID NO: 2210129 - RNA, 16 nt, Human
gccuggaccugccucc

SEQ ID NO: 2210130 - RNA, 17 nt, Human
gccuggaccugccuccu

SEQ ID NO: 2210131 - RNA, 14 nt, Human
gccuggacuuuccu

SEQ ID NO: 2210132 - RNA, 18 nt, Human
gccuggaccugccuccug

SEQ ID NO: 2210133 - RNA, 19 nt, Human
gccuggaccugccuccugc

SEQ ID NO: 2210134 - RNA, 15 nt, Human
gccuggacuuuccug

SEQ ID NO: 2210135 - RNA, 16 nt, Human
gccuggacuuuccugc

SEQ ID NO: 2210136 - RNA, 17 nt, Human
gccuggacuuuccugca

SEQ ID NO: 2210137 - RNA, 18 nt, Human
gccuggacuuuccugcaa

SEQ ID NO: 2210138 - RNA, 23 nt, Human
gccuggaccugccuccugccugc

SEQ ID NO: 2210139 - RNA, 12 nt, Human
gccuggagaagc

SEQ ID NO: 2210140 - RNA, 15 nt, Human
gccuggagaagcuga

SEQ ID NO: 2210141 - RNA, 17 nt, Human
gccuggagacuuagggc

SEQ ID NO: 2210142 - RNA, 19 nt, Human
gccuggagacuuagggcac

SEQ ID NO: 2210143 - RNA, 23 nt, Human
gccuggagacuuagggcaccagg

SEQ ID NO: 2210144 - RNA, 16 nt, Human
gccuggagauccuccu

SEQ ID NO: 2210145 - RNA, 17 nt, Human
gccuguccagccugggc

SEQ ID NO: 2210146 - RNA, 15 nt, Human
gccuguccagccugg

SEQ ID NO: 2210147 - RNA, 20 nt, Human
gccugucccacccccacccc

SEQ ID NO: 2210148 - RNA, 21 nt, Human
gccugucccauggacacucca

SEQ ID NO: 2210149 - RNA, 18 nt, Human
gccugucccucucaggca

SEQ ID NO: 2210150 - RNA, 22 nt, Human
gccugucccauggacacuccag

SEQ ID NO: 2210151 - RNA, 14 nt, Human
gccugucccucuca

SEQ ID NO: 2210152 - RNA, 22 nt, Human
gccuguccuccaacaccaagca

SEQ ID NO: 2210153 - RNA, 14 nt, Human
gccuuaccuccugc

SEQ ID NO: 2210154 - RNA, 13 nt, Human
gccuuaccuccug

SEQ ID NO: 2210155 - RNA, 12 nt, Human
gccuuaccuccu

SEQ ID NO: 2210156 - RNA, 20 nt, Human
gccuguccugaccugucuca

SEQ ID NO: 2210157 - RNA, 19 nt, Human
gccuuacccucauguucuu

SEQ ID NO: 2210158 - RNA, 20 nt, Human
gccuuagaagucacacagua

SEQ ID NO: 2210159 - RNA, 13 nt, Human
gccuuagagccag

SEQ ID NO: 2210160 - RNA, 14 nt, Human
gccuuagagccagg

SEQ ID NO: 2210161 - RNA, 15 nt, Human
gccuuagagccaggc

SEQ ID NO: 2210162 - RNA, 17 nt, Human
gccuuagagccaggcac

SEQ ID NO: 2210163 - RNA, 22 nt, Human
gccuuaccuccugcccaggaga

SEQ ID NO: 2210164 - RNA, 21 nt, Human
gccuuaccuccugcccaggag

SEQ ID NO: 2210165 - RNA, 20 nt, Human
gccuuaccuccugcccagga

SEQ ID NO: 2210166 - RNA, 19 nt, Human
gccuuaccuccugcccagg

SEQ ID NO: 2210167 - RNA, 18 nt, Human
gccuuaccuccugcccag

SEQ ID NO: 2210168 - RNA, 17 nt, Human
gccuuaccuccugccca

SEQ ID NO: 2210169 - RNA, 16 nt, Human
gccuuaccuccugccc

SEQ ID NO: 2210170 - RNA, 15 nt, Human
gccuuaccuccugcc

SEQ ID NO: 2210171 - RNA, 16 nt, Human
gccuuagaaccuuucu

SEQ ID NO: 2210172 - RNA, 15 nt, Human
gccuuagucucaguu

SEQ ID NO: 2210173 - RNA, 23 nt, Human
gccuuagagccaggcacacacug

SEQ ID NO: 2210174 - RNA, 14 nt, Human
gccuuagcauguuu

SEQ ID NO: 2210175 - RNA, 15 nt, Human
gccuuagcauguuug

SEQ ID NO: 2210176 - RNA, 17 nt, Human
gccuuagcauguuugcu

SEQ ID NO: 2210177 - RNA, 18 nt, Human
gccuuagcauguuugcug

SEQ ID NO: 2210178 - RNA, 20 nt, Human
gccuuagcauguuugcugaa

SEQ ID NO: 2210179 - RNA, 21 nt, Human
gccuuauggaacacucugaga

SEQ ID NO: 2210180 - RNA, 22 nt, Human
gccuuauggaacacucugagac

SEQ ID NO: 2210181 - RNA, 23 nt, Human
gccuuauggaacacucugagacu

SEQ ID NO: 2210182 - RNA, 22 nt, Human
gccuuagucucaguuugugugu

SEQ ID NO: 2210183 - RNA, 18 nt, Human
gccuuagucucaguuugu

SEQ ID NO: 2210184 - RNA, 12 nt, Human
gccuuauuaaag

SEQ ID NO: 2210185 - RNA, 19 nt, Human
gccuuauuagagugucuuu

SEQ ID NO: 2210186 - RNA, 15 nt, Human
gccuucaauaaaugg

SEQ ID NO: 2210187 - RNA, 16 nt, Human
gcgucgcccucccagg

SEQ ID NO: 2210188 - RNA, 15 nt, Human
gcgugagaccugccc

SEQ ID NO: 2210189 - RNA, 14 nt, Human
gcgugagccacugc

SEQ ID NO: 2210190 - RNA, 16 nt, Human
gcgugagccacugcac

SEQ ID NO: 2210191 - RNA, 16 nt, Human
gcgugagaccugcccc

SEQ ID NO: 2210192 - RNA, 15 nt, Human
gcgugagccacugca

SEQ ID NO: 2210193 - RNA, 22 nt, Human
gcuaacccccuucuacugagcc

SEQ ID NO: 2210194 - RNA, 14 nt, Human
gcuaacauuuuaaa

SEQ ID NO: 2210195 - RNA, 17 nt, Human
gcuaacauuuuaaauaa

SEQ ID NO: 2210196 - RNA, 23 nt, Human
gcuaacauuuuaaauaaaagaaa

SEQ ID NO: 2210197 - RNA, 14 nt, Human
gcuaacauggaagu

SEQ ID NO: 2210198 - RNA, 24 nt, Human
gcguccuguccacacccagcucag

SEQ ID NO: 2210199 - RNA, 11 nt, Human
gcgugagacgc

SEQ ID NO: 2210200 - RNA, 15 nt, Human
gcgugagacgccacc

SEQ ID NO: 2210201 - RNA, 13 nt, Human
gcuaacauuuuaa

SEQ ID NO: 2210202 - RNA, 17 nt, Human
gcuaacauggaaguacu

SEQ ID NO: 2210203 - RNA, 18 nt, Human
gcuaacauggaaguacua

SEQ ID NO: 2210204 - RNA, 13 nt, Human
gcuacaccuuucu

SEQ ID NO: 2210205 - RNA, 19 nt, Human
gcuacacccuuuuccagcu

SEQ ID NO: 2210206 - RNA, 15 nt, Human
gcuacaccuuucucc

SEQ ID NO: 2210207 - RNA, 20 nt, Human
gcuacaccuuucuccuuugu

SEQ ID NO: 2210208 - RNA, 22 nt, Human
gcuacacaggggaaaagaggag

SEQ ID NO: 2210209 - RNA, 17 nt, Human
gcuacacccuuuuccag

SEQ ID NO: 2210210 - RNA, 21 nt, Human
gcuaacuagcuuggaaacugg

SEQ ID NO: 2210211 - RNA, 12 nt, Human
gcuaacuggaag

SEQ ID NO: 2210212 - RNA, 21 nt, Human
gcuaacauuuuaaauaaaaga

SEQ ID NO: 2210213 - RNA, 21 nt, Human
gcuaacccccuucuacugagc

SEQ ID NO: 2210214 - RNA, 20 nt, Human
gcuaacuuggagccccagug

SEQ ID NO: 2210215 - RNA, 13 nt, Human
gcuaacuggaagc

SEQ ID NO: 2210216 - RNA, 18 nt, Human
gcuaacuuggagccccag

SEQ ID NO: 2210217 - RNA, 14 nt, Human
gcuaagaaaagauu

SEQ ID NO: 2210218 - RNA, 17 nt, Human
gcuaagaaccuggaacu

SEQ ID NO: 2210219 - RNA, 16 nt, Human
gcuaagaaccuggaac

SEQ ID NO: 2210220 - RNA, 23 nt, Human
gcuaagaaccuggaacuugggga

SEQ ID NO: 2210221 - RNA, 14 nt, Human
gcuaagaauauuug

SEQ ID NO: 2210222 - RNA, 20 nt, Human
gcuagaggaaccaaccccca

SEQ ID NO: 2210223 - RNA, 21 nt, Human
gcuagagauauggcagcgaaa

SEQ ID NO: 2210224 - RNA, 20 nt, Human
gcuagagauauggcagcgaa

SEQ ID NO: 2210225 - RNA, 14 nt, Human
gcuaccucacuggg

SEQ ID NO: 2210226 - RNA, 15 nt, Human
gcuagacacccauuu

SEQ ID NO: 2210227 - RNA, 17 nt, Human
gcuaccucaagggggac

SEQ ID NO: 2210228 - RNA, 13 nt, Human
gcuaccucaaggg

SEQ ID NO: 2210229 - RNA, 22 nt, Human
gcuacccuuuuucuccagcugg

SEQ ID NO: 2210230 - RNA, 18 nt, Human
gcuacccuuuuucuccag

SEQ ID NO: 2210231 - RNA, 19 nt, Human
gcuacccuuuuucuccagc

SEQ ID NO: 2210232 - RNA, 20 nt, Human
gcuacccuuuuucuccagcu

SEQ ID NO: 2210233 - RNA, 21 nt, Human
gcuacccuuuuucuccagcug

SEQ ID NO: 2210234 - RNA, 21 nt, Human
gcuagacgagcaggcuucuuc

SEQ ID NO: 2210235 - RNA, 22 nt, Human
gcuagacgagcaggcuucuucc

SEQ ID NO: 2210236 - RNA, 20 nt, Human
gcuacccccaugcuggaggu

SEQ ID NO: 2210237 - RNA, 16 nt, Human
gcuacccucccugcug

SEQ ID NO: 2210238 - RNA, 17 nt, Human
gcuacccucccugcugu

SEQ ID NO: 2210239 - RNA, 17 nt, Human
gcuacccacuucuaaau

SEQ ID NO: 2210240 - RNA, 19 nt, Human
gcuacccugagcugaggca

SEQ ID NO: 2210241 - RNA, 16 nt, Human
gcuacccuuuuucucc

SEQ ID NO: 2210242 - RNA, 20 nt, Human
gcuacccugagcugaggcag

SEQ ID NO: 2210243 - RNA, 16 nt, Human
gcuacccugagcugag

SEQ ID NO: 2210244 - RNA, 14 nt, Human
gcuacccugagcug

SEQ ID NO: 2210245 - RNA, 12 nt, Human
gcuacccugagc

SEQ ID NO: 2210246 - RNA, 19 nt, Human
gcuacccucccugcugucc

SEQ ID NO: 2210247 - RNA, 23 nt, Human
gcuacccucccugcuguccccuc

SEQ ID NO: 2210248 - RNA, 20 nt, Human
gcuaccaaagcaccuuagcu

SEQ ID NO: 2210249 - RNA, 17 nt, Human
gcgcccaguccuuccac

SEQ ID NO: 2210250 - RNA, 17 nt, Human
gcgcccaccuccccacg

SEQ ID NO: 2210251 - RNA, 12 nt, Human
gcgcccaccucc

SEQ ID NO: 2210252 - RNA, 13 nt, Human
gcgcccaccuccc

SEQ ID NO: 2210253 - RNA, 18 nt, Human
gcgccuacaggagugagc

SEQ ID NO: 2210254 - RNA, 20 nt, Human
gcgccauugcacuccagccu

SEQ ID NO: 2210255 - RNA, 16 nt, Human
gcgcccaccccgcucu

SEQ ID NO: 2210256 - RNA, 16 nt, Human
gcgccauugcacucca

SEQ ID NO: 2210257 - RNA, 22 nt, Human
gcgccaggcugaccacagcaca

SEQ ID NO: 2210258 - RNA, 20 nt, Human
gcgccaggcugaccacagca

SEQ ID NO: 2210259 - RNA, 15 nt, Human
gcgccaggcugacca

SEQ ID NO: 2210260 - RNA, 22 nt, Human
gcgccaggauggaacacggcca

SEQ ID NO: 2210261 - RNA, 21 nt, Human
gcgccaggauggaacacggcc

SEQ ID NO: 2210262 - RNA, 23 nt, Human
gcgaccuuccucauccaccccau

SEQ ID NO: 2210263 - RNA, 21 nt, Human
gcgacguuagucgugagcucu

SEQ ID NO: 2210264 - RNA, 22 nt, Human
gcgacguuagucgugagcucuu

SEQ ID NO: 2210265 - RNA, 23 nt, Human
gcgacuaauuucaaaaugcuuuu

SEQ ID NO: 2210266 - RNA, 21 nt, Human
gcgacuaauuucaaaaugcuu

SEQ ID NO: 2210267 - RNA, 13 nt, Human
gcgacuaauuuca

SEQ ID NO: 2210268 - RNA, 21 nt, Human
gcgaccccaucugcccaggac

SEQ ID NO: 2210269 - RNA, 21 nt, Human
gcgacucuauagacucuagga

SEQ ID NO: 2210270 - RNA, 20 nt, Human
gcgacuccguuggccacucc

SEQ ID NO: 2210271 - RNA, 18 nt, Human
gcgacuccguuggccacu

SEQ ID NO: 2210272 - RNA, 19 nt, Human
gcgacuccguuggccacuc

SEQ ID NO: 2210273 - RNA, 12 nt, Human
gcgacuuucugc

SEQ ID NO: 2210274 - RNA, 17 nt, Human
gcgccagcacagaaaca

SEQ ID NO: 2210275 - RNA, 21 nt, Human
gcgccagcacagaaacagagg

SEQ ID NO: 2210276 - RNA, 19 nt, Human
gcgcccaguccuuccaccu

SEQ ID NO: 2210277 - RNA, 21 nt, Human
gcgccuaguggggucucccuc

SEQ ID NO: 2210278 - RNA, 20 nt, Human
gcgccuaguggggucucccu

SEQ ID NO: 2210279 - RNA, 19 nt, Human
gcgcuccugccgcagagcu

SEQ ID NO: 2210280 - RNA, 20 nt, Human
gcgcuccugccgcagagcug

SEQ ID NO: 2210281 - RNA, 21 nt, Human
gcgcuccugccgcagagcugg

SEQ ID NO: 2210282 - RNA, 20 nt, Human
gcgccuacaggagugagcac

SEQ ID NO: 2210283 - RNA, 21 nt, Human
gcgccuacaggagugagcacu

SEQ ID NO: 2210284 - RNA, 19 nt, Human
gcgcugacaaccaccgcuc

SEQ ID NO: 2210285 - RNA, 16 nt, Human
gcgcucuagccugggc

SEQ ID NO: 2210286 - RNA, 14 nt, Human
gcgcugccccuggc

SEQ ID NO: 2210287 - RNA, 23 nt, Human
gcgcugacaaccaccgcucccca

SEQ ID NO: 2210288 - RNA, 11 nt, Human
gcgcugcaaau

SEQ ID NO: 2210289 - RNA, 15 nt, Human
gcgcuggcccagccg

SEQ ID NO: 2210290 - RNA, 17 nt, Human
gcgcugccccuggcagc

SEQ ID NO: 2210291 - RNA, 19 nt, Human
gcgcuggccgggaccccga

SEQ ID NO: 2210292 - RNA, 16 nt, Human
gcgcuggcccagccgg

SEQ ID NO: 2210293 - RNA, 17 nt, Human
gcgcuggcccagccggc

SEQ ID NO: 2210294 - RNA, 16 nt, Human
gcggacaucagcuggu

SEQ ID NO: 2210295 - RNA, 18 nt, Human
gcggggacagcuccuucu

SEQ ID NO: 2210296 - RNA, 19 nt, Human
gcggggacagcuccuucug

SEQ ID NO: 2210297 - RNA, 20 nt, Human
gcggaacaaggagucagaca

SEQ ID NO: 2210298 - RNA, 17 nt, Human
gcgcuuuugcuggucac

SEQ ID NO: 2210299 - RNA, 15 nt, Human
gcggaaagcagcuca

SEQ ID NO: 2210300 - RNA, 22 nt, Human
gcgcuuucuggaaaagaggagu

SEQ ID NO: 2210301 - RNA, 23 nt, Human
gcggacagccacggccaggccag

SEQ ID NO: 2210302 - RNA, 19 nt, Human
gcggaaugaaccacaucuu

SEQ ID NO: 2210303 - RNA, 15 nt, Human
gcgcuuucuggaaaa

SEQ ID NO: 2210304 - RNA, 19 nt, Human
gcgcuggcccagccggccu

SEQ ID NO: 2210305 - RNA, 16 nt, Human
gcggacagccacggcc

SEQ ID NO: 2210306 - RNA, 19 nt, Human
gcggacagccacggccagg

SEQ ID NO: 2210307 - RNA, 22 nt, Human
gcgguccccuccgccaggcgag

SEQ ID NO: 2210308 - RNA, 20 nt, Human
gcggggcgaagcccaggccc

SEQ ID NO: 2210309 - RNA, 22 nt, Human
gcggucucaggcuggugggagg

SEQ ID NO: 2210310 - RNA, 20 nt, Human
gcggucucaggcugguggga

SEQ ID NO: 2210311 - RNA, 16 nt, Human
gcguccgcgcgccagc

SEQ ID NO: 2210312 - RNA, 19 nt, Human
gcgguccccuccgccaggc

SEQ ID NO: 2210313 - RNA, 13 nt, Human
gcguccuguccac

SEQ ID NO: 2210314 - RNA, 20 nt, Human
gcguccuccucaccucaugc

SEQ ID NO: 2210315 - RNA, 19 nt, Human
gcguccuguccacacccag

SEQ ID NO: 2210316 - RNA, 21 nt, Human
gcguccuguccacacccagcu

SEQ ID NO: 2210317 - RNA, 16 nt, Human
gcguccuccucuguga

SEQ ID NO: 2210318 - RNA, 15 nt, Human
gcguccuccucugug

SEQ ID NO: 2210319 - RNA, 14 nt, Human
gcguccuccucugu

SEQ ID NO: 2210320 - RNA, 19 nt, Human
gcguccgcgcgccagcaca

SEQ ID NO: 2210321 - RNA, 20 nt, Human
gcguccgcgcgccagcacag

SEQ ID NO: 2210322 - RNA, 23 nt, Human
gcggggacagcuccuucuguccu

SEQ ID NO: 2210323 - RNA, 20 nt, Human
gcgguccacccaggagcccc

SEQ ID NO: 2210324 - RNA, 19 nt, Human
gcggggacucgguaagcac

SEQ ID NO: 2210325 - RNA, 12 nt, Human
gcggggccuugc

SEQ ID NO: 2210326 - RNA, 17 nt, Human
gcggggcgaagcccagg

SEQ ID NO: 2210327 - RNA, 18 nt, Human
gcggggcgaagcccaggc

SEQ ID NO: 2210328 - RNA, 23 nt, Human
gcgguccacccaggagccccgag

SEQ ID NO: 2210329 - RNA, 20 nt, Human
gccugaagaguccucugaau

SEQ ID NO: 2210330 - RNA, 15 nt, Human
gccugaaccuuccau

SEQ ID NO: 2210331 - RNA, 15 nt, Human
gccugaagucacaca

SEQ ID NO: 2210332 - RNA, 18 nt, Human
gccugaagaguccucuga

SEQ ID NO: 2210333 - RNA, 14 nt, Human
gccugaaccuucca

SEQ ID NO: 2210334 - RNA, 21 nt, Human
gccugaacauccuuccuuccc

SEQ ID NO: 2210335 - RNA, 21 nt, Human
gccugagaguauuuaggcaga

SEQ ID NO: 2210336 - RNA, 13 nt, Human
gccugagaguauu

SEQ ID NO: 2210337 - RNA, 22 nt, Human
gccugaaggggcgucuguuccc

SEQ ID NO: 2210338 - RNA, 18 nt, Human
gccugaaggggcgucugu

SEQ ID NO: 2210339 - RNA, 17 nt, Human
gccugaaggggcgucug

SEQ ID NO: 2210340 - RNA, 16 nt, Human
gccugagauuucaucu

SEQ ID NO: 2210341 - RNA, 13 nt, Human
gccugagaugguc

SEQ ID NO: 2210342 - RNA, 18 nt, Human
gccugagauuucaucugc

SEQ ID NO: 2210343 - RNA, 22 nt, Human
gccugagauuucaucugcucuc

SEQ ID NO: 2210344 - RNA, 12 nt, Human
gccucugcauuc

SEQ ID NO: 2210345 - RNA, 15 nt, Human
gccucugcacucccc

SEQ ID NO: 2210346 - RNA, 21 nt, Human
gccucugcacuccccugcugg

SEQ ID NO: 2210347 - RNA, 14 nt, Human
gccugaaaggagcc

SEQ ID NO: 2210348 - RNA, 23 nt, Human
gccugaaagaggcugaggccugg

SEQ ID NO: 2210349 - RNA, 14 nt, Human
gccugaacauccuu

SEQ ID NO: 2210350 - RNA, 18 nt, Human
gccugaaauuucaccauu

SEQ ID NO: 2210351 - RNA, 15 nt, Human
gccugaacauccuuc

SEQ ID NO: 2210352 - RNA, 23 nt, Human
gccugaaaggagcccuuaucugu

SEQ ID NO: 2210353 - RNA, 17 nt, Human
gccugaaaggagcccuu

SEQ ID NO: 2210354 - RNA, 16 nt, Human
gccucugacacacagc

SEQ ID NO: 2210355 - RNA, 16 nt, Human
gccucugcacuccccu

SEQ ID NO: 2210356 - RNA, 19 nt, Human
gccucucuugguuuccuuc

SEQ ID NO: 2210357 - RNA, 23 nt, Human
gccucucuggccucccacccgau

SEQ ID NO: 2210358 - RNA, 15 nt, Human
gccucugacacacag

SEQ ID NO: 2210359 - RNA, 17 nt, Human
gccucugcacuccccug

SEQ ID NO: 2210360 - RNA, 18 nt, Human
gccucugcacuccccugc

SEQ ID NO: 2210361 - RNA, 19 nt, Human
gccucugcacuccccugcu

SEQ ID NO: 2210362 - RNA, 20 nt, Human
gccucugcacuccccugcug

SEQ ID NO: 2210363 - RNA, 11 nt, Human
gccugcagccc

SEQ ID NO: 2210364 - RNA, 17 nt, Human
gccugcaggaccugccu

SEQ ID NO: 2210365 - RNA, 16 nt, Human
gccugcaggaccugcc

SEQ ID NO: 2210366 - RNA, 14 nt, Human
gccugcaggaccug

SEQ ID NO: 2210367 - RNA, 21 nt, Human
gccugcaggaccugccuguag

SEQ ID NO: 2210368 - RNA, 20 nt, Human
gccugcaggaccugccugua

SEQ ID NO: 2210369 - RNA, 19 nt, Human
gccugcaggaccugccugu

SEQ ID NO: 2210370 - RNA, 18 nt, Human
gccugcaggaccugccug

SEQ ID NO: 2210371 - RNA, 21 nt, Human
gccugcagaggucugugcuga

SEQ ID NO: 2210372 - RNA, 18 nt, Human
gccugccaguccuagcug

SEQ ID NO: 2210373 - RNA, 19 nt, Human
gccugccaguccuagcugc

SEQ ID NO: 2210374 - RNA, 20 nt, Human
gccugccaguccuagcugca

SEQ ID NO: 2210375 - RNA, 23 nt, Human
gccugccaguccuagcugcacag

SEQ ID NO: 2210376 - RNA, 22 nt, Human
gccugagcaacagagugagacc

SEQ ID NO: 2210377 - RNA, 23 nt, Human
gccugagauuucaucugcucucc

SEQ ID NO: 2210378 - RNA, 18 nt, Human
gccugagcaacucuugau

SEQ ID NO: 2210379 - RNA, 10 nt, Human
gccugcagcc

SEQ ID NO: 2210380 - RNA, 19 nt, Human
gccugcagaggucugugcu

SEQ ID NO: 2210381 - RNA, 20 nt, Human
gccugcagaggucugugcug

SEQ ID NO: 2210382 - RNA, 20 nt, Human
gccugcagagcugcgggcug

SEQ ID NO: 2210383 - RNA, 14 nt, Human
gccugagccuggcc

SEQ ID NO: 2210384 - RNA, 24 nt, Human
gccugcugggcucuccaccucagc

SEQ ID NO: 2210385 - RNA, 23 nt, Human
gccugcugggcucuccaccucag

SEQ ID NO: 2210386 - RNA, 22 nt, Human
gccugcugggcucuccaccuca

SEQ ID NO: 2210387 - RNA, 21 nt, Human
gccugcugggcucuccaccuc

SEQ ID NO: 2210388 - RNA, 20 nt, Human
gccugcugggcucuccaccu

SEQ ID NO: 2210389 - RNA, 19 nt, Human
gccugcugggcucuccacc

SEQ ID NO: 2210390 - RNA, 18 nt, Human
gccugcugggcucuccac

SEQ ID NO: 2210391 - RNA, 17 nt, Human
gccugcugggcucucca

SEQ ID NO: 2210392 - RNA, 16 nt, Human
gccugcugggcucucc

SEQ ID NO: 2210393 - RNA, 13 nt, Human
gccugcugggcuc

SEQ ID NO: 2210394 - RNA, 22 nt, Human
gccugcuggcacccaccgugga

SEQ ID NO: 2210395 - RNA, 13 nt, Human
gccugcuggcacc

SEQ ID NO: 2210396 - RNA, 16 nt, Human
gccugcuggcacccac

SEQ ID NO: 2210397 - RNA, 17 nt, Human
gccugcuggcacccacc

SEQ ID NO: 2210398 - RNA, 19 nt, Human
gccugcuggcacccaccgu

SEQ ID NO: 2210399 - RNA, 14 nt, Human
gccuggacccugug

SEQ ID NO: 2210400 - RNA, 17 nt, Human
gccugcuggucacagcc

SEQ ID NO: 2210401 - RNA, 18 nt, Human
gccugcuggucacagccu

SEQ ID NO: 2210402 - RNA, 19 nt, Human
gccugcuggucacagccuc

SEQ ID NO: 2210403 - RNA, 21 nt, Human
gccugcuggucacagccuccu

SEQ ID NO: 2210404 - RNA, 14 nt, Human
gccugcccacccgu

SEQ ID NO: 2210405 - RNA, 13 nt, Human
gccugcccacccg

SEQ ID NO: 2210406 - RNA, 10 nt, Human
gccugcccac

SEQ ID NO: 2210407 - RNA, 10 nt, Human
gccugcuggc

SEQ ID NO: 2210408 - RNA, 11 nt, Human
gccugcccagg

SEQ ID NO: 2210409 - RNA, 12 nt, Human
gccugcccaggc

SEQ ID NO: 2210410 - RNA, 17 nt, Human
gccucagcccugacccu

SEQ ID NO: 2210411 - RNA, 22 nt, Human
gccucagcccugacccugugga

SEQ ID NO: 2210412 - RNA, 22 nt, Human
gccucagccucccaaagugcug

SEQ ID NO: 2210413 - RNA, 12 nt, Human
gccucagccucc

SEQ ID NO: 2210414 - RNA, 14 nt, Human
gccucagccuccca

SEQ ID NO: 2210415 - RNA, 18 nt, Human
gccuccccgaaacaggcu

SEQ ID NO: 2210416 - RNA, 23 nt, Human
gccuccccauuucccaucugcac

SEQ ID NO: 2210417 - RNA, 21 nt, Human
gccuccccauuucccaucugc

SEQ ID NO: 2210418 - RNA, 22 nt, Human
gccuccccauuucccaucugca

SEQ ID NO: 2210419 - RNA, 21 nt, Human
gccuccccacggccgcuccag

SEQ ID NO: 2210420 - RNA, 22 nt, Human
gccuccccacggccgcuccagg

SEQ ID NO: 2210421 - RNA, 17 nt, Human
gccuccccagcucaccc

SEQ ID NO: 2210422 - RNA, 13 nt, Human
gccuccccauuuc

SEQ ID NO: 2210423 - RNA, 16 nt, Human
gccuccccauuuccca

SEQ ID NO: 2210424 - RNA, 18 nt, Human
gccuccccauuucccauc

SEQ ID NO: 2210425 - RNA, 19 nt, Human
gccuccccauuucccaucu

SEQ ID NO: 2210426 - RNA, 20 nt, Human
gccuccccauuucccaucug

SEQ ID NO: 2210427 - RNA, 12 nt, Human
gccuccccaccu

SEQ ID NO: 2210428 - RNA, 19 nt, Human
gccuccccacggccgcucc

SEQ ID NO: 2210429 - RNA, 22 nt, Human
gccuccccaacccugccccugc

SEQ ID NO: 2210430 - RNA, 21 nt, Human
gccuccccaacccugccccug

SEQ ID NO: 2210431 - RNA, 20 nt, Human
gccuccccaacccugccccu

SEQ ID NO: 2210432 - RNA, 19 nt, Human
gccuccccaacccugcccc

SEQ ID NO: 2210433 - RNA, 17 nt, Human
gccuccccaacccugcc

SEQ ID NO: 2210434 - RNA, 22 nt, Human
gccucccauccagggcccccau

SEQ ID NO: 2210435 - RNA, 15 nt, Human
gccucccauccaggg

SEQ ID NO: 2210436 - RNA, 18 nt, Human
gccucccgaauagcuggg

SEQ ID NO: 2210437 - RNA, 19 nt, Human
gccucccgaauagcuggga

SEQ ID NO: 2210438 - RNA, 21 nt, Human
gccucccgaguagcugggacu

SEQ ID NO: 2210439 - RNA, 23 nt, Human
gccucccgaguagcugggacuac

SEQ ID NO: 2210440 - RNA, 20 nt, Human
gccucccgaauagcugggac

SEQ ID NO: 2210441 - RNA, 18 nt, Human
gccucuccccagguccag

SEQ ID NO: 2210442 - RNA, 15 nt, Human
gccucucccaucacu

SEQ ID NO: 2210443 - RNA, 22 nt, Human
gccucccugaaaauguuuuucu

SEQ ID NO: 2210444 - RNA, 11 nt, Human
gccucccugaa

SEQ ID NO: 2210445 - RNA, 18 nt, Human
gccucccugaagccuuug

SEQ ID NO: 2210446 - RNA, 13 nt, Human
gccucccugaagc

SEQ ID NO: 2210447 - RNA, 21 nt, Human
gccucccucugaccugcaggc

SEQ ID NO: 2210448 - RNA, 20 nt, Human
gccucccucugaccugcagg

SEQ ID NO: 2210449 - RNA, 14 nt, Human
gccucccucugacc

SEQ ID NO: 2210450 - RNA, 12 nt, Human
gccucccucuga

SEQ ID NO: 2210451 - RNA, 23 nt, Human
gccucccucucucuucugcucca

SEQ ID NO: 2210452 - RNA, 22 nt, Human
gccucccucucucuucugcucc

SEQ ID NO: 2210453 - RNA, 21 nt, Human
gccucccucucucuucugcuc

SEQ ID NO: 2210454 - RNA, 16 nt, Human
gccucccucucucuuc

SEQ ID NO: 2210455 - RNA, 17 nt, Human
gccucccucacccugag

SEQ ID NO: 2210456 - RNA, 18 nt, Human
gccucccucacccugagc

SEQ ID NO: 2210457 - RNA, 20 nt, Human
gccucccucacccugagccc

SEQ ID NO: 2210458 - RNA, 14 nt, Human
gccucccucaaccc

SEQ ID NO: 2210459 - RNA, 13 nt, Human
gccucccucaacc

SEQ ID NO: 2210460 - RNA, 19 nt, Human
gccucccgcguugggcaac

SEQ ID NO: 2210461 - RNA, 16 nt, Human
gccucccuagccagca

SEQ ID NO: 2210462 - RNA, 10 nt, Human
gccucucugc

SEQ ID NO: 2210463 - RNA, 14 nt, Human
gccucucugcaggu

SEQ ID NO: 2210464 - RNA, 20 nt, Human
gccucuccccagguccagcu

SEQ ID NO: 2210465 - RNA, 22 nt, Human
gccucuccccagguccagcucu

SEQ ID NO: 2210466 - RNA, 23 nt, Human
gccucuccccagguccagcucug

SEQ ID NO: 2210467 - RNA, 12 nt, Human
gccucuccccug

SEQ ID NO: 2210468 - RNA, 13 nt, Human
gccucuccccuga

SEQ ID NO: 2210469 - RNA, 13 nt, Human
gccucucccguca

SEQ ID NO: 2210470 - RNA, 17 nt, Human
gccucucccgucagggc

SEQ ID NO: 2210471 - RNA, 18 nt, Human
gccucucccgucagggcc

SEQ ID NO: 2210472 - RNA, 19 nt, Human
gccucucccgucagggccc

SEQ ID NO: 2210473 - RNA, 16 nt, Human
gccucucugcaggucc

SEQ ID NO: 2210474 - RNA, 17 nt, Human
gccucucugcagguccc

SEQ ID NO: 2210475 - RNA, 17 nt, Human
gccucucucccagucua

SEQ ID NO: 2210476 - RNA, 23 nt, Human
gccucucccgucagggcccaagu

SEQ ID NO: 2210477 - RNA, 12 nt, Human
gccucucuggcc

SEQ ID NO: 2210478 - RNA, 13 nt, Human
gccucucuggccu

SEQ ID NO: 2210479 - RNA, 14 nt, Human
gccucucuggccuc

SEQ ID NO: 2210480 - RNA, 15 nt, Human
gccucucuggccucc

SEQ ID NO: 2210481 - RNA, 16 nt, Human
gccucucuggccuccc

SEQ ID NO: 2210482 - RNA, 17 nt, Human
gccucucuggccuccca

SEQ ID NO: 2210483 - RNA, 18 nt, Human
gccucucuggccucccac

SEQ ID NO: 2210484 - RNA, 19 nt, Human
gccucucuggccucccacc

SEQ ID NO: 2210485 - RNA, 20 nt, Human
gccucucuggccucccaccc

SEQ ID NO: 2210486 - RNA, 20 nt, Human
gccguugauguuggcuggga

SEQ ID NO: 2210487 - RNA, 17 nt, Human
gccguugauguuggcug

SEQ ID NO: 2210488 - RNA, 19 nt, Human
gccguugauguuggcuggg

SEQ ID NO: 2210489 - RNA, 14 nt, Human
gccuaaaaaugcaa

SEQ ID NO: 2210490 - RNA, 23 nt, Human
gccguuugagaagaaaacaucua

SEQ ID NO: 2210491 - RNA, 12 nt, Human
gccguuggccac

SEQ ID NO: 2210492 - RNA, 14 nt, Human
gccguuggccacgu

SEQ ID NO: 2210493 - RNA, 13 nt, Human
gccguuguuuacu

SEQ ID NO: 2210494 - RNA, 17 nt, Human
gccuaaaaaugcaacuu

SEQ ID NO: 2210495 - RNA, 15 nt, Human
gccuaaaaguaaaca

SEQ ID NO: 2210496 - RNA, 16 nt, Human
gccuaaaaguaaacau

SEQ ID NO: 2210497 - RNA, 23 nt, Human
gccuaaaagugggcuugauucug

SEQ ID NO: 2210498 - RNA, 18 nt, Human
gccguggcugcggcaccc

SEQ ID NO: 2210499 - RNA, 14 nt, Human
gccguggcugcggc

SEQ ID NO: 2210500 - RNA, 15 nt, Human
gccguggcugcggca

SEQ ID NO: 2210501 - RNA, 15 nt, Human
gccgugcccaggggc

SEQ ID NO: 2210502 - RNA, 14 nt, Human
gccgugcccagggg

SEQ ID NO: 2210503 - RNA, 21 nt, Human
gccguggauugcacguggccu

SEQ ID NO: 2210504 - RNA, 22 nt, Human
gccguggauugcacguggccuc

SEQ ID NO: 2210505 - RNA, 23 nt, Human
gccguggauugcacguggccucu

SEQ ID NO: 2210506 - RNA, 11 nt, Human
gccguggcuuc

SEQ ID NO: 2210507 - RNA, 12 nt, Human
gccguggcuucc

SEQ ID NO: 2210508 - RNA, 13 nt, Human
gccguggcuuccc

SEQ ID NO: 2210509 - RNA, 20 nt, Human
gccgucuucacucgcccccg

SEQ ID NO: 2210510 - RNA, 19 nt, Human
gccgucuucacucgccccc

SEQ ID NO: 2210511 - RNA, 23 nt, Human
gccgucuccaggggcugcuuccu

SEQ ID NO: 2210512 - RNA, 16 nt, Human
gccgucuccaggggcu

SEQ ID NO: 2210513 - RNA, 21 nt, Human
gccgucuccaggggcugcuuc

SEQ ID NO: 2210514 - RNA, 11 nt, Human
gccgucucaac

SEQ ID NO: 2210515 - RNA, 14 nt, Human
gccgucuccagggg

SEQ ID NO: 2210516 - RNA, 17 nt, Human
gccgggugcucagggcu

SEQ ID NO: 2210517 - RNA, 16 nt, Human
gccgggugcucagggc

SEQ ID NO: 2210518 - RNA, 18 nt, Human
gccggguucuagucuccu

SEQ ID NO: 2210519 - RNA, 15 nt, Human
gccgugaugccuccc

SEQ ID NO: 2210520 - RNA, 12 nt, Human
gccgugcccagg

SEQ ID NO: 2210521 - RNA, 17 nt, Human
gccgugaugcucaggcu

SEQ ID NO: 2210522 - RNA, 18 nt, Human
gccgugaguucucagggc

SEQ ID NO: 2210523 - RNA, 20 nt, Human
gccgugaguucucagggcuc

SEQ ID NO: 2210524 - RNA, 21 nt, Human
gccgugaguucucagggcucc

SEQ ID NO: 2210525 - RNA, 23 nt, Human
gccgugaguucucagggcuccug

SEQ ID NO: 2210526 - RNA, 22 nt, Human
gccgucuucacucgcccccggg

SEQ ID NO: 2210527 - RNA, 21 nt, Human
gccgucuucacucgcccccgg

SEQ ID NO: 2210528 - RNA, 16 nt, Human
gccgugaguucucagg

SEQ ID NO: 2210529 - RNA, 18 nt, Human
gccgucuaccugaggggc

SEQ ID NO: 2210530 - RNA, 20 nt, Human
gccgucuaccugaggggccu

SEQ ID NO: 2210531 - RNA, 22 nt, Human
gccgucuaccugaggggccucu

SEQ ID NO: 2210532 - RNA, 23 nt, Human
gccgucuaccugaggggccucuu

SEQ ID NO: 2210533 - RNA, 22 nt, Human
gccucaagugauucuccugccu

SEQ ID NO: 2210534 - RNA, 24 nt, Human
gccucaagugauucuccugccuca

SEQ ID NO: 2210535 - RNA, 22 nt, Human
gccucaaugugaaucagacccu

SEQ ID NO: 2210536 - RNA, 17 nt, Human
gccucaaugugaccagg

SEQ ID NO: 2210537 - RNA, 21 nt, Human
gccucaaugugaaucagaccc

SEQ ID NO: 2210538 - RNA, 18 nt, Human
gccucaauaagccuuguc

SEQ ID NO: 2210539 - RNA, 13 nt, Human
gccucacagaaga

SEQ ID NO: 2210540 - RNA, 21 nt, Human
gccucaaugugguugcaaggc

SEQ ID NO: 2210541 - RNA, 23 nt, Human
gccucacacgguuugaagccugg

SEQ ID NO: 2210542 - RNA, 15 nt, Human
gccucaacccucccu

SEQ ID NO: 2210543 - RNA, 17 nt, Human
gccucaauaagccuugu

SEQ ID NO: 2210544 - RNA, 14 nt, Human
gccucaaugccagu

SEQ ID NO: 2210545 - RNA, 14 nt, Human
gccucaacccuccc

SEQ ID NO: 2210546 - RNA, 18 nt, Human
gccucagcauccuggcac

SEQ ID NO: 2210547 - RNA, 17 nt, Human
gccucagcauccuggca

SEQ ID NO: 2210548 - RNA, 15 nt, Human
gccucacagaagaau

SEQ ID NO: 2210549 - RNA, 13 nt, Human
gccucagccagag

SEQ ID NO: 2210550 - RNA, 15 nt, Human
gccucagccagagaa

SEQ ID NO: 2210551 - RNA, 14 nt, Human
gccucagccagaga

SEQ ID NO: 2210552 - RNA, 16 nt, Human
gccucagccagagaag

SEQ ID NO: 2210553 - RNA, 15 nt, Human
gccucagccauucac

SEQ ID NO: 2210554 - RNA, 16 nt, Human
gccucagccauucacu

SEQ ID NO: 2210555 - RNA, 17 nt, Human
gccucagccauucacug

SEQ ID NO: 2210556 - RNA, 21 nt, Human
gccucagcauccuggcacccg

SEQ ID NO: 2210557 - RNA, 22 nt, Human
gccuauucccacaccuccacag

SEQ ID NO: 2210558 - RNA, 17 nt, Human
gccuauuuuaauaaaca

SEQ ID NO: 2210559 - RNA, 17 nt, Human
gccucaaaggcccgcuc

SEQ ID NO: 2210560 - RNA, 15 nt, Human
gccucaaaggcccgc

SEQ ID NO: 2210561 - RNA, 21 nt, Human
gccuauuucaguggcacguca

SEQ ID NO: 2210562 - RNA, 14 nt, Human
gccuaaggcugaac

SEQ ID NO: 2210563 - RNA, 22 nt, Human
gccuaaaagugggcuugauucu

SEQ ID NO: 2210564 - RNA, 16 nt, Human
gccgcaaaccacacug

SEQ ID NO: 2210565 - RNA, 17 nt, Human
gccgcaaaccacacugg

SEQ ID NO: 2210566 - RNA, 19 nt, Human
gccgcaaaccacacuggac

SEQ ID NO: 2210567 - RNA, 21 nt, Human
gccgcaaaccacacuggacuc

SEQ ID NO: 2210568 - RNA, 15 nt, Human
gccgcagcccugcag

SEQ ID NO: 2210569 - RNA, 16 nt, Human
gccgcagcccugcaga

SEQ ID NO: 2210570 - RNA, 17 nt, Human
gccgcagcccugcagag

SEQ ID NO: 2210571 - RNA, 18 nt, Human
gccgaguccaagcuggga

SEQ ID NO: 2210572 - RNA, 15 nt, Human
gccgaguccaagcug

SEQ ID NO: 2210573 - RNA, 14 nt, Human
gccgaguccaagcu

SEQ ID NO: 2210574 - RNA, 22 nt, Human
gccgauauacucuagaugaagu

SEQ ID NO: 2210575 - RNA, 17 nt, Human
gccgauauacucuagau

SEQ ID NO: 2210576 - RNA, 17 nt, Human
gccgauucaccugagca

SEQ ID NO: 2210577 - RNA, 20 nt, Human
gccgaggguccuggcuccug

SEQ ID NO: 2210578 - RNA, 18 nt, Human
gccgaggguccuggcucc

SEQ ID NO: 2210579 - RNA, 17 nt, Human
gccgagauagccaaggc

SEQ ID NO: 2210580 - RNA, 22 nt, Human
gccgcaaaccacacuggacucc

SEQ ID NO: 2210581 - RNA, 12 nt, Human
gccgggccccug

SEQ ID NO: 2210582 - RNA, 23 nt, Human
gccgggcaugguggcgcaagccu

SEQ ID NO: 2210583 - RNA, 14 nt, Human
gccgagucugucuc

SEQ ID NO: 2210584 - RNA, 22 nt, Human
gccggguacugagagucugcac

SEQ ID NO: 2210585 - RNA, 21 nt, Human
gccgggucugccucuucuggg

SEQ ID NO: 2210586 - RNA, 14 nt, Human
gccgggucugccuc

SEQ ID NO: 2210587 - RNA, 13 nt, Human
gccgggugcggug

SEQ ID NO: 2210588 - RNA, 16 nt, Human
gccgggugcgguggcu

SEQ ID NO: 2210589 - RNA, 19 nt, Human
gccgggugcgguggcucac

SEQ ID NO: 2210590 - RNA, 23 nt, Human
gccggggacagaggccugcccgg

SEQ ID NO: 2210591 - RNA, 19 nt, Human
gccggggacagaggccugc

SEQ ID NO: 2210592 - RNA, 21 nt, Human
gccggggacagaggccugccc

SEQ ID NO: 2210593 - RNA, 15 nt, Human
gccggggcugagacu

SEQ ID NO: 2210594 - RNA, 22 nt, Human
gccggggguucauaggucacug

SEQ ID NO: 2210595 - RNA, 22 nt, Human
gccgggguggagcaugggccug

SEQ ID NO: 2210596 - RNA, 13 nt, Human
gcccuugcccuga

SEQ ID NO: 2210597 - RNA, 16 nt, Human
gccggggacagaggcc

SEQ ID NO: 2210598 - RNA, 14 nt, Human
gccgggccccuggg

SEQ ID NO: 2210599 - RNA, 17 nt, Human
gccgggccccugggcuu

SEQ ID NO: 2210600 - RNA, 19 nt, Human
gccgggccccugggcuugg

SEQ ID NO: 2210601 - RNA, 19 nt, Human
gccgggccgaauccccucc

SEQ ID NO: 2210602 - RNA, 11 nt, Human
gcccucuucca

SEQ ID NO: 2210603 - RNA, 14 nt, Human
gcccucuuccauca

SEQ ID NO: 2210604 - RNA, 13 nt, Human
gcccucuguccug

SEQ ID NO: 2210605 - RNA, 14 nt, Human
gcccucuguccuga

SEQ ID NO: 2210606 - RNA, 15 nt, Human
gcccucuguccugac

SEQ ID NO: 2210607 - RNA, 12 nt, Human
gcccucuguccu

SEQ ID NO: 2210608 - RNA, 22 nt, Human
gcccuuccucuccacugccuuc

SEQ ID NO: 2210609 - RNA, 13 nt, Human
gcccuucucucca

SEQ ID NO: 2210610 - RNA, 19 nt, Human
gcccuucuuuccacagaag

SEQ ID NO: 2210611 - RNA, 23 nt, Human
gcccuucucuccagccccuggau

SEQ ID NO: 2210612 - RNA, 16 nt, Human
gccgagagccugcucc

SEQ ID NO: 2210613 - RNA, 15 nt, Human
gccgagagccugcuc

SEQ ID NO: 2210614 - RNA, 12 nt, Human
gccgagagccug

SEQ ID NO: 2210615 - RNA, 20 nt, Human
gccgagaagccagugcggca

SEQ ID NO: 2210616 - RNA, 22 nt, Human
gccgagacauggcuugccacag

SEQ ID NO: 2210617 - RNA, 14 nt, Human
gccgagaagcaaga

SEQ ID NO: 2210618 - RNA, 13 nt, Human
gccgagaagcaag

SEQ ID NO: 2210619 - RNA, 20 nt, Human
gccgaccucguccucccccu

SEQ ID NO: 2210620 - RNA, 22 nt, Human
gccgacugcacagcggccccug

SEQ ID NO: 2210621 - RNA, 21 nt, Human
gccgacuuuguaccccccaac

SEQ ID NO: 2210622 - RNA, 23 nt, Human
gccgacuuuguaccccccaaccc

SEQ ID NO: 2210623 - RNA, 13 nt, Human
gccgacuccuggg

SEQ ID NO: 2210624 - RNA, 22 nt, Human
gccgagagccugcucccccacc

SEQ ID NO: 2210625 - RNA, 20 nt, Human
gccgagagccugcuccccca

SEQ ID NO: 2210626 - RNA, 19 nt, Human
gccgagagccugcuccccc

SEQ ID NO: 2210627 - RNA, 17 nt, Human
gccgagagccugcuccc

SEQ ID NO: 2210628 - RNA, 16 nt, Human
gccgagauagccaagg

SEQ ID NO: 2210629 - RNA, 22 nt, Human
gcccuugcaguucagcaccacc

SEQ ID NO: 2210630 - RNA, 21 nt, Human
gcccuugcaguucagcaccac

SEQ ID NO: 2210631 - RNA, 20 nt, Human
gcccuugcaguucagcacca

SEQ ID NO: 2210632 - RNA, 19 nt, Human
gcccuugcaguucagcacc

SEQ ID NO: 2210633 - RNA, 22 nt, Human
gcccuugagcuccccaaaaacc

SEQ ID NO: 2210634 - RNA, 17 nt, Human
gcccuugagcuccccaa

SEQ ID NO: 2210635 - RNA, 21 nt, Human
gccgaccucguccucccccug

SEQ ID NO: 2210636 - RNA, 19 nt, Human
gccgaccucguccuccccc

SEQ ID NO: 2210637 - RNA, 13 nt, Human
gccgaccucgucc

SEQ ID NO: 2210638 - RNA, 17 nt, Human
gccgaccucagccuucc

SEQ ID NO: 2210639 - RNA, 15 nt, Human
gccgaccucagccuu

SEQ ID NO: 2210640 - RNA, 14 nt, Human
gccgaccucagccu

SEQ ID NO: 2210641 - RNA, 13 nt, Human
gccgaccucagcc

SEQ ID NO: 2210642 - RNA, 12 nt, Human
gccgaccucagc

SEQ ID NO: 2210643 - RNA, 18 nt, Human
gcccuugagcuccccaaa

SEQ ID NO: 2210644 - RNA, 14 nt, Human
gcccagguuucugg

SEQ ID NO: 2210645 - RNA, 23 nt, Human
gcccagguuucuggucucuaggc

SEQ ID NO: 2210646 - RNA, 17 nt, Human
gcccagguuucuggucu

SEQ ID NO: 2210647 - RNA, 15 nt, Human
gcccaguagaccuug

SEQ ID NO: 2210648 - RNA, 17 nt, Human
gcccaguagaccuuguu

SEQ ID NO: 2210649 - RNA, 22 nt, Human
gcccagucuggaaugcaguggu

SEQ ID NO: 2210650 - RNA, 13 nt, Human
gcccaguccccca

SEQ ID NO: 2210651 - RNA, 21 nt, Human
gcccagucccccaaccccagc

SEQ ID NO: 2210652 - RNA, 22 nt, Human
gcccagugucaaguugugcuug

SEQ ID NO: 2210653 - RNA, 13 nt, Human
gcccaguggcugc

SEQ ID NO: 2210654 - RNA, 17 nt, Human
gcccagucccccaaccc

SEQ ID NO: 2210655 - RNA, 14 nt, Human
gcccagucccccaa

SEQ ID NO: 2210656 - RNA, 15 nt, Human
gcccagucccccaac

SEQ ID NO: 2210657 - RNA, 19 nt, Human
gcccaguucacccugauuu

SEQ ID NO: 2210658 - RNA, 18 nt, Human
gcccauccccaggcaccu

SEQ ID NO: 2210659 - RNA, 12 nt, Human
gcccaucccccc

SEQ ID NO: 2210660 - RNA, 14 nt, Human
gcccauccccccuc

SEQ ID NO: 2210661 - RNA, 15 nt, Human
gcccauccccccuca

SEQ ID NO: 2210662 - RNA, 16 nt, Human
gcccauccccccucac

SEQ ID NO: 2210663 - RNA, 17 nt, Human
gcccauccccccucacc

SEQ ID NO: 2210664 - RNA, 18 nt, Human
gcccauccccccucacca

SEQ ID NO: 2210665 - RNA, 23 nt, Human
gcccaggguucccccagcccugu

SEQ ID NO: 2210666 - RNA, 22 nt, Human
gcccaggguucccccagcccug

SEQ ID NO: 2210667 - RNA, 15 nt, Human
gcccagguccucuga

SEQ ID NO: 2210668 - RNA, 16 nt, Human
gcccagguccucugau

SEQ ID NO: 2210669 - RNA, 21 nt, Human
gcccaggguucccccagcccu

SEQ ID NO: 2210670 - RNA, 20 nt, Human
gcccaggguucccccagccc

SEQ ID NO: 2210671 - RNA, 19 nt, Human
gcccaggguucccccagcc

SEQ ID NO: 2210672 - RNA, 17 nt, Human
gcccaggguucccccag

SEQ ID NO: 2210673 - RNA, 18 nt, Human
gcccagggcucagccugg

SEQ ID NO: 2210674 - RNA, 23 nt, Human
gcccaggcuggccagccccacag

SEQ ID NO: 2210675 - RNA, 17 nt, Human
gcccagggcucagccug

SEQ ID NO: 2210676 - RNA, 16 nt, Human
gcccagggcucagccu

SEQ ID NO: 2210677 - RNA, 15 nt, Human
gcccagggcucagcc

SEQ ID NO: 2210678 - RNA, 14 nt, Human
gcccagggcucagc

SEQ ID NO: 2210679 - RNA, 13 nt, Human
gcccagggcucag

SEQ ID NO: 2210680 - RNA, 12 nt, Human
gcccagggcuca

SEQ ID NO: 2210681 - RNA, 23 nt, Human
gcccagggcccagagcccagcuc

SEQ ID NO: 2210682 - RNA, 21 nt, Human
gcccagggcccagagcccagc

SEQ ID NO: 2210683 - RNA, 20 nt, Human
gcccagggcccagagcccag

SEQ ID NO: 2210684 - RNA, 19 nt, Human
gcccagggcccagagccca

SEQ ID NO: 2210685 - RNA, 18 nt, Human
gcccagggcccagagccc

SEQ ID NO: 2210686 - RNA, 16 nt, Human
gcccaggcuggcgugc

SEQ ID NO: 2210687 - RNA, 17 nt, Human
gcccagggcccagagcc

SEQ ID NO: 2210688 - RNA, 16 nt, Human
gcccagggcccagagc

SEQ ID NO: 2210689 - RNA, 15 nt, Human
gcccagggcccagag

SEQ ID NO: 2210690 - RNA, 14 nt, Human
gcccagggcccaga

SEQ ID NO: 2210691 - RNA, 14 nt, Human
gcccaggcuggcgu

SEQ ID NO: 2210692 - RNA, 15 nt, Human
gcccaggcuggcgug

SEQ ID NO: 2210693 - RNA, 17 nt, Human
gcccagcuugggcccag

SEQ ID NO: 2210694 - RNA, 18 nt, Human
gcccagcuugggcccagc

SEQ ID NO: 2210695 - RNA, 24 nt, Human
gcccagcugcaccugccagccugg

SEQ ID NO: 2210696 - RNA, 23 nt, Human
gcccagcugcaccugccagccug

SEQ ID NO: 2210697 - RNA, 18 nt, Human
gcccagcugcaccugcca

SEQ ID NO: 2210698 - RNA, 15 nt, Human
gcccagcugcaccug

SEQ ID NO: 2210699 - RNA, 14 nt, Human
gcccagcugcaccu

SEQ ID NO: 2210700 - RNA, 13 nt, Human
gcccagcugcacc

SEQ ID NO: 2210701 - RNA, 11 nt, Human
gcccagcuccc

SEQ ID NO: 2210702 - RNA, 12 nt, Human
gcccagcucccc

SEQ ID NO: 2210703 - RNA, 13 nt, Human
gcccagcuccccc

SEQ ID NO: 2210704 - RNA, 15 nt, Human
gcccagcuccaaggg

SEQ ID NO: 2210705 - RNA, 12 nt, Human
gcccagcuccaa

SEQ ID NO: 2210706 - RNA, 13 nt, Human
gcccagcucugaa

SEQ ID NO: 2210707 - RNA, 19 nt, Human
gcccagcucccccgggagg

SEQ ID NO: 2210708 - RNA, 16 nt, Human
gcccagcucccccggg

SEQ ID NO: 2210709 - RNA, 17 nt, Human
gcccagcucccccggga

SEQ ID NO: 2210710 - RNA, 20 nt, Human
gcccaccugcccaucacagg

SEQ ID NO: 2210711 - RNA, 15 nt, Human
gcccaccugcccauc

SEQ ID NO: 2210712 - RNA, 14 nt, Human
gcccaccugcccau

SEQ ID NO: 2210713 - RNA, 13 nt, Human
gcccaccugccca

SEQ ID NO: 2210714 - RNA, 15 nt, Human
gcccagcucagaggg

SEQ ID NO: 2210715 - RNA, 20 nt, Human
gcccagcuauaccugugccu

SEQ ID NO: 2210716 - RNA, 18 nt, Human
gcccaccuccccacgccc

SEQ ID NO: 2210717 - RNA, 19 nt, Human
gcccagcuauaccugugcc

SEQ ID NO: 2210718 - RNA, 10 nt, Human
gcccaccucc

SEQ ID NO: 2210719 - RNA, 20 nt, Human
gcccaccgcaugcccccucg

SEQ ID NO: 2210720 - RNA, 12 nt, Human
gcccaccucccc

SEQ ID NO: 2210721 - RNA, 15 nt, Human
gcccaccuccccacg

SEQ ID NO: 2210722 - RNA, 17 nt, Human
gcccaccuccccacgcc

SEQ ID NO: 2210723 - RNA, 21 nt, Human
gcccaccuccccacgcccucc

SEQ ID NO: 2210724 - RNA, 14 nt, Human
gcccaccgcaugcc

SEQ ID NO: 2210725 - RNA, 16 nt, Human
gcccaccgcaugcccc

SEQ ID NO: 2210726 - RNA, 17 nt, Human
gcccaccgcaugccccc

SEQ ID NO: 2210727 - RNA, 18 nt, Human
gcccaccgcaugcccccu

SEQ ID NO: 2210728 - RNA, 19 nt, Human
gcccaccgcaugcccccuc

SEQ ID NO: 2210729 - RNA, 11 nt, Human
gcccaggcugg

SEQ ID NO: 2210730 - RNA, 19 nt, Human
gcccaggcuggccagcccc

SEQ ID NO: 2210731 - RNA, 20 nt, Human
gcccaggcuggccagcccca

SEQ ID NO: 2210732 - RNA, 22 nt, Human
gcccaggcuggccagccccaca

SEQ ID NO: 2210733 - RNA, 17 nt, Human
gcccaggccugccuguu

SEQ ID NO: 2210734 - RNA, 19 nt, Human
gcccagcuugggcccagcu

SEQ ID NO: 2210735 - RNA, 20 nt, Human
gcccagcuugggcccagcug

SEQ ID NO: 2210736 - RNA, 21 nt, Human
gcccagcuugggcccagcugg

SEQ ID NO: 2210737 - RNA, 22 nt, Human
gcccagcuugggcccagcuggg

SEQ ID NO: 2210738 - RNA, 23 nt, Human
gcccagcuugggcccagcugggc

SEQ ID NO: 2210739 - RNA, 12 nt, Human
gcccaggcggga

SEQ ID NO: 2210740 - RNA, 22 nt, Human
gcccaggcgggagcgguggccc

SEQ ID NO: 2210741 - RNA, 12 nt, Human
gcccaggaaagg

SEQ ID NO: 2210742 - RNA, 15 nt, Human
gcccaggaaaggcuc

SEQ ID NO: 2210743 - RNA, 16 nt, Human
gcccaggaaaggcucc

SEQ ID NO: 2210744 - RNA, 18 nt, Human
gcccaggccuccuacagc

SEQ ID NO: 2210745 - RNA, 21 nt, Human
gccccaggcagggccaacccu

SEQ ID NO: 2210746 - RNA, 20 nt, Human
gccccaggcaggcugugcgc

SEQ ID NO: 2210747 - RNA, 19 nt, Human
gccccaggcaggcugugcg

SEQ ID NO: 2210748 - RNA, 15 nt, Human
gccccaggcaggcug

SEQ ID NO: 2210749 - RNA, 12 nt, Human
gccccaggcagg

SEQ ID NO: 2210750 - RNA, 22 nt, Human
gccccaggaccuggcugccaua

SEQ ID NO: 2210751 - RNA, 21 nt, Human
gccccaggaccuggcugccau

SEQ ID NO: 2210752 - RNA, 20 nt, Human
gccccaggaccuggcugcca

SEQ ID NO: 2210753 - RNA, 24 nt, Human
gccccaggaccagcucaggacaga

SEQ ID NO: 2210754 - RNA, 23 nt, Human
gccccaggaccagcucaggacag

SEQ ID NO: 2210755 - RNA, 22 nt, Human
gccccaggaccagcucaggaca

SEQ ID NO: 2210756 - RNA, 19 nt, Human
gccccaggaccagcucagg

SEQ ID NO: 2210757 - RNA, 18 nt, Human
gccccaggaccagcucag

SEQ ID NO: 2210758 - RNA, 17 nt, Human
gccccaggaccagcuca

SEQ ID NO: 2210759 - RNA, 16 nt, Human
gccccaggaccagcuc

SEQ ID NO: 2210760 - RNA, 15 nt, Human
gccccaggaccagcu

SEQ ID NO: 2210761 - RNA, 14 nt, Human
gccccaggaccagc

SEQ ID NO: 2210762 - RNA, 12 nt, Human
gccccaggacca

SEQ ID NO: 2210763 - RNA, 15 nt, Human
gccccagugcccaca

SEQ ID NO: 2210764 - RNA, 16 nt, Human
gccccagugcccacag

SEQ ID NO: 2210765 - RNA, 17 nt, Human
gccccagugcccacagg

SEQ ID NO: 2210766 - RNA, 21 nt, Human
gccccagugcccacaggauca

SEQ ID NO: 2210767 - RNA, 20 nt, Human
gccccaugccuguccagccu

SEQ ID NO: 2210768 - RNA, 17 nt, Human
gccccaugccuguccag

SEQ ID NO: 2210769 - RNA, 23 nt, Human
gccccaugccuguccagccuggg

SEQ ID NO: 2210770 - RNA, 12 nt, Human
gccccaugcugg

SEQ ID NO: 2210771 - RNA, 16 nt, Human
gccccaugccugucca

SEQ ID NO: 2210772 - RNA, 14 nt, Human
gccccaugccuguc

SEQ ID NO: 2210773 - RNA, 23 nt, Human
gccccauccucuguacagagccc

SEQ ID NO: 2210774 - RNA, 17 nt, Human
gccccauucugccugcc

SEQ ID NO: 2210775 - RNA, 18 nt, Human
gccccauucugccugccc

SEQ ID NO: 2210776 - RNA, 20 nt, Human
gccccauucugccugcccag

SEQ ID NO: 2210777 - RNA, 21 nt, Human
gccccauucugccugcccagg

SEQ ID NO: 2210778 - RNA, 10 nt, Human
gccccagccu

SEQ ID NO: 2210779 - RNA, 18 nt, Human
gccccagccucccugaag

SEQ ID NO: 2210780 - RNA, 16 nt, Human
gccccagccucccuga

SEQ ID NO: 2210781 - RNA, 21 nt, Human
gccccagccucccugaagccu

SEQ ID NO: 2210782 - RNA, 21 nt, Human
gccccagcccacccuccuguc

SEQ ID NO: 2210783 - RNA, 18 nt, Human
gccccagcccacccuccu

SEQ ID NO: 2210784 - RNA, 20 nt, Human
gccccagcccacccuccugu

SEQ ID NO: 2210785 - RNA, 17 nt, Human
gccccagcccccuuugg

SEQ ID NO: 2210786 - RNA, 12 nt, Human
gccccagcccaa

SEQ ID NO: 2210787 - RNA, 14 nt, Human
gccccagcccaagu

SEQ ID NO: 2210788 - RNA, 15 nt, Human
gccccagcccaaguc

SEQ ID NO: 2210789 - RNA, 16 nt, Human
gccccagcccaagucc

SEQ ID NO: 2210790 - RNA, 12 nt, Human
gccccagcccac

SEQ ID NO: 2210791 - RNA, 14 nt, Human
gccccagcccaccc

SEQ ID NO: 2210792 - RNA, 15 nt, Human
gccccagcccacccu

SEQ ID NO: 2210793 - RNA, 16 nt, Human
gccccagcccacccuc

SEQ ID NO: 2210794 - RNA, 14 nt, Human
gccccagcucuggc

SEQ ID NO: 2210795 - RNA, 11 nt, Human
gccccagcuga

SEQ ID NO: 2210796 - RNA, 17 nt, Human
gccccagcugacaugga

SEQ ID NO: 2210797 - RNA, 15 nt, Human
gccccaggaaaggcc

SEQ ID NO: 2210798 - RNA, 14 nt, Human
gccccaggaagccg

SEQ ID NO: 2210799 - RNA, 11 nt, Human
gccccaggacc

SEQ ID NO: 2210800 - RNA, 22 nt, Human
gccccaggaaaggcccagccac

SEQ ID NO: 2210801 - RNA, 13 nt, Human
gccccagcucugg

SEQ ID NO: 2210802 - RNA, 19 nt, Human
gccccagccuggcccagcu

SEQ ID NO: 2210803 - RNA, 20 nt, Human
gccccagccuggcccagcuc

SEQ ID NO: 2210804 - RNA, 21 nt, Human
gccccagccuggcccagcucc

SEQ ID NO: 2210805 - RNA, 22 nt, Human
gccccagccuggcccagcuccc

SEQ ID NO: 2210806 - RNA, 12 nt, Human
gccccagccugg

SEQ ID NO: 2210807 - RNA, 13 nt, Human
gccccagccuggc

SEQ ID NO: 2210808 - RNA, 14 nt, Human
gccccagccuggcc

SEQ ID NO: 2210809 - RNA, 15 nt, Human
gccccagccuggccc

SEQ ID NO: 2210810 - RNA, 16 nt, Human
gccccagccuggccca

SEQ ID NO: 2210811 - RNA, 17 nt, Human
gccccagccuggcccag

SEQ ID NO: 2210812 - RNA, 18 nt, Human
gccccagccuggcccagc

SEQ ID NO: 2210813 - RNA, 19 nt, Human
gcccaugcccaccugccca

SEQ ID NO: 2210814 - RNA, 15 nt, Human
gcccaugcccaccug

SEQ ID NO: 2210815 - RNA, 14 nt, Human
gcccaugcccaccu

SEQ ID NO: 2210816 - RNA, 13 nt, Human
gcccaugcccacc

SEQ ID NO: 2210817 - RNA, 18 nt, Human
gcccaucugggaaaauac

SEQ ID NO: 2210818 - RNA, 17 nt, Human
gcccaugaguccuugaa

SEQ ID NO: 2210819 - RNA, 16 nt, Human
gcccaugccaccgcuu

SEQ ID NO: 2210820 - RNA, 23 nt, Human
gcccauggacaggcuggcuccag

SEQ ID NO: 2210821 - RNA, 21 nt, Human
gcccauggacaggcuggcucc

SEQ ID NO: 2210822 - RNA, 20 nt, Human
gcccauggacaggcuggcuc

SEQ ID NO: 2210823 - RNA, 19 nt, Human
gcccauggacaggcuggcu

SEQ ID NO: 2210824 - RNA, 12 nt, Human
gccccagccaga

SEQ ID NO: 2210825 - RNA, 14 nt, Human
gccccagccagagu

SEQ ID NO: 2210826 - RNA, 19 nt, Human
gccccagccagaguuccug

SEQ ID NO: 2210827 - RNA, 20 nt, Human
gccccagccagaguuccugc

SEQ ID NO: 2210828 - RNA, 22 nt, Human
gcccaucuaugucccuugcugu

SEQ ID NO: 2210829 - RNA, 22 nt, Human
gcccaucugggggccucuucug

SEQ ID NO: 2210830 - RNA, 20 nt, Human
gcccauccccccucaccagg

SEQ ID NO: 2210831 - RNA, 12 nt, Human
gcccaucccugc

SEQ ID NO: 2210832 - RNA, 14 nt, Human
gcccaucccugccu

SEQ ID NO: 2210833 - RNA, 16 nt, Human
gcccaucccugccugg

SEQ ID NO: 2210834 - RNA, 18 nt, Human
gcccaucccugccugguc

SEQ ID NO: 2210835 - RNA, 19 nt, Human
gcccaucccugccugguca

SEQ ID NO: 2210836 - RNA, 21 nt, Human
gcccaucccuggaaggugcug

SEQ ID NO: 2210837 - RNA, 20 nt, Human
gccccauucuuuuguaauuu

SEQ ID NO: 2210838 - RNA, 13 nt, Human
gccccaugcugga

SEQ ID NO: 2210839 - RNA, 14 nt, Human
gccccaugcuggag

SEQ ID NO: 2210840 - RNA, 15 nt, Human
gccccaugcuggagc

SEQ ID NO: 2210841 - RNA, 23 nt, Human
gccccgaggccuucucugaagga

SEQ ID NO: 2210842 - RNA, 22 nt, Human
gccccauucugccugcccaggc

SEQ ID NO: 2210843 - RNA, 23 nt, Human
gccccauucugccugcccaggcc

SEQ ID NO: 2210844 - RNA, 13 nt, Human
gccccgccgccug

SEQ ID NO: 2210845 - RNA, 21 nt, Human
gccccgcccccaguccccacc

SEQ ID NO: 2210846 - RNA, 14 nt, Human
gccccgccuccccg

SEQ ID NO: 2210847 - RNA, 14 nt, Human
gccccgccccacau

SEQ ID NO: 2210848 - RNA, 13 nt, Human
gccccgccccaca

SEQ ID NO: 2210849 - RNA, 20 nt, Human
gccccgcagaccuccccagc

SEQ ID NO: 2210850 - RNA, 21 nt, Human
gccccgcagaccuccccagcc

SEQ ID NO: 2210851 - RNA, 22 nt, Human
gccccgccccacauuccgacaa

SEQ ID NO: 2210852 - RNA, 15 nt, Human
gccccgccccacauu

SEQ ID NO: 2210853 - RNA, 15 nt, Human
gccccgcagaccucc

SEQ ID NO: 2210854 - RNA, 18 nt, Human
gccccgcagaccucccca

SEQ ID NO: 2210855 - RNA, 19 nt, Human
gccccgcagaccuccccag

SEQ ID NO: 2210856 - RNA, 22 nt, Human
gccccgaggccuucucugaagg

SEQ ID NO: 2210857 - RNA, 14 nt, Human
gccccgcccaggcu

SEQ ID NO: 2210858 - RNA, 20 nt, Human
gccccgcuuguccagcgccu

SEQ ID NO: 2210859 - RNA, 13 nt, Human
gccccggccaccu

SEQ ID NO: 2210860 - RNA, 14 nt, Human
gccccggccaccuc

SEQ ID NO: 2210861 - RNA, 15 nt, Human
gccccggccaccucu

SEQ ID NO: 2210862 - RNA, 16 nt, Human
gccccggccaccucug

SEQ ID NO: 2210863 - RNA, 19 nt, Human
gccccgcuuguccagcgcc

SEQ ID NO: 2210864 - RNA, 18 nt, Human
gccccgcuuguccagcgc

SEQ ID NO: 2210865 - RNA, 16 nt, Human
gccccgcuuguccagc

SEQ ID NO: 2210866 - RNA, 14 nt, Human
gccccgcuugucca

SEQ ID NO: 2210867 - RNA, 17 nt, Human
gccccgcgccuccuucc

SEQ ID NO: 2210868 - RNA, 18 nt, Human
gccccgcuuggcuucuuc

SEQ ID NO: 2210869 - RNA, 22 nt, Human
gccccgcuuggcuucuucuuua

SEQ ID NO: 2210870 - RNA, 15 nt, Human
gccccgucaccaucu

SEQ ID NO: 2210871 - RNA, 19 nt, Human
gccccggggugaguccauu

SEQ ID NO: 2210872 - RNA, 15 nt, Human
gccccggcccugggc

SEQ ID NO: 2210873 - RNA, 17 nt, Human
gccccggcccugggcuc

SEQ ID NO: 2210874 - RNA, 21 nt, Human
gccccggcccugggcucggag

SEQ ID NO: 2210875 - RNA, 17 nt, Human
gccccgggacuuggagg

SEQ ID NO: 2210876 - RNA, 17 nt, Human
gccccggccaccucugc

SEQ ID NO: 2210877 - RNA, 18 nt, Human
gccccggccaccucugcg

SEQ ID NO: 2210878 - RNA, 14 nt, Human
gccccggccccagc

SEQ ID NO: 2210879 - RNA, 16 nt, Human
gccccggccccagcca

SEQ ID NO: 2210880 - RNA, 17 nt, Human
gccccggccccagccag

SEQ ID NO: 2210881 - RNA, 18 nt, Human
gccccggccccagccaga

SEQ ID NO: 2210882 - RNA, 13 nt, Human
gccccggccccgg

SEQ ID NO: 2210883 - RNA, 14 nt, Human
gccccggcccuggg

SEQ ID NO: 2210884 - RNA, 20 nt, Human
gccccgucucaugaggggcc

SEQ ID NO: 2210885 - RNA, 13 nt, Human
gccccgugaggca

SEQ ID NO: 2210886 - RNA, 17 nt, Human
gccccgugggguuccuc

SEQ ID NO: 2210887 - RNA, 20 nt, Human
gccccgucaccaucucaggc

SEQ ID NO: 2210888 - RNA, 18 nt, Human
gccccgucaccaucucag

SEQ ID NO: 2210889 - RNA, 17 nt, Human
gccccgucaccaucuca

SEQ ID NO: 2210890 - RNA, 18 nt, Human
gccccgggacuuggaggg

SEQ ID NO: 2210891 - RNA, 17 nt, Human
gccccgucccccucugg

SEQ ID NO: 2210892 - RNA, 22 nt, Human
gccccgucaccaucucaggcca

SEQ ID NO: 2210893 - RNA, 21 nt, Human
gccccgucaccaucucaggcc

SEQ ID NO: 2210894 - RNA, 23 nt, Human
gccccgucaccaucucaggccac

SEQ ID NO: 2210895 - RNA, 21 nt, Human
gccccgucccccucuggcucc

SEQ ID NO: 2210896 - RNA, 13 nt, Human
gccccugcacaaa

SEQ ID NO: 2210897 - RNA, 23 nt, Human
gccccugagcaaugucugugcua

SEQ ID NO: 2210898 - RNA, 20 nt, Human
gccccugagcaaugucugug

SEQ ID NO: 2210899 - RNA, 22 nt, Human
gccccugagcaaugucugugcu

SEQ ID NO: 2210900 - RNA, 18 nt, Human
gccccucccacagcgcug

SEQ ID NO: 2210901 - RNA, 20 nt, Human
gccccugagaucucugcagg

SEQ ID NO: 2210902 - RNA, 23 nt, Human
gccccuggcagccccuguucugg

SEQ ID NO: 2210903 - RNA, 19 nt, Human
gccccugcacuccagccug

SEQ ID NO: 2210904 - RNA, 17 nt, Human
gccccuucccccuccaa

SEQ ID NO: 2210905 - RNA, 23 nt, Human
gccccuggcugggacguggcuca

SEQ ID NO: 2210906 - RNA, 16 nt, Human
gccccuggcugggacg

SEQ ID NO: 2210907 - RNA, 14 nt, Human
gccccuggcuggga

SEQ ID NO: 2210908 - RNA, 12 nt, Human
gccccuggcugg

SEQ ID NO: 2210909 - RNA, 14 nt, Human
gccccuggccccag

SEQ ID NO: 2210910 - RNA, 14 nt, Human
gccccugcaucccc

SEQ ID NO: 2210911 - RNA, 13 nt, Human
gccccuggcccag

SEQ ID NO: 2210912 - RNA, 13 nt, Human
gccccuggcccca

SEQ ID NO: 2210913 - RNA, 22 nt, Human
gccccuggcccagcggccccuc

SEQ ID NO: 2210914 - RNA, 23 nt, Human
gccccuggcccagcggccccucc

SEQ ID NO: 2210915 - RNA, 16 nt, Human
gccccuggcccagcgg

SEQ ID NO: 2210916 - RNA, 17 nt, Human
gccccuggcccagcggc

SEQ ID NO: 2210917 - RNA, 18 nt, Human
gccccuggcccagcggcc

SEQ ID NO: 2210918 - RNA, 19 nt, Human
gccccuggcccagcggccc

SEQ ID NO: 2210919 - RNA, 20 nt, Human
gccccuagaaucagccuagg

SEQ ID NO: 2210920 - RNA, 13 nt, Human
gccccuagcccag

SEQ ID NO: 2210921 - RNA, 17 nt, Human
gccccuagaaucagccu

SEQ ID NO: 2210922 - RNA, 22 nt, Human
gccccgugcagacuggagggga

SEQ ID NO: 2210923 - RNA, 20 nt, Human
gccccgugcagacuggaggg

SEQ ID NO: 2210924 - RNA, 19 nt, Human
gccccgugcagacuggagg

SEQ ID NO: 2210925 - RNA, 15 nt, Human
gccccgugcagacug

SEQ ID NO: 2210926 - RNA, 19 nt, Human
gccccguguccugccuguc

SEQ ID NO: 2210927 - RNA, 16 nt, Human
gccccuaccccacacc

SEQ ID NO: 2210928 - RNA, 23 nt, Human
gccccucaacucuccuccagagu

SEQ ID NO: 2210929 - RNA, 20 nt, Human
gccccuagcccaggagagag

SEQ ID NO: 2210930 - RNA, 21 nt, Human
gccccuagcccaggagagaga

SEQ ID NO: 2210931 - RNA, 14 nt, Human
gccccuagcccagg

SEQ ID NO: 2210932 - RNA, 15 nt, Human
gccccuagcccagga

SEQ ID NO: 2210933 - RNA, 18 nt, Human
gccccuagcccaggagag

SEQ ID NO: 2210934 - RNA, 19 nt, Human
gccccuagcccaggagaga

SEQ ID NO: 2210935 - RNA, 19 nt, Human
gccccucagggucccuggu

SEQ ID NO: 2210936 - RNA, 21 nt, Human
gccccucagggucccuggugg

SEQ ID NO: 2210937 - RNA, 20 nt, Human
gccccuauguaguccgugcu

SEQ ID NO: 2210938 - RNA, 22 nt, Human
gccccuagcuuagagccucccu

SEQ ID NO: 2210939 - RNA, 21 nt, Human
gccccucaucucucugcccaa

SEQ ID NO: 2210940 - RNA, 21 nt, Human
gccccucaucugcucagcagc

SEQ ID NO: 2210941 - RNA, 12 nt, Human
gccccuccagcu

SEQ ID NO: 2210942 - RNA, 13 nt, Human
gccccuccagcuu

SEQ ID NO: 2210943 - RNA, 18 nt, Human
gccccuccagcuugugga

SEQ ID NO: 2210944 - RNA, 14 nt, Human
gccccuccagcuug

SEQ ID NO: 2210945 - RNA, 15 nt, Human
gccccucccacacac

SEQ ID NO: 2210946 - RNA, 21 nt, Human
gccccucccacacacacccac

SEQ ID NO: 2210947 - RNA, 15 nt, Human
gcccuccccucucug

SEQ ID NO: 2210948 - RNA, 20 nt, Human
gcccuccccuccccugcugc

SEQ ID NO: 2210949 - RNA, 21 nt, Human
gcccuccccuccccugcugca

SEQ ID NO: 2210950 - RNA, 18 nt, Human
gcccuccccucucugcac

SEQ ID NO: 2210951 - RNA, 19 nt, Human
gcccuccccucucugcacc

SEQ ID NO: 2210952 - RNA, 12 nt, Human
gcccuccccucc

SEQ ID NO: 2210953 - RNA, 13 nt, Human
gcccuccccuccc

SEQ ID NO: 2210954 - RNA, 16 nt, Human
gcccuccccuccccug

SEQ ID NO: 2210955 - RNA, 17 nt, Human
gcccuccccuccccugc

SEQ ID NO: 2210956 - RNA, 18 nt, Human
gcccuccccuccccugcu

SEQ ID NO: 2210957 - RNA, 19 nt, Human
gcccuccccuccccugcug

SEQ ID NO: 2210958 - RNA, 19 nt, Human
gcccuccuacccugcgccc

SEQ ID NO: 2210959 - RNA, 24 nt, Human
gcccuccuacccugcgcccagucc

SEQ ID NO: 2210960 - RNA, 21 nt, Human
gcccuccucaccccgucuggg

SEQ ID NO: 2210961 - RNA, 14 nt, Human
gcccuccucacccc

SEQ ID NO: 2210962 - RNA, 13 nt, Human
gcccuccucaccc

SEQ ID NO: 2210963 - RNA, 15 nt, Human
gcccucccgccccuu

SEQ ID NO: 2210964 - RNA, 15 nt, Human
gcccucccugccccu

SEQ ID NO: 2210965 - RNA, 18 nt, Human
gcccuccuacccugcgcc

SEQ ID NO: 2210966 - RNA, 22 nt, Human
gcccuccccuccccugcugcag

SEQ ID NO: 2210967 - RNA, 13 nt, Human
gcccucccgcccc

SEQ ID NO: 2210968 - RNA, 21 nt, Human
gcccggagauuggacggccug

SEQ ID NO: 2210969 - RNA, 19 nt, Human
gcccggagauuggacggcc

SEQ ID NO: 2210970 - RNA, 22 nt, Human
gcccggagauuggacggccuga

SEQ ID NO: 2210971 - RNA, 19 nt, Human
gcccuccccauggagccag

SEQ ID NO: 2210972 - RNA, 21 nt, Human
gcccgggcucugccucccauc

SEQ ID NO: 2210973 - RNA, 19 nt, Human
gcccgggcucugccuccca

SEQ ID NO: 2210974 - RNA, 20 nt, Human
gcccgggcucugccucccau

SEQ ID NO: 2210975 - RNA, 10 nt, Human
gcccuccuuc

SEQ ID NO: 2210976 - RNA, 15 nt, Human
gcccuccuuguccac

SEQ ID NO: 2210977 - RNA, 17 nt, Human
gcccuccuuguccaccc

SEQ ID NO: 2210978 - RNA, 23 nt, Human
gcccuccugaaacuuacacacaa

SEQ ID NO: 2210979 - RNA, 12 nt, Human
gcccuccucucc

SEQ ID NO: 2210980 - RNA, 20 nt, Human
gcccuccucucccauugucc

SEQ ID NO: 2210981 - RNA, 17 nt, Human
gcccuccucucccauug

SEQ ID NO: 2210982 - RNA, 14 nt, Human
gcccuccucuccca

SEQ ID NO: 2210983 - RNA, 22 nt, Human
gcccucugcccacucccugcaa

SEQ ID NO: 2210984 - RNA, 22 nt, Human
gcccucuggaguggccacuaag

SEQ ID NO: 2210985 - RNA, 20 nt, Human
gcccucuggaguggccacua

SEQ ID NO: 2210986 - RNA, 19 nt, Human
gcccucuggaguggccacu

SEQ ID NO: 2210987 - RNA, 18 nt, Human
gcccucuggaguggccac

SEQ ID NO: 2210988 - RNA, 17 nt, Human
gcccucuggaguggcca

SEQ ID NO: 2210989 - RNA, 16 nt, Human
gcccucuggaguggcc

SEQ ID NO: 2210990 - RNA, 14 nt, Human
gcccucuggagugg

SEQ ID NO: 2210991 - RNA, 16 nt, Human
gcccuccuuguccacc

SEQ ID NO: 2210992 - RNA, 18 nt, Human
gcccgcggggacauuggg

SEQ ID NO: 2210993 - RNA, 23 nt, Human
gcccgcgcccucgcccccgcccc

SEQ ID NO: 2210994 - RNA, 12 nt, Human
gcccgcucccag

SEQ ID NO: 2210995 - RNA, 22 nt, Human
gcccgcucuacaucuucugccu

SEQ ID NO: 2210996 - RNA, 13 nt, Human
gcccgcucccagu

SEQ ID NO: 2210997 - RNA, 15 nt, Human
gcccgcucugcagac

SEQ ID NO: 2210998 - RNA, 17 nt, Human
gcccgcugaguggacug

SEQ ID NO: 2210999 - RNA, 12 nt, Human
gcccgcugggcu

SEQ ID NO: 2211000 - RNA, 13 nt, Human
gcccgcugggcug

SEQ ID NO: 2211001 - RNA, 14 nt, Human
gcccgcugggcuga

SEQ ID NO: 2211002 - RNA, 15 nt, Human
gcccgcugggcugag

SEQ ID NO: 2211003 - RNA, 16 nt, Human
gcccgcugggcugagc

SEQ ID NO: 2211004 - RNA, 17 nt, Human
gcccgcugggcugagcc

SEQ ID NO: 2211005 - RNA, 18 nt, Human
gcccgcugggcugagccc

SEQ ID NO: 2211006 - RNA, 12 nt, Human
gcccggcuccag

SEQ ID NO: 2211007 - RNA, 12 nt, Human
gcccgcuugccu

SEQ ID NO: 2211008 - RNA, 14 nt, Human
gcccgcuugccucg

SEQ ID NO: 2211009 - RNA, 18 nt, Human
gcccgcuugccucggcuc

SEQ ID NO: 2211010 - RNA, 19 nt, Human
gcccgcuugccucggcucc

SEQ ID NO: 2211011 - RNA, 21 nt, Human
gcccgcuugccucggcuccug

SEQ ID NO: 2211012 - RNA, 22 nt, Human
gcccgcuugccucggcuccugc

SEQ ID NO: 2211013 - RNA, 23 nt, Human
gcccgcuugccucggcuccugcu

SEQ ID NO: 2211014 - RNA, 14 nt, Human
gcccggaccuuggc

SEQ ID NO: 2211015 - RNA, 23 nt, Human
gccccuucuagguggcaaggcug

SEQ ID NO: 2211016 - RNA, 20 nt, Human
gccccuuccuugcucugcac

SEQ ID NO: 2211017 - RNA, 18 nt, Human
gccccuucucagaaucua

SEQ ID NO: 2211018 - RNA, 11 nt, Human
gccccugggcu

SEQ ID NO: 2211019 - RNA, 12 nt, Human
gccccugggcuu

SEQ ID NO: 2211020 - RNA, 16 nt, Human
gccccuuccccgaggg

SEQ ID NO: 2211021 - RNA, 20 nt, Human
gccccuucugacccaugcug

SEQ ID NO: 2211022 - RNA, 13 nt, Human
gcccgcgcccgcg

SEQ ID NO: 2211023 - RNA, 17 nt, Human
gccccuucucagaaucu

SEQ ID NO: 2211024 - RNA, 19 nt, Human
gccccuucugacccaugcu

SEQ ID NO: 2211025 - RNA, 13 nt, Human
gcccggcuccagg

SEQ ID NO: 2211026 - RNA, 14 nt, Human
gcccggcuccaggc

SEQ ID NO: 2211027 - RNA, 15 nt, Human
gcccggcuccaggcu

SEQ ID NO: 2211028 - RNA, 12 nt, Human
gcccgggcucug

SEQ ID NO: 2211029 - RNA, 13 nt, Human
gcccgggcucugc

SEQ ID NO: 2211030 - RNA, 14 nt, Human
gcccgggcucugcc

SEQ ID NO: 2211031 - RNA, 15 nt, Human
gcccgggcucugccu

SEQ ID NO: 2211032 - RNA, 18 nt, Human
gcccgggcucugccuccc

SEQ ID NO: 2211033 - RNA, 22 nt, Human
gccagagcuacccgcagaguuc

SEQ ID NO: 2211034 - RNA, 15 nt, Human
gccagagcugggagg

SEQ ID NO: 2211035 - RNA, 18 nt, Human
gccagagggagugacaga

SEQ ID NO: 2211036 - RNA, 14 nt, Human
gccagaggaacugu

SEQ ID NO: 2211037 - RNA, 18 nt, Human
gccagaggaacuguccag

SEQ ID NO: 2211038 - RNA, 20 nt, Human
gccagaggaacuguccagag

SEQ ID NO: 2211039 - RNA, 21 nt, Human
gccagaggaacuguccagaga

SEQ ID NO: 2211040 - RNA, 24 nt, Human
gccagaggaacuguccagagagca

SEQ ID NO: 2211041 - RNA, 12 nt, Human
gccagagacaca

SEQ ID NO: 2211042 - RNA, 15 nt, Human
gccagagacacaagc

SEQ ID NO: 2211043 - RNA, 23 nt, Human
gccagagauccaaaagaagcccc

SEQ ID NO: 2211044 - RNA, 18 nt, Human
gccagagaagugacaggg

SEQ ID NO: 2211045 - RNA, 19 nt, Human
gccagagaagugacaggga

SEQ ID NO: 2211046 - RNA, 14 nt, Human
gccagagaagugac

SEQ ID NO: 2211047 - RNA, 15 nt, Human
gccagagaagugaca

SEQ ID NO: 2211048 - RNA, 16 nt, Human
gccagagaagugacag

SEQ ID NO: 2211049 - RNA, 17 nt, Human
gccagagaagugacagg

SEQ ID NO: 2211050 - RNA, 14 nt, Human
gccagagccagggg

SEQ ID NO: 2211051 - RNA, 12 nt, Human
gccagagccagg

SEQ ID NO: 2211052 - RNA, 22 nt, Human
gccagagauccaaaagaagccc

SEQ ID NO: 2211053 - RNA, 17 nt, Human
gccacugcaccgggcca

SEQ ID NO: 2211054 - RNA, 18 nt, Human
gccacugcaccgggccac

SEQ ID NO: 2211055 - RNA, 13 nt, Human
gccagagaagcua

SEQ ID NO: 2211056 - RNA, 11 nt, Human
gccagagaagu

SEQ ID NO: 2211057 - RNA, 13 nt, Human
gccagagaaguga

SEQ ID NO: 2211058 - RNA, 10 nt, Human
gccagagaag

SEQ ID NO: 2211059 - RNA, 17 nt, Human
gccacugcacagagcuc

SEQ ID NO: 2211060 - RNA, 22 nt, Human
gccacugcacagagcucuccag

SEQ ID NO: 2211061 - RNA, 15 nt, Human
gccacugcacagagc

SEQ ID NO: 2211062 - RNA, 16 nt, Human
gccacugcacagagcu

SEQ ID NO: 2211063 - RNA, 21 nt, Human
gccacucaggaggcugaggca

SEQ ID NO: 2211064 - RNA, 20 nt, Human
gccacucaggaggcugaggc

SEQ ID NO: 2211065 - RNA, 14 nt, Human
gccacucaggccca

SEQ ID NO: 2211066 - RNA, 22 nt, Human
gccacucaggcccaaagccucg

SEQ ID NO: 2211067 - RNA, 15 nt, Human
gccacucagcuuccu

SEQ ID NO: 2211068 - RNA, 16 nt, Human
gccacucauuccugua

SEQ ID NO: 2211069 - RNA, 19 nt, Human
gccacugaagcugggauuc

SEQ ID NO: 2211070 - RNA, 19 nt, Human
gccacuccagaccccuggc

SEQ ID NO: 2211071 - RNA, 16 nt, Human
gccacuccagaccccu

SEQ ID NO: 2211072 - RNA, 18 nt, Human
gccacuccagaccccugg

SEQ ID NO: 2211073 - RNA, 14 nt, Human
gccacggcagccua

SEQ ID NO: 2211074 - RNA, 18 nt, Human
gccaaauguaauugaaua

SEQ ID NO: 2211075 - RNA, 16 nt, Human
gccaaauguaauugaa

SEQ ID NO: 2211076 - RNA, 22 nt, Human
gccaaaugguuuaacuucugcc

SEQ ID NO: 2211077 - RNA, 17 nt, Human
gccaaauauguccuggg

SEQ ID NO: 2211078 - RNA, 14 nt, Human
gccacggccaggcc

SEQ ID NO: 2211079 - RNA, 15 nt, Human
gccacggccaggcca

SEQ ID NO: 2211080 - RNA, 23 nt, Human
gccaaaggagggucaggaaggau

SEQ ID NO: 2211081 - RNA, 14 nt, Human
gccaaagaucacuu

SEQ ID NO: 2211082 - RNA, 16 nt, Human
gccaaagauaaucucu

SEQ ID NO: 2211083 - RNA, 19 nt, Human
gccaaagacuuaguauauu

SEQ ID NO: 2211084 - RNA, 19 nt, Human
gccaaagggaaauaucauu

SEQ ID NO: 2211085 - RNA, 18 nt, Human
gccaaaggaugugauaua

SEQ ID NO: 2211086 - RNA, 16 nt, Human
gccaaaggaugugaua

SEQ ID NO: 2211087 - RNA, 17 nt, Human
gccaaaggaugugauau

SEQ ID NO: 2211088 - RNA, 12 nt, Human
gccaaaguguua

SEQ ID NO: 2211089 - RNA, 16 nt, Human
gccaaauaaugucucu

SEQ ID NO: 2211090 - RNA, 15 nt, Human
gccaaauauguccug

SEQ ID NO: 2211091 - RNA, 18 nt, Human
gccaaauaaugucucugu

SEQ ID NO: 2211092 - RNA, 22 nt, Human
gccaaauaaugucucugugaga

SEQ ID NO: 2211093 - RNA, 21 nt, Human
gccacguuccuuacugcagaa

SEQ ID NO: 2211094 - RNA, 16 nt, Human
gccacguuccuuacug

SEQ ID NO: 2211095 - RNA, 23 nt, Human
gccacguguuugugcuguggugu

SEQ ID NO: 2211096 - RNA, 22 nt, Human
gccacguuccuuacugcagaau

SEQ ID NO: 2211097 - RNA, 22 nt, Human
gccacguuggagaagcccgugu

SEQ ID NO: 2211098 - RNA, 22 nt, Human
gccacguucuuacuaguuuccc

SEQ ID NO: 2211099 - RNA, 17 nt, Human
gccacgugccaggcccg

SEQ ID NO: 2211100 - RNA, 16 nt, Human
gccacgugccaggccc

SEQ ID NO: 2211101 - RNA, 18 nt, Human
gccacgugccaggcccgg

SEQ ID NO: 2211102 - RNA, 21 nt, Human
gccacgugggcaaacaggcag

SEQ ID NO: 2211103 - RNA, 16 nt, Human
gccacggccaggccag

SEQ ID NO: 2211104 - RNA, 21 nt, Human
gccacuauuguuagucucuug

SEQ ID NO: 2211105 - RNA, 20 nt, Human
gccacuauuguuagucucuu

SEQ ID NO: 2211106 - RNA, 23 nt, Human
gccacuaacuagagcagcccugg

SEQ ID NO: 2211107 - RNA, 14 nt, Human
gccacucacuaggc

SEQ ID NO: 2211108 - RNA, 15 nt, Human
gccacucacuaggcc

SEQ ID NO: 2211109 - RNA, 14 nt, Human
gccacucacacagc

SEQ ID NO: 2211110 - RNA, 17 nt, Human
gccacucacacagccag

SEQ ID NO: 2211111 - RNA, 18 nt, Human
gccacucacacagccagg

SEQ ID NO: 2211112 - RNA, 20 nt, Human
gccacucacacagccaggug

SEQ ID NO: 2211113 - RNA, 18 nt, Human
gccacucacuaggccccc

SEQ ID NO: 2211114 - RNA, 19 nt, Human
gccacucacuaggccccca

SEQ ID NO: 2211115 - RNA, 23 nt, Human
gccacucacuaggcccccacuug

SEQ ID NO: 2211116 - RNA, 16 nt, Human
gccacucaccgaagcc

SEQ ID NO: 2211117 - RNA, 13 nt, Human
gccacucagcuuc

SEQ ID NO: 2211118 - RNA, 19 nt, Human
gccagcgggaauggcagcu

SEQ ID NO: 2211119 - RNA, 16 nt, Human
gccagcgaacuugaca

SEQ ID NO: 2211120 - RNA, 13 nt, Human
gccagcguccucc

SEQ ID NO: 2211121 - RNA, 12 nt, Human
gccagcguccuc

SEQ ID NO: 2211122 - RNA, 21 nt, Human
gccagccuucuuccaucccag

SEQ ID NO: 2211123 - RNA, 12 nt, Human
gccagcgaacuu

SEQ ID NO: 2211124 - RNA, 23 nt, Human
gccagcuacuuccuccuccccac

SEQ ID NO: 2211125 - RNA, 22 nt, Human
gccagcguccuccucugugacc

SEQ ID NO: 2211126 - RNA, 19 nt, Human
gccagcguccuccucugug

SEQ ID NO: 2211127 - RNA, 14 nt, Human
gccagccuugacca

SEQ ID NO: 2211128 - RNA, 20 nt, Human
gccagccuugaccauucucc

SEQ ID NO: 2211129 - RNA, 21 nt, Human
gccagccuugaccauucucca

SEQ ID NO: 2211130 - RNA, 22 nt, Human
gccagccuugaccauucuccac

SEQ ID NO: 2211131 - RNA, 13 nt, Human
gccagcugccucc

SEQ ID NO: 2211132 - RNA, 13 nt, Human
gccagcugcuccc

SEQ ID NO: 2211133 - RNA, 14 nt, Human
gccagcucauuuca

SEQ ID NO: 2211134 - RNA, 15 nt, Human
gccagcucucagcca

SEQ ID NO: 2211135 - RNA, 13 nt, Human
gccagcucuguau

SEQ ID NO: 2211136 - RNA, 14 nt, Human
gccagcucucagcc

SEQ ID NO: 2211137 - RNA, 13 nt, Human
gccagcucucagc

SEQ ID NO: 2211138 - RNA, 16 nt, Human
gccagcucagucccau

SEQ ID NO: 2211139 - RNA, 13 nt, Human
gccagcucccucu

SEQ ID NO: 2211140 - RNA, 16 nt, Human
gccagcugcuccccag

SEQ ID NO: 2211141 - RNA, 15 nt, Human
gccagcugcucccca

SEQ ID NO: 2211142 - RNA, 14 nt, Human
gccagcugcucccc

SEQ ID NO: 2211143 - RNA, 14 nt, Human
gccagcugcuuggg

SEQ ID NO: 2211144 - RNA, 13 nt, Human
gccagcuggagaa

SEQ ID NO: 2211145 - RNA, 16 nt, Human
gccagcugcuugggcu

SEQ ID NO: 2211146 - RNA, 15 nt, Human
gccagcugcuugggc

SEQ ID NO: 2211147 - RNA, 18 nt, Human
gccagcuggcagcagagu

SEQ ID NO: 2211148 - RNA, 17 nt, Human
gccagcuggcagcagag

SEQ ID NO: 2211149 - RNA, 14 nt, Human
gccagcuggcagca

SEQ ID NO: 2211150 - RNA, 18 nt, Human
gccagcuuguuauuuaua

SEQ ID NO: 2211151 - RNA, 21 nt, Human
gccagcccucccuguccuccu

SEQ ID NO: 2211152 - RNA, 20 nt, Human
gccagcccucccuguccucc

SEQ ID NO: 2211153 - RNA, 17 nt, Human
gccagcccucccugucc

SEQ ID NO: 2211154 - RNA, 15 nt, Human
gccagcccucccugu

SEQ ID NO: 2211155 - RNA, 14 nt, Human
gccagcccucccug

SEQ ID NO: 2211156 - RNA, 13 nt, Human
gccagcccucccu

SEQ ID NO: 2211157 - RNA, 10 nt, Human
gccagcccuc

SEQ ID NO: 2211158 - RNA, 15 nt, Human
gccagcccggcuggu

SEQ ID NO: 2211159 - RNA, 23 nt, Human
gccagcccucccuguccuccucg

SEQ ID NO: 2211160 - RNA, 22 nt, Human
gccagcccucccuguccuccuc

SEQ ID NO: 2211161 - RNA, 21 nt, Human
gccagccccucccaccacagc

SEQ ID NO: 2211162 - RNA, 20 nt, Human
gccagccccucccaccacag

SEQ ID NO: 2211163 - RNA, 17 nt, Human
gccagccccucccacca

SEQ ID NO: 2211164 - RNA, 19 nt, Human
gccagccccuggccccagg

SEQ ID NO: 2211165 - RNA, 14 nt, Human
gccagccccuggcc

SEQ ID NO: 2211166 - RNA, 20 nt, Human
gccagccccuggccccagga

SEQ ID NO: 2211167 - RNA, 21 nt, Human
gccagccgagauagccaaggc

SEQ ID NO: 2211168 - RNA, 20 nt, Human
gccagccgagauagccaagg

SEQ ID NO: 2211169 - RNA, 12 nt, Human
gccagccuugac

SEQ ID NO: 2211170 - RNA, 20 nt, Human
gccagccugucccauggaca

SEQ ID NO: 2211171 - RNA, 16 nt, Human
gccagccuuccucugc

SEQ ID NO: 2211172 - RNA, 17 nt, Human
gccagccuuccucugca

SEQ ID NO: 2211173 - RNA, 19 nt, Human
gccagccuuccucugcagc

SEQ ID NO: 2211174 - RNA, 21 nt, Human
gccagccuuccucugcagcug

SEQ ID NO: 2211175 - RNA, 22 nt, Human
gccagccuuccucugcagcuga

SEQ ID NO: 2211176 - RNA, 12 nt, Human
gccagccuucuu

SEQ ID NO: 2211177 - RNA, 19 nt, Human
gccagccuucuuccauccc

SEQ ID NO: 2211178 - RNA, 16 nt, Human
gccagccccucccacc

SEQ ID NO: 2211179 - RNA, 21 nt, Human
gccagccccggcccugggcuc

SEQ ID NO: 2211180 - RNA, 12 nt, Human
gccagccccucc

SEQ ID NO: 2211181 - RNA, 11 nt, Human
gccagccccuc

SEQ ID NO: 2211182 - RNA, 18 nt, Human
gccagccccggcccuggg

SEQ ID NO: 2211183 - RNA, 19 nt, Human
gccagccccggcccugggc

SEQ ID NO: 2211184 - RNA, 18 nt, Human
gccagccccacccaggag

SEQ ID NO: 2211185 - RNA, 17 nt, Human
gccagauggggccucug

SEQ ID NO: 2211186 - RNA, 18 nt, Human
gccagauggggccucugu

SEQ ID NO: 2211187 - RNA, 19 nt, Human
gccagccccacccaggagg

SEQ ID NO: 2211188 - RNA, 17 nt, Human
gccagccccggcccugg

SEQ ID NO: 2211189 - RNA, 17 nt, Human
gccagauucuuuccuga

SEQ ID NO: 2211190 - RNA, 24 nt, Human
gccagaugcugauguucaguguaa

SEQ ID NO: 2211191 - RNA, 22 nt, Human
gccagauggacuccagccugcc

SEQ ID NO: 2211192 - RNA, 14 nt, Human
gccagauggggccu

SEQ ID NO: 2211193 - RNA, 19 nt, Human
gccagagggagugacagag

SEQ ID NO: 2211194 - RNA, 20 nt, Human
gccagagggagugacagagg

SEQ ID NO: 2211195 - RNA, 16 nt, Human
gccagauucuuuccug

SEQ ID NO: 2211196 - RNA, 22 nt, Human
gccagaggaacuguccagagag

SEQ ID NO: 2211197 - RNA, 23 nt, Human
gccagaggaacuguccagagagc

SEQ ID NO: 2211198 - RNA, 15 nt, Human
gccagaugcugaugu

SEQ ID NO: 2211199 - RNA, 16 nt, Human
gccagaugcugauguu

SEQ ID NO: 2211200 - RNA, 17 nt, Human
gccagaugcugauguuc

SEQ ID NO: 2211201 - RNA, 19 nt, Human
gccagaugcugauguucag

SEQ ID NO: 2211202 - RNA, 20 nt, Human
gccagaugcugauguucagu

SEQ ID NO: 2211203 - RNA, 21 nt, Human
gccagaugcugauguucagug

SEQ ID NO: 2211204 - RNA, 20 nt, Human
gccagucuugacgaguguga

SEQ ID NO: 2211205 - RNA, 17 nt, Human
gccagucugggcugccg

SEQ ID NO: 2211206 - RNA, 13 nt, Human
gccagucuugugu

SEQ ID NO: 2211207 - RNA, 13 nt, Human
gccagugacagac

SEQ ID NO: 2211208 - RNA, 12 nt, Human
gccagucugugg

SEQ ID NO: 2211209 - RNA, 15 nt, Human
gccagucugggcugc

SEQ ID NO: 2211210 - RNA, 16 nt, Human
gccagucugggcugcc

SEQ ID NO: 2211211 - RNA, 13 nt, Human
gccagucugugga

SEQ ID NO: 2211212 - RNA, 20 nt, Human
gccagucuguggaucagaga

SEQ ID NO: 2211213 - RNA, 19 nt, Human
gccauccagguucagcuug

SEQ ID NO: 2211214 - RNA, 20 nt, Human
gccauccagguucagcuugu

SEQ ID NO: 2211215 - RNA, 13 nt, Human
gccaggugcagug

SEQ ID NO: 2211216 - RNA, 14 nt, Human
gccaggugcagugg

SEQ ID NO: 2211217 - RNA, 12 nt, Human
gccaggugccuu

SEQ ID NO: 2211218 - RNA, 18 nt, Human
gccaguccugccuggcca

SEQ ID NO: 2211219 - RNA, 13 nt, Human
gccaggugccuug

SEQ ID NO: 2211220 - RNA, 14 nt, Human
gccaggugccuugg

SEQ ID NO: 2211221 - RNA, 15 nt, Human
gccaggugccuugga

SEQ ID NO: 2211222 - RNA, 16 nt, Human
gccaggugccuuggag

SEQ ID NO: 2211223 - RNA, 22 nt, Human
gccagucucacugugggaaggc

SEQ ID NO: 2211224 - RNA, 20 nt, Human
gccagucgcgcugccugugu

SEQ ID NO: 2211225 - RNA, 13 nt, Human
gccagucugggcu

SEQ ID NO: 2211226 - RNA, 14 nt, Human
gccagucugggcug

SEQ ID NO: 2211227 - RNA, 16 nt, Human
gccagucgcgcugccu

SEQ ID NO: 2211228 - RNA, 17 nt, Human
gccagucgcgcugccug

SEQ ID NO: 2211229 - RNA, 18 nt, Human
gccagucgcgcugccugu

SEQ ID NO: 2211230 - RNA, 19 nt, Human
gccagucgcgcugccugug

SEQ ID NO: 2211231 - RNA, 20 nt, Human
gccaguccugccuggccagg

SEQ ID NO: 2211232 - RNA, 19 nt, Human
gccaguccugccuggccag

SEQ ID NO: 2211233 - RNA, 15 nt, Human
gccagucgcgcugcc

SEQ ID NO: 2211234 - RNA, 14 nt, Human
gccagucgcgcugc

SEQ ID NO: 2211235 - RNA, 13 nt, Human
gccaucccagccc

SEQ ID NO: 2211236 - RNA, 14 nt, Human
gccaucccagcccc

SEQ ID NO: 2211237 - RNA, 15 nt, Human
gccaucccagcccca

SEQ ID NO: 2211238 - RNA, 16 nt, Human
gccaucccagccccaa

SEQ ID NO: 2211239 - RNA, 17 nt, Human
gccaucccagccccaau

SEQ ID NO: 2211240 - RNA, 14 nt, Human
gccagugacagaca

SEQ ID NO: 2211241 - RNA, 17 nt, Human
gccaucccagccuuggc

SEQ ID NO: 2211242 - RNA, 15 nt, Human
gccagggccuggaag

SEQ ID NO: 2211243 - RNA, 16 nt, Human
gccagggccuggaaga

SEQ ID NO: 2211244 - RNA, 11 nt, Human
gccagggcugc

SEQ ID NO: 2211245 - RNA, 22 nt, Human
gccagggccuggaagacagaga

SEQ ID NO: 2211246 - RNA, 22 nt, Human
gccagggcuauagcucaggacc

SEQ ID NO: 2211247 - RNA, 17 nt, Human
gccaggggaaaaucagc

SEQ ID NO: 2211248 - RNA, 22 nt, Human
gccaggggaaaaucagccugcu

SEQ ID NO: 2211249 - RNA, 21 nt, Human
gccaggggaaaaucagccugc

SEQ ID NO: 2211250 - RNA, 15 nt, Human
gccagguaaugugaa

SEQ ID NO: 2211251 - RNA, 21 nt, Human
gccaggguuucgagaagcugc

SEQ ID NO: 2211252 - RNA, 16 nt, Human
gccagguaaugaggga

SEQ ID NO: 2211253 - RNA, 21 nt, Human
gccagguaaugugaauaaauu

SEQ ID NO: 2211254 - RNA, 21 nt, Human
gccaggucacccuuugcugug

SEQ ID NO: 2211255 - RNA, 22 nt, Human
gccaggucacccuuugcuguga

SEQ ID NO: 2211256 - RNA, 16 nt, Human
gccagguccuugcccu

SEQ ID NO: 2211257 - RNA, 23 nt, Human
gccaggggaaaaucagccugcuc

SEQ ID NO: 2211258 - RNA, 14 nt, Human
gccaggguguggcc

SEQ ID NO: 2211259 - RNA, 20 nt, Human
gccaggguguggcccugcca

SEQ ID NO: 2211260 - RNA, 23 nt, Human
gccaggguguggcccugccaucu

SEQ ID NO: 2211261 - RNA, 19 nt, Human
gccagggcccugcagaggg

SEQ ID NO: 2211262 - RNA, 17 nt, Human
gccagggcccugcagag

SEQ ID NO: 2211263 - RNA, 16 nt, Human
gccagggcccugcaga

SEQ ID NO: 2211264 - RNA, 15 nt, Human
gccagggcccugcag

SEQ ID NO: 2211265 - RNA, 13 nt, Human
gccagggcccugc

SEQ ID NO: 2211266 - RNA, 20 nt, Human
gccaggaagccagcaggcuc

SEQ ID NO: 2211267 - RNA, 19 nt, Human
gccaggaagccagcaggcu

SEQ ID NO: 2211268 - RNA, 17 nt, Human
gccagcuuuuccucccu

SEQ ID NO: 2211269 - RNA, 15 nt, Human
gccagcuuucccugc

SEQ ID NO: 2211270 - RNA, 11 nt, Human
gccaggaagcc

SEQ ID NO: 2211271 - RNA, 17 nt, Human
gccaggaagccagcagg

SEQ ID NO: 2211272 - RNA, 18 nt, Human
gccaggaagccagcaggc

SEQ ID NO: 2211273 - RNA, 21 nt, Human
gccauggaggcacacagcugc

SEQ ID NO: 2211274 - RNA, 22 nt, Human
gccauggcgugucccucucgga

SEQ ID NO: 2211275 - RNA, 20 nt, Human
gccauggcugucucaaacca

SEQ ID NO: 2211276 - RNA, 17 nt, Human
gccauggcgugucccuc

SEQ ID NO: 2211277 - RNA, 16 nt, Human
gccauggcgugucccu

SEQ ID NO: 2211278 - RNA, 19 nt, Human
gccaugggacagggaggac

SEQ ID NO: 2211279 - RNA, 14 nt, Human
gccaugggacaggg

SEQ ID NO: 2211280 - RNA, 15 nt, Human
gccauggaggcacac

SEQ ID NO: 2211281 - RNA, 22 nt, Human
gccauggagagcuggagccugg

SEQ ID NO: 2211282 - RNA, 23 nt, Human
gccauggagagcuggagccuggu

SEQ ID NO: 2211283 - RNA, 16 nt, Human
gccauggaggcacaca

SEQ ID NO: 2211284 - RNA, 18 nt, Human
gccauggaggcacacagc

SEQ ID NO: 2211285 - RNA, 15 nt, Human
gccauggagagcugg

SEQ ID NO: 2211286 - RNA, 16 nt, Human
gccauggagagcugga

SEQ ID NO: 2211287 - RNA, 18 nt, Human
gccauggagagcuggagc

SEQ ID NO: 2211288 - RNA, 20 nt, Human
gccauggagagcuggagccu

SEQ ID NO: 2211289 - RNA, 16 nt, Human
gccaucccagccuugg

SEQ ID NO: 2211290 - RNA, 23 nt, Human
gccauuugcacccuccgccuuca

SEQ ID NO: 2211291 - RNA, 20 nt, Human
gccauuugcacccuccgccu

SEQ ID NO: 2211292 - RNA, 15 nt, Human
gccauuugcuuuuuc

SEQ ID NO: 2211293 - RNA, 20 nt, Human
gccauuucuuccacaagagc

SEQ ID NO: 2211294 - RNA, 22 nt, Human
gccauuucuuccacaagagccc

SEQ ID NO: 2211295 - RNA, 19 nt, Human
gccauggcuuccaaggugg

SEQ ID NO: 2211296 - RNA, 24 nt, Human
gccauggcuuccaagguggucugc

SEQ ID NO: 2211297 - RNA, 22 nt, Human
gccauuuaaagcuuauuaaaac

SEQ ID NO: 2211298 - RNA, 23 nt, Human
gccauugucuucggaaaccuugg

SEQ ID NO: 2211299 - RNA, 21 nt, Human
gccauuuagccaccaucuuug

SEQ ID NO: 2211300 - RNA, 17 nt, Human
gccauuucuuccacaag

SEQ ID NO: 2211301 - RNA, 13 nt, Human
gcccacacacccc

SEQ ID NO: 2211302 - RNA, 23 nt, Human
gcccacacccagcuacuuuaaca

SEQ ID NO: 2211303 - RNA, 13 nt, Human
gcccacacccccu

SEQ ID NO: 2211304 - RNA, 13 nt, Human
gcccacacuugag

SEQ ID NO: 2211305 - RNA, 17 nt, Human
gcccacagcucccaccc

SEQ ID NO: 2211306 - RNA, 16 nt, Human
gcccacagcucccacc

SEQ ID NO: 2211307 - RNA, 13 nt, Human
gcccacagcuccc

SEQ ID NO: 2211308 - RNA, 14 nt, Human
gcccacagcuccca

SEQ ID NO: 2211309 - RNA, 16 nt, Human
gcccacagcaggugcu

SEQ ID NO: 2211310 - RNA, 16 nt, Human
gcccacagcuguauga

SEQ ID NO: 2211311 - RNA, 19 nt, Human
gcccaaagugguauagaaa

SEQ ID NO: 2211312 - RNA, 17 nt, Human
gcccaaagucuguguga

SEQ ID NO: 2211313 - RNA, 17 nt, Human
gcccaaagccagacagc

SEQ ID NO: 2211314 - RNA, 16 nt, Human
gcccaaagccagacag

SEQ ID NO: 2211315 - RNA, 16 nt, Human
gccauuuguguuuaua

SEQ ID NO: 2211316 - RNA, 15 nt, Human
gcccaaagaugcagc

SEQ ID NO: 2211317 - RNA, 16 nt, Human
gcccaaagaugcagcc

SEQ ID NO: 2211318 - RNA, 15 nt, Human
gcccaccccccucau

SEQ ID NO: 2211319 - RNA, 19 nt, Human
gcccacagcucccacccca

SEQ ID NO: 2211320 - RNA, 12 nt, Human
gcccacagggaa

SEQ ID NO: 2211321 - RNA, 19 nt, Human
gcccacagggaacccugcu

SEQ ID NO: 2211322 - RNA, 15 nt, Human
gcccacccccucaag

SEQ ID NO: 2211323 - RNA, 19 nt, Human
gcccacaggaucagucuga

SEQ ID NO: 2211324 - RNA, 13 nt, Human
gcccacaggauca

SEQ ID NO: 2211325 - RNA, 18 nt, Human
gcccacaggaucagucug

SEQ ID NO: 2211326 - RNA, 15 nt, Human
gcccaccccucaaca

SEQ ID NO: 2211327 - RNA, 22 nt, Human
gcccacccccucaagccaaucc

SEQ ID NO: 2211328 - RNA, 14 nt, Human
gcccacccccugcc

SEQ ID NO: 2211329 - RNA, 15 nt, Human
gcccacccccugccc

SEQ ID NO: 2211330 - RNA, 16 nt, Human
gcccacccccugcccu

SEQ ID NO: 2211331 - RNA, 17 nt, Human
gcccacccccugcccug

SEQ ID NO: 2211332 - RNA, 18 nt, Human
gcccacccccugcccugc

SEQ ID NO: 2211333 - RNA, 19 nt, Human
gcccacccccugcccugca

SEQ ID NO: 2211334 - RNA, 20 nt, Human
gcccacccccugcccugcac

SEQ ID NO: 2211335 - RNA, 19 nt, Human
gcccacccguggagauggg

SEQ ID NO: 2211336 - RNA, 14 nt, Human
gcccacccuccugu

SEQ ID NO: 2211337 - RNA, 22 nt, Human
gcccacccccugcccugcacgu

SEQ ID NO: 2211338 - RNA, 13 nt, Human
gcccaccccgcuc

SEQ ID NO: 2211339 - RNA, 17 nt, Human
gcccaccccgcucugca

SEQ ID NO: 2211340 - RNA, 18 nt, Human
gcccaccccgcucugcau

SEQ ID NO: 2211341 - RNA, 20 nt, Human
gcccacccuccugucuuccc

SEQ ID NO: 2211342 - RNA, 18 nt, Human
gcccacccuccugucuuc

SEQ ID NO: 2211343 - RNA, 19 nt, Human
gcccacccuccugucuucc

SEQ ID NO: 2211344 - RNA, 22 nt, Human
gcccacccuccugucuucccag

SEQ ID NO: 2211345 - RNA, 20 nt, Human
gcauuuuccuccaucgcagu

SEQ ID NO: 2211346 - RNA, 18 nt, Human
gcauuuucaccccacccu

SEQ ID NO: 2211347 - RNA, 14 nt, Human
gcauuuucccagau

SEQ ID NO: 2211348 - RNA, 22 nt, Human
gcauuuugcuaaaugugaauga

SEQ ID NO: 2211349 - RNA, 23 nt, Human
gcauuuuggagaguuuccugaaa

SEQ ID NO: 2211350 - RNA, 22 nt, Human
gcauuuuggagaguuuccugaa

SEQ ID NO: 2211351 - RNA, 13 nt, Human
gcauuuugcuauu

SEQ ID NO: 2211352 - RNA, 14 nt, Human
gcauuuugcuauug

SEQ ID NO: 2211353 - RNA, 17 nt, Human
gcauuuugcuauuguaa

SEQ ID NO: 2211354 - RNA, 19 nt, Human
gcauuuugcuauuguaaau

SEQ ID NO: 2211355 - RNA, 14 nt, Human
gcauuuuguauuug

SEQ ID NO: 2211356 - RNA, 23 nt, Human
gcauuuuguauuugucuaacugg

SEQ ID NO: 2211357 - RNA, 16 nt, Human
gcauuuuguuugguau

SEQ ID NO: 2211358 - RNA, 15 nt, Human
gccaaaagcugcuca

SEQ ID NO: 2211359 - RNA, 14 nt, Human
gccaaaagcugcuc

SEQ ID NO: 2211360 - RNA, 23 nt, Human
gccaaacaaaaagguucucaggu

SEQ ID NO: 2211361 - RNA, 17 nt, Human
gccaaacucugccagcc

SEQ ID NO: 2211362 - RNA, 14 nt, Human
gccaaaggaagcac

SEQ ID NO: 2211363 - RNA, 16 nt, Human
gccaaaggaagcacau

SEQ ID NO: 2211364 - RNA, 20 nt, Human
gccaaaggaagcacaugccu

SEQ ID NO: 2211365 - RNA, 15 nt, Human
gccaaacagccacac

SEQ ID NO: 2211366 - RNA, 19 nt, Human
gccaaacucaccugccccu

SEQ ID NO: 2211367 - RNA, 18 nt, Human
gccaaacucugccagcca

SEQ ID NO: 2211368 - RNA, 21 nt, Human
gccaaacucaccugccccuca

SEQ ID NO: 2211369 - RNA, 17 nt, Human
gcauuuuacuguacaga

SEQ ID NO: 2211370 - RNA, 13 nt, Human
gcauuuuauaaau

SEQ ID NO: 2211371 - RNA, 17 nt, Human
gcauuuuaaaaaugaaa

SEQ ID NO: 2211372 - RNA, 12 nt, Human
gcauuuuauucu

SEQ ID NO: 2211373 - RNA, 16 nt, Human
gcauuuuauugcuuga

SEQ ID NO: 2211374 - RNA, 16 nt, Human
gcauuuuacuguacag

SEQ ID NO: 2211375 - RNA, 23 nt, Human
gcauuuggauuggggucccucua

SEQ ID NO: 2211376 - RNA, 15 nt, Human
gcauuuuaaaaauga

SEQ ID NO: 2211377 - RNA, 13 nt, Human
gcauugcuuucug

SEQ ID NO: 2211378 - RNA, 21 nt, Human
gcauuggaaacccuauuuccc

SEQ ID NO: 2211379 - RNA, 20 nt, Human
gcauugcuuucugaaauuag

SEQ ID NO: 2211380 - RNA, 16 nt, Human
gcauuggaagacccca

SEQ ID NO: 2211381 - RNA, 23 nt, Human
gcauuugcugaauacagaggcaa

SEQ ID NO: 2211382 - RNA, 21 nt, Human
gcauuuggugguuucagaaau

SEQ ID NO: 2211383 - RNA, 22 nt, Human
gcauuuggauuggggucccucu

SEQ ID NO: 2211384 - RNA, 16 nt, Human
gcauuuggauuggggu

SEQ ID NO: 2211385 - RNA, 15 nt, Human
gcauuggcagcaggu

SEQ ID NO: 2211386 - RNA, 12 nt, Human
gcauuccccacu

SEQ ID NO: 2211387 - RNA, 12 nt, Human
gcauuccccagg

SEQ ID NO: 2211388 - RNA, 13 nt, Human
gcauucccagugg

SEQ ID NO: 2211389 - RNA, 22 nt, Human
gcauuccuucuuugauaauguu

SEQ ID NO: 2211390 - RNA, 13 nt, Human
gcauucucacucc

SEQ ID NO: 2211391 - RNA, 15 nt, Human
gcauucucacuccua

SEQ ID NO: 2211392 - RNA, 23 nt, Human
gcauuccuucuuugauaauguua

SEQ ID NO: 2211393 - RNA, 13 nt, Human
gcauucuaguacu

SEQ ID NO: 2211394 - RNA, 18 nt, Human
gcauucucacuccuaccu

SEQ ID NO: 2211395 - RNA, 14 nt, Human
gcauucucauggag

SEQ ID NO: 2211396 - RNA, 18 nt, Human
gcauugauggggaaggag

SEQ ID NO: 2211397 - RNA, 17 nt, Human
gcauugauggggaagga

SEQ ID NO: 2211398 - RNA, 16 nt, Human
gcauugauggggaagg

SEQ ID NO: 2211399 - RNA, 14 nt, Human
gcauucucugaaga

SEQ ID NO: 2211400 - RNA, 12 nt, Human
gcauugcuuucu

SEQ ID NO: 2211401 - RNA, 12 nt, Human
gcauugcuuucc

SEQ ID NO: 2211402 - RNA, 15 nt, Human
gcauugcuuuccacu

SEQ ID NO: 2211403 - RNA, 13 nt, Human
gcauugcugguuc

SEQ ID NO: 2211404 - RNA, 13 nt, Human
gcauugcauggac

SEQ ID NO: 2211405 - RNA, 14 nt, Human
gcauugccaagggc

SEQ ID NO: 2211406 - RNA, 14 nt, Human
gcauugccauuccc

SEQ ID NO: 2211407 - RNA, 16 nt, Human
gcauugccaagggcuu

SEQ ID NO: 2211408 - RNA, 15 nt, Human
gcaugccugugugac

SEQ ID NO: 2211409 - RNA, 13 nt, Human
gcaugccugugug

SEQ ID NO: 2211410 - RNA, 12 nt, Human
gcaugcccccuc

SEQ ID NO: 2211411 - RNA, 15 nt, Human
gcaugcccccucgug

SEQ ID NO: 2211412 - RNA, 21 nt, Human
gcaugcgcacaaggcugacca

SEQ ID NO: 2211413 - RNA, 13 nt, Human
gcaugcggcccag

SEQ ID NO: 2211414 - RNA, 14 nt, Human
gcaugcgcacaagg

SEQ ID NO: 2211415 - RNA, 16 nt, Human
gcaugccuuccagcac

SEQ ID NO: 2211416 - RNA, 21 nt, Human
gcaugccuuccagcacccugc

SEQ ID NO: 2211417 - RNA, 14 nt, Human
gcaugcggcccagc

SEQ ID NO: 2211418 - RNA, 16 nt, Human
gcaugcuggggcaagu

SEQ ID NO: 2211419 - RNA, 15 nt, Human
gcaugcugucccuua

SEQ ID NO: 2211420 - RNA, 15 nt, Human
gcauggagaauaaac

SEQ ID NO: 2211421 - RNA, 23 nt, Human
gcauggacaccccuuauccagga

SEQ ID NO: 2211422 - RNA, 17 nt, Human
gcauggaauuuguaagu

SEQ ID NO: 2211423 - RNA, 23 nt, Human
gcauggaaauucccuucaucugg

SEQ ID NO: 2211424 - RNA, 13 nt, Human
gcauggaauuugu

SEQ ID NO: 2211425 - RNA, 18 nt, Human
gcauguugagccaggccu

SEQ ID NO: 2211426 - RNA, 16 nt, Human
gcauguugcugaggag

SEQ ID NO: 2211427 - RNA, 17 nt, Human
gcauguuugugauugac

SEQ ID NO: 2211428 - RNA, 13 nt, Human
gcauuagaaauua

SEQ ID NO: 2211429 - RNA, 20 nt, Human
gcauuagauuucucauuugc

SEQ ID NO: 2211430 - RNA, 17 nt, Human
gcauuagaauuauuuaa

SEQ ID NO: 2211431 - RNA, 18 nt, Human
gcauuagaauuauuuaaa

SEQ ID NO: 2211432 - RNA, 16 nt, Human
gcauuccagccccucu

SEQ ID NO: 2211433 - RNA, 19 nt, Human
gcauuccagccccucuggu

SEQ ID NO: 2211434 - RNA, 17 nt, Human
gcauuccaacaaagggu

SEQ ID NO: 2211435 - RNA, 18 nt, Human
gcauuccaacaaaggguu

SEQ ID NO: 2211436 - RNA, 12 nt, Human
gcauuccagccc

SEQ ID NO: 2211437 - RNA, 15 nt, Human
gcauuccagccccuc

SEQ ID NO: 2211438 - RNA, 21 nt, Human
gcauuagaaauagacaguaua

SEQ ID NO: 2211439 - RNA, 16 nt, Human
gcauuagaaauagaca

SEQ ID NO: 2211440 - RNA, 15 nt, Human
gcauuagaauuauuu

SEQ ID NO: 2211441 - RNA, 17 nt, Human
gcauuacugcaugcacu

SEQ ID NO: 2211442 - RNA, 14 nt, Human
gcauuacugcaugc

SEQ ID NO: 2211443 - RNA, 15 nt, Human
gcauuaaaagaaaau

SEQ ID NO: 2211444 - RNA, 17 nt, Human
gcauuacgugagccagg

SEQ ID NO: 2211445 - RNA, 18 nt, Human
gcauuacgugagccaggu

SEQ ID NO: 2211446 - RNA, 14 nt, Human
gcauuaaaagaaaa

SEQ ID NO: 2211447 - RNA, 13 nt, Human
gcauuaaaagaaa

SEQ ID NO: 2211448 - RNA, 15 nt, Human
gcauguuucauguuu

SEQ ID NO: 2211449 - RNA, 20 nt, Human
gcauguuucauguuuuguga

SEQ ID NO: 2211450 - RNA, 12 nt, Human
gcauguuugcug

SEQ ID NO: 2211451 - RNA, 18 nt, Human
gcauguuuuccagcuccu

SEQ ID NO: 2211452 - RNA, 19 nt, Human
gcauguuuuccagcuccuc

SEQ ID NO: 2211453 - RNA, 21 nt, Human
gcaugcauuuugcagcaguga

SEQ ID NO: 2211454 - RNA, 14 nt, Human
gcaugcauuuugca

SEQ ID NO: 2211455 - RNA, 15 nt, Human
gcaugcauuuugcag

SEQ ID NO: 2211456 - RNA, 21 nt, Human
gcaugacaagccccaggcagg

SEQ ID NO: 2211457 - RNA, 23 nt, Human
gcaugcacuguucccccugugca

SEQ ID NO: 2211458 - RNA, 17 nt, Human
gcaugccuggauggggc

SEQ ID NO: 2211459 - RNA, 22 nt, Human
gcaugccuggauggggcugcac

SEQ ID NO: 2211460 - RNA, 19 nt, Human
gcaugacaagccccaggca

SEQ ID NO: 2211461 - RNA, 18 nt, Human
gcaugacaagccccaggc

SEQ ID NO: 2211462 - RNA, 17 nt, Human
gcaugacaagccccagg

SEQ ID NO: 2211463 - RNA, 16 nt, Human
gcaugacaagccccag

SEQ ID NO: 2211464 - RNA, 15 nt, Human
gcaugacaagcccca

SEQ ID NO: 2211465 - RNA, 17 nt, Human
gcaugaauuugugaagg

SEQ ID NO: 2211466 - RNA, 22 nt, Human
gcaugcacuguucccccugugc

SEQ ID NO: 2211467 - RNA, 21 nt, Human
gcaugcacuguucccccugug

SEQ ID NO: 2211468 - RNA, 17 nt, Human
gcaugcacuguuccccc

SEQ ID NO: 2211469 - RNA, 16 nt, Human
gcaugcacuguucccc

SEQ ID NO: 2211470 - RNA, 13 nt, Human
gcaucaccucagg

SEQ ID NO: 2211471 - RNA, 12 nt, Human
gcaucacaguuu

SEQ ID NO: 2211472 - RNA, 23 nt, Human
gcaugaaguaauaugcacacauu

SEQ ID NO: 2211473 - RNA, 15 nt, Human
gcaugaauuugugaa

SEQ ID NO: 2211474 - RNA, 16 nt, Human
gcaucaggccaggccc

SEQ ID NO: 2211475 - RNA, 17 nt, Human
gcaucaggccaggcccu

SEQ ID NO: 2211476 - RNA, 22 nt, Human
gcaucacagggcagagccggga

SEQ ID NO: 2211477 - RNA, 21 nt, Human
gcaucacagggcagagccggg

SEQ ID NO: 2211478 - RNA, 17 nt, Human
gcaucacagggcagagc

SEQ ID NO: 2211479 - RNA, 16 nt, Human
gcaucacagggcagag

SEQ ID NO: 2211480 - RNA, 15 nt, Human
gcaucacagggcaga

SEQ ID NO: 2211481 - RNA, 14 nt, Human
gcaucacagggcag

SEQ ID NO: 2211482 - RNA, 21 nt, Human
gcaucaaaagacaauucuuua

SEQ ID NO: 2211483 - RNA, 22 nt, Human
gcaucaaaagacaauucuuuau

SEQ ID NO: 2211484 - RNA, 13 nt, Human
gcaucaggccagg

SEQ ID NO: 2211485 - RNA, 15 nt, Human
gcaucaggccaggcc

SEQ ID NO: 2211486 - RNA, 15 nt, Human
gcauauguguuggcu

SEQ ID NO: 2211487 - RNA, 12 nt, Human
gcauauguugaa

SEQ ID NO: 2211488 - RNA, 17 nt, Human
gcauauguugaauacuu

SEQ ID NO: 2211489 - RNA, 14 nt, Human
gcauauguugaaua

SEQ ID NO: 2211490 - RNA, 15 nt, Human
gcauauguaugacuc

SEQ ID NO: 2211491 - RNA, 18 nt, Human
gcauauuauuuuauguug

SEQ ID NO: 2211492 - RNA, 21 nt, Human
gcauauguugaauacuuuuua

SEQ ID NO: 2211493 - RNA, 20 nt, Human
gcauauguugaauacuuuuu

SEQ ID NO: 2211494 - RNA, 19 nt, Human
gcauauguugaauacuuuu

SEQ ID NO: 2211495 - RNA, 18 nt, Human
gcauauguugaauacuuu

SEQ ID NO: 2211496 - RNA, 23 nt, Human
gcauauuauuuuauguugcauag

SEQ ID NO: 2211497 - RNA, 15 nt, Human
gcauauucaggaagc

SEQ ID NO: 2211498 - RNA, 21 nt, Human
gcauauguuucgcugauauau

SEQ ID NO: 2211499 - RNA, 18 nt, Human
gcauauguguuggcuugu

SEQ ID NO: 2211500 - RNA, 20 nt, Human
gcauauuccuuucuaucauu

SEQ ID NO: 2211501 - RNA, 15 nt, Human
gcauauuccuuucua

SEQ ID NO: 2211502 - RNA, 16 nt, Human
gcauauuccuuucuau

SEQ ID NO: 2211503 - RNA, 20 nt, Human
gcauauucaggaagcucagg

SEQ ID NO: 2211504 - RNA, 17 nt, Human
gcauauucaggaagcuc

SEQ ID NO: 2211505 - RNA, 18 nt, Human
gcauauucaggaagcuca

SEQ ID NO: 2211506 - RNA, 19 nt, Human
gcauauuguuauuauauaa

SEQ ID NO: 2211507 - RNA, 17 nt, Human
gcaucaaaagacaauuc

SEQ ID NO: 2211508 - RNA, 18 nt, Human
gcaucaaaagacaauucu

SEQ ID NO: 2211509 - RNA, 19 nt, Human
gcaucaaaagacaauucuu

SEQ ID NO: 2211510 - RNA, 21 nt, Human
gcaucaagaugugacauguuu

SEQ ID NO: 2211511 - RNA, 15 nt, Human
gcauauuguuauuau

SEQ ID NO: 2211512 - RNA, 21 nt, Human
gcauauuguauuacuagaaga

SEQ ID NO: 2211513 - RNA, 19 nt, Human
gcauauuguacacuuuuuu

SEQ ID NO: 2211514 - RNA, 20 nt, Human
gcauauuguacacuuuuuug

SEQ ID NO: 2211515 - RNA, 15 nt, Human
gcauauuguacacuu

SEQ ID NO: 2211516 - RNA, 16 nt, Human
gcauauuguacacuuu

SEQ ID NO: 2211517 - RNA, 17 nt, Human
gcauauuguacacuuuu

SEQ ID NO: 2211518 - RNA, 18 nt, Human
gcauauuguacacuuuuu

SEQ ID NO: 2211519 - RNA, 16 nt, Human
gcauauucuuauguau

SEQ ID NO: 2211520 - RNA, 19 nt, Human
gcauauugcuuuuucuaau

SEQ ID NO: 2211521 - RNA, 12 nt, Human
gcauauuguaca

SEQ ID NO: 2211522 - RNA, 21 nt, Human
gcagugugcacuaaggggccc

SEQ ID NO: 2211523 - RNA, 21 nt, Human
gcaguguuccccaucuggguc

SEQ ID NO: 2211524 - RNA, 20 nt, Human
gcaguguuccccaucugggu

SEQ ID NO: 2211525 - RNA, 15 nt, Human
gcagugggccuggcc

SEQ ID NO: 2211526 - RNA, 19 nt, Human
gcagugugaggccagggca

SEQ ID NO: 2211527 - RNA, 20 nt, Human
gcagugugcacuaaggggcc

SEQ ID NO: 2211528 - RNA, 21 nt, Human
gcagugugaggccagggcaga

SEQ ID NO: 2211529 - RNA, 17 nt, Human
gcagugggagcugccug

SEQ ID NO: 2211530 - RNA, 18 nt, Human
gcagugggagcugccugu

SEQ ID NO: 2211531 - RNA, 14 nt, Human
gcaguuauagaaaa

SEQ ID NO: 2211532 - RNA, 18 nt, Human
gcaguuacaugcauacuu

SEQ ID NO: 2211533 - RNA, 21 nt, Human
gcaguuacaugcauacuucaa

SEQ ID NO: 2211534 - RNA, 13 nt, Human
gcaguuacaugca

SEQ ID NO: 2211535 - RNA, 14 nt, Human
gcaguguuuccuuu

SEQ ID NO: 2211536 - RNA, 21 nt, Human
gcaguguuccuauuuggggcu

SEQ ID NO: 2211537 - RNA, 15 nt, Human
gcaguguuuccuuuu

SEQ ID NO: 2211538 - RNA, 23 nt, Human
gcaguuccggauuggcuugugug

SEQ ID NO: 2211539 - RNA, 21 nt, Human
gcaguuccggauuggcuugug

SEQ ID NO: 2211540 - RNA, 16 nt, Human
gcauagcaagacacau

SEQ ID NO: 2211541 - RNA, 21 nt, Human
gcaguucuaguuugcauuccu

SEQ ID NO: 2211542 - RNA, 14 nt, Human
gcauagcaaacaga

SEQ ID NO: 2211543 - RNA, 16 nt, Human
gcaguucuaguuugca

SEQ ID NO: 2211544 - RNA, 18 nt, Human
gcauagauucccugagca

SEQ ID NO: 2211545 - RNA, 13 nt, Human
gcaguucugaaga

SEQ ID NO: 2211546 - RNA, 14 nt, Human
gcaguucugaagaa

SEQ ID NO: 2211547 - RNA, 16 nt, Human
gcauaggccugggugc

SEQ ID NO: 2211548 - RNA, 12 nt, Human
gcauaggccugg

SEQ ID NO: 2211549 - RNA, 22 nt, Human
gcauagcccagacacagaagag

SEQ ID NO: 2211550 - RNA, 19 nt, Human
gcauaggaccuuuccacca

SEQ ID NO: 2211551 - RNA, 22 nt, Human
gcauaggccugggugcuggcug

SEQ ID NO: 2211552 - RNA, 17 nt, Human
gcauaggccugggugcu

SEQ ID NO: 2211553 - RNA, 23 nt, Human
gcauaggccugggugcuggcugc

SEQ ID NO: 2211554 - RNA, 15 nt, Human
gcauauaacuuauau

SEQ ID NO: 2211555 - RNA, 23 nt, Human
gcauauaacuuauauuguaagaa

SEQ ID NO: 2211556 - RNA, 16 nt, Human
gcauauaacuuauauu

SEQ ID NO: 2211557 - RNA, 13 nt, Human
gcaggugccucca

SEQ ID NO: 2211558 - RNA, 14 nt, Human
gcaggugccuccag

SEQ ID NO: 2211559 - RNA, 15 nt, Human
gcaggugccuccagg

SEQ ID NO: 2211560 - RNA, 16 nt, Human
gcaggugccuccaggu

SEQ ID NO: 2211561 - RNA, 18 nt, Human
gcaggugccuccaggugu

SEQ ID NO: 2211562 - RNA, 21 nt, Human
gcaggugccuccaggugugca

SEQ ID NO: 2211563 - RNA, 14 nt, Human
gcaggugcugcuac

SEQ ID NO: 2211564 - RNA, 15 nt, Human
gcaggugcugcuacc

SEQ ID NO: 2211565 - RNA, 23 nt, Human
gcagggguggggguggaggcuuc

SEQ ID NO: 2211566 - RNA, 23 nt, Human
gcagguccccagacuccaccaag

SEQ ID NO: 2211567 - RNA, 12 nt, Human
gcaggucccuaa

SEQ ID NO: 2211568 - RNA, 13 nt, Human
gcaggucccuaau

SEQ ID NO: 2211569 - RNA, 10 nt, Human
gcaggucccu

SEQ ID NO: 2211570 - RNA, 11 nt, Human
gcaggucccua

SEQ ID NO: 2211571 - RNA, 22 nt, Human
gcagggguggcugccucauuua

SEQ ID NO: 2211572 - RNA, 17 nt, Human
gcaggggugggggugga

SEQ ID NO: 2211573 - RNA, 18 nt, Human
gcagggguggcugccuca

SEQ ID NO: 2211574 - RNA, 19 nt, Human
gcagggguccuugguguga

SEQ ID NO: 2211575 - RNA, 20 nt, Human
gcagggguggggguggaggc

SEQ ID NO: 2211576 - RNA, 21 nt, Human
gcagggguggggguggaggcu

SEQ ID NO: 2211577 - RNA, 15 nt, Human
gcagggguugcagug

SEQ ID NO: 2211578 - RNA, 14 nt, Human
gcagguccccagac

SEQ ID NO: 2211579 - RNA, 20 nt, Human
gcaggggcuuguugcaggcu

SEQ ID NO: 2211580 - RNA, 16 nt, Human
gcaggugggagcuuga

SEQ ID NO: 2211581 - RNA, 17 nt, Human
gcagguggggagacugg

SEQ ID NO: 2211582 - RNA, 13 nt, Human
gcagguggggagg

SEQ ID NO: 2211583 - RNA, 21 nt, Human
gcagguggggagacugggcug

SEQ ID NO: 2211584 - RNA, 22 nt, Human
gcagugcgcgugcacguggaga

SEQ ID NO: 2211585 - RNA, 16 nt, Human
gcagugccuuccauaa

SEQ ID NO: 2211586 - RNA, 22 nt, Human
gcagugccuuccauaauuauga

SEQ ID NO: 2211587 - RNA, 15 nt, Human
gcagugccuugggga

SEQ ID NO: 2211588 - RNA, 15 nt, Human
gcaggugcugcugcg

SEQ ID NO: 2211589 - RNA, 20 nt, Human
gcaggugcugcuacccuccc

SEQ ID NO: 2211590 - RNA, 21 nt, Human
gcaggugcugcuacccucccu

SEQ ID NO: 2211591 - RNA, 22 nt, Human
gcaggugcugcuacccucccug

SEQ ID NO: 2211592 - RNA, 23 nt, Human
gcaggugcugcuacccucccugc

SEQ ID NO: 2211593 - RNA, 17 nt, Human
gcagguggcaucucuaa

SEQ ID NO: 2211594 - RNA, 23 nt, Human
gcagugcuuccaaggauggacca

SEQ ID NO: 2211595 - RNA, 17 nt, Human
gcagugcucgcuguugc

SEQ ID NO: 2211596 - RNA, 18 nt, Human
gcagugcucgcuguugcu

SEQ ID NO: 2211597 - RNA, 19 nt, Human
gcagugcucgcuguugcug

SEQ ID NO: 2211598 - RNA, 21 nt, Human
gcagugcucgcuguugcugaa

SEQ ID NO: 2211599 - RNA, 16 nt, Human
gcagugcuucucuaca

SEQ ID NO: 2211600 - RNA, 23 nt, Human
gcagugccuuggggaauuuccuc

SEQ ID NO: 2211601 - RNA, 15 nt, Human
gcagugcuucucaaa

SEQ ID NO: 2211602 - RNA, 16 nt, Human
gcagugggagcugccu

SEQ ID NO: 2211603 - RNA, 16 nt, Human
gcaggauggccuggcc

SEQ ID NO: 2211604 - RNA, 24 nt, Human
gcaggauggccuggccagggccug

SEQ ID NO: 2211605 - RNA, 19 nt, Human
gcaggauugauuaugcaga

SEQ ID NO: 2211606 - RNA, 21 nt, Human
gcaggauugauuaugcagaau

SEQ ID NO: 2211607 - RNA, 12 nt, Human
gcaggcacagca

SEQ ID NO: 2211608 - RNA, 13 nt, Human
gcaggcacagcac

SEQ ID NO: 2211609 - RNA, 19 nt, Human
gcaggcguucagcucacug

SEQ ID NO: 2211610 - RNA, 17 nt, Human
gcaggcuaaggcgugga

SEQ ID NO: 2211611 - RNA, 22 nt, Human
gcaggauaguugcuccgccucu

SEQ ID NO: 2211612 - RNA, 21 nt, Human
gcaggauaguugcuccgccuc

SEQ ID NO: 2211613 - RNA, 20 nt, Human
gcaggauucuuccucccucc

SEQ ID NO: 2211614 - RNA, 17 nt, Human
gcagggagggccugggc

SEQ ID NO: 2211615 - RNA, 14 nt, Human
gcagggagggccug

SEQ ID NO: 2211616 - RNA, 22 nt, Human
gcaggcucacugccaggccagc

SEQ ID NO: 2211617 - RNA, 23 nt, Human
gcaggcucacugccaggccagcc

SEQ ID NO: 2211618 - RNA, 17 nt, Human
gcaggcucacugccagg

SEQ ID NO: 2211619 - RNA, 18 nt, Human
gcaggcucacugccaggc

SEQ ID NO: 2211620 - RNA, 19 nt, Human
gcaggcucacugccaggcc

SEQ ID NO: 2211621 - RNA, 21 nt, Human
gcaggcucacugccaggccag

SEQ ID NO: 2211622 - RNA, 15 nt, Human
gcaggcuacugucag

SEQ ID NO: 2211623 - RNA, 20 nt, Human
gcaggcuaaggcguggagcu

SEQ ID NO: 2211624 - RNA, 21 nt, Human
gcaggcuaaggcguggagcug

SEQ ID NO: 2211625 - RNA, 22 nt, Human
gcaggcuaaggcguggagcugc

SEQ ID NO: 2211626 - RNA, 16 nt, Human
gcaggcuacacugaca

SEQ ID NO: 2211627 - RNA, 20 nt, Human
gcaggcuacacugacacugg

SEQ ID NO: 2211628 - RNA, 16 nt, Human
gcaggcuagaaccugg

SEQ ID NO: 2211629 - RNA, 14 nt, Human
gcaggcucacugcc

SEQ ID NO: 2211630 - RNA, 15 nt, Human
gcaggcucacugcca

SEQ ID NO: 2211631 - RNA, 21 nt, Human
gcagggccuugcccagagaug

SEQ ID NO: 2211632 - RNA, 19 nt, Human
gcagggccuugcccagaga

SEQ ID NO: 2211633 - RNA, 18 nt, Human
gcagggccuugcccagag

SEQ ID NO: 2211634 - RNA, 13 nt, Human
gcagggaggggac

SEQ ID NO: 2211635 - RNA, 16 nt, Human
gcagggccucacacgg

SEQ ID NO: 2211636 - RNA, 12 nt, Human
gcagggagggga

SEQ ID NO: 2211637 - RNA, 20 nt, Human
gcagggcuacccugagcuga

SEQ ID NO: 2211638 - RNA, 17 nt, Human
gcagggcuacccugagc

SEQ ID NO: 2211639 - RNA, 16 nt, Human
gcagggagggcuucug

SEQ ID NO: 2211640 - RNA, 22 nt, Human
gcagggagggccugggccccag

SEQ ID NO: 2211641 - RNA, 18 nt, Human
gcagggagggccugggcc

SEQ ID NO: 2211642 - RNA, 12 nt, Human
gcagggcucagc

SEQ ID NO: 2211643 - RNA, 22 nt, Human
gcagggcuacccugagcugagg

SEQ ID NO: 2211644 - RNA, 21 nt, Human
gcagggcuacccugagcugag

SEQ ID NO: 2211645 - RNA, 23 nt, Human
gcagggcuacccugagcugaggc

SEQ ID NO: 2211646 - RNA, 13 nt, Human
gcaggggcucugg

SEQ ID NO: 2211647 - RNA, 14 nt, Human
gcaggggcucugga

SEQ ID NO: 2211648 - RNA, 16 nt, Human
gcaggggcucuggaga

SEQ ID NO: 2211649 - RNA, 17 nt, Human
gcaggggcucuggagag

SEQ ID NO: 2211650 - RNA, 18 nt, Human
gcaggggcucuggagaga

SEQ ID NO: 2211651 - RNA, 21 nt, Human
gcaggggcucuggagagaaac

SEQ ID NO: 2211652 - RNA, 19 nt, Human
gcaggggcucuggagagaa

SEQ ID NO: 2211653 - RNA, 20 nt, Human
gcaggggcucuggagagaaa

SEQ ID NO: 2211654 - RNA, 22 nt, Human
gcaggggcucuggagagaaaca

SEQ ID NO: 2211655 - RNA, 13 nt, Human
gcacccacccugg

SEQ ID NO: 2211656 - RNA, 14 nt, Human
gcacccacccuggg

SEQ ID NO: 2211657 - RNA, 17 nt, Human
gcacccacccugggacc

SEQ ID NO: 2211658 - RNA, 18 nt, Human
gcacccaccguggaggag

SEQ ID NO: 2211659 - RNA, 19 nt, Human
gcacccaccguggaggagg

SEQ ID NO: 2211660 - RNA, 19 nt, Human
gcaccacugcacuccagcc

SEQ ID NO: 2211661 - RNA, 23 nt, Human
gcaccacccuagucccuuccccu

SEQ ID NO: 2211662 - RNA, 22 nt, Human
gcaccaccgagagaggcuggga

SEQ ID NO: 2211663 - RNA, 22 nt, Human
gcacauggaggagcuuggggga

SEQ ID NO: 2211664 - RNA, 22 nt, Human
gcacaugcugagucucccaagg

SEQ ID NO: 2211665 - RNA, 19 nt, Human
gcacaugcugagucuccca

SEQ ID NO: 2211666 - RNA, 20 nt, Human
gcacaugcugagucucccaa

SEQ ID NO: 2211667 - RNA, 13 nt, Human
gcacaugucuuaa

SEQ ID NO: 2211668 - RNA, 15 nt, Human
gcacaugucuuaaug

SEQ ID NO: 2211669 - RNA, 17 nt, Human
gcacaugucuuaaugaa

SEQ ID NO: 2211670 - RNA, 20 nt, Human
gcacaugucuuaaugaaguu

SEQ ID NO: 2211671 - RNA, 21 nt, Human
gcacaugucuuaaugaaguuu

SEQ ID NO: 2211672 - RNA, 22 nt, Human
gcacaugucuuaaugaaguuug

SEQ ID NO: 2211673 - RNA, 22 nt, Human
gcaccacccuagucccuucccc

SEQ ID NO: 2211674 - RNA, 20 nt, Human
gcaccacccuagucccuucc

SEQ ID NO: 2211675 - RNA, 11 nt, Human
gcaccacccua

SEQ ID NO: 2211676 - RNA, 21 nt, Human
gcacaugucuuguacaugugu

SEQ ID NO: 2211677 - RNA, 18 nt, Human
gcaccaccaagccaaggg

SEQ ID NO: 2211678 - RNA, 13 nt, Human
gcacaugucuugu

SEQ ID NO: 2211679 - RNA, 20 nt, Human
gcacaugucuuguacaugug

SEQ ID NO: 2211680 - RNA, 13 nt, Human
gcaccccaaggcu

SEQ ID NO: 2211681 - RNA, 20 nt, Human
gcaccccaaagcuuuccugc

SEQ ID NO: 2211682 - RNA, 17 nt, Human
gcaccccaaagcuuucc

SEQ ID NO: 2211683 - RNA, 14 nt, Human
gcacccggccccug

SEQ ID NO: 2211684 - RNA, 14 nt, Human
gcacccacucugcu

SEQ ID NO: 2211685 - RNA, 20 nt, Human
gcacccaccguggaggagga

SEQ ID NO: 2211686 - RNA, 11 nt, Human
gcacccagccc

SEQ ID NO: 2211687 - RNA, 12 nt, Human
gcacccagcccu

SEQ ID NO: 2211688 - RNA, 13 nt, Human
gcacccagcccug

SEQ ID NO: 2211689 - RNA, 14 nt, Human
gcacccagcccugg

SEQ ID NO: 2211690 - RNA, 15 nt, Human
gcacccagcccuggu

SEQ ID NO: 2211691 - RNA, 23 nt, Human
gcacccagugagcacucccaagu

SEQ ID NO: 2211692 - RNA, 19 nt, Human
gcacccagccucuagggac

SEQ ID NO: 2211693 - RNA, 21 nt, Human
gcacccagccucuagggaccc

SEQ ID NO: 2211694 - RNA, 17 nt, Human
gcacccagugagcacuc

SEQ ID NO: 2211695 - RNA, 21 nt, Human
gcacccagugagcacucccaa

SEQ ID NO: 2211696 - RNA, 15 nt, Human
gcacccggccccugc

SEQ ID NO: 2211697 - RNA, 17 nt, Human
gcacccggccccugcug

SEQ ID NO: 2211698 - RNA, 14 nt, Human
gcaccuccugccuc

SEQ ID NO: 2211699 - RNA, 15 nt, Human
gcaccuccugccucg

SEQ ID NO: 2211700 - RNA, 16 nt, Human
gcacagcuaugaaggc

SEQ ID NO: 2211701 - RNA, 21 nt, Human
gcacagcggggccccagggcu

SEQ ID NO: 2211702 - RNA, 16 nt, Human
gcaaugacaucuucaa

SEQ ID NO: 2211703 - RNA, 14 nt, Human
gcacagccuucucc

SEQ ID NO: 2211704 - RNA, 13 nt, Human
gcacagcuaugaa

SEQ ID NO: 2211705 - RNA, 19 nt, Human
gcacagcuaacauggaagu

SEQ ID NO: 2211706 - RNA, 13 nt, Human
gcaaugaccuuuc

SEQ ID NO: 2211707 - RNA, 14 nt, Human
gcaaugaccuuuca

SEQ ID NO: 2211708 - RNA, 20 nt, Human
gcacagccucuuagaugcag

SEQ ID NO: 2211709 - RNA, 19 nt, Human
gcaaugacagguaaauuaa

SEQ ID NO: 2211710 - RNA, 16 nt, Human
gcaaugacaucucagg

SEQ ID NO: 2211711 - RNA, 19 nt, Human
gcaaugacaucucaggggc

SEQ ID NO: 2211712 - RNA, 21 nt, Human
gcaaugacaucucaggggcca

SEQ ID NO: 2211713 - RNA, 12 nt, Human
gcacagcuggcc

SEQ ID NO: 2211714 - RNA, 14 nt, Human
gcacaggacaugcg

SEQ ID NO: 2211715 - RNA, 16 nt, Human
gcacagcuucauuucc

SEQ ID NO: 2211716 - RNA, 22 nt, Human
gcacaggacaugcgguagccag

SEQ ID NO: 2211717 - RNA, 21 nt, Human
gcacaggacaugcgguagcca

SEQ ID NO: 2211718 - RNA, 19 nt, Human
gcacaugccuguaguccca

SEQ ID NO: 2211719 - RNA, 23 nt, Human
gcacaugcugagucucccaaggc

SEQ ID NO: 2211720 - RNA, 12 nt, Human
gcacaggcagcu

SEQ ID NO: 2211721 - RNA, 14 nt, Human
gcacaggcagcugg

SEQ ID NO: 2211722 - RNA, 14 nt, Human
gcacaggcccccuu

SEQ ID NO: 2211723 - RNA, 14 nt, Human
gcacuaaggggccc

SEQ ID NO: 2211724 - RNA, 20 nt, Human
gcacuaacguugagccccug

SEQ ID NO: 2211725 - RNA, 18 nt, Human
gcacuaaggugugcucug

SEQ ID NO: 2211726 - RNA, 21 nt, Human
gcacuacucccucaaagcaca

SEQ ID NO: 2211727 - RNA, 23 nt, Human
gcacuaaggggcccggccagcca

SEQ ID NO: 2211728 - RNA, 21 nt, Human
gcacuaccacuccugccaagg

SEQ ID NO: 2211729 - RNA, 13 nt, Human
gcacuacuccucu

SEQ ID NO: 2211730 - RNA, 16 nt, Human
gcacuacuccucugca

SEQ ID NO: 2211731 - RNA, 17 nt, Human
gcacuacuccucugcag

SEQ ID NO: 2211732 - RNA, 19 nt, Human
gcacuacuccucugcagug

SEQ ID NO: 2211733 - RNA, 17 nt, Human
gcacuacugacaugugg

SEQ ID NO: 2211734 - RNA, 15 nt, Human
gcacuacucugugcc

SEQ ID NO: 2211735 - RNA, 17 nt, Human
gcacuacucugugccag

SEQ ID NO: 2211736 - RNA, 18 nt, Human
gcacuacugacauguggg

SEQ ID NO: 2211737 - RNA, 17 nt, Human
gcacugaggaccagcca

SEQ ID NO: 2211738 - RNA, 18 nt, Human
gcacugaggaagaacggg

SEQ ID NO: 2211739 - RNA, 11 nt, Human
gcacugagggc

SEQ ID NO: 2211740 - RNA, 12 nt, Human
gcacugagggcc

SEQ ID NO: 2211741 - RNA, 13 nt, Human
gcacugagggcca

SEQ ID NO: 2211742 - RNA, 24 nt, Human
gcacugagggccacacuauuacca

SEQ ID NO: 2211743 - RNA, 13 nt, Human
gcacugaugcugc

SEQ ID NO: 2211744 - RNA, 14 nt, Human
gcacugagggccac

SEQ ID NO: 2211745 - RNA, 15 nt, Human
gcacugagggccaca

SEQ ID NO: 2211746 - RNA, 16 nt, Human
gcacugagggccacac

SEQ ID NO: 2211747 - RNA, 20 nt, Human
gcacugagggccacacuauu

SEQ ID NO: 2211748 - RNA, 13 nt, Human
gcacuagccuuug

SEQ ID NO: 2211749 - RNA, 15 nt, Human
gcacuagccuuuggc

SEQ ID NO: 2211750 - RNA, 16 nt, Human
gcacuagccuuuggcu

SEQ ID NO: 2211751 - RNA, 18 nt, Human
gcacuagccuuuggcucu

SEQ ID NO: 2211752 - RNA, 20 nt, Human
gcacuagccuuuggcucugg

SEQ ID NO: 2211753 - RNA, 22 nt, Human
gcacuagccuuuggcucuggag

SEQ ID NO: 2211754 - RNA, 21 nt, Human
gcacuagccuuuggcucugga

SEQ ID NO: 2211755 - RNA, 21 nt, Human
gcacuaggggauauaggagag

SEQ ID NO: 2211756 - RNA, 22 nt, Human
gcaccugcccccugguggacag

SEQ ID NO: 2211757 - RNA, 19 nt, Human
gcaccugccgaccucgucc

SEQ ID NO: 2211758 - RNA, 21 nt, Human
gcaccugccgaccucguccuc

SEQ ID NO: 2211759 - RNA, 23 nt, Human
gcaccugcauccguaguucccug

SEQ ID NO: 2211760 - RNA, 12 nt, Human
gcaccugccuca

SEQ ID NO: 2211761 - RNA, 16 nt, Human
gcaccugccucaggac

SEQ ID NO: 2211762 - RNA, 15 nt, Human
gcaccugccucagga

SEQ ID NO: 2211763 - RNA, 14 nt, Human
gcaccugccucagg

SEQ ID NO: 2211764 - RNA, 13 nt, Human
gcaccugccucag

SEQ ID NO: 2211765 - RNA, 17 nt, Human
gcacuaaggugugcucu

SEQ ID NO: 2211766 - RNA, 19 nt, Human
gcacuaacguugagccccu

SEQ ID NO: 2211767 - RNA, 15 nt, Human
gcaccugcucucuug

SEQ ID NO: 2211768 - RNA, 20 nt, Human
gcaccugcuucaugcucagc

SEQ ID NO: 2211769 - RNA, 18 nt, Human
gcaccugcccccuggugg

SEQ ID NO: 2211770 - RNA, 17 nt, Human
gcaccugcccccuggug

SEQ ID NO: 2211771 - RNA, 16 nt, Human
gcaccugcccccuggu

SEQ ID NO: 2211772 - RNA, 15 nt, Human
gcaccugcccccugg

SEQ ID NO: 2211773 - RNA, 22 nt, Human
gcaccugccagccuggcuucug

SEQ ID NO: 2211774 - RNA, 17 nt, Human
gcaccugccagccuggc

SEQ ID NO: 2211775 - RNA, 16 nt, Human
gcaccugccagccugg

SEQ ID NO: 2211776 - RNA, 15 nt, Human
gcaccugccagccug

SEQ ID NO: 2211777 - RNA, 14 nt, Human
gcaccugccagccu

SEQ ID NO: 2211778 - RNA, 13 nt, Human
gcaccugccagcc

SEQ ID NO: 2211779 - RNA, 22 nt, Human
gcaccugcauccguaguucccu

SEQ ID NO: 2211780 - RNA, 21 nt, Human
gcaccugcagguugggccaua

SEQ ID NO: 2211781 - RNA, 15 nt, Human
gcaccugcagguugg

SEQ ID NO: 2211782 - RNA, 20 nt, Human
gcaccugcagguugggccau

SEQ ID NO: 2211783 - RNA, 21 nt, Human
gcaccugauggaaaagauaua

SEQ ID NO: 2211784 - RNA, 19 nt, Human
gcaccucugaccuaucacu

SEQ ID NO: 2211785 - RNA, 23 nt, Human
gcagaagaauugaacccaggagg

SEQ ID NO: 2211786 - RNA, 14 nt, Human
gcagaagacaccag

SEQ ID NO: 2211787 - RNA, 15 nt, Human
gcagaagacaccaga

SEQ ID NO: 2211788 - RNA, 21 nt, Human
gcagaagaauugaacccagga

SEQ ID NO: 2211789 - RNA, 22 nt, Human
gcagaagaaugggaauauuuua

SEQ ID NO: 2211790 - RNA, 14 nt, Human
gcagaagacaguau

SEQ ID NO: 2211791 - RNA, 20 nt, Human
gcacuguccugcuccacagu

SEQ ID NO: 2211792 - RNA, 18 nt, Human
gcacuguccugcuccaca

SEQ ID NO: 2211793 - RNA, 19 nt, Human
gcacuguccugcuccacag

SEQ ID NO: 2211794 - RNA, 14 nt, Human
gcacuguccugcuc

SEQ ID NO: 2211795 - RNA, 15 nt, Human
gcacuguccugcucc

SEQ ID NO: 2211796 - RNA, 16 nt, Human
gcacuguccugcucca

SEQ ID NO: 2211797 - RNA, 17 nt, Human
gcacuguccugcuccac

SEQ ID NO: 2211798 - RNA, 17 nt, Human
gcacugucccuugccuc

SEQ ID NO: 2211799 - RNA, 18 nt, Human
gcacugucccuugccuca

SEQ ID NO: 2211800 - RNA, 23 nt, Human
gcacugucccuugccucaaugcc

SEQ ID NO: 2211801 - RNA, 21 nt, Human
gcacugucacuuugcucuggg

SEQ ID NO: 2211802 - RNA, 12 nt, Human
gcacuguccugc

SEQ ID NO: 2211803 - RNA, 12 nt, Human
gcagaaggaaga

SEQ ID NO: 2211804 - RNA, 13 nt, Human
gcagaagcauuaa

SEQ ID NO: 2211805 - RNA, 16 nt, Human
gcagaagacaccagag

SEQ ID NO: 2211806 - RNA, 18 nt, Human
gcagaagacaccagagca

SEQ ID NO: 2211807 - RNA, 20 nt, Human
gcagaagacaccagagcaga

SEQ ID NO: 2211808 - RNA, 21 nt, Human
gcagaagacaccagagcagau

SEQ ID NO: 2211809 - RNA, 13 nt, Human
gcagaaggaagac

SEQ ID NO: 2211810 - RNA, 14 nt, Human
gcagaaggaagacu

SEQ ID NO: 2211811 - RNA, 16 nt, Human
gcacuguaugcuggac

SEQ ID NO: 2211812 - RNA, 15 nt, Human
gcacuguaugcugga

SEQ ID NO: 2211813 - RNA, 16 nt, Human
gcacugucacuuugcu

SEQ ID NO: 2211814 - RNA, 18 nt, Human
gcacugucacuuugcucu

SEQ ID NO: 2211815 - RNA, 20 nt, Human
gcacugucacuuugcucugg

SEQ ID NO: 2211816 - RNA, 15 nt, Human
gcacugucaagauga

SEQ ID NO: 2211817 - RNA, 15 nt, Human
gcacuggggagcccg

SEQ ID NO: 2211818 - RNA, 19 nt, Human
gcacugauuucacaacaga

SEQ ID NO: 2211819 - RNA, 20 nt, Human
gcacugauuucacaacagau

SEQ ID NO: 2211820 - RNA, 18 nt, Human
gcacuggggagcccgucu

SEQ ID NO: 2211821 - RNA, 19 nt, Human
gcacuggggagcccgucuc

SEQ ID NO: 2211822 - RNA, 22 nt, Human
gcacuggggagcccgucucagu

SEQ ID NO: 2211823 - RNA, 23 nt, Human
gcacuggggagcccgucucagug

SEQ ID NO: 2211824 - RNA, 13 nt, Human
gcacugcaggggc

SEQ ID NO: 2211825 - RNA, 22 nt, Human
gcacugggcuuggggaccagag

SEQ ID NO: 2211826 - RNA, 23 nt, Human
gcacugggcuuggggaccagagc

SEQ ID NO: 2211827 - RNA, 14 nt, Human
gcacugggcuuggg

SEQ ID NO: 2211828 - RNA, 15 nt, Human
gcacugauuucacaa

SEQ ID NO: 2211829 - RNA, 12 nt, Human
gcacugauuuca

SEQ ID NO: 2211830 - RNA, 19 nt, Human
gcacugaugcugccccuca

SEQ ID NO: 2211831 - RNA, 18 nt, Human
gcacugaugcugccccuc

SEQ ID NO: 2211832 - RNA, 22 nt, Human
gcacugaugcugccccucaucu

SEQ ID NO: 2211833 - RNA, 14 nt, Human
gcacugauauuuua

SEQ ID NO: 2211834 - RNA, 20 nt, Human
gcagcaggugcugcuacccu

SEQ ID NO: 2211835 - RNA, 22 nt, Human
gcagcaggugcugcuacccucc

SEQ ID NO: 2211836 - RNA, 14 nt, Human
gcagccgugccuuc

SEQ ID NO: 2211837 - RNA, 15 nt, Human
gcagccgugccuuca

SEQ ID NO: 2211838 - RNA, 17 nt, Human
gcagccgugccuucagc

SEQ ID NO: 2211839 - RNA, 19 nt, Human
gcagccucaaccuccuggg

SEQ ID NO: 2211840 - RNA, 20 nt, Human
gcagccucaaccuccugggc

SEQ ID NO: 2211841 - RNA, 20 nt, Human
gcagcagggcuacccugagc

SEQ ID NO: 2211842 - RNA, 19 nt, Human
gcagcagggcuacccugag

SEQ ID NO: 2211843 - RNA, 12 nt, Human
gcagcaggugcu

SEQ ID NO: 2211844 - RNA, 13 nt, Human
gcagcaggugcug

SEQ ID NO: 2211845 - RNA, 14 nt, Human
gcagcaggugcugc

SEQ ID NO: 2211846 - RNA, 15 nt, Human
gcagcaggugcugcu

SEQ ID NO: 2211847 - RNA, 16 nt, Human
gcagcaggugcugcua

SEQ ID NO: 2211848 - RNA, 17 nt, Human
gcagcaggugcugcuac

SEQ ID NO: 2211849 - RNA, 18 nt, Human
gcagcaggugcugcuacc

SEQ ID NO: 2211850 - RNA, 19 nt, Human
gcagcaggugcugcuaccc

SEQ ID NO: 2211851 - RNA, 12 nt, Human
gcagcagaaggg

SEQ ID NO: 2211852 - RNA, 19 nt, Human
gcagcacucacacaggacc

SEQ ID NO: 2211853 - RNA, 20 nt, Human
gcagcagggaugcccuggag

SEQ ID NO: 2211854 - RNA, 19 nt, Human
gcagcagggaugcccugga

SEQ ID NO: 2211855 - RNA, 17 nt, Human
gcagcagggaugcccug

SEQ ID NO: 2211856 - RNA, 15 nt, Human
gcagcagggaugccc

SEQ ID NO: 2211857 - RNA, 17 nt, Human
gcagcagggcuacccug

SEQ ID NO: 2211858 - RNA, 12 nt, Human
gcagcagggcua

SEQ ID NO: 2211859 - RNA, 18 nt, Human
gcagccgugccuucagcu

SEQ ID NO: 2211860 - RNA, 22 nt, Human
gcagccguuugagaagaaaaca

SEQ ID NO: 2211861 - RNA, 18 nt, Human
gcagccguuugagaagaa

SEQ ID NO: 2211862 - RNA, 21 nt, Human
gcagccucaaccuccugggcu

SEQ ID NO: 2211863 - RNA, 22 nt, Human
gcagccucaaccuccugggcua

SEQ ID NO: 2211864 - RNA, 13 nt, Human
gcagccuggaggc

SEQ ID NO: 2211865 - RNA, 12 nt, Human
gcagccuggagg

SEQ ID NO: 2211866 - RNA, 14 nt, Human
gcagcgaccacccc

SEQ ID NO: 2211867 - RNA, 15 nt, Human
gcagcgaccaccccu

SEQ ID NO: 2211868 - RNA, 16 nt, Human
gcagcgaccaccccug

SEQ ID NO: 2211869 - RNA, 14 nt, Human
gcagcgaccgcccc

SEQ ID NO: 2211870 - RNA, 20 nt, Human
gcagcgaccaccccugccuc

SEQ ID NO: 2211871 - RNA, 22 nt, Human
gcagcgaccaccccugccucca

SEQ ID NO: 2211872 - RNA, 18 nt, Human
gcagccuggacauagaga

SEQ ID NO: 2211873 - RNA, 23 nt, Human
gcagccugcgccaccgcccagag

SEQ ID NO: 2211874 - RNA, 14 nt, Human
gcagccuggacccu

SEQ ID NO: 2211875 - RNA, 21 nt, Human
gcaggagauugagaaggagag

SEQ ID NO: 2211876 - RNA, 22 nt, Human
gcaggagauugagaaggagaga

SEQ ID NO: 2211877 - RNA, 14 nt, Human
gcaggagccugagc

SEQ ID NO: 2211878 - RNA, 22 nt, Human
gcaggagcaguaucaugaagcc

SEQ ID NO: 2211879 - RNA, 17 nt, Human
gcaggagcaguaucaug

SEQ ID NO: 2211880 - RNA, 13 nt, Human
gcaggagcaguau

SEQ ID NO: 2211881 - RNA, 23 nt, Human
gcaggagauugagaaggagagaa

SEQ ID NO: 2211882 - RNA, 13 nt, Human
gcaggaggaggug

SEQ ID NO: 2211883 - RNA, 11 nt, Human
gcaggaggaag

SEQ ID NO: 2211884 - RNA, 14 nt, Human
gcaggaggaggugc

SEQ ID NO: 2211885 - RNA, 15 nt, Human
gcaggaggaggugcc

SEQ ID NO: 2211886 - RNA, 22 nt, Human
gcaggagggcccuaccugauug

SEQ ID NO: 2211887 - RNA, 18 nt, Human
gcaggagggcccuaccug

SEQ ID NO: 2211888 - RNA, 20 nt, Human
gcaggaggaggugccaacag

SEQ ID NO: 2211889 - RNA, 20 nt, Human
gcaggaguuucguuuucaaa

SEQ ID NO: 2211890 - RNA, 21 nt, Human
gcaggaguuucguuuucaaaa

SEQ ID NO: 2211891 - RNA, 24 nt, Human
gcagcgaguuguggaaagccucug

SEQ ID NO: 2211892 - RNA, 15 nt, Human
gcagcgccaagcaac

SEQ ID NO: 2211893 - RNA, 22 nt, Human
gcagcgagcuaugaucgcgcca

SEQ ID NO: 2211894 - RNA, 16 nt, Human
gcagcgaccgcccccu

SEQ ID NO: 2211895 - RNA, 17 nt, Human
gcagcgaccgcccccuc

SEQ ID NO: 2211896 - RNA, 18 nt, Human
gcagcgaccgcccccucc

SEQ ID NO: 2211897 - RNA, 22 nt, Human
gcagcgaccgcccccuccucua

SEQ ID NO: 2211898 - RNA, 19 nt, Human
gcagcgcccuuccucucca

SEQ ID NO: 2211899 - RNA, 21 nt, Human
gcagcgcccuuccucuccacc

SEQ ID NO: 2211900 - RNA, 14 nt, Human
gcagcgccaggcug

SEQ ID NO: 2211901 - RNA, 16 nt, Human
gcagcgcccuuccucu

SEQ ID NO: 2211902 - RNA, 18 nt, Human
gcagcgcccuuccucucc

SEQ ID NO: 2211903 - RNA, 13 nt, Human
gcagcgccaggcu

SEQ ID NO: 2211904 - RNA, 18 nt, Human
gcagcgccaagcaaccug

SEQ ID NO: 2211905 - RNA, 20 nt, Human
gcagcgccaagcaaccuggg

SEQ ID NO: 2211906 - RNA, 23 nt, Human
gcaggaccucagaguccaggccc

SEQ ID NO: 2211907 - RNA, 22 nt, Human
gcaggaccucagaguccaggcc

SEQ ID NO: 2211908 - RNA, 16 nt, Human
gcaggaccucagaguc

SEQ ID NO: 2211909 - RNA, 12 nt, Human
gcaggaccucug

SEQ ID NO: 2211910 - RNA, 15 nt, Human
gcaggaccucagagu

SEQ ID NO: 2211911 - RNA, 14 nt, Human
gcaggaccucagag

SEQ ID NO: 2211912 - RNA, 11 nt, Human
gcaggaccuca

SEQ ID NO: 2211913 - RNA, 15 nt, Human
gcaggaccaggacua

SEQ ID NO: 2211914 - RNA, 12 nt, Human
gcaggaccagga

SEQ ID NO: 2211915 - RNA, 13 nt, Human
gcaggaccaggac

SEQ ID NO: 2211916 - RNA, 14 nt, Human
gcaggaccaggacu

SEQ ID NO: 2211917 - RNA, 20 nt, Human
gcaggaccuucgggcugugc

SEQ ID NO: 2211918 - RNA, 20 nt, Human
gcaggaccugccuguagccc

SEQ ID NO: 2211919 - RNA, 18 nt, Human
gcaggagauugagaagga

SEQ ID NO: 2211920 - RNA, 19 nt, Human
gcaggagauugagaaggag

SEQ ID NO: 2211921 - RNA, 16 nt, Human
gcaggaccugccugua

SEQ ID NO: 2211922 - RNA, 15 nt, Human
gcaggaccugccugu

SEQ ID NO: 2211923 - RNA, 14 nt, Human
gcaggaccugccug

SEQ ID NO: 2211924 - RNA, 20 nt, Human
gcaggaccucugaaacccug

SEQ ID NO: 2211925 - RNA, 12 nt, Human
gcagcaauaaag

SEQ ID NO: 2211926 - RNA, 12 nt, Human
gcagcacagcaa

SEQ ID NO: 2211927 - RNA, 22 nt, Human
gcagcacagcaaggaggcuggc

SEQ ID NO: 2211928 - RNA, 18 nt, Human
gcagcaccguucugugca

SEQ ID NO: 2211929 - RNA, 17 nt, Human
gcagcaccguucugugc

SEQ ID NO: 2211930 - RNA, 19 nt, Human
gcagcaccguucugugcac

SEQ ID NO: 2211931 - RNA, 16 nt, Human
gcagcacucacacagg

SEQ ID NO: 2211932 - RNA, 18 nt, Human
gcagcacucacacaggac

SEQ ID NO: 2211933 - RNA, 15 nt, Human
gcagaugcuggucau

SEQ ID NO: 2211934 - RNA, 18 nt, Human
gcagauggaaugcugugu

SEQ ID NO: 2211935 - RNA, 19 nt, Human
gcagauuuugcccuugaca

SEQ ID NO: 2211936 - RNA, 22 nt, Human
gcagauggaaugcuguguuaaa

SEQ ID NO: 2211937 - RNA, 19 nt, Human
gcagaugcaaugacucagg

SEQ ID NO: 2211938 - RNA, 15 nt, Human
gcagaugcagagagc

SEQ ID NO: 2211939 - RNA, 17 nt, Human
gcagaugcagagagcca

SEQ ID NO: 2211940 - RNA, 13 nt, Human
gcagaugcaauga

SEQ ID NO: 2211941 - RNA, 22 nt, Human
gcagaugcaaagaggcaagagg

SEQ ID NO: 2211942 - RNA, 19 nt, Human
gcagaugcaaagaggcaag

SEQ ID NO: 2211943 - RNA, 18 nt, Human
gcagaugcagagagccau

SEQ ID NO: 2211944 - RNA, 18 nt, Human
gcagaugcaaagaggcaa

SEQ ID NO: 2211945 - RNA, 19 nt, Human
gcagaguugaagacagagc

SEQ ID NO: 2211946 - RNA, 16 nt, Human
gcagaguugaagacag

SEQ ID NO: 2211947 - RNA, 17 nt, Human
gcagaguugaagacaga

SEQ ID NO: 2211948 - RNA, 15 nt, Human
gcagagacagagagg

SEQ ID NO: 2211949 - RNA, 17 nt, Human
gcagagacaggaccuga

SEQ ID NO: 2211950 - RNA, 17 nt, Human
gcagagaccaucccuga

SEQ ID NO: 2211951 - RNA, 14 nt, Human
gcagagaccauccc

SEQ ID NO: 2211952 - RNA, 15 nt, Human
gcagagaccaucccu

SEQ ID NO: 2211953 - RNA, 12 nt, Human
gcagagucagca

SEQ ID NO: 2211954 - RNA, 23 nt, Human
gcagagucacacgggggcagcug

SEQ ID NO: 2211955 - RNA, 13 nt, Human
gcagagucacacg

SEQ ID NO: 2211956 - RNA, 14 nt, Human
gcagagucacacgg

SEQ ID NO: 2211957 - RNA, 14 nt, Human
gcagagucagcaga

SEQ ID NO: 2211958 - RNA, 13 nt, Human
gcagagucagcag

SEQ ID NO: 2211959 - RNA, 15 nt, Human
gcagagucuugcuac

SEQ ID NO: 2211960 - RNA, 22 nt, Human
gcagaguccugcacaguuuucu

SEQ ID NO: 2211961 - RNA, 15 nt, Human
gcagaguugaagaca

SEQ ID NO: 2211962 - RNA, 23 nt, Human
gcagagucuugcuaccucaguca

SEQ ID NO: 2211963 - RNA, 13 nt, Human
gcagaaggaaaaa

SEQ ID NO: 2211964 - RNA, 18 nt, Human
gcagaaggaagacuucau

SEQ ID NO: 2211965 - RNA, 19 nt, Human
gcagagaaugaaagggccc

SEQ ID NO: 2211966 - RNA, 20 nt, Human
gcagagaaugaaagggccca

SEQ ID NO: 2211967 - RNA, 21 nt, Human
gcagagaaugaaagggcccag

SEQ ID NO: 2211968 - RNA, 21 nt, Human
gcagagaauucucuuauccaa

SEQ ID NO: 2211969 - RNA, 13 nt, Human
gcagagacacuaa

SEQ ID NO: 2211970 - RNA, 20 nt, Human
gcagagaaucauacuuagca

SEQ ID NO: 2211971 - RNA, 21 nt, Human
gcagaaggaaaaauguguaau

SEQ ID NO: 2211972 - RNA, 15 nt, Human
gcagaaggaaaaaug

SEQ ID NO: 2211973 - RNA, 20 nt, Human
gcagaaggaaaaauguguaa

SEQ ID NO: 2211974 - RNA, 22 nt, Human
gcagagaaugaaagggcccaga

SEQ ID NO: 2211975 - RNA, 23 nt, Human
gcagagaaugaaagggcccagag

SEQ ID NO: 2211976 - RNA, 17 nt, Human
gauuuuaacaauaacua

SEQ ID NO: 2211977 - RNA, 23 nt, Human
gauuuuaacaauaacuacugugu

SEQ ID NO: 2211978 - RNA, 19 nt, Human
gcaaacccaucaacaaaaa

SEQ ID NO: 2211979 - RNA, 18 nt, Human
gcaaacccccuuugugcu

SEQ ID NO: 2211980 - RNA, 22 nt, Human
gcaaacccccuuugugcugugg

SEQ ID NO: 2211981 - RNA, 14 nt, Human
gcaaacgcuaaaga

SEQ ID NO: 2211982 - RNA, 21 nt, Human
gcaaaccugaccccugcucag

SEQ ID NO: 2211983 - RNA, 19 nt, Human
gcaaaccugaccccugcuc

SEQ ID NO: 2211984 - RNA, 18 nt, Human
gcaaacgcugccugcccg

SEQ ID NO: 2211985 - RNA, 16 nt, Human
gcaaacgcugccugcc

SEQ ID NO: 2211986 - RNA, 15 nt, Human
gcaaacgcugccugc

SEQ ID NO: 2211987 - RNA, 14 nt, Human
gcaaacgcugccug

SEQ ID NO: 2211988 - RNA, 18 nt, Human
gcaaacuuuauuuugugu

SEQ ID NO: 2211989 - RNA, 17 nt, Human
gcaaacucacugcucaa

SEQ ID NO: 2211990 - RNA, 17 nt, Human
gcaaacgcugccugccg

SEQ ID NO: 2211991 - RNA, 19 nt, Human
gcaaacuaagcccccgcug

SEQ ID NO: 2211992 - RNA, 19 nt, Human
gcaaacucacugcucaaga

SEQ ID NO: 2211993 - RNA, 13 nt, Human
gcaaacucugcug

SEQ ID NO: 2211994 - RNA, 14 nt, Human
gcaaacucugcugu

SEQ ID NO: 2211995 - RNA, 15 nt, Human
gauuuuaacaauaac

SEQ ID NO: 2211996 - RNA, 14 nt, Human
gauuuuaacaauaa

SEQ ID NO: 2211997 - RNA, 12 nt, Human
gauuuuaacaau

SEQ ID NO: 2211998 - RNA, 20 nt, Human
gauuuuaacaaaagcaagac

SEQ ID NO: 2211999 - RNA, 21 nt, Human
gauuuuaaauucacaauagaa

SEQ ID NO: 2212000 - RNA, 16 nt, Human
gcaaaccaucauugaa

SEQ ID NO: 2212001 - RNA, 22 nt, Human
gauuuuaaagagugaaaaauga

SEQ ID NO: 2212002 - RNA, 23 nt, Human
gauuuuaaaccauaaaaagcuga

SEQ ID NO: 2212003 - RNA, 19 nt, Human
gauuuguuuuuguauuuuu

SEQ ID NO: 2212004 - RNA, 17 nt, Human
gcaaaccaucauugaaa

SEQ ID NO: 2212005 - RNA, 19 nt, Human
gcaaaccaucauugaaauc

SEQ ID NO: 2212006 - RNA, 20 nt, Human
gcaaaccaucauugaaaucu

SEQ ID NO: 2212007 - RNA, 21 nt, Human
gcaaaccaucauugaaaucuu

SEQ ID NO: 2212008 - RNA, 17 nt, Human
gcaaagugagggccgag

SEQ ID NO: 2212009 - RNA, 20 nt, Human
gcaaagugaagacacuggcu

SEQ ID NO: 2212010 - RNA, 22 nt, Human
gcaaagucuaaaguuuacagua

SEQ ID NO: 2212011 - RNA, 16 nt, Human
gcaaagucuaaaguuu

SEQ ID NO: 2212012 - RNA, 21 nt, Human
gcaaagucuaaaguuuacagu

SEQ ID NO: 2212013 - RNA, 14 nt, Human
gcaaagaggcaaga

SEQ ID NO: 2212014 - RNA, 21 nt, Human
gcaaagucaugcaaaggcugg

SEQ ID NO: 2212015 - RNA, 16 nt, Human
gcaaagucaugcaaag

SEQ ID NO: 2212016 - RNA, 22 nt, Human
gcaaagucaugcaaaggcuggg

SEQ ID NO: 2212017 - RNA, 23 nt, Human
gcaaagucaugcaaaggcuggga

SEQ ID NO: 2212018 - RNA, 14 nt, Human
gcaaagucuaaagu

SEQ ID NO: 2212019 - RNA, 15 nt, Human
gcaaagucuaaaguu

SEQ ID NO: 2212020 - RNA, 22 nt, Human
gcaaauaauuuccuggugugaa

SEQ ID NO: 2212021 - RNA, 19 nt, Human
gcaaauaauuuccuggugu

SEQ ID NO: 2212022 - RNA, 23 nt, Human
gcaaaguucccuacuuccuguga

SEQ ID NO: 2212023 - RNA, 12 nt, Human
gcaaauaaaagu

SEQ ID NO: 2212024 - RNA, 22 nt, Human
gcaaagacuauucccuucuaac

SEQ ID NO: 2212025 - RNA, 13 nt, Human
gcaaagaggcaag

SEQ ID NO: 2212026 - RNA, 20 nt, Human
gcaaagagccagcacccuga

SEQ ID NO: 2212027 - RNA, 21 nt, Human
gcaaagacuauucccuucuaa

SEQ ID NO: 2212028 - RNA, 17 nt, Human
gcaaagacagaagccuc

SEQ ID NO: 2212029 - RNA, 16 nt, Human
gcaaagacagaagccu

SEQ ID NO: 2212030 - RNA, 15 nt, Human
gcaaagacagaagcc

SEQ ID NO: 2212031 - RNA, 23 nt, Human
gcaaacuuggaauuuguaaccuc

SEQ ID NO: 2212032 - RNA, 23 nt, Human
gcaaacuuuguaugucauuuccu

SEQ ID NO: 2212033 - RNA, 20 nt, Human
gcaaacuuuauuuuguguuu

SEQ ID NO: 2212034 - RNA, 11 nt, Human
gcaaaugcccu

SEQ ID NO: 2212035 - RNA, 12 nt, Human
gcaaaugacuuu

SEQ ID NO: 2212036 - RNA, 14 nt, Human
gcaaaugcccaagg

SEQ ID NO: 2212037 - RNA, 20 nt, Human
gcaaaugcccaagggaaaga

SEQ ID NO: 2212038 - RNA, 12 nt, Human
gcaaaucuugaa

SEQ ID NO: 2212039 - RNA, 13 nt, Human
gcaaaugacuuug

SEQ ID NO: 2212040 - RNA, 18 nt, Human
gcaaaugucaucagaacu

SEQ ID NO: 2212041 - RNA, 21 nt, Human
gcaaaugucagauacaaugua

SEQ ID NO: 2212042 - RNA, 12 nt, Human
gcaaaugugaau

SEQ ID NO: 2212043 - RNA, 15 nt, Human
gcaacugaggcagac

SEQ ID NO: 2212044 - RNA, 14 nt, Human
gcaacugaggcaga

SEQ ID NO: 2212045 - RNA, 13 nt, Human
gcaacugaggcag

SEQ ID NO: 2212046 - RNA, 21 nt, Human
gcaacugaauaaauaccucuu

SEQ ID NO: 2212047 - RNA, 12 nt, Human
gcaacugaauaa

SEQ ID NO: 2212048 - RNA, 15 nt, Human
gcaacucuugauuau

SEQ ID NO: 2212049 - RNA, 13 nt, Human
gcaacugaauaaa

SEQ ID NO: 2212050 - RNA, 18 nt, Human
gcaacugaauaaauaccu

SEQ ID NO: 2212051 - RNA, 19 nt, Human
gcaacugaauaaauaccuc

SEQ ID NO: 2212052 - RNA, 18 nt, Human
gcaacugagucugcggga

SEQ ID NO: 2212053 - RNA, 22 nt, Human
gcaacugaggcagacagcagcu

SEQ ID NO: 2212054 - RNA, 21 nt, Human
gcaacugaggcagacagcagc

SEQ ID NO: 2212055 - RNA, 19 nt, Human
gcaacugaggcagacagca

SEQ ID NO: 2212056 - RNA, 18 nt, Human
gcaacugcauuggcuuug

SEQ ID NO: 2212057 - RNA, 19 nt, Human
gcaacuugucuuuuucugg

SEQ ID NO: 2212058 - RNA, 19 nt, Human
gcaacugucuauuucugcu

SEQ ID NO: 2212059 - RNA, 20 nt, Human
gcaacugucuauuucugcug

SEQ ID NO: 2212060 - RNA, 23 nt, Human
gcaacugucuauuucugcugaau

SEQ ID NO: 2212061 - RNA, 12 nt, Human
gcaacuguuaug

SEQ ID NO: 2212062 - RNA, 18 nt, Human
gcaacuguuaugaaauaa

SEQ ID NO: 2212063 - RNA, 20 nt, Human
gcaacuguuaugaaauaaag

SEQ ID NO: 2212064 - RNA, 21 nt, Human
gcaacuguuaugaaauaaaga

SEQ ID NO: 2212065 - RNA, 23 nt, Human
gcaacuugucuuuuucuggacug

SEQ ID NO: 2212066 - RNA, 22 nt, Human
gcaacuugucuuuuucuggacu

SEQ ID NO: 2212067 - RNA, 21 nt, Human
gcaacuugucuuuuucuggac

SEQ ID NO: 2212068 - RNA, 17 nt, Human
gcaacuuuaagcagcuc

SEQ ID NO: 2212069 - RNA, 15 nt, Human
gcaagauauuuauau

SEQ ID NO: 2212070 - RNA, 22 nt, Human
gcaacuuuguauaaaagggacu

SEQ ID NO: 2212071 - RNA, 22 nt, Human
gcaagauuuuccacaagauucc

SEQ ID NO: 2212072 - RNA, 13 nt, Human
gcaagauugcuua

SEQ ID NO: 2212073 - RNA, 18 nt, Human
gcaagauucugaaacauu

SEQ ID NO: 2212074 - RNA, 16 nt, Human
gcaagaugugggcagu

SEQ ID NO: 2212075 - RNA, 16 nt, Human
gcaagauauuuauaua

SEQ ID NO: 2212076 - RNA, 12 nt, Human
gcaagauguggg

SEQ ID NO: 2212077 - RNA, 15 nt, Human
gcaagcaccuccugc

SEQ ID NO: 2212078 - RNA, 16 nt, Human
gcaagcaccuccugcc

SEQ ID NO: 2212079 - RNA, 14 nt, Human
gcaagauugcuuaa

SEQ ID NO: 2212080 - RNA, 18 nt, Human
gcaagcaagaaacacugg

SEQ ID NO: 2212081 - RNA, 14 nt, Human
gcaagcacaucugc

SEQ ID NO: 2212082 - RNA, 20 nt, Human
gcaagcaauccuagguaggg

SEQ ID NO: 2212083 - RNA, 18 nt, Human
gcaagcaccuccugccuc

SEQ ID NO: 2212084 - RNA, 20 nt, Human
gcaagcaccuccugccucga

SEQ ID NO: 2212085 - RNA, 21 nt, Human
gcaagcacugcaugggcaagc

SEQ ID NO: 2212086 - RNA, 13 nt, Human
gcaagcuggguaa

SEQ ID NO: 2212087 - RNA, 22 nt, Human
gcaagcuuggcuguagaaggag

SEQ ID NO: 2212088 - RNA, 21 nt, Human
gcaagcuuggcuguagaagga

SEQ ID NO: 2212089 - RNA, 17 nt, Human
gcaagcuuggcuguaga

SEQ ID NO: 2212090 - RNA, 16 nt, Human
gcaaggaaaaacaggu

SEQ ID NO: 2212091 - RNA, 21 nt, Human
gcaaggaccaggacucccucc

SEQ ID NO: 2212092 - RNA, 15 nt, Human
gcaaggaccaggacu

SEQ ID NO: 2212093 - RNA, 14 nt, Human
gcaaggaccaggac

SEQ ID NO: 2212094 - RNA, 14 nt, Human
gcaaggaaggaaag

SEQ ID NO: 2212095 - RNA, 13 nt, Human
gcaaggaaggaaa

SEQ ID NO: 2212096 - RNA, 15 nt, Human
gcaaggaaggaaaga

SEQ ID NO: 2212097 - RNA, 20 nt, Human
gcaaggaccaggacucccuc

SEQ ID NO: 2212098 - RNA, 21 nt, Human
gcaaggacacagaugaaacac

SEQ ID NO: 2212099 - RNA, 12 nt, Human
gcaaggcugugc

SEQ ID NO: 2212100 - RNA, 21 nt, Human
gcaagggaauuucuucaacuc

SEQ ID NO: 2212101 - RNA, 12 nt, Human
gcaagggacugu

SEQ ID NO: 2212102 - RNA, 13 nt, Human
gcaaggcugugcu

SEQ ID NO: 2212103 - RNA, 18 nt, Human
gcaaggcugugcucccug

SEQ ID NO: 2212104 - RNA, 14 nt, Human
gcaaggucauuuuu

SEQ ID NO: 2212105 - RNA, 14 nt, Human
gcaaggcugucaau

SEQ ID NO: 2212106 - RNA, 18 nt, Human
gcaaggcugucaauuaca

SEQ ID NO: 2212107 - RNA, 23 nt, Human
gcaaguauguuuuagcauguguu

SEQ ID NO: 2212108 - RNA, 18 nt, Human
gcaaguaugugagugugu

SEQ ID NO: 2212109 - RNA, 14 nt, Human
gcaaguaugugagu

SEQ ID NO: 2212110 - RNA, 23 nt, Human
gcaagguuuaggcugguggccca

SEQ ID NO: 2212111 - RNA, 24 nt, Human
gcaagguuuaggcugguggcccag

SEQ ID NO: 2212112 - RNA, 22 nt, Human
gcaagguuuaggcugguggccc

SEQ ID NO: 2212113 - RNA, 21 nt, Human
gcaagguuuaggcugguggcc

SEQ ID NO: 2212114 - RNA, 20 nt, Human
gcaagguuuaggcugguggc

SEQ ID NO: 2212115 - RNA, 20 nt, Human
gcaagguggcuccagcacca

SEQ ID NO: 2212116 - RNA, 14 nt, Human
gcaaggugcucaca

SEQ ID NO: 2212117 - RNA, 21 nt, Human
gcaaggugcucacaccccauu

SEQ ID NO: 2212118 - RNA, 22 nt, Human
gcaaggucuggccucagguggg

SEQ ID NO: 2212119 - RNA, 19 nt, Human
gcaaggucuggccucaggu

SEQ ID NO: 2212120 - RNA, 18 nt, Human
gcaagguccggcccaucc

SEQ ID NO: 2212121 - RNA, 16 nt, Human
gcaaugaaaaauucuc

SEQ ID NO: 2212122 - RNA, 23 nt, Human
gcaaucuauuaauagcugccuua

SEQ ID NO: 2212123 - RNA, 19 nt, Human
gcaaucucggcucauugaa

SEQ ID NO: 2212124 - RNA, 15 nt, Human
gcaaugaaaaauucu

SEQ ID NO: 2212125 - RNA, 18 nt, Human
gcaaugacagguaaauua

SEQ ID NO: 2212126 - RNA, 19 nt, Human
gcaaugaagucucugaagu

SEQ ID NO: 2212127 - RNA, 17 nt, Human
gcaaugaagucucugaa

SEQ ID NO: 2212128 - RNA, 14 nt, Human
gcaaugaacacuua

SEQ ID NO: 2212129 - RNA, 21 nt, Human
gcaaucuauuaauagcugccu

SEQ ID NO: 2212130 - RNA, 21 nt, Human
gcaaucguaauguacagaugg

SEQ ID NO: 2212131 - RNA, 14 nt, Human
gcaauccugucuuu

SEQ ID NO: 2212132 - RNA, 17 nt, Human
gcaauccugcaagaaca

SEQ ID NO: 2212133 - RNA, 17 nt, Human
gauuucaucugcucucc

SEQ ID NO: 2212134 - RNA, 20 nt, Human
gauuucaucugcucuccuuc

SEQ ID NO: 2212135 - RNA, 21 nt, Human
gauuucaucugcucuccuucc

SEQ ID NO: 2212136 - RNA, 22 nt, Human
gauuucaucugcucuccuuccu

SEQ ID NO: 2212137 - RNA, 17 nt, Human
gauuguuugcucugaga

SEQ ID NO: 2212138 - RNA, 13 nt, Human
gauuguuguuugc

SEQ ID NO: 2212139 - RNA, 12 nt, Human
gauuguuuuauc

SEQ ID NO: 2212140 - RNA, 18 nt, Human
gauuguuuuaucaugaca

SEQ ID NO: 2212141 - RNA, 15 nt, Human
gauuuaaaacaugua

SEQ ID NO: 2212142 - RNA, 15 nt, Human
gauuuaaaagggaag

SEQ ID NO: 2212143 - RNA, 21 nt, Human
gauuguuaagucuaaauauuu

SEQ ID NO: 2212144 - RNA, 18 nt, Human
gauuguucgggugugcaa

SEQ ID NO: 2212145 - RNA, 16 nt, Human
gauuguuaaaauaacu

SEQ ID NO: 2212146 - RNA, 13 nt, Human
gauuguucaucau

SEQ ID NO: 2212147 - RNA, 15 nt, Human
gauugggccccugcc

SEQ ID NO: 2212148 - RNA, 13 nt, Human
gauugggacagag

SEQ ID NO: 2212149 - RNA, 16 nt, Human
gauugggaauccgccc

SEQ ID NO: 2212150 - RNA, 22 nt, Human
gauuggcucacccaagcaaggc

SEQ ID NO: 2212151 - RNA, 18 nt, Human
gauuggcucacccaagca

SEQ ID NO: 2212152 - RNA, 18 nt, Human
gauuggcuuguguguuuc

SEQ ID NO: 2212153 - RNA, 19 nt, Human
gauuggcuuguguguuuca

SEQ ID NO: 2212154 - RNA, 16 nt, Human
gauuggcuuuaaacac

SEQ ID NO: 2212155 - RNA, 15 nt, Human
gauugggaauaaaua

SEQ ID NO: 2212156 - RNA, 23 nt, Human
gauugggaauaaauaugccucuc

SEQ ID NO: 2212157 - RNA, 19 nt, Human
gauuuguuaaugauagcua

SEQ ID NO: 2212158 - RNA, 13 nt, Human
gauuugaacucag

SEQ ID NO: 2212159 - RNA, 16 nt, Human
gauuugaacucagauc

SEQ ID NO: 2212160 - RNA, 22 nt, Human
gauuugaacucagaucugucug

SEQ ID NO: 2212161 - RNA, 21 nt, Human
gauuucauuucaacuguuugc

SEQ ID NO: 2212162 - RNA, 15 nt, Human
gauuuccagccaggg

SEQ ID NO: 2212163 - RNA, 11 nt, Human
gauuucuuucc

SEQ ID NO: 2212164 - RNA, 15 nt, Human
gauuucuuuccagag

SEQ ID NO: 2212165 - RNA, 17 nt, Human
gauuucuuuccagaggg

SEQ ID NO: 2212166 - RNA, 20 nt, Human
gauuucauuucaacuguuug

SEQ ID NO: 2212167 - RNA, 13 nt, Human
gauuucaugauuu

SEQ ID NO: 2212168 - RNA, 16 nt, Human
gauuucaugcuaucuc

SEQ ID NO: 2212169 - RNA, 20 nt, Human
gauuucaugcuaucucugug

SEQ ID NO: 2212170 - RNA, 18 nt, Human
gauuucaugcuaucucug

SEQ ID NO: 2212171 - RNA, 21 nt, Human
gauuucuguuuagauaauaca

SEQ ID NO: 2212172 - RNA, 22 nt, Human
gauuucuguuuagauaauacac

SEQ ID NO: 2212173 - RNA, 15 nt, Human
gauugcuaugaauga

SEQ ID NO: 2212174 - RNA, 20 nt, Human
gauugcuaaauguaacaguc

SEQ ID NO: 2212175 - RNA, 15 nt, Human
gauugcaacaggcug

SEQ ID NO: 2212176 - RNA, 20 nt, Human
gauugcugccccaucagugc

SEQ ID NO: 2212177 - RNA, 16 nt, Human
gauugcugccccauca

SEQ ID NO: 2212178 - RNA, 18 nt, Human
gauugcugauaauaaauu

SEQ ID NO: 2212179 - RNA, 13 nt, Human
gauugcugccacu

SEQ ID NO: 2212180 - RNA, 16 nt, Human
gauugcugccacuuuu

SEQ ID NO: 2212181 - RNA, 17 nt, Human
gauugcaacaggcuggg

SEQ ID NO: 2212182 - RNA, 18 nt, Human
gauugcaacaggcugggc

SEQ ID NO: 2212183 - RNA, 19 nt, Human
gauugcuugagcccaggag

SEQ ID NO: 2212184 - RNA, 16 nt, Human
gauugcuugagcccag

SEQ ID NO: 2212185 - RNA, 18 nt, Human
gauugcuuaaaauagcaa

SEQ ID NO: 2212186 - RNA, 17 nt, Human
gauugcuuaaaauagca

SEQ ID NO: 2212187 - RNA, 21 nt, Human
gauugcugccccaucagugcu

SEQ ID NO: 2212188 - RNA, 14 nt, Human
gauugcuuaaaaua

SEQ ID NO: 2212189 - RNA, 22 nt, Human
gauugcugccacuuuuuaacua

SEQ ID NO: 2212190 - RNA, 21 nt, Human
gauuccacuacaccuggcuga

SEQ ID NO: 2212191 - RNA, 17 nt, Human
gauuggcucacacugag

SEQ ID NO: 2212192 - RNA, 18 nt, Human
gauuggcucacacugaga

SEQ ID NO: 2212193 - RNA, 20 nt, Human
gauuggcucacacugagaau

SEQ ID NO: 2212194 - RNA, 12 nt, Human
gauuggcucacc

SEQ ID NO: 2212195 - RNA, 16 nt, Human
gauucccaagcucugc

SEQ ID NO: 2212196 - RNA, 17 nt, Human
gauucccaagcucugcu

SEQ ID NO: 2212197 - RNA, 17 nt, Human
gauuccaaccccaacuc

SEQ ID NO: 2212198 - RNA, 22 nt, Human
gauuccaaccccaacuccagua

SEQ ID NO: 2212199 - RNA, 20 nt, Human
gauuccaaguucucaccucu

SEQ ID NO: 2212200 - RNA, 19 nt, Human
gauucuuuccugaggcugg

SEQ ID NO: 2212201 - RNA, 16 nt, Human
gauugcaacaggcugg

SEQ ID NO: 2212202 - RNA, 20 nt, Human
gauucuuuuuaaaguguuuc

SEQ ID NO: 2212203 - RNA, 17 nt, Human
gauuccacuacaccugg

SEQ ID NO: 2212204 - RNA, 20 nt, Human
gauuccacuacaccuggcug

SEQ ID NO: 2212205 - RNA, 14 nt, Human
gauugaaaacuuuu

SEQ ID NO: 2212206 - RNA, 15 nt, Human
gauugaaaacuuuuc

SEQ ID NO: 2212207 - RNA, 19 nt, Human
gauugaaaacuuuucucag

SEQ ID NO: 2212208 - RNA, 20 nt, Human
gauucuuuccugaggcuggg

SEQ ID NO: 2212209 - RNA, 22 nt, Human
gauucuuuccugaggcugggcu

SEQ ID NO: 2212210 - RNA, 19 nt, Human
gauguucuaagucuuucca

SEQ ID NO: 2212211 - RNA, 16 nt, Human
gaugcgguggcucacg

SEQ ID NO: 2212212 - RNA, 21 nt, Human
gaugcgguggcucacgccugu

SEQ ID NO: 2212213 - RNA, 15 nt, Human
gauguucucuaucau

SEQ ID NO: 2212214 - RNA, 19 nt, Human
gauguucucuaucauuuaa

SEQ ID NO: 2212215 - RNA, 21 nt, Human
gauguucucuaucauuuaaua

SEQ ID NO: 2212216 - RNA, 18 nt, Human
gauguucuagcauggcug

SEQ ID NO: 2212217 - RNA, 17 nt, Human
gaugccugguggcagcu

SEQ ID NO: 2212218 - RNA, 20 nt, Human
gaugccugugaacugaacuc

SEQ ID NO: 2212219 - RNA, 22 nt, Human
gaugcagugcucgcuguugcug

SEQ ID NO: 2212220 - RNA, 14 nt, Human
gaugcgcacugcau

SEQ ID NO: 2212221 - RNA, 16 nt, Human
gaugcuagaacucccu

SEQ ID NO: 2212222 - RNA, 18 nt, Human
gauuaauauggggaugca

SEQ ID NO: 2212223 - RNA, 14 nt, Human
gauuaauaugaaaa

SEQ ID NO: 2212224 - RNA, 18 nt, Human
gauuaauaugaaaacuua

SEQ ID NO: 2212225 - RNA, 15 nt, Human
gauuaauccagaaua

SEQ ID NO: 2212226 - RNA, 19 nt, Human
gauuaauccagaauaacua

SEQ ID NO: 2212227 - RNA, 22 nt, Human
gauuaaguaaugauaacuggaa

SEQ ID NO: 2212228 - RNA, 18 nt, Human
gauguuuguggccucaga

SEQ ID NO: 2212229 - RNA, 21 nt, Human
gauguuuuaaggaugcuugua

SEQ ID NO: 2212230 - RNA, 14 nt, Human
gauuaaguaaugau

SEQ ID NO: 2212231 - RNA, 17 nt, Human
gauguuuguggccucag

SEQ ID NO: 2212232 - RNA, 16 nt, Human
gauguuuguggccuca

SEQ ID NO: 2212233 - RNA, 15 nt, Human
gauguuuguggccuc

SEQ ID NO: 2212234 - RNA, 14 nt, Human
gauguuuguggccu

SEQ ID NO: 2212235 - RNA, 13 nt, Human
gauguuuguggcc

SEQ ID NO: 2212236 - RNA, 18 nt, Human
gauguuucuuuuguaugu

SEQ ID NO: 2212237 - RNA, 19 nt, Human
gauguuucuuuuguaugua

SEQ ID NO: 2212238 - RNA, 20 nt, Human
gauguuucuuuuguauguaa

SEQ ID NO: 2212239 - RNA, 23 nt, Human
gauguuucuuuuguauguaaaug

SEQ ID NO: 2212240 - RNA, 14 nt, Human
gauguucuggcccu

SEQ ID NO: 2212241 - RNA, 19 nt, Human
gauguuuccagacuuccuu

SEQ ID NO: 2212242 - RNA, 13 nt, Human
gauguuuccagac

SEQ ID NO: 2212243 - RNA, 12 nt, Human
gauguuuccaga

SEQ ID NO: 2212244 - RNA, 15 nt, Human
gauuaauuaaaugca

SEQ ID NO: 2212245 - RNA, 13 nt, Human
gauuacaagcgug

SEQ ID NO: 2212246 - RNA, 21 nt, Human
gauuacaagcgugagccacug

SEQ ID NO: 2212247 - RNA, 13 nt, Human
gauucagacagcu

SEQ ID NO: 2212248 - RNA, 14 nt, Human
gauucagacagcug

SEQ ID NO: 2212249 - RNA, 17 nt, Human
gauucagacagcugccu

SEQ ID NO: 2212250 - RNA, 18 nt, Human
gauucagacagcugccug

SEQ ID NO: 2212251 - RNA, 16 nt, Human
gauucaggcugcuugg

SEQ ID NO: 2212252 - RNA, 13 nt, Human
gauucaggcugcu

SEQ ID NO: 2212253 - RNA, 12 nt, Human
gauucaggcugc

SEQ ID NO: 2212254 - RNA, 13 nt, Human
gauucaggaaugu

SEQ ID NO: 2212255 - RNA, 16 nt, Human
gauucauaguaacuuc

SEQ ID NO: 2212256 - RNA, 22 nt, Human
gauucaucucucagaagggagg

SEQ ID NO: 2212257 - RNA, 22 nt, Human
gauucaguuuucauuugguuca

SEQ ID NO: 2212258 - RNA, 15 nt, Human
gauucaguuuucauu

SEQ ID NO: 2212259 - RNA, 20 nt, Human
gauucaguguuaaaugugau

SEQ ID NO: 2212260 - RNA, 17 nt, Human
gauucagguauguugcc

SEQ ID NO: 2212261 - RNA, 11 nt, Human
gauucaugugg

SEQ ID NO: 2212262 - RNA, 21 nt, Human
gauucaugccaauuagcaauu

SEQ ID NO: 2212263 - RNA, 23 nt, Human
gauucaucucucagaagggaggc

SEQ ID NO: 2212264 - RNA, 19 nt, Human
gauucauuuuaacaucuga

SEQ ID NO: 2212265 - RNA, 23 nt, Human
gauucauuuccugcccuuccuca

SEQ ID NO: 2212266 - RNA, 10 nt, Human
gauucauuuu

SEQ ID NO: 2212267 - RNA, 13 nt, Human
gauucauuuccug

SEQ ID NO: 2212268 - RNA, 16 nt, Human
gauucauuuccugccc

SEQ ID NO: 2212269 - RNA, 21 nt, Human
gauucauuuccugcccuuccu

SEQ ID NO: 2212270 - RNA, 15 nt, Human
gauucccaagcucug

SEQ ID NO: 2212271 - RNA, 23 nt, Human
gauuccaaagaguagaauugcau

SEQ ID NO: 2212272 - RNA, 19 nt, Human
gauuccaaagaguagaauu

SEQ ID NO: 2212273 - RNA, 18 nt, Human
gauuccaaagaguagaau

SEQ ID NO: 2212274 - RNA, 19 nt, Human
gauucauuuuuaaucauga

SEQ ID NO: 2212275 - RNA, 13 nt, Human
gaugaacccagga

SEQ ID NO: 2212276 - RNA, 22 nt, Human
gaugaacccaggacgcuucuga

SEQ ID NO: 2212277 - RNA, 23 nt, Human
gaugaacccaggacgcuucugaa

SEQ ID NO: 2212278 - RNA, 19 nt, Human
gaucuuggcuuacugcagc

SEQ ID NO: 2212279 - RNA, 23 nt, Human
gaugaaauuuucuagacuuucug

SEQ ID NO: 2212280 - RNA, 16 nt, Human
gaugaaauguaaauac

SEQ ID NO: 2212281 - RNA, 13 nt, Human
gaucuuuaaaaua

SEQ ID NO: 2212282 - RNA, 15 nt, Human
gaugaaugauaaacu

SEQ ID NO: 2212283 - RNA, 23 nt, Human
gaugaaugaggucccaggcagag

SEQ ID NO: 2212284 - RNA, 19 nt, Human
gaugaaugaggucccaggc

SEQ ID NO: 2212285 - RNA, 13 nt, Human
gaugaaugagaau

SEQ ID NO: 2212286 - RNA, 17 nt, Human
gaugaaguuuuacauug

SEQ ID NO: 2212287 - RNA, 23 nt, Human
gaugaaguuuuacauuguugagc

SEQ ID NO: 2212288 - RNA, 22 nt, Human
gaugaaguuuuacauuguugag

SEQ ID NO: 2212289 - RNA, 20 nt, Human
gaugacaaaaauucaacuca

SEQ ID NO: 2212290 - RNA, 19 nt, Human
gaugacaaauggagaagaa

SEQ ID NO: 2212291 - RNA, 16 nt, Human
gaugaauuaaauuuaa

SEQ ID NO: 2212292 - RNA, 14 nt, Human
gaugaauguauuua

SEQ ID NO: 2212293 - RNA, 13 nt, Human
gaugaauguaugu

SEQ ID NO: 2212294 - RNA, 14 nt, Human
gaugaauguaugug

SEQ ID NO: 2212295 - RNA, 15 nt, Human
gaugaaugccgugga

SEQ ID NO: 2212296 - RNA, 16 nt, Human
gaugaaugccguggau

SEQ ID NO: 2212297 - RNA, 12 nt, Human
gaugaccccucc

SEQ ID NO: 2212298 - RNA, 13 nt, Human
gaugaccagaaca

SEQ ID NO: 2212299 - RNA, 16 nt, Human
gaugaccccuccccua

SEQ ID NO: 2212300 - RNA, 17 nt, Human
gaugaccccuccccuaa

SEQ ID NO: 2212301 - RNA, 23 nt, Human
gaugacccugcgaaggggcccug

SEQ ID NO: 2212302 - RNA, 18 nt, Human
gaugaccagaacaagguu

SEQ ID NO: 2212303 - RNA, 16 nt, Human
gaucugucacaccagc

SEQ ID NO: 2212304 - RNA, 20 nt, Human
gaucuguauauacaauaaca

SEQ ID NO: 2212305 - RNA, 15 nt, Human
gaucuguauauacaa

SEQ ID NO: 2212306 - RNA, 16 nt, Human
gaucugguuuugcuau

SEQ ID NO: 2212307 - RNA, 18 nt, Human
gaucugguuuugcuauua

SEQ ID NO: 2212308 - RNA, 14 nt, Human
gaucuguccucagc

SEQ ID NO: 2212309 - RNA, 20 nt, Human
gaucugucacaccagccaua

SEQ ID NO: 2212310 - RNA, 15 nt, Human
gaucuguccaaggaa

SEQ ID NO: 2212311 - RNA, 24 nt, Human
gaucugguuuugcuauuagacugu

SEQ ID NO: 2212312 - RNA, 17 nt, Human
gaucugucacaccagcc

SEQ ID NO: 2212313 - RNA, 18 nt, Human
gaucugucacaccagcca

SEQ ID NO: 2212314 - RNA, 19 nt, Human
gaucugucacaccagccau

SEQ ID NO: 2212315 - RNA, 22 nt, Human
gaucuucuguggguuucuaaag

SEQ ID NO: 2212316 - RNA, 18 nt, Human
gaucuguccucagccuug

SEQ ID NO: 2212317 - RNA, 17 nt, Human
gaucuguccucagccuu

SEQ ID NO: 2212318 - RNA, 16 nt, Human
gaucuguccucagccu

SEQ ID NO: 2212319 - RNA, 15 nt, Human
gaucuguccucagcc

SEQ ID NO: 2212320 - RNA, 19 nt, Human
gaucuucuuuauaauucua

SEQ ID NO: 2212321 - RNA, 19 nt, Human
gaucuugagcaaguuccuu

SEQ ID NO: 2212322 - RNA, 15 nt, Human
gaugaaaugagguca

SEQ ID NO: 2212323 - RNA, 21 nt, Human
gaugaaaugaggucagagccu

SEQ ID NO: 2212324 - RNA, 14 nt, Human
gaugcagugcuucc

SEQ ID NO: 2212325 - RNA, 14 nt, Human
gaugccugguggca

SEQ ID NO: 2212326 - RNA, 15 nt, Human
gaugccugguggcag

SEQ ID NO: 2212327 - RNA, 16 nt, Human
gaugccugguggcagc

SEQ ID NO: 2212328 - RNA, 16 nt, Human
gaugagaggaaaucac

SEQ ID NO: 2212329 - RNA, 21 nt, Human
gaugagagcccagagguaaca

SEQ ID NO: 2212330 - RNA, 15 nt, Human
gaugcagggcaguca

SEQ ID NO: 2212331 - RNA, 22 nt, Human
gaugcaggugagcccauggccc

SEQ ID NO: 2212332 - RNA, 14 nt, Human
gaugcagggcaguc

SEQ ID NO: 2212333 - RNA, 14 nt, Human
gaugagaagagggg

SEQ ID NO: 2212334 - RNA, 23 nt, Human
gaugagacuuccaaaccugacag

SEQ ID NO: 2212335 - RNA, 14 nt, Human
gaugagagcccaga

SEQ ID NO: 2212336 - RNA, 15 nt, Human
gaugagagcccagag

SEQ ID NO: 2212337 - RNA, 17 nt, Human
gaugagagcccagaggu

SEQ ID NO: 2212338 - RNA, 18 nt, Human
gaugagagcccagaggua

SEQ ID NO: 2212339 - RNA, 15 nt, Human
gaugaccuggauaac

SEQ ID NO: 2212340 - RNA, 20 nt, Human
gaugaccuugaaugaugcca

SEQ ID NO: 2212341 - RNA, 23 nt, Human
gaugagaaauaaaguuucuguug

SEQ ID NO: 2212342 - RNA, 18 nt, Human
gaugaccuugaaugaugc

SEQ ID NO: 2212343 - RNA, 14 nt, Human
gaugcaccagcccu

SEQ ID NO: 2212344 - RNA, 14 nt, Human
gaugagaggaaauc

SEQ ID NO: 2212345 - RNA, 15 nt, Human
gaugcaccagcccuu

SEQ ID NO: 2212346 - RNA, 23 nt, Human
gaugcaccagcccuuagcaggga

SEQ ID NO: 2212347 - RNA, 18 nt, Human
gauccuaggcauuugcug

SEQ ID NO: 2212348 - RNA, 18 nt, Human
gauccuaagggcucaccg

SEQ ID NO: 2212349 - RNA, 20 nt, Human
gauccuagccuuauccucug

SEQ ID NO: 2212350 - RNA, 23 nt, Human
gauccuaaugaaugcauaaaaug

SEQ ID NO: 2212351 - RNA, 23 nt, Human
gauccgacuugaauuuucccacu

SEQ ID NO: 2212352 - RNA, 20 nt, Human
gauccgacugcuuuggaccu

SEQ ID NO: 2212353 - RNA, 14 nt, Human
gauccgacugcuuu

SEQ ID NO: 2212354 - RNA, 17 nt, Human
gauccgacugcuuugga

SEQ ID NO: 2212355 - RNA, 18 nt, Human
gauccgacugcuuuggac

SEQ ID NO: 2212356 - RNA, 16 nt, Human
gauccucccaccucag

SEQ ID NO: 2212357 - RNA, 14 nt, Human
gauccuccaggugc

SEQ ID NO: 2212358 - RNA, 17 nt, Human
gauccucccaccucagc

SEQ ID NO: 2212359 - RNA, 13 nt, Human
gaucauccacugu

SEQ ID NO: 2212360 - RNA, 12 nt, Human
gaucccucaucu

SEQ ID NO: 2212361 - RNA, 19 nt, Human
gaucauauacgugaaaauu

SEQ ID NO: 2212362 - RNA, 17 nt, Human
gaucauagguauuucaa

SEQ ID NO: 2212363 - RNA, 14 nt, Human
gaucaggcucugcc

SEQ ID NO: 2212364 - RNA, 18 nt, Human
gaucauagguauuucaaa

SEQ ID NO: 2212365 - RNA, 18 nt, Human
gaucccuguuacccagag

SEQ ID NO: 2212366 - RNA, 20 nt, Human
gaucccuguuacccagagaa

SEQ ID NO: 2212367 - RNA, 21 nt, Human
gaucccuguguugucucuaga

SEQ ID NO: 2212368 - RNA, 24 nt, Human
gaucccuguguugucucuagagca

SEQ ID NO: 2212369 - RNA, 14 nt, Human
gaucccuguguugu

SEQ ID NO: 2212370 - RNA, 18 nt, Human
gaucccuguguugucucu

SEQ ID NO: 2212371 - RNA, 19 nt, Human
gaucccuguguugucucua

SEQ ID NO: 2212372 - RNA, 20 nt, Human
gaucccuguguugucucuag

SEQ ID NO: 2212373 - RNA, 19 nt, Human
gaucccucccccccaugca

SEQ ID NO: 2212374 - RNA, 13 nt, Human
gaucccucccccc

SEQ ID NO: 2212375 - RNA, 18 nt, Human
gaucccucaucugucccu

SEQ ID NO: 2212376 - RNA, 14 nt, Human
gaucccucaucugu

SEQ ID NO: 2212377 - RNA, 23 nt, Human
gaucccucccccccaugcacugu

SEQ ID NO: 2212378 - RNA, 21 nt, Human
gaucccucccccccaugcacu

SEQ ID NO: 2212379 - RNA, 23 nt, Human
gaucccucuacagagcuucccug

SEQ ID NO: 2212380 - RNA, 14 nt, Human
gaucccucucugga

SEQ ID NO: 2212381 - RNA, 15 nt, Human
gaucuaggugaggau

SEQ ID NO: 2212382 - RNA, 14 nt, Human
gaucuagguuuaac

SEQ ID NO: 2212383 - RNA, 15 nt, Human
gaucuagguuuaacu

SEQ ID NO: 2212384 - RNA, 16 nt, Human
gaucuagaauguguuu

SEQ ID NO: 2212385 - RNA, 20 nt, Human
gaucuagaauguguuuucug

SEQ ID NO: 2212386 - RNA, 21 nt, Human
gaucuagaauguguuuucuga

SEQ ID NO: 2212387 - RNA, 22 nt, Human
gaucuagaauguguuuucugaa

SEQ ID NO: 2212388 - RNA, 20 nt, Human
gaucuaggaagacuuuggaa

SEQ ID NO: 2212389 - RNA, 16 nt, Human
gaucugguccuaccca

SEQ ID NO: 2212390 - RNA, 16 nt, Human
gaucugguuugacucc

SEQ ID NO: 2212391 - RNA, 14 nt, Human
gaucugguuuugcu

SEQ ID NO: 2212392 - RNA, 15 nt, Human
gaucugguccuaccc

SEQ ID NO: 2212393 - RNA, 22 nt, Human
gaucuagguuuaacucagauca

SEQ ID NO: 2212394 - RNA, 20 nt, Human
gaucuagguuuaacucagau

SEQ ID NO: 2212395 - RNA, 21 nt, Human
gaucuagguuuaacucagauc

SEQ ID NO: 2212396 - RNA, 16 nt, Human
gaucuagguuuaacuc

SEQ ID NO: 2212397 - RNA, 17 nt, Human
gaucuagguuuaacuca

SEQ ID NO: 2212398 - RNA, 18 nt, Human
gaucuagguuuaacucag

SEQ ID NO: 2212399 - RNA, 19 nt, Human
gaucuagguuuaacucaga

SEQ ID NO: 2212400 - RNA, 18 nt, Human
gaucuaccagcauaaaua

SEQ ID NO: 2212401 - RNA, 21 nt, Human
gaucuaaggaugucacagggc

SEQ ID NO: 2212402 - RNA, 17 nt, Human
gaucuaccccuuacuua

SEQ ID NO: 2212403 - RNA, 13 nt, Human
gaucuaggaagac

SEQ ID NO: 2212404 - RNA, 14 nt, Human
gaucuaggaagacu

SEQ ID NO: 2212405 - RNA, 18 nt, Human
gaucuaggaagacuuugg

SEQ ID NO: 2212406 - RNA, 18 nt, Human
gaucuaagccuuuccaua

SEQ ID NO: 2212407 - RNA, 23 nt, Human
gauccuggguggucugcaggcag

SEQ ID NO: 2212408 - RNA, 23 nt, Human
gaucuaaggaugucacagggcca

SEQ ID NO: 2212409 - RNA, 17 nt, Human
gaucuaagccuuuccau

SEQ ID NO: 2212410 - RNA, 12 nt, Human
gauccugugaag

SEQ ID NO: 2212411 - RNA, 20 nt, Human
gauccugucuuuaaggaaaa

SEQ ID NO: 2212412 - RNA, 19 nt, Human
gauccugucuuuaaggaaa

SEQ ID NO: 2212413 - RNA, 16 nt, Human
gauccugucuuuaagg

SEQ ID NO: 2212414 - RNA, 17 nt, Human
gauccuggaggcccagu

SEQ ID NO: 2212415 - RNA, 16 nt, Human
gauccuggaggcccag

SEQ ID NO: 2212416 - RNA, 15 nt, Human
gauccuggaggccca

SEQ ID NO: 2212417 - RNA, 12 nt, Human
gauccuggaggc

SEQ ID NO: 2212418 - RNA, 14 nt, Human
gauccuggaaauca

SEQ ID NO: 2212419 - RNA, 15 nt, Human
gauccuccugcagac

SEQ ID NO: 2212420 - RNA, 16 nt, Human
gauccuccugcagacc

SEQ ID NO: 2212421 - RNA, 21 nt, Human
gauccuccugcagaccacgcc

SEQ ID NO: 2212422 - RNA, 22 nt, Human
gauccuagccuuauccucugau

SEQ ID NO: 2212423 - RNA, 23 nt, Human
gauccuagccuuauccucugauc

SEQ ID NO: 2212424 - RNA, 16 nt, Human
gauccucccaggcuuc

SEQ ID NO: 2212425 - RNA, 12 nt, Human
gauccugagcca

SEQ ID NO: 2212426 - RNA, 22 nt, Human
gauccuccugcagaccacgccc

SEQ ID NO: 2212427 - RNA, 21 nt, Human
gaguucucagggcuccugccu

SEQ ID NO: 2212428 - RNA, 16 nt, Human
gaguucucagggcucc

SEQ ID NO: 2212429 - RNA, 18 nt, Human
gaguucucagggcuccug

SEQ ID NO: 2212430 - RNA, 19 nt, Human
gaguucucagggcuccugc

SEQ ID NO: 2212431 - RNA, 20 nt, Human
gaguucucagggcuccugcc

SEQ ID NO: 2212432 - RNA, 13 nt, Human
gaguucugguucc

SEQ ID NO: 2212433 - RNA, 14 nt, Human
gauaaaauaaauga

SEQ ID NO: 2212434 - RNA, 13 nt, Human
gauaaacaguagu

SEQ ID NO: 2212435 - RNA, 16 nt, Human
gauaaauuccacugga

SEQ ID NO: 2212436 - RNA, 12 nt, Human
gauaaauuauaa

SEQ ID NO: 2212437 - RNA, 13 nt, Human
gauaaauuauaag

SEQ ID NO: 2212438 - RNA, 15 nt, Human
gauaacaagaucuuu

SEQ ID NO: 2212439 - RNA, 16 nt, Human
gauaacaaccuggaga

SEQ ID NO: 2212440 - RNA, 13 nt, Human
gauaacagcacug

SEQ ID NO: 2212441 - RNA, 17 nt, Human
gauaacaaccuggagac

SEQ ID NO: 2212442 - RNA, 11 nt, Human
gauaaagauga

SEQ ID NO: 2212443 - RNA, 12 nt, Human
gauaaagaugau

SEQ ID NO: 2212444 - RNA, 15 nt, Human
gauaaagauaucaau

SEQ ID NO: 2212445 - RNA, 18 nt, Human
gauaaaaugagguucaac

SEQ ID NO: 2212446 - RNA, 19 nt, Human
gauaaaauuauagauggga

SEQ ID NO: 2212447 - RNA, 22 nt, Human
gauaaaauuauagaugggaaug

SEQ ID NO: 2212448 - RNA, 22 nt, Human
gauaaccuguacuucaaguuaa

SEQ ID NO: 2212449 - RNA, 13 nt, Human
gauaacuagaugg

SEQ ID NO: 2212450 - RNA, 21 nt, Human
gauaaccuguacuucaaguua

SEQ ID NO: 2212451 - RNA, 23 nt, Human
gauaaccuauaugauuuauaguu

SEQ ID NO: 2212452 - RNA, 17 nt, Human
gauaaccuauaugauuu

SEQ ID NO: 2212453 - RNA, 16 nt, Human
gauaacagcacugacu

SEQ ID NO: 2212454 - RNA, 15 nt, Human
gauaaccagcuguaa

SEQ ID NO: 2212455 - RNA, 23 nt, Human
gauaaguucuuaugccauguuaa

SEQ ID NO: 2212456 - RNA, 17 nt, Human
gauaacuagauggugcu

SEQ ID NO: 2212457 - RNA, 24 nt, Human
gauaauacaccacuacauucuguu

SEQ ID NO: 2212458 - RNA, 23 nt, Human
gauaauacaccacuacauucugu

SEQ ID NO: 2212459 - RNA, 12 nt, Human
gauaauacacca

SEQ ID NO: 2212460 - RNA, 16 nt, Human
gauaauaauauauguu

SEQ ID NO: 2212461 - RNA, 18 nt, Human
gaguucgagaccagccug

SEQ ID NO: 2212462 - RNA, 22 nt, Human
gaguucagguagcugccccugg

SEQ ID NO: 2212463 - RNA, 21 nt, Human
gaguucagguagcugccccug

SEQ ID NO: 2212464 - RNA, 19 nt, Human
gaguucagguagcugcccc

SEQ ID NO: 2212465 - RNA, 22 nt, Human
gaguucacuucaucuucucagc

SEQ ID NO: 2212466 - RNA, 16 nt, Human
gaguucaauggcugcu

SEQ ID NO: 2212467 - RNA, 19 nt, Human
gaguucaauggcugcugaa

SEQ ID NO: 2212468 - RNA, 18 nt, Human
gaguucaaugaucuaggu

SEQ ID NO: 2212469 - RNA, 19 nt, Human
gaguucaaugaucuagguu

SEQ ID NO: 2212470 - RNA, 21 nt, Human
gaguucaaugaucuagguuua

SEQ ID NO: 2212471 - RNA, 15 nt, Human
gaguucaauggcugc

SEQ ID NO: 2212472 - RNA, 19 nt, Human
gaguucgaggcugcaguca

SEQ ID NO: 2212473 - RNA, 21 nt, Human
gaguucgagaccagccuggcc

SEQ ID NO: 2212474 - RNA, 20 nt, Human
gaguucgagaccagccuggc

SEQ ID NO: 2212475 - RNA, 19 nt, Human
gaguucgagaccagccugg

SEQ ID NO: 2212476 - RNA, 11 nt, Human
gaguucuacau

SEQ ID NO: 2212477 - RNA, 14 nt, Human
gaguucaguuuuac

SEQ ID NO: 2212478 - RNA, 13 nt, Human
gaguucucagggc

SEQ ID NO: 2212479 - RNA, 14 nt, Human
gaguucucagggcu

SEQ ID NO: 2212480 - RNA, 15 nt, Human
gaguucucagggcuc

SEQ ID NO: 2212481 - RNA, 19 nt, Human
gaguguuccccuuccacug

SEQ ID NO: 2212482 - RNA, 17 nt, Human
gaguguguuugucaccg

SEQ ID NO: 2212483 - RNA, 19 nt, Human
gagugugugcaugugugug

SEQ ID NO: 2212484 - RNA, 21 nt, Human
gaguguguccaagugugugug

SEQ ID NO: 2212485 - RNA, 19 nt, Human
gaguguguauuguucccag

SEQ ID NO: 2212486 - RNA, 11 nt, Human
gagugugugca

SEQ ID NO: 2212487 - RNA, 23 nt, Human
gaguuauuuuaauuaucuuuucu

SEQ ID NO: 2212488 - RNA, 22 nt, Human
gaguucaauaaaugucuguuga

SEQ ID NO: 2212489 - RNA, 11 nt, Human
gaguucaauga

SEQ ID NO: 2212490 - RNA, 12 nt, Human
gaguucaaugau

SEQ ID NO: 2212491 - RNA, 13 nt, Human
gaguucaaugauc

SEQ ID NO: 2212492 - RNA, 14 nt, Human
gaguucaaugaucu

SEQ ID NO: 2212493 - RNA, 15 nt, Human
gaguucaaugaucua

SEQ ID NO: 2212494 - RNA, 16 nt, Human
gaguucaaugaucuag

SEQ ID NO: 2212495 - RNA, 15 nt, Human
gacuucauuuuuccu

SEQ ID NO: 2212496 - RNA, 16 nt, Human
gacuucauuuuuccua

SEQ ID NO: 2212497 - RNA, 15 nt, Human
gacuucauuaauaau

SEQ ID NO: 2212498 - RNA, 21 nt, Human
gacuucauagauuuccuuccc

SEQ ID NO: 2212499 - RNA, 21 nt, Human
gacuucaguauguugucaaag

SEQ ID NO: 2212500 - RNA, 24 nt, Human
gacuucaucucccaccuagcagca

SEQ ID NO: 2212501 - RNA, 13 nt, Human
gacuucaguaugu

SEQ ID NO: 2212502 - RNA, 17 nt, Human
gacuucaguauguuguc

SEQ ID NO: 2212503 - RNA, 19 nt, Human
gacuucaguauguugucaa

SEQ ID NO: 2212504 - RNA, 20 nt, Human
gacuucaguauguugucaaa

SEQ ID NO: 2212505 - RNA, 19 nt, Human
gacuucccacucuagggca

SEQ ID NO: 2212506 - RNA, 18 nt, Human
gaguguguauuguuccca

SEQ ID NO: 2212507 - RNA, 17 nt, Human
gaguguguauuguuccc

SEQ ID NO: 2212508 - RNA, 16 nt, Human
gaguguguauuguucc

SEQ ID NO: 2212509 - RNA, 22 nt, Human
gaguguguaauuuaaaauugug

SEQ ID NO: 2212510 - RNA, 21 nt, Human
gaguguguaauuuaaaauugu

SEQ ID NO: 2212511 - RNA, 14 nt, Human
gacuuccuuacuaa

SEQ ID NO: 2212512 - RNA, 14 nt, Human
gacuuccuugagac

SEQ ID NO: 2212513 - RNA, 18 nt, Human
gacuuccuguccagcucc

SEQ ID NO: 2212514 - RNA, 22 nt, Human
gacuuccuguccagcuccaacc

SEQ ID NO: 2212515 - RNA, 21 nt, Human
gacuuccuguccagcuccaac

SEQ ID NO: 2212516 - RNA, 20 nt, Human
gacuuccuguccagcuccaa

SEQ ID NO: 2212517 - RNA, 19 nt, Human
gacuuccuguccagcucca

SEQ ID NO: 2212518 - RNA, 15 nt, Human
gauauaaauaaaaca

SEQ ID NO: 2212519 - RNA, 16 nt, Human
gauauagccagaaaaa

SEQ ID NO: 2212520 - RNA, 19 nt, Human
gauauaguuuuacuuuuaa

SEQ ID NO: 2212521 - RNA, 24 nt, Human
gauauaguuuuacuuuuaaacugu

SEQ ID NO: 2212522 - RNA, 21 nt, Human
gauauaguuuuacuuuuaaac

SEQ ID NO: 2212523 - RNA, 15 nt, Human
gauauauaaguguac

SEQ ID NO: 2212524 - RNA, 17 nt, Human
gauauauaaguguacau

SEQ ID NO: 2212525 - RNA, 18 nt, Human
gauauaugcucugcaugu

SEQ ID NO: 2212526 - RNA, 14 nt, Human
gauauauacauagc

SEQ ID NO: 2212527 - RNA, 13 nt, Human
gauauauaucaua

SEQ ID NO: 2212528 - RNA, 21 nt, Human
gauauaucaugagugaauaaa

SEQ ID NO: 2212529 - RNA, 23 nt, Human
gauaguggggagacuucuuggcu

SEQ ID NO: 2212530 - RNA, 21 nt, Human
gauagggauacaugcucuuag

SEQ ID NO: 2212531 - RNA, 20 nt, Human
gauaggcucugcacagaugg

SEQ ID NO: 2212532 - RNA, 17 nt, Human
gauaggcucugcacaga

SEQ ID NO: 2212533 - RNA, 14 nt, Human
gauaggcucugcac

SEQ ID NO: 2212534 - RNA, 13 nt, Human
gauaggcucugca

SEQ ID NO: 2212535 - RNA, 20 nt, Human
gauagugucccacggugccu

SEQ ID NO: 2212536 - RNA, 13 nt, Human
gauauaaauaaaa

SEQ ID NO: 2212537 - RNA, 18 nt, Human
gauauaaaagacugacca

SEQ ID NO: 2212538 - RNA, 12 nt, Human
gauaguuacugu

SEQ ID NO: 2212539 - RNA, 14 nt, Human
gauaguuacuguug

SEQ ID NO: 2212540 - RNA, 17 nt, Human
gauaguuacuguuguga

SEQ ID NO: 2212541 - RNA, 20 nt, Human
gauaguuacuguugugaccu

SEQ ID NO: 2212542 - RNA, 12 nt, Human
gauaggcucugc

SEQ ID NO: 2212543 - RNA, 17 nt, Human
gauaggagccugcuggu

SEQ ID NO: 2212544 - RNA, 18 nt, Human
gauaggaaugugaaagca

SEQ ID NO: 2212545 - RNA, 17 nt, Human
gauaggucagugcaaau

SEQ ID NO: 2212546 - RNA, 16 nt, Human
gauacaaaagcaugug

SEQ ID NO: 2212547 - RNA, 19 nt, Human
gauaggaaaaaugaguaau

SEQ ID NO: 2212548 - RNA, 17 nt, Human
gauaauaugagaaucag

SEQ ID NO: 2212549 - RNA, 18 nt, Human
gauaauauuguggugcca

SEQ ID NO: 2212550 - RNA, 14 nt, Human
gauaauuauaauau

SEQ ID NO: 2212551 - RNA, 17 nt, Human
gauaaucaacugggcug

SEQ ID NO: 2212552 - RNA, 18 nt, Human
gauaauucuagcuuugag

SEQ ID NO: 2212553 - RNA, 18 nt, Human
gauaauugcauucaucuu

SEQ ID NO: 2212554 - RNA, 13 nt, Human
gauaauuccagug

SEQ ID NO: 2212555 - RNA, 17 nt, Human
gauaauuccaguggucc

SEQ ID NO: 2212556 - RNA, 23 nt, Human
gauaucccuaugcugccuaggcu

SEQ ID NO: 2212557 - RNA, 22 nt, Human
gauaucccuaugcugccuaggc

SEQ ID NO: 2212558 - RNA, 17 nt, Human
gauaucccuaugcugcc

SEQ ID NO: 2212559 - RNA, 13 nt, Human
gauaucucaucuc

SEQ ID NO: 2212560 - RNA, 23 nt, Human
gauaucgacuuguuuuugcacau

SEQ ID NO: 2212561 - RNA, 14 nt, Human
gauaucucaucucu

SEQ ID NO: 2212562 - RNA, 15 nt, Human
gauaucugagggagg

SEQ ID NO: 2212563 - RNA, 16 nt, Human
gauaucugagggagga

SEQ ID NO: 2212564 - RNA, 20 nt, Human
gauaucugagggaggaggcc

SEQ ID NO: 2212565 - RNA, 23 nt, Human
gauaucugagggaggaggccacc

SEQ ID NO: 2212566 - RNA, 23 nt, Human
gauauaggucagugaggcccagg

SEQ ID NO: 2212567 - RNA, 20 nt, Human
gauauaucaugagugaauaa

SEQ ID NO: 2212568 - RNA, 15 nt, Human
gauauauuuuucaca

SEQ ID NO: 2212569 - RNA, 17 nt, Human
gauauauuuuuaagaua

SEQ ID NO: 2212570 - RNA, 17 nt, Human
gauauauuuuucacagu

SEQ ID NO: 2212571 - RNA, 19 nt, Human
gauauccauucuuucugau

SEQ ID NO: 2212572 - RNA, 16 nt, Human
gauauccauucuuucu

SEQ ID NO: 2212573 - RNA, 15 nt, Human
gauauccauucuuuc

SEQ ID NO: 2212574 - RNA, 18 nt, Human
gauaucacagucuaauuu

SEQ ID NO: 2212575 - RNA, 19 nt, Human
gauaucacagucuaauuuu

SEQ ID NO: 2212576 - RNA, 19 nt, Human
gaucacagcuucagccagg

SEQ ID NO: 2212577 - RNA, 21 nt, Human
gaucacagcuucagccaggag

SEQ ID NO: 2212578 - RNA, 21 nt, Human
gauaucugagggaggaggcca

SEQ ID NO: 2212579 - RNA, 13 nt, Human
gaucacagcugcu

SEQ ID NO: 2212580 - RNA, 17 nt, Human
gaucacagcugcuuucu

SEQ ID NO: 2212581 - RNA, 20 nt, Human
gaucacagcugcuuucuguu

SEQ ID NO: 2212582 - RNA, 14 nt, Human
gaucacagccucug

SEQ ID NO: 2212583 - RNA, 14 nt, Human
gaucaccagaauaa

SEQ ID NO: 2212584 - RNA, 20 nt, Human
gaucacagggccccagaagg

SEQ ID NO: 2212585 - RNA, 13 nt, Human
gaucacagggccc

SEQ ID NO: 2212586 - RNA, 16 nt, Human
gaucacauguggacuu

SEQ ID NO: 2212587 - RNA, 20 nt, Human
gaucaccagcccggccugcu

SEQ ID NO: 2212588 - RNA, 22 nt, Human
gaucaccagcccggccugcucc

SEQ ID NO: 2212589 - RNA, 15 nt, Human
gaucaccagaauaaa

SEQ ID NO: 2212590 - RNA, 14 nt, Human
gaucaccagcccgg

SEQ ID NO: 2212591 - RNA, 15 nt, Human
gaucaccagcccggc

SEQ ID NO: 2212592 - RNA, 18 nt, Human
gaucaccagcccggccug

SEQ ID NO: 2212593 - RNA, 23 nt, Human
gaucacggcucacugcagccuca

SEQ ID NO: 2212594 - RNA, 20 nt, Human
gaucacggcucacugcagcc

SEQ ID NO: 2212595 - RNA, 13 nt, Human
gaucacuggagcc

SEQ ID NO: 2212596 - RNA, 12 nt, Human
gaucacuggagc

SEQ ID NO: 2212597 - RNA, 14 nt, Human
gaucaccugagguu

SEQ ID NO: 2212598 - RNA, 14 nt, Human
gaucaccugagguc

SEQ ID NO: 2212599 - RNA, 12 nt, Human
gaucacuacugc

SEQ ID NO: 2212600 - RNA, 14 nt, Human
gaucacuacugcag

SEQ ID NO: 2212601 - RNA, 16 nt, Human
gaucagcuguuuguca

SEQ ID NO: 2212602 - RNA, 14 nt, Human
gaucacuggagccc

SEQ ID NO: 2212603 - RNA, 17 nt, Human
gaucacuggagcccagg

SEQ ID NO: 2212604 - RNA, 23 nt, Human
gaucagcuuauugucuagugaaa

SEQ ID NO: 2212605 - RNA, 18 nt, Human
gaucagcuguuugucaua

SEQ ID NO: 2212606 - RNA, 17 nt, Human
gaucagcuguuugucau

SEQ ID NO: 2212607 - RNA, 17 nt, Human
gaaugaaccuucuggcc

SEQ ID NO: 2212608 - RNA, 15 nt, Human
gaaugaaccuucugg

SEQ ID NO: 2212609 - RNA, 14 nt, Human
gaaugaaaccccca

SEQ ID NO: 2212610 - RNA, 23 nt, Human
gaaugaaccacaucuugcucugc

SEQ ID NO: 2212611 - RNA, 22 nt, Human
gaaugaaccacaucuugcucug

SEQ ID NO: 2212612 - RNA, 18 nt, Human
gaaugaaccacaucuugc

SEQ ID NO: 2212613 - RNA, 23 nt, Human
gaaugaaaaauuuaagcauuguu

SEQ ID NO: 2212614 - RNA, 16 nt, Human
gaaugaaaauuguaug

SEQ ID NO: 2212615 - RNA, 22 nt, Human
gaaugaaaaauuuaagcauugu

SEQ ID NO: 2212616 - RNA, 20 nt, Human
gaaugaaaaauuuaagcauu

SEQ ID NO: 2212617 - RNA, 15 nt, Human
gaaugaaaacucauu

SEQ ID NO: 2212618 - RNA, 19 nt, Human
gaaugaaaaauuuaagcau

SEQ ID NO: 2212619 - RNA, 15 nt, Human
gaaugaaaaauuuaa

SEQ ID NO: 2212620 - RNA, 20 nt, Human
gaaucuuuccaauaaaccag

SEQ ID NO: 2212621 - RNA, 23 nt, Human
gaaucuuuuucagaaacagugag

SEQ ID NO: 2212622 - RNA, 15 nt, Human
gaaugaaaaaacagu

SEQ ID NO: 2212623 - RNA, 11 nt, Human
gaaucaauaau

SEQ ID NO: 2212624 - RNA, 22 nt, Human
gaaucuugucucaaugcucaua

SEQ ID NO: 2212625 - RNA, 22 nt, Human
gaaucuuuagagaaguauacau

SEQ ID NO: 2212626 - RNA, 23 nt, Human
gaaucuuuagagaaguauacaua

SEQ ID NO: 2212627 - RNA, 17 nt, Human
gaaucuuuauugagaaa

SEQ ID NO: 2212628 - RNA, 18 nt, Human
gaaucuuuauugagaaag

SEQ ID NO: 2212629 - RNA, 19 nt, Human
gaaucuuuauugagaaaga

SEQ ID NO: 2212630 - RNA, 22 nt, Human
gaaucuuuauugagaaagagca

SEQ ID NO: 2212631 - RNA, 17 nt, Human
gaaugaaggugucagaa

SEQ ID NO: 2212632 - RNA, 20 nt, Human
gaaugaagcuuguguaucca

SEQ ID NO: 2212633 - RNA, 16 nt, Human
gaaugaagcuugugua

SEQ ID NO: 2212634 - RNA, 18 nt, Human
gaaugaagcuuguguauc

SEQ ID NO: 2212635 - RNA, 11 nt, Human
gaaugcagugg

SEQ ID NO: 2212636 - RNA, 14 nt, Human
gaaugcauaaaaug

SEQ ID NO: 2212637 - RNA, 14 nt, Human
gaaugcauuuuguu

SEQ ID NO: 2212638 - RNA, 22 nt, Human
gaaugccacugccuucgcuucu

SEQ ID NO: 2212639 - RNA, 22 nt, Human
gaaugcccacaggcaaaugcau

SEQ ID NO: 2212640 - RNA, 17 nt, Human
gaaugcccacaggcaaa

SEQ ID NO: 2212641 - RNA, 21 nt, Human
gaaugccacugccuucgcuuc

SEQ ID NO: 2212642 - RNA, 14 nt, Human
gaaugcccucaggg

SEQ ID NO: 2212643 - RNA, 17 nt, Human
gaaugcccccagcuggc

SEQ ID NO: 2212644 - RNA, 18 nt, Human
gaaugcccccagcuggcc

SEQ ID NO: 2212645 - RNA, 13 nt, Human
gaaugcuuuagga

SEQ ID NO: 2212646 - RNA, 14 nt, Human
gaaugccguggauu

SEQ ID NO: 2212647 - RNA, 20 nt, Human
gaaugccucaaugugaccag

SEQ ID NO: 2212648 - RNA, 18 nt, Human
gaaugcuuuuugaauguu

SEQ ID NO: 2212649 - RNA, 23 nt, Human
gaauggucagcguugcaugucgu

SEQ ID NO: 2212650 - RNA, 13 nt, Human
gaaugguccaggg

SEQ ID NO: 2212651 - RNA, 15 nt, Human
gaaugggcaguuaca

SEQ ID NO: 2212652 - RNA, 16 nt, Human
gaaugggcaguuacau

SEQ ID NO: 2212653 - RNA, 17 nt, Human
gaaugggcuguuuuugg

SEQ ID NO: 2212654 - RNA, 18 nt, Human
gaauggggaucacagaga

SEQ ID NO: 2212655 - RNA, 13 nt, Human
gaaugguuauaaa

SEQ ID NO: 2212656 - RNA, 16 nt, Human
gaaugguuauaaaagu

SEQ ID NO: 2212657 - RNA, 17 nt, Human
gaaugguuauaaaagug

SEQ ID NO: 2212658 - RNA, 16 nt, Human
gaaugguuccaugccu

SEQ ID NO: 2212659 - RNA, 14 nt, Human
gaaugguccagggu

SEQ ID NO: 2212660 - RNA, 15 nt, Human
gaaugguccaggguu

SEQ ID NO: 2212661 - RNA, 19 nt, Human
gaauggauuggauuauuua

SEQ ID NO: 2212662 - RNA, 20 nt, Human
gaauggauuggauuauuuaa

SEQ ID NO: 2212663 - RNA, 13 nt, Human
gaauggcaauggu

SEQ ID NO: 2212664 - RNA, 23 nt, Human
gaaugggagguugaucagaucug

SEQ ID NO: 2212665 - RNA, 13 nt, Human
gaaugggaaaaga

SEQ ID NO: 2212666 - RNA, 21 nt, Human
gaaugggcaaaacugaauuau

SEQ ID NO: 2212667 - RNA, 21 nt, Human
gaauggaaggguucuggcugc

SEQ ID NO: 2212668 - RNA, 22 nt, Human
gaauggaaggguucuggcugcc

SEQ ID NO: 2212669 - RNA, 22 nt, Human
gaaugguuuucaaaauaaaaau

SEQ ID NO: 2212670 - RNA, 19 nt, Human
gaaugguuccaugccugag

SEQ ID NO: 2212671 - RNA, 20 nt, Human
gaaugguuccaugccugagg

SEQ ID NO: 2212672 - RNA, 22 nt, Human
gaaugguuccaugccugagggu

SEQ ID NO: 2212673 - RNA, 18 nt, Human
gaauguaugcuucauaca

SEQ ID NO: 2212674 - RNA, 16 nt, Human
gaauguaugcuucaua

SEQ ID NO: 2212675 - RNA, 18 nt, Human
gaauguaagaacuacaaa

SEQ ID NO: 2212676 - RNA, 18 nt, Human
gaauguaacugcugaaaa

SEQ ID NO: 2212677 - RNA, 15 nt, Human
gaauguaacugcuga

SEQ ID NO: 2212678 - RNA, 21 nt, Human
gaauguauuauucugcagcau

SEQ ID NO: 2212679 - RNA, 19 nt, Human
gaauguauuauucugcagc

SEQ ID NO: 2212680 - RNA, 18 nt, Human
gaauguauuauucugcag

SEQ ID NO: 2212681 - RNA, 17 nt, Human
gaauguauuauucugca

SEQ ID NO: 2212682 - RNA, 12 nt, Human
gaauguauugua

SEQ ID NO: 2212683 - RNA, 13 nt, Human
gaauguauuguac

SEQ ID NO: 2212684 - RNA, 14 nt, Human
gaauguauuguacc

SEQ ID NO: 2212685 - RNA, 15 nt, Human
gaauguauuguaccu

SEQ ID NO: 2212686 - RNA, 16 nt, Human
gaauguauuauucugc

SEQ ID NO: 2212687 - RNA, 21 nt, Human
gaauguaugcuucauacaggg

SEQ ID NO: 2212688 - RNA, 14 nt, Human
gaaugucaguguga

SEQ ID NO: 2212689 - RNA, 23 nt, Human
gaauguauuuauuugggagaccg

SEQ ID NO: 2212690 - RNA, 16 nt, Human
gaauguauuuauuugg

SEQ ID NO: 2212691 - RNA, 13 nt, Human
gaauguauuuauu

SEQ ID NO: 2212692 - RNA, 21 nt, Human
gaauguauuguaccuuuuaac

SEQ ID NO: 2212693 - RNA, 22 nt, Human
gaauguauuguaccuuuuaaca

SEQ ID NO: 2212694 - RNA, 18 nt, Human
gaauugaggggauuaaua

SEQ ID NO: 2212695 - RNA, 18 nt, Human
gaauugaacccaggaggu

SEQ ID NO: 2212696 - RNA, 18 nt, Human
gaauugacuucgacugug

SEQ ID NO: 2212697 - RNA, 16 nt, Human
gaauugaacccaggag

SEQ ID NO: 2212698 - RNA, 15 nt, Human
gaauugaacccagga

SEQ ID NO: 2212699 - RNA, 20 nt, Human
gaauugaucauuuucccccc

SEQ ID NO: 2212700 - RNA, 15 nt, Human
gaauugaggucugcu

SEQ ID NO: 2212701 - RNA, 22 nt, Human
gaauugaggggauuaauaugaa

SEQ ID NO: 2212702 - RNA, 14 nt, Human
gaauugaagcagga

SEQ ID NO: 2212703 - RNA, 16 nt, Human
gaauucuuuuggggaa

SEQ ID NO: 2212704 - RNA, 14 nt, Human
gaauugaaaaacca

SEQ ID NO: 2212705 - RNA, 19 nt, Human
gaauucugcuaccucacug

SEQ ID NO: 2212706 - RNA, 19 nt, Human
gaauucuugguugaggaaa

SEQ ID NO: 2212707 - RNA, 20 nt, Human
gaauucuugguugaggaaac

SEQ ID NO: 2212708 - RNA, 23 nt, Human
gaauucuugaaggaaaaugauac

SEQ ID NO: 2212709 - RNA, 18 nt, Human
gaauucugcuaccucacu

SEQ ID NO: 2212710 - RNA, 17 nt, Human
gaauucuagugcugcug

SEQ ID NO: 2212711 - RNA, 15 nt, Human
gaauucuauuugcug

SEQ ID NO: 2212712 - RNA, 23 nt, Human
gaauucuaggcaucccaggggac

SEQ ID NO: 2212713 - RNA, 17 nt, Human
gaauuccuucaggguga

SEQ ID NO: 2212714 - RNA, 14 nt, Human
gaauucuagugcug

SEQ ID NO: 2212715 - RNA, 16 nt, Human
gaauucuagugcugcu

SEQ ID NO: 2212716 - RNA, 19 nt, Human
gaauucucuaguuugauua

SEQ ID NO: 2212717 - RNA, 16 nt, Human
gaauucagauuuuaaa

SEQ ID NO: 2212718 - RNA, 23 nt, Human
gaauguauuguaccuuuuaacac

SEQ ID NO: 2212719 - RNA, 23 nt, Human
gaauucaaacuggggccuccaga

SEQ ID NO: 2212720 - RNA, 20 nt, Human
gaaugucagugugacugauc

SEQ ID NO: 2212721 - RNA, 21 nt, Human
gaaugucagugugacugaucu

SEQ ID NO: 2212722 - RNA, 13 nt, Human
gaauuccaaggag

SEQ ID NO: 2212723 - RNA, 12 nt, Human
gaauuccaagga

SEQ ID NO: 2212724 - RNA, 16 nt, Human
gaauuccaaggaguuc

SEQ ID NO: 2212725 - RNA, 17 nt, Human
gaauucggugugcacca

SEQ ID NO: 2212726 - RNA, 16 nt, Human
gaauuccuucagggug

SEQ ID NO: 2212727 - RNA, 17 nt, Human
gaauucucagaaucuca

SEQ ID NO: 2212728 - RNA, 17 nt, Human
gaauucucuaguuugau

SEQ ID NO: 2212729 - RNA, 21 nt, Human
gaauugaucauuuucccccca

SEQ ID NO: 2212730 - RNA, 12 nt, Human
gaauugauuugc

SEQ ID NO: 2212731 - RNA, 17 nt, Human
gaauugauuugcauuga

SEQ ID NO: 2212732 - RNA, 15 nt, Human
gaauugauuugcauu

SEQ ID NO: 2212733 - RNA, 14 nt, Human
gaauugauuugcau

SEQ ID NO: 2212734 - RNA, 13 nt, Human
gaauugauuugca

SEQ ID NO: 2212735 - RNA, 18 nt, Human
gaauugugaccaaguuau

SEQ ID NO: 2212736 - RNA, 23 nt, Human
gaauuguccccaguuugcagaaa

SEQ ID NO: 2212737 - RNA, 14 nt, Human
gaauuguccccagu

SEQ ID NO: 2212738 - RNA, 14 nt, Human
gaauuguaucauuu

SEQ ID NO: 2212739 - RNA, 22 nt, Human
gaauuguaaggaaugauuaauu

SEQ ID NO: 2212740 - RNA, 15 nt, Human
gaauuguguuuauaa

SEQ ID NO: 2212741 - RNA, 23 nt, Human
gaauuguguuuauaauuuuaaau

SEQ ID NO: 2212742 - RNA, 18 nt, Human
gaauuuaaaaauaagaaa

SEQ ID NO: 2212743 - RNA, 16 nt, Human
gaauugugugauguuu

SEQ ID NO: 2212744 - RNA, 16 nt, Human
gaauugugucugcagg

SEQ ID NO: 2212745 - RNA, 16 nt, Human
gaauugugcucaaaau

SEQ ID NO: 2212746 - RNA, 20 nt, Human
gaauuuaucacacuucugug

SEQ ID NO: 2212747 - RNA, 16 nt, Human
gaauuuagguuuuuau

SEQ ID NO: 2212748 - RNA, 22 nt, Human
gaauuuauauacaaccugcuug

SEQ ID NO: 2212749 - RNA, 19 nt, Human
gaauuuagguuuuuauuag

SEQ ID NO: 2212750 - RNA, 13 nt, Human
gaauuuauucaau

SEQ ID NO: 2212751 - RNA, 17 nt, Human
gaauuuauucaauuccu

SEQ ID NO: 2212752 - RNA, 22 nt, Human
gaauuuaucacacuucugugag

SEQ ID NO: 2212753 - RNA, 16 nt, Human
gaauuuaauaaucugu

SEQ ID NO: 2212754 - RNA, 23 nt, Human
gaauuuaaauauaauucuguaaa

SEQ ID NO: 2212755 - RNA, 19 nt, Human
gaauuuagggagaaauguu

SEQ ID NO: 2212756 - RNA, 21 nt, Human
gaauuuagggagaaauguugu

SEQ ID NO: 2212757 - RNA, 13 nt, Human
gaauuuaaauaua

SEQ ID NO: 2212758 - RNA, 14 nt, Human
gaauuuaaauauaa

SEQ ID NO: 2212759 - RNA, 15 nt, Human
gaauuuaaauauaau

SEQ ID NO: 2212760 - RNA, 17 nt, Human
gaauuuaaauauaauuc

SEQ ID NO: 2212761 - RNA, 20 nt, Human
gaauuuaaauauaauucugu

SEQ ID NO: 2212762 - RNA, 22 nt, Human
gaauuuaaauauaauucuguaa

SEQ ID NO: 2212763 - RNA, 23 nt, Human
gaauuuauucaauuccucuggga

SEQ ID NO: 2212764 - RNA, 17 nt, Human
gaauuuauuauuguucu

SEQ ID NO: 2212765 - RNA, 15 nt, Human
gaauuucccaaagca

SEQ ID NO: 2212766 - RNA, 15 nt, Human
gaauaccuguccccc

SEQ ID NO: 2212767 - RNA, 20 nt, Human
gaauacaguguuauuuucuu

SEQ ID NO: 2212768 - RNA, 13 nt, Human
gaauaccuguccc

SEQ ID NO: 2212769 - RNA, 23 nt, Human
gaauagcugggacuacaggugug

SEQ ID NO: 2212770 - RNA, 16 nt, Human
gaauaggcgaucacaa

SEQ ID NO: 2212771 - RNA, 22 nt, Human
gaauagcugggacuacaggugu

SEQ ID NO: 2212772 - RNA, 22 nt, Human
gaauauuuguuauguagauaac

SEQ ID NO: 2212773 - RNA, 18 nt, Human
gaauauuuuaaguauugc

SEQ ID NO: 2212774 - RNA, 16 nt, Human
gaauauuuuaacuucc

SEQ ID NO: 2212775 - RNA, 17 nt, Human
gaauauuugaauguaug

SEQ ID NO: 2212776 - RNA, 18 nt, Human
gaauauuugaaucuuguc

SEQ ID NO: 2212777 - RNA, 22 nt, Human
gaauauuugaaucuugucucaa

SEQ ID NO: 2212778 - RNA, 22 nt, Human
gaauaggcgaucacaacgugca

SEQ ID NO: 2212779 - RNA, 23 nt, Human
gaauaggcgaucacaacgugcau

SEQ ID NO: 2212780 - RNA, 14 nt, Human
gaauauuugaaucu

SEQ ID NO: 2212781 - RNA, 16 nt, Human
gaauauuugaaucuug

SEQ ID NO: 2212782 - RNA, 14 nt, Human
gaaucaaaacucuc

SEQ ID NO: 2212783 - RNA, 13 nt, Human
gaaucaaaacucu

SEQ ID NO: 2212784 - RNA, 15 nt, Human
gaaucaaaacucucc

SEQ ID NO: 2212785 - RNA, 16 nt, Human
gaaucaaagacaugga

SEQ ID NO: 2212786 - RNA, 17 nt, Human
gaaucaaagacauggaa

SEQ ID NO: 2212787 - RNA, 17 nt, Human
gaaucaaagcaaugcau

SEQ ID NO: 2212788 - RNA, 18 nt, Human
gaaucaaagcaaugcauu

SEQ ID NO: 2212789 - RNA, 19 nt, Human
gaaucaaagcaaugcauuu

SEQ ID NO: 2212790 - RNA, 21 nt, Human
gaaucaagaugucagacuggc

SEQ ID NO: 2212791 - RNA, 20 nt, Human
gaaucaagcuagaaggccac

SEQ ID NO: 2212792 - RNA, 22 nt, Human
gaaucaagcuagaaggccacau

SEQ ID NO: 2212793 - RNA, 20 nt, Human
gaaucaagaugucagacugg

SEQ ID NO: 2212794 - RNA, 18 nt, Human
gaaucaagagcugcccuc

SEQ ID NO: 2212795 - RNA, 19 nt, Human
gaaucaagagcugcccucc

SEQ ID NO: 2212796 - RNA, 22 nt, Human
gaaucaaagcaguuaacuuuaa

SEQ ID NO: 2212797 - RNA, 17 nt, Human
gaaucaacauuucucaa

SEQ ID NO: 2212798 - RNA, 14 nt, Human
gaaucaagagcugc

SEQ ID NO: 2212799 - RNA, 15 nt, Human
gaaucaagagcugcc

SEQ ID NO: 2212800 - RNA, 16 nt, Human
gaaucaagagcugccc

SEQ ID NO: 2212801 - RNA, 17 nt, Human
gaaucaagagcugcccu

SEQ ID NO: 2212802 - RNA, 22 nt, Human
gaauaauaauuauccagaguuu

SEQ ID NO: 2212803 - RNA, 12 nt, Human
gaauaauagaag

SEQ ID NO: 2212804 - RNA, 16 nt, Human
gaauaauacauugaau

SEQ ID NO: 2212805 - RNA, 19 nt, Human
gaauaauaugcugccaaau

SEQ ID NO: 2212806 - RNA, 15 nt, Human
gaauaauagaagaac

SEQ ID NO: 2212807 - RNA, 17 nt, Human
gaauaauacaguaucuc

SEQ ID NO: 2212808 - RNA, 23 nt, Human
gaauaaccacuuaaaaaaugucc

SEQ ID NO: 2212809 - RNA, 15 nt, Human
gaauaacuagcacca

SEQ ID NO: 2212810 - RNA, 22 nt, Human
gaauaaccacuuaaaaaauguc

SEQ ID NO: 2212811 - RNA, 21 nt, Human
gaauaaaauacuauuuuuacu

SEQ ID NO: 2212812 - RNA, 21 nt, Human
gaauaacucuguggcauuauu

SEQ ID NO: 2212813 - RNA, 17 nt, Human
gaauaagaaaguuucac

SEQ ID NO: 2212814 - RNA, 23 nt, Human
gaauaauuucccaauuaggaagu

SEQ ID NO: 2212815 - RNA, 21 nt, Human
gaauaauuucccaauuaggaa

SEQ ID NO: 2212816 - RNA, 14 nt, Human
gaauaauuucuuac

SEQ ID NO: 2212817 - RNA, 17 nt, Human
gaauacaaacaccugga

SEQ ID NO: 2212818 - RNA, 14 nt, Human
gaauaauuucccaa

SEQ ID NO: 2212819 - RNA, 21 nt, Human
gaauaaucacgcuuuccugaa

SEQ ID NO: 2212820 - RNA, 20 nt, Human
gaauaaucacgcuuuccuga

SEQ ID NO: 2212821 - RNA, 19 nt, Human
gaauaaucacgcuuuccug

SEQ ID NO: 2212822 - RNA, 18 nt, Human
gaauaaucacgcuuuccu

SEQ ID NO: 2212823 - RNA, 13 nt, Human
gaauacaguguua

SEQ ID NO: 2212824 - RNA, 21 nt, Human
gaauacaguaagcugcucuau

SEQ ID NO: 2212825 - RNA, 23 nt, Human
gaauacagggcaugcauuuugca

SEQ ID NO: 2212826 - RNA, 14 nt, Human
gaauacagaaagau

SEQ ID NO: 2212827 - RNA, 16 nt, Human
gaauacaaacauauuu

SEQ ID NO: 2212828 - RNA, 21 nt, Human
gaauacagaggcaacugcauu

SEQ ID NO: 2212829 - RNA, 17 nt, Human
gaaguuuugcauuuaug

SEQ ID NO: 2212830 - RNA, 15 nt, Human
gaaguuuuguacaga

SEQ ID NO: 2212831 - RNA, 14 nt, Human
gaaguuuuuguacu

SEQ ID NO: 2212832 - RNA, 18 nt, Human
gaaguuuuuguacuguaa

SEQ ID NO: 2212833 - RNA, 12 nt, Human
gaaguuuugcau

SEQ ID NO: 2212834 - RNA, 13 nt, Human
gaaguuuucagga

SEQ ID NO: 2212835 - RNA, 23 nt, Human
gaaguuuucaggacuuggucuga

SEQ ID NO: 2212836 - RNA, 16 nt, Human
gaauaaaaacuuugcu

SEQ ID NO: 2212837 - RNA, 19 nt, Human
gaaguuuuuguacuguaaa

SEQ ID NO: 2212838 - RNA, 23 nt, Human
gaauaaaauacuauuuuuacugc

SEQ ID NO: 2212839 - RNA, 19 nt, Human
gaauaacauguaauuaagu

SEQ ID NO: 2212840 - RNA, 18 nt, Human
gaauaacauguaauuaag

SEQ ID NO: 2212841 - RNA, 19 nt, Human
gaaguuugauauuaaagga

SEQ ID NO: 2212842 - RNA, 13 nt, Human
gaaguuuuacauu

SEQ ID NO: 2212843 - RNA, 11 nt, Human
gaaguuuucaa

SEQ ID NO: 2212844 - RNA, 23 nt, Human
gaaguuuucaaugaugggcgagc

SEQ ID NO: 2212845 - RNA, 19 nt, Human
gaaguuugaauguuaaaua

SEQ ID NO: 2212846 - RNA, 20 nt, Human
gaaguuugaauguuaaauaa

SEQ ID NO: 2212847 - RNA, 20 nt, Human
gaaguuugagaucagccugg

SEQ ID NO: 2212848 - RNA, 13 nt, Human
gaaguuugaaugu

SEQ ID NO: 2212849 - RNA, 14 nt, Human
gaaguuugaauguu

SEQ ID NO: 2212850 - RNA, 16 nt, Human
gaaguuugaauguuaa

SEQ ID NO: 2212851 - RNA, 17 nt, Human
gaaguuugaauguuaaa

SEQ ID NO: 2212852 - RNA, 15 nt, Human
gaaguauuauaaauu

SEQ ID NO: 2212853 - RNA, 19 nt, Human
gaaguaguuuguauaacuu

SEQ ID NO: 2212854 - RNA, 14 nt, Human
gaaguauaccugau

SEQ ID NO: 2212855 - RNA, 16 nt, Human
gaaguauccuucagcc

SEQ ID NO: 2212856 - RNA, 15 nt, Human
gaagucaugaagccc

SEQ ID NO: 2212857 - RNA, 19 nt, Human
gaagucaugaagcccaagu

SEQ ID NO: 2212858 - RNA, 18 nt, Human
gaagucauaccaaugaaa

SEQ ID NO: 2212859 - RNA, 16 nt, Human
gaaguauuauaaauua

SEQ ID NO: 2212860 - RNA, 19 nt, Human
gaaguauuauaaauuaugu

SEQ ID NO: 2212861 - RNA, 20 nt, Human
gaaguauuauaaauuauguu

SEQ ID NO: 2212862 - RNA, 23 nt, Human
gaaguauuauaaauuauguuuau

SEQ ID NO: 2212863 - RNA, 23 nt, Human
gaaguaggaagugaaaauaggua

SEQ ID NO: 2212864 - RNA, 13 nt, Human
gaaguaggaagua

SEQ ID NO: 2212865 - RNA, 14 nt, Human
gaaguauccuucag

SEQ ID NO: 2212866 - RNA, 16 nt, Human
gaagucuaggagcugg

SEQ ID NO: 2212867 - RNA, 15 nt, Human
gaagucuaggagcug

SEQ ID NO: 2212868 - RNA, 22 nt, Human
gaagucuaggagcugggaggaa

SEQ ID NO: 2212869 - RNA, 20 nt, Human
gaagucuaggagcugggagg

SEQ ID NO: 2212870 - RNA, 18 nt, Human
gaagucucuagguucuga

SEQ ID NO: 2212871 - RNA, 16 nt, Human
gaagucucugaaguga

SEQ ID NO: 2212872 - RNA, 21 nt, Human
gaagucucugaagugaaacug

SEQ ID NO: 2212873 - RNA, 15 nt, Human
gaagucucuuuucuu

SEQ ID NO: 2212874 - RNA, 12 nt, Human
gaaguccaagca

SEQ ID NO: 2212875 - RNA, 22 nt, Human
gaaguccaagcauuuagaugua

SEQ ID NO: 2212876 - RNA, 15 nt, Human
gaagucuuagaugua

SEQ ID NO: 2212877 - RNA, 20 nt, Human
gaaguuucugccgcagcccu

SEQ ID NO: 2212878 - RNA, 21 nt, Human
gaaguuucugccgcagcccug

SEQ ID NO: 2212879 - RNA, 11 nt, Human
gaagucugaaa

SEQ ID NO: 2212880 - RNA, 12 nt, Human
gaaguuugaaug

SEQ ID NO: 2212881 - RNA, 15 nt, Human
gaagcgugagacgcc

SEQ ID NO: 2212882 - RNA, 21 nt, Human
gaagcccuggauuucagaaag

SEQ ID NO: 2212883 - RNA, 18 nt, Human
gaagcggucguguuguga

SEQ ID NO: 2212884 - RNA, 14 nt, Human
gaagcggcuggcag

SEQ ID NO: 2212885 - RNA, 15 nt, Human
gaagggggcugggac

SEQ ID NO: 2212886 - RNA, 17 nt, Human
gaaggggguccacccag

SEQ ID NO: 2212887 - RNA, 18 nt, Human
gaaggggguccacccagc

SEQ ID NO: 2212888 - RNA, 12 nt, Human
gaaggggguggu

SEQ ID NO: 2212889 - RNA, 19 nt, Human
gaaggggguggugucucca

SEQ ID NO: 2212890 - RNA, 22 nt, Human
gaaggugccccaaaaugcaaga

SEQ ID NO: 2212891 - RNA, 22 nt, Human
gaagggguaggauuacuaggug

SEQ ID NO: 2212892 - RNA, 16 nt, Human
gaagggggcugggaca

SEQ ID NO: 2212893 - RNA, 19 nt, Human
gaagggggcugggacaugg

SEQ ID NO: 2212894 - RNA, 20 nt, Human
gaagguuaggauuuaacagu

SEQ ID NO: 2212895 - RNA, 18 nt, Human
gaagguggccucugugga

SEQ ID NO: 2212896 - RNA, 22 nt, Human
gaagguggauggccccagcaca

SEQ ID NO: 2212897 - RNA, 22 nt, Human
gaaguaauaugcacacauuuuu

SEQ ID NO: 2212898 - RNA, 21 nt, Human
gaaggugcugacggccaggga

SEQ ID NO: 2212899 - RNA, 12 nt, Human
gaaggugcugga

SEQ ID NO: 2212900 - RNA, 14 nt, Human
gaaggugcuggagg

SEQ ID NO: 2212901 - RNA, 19 nt, Human
gaaggugcugacggccagg

SEQ ID NO: 2212902 - RNA, 18 nt, Human
gaaggugcugacggccag

SEQ ID NO: 2212903 - RNA, 16 nt, Human
gaaggugcuggaggug

SEQ ID NO: 2212904 - RNA, 17 nt, Human
gaaggugcuggaggugg

SEQ ID NO: 2212905 - RNA, 18 nt, Human
gaaggugcuggagguggg

SEQ ID NO: 2212906 - RNA, 19 nt, Human
gaaggugcuggagguggga

SEQ ID NO: 2212907 - RNA, 20 nt, Human
gaaggugcuggaggugggag

SEQ ID NO: 2212908 - RNA, 21 nt, Human
gaaggugcuggaggugggagc

SEQ ID NO: 2212909 - RNA, 23 nt, Human
gaaggugcuggaggugggagcag

SEQ ID NO: 2212910 - RNA, 15 nt, Human
gaaguaaugaauuuu

SEQ ID NO: 2212911 - RNA, 13 nt, Human
gaaguaaugaauu

SEQ ID NO: 2212912 - RNA, 23 nt, Human
gaagguggugggggugcagauga

SEQ ID NO: 2212913 - RNA, 18 nt, Human
gaaguacuauaauuuacc

SEQ ID NO: 2212914 - RNA, 13 nt, Human
gaaguagaaaggg

SEQ ID NO: 2212915 - RNA, 21 nt, Human
gaaguacguuauuguugacuu

SEQ ID NO: 2212916 - RNA, 21 nt, Human
gaaguacccguucacauuuuu

SEQ ID NO: 2212917 - RNA, 15 nt, Human
gaaguacuggagaaa

SEQ ID NO: 2212918 - RNA, 23 nt, Human
gaagagcaggcacauggaggagc

SEQ ID NO: 2212919 - RNA, 18 nt, Human
gaagagcaggcacaugga

SEQ ID NO: 2212920 - RNA, 15 nt, Human
gaagagcaggcacau

SEQ ID NO: 2212921 - RNA, 15 nt, Human
gaagagcacagcccu

SEQ ID NO: 2212922 - RNA, 20 nt, Human
gaagagcacagcccucccgc

SEQ ID NO: 2212923 - RNA, 15 nt, Human
gaagaggcgggccag

SEQ ID NO: 2212924 - RNA, 16 nt, Human
gaagaggcgggccagc

SEQ ID NO: 2212925 - RNA, 17 nt, Human
gaagaggcgggccagcc

SEQ ID NO: 2212926 - RNA, 18 nt, Human
gaagaggcgggccagcca

SEQ ID NO: 2212927 - RNA, 19 nt, Human
gaagaggcgggccagccag

SEQ ID NO: 2212928 - RNA, 16 nt, Human
gaagaggcuggugcug

SEQ ID NO: 2212929 - RNA, 15 nt, Human
gaagaggcugguucu

SEQ ID NO: 2212930 - RNA, 21 nt, Human
gaagagaguccauauuucaau

SEQ ID NO: 2212931 - RNA, 20 nt, Human
gaagagaggaguucaaugau

SEQ ID NO: 2212932 - RNA, 21 nt, Human
gaagagaggaguucaaugauc

SEQ ID NO: 2212933 - RNA, 16 nt, Human
gaagagaggaguucaa

SEQ ID NO: 2212934 - RNA, 17 nt, Human
gaagagaggaguucaau

SEQ ID NO: 2212935 - RNA, 18 nt, Human
gaagagaggaguucaaug

SEQ ID NO: 2212936 - RNA, 19 nt, Human
gaagagaggaguucaauga

SEQ ID NO: 2212937 - RNA, 13 nt, Human
gaagagaggagag

SEQ ID NO: 2212938 - RNA, 14 nt, Human
gaagagaggagagg

SEQ ID NO: 2212939 - RNA, 19 nt, Human
gaagagaggagaggagaga

SEQ ID NO: 2212940 - RNA, 21 nt, Human
gaagagaggagaggagagagg

SEQ ID NO: 2212941 - RNA, 12 nt, Human
gaagagaggagu

SEQ ID NO: 2212942 - RNA, 13 nt, Human
gaagagaggaguu

SEQ ID NO: 2212943 - RNA, 15 nt, Human
gaagagaggaguuca

SEQ ID NO: 2212944 - RNA, 18 nt, Human
gaagagaugggcuuguuu

SEQ ID NO: 2212945 - RNA, 22 nt, Human
gaagagaggaguucaaugaucu

SEQ ID NO: 2212946 - RNA, 18 nt, Human
gaagagauuuuucaugau

SEQ ID NO: 2212947 - RNA, 15 nt, Human
gaagagauuuuucau

SEQ ID NO: 2212948 - RNA, 13 nt, Human
gaagagcacagcc

SEQ ID NO: 2212949 - RNA, 14 nt, Human
gaagagcacagccc

SEQ ID NO: 2212950 - RNA, 16 nt, Human
gaagagagaucaaaug

SEQ ID NO: 2212951 - RNA, 19 nt, Human
gaagagagaucaaauggaa

SEQ ID NO: 2212952 - RNA, 16 nt, Human
gaagagagcaugagag

SEQ ID NO: 2212953 - RNA, 16 nt, Human
gaagagacugggaaga

SEQ ID NO: 2212954 - RNA, 17 nt, Human
gaagagaagggcagggc

SEQ ID NO: 2212955 - RNA, 18 nt, Human
gaagagacaggagggcaa

SEQ ID NO: 2212956 - RNA, 19 nt, Human
gaagagaaugcacaaacag

SEQ ID NO: 2212957 - RNA, 13 nt, Human
gaagacuguggcu

SEQ ID NO: 2212958 - RNA, 12 nt, Human
gaagagaaacca

SEQ ID NO: 2212959 - RNA, 20 nt, Human
gaagacuuuucuuucagcca

SEQ ID NO: 2212960 - RNA, 14 nt, Human
gaagacuuuggaaa

SEQ ID NO: 2212961 - RNA, 17 nt, Human
gaagacuuuggaaagag

SEQ ID NO: 2212962 - RNA, 13 nt, Human
gaagaaaaaauac

SEQ ID NO: 2212963 - RNA, 18 nt, Human
gaagaaaaaauacauuuu

SEQ ID NO: 2212964 - RNA, 22 nt, Human
gaagaaccaguccccccacccu

SEQ ID NO: 2212965 - RNA, 19 nt, Human
gaagaaccaguccccccac

SEQ ID NO: 2212966 - RNA, 14 nt, Human
gaacuuuuuguagg

SEQ ID NO: 2212967 - RNA, 18 nt, Human
gaacucaucccuaaugcu

SEQ ID NO: 2212968 - RNA, 22 nt, Human
gaacucaucccuaaugcugcag

SEQ ID NO: 2212969 - RNA, 19 nt, Human
gaacuuugcugagccugua

SEQ ID NO: 2212970 - RNA, 20 nt, Human
gaacucaucuagguaaauua

SEQ ID NO: 2212971 - RNA, 18 nt, Human
gaacucagccaagcacag

SEQ ID NO: 2212972 - RNA, 19 nt, Human
gaacucagccaagcacagu

SEQ ID NO: 2212973 - RNA, 20 nt, Human
gaacucagccaagcacagug

SEQ ID NO: 2212974 - RNA, 24 nt, Human
gaacucagccaagcacaguggugg

SEQ ID NO: 2212975 - RNA, 21 nt, Human
gaacucaucuagguaaauuac

SEQ ID NO: 2212976 - RNA, 23 nt, Human
gaacuuugaccucugcagcaaua

SEQ ID NO: 2212977 - RNA, 12 nt, Human
gaagacuguggc

SEQ ID NO: 2212978 - RNA, 11 nt, Human
gaagacugugg

SEQ ID NO: 2212979 - RNA, 20 nt, Human
gaagacugucagcuuccaaa

SEQ ID NO: 2212980 - RNA, 17 nt, Human
gaagacuggaagcuaau

SEQ ID NO: 2212981 - RNA, 16 nt, Human
gaagacuggaagcuaa

SEQ ID NO: 2212982 - RNA, 15 nt, Human
gaagacuggaagcua

SEQ ID NO: 2212983 - RNA, 19 nt, Human
gaagaacugcaggcccugg

SEQ ID NO: 2212984 - RNA, 11 nt, Human
gaagacuuugg

SEQ ID NO: 2212985 - RNA, 13 nt, Human
gaagacuuuggaa

SEQ ID NO: 2212986 - RNA, 13 nt, Human
gaagaacugcagg

SEQ ID NO: 2212987 - RNA, 14 nt, Human
gaagaacugcaggc

SEQ ID NO: 2212988 - RNA, 15 nt, Human
gaagaacugcaggcc

SEQ ID NO: 2212989 - RNA, 19 nt, Human
gaagacugcauuauauuua

SEQ ID NO: 2212990 - RNA, 13 nt, Human
gaagaacggggcu

SEQ ID NO: 2212991 - RNA, 20 nt, Human
gaagaacggggcucuucuca

SEQ ID NO: 2212992 - RNA, 22 nt, Human
gaagaacggggcucuucucauu

SEQ ID NO: 2212993 - RNA, 23 nt, Human
gaagaacggggcucuucucauuu

SEQ ID NO: 2212994 - RNA, 12 nt, Human
gaagaacugaaa

SEQ ID NO: 2212995 - RNA, 23 nt, Human
gaagcccaggccccuuuucacuc

SEQ ID NO: 2212996 - RNA, 21 nt, Human
gaagcccccagcuaagaaccu

SEQ ID NO: 2212997 - RNA, 17 nt, Human
gaagcccccagcuaaga

SEQ ID NO: 2212998 - RNA, 14 nt, Human
gaagcccccagcua

SEQ ID NO: 2212999 - RNA, 20 nt, Human
gaagcccccaccgugggcag

SEQ ID NO: 2213000 - RNA, 22 nt, Human
gaagcccccagcuaagaaccug

SEQ ID NO: 2213001 - RNA, 14 nt, Human
gaagccccuucccc

SEQ ID NO: 2213002 - RNA, 17 nt, Human
gaagccccuuccccaug

SEQ ID NO: 2213003 - RNA, 19 nt, Human
gaagccccuuccccauggg

SEQ ID NO: 2213004 - RNA, 19 nt, Human
gaagcccuccuuccacgga

SEQ ID NO: 2213005 - RNA, 16 nt, Human
gaagcccuccuuccac

SEQ ID NO: 2213006 - RNA, 15 nt, Human
gaagcccuccuucca

SEQ ID NO: 2213007 - RNA, 14 nt, Human
gaagcccuccuucc

SEQ ID NO: 2213008 - RNA, 12 nt, Human
gaagcccuccuu

SEQ ID NO: 2213009 - RNA, 11 nt, Human
gaagcccuccu

SEQ ID NO: 2213010 - RNA, 17 nt, Human
gaagcccuccaaaagca

SEQ ID NO: 2213011 - RNA, 22 nt, Human
gaagcccuggauuucagaaaga

SEQ ID NO: 2213012 - RNA, 19 nt, Human
gaagcccuggauuucagaa

SEQ ID NO: 2213013 - RNA, 18 nt, Human
gaagcccuggauuucaga

SEQ ID NO: 2213014 - RNA, 11 nt, Human
gaagcccugga

SEQ ID NO: 2213015 - RNA, 23 nt, Human
gaagcccuucuaccuuccugcaa

SEQ ID NO: 2213016 - RNA, 20 nt, Human
gaagccagcaggcucucagg

SEQ ID NO: 2213017 - RNA, 19 nt, Human
gaagccagcaggcucucag

SEQ ID NO: 2213018 - RNA, 17 nt, Human
gaagccacaggccugag

SEQ ID NO: 2213019 - RNA, 18 nt, Human
gaagccacaggccugaga

SEQ ID NO: 2213020 - RNA, 21 nt, Human
gaagccagcaggcucucaggc

SEQ ID NO: 2213021 - RNA, 22 nt, Human
gaagccagcaggcucucaggcc

SEQ ID NO: 2213022 - RNA, 13 nt, Human
gaagcccaggaaa

SEQ ID NO: 2213023 - RNA, 15 nt, Human
gaagcccaggaaagg

SEQ ID NO: 2213024 - RNA, 16 nt, Human
gaagcccaggaaaggc

SEQ ID NO: 2213025 - RNA, 19 nt, Human
gaagcccaggaaaggcucc

SEQ ID NO: 2213026 - RNA, 17 nt, Human
gaagcauuuacuuugug

SEQ ID NO: 2213027 - RNA, 22 nt, Human
gaagcauuccuucuuugauaau

SEQ ID NO: 2213028 - RNA, 15 nt, Human
gaagcauuccuucuu

SEQ ID NO: 2213029 - RNA, 18 nt, Human
gaagcauuccuucuuuga

SEQ ID NO: 2213030 - RNA, 21 nt, Human
gaagcauuaacuucucuggaa

SEQ ID NO: 2213031 - RNA, 15 nt, Human
gaagcauucagagag

SEQ ID NO: 2213032 - RNA, 16 nt, Human
gaagcauucagagagc

SEQ ID NO: 2213033 - RNA, 17 nt, Human
gaagcauucagagagca

SEQ ID NO: 2213034 - RNA, 13 nt, Human
gaagauguuuaac

SEQ ID NO: 2213035 - RNA, 21 nt, Human
gaagauguuuaacuuaaucaa

SEQ ID NO: 2213036 - RNA, 22 nt, Human
gaagauguuuaacuuaaucaau

SEQ ID NO: 2213037 - RNA, 15 nt, Human
gaagauguuucaaaa

SEQ ID NO: 2213038 - RNA, 17 nt, Human
gaagcauuaacuucucu

SEQ ID NO: 2213039 - RNA, 18 nt, Human
gaagcauuaacuucucug

SEQ ID NO: 2213040 - RNA, 20 nt, Human
gaagcauuaacuucucugga

SEQ ID NO: 2213041 - RNA, 20 nt, Human
gaagccaauucagacaggca

SEQ ID NO: 2213042 - RNA, 15 nt, Human
gaagccacaggccug

SEQ ID NO: 2213043 - RNA, 16 nt, Human
gaagccacaggccuga

SEQ ID NO: 2213044 - RNA, 18 nt, Human
gaagccaauucagacagg

SEQ ID NO: 2213045 - RNA, 22 nt, Human
gaagccaaguggggugcuggga

SEQ ID NO: 2213046 - RNA, 23 nt, Human
gaagccaaguggggugcugggag

SEQ ID NO: 2213047 - RNA, 21 nt, Human
gaagccaagggaaaggggugc

SEQ ID NO: 2213048 - RNA, 13 nt, Human
gaagccaaguggg

SEQ ID NO: 2213049 - RNA, 19 nt, Human
gaagccaaguggggugcug

SEQ ID NO: 2213050 - RNA, 21 nt, Human
gaagccaaguggggugcuggg

SEQ ID NO: 2213051 - RNA, 14 nt, Human
gaagccaagggaaa

SEQ ID NO: 2213052 - RNA, 15 nt, Human
gaagccaagggaaag

SEQ ID NO: 2213053 - RNA, 16 nt, Human
gaagccaagggaaagg

SEQ ID NO: 2213054 - RNA, 17 nt, Human
gaagccaagggaaaggg

SEQ ID NO: 2213055 - RNA, 19 nt, Human
gaagccaagggaaaggggu

SEQ ID NO: 2213056 - RNA, 20 nt, Human
gaagccaagggaaaggggug

SEQ ID NO: 2213057 - RNA, 20 nt, Human
gaagagggagaagcaugaaa

SEQ ID NO: 2213058 - RNA, 11 nt, Human
gaagaggcuuc

SEQ ID NO: 2213059 - RNA, 19 nt, Human
gaagagggauaagguaccu

SEQ ID NO: 2213060 - RNA, 13 nt, Human
gaagagggccugu

SEQ ID NO: 2213061 - RNA, 12 nt, Human
gaagagggcugc

SEQ ID NO: 2213062 - RNA, 20 nt, Human
gaagagggccugugggagcc

SEQ ID NO: 2213063 - RNA, 14 nt, Human
gaagaggggacagg

SEQ ID NO: 2213064 - RNA, 19 nt, Human
gaagaggggacaggucccu

SEQ ID NO: 2213065 - RNA, 11 nt, Human
gaagaggggca

SEQ ID NO: 2213066 - RNA, 13 nt, Human
gaagaggggcagc

SEQ ID NO: 2213067 - RNA, 14 nt, Human
gaagaggggcagcc

SEQ ID NO: 2213068 - RNA, 15 nt, Human
gaagaggggcagccc

SEQ ID NO: 2213069 - RNA, 17 nt, Human
gaagaggggcagcccuu

SEQ ID NO: 2213070 - RNA, 20 nt, Human
gaagauaauauuaaggaaga

SEQ ID NO: 2213071 - RNA, 21 nt, Human
gaagauaaguguauuuuucaa

SEQ ID NO: 2213072 - RNA, 18 nt, Human
gaagaggggcagcccuug

SEQ ID NO: 2213073 - RNA, 13 nt, Human
gaagauaggcucu

SEQ ID NO: 2213074 - RNA, 17 nt, Human
gaagauaggcucugcac

SEQ ID NO: 2213075 - RNA, 16 nt, Human
gaagauaggcucugca

SEQ ID NO: 2213076 - RNA, 15 nt, Human
gaagauaggcucugc

SEQ ID NO: 2213077 - RNA, 18 nt, Human
gaagauguagaggagaaa

SEQ ID NO: 2213078 - RNA, 14 nt, Human
gaacaguguuuccc

SEQ ID NO: 2213079 - RNA, 15 nt, Human
gaacauaaaauacaa

SEQ ID NO: 2213080 - RNA, 18 nt, Human
gaacagugcuugccacag

SEQ ID NO: 2213081 - RNA, 23 nt, Human
gaacagccaaaugcauggugcag

SEQ ID NO: 2213082 - RNA, 18 nt, Human
gaacagugaggugcccag

SEQ ID NO: 2213083 - RNA, 18 nt, Human
gaacauacuggcugguga

SEQ ID NO: 2213084 - RNA, 18 nt, Human
gaacauauuguugaaagg

SEQ ID NO: 2213085 - RNA, 12 nt, Human
gaacauauuguu

SEQ ID NO: 2213086 - RNA, 13 nt, Human
gaacauacuucag

SEQ ID NO: 2213087 - RNA, 20 nt, Human
gaacaucaucaaggcacugc

SEQ ID NO: 2213088 - RNA, 23 nt, Human
gaacaucaccgacgcgucuccug

SEQ ID NO: 2213089 - RNA, 12 nt, Human
gaacauccaagg

SEQ ID NO: 2213090 - RNA, 15 nt, Human
gaacaucauuagaac

SEQ ID NO: 2213091 - RNA, 18 nt, Human
gaacauccaaccuuccca

SEQ ID NO: 2213092 - RNA, 17 nt, Human
gaacauccaaccuuccc

SEQ ID NO: 2213093 - RNA, 21 nt, Human
gaacaucaucaaggcacugcc

SEQ ID NO: 2213094 - RNA, 22 nt, Human
gaacaucaucaaggcacugccu

SEQ ID NO: 2213095 - RNA, 23 nt, Human
gaacagcuaugggagccccaggg

SEQ ID NO: 2213096 - RNA, 22 nt, Human
gaacagcuaugggagccccagg

SEQ ID NO: 2213097 - RNA, 21 nt, Human
gaacagcuaugggagccccag

SEQ ID NO: 2213098 - RNA, 18 nt, Human
gaacagccgcuccugucu

SEQ ID NO: 2213099 - RNA, 21 nt, Human
gaacagcggcuggacuuggag

SEQ ID NO: 2213100 - RNA, 22 nt, Human
gaacagccaaaugcauggugca

SEQ ID NO: 2213101 - RNA, 17 nt, Human
gaacagauucacacugu

SEQ ID NO: 2213102 - RNA, 21 nt, Human
gaacagauucacacugucugg

SEQ ID NO: 2213103 - RNA, 20 nt, Human
gaacagugauuaccagggac

SEQ ID NO: 2213104 - RNA, 16 nt, Human
gaacagugauuaccag

SEQ ID NO: 2213105 - RNA, 23 nt, Human
gaacacugcacucuuaagcuucc

SEQ ID NO: 2213106 - RNA, 21 nt, Human
gaacagauguuucuuuuguau

SEQ ID NO: 2213107 - RNA, 15 nt, Human
gaacacucugagacu

SEQ ID NO: 2213108 - RNA, 18 nt, Human
gaacacucuuuugcuuua

SEQ ID NO: 2213109 - RNA, 16 nt, Human
gaacacucuuuugcuu

SEQ ID NO: 2213110 - RNA, 23 nt, Human
gaaauuucagauucccagagcaa

SEQ ID NO: 2213111 - RNA, 21 nt, Human
gaaauuucagauucccagagc

SEQ ID NO: 2213112 - RNA, 17 nt, Human
gaaaauaaaaaguuaaa

SEQ ID NO: 2213113 - RNA, 19 nt, Human
gaaaauacaacuuaaauaa

SEQ ID NO: 2213114 - RNA, 23 nt, Human
gaaaauaaaucaaugcuauaacu

SEQ ID NO: 2213115 - RNA, 19 nt, Human
gaaaauagcucuuucaggg

SEQ ID NO: 2213116 - RNA, 20 nt, Human
gaaaauaguaaaugcuuugu

SEQ ID NO: 2213117 - RNA, 16 nt, Human
gaaaauauaaccagcc

SEQ ID NO: 2213118 - RNA, 12 nt, Human
gaaaauauacug

SEQ ID NO: 2213119 - RNA, 16 nt, Human
gaaaauauacuguaaa

SEQ ID NO: 2213120 - RNA, 15 nt, Human
gaaaauauacuguaa

SEQ ID NO: 2213121 - RNA, 14 nt, Human
gaaaauauacugua

SEQ ID NO: 2213122 - RNA, 13 nt, Human
gaaaauauacugu

SEQ ID NO: 2213123 - RNA, 16 nt, Human
gaaauuguauuacaaa

SEQ ID NO: 2213124 - RNA, 18 nt, Human
gaaauuguauuacaaauc

SEQ ID NO: 2213125 - RNA, 18 nt, Human
gaaauuguacauauuugu

SEQ ID NO: 2213126 - RNA, 17 nt, Human
gaaaauauacuguaaag

SEQ ID NO: 2213127 - RNA, 16 nt, Human
gaaauuuauaaacuuu

SEQ ID NO: 2213128 - RNA, 17 nt, Human
gaaauuuauaaacuuuu

SEQ ID NO: 2213129 - RNA, 11 nt, Human
gaaauuucaga

SEQ ID NO: 2213130 - RNA, 23 nt, Human
gaaauuuauuuccuaguucugua

SEQ ID NO: 2213131 - RNA, 22 nt, Human
gaaauuuauuuccuaguucugu

SEQ ID NO: 2213132 - RNA, 19 nt, Human
gaaauuuauuaguuaauau

SEQ ID NO: 2213133 - RNA, 21 nt, Human
gaaauuuauuaguuaauauau

SEQ ID NO: 2213134 - RNA, 13 nt, Human
gaacacucugaga

SEQ ID NO: 2213135 - RNA, 14 nt, Human
gaacacucugagac

SEQ ID NO: 2213136 - RNA, 11 nt, Human
gaaccaaagcg

SEQ ID NO: 2213137 - RNA, 17 nt, Human
gaaccuagaagggcuag

SEQ ID NO: 2213138 - RNA, 16 nt, Human
gaaccucacgcaccuc

SEQ ID NO: 2213139 - RNA, 17 nt, Human
gaaccaaagagacugga

SEQ ID NO: 2213140 - RNA, 20 nt, Human
gaaccaaagagacuggagca

SEQ ID NO: 2213141 - RNA, 21 nt, Human
gaaccaaagagacuggagcau

SEQ ID NO: 2213142 - RNA, 21 nt, Human
gaaccucacgcaccucccauc

SEQ ID NO: 2213143 - RNA, 11 nt, Human
gaaccucacuc

SEQ ID NO: 2213144 - RNA, 16 nt, Human
gaaccucacucuugcc

SEQ ID NO: 2213145 - RNA, 17 nt, Human
gaaccucacucuugcca

SEQ ID NO: 2213146 - RNA, 20 nt, Human
gaaccucacgcaccucccau

SEQ ID NO: 2213147 - RNA, 19 nt, Human
gaaccucacgcaccuccca

SEQ ID NO: 2213148 - RNA, 18 nt, Human
gaaccucacgcaccuccc

SEQ ID NO: 2213149 - RNA, 17 nt, Human
gaaccucacgcaccucc

SEQ ID NO: 2213150 - RNA, 13 nt, Human
gaaccucagccug

SEQ ID NO: 2213151 - RNA, 12 nt, Human
gaaccucagccu

SEQ ID NO: 2213152 - RNA, 18 nt, Human
gaaccucacucuugccaa

SEQ ID NO: 2213153 - RNA, 19 nt, Human
gaaccucacucuugccaac

SEQ ID NO: 2213154 - RNA, 20 nt, Human
gaaccucacucuugccaacc

SEQ ID NO: 2213155 - RNA, 21 nt, Human
gaaccucacucuugccaaccu

SEQ ID NO: 2213156 - RNA, 14 nt, Human
gaacaucccuccug

SEQ ID NO: 2213157 - RNA, 23 nt, Human
gaacauugcauauaacuuauauu

SEQ ID NO: 2213158 - RNA, 23 nt, Human
gaacauccaaggagaaacagaga

SEQ ID NO: 2213159 - RNA, 20 nt, Human
gaacauccaaggagaaacag

SEQ ID NO: 2213160 - RNA, 21 nt, Human
gaacauugcauauaacuuaua

SEQ ID NO: 2213161 - RNA, 18 nt, Human
gaaccucaggcuuccuug

SEQ ID NO: 2213162 - RNA, 15 nt, Human
gaaccucauccagcu

SEQ ID NO: 2213163 - RNA, 16 nt, Human
gaaccuccucugugaa

SEQ ID NO: 2213164 - RNA, 13 nt, Human
gaaccuccuuucu

SEQ ID NO: 2213165 - RNA, 15 nt, Human
gaaccuccucuguga

SEQ ID NO: 2213166 - RNA, 14 nt, Human
gaaccuccucugug

SEQ ID NO: 2213167 - RNA, 13 nt, Human
gaaccuccucugu

SEQ ID NO: 2213168 - RNA, 14 nt, Human
gaaccucaggcuuc

SEQ ID NO: 2213169 - RNA, 11 nt, Human
gaaccucaggc

SEQ ID NO: 2213170 - RNA, 21 nt, Human
gaaccucagccuggccagaca

SEQ ID NO: 2213171 - RNA, 19 nt, Human
gaaccucagccuggccaga

SEQ ID NO: 2213172 - RNA, 18 nt, Human
gaaccucagccuggccag

SEQ ID NO: 2213173 - RNA, 17 nt, Human
gaaccucagccuggcca

SEQ ID NO: 2213174 - RNA, 15 nt, Human
gaaccucagccuggc

SEQ ID NO: 2213175 - RNA, 14 nt, Human
gaaccucagccugg

SEQ ID NO: 2213176 - RNA, 14 nt, Human
gaaccucuucccca

SEQ ID NO: 2213177 - RNA, 13 nt, Human
gaaccucuucccc

SEQ ID NO: 2213178 - RNA, 18 nt, Human
gaaccuuuugagugccuu

SEQ ID NO: 2213179 - RNA, 19 nt, Human
gaaccuuuugagugccuua

SEQ ID NO: 2213180 - RNA, 21 nt, Human
gaaccuuuugagugccuuaca

SEQ ID NO: 2213181 - RNA, 14 nt, Human
gaacgagaggggaa

SEQ ID NO: 2213182 - RNA, 12 nt, Human
gaacgcagcccu

SEQ ID NO: 2213183 - RNA, 18 nt, Human
gaacgauuuagaaagaag

SEQ ID NO: 2213184 - RNA, 22 nt, Human
gaacgcagcccuagagccugcc

SEQ ID NO: 2213185 - RNA, 23 nt, Human
gaacgcagcccuagagccugccu

SEQ ID NO: 2213186 - RNA, 16 nt, Human
gaacgcagcccuagag

SEQ ID NO: 2213187 - RNA, 17 nt, Human
gaacgcagcccuagagc

SEQ ID NO: 2213188 - RNA, 20 nt, Human
gaacgcagcccuagagccug

SEQ ID NO: 2213189 - RNA, 21 nt, Human
gaacgcagcccuagagccugc

SEQ ID NO: 2213190 - RNA, 17 nt, Human
gaaccucuuccccagaa

SEQ ID NO: 2213191 - RNA, 21 nt, Human
gaacgacaauagcuuuacccu

SEQ ID NO: 2213192 - RNA, 22 nt, Human
gaaccuuuugagugccuuacac

SEQ ID NO: 2213193 - RNA, 12 nt, Human
gaacguuuuucc

SEQ ID NO: 2213194 - RNA, 20 nt, Human
gaacgcccccccccaccccu

SEQ ID NO: 2213195 - RNA, 20 nt, Human
gaacgcguguguacacggga

SEQ ID NO: 2213196 - RNA, 19 nt, Human
gaacgcccccccccacccc

SEQ ID NO: 2213197 - RNA, 18 nt, Human
gaacgcccccccccaccc

SEQ ID NO: 2213198 - RNA, 15 nt, Human
gaacguuuuuccugu

SEQ ID NO: 2213199 - RNA, 17 nt, Human
gaacuaaacucauuuau

SEQ ID NO: 2213200 - RNA, 12 nt, Human
gaacuaaacuuu

SEQ ID NO: 2213201 - RNA, 18 nt, Human
gaacuaaacuuucacacc

SEQ ID NO: 2213202 - RNA, 16 nt, Human
gaacuaaacuuucaca

SEQ ID NO: 2213203 - RNA, 14 nt, Human
gaacuaaacuuuca

SEQ ID NO: 2213204 - RNA, 15 nt, Human
gaacuaauaaaagca

SEQ ID NO: 2213205 - RNA, 22 nt, Human
gaacuacaaacaaaauuucuau

SEQ ID NO: 2213206 - RNA, 23 nt, Human
gaacuacaaacaaaauuucuauu

SEQ ID NO: 2213207 - RNA, 19 nt, Human
gaacuaccuugguuccccc

SEQ ID NO: 2213208 - RNA, 17 nt, Human
gaacuaaacuuucacac

SEQ ID NO: 2213209 - RNA, 17 nt, Human
gaacuaacacuauuuua

SEQ ID NO: 2213210 - RNA, 22 nt, Human
gaacuacgcuugcucauuuuuu

SEQ ID NO: 2213211 - RNA, 20 nt, Human
gaacuaccuugguuccccca

SEQ ID NO: 2213212 - RNA, 19 nt, Human
gaacuagaauuugauuauu

SEQ ID NO: 2213213 - RNA, 14 nt, Human
gaacuacugaggau

SEQ ID NO: 2213214 - RNA, 21 nt, Human
gaacucagauccagggacaga

SEQ ID NO: 2213215 - RNA, 22 nt, Human
gaacucaccuggggcugcuggc

SEQ ID NO: 2213216 - RNA, 18 nt, Human
gaacucagaucugucuga

SEQ ID NO: 2213217 - RNA, 14 nt, Human
gaacucagccaagc

SEQ ID NO: 2213218 - RNA, 15 nt, Human
gaacucagccaagca

SEQ ID NO: 2213219 - RNA, 16 nt, Human
gaacucagccaagcac

SEQ ID NO: 2213220 - RNA, 17 nt, Human
gaacucagccaagcaca

SEQ ID NO: 2213221 - RNA, 19 nt, Human
gaacucagauccagggaca

SEQ ID NO: 2213222 - RNA, 18 nt, Human
gaacucagauccagggac

SEQ ID NO: 2213223 - RNA, 16 nt, Human
gaacucagauccaggg

SEQ ID NO: 2213224 - RNA, 15 nt, Human
gaacucagauccagg

SEQ ID NO: 2213225 - RNA, 16 nt, Human
gaacucacuggggccu

SEQ ID NO: 2213226 - RNA, 14 nt, Human
gaacucacuggggc

SEQ ID NO: 2213227 - RNA, 14 nt, Human
gaacucagauccag

SEQ ID NO: 2213228 - RNA, 13 nt, Human
gaacucagaucca

SEQ ID NO: 2213229 - RNA, 16 nt, Human
gaacucaacuuugaca

SEQ ID NO: 2213230 - RNA, 16 nt, Human
gaacucaccuggggcu

SEQ ID NO: 2213231 - RNA, 21 nt, Human
gaacucaccuggggcugcugg

SEQ ID NO: 2213232 - RNA, 16 nt, Human
gacguggcucagccag

SEQ ID NO: 2213233 - RNA, 15 nt, Human
gacguggcucagcca

SEQ ID NO: 2213234 - RNA, 11 nt, Human
gacguguuaug

SEQ ID NO: 2213235 - RNA, 14 nt, Human
gacguguuaugacu

SEQ ID NO: 2213236 - RNA, 15 nt, Human
gacguguuaugacuc

SEQ ID NO: 2213237 - RNA, 18 nt, Human
gacguuuacaagcccccc

SEQ ID NO: 2213238 - RNA, 22 nt, Human
gacguuccagccggcauggcug

SEQ ID NO: 2213239 - RNA, 21 nt, Human
gacguucggggcaugcugggg

SEQ ID NO: 2213240 - RNA, 15 nt, Human
gacguuccagccggc

SEQ ID NO: 2213241 - RNA, 18 nt, Human
gacuaaaaauauuauaac

SEQ ID NO: 2213242 - RNA, 13 nt, Human
gacguuuccauca

SEQ ID NO: 2213243 - RNA, 12 nt, Human
gacuaaaagaua

SEQ ID NO: 2213244 - RNA, 13 nt, Human
gacuaaaagauau

SEQ ID NO: 2213245 - RNA, 17 nt, Human
gacuaaaagauauaagu

SEQ ID NO: 2213246 - RNA, 18 nt, Human
gacuaaaagauauaagug

SEQ ID NO: 2213247 - RNA, 19 nt, Human
gacuaaaagauauaagugc

SEQ ID NO: 2213248 - RNA, 20 nt, Human
gacuaaaagauauaagugcu

SEQ ID NO: 2213249 - RNA, 21 nt, Human
gacuaaaagauauaagugcug

SEQ ID NO: 2213250 - RNA, 22 nt, Human
gacuaaaagauauaagugcugu

SEQ ID NO: 2213251 - RNA, 23 nt, Human
gacuaaaagauauaagugcugua

SEQ ID NO: 2213252 - RNA, 18 nt, Human
gacuaaccccaccacacc

SEQ ID NO: 2213253 - RNA, 18 nt, Human
gacuaaagagagaaugua

SEQ ID NO: 2213254 - RNA, 17 nt, Human
gacuaaagagagaaugu

SEQ ID NO: 2213255 - RNA, 14 nt, Human
gacuaaagagagaa

SEQ ID NO: 2213256 - RNA, 13 nt, Human
gacuaaagagaga

SEQ ID NO: 2213257 - RNA, 10 nt, Human
gacuaaagag

SEQ ID NO: 2213258 - RNA, 14 nt, Human
gacuaagcccuguc

SEQ ID NO: 2213259 - RNA, 22 nt, Human
gacuaagcccugucgagacacu

SEQ ID NO: 2213260 - RNA, 17 nt, Human
gacuaauauauuaauau

SEQ ID NO: 2213261 - RNA, 23 nt, Human
gacuaagcccugucgagacacuu

SEQ ID NO: 2213262 - RNA, 15 nt, Human
gacuaagccuaccug

SEQ ID NO: 2213263 - RNA, 18 nt, Human
gacuaagccuaccugcuc

SEQ ID NO: 2213264 - RNA, 21 nt, Human
gacuaagccuaccugcucucc

SEQ ID NO: 2213265 - RNA, 16 nt, Human
gacuaacuugucuuug

SEQ ID NO: 2213266 - RNA, 23 nt, Human
gacuaacuugucuuuggacccug

SEQ ID NO: 2213267 - RNA, 12 nt, Human
gacggcugggca

SEQ ID NO: 2213268 - RNA, 13 nt, Human
gacggcugggcac

SEQ ID NO: 2213269 - RNA, 18 nt, Human
gacggcugggcacacgcc

SEQ ID NO: 2213270 - RNA, 19 nt, Human
gacggcaggcucacugcca

SEQ ID NO: 2213271 - RNA, 23 nt, Human
gacggccugaugcucccuccccu

SEQ ID NO: 2213272 - RNA, 22 nt, Human
gacggccugaugcucccucccc

SEQ ID NO: 2213273 - RNA, 20 nt, Human
gacggccugaugcucccucc

SEQ ID NO: 2213274 - RNA, 15 nt, Human
gacggccugaugcuc

SEQ ID NO: 2213275 - RNA, 11 nt, Human
gacggcaggcu

SEQ ID NO: 2213276 - RNA, 16 nt, Human
gacggcaggcucacug

SEQ ID NO: 2213277 - RNA, 20 nt, Human
gacggcaggcucacugccag

SEQ ID NO: 2213278 - RNA, 14 nt, Human
gacggagccgggaa

SEQ ID NO: 2213279 - RNA, 21 nt, Human
gacggaagccuuuuuccccaa

SEQ ID NO: 2213280 - RNA, 19 nt, Human
gacggcacccacccagcac

SEQ ID NO: 2213281 - RNA, 19 nt, Human
gacggagucucgcucuguc

SEQ ID NO: 2213282 - RNA, 17 nt, Human
gacgugauuuugcugua

SEQ ID NO: 2213283 - RNA, 18 nt, Human
gacgugcaccuguacuca

SEQ ID NO: 2213284 - RNA, 23 nt, Human
gacgugcacugagagugaaguga

SEQ ID NO: 2213285 - RNA, 22 nt, Human
gacgugccuuuugcaccccucc

SEQ ID NO: 2213286 - RNA, 23 nt, Human
gacgugccuuuugcaccccuccc

SEQ ID NO: 2213287 - RNA, 14 nt, Human
gacguggcucagcc

SEQ ID NO: 2213288 - RNA, 12 nt, Human
gacguggcucag

SEQ ID NO: 2213289 - RNA, 16 nt, Human
gacgugauuuugcugu

SEQ ID NO: 2213290 - RNA, 21 nt, Human
gacguccugccaccuggggca

SEQ ID NO: 2213291 - RNA, 22 nt, Human
gacgugauucaauucaacacuc

SEQ ID NO: 2213292 - RNA, 22 nt, Human
gacgugaccggacuuuucugca

SEQ ID NO: 2213293 - RNA, 13 nt, Human
gacguccugccac

SEQ ID NO: 2213294 - RNA, 18 nt, Human
gacgucccuuuuuucucu

SEQ ID NO: 2213295 - RNA, 15 nt, Human
gacgucccugcccau

SEQ ID NO: 2213296 - RNA, 18 nt, Human
gacguccugccaccuggg

SEQ ID NO: 2213297 - RNA, 14 nt, Human
gacguccugccacc

SEQ ID NO: 2213298 - RNA, 13 nt, Human
gacggagucccac

SEQ ID NO: 2213299 - RNA, 22 nt, Human
gaccuuuagugguggccauuua

SEQ ID NO: 2213300 - RNA, 13 nt, Human
gacgcuucugaau

SEQ ID NO: 2213301 - RNA, 21 nt, Human
gacgcugugcugcccugccca

SEQ ID NO: 2213302 - RNA, 22 nt, Human
gacgcugugcugcccugcccac

SEQ ID NO: 2213303 - RNA, 22 nt, Human
gaccuuuaagagaaaugagcug

SEQ ID NO: 2213304 - RNA, 11 nt, Human
gaccuuucaau

SEQ ID NO: 2213305 - RNA, 19 nt, Human
gaccuuucaauaggaaaaa

SEQ ID NO: 2213306 - RNA, 20 nt, Human
gaccuuucaauaggaaaaac

SEQ ID NO: 2213307 - RNA, 15 nt, Human
gaccuucuaggaagc

SEQ ID NO: 2213308 - RNA, 19 nt, Human
gaccuuccugccaccaguc

SEQ ID NO: 2213309 - RNA, 23 nt, Human
gaccuuccugccaccagucacug

SEQ ID NO: 2213310 - RNA, 17 nt, Human
gaccuugaacuccuggg

SEQ ID NO: 2213311 - RNA, 12 nt, Human
gaccuucuggga

SEQ ID NO: 2213312 - RNA, 18 nt, Human
gaccuucuccaaaugaga

SEQ ID NO: 2213313 - RNA, 23 nt, Human
gaccuucuaggacgccacccagc

SEQ ID NO: 2213314 - RNA, 14 nt, Human
gaccuugaacuggg

SEQ ID NO: 2213315 - RNA, 20 nt, Human
gaccuucuccuucaccuuug

SEQ ID NO: 2213316 - RNA, 21 nt, Human
gaccuucuccuucaccuuugu

SEQ ID NO: 2213317 - RNA, 14 nt, Human
gaccuucuccuuca

SEQ ID NO: 2213318 - RNA, 19 nt, Human
gaccuucgggcugugcccg

SEQ ID NO: 2213319 - RNA, 18 nt, Human
gaccuucgggcugugccc

SEQ ID NO: 2213320 - RNA, 15 nt, Human
gaccuucuccuucac

SEQ ID NO: 2213321 - RNA, 16 nt, Human
gaccuucuccuucacc

SEQ ID NO: 2213322 - RNA, 22 nt, Human
gaccuuaucugugcgugaaaca

SEQ ID NO: 2213323 - RNA, 21 nt, Human
gaccuuaucugugcgugaaac

SEQ ID NO: 2213324 - RNA, 14 nt, Human
gaccuuaucugugc

SEQ ID NO: 2213325 - RNA, 12 nt, Human
gaccuuaucugu

SEQ ID NO: 2213326 - RNA, 16 nt, Human
gaccuucaccaaacau

SEQ ID NO: 2213327 - RNA, 19 nt, Human
gaccuucaccaaacauacu

SEQ ID NO: 2213328 - RNA, 17 nt, Human
gaccuuccaagagccug

SEQ ID NO: 2213329 - RNA, 16 nt, Human
gaccuuccaagagccu

SEQ ID NO: 2213330 - RNA, 21 nt, Human
gaccuuaggccuuccucucuc

SEQ ID NO: 2213331 - RNA, 16 nt, Human
gaccuuaguguuucug

SEQ ID NO: 2213332 - RNA, 20 nt, Human
gaccuuaguguuucugugca

SEQ ID NO: 2213333 - RNA, 21 nt, Human
gaccuuaguguuucugugcau

SEQ ID NO: 2213334 - RNA, 22 nt, Human
gaccuuaguguuucugugcaug

SEQ ID NO: 2213335 - RNA, 23 nt, Human
gaccuuaguguuucugugcaugg

SEQ ID NO: 2213336 - RNA, 18 nt, Human
gaccuuaggccuuccucu

SEQ ID NO: 2213337 - RNA, 16 nt, Human
gaccuuaggccuuccu

SEQ ID NO: 2213338 - RNA, 15 nt, Human
gaccuuaggccuucc

SEQ ID NO: 2213339 - RNA, 13 nt, Human
gaccuuaggccuu

SEQ ID NO: 2213340 - RNA, 16 nt, Human
gaccuucgggcugugc

SEQ ID NO: 2213341 - RNA, 22 nt, Human
gaccuuccucgcagagaggcca

SEQ ID NO: 2213342 - RNA, 12 nt, Human
gaccuuccugcc

SEQ ID NO: 2213343 - RNA, 14 nt, Human
gaccuuccugccac

SEQ ID NO: 2213344 - RNA, 16 nt, Human
gaccuuccugccacca

SEQ ID NO: 2213345 - RNA, 16 nt, Human
gaccuuccucgcagag

SEQ ID NO: 2213346 - RNA, 17 nt, Human
gaccuuccucgcagaga

SEQ ID NO: 2213347 - RNA, 18 nt, Human
gaccuuccucgcagagag

SEQ ID NO: 2213348 - RNA, 19 nt, Human
gaccuuccucgcagagagg

SEQ ID NO: 2213349 - RNA, 20 nt, Human
gaccuuccucgcagagaggc

SEQ ID NO: 2213350 - RNA, 21 nt, Human
gaccuuccucgcagagaggcc

SEQ ID NO: 2213351 - RNA, 23 nt, Human
gaccuuccucgcagagaggccag

SEQ ID NO: 2213352 - RNA, 22 nt, Human
gaccuuccauaaugcuacuguc

SEQ ID NO: 2213353 - RNA, 18 nt, Human
gaccuuccaagagccuga

SEQ ID NO: 2213354 - RNA, 12 nt, Human
gaccuuccucau

SEQ ID NO: 2213355 - RNA, 14 nt, Human
gaccuuccucaucc

SEQ ID NO: 2213356 - RNA, 22 nt, Human
gaccuuccucauccaccccauc

SEQ ID NO: 2213357 - RNA, 23 nt, Human
gaccuuccucauccaccccaucc

SEQ ID NO: 2213358 - RNA, 23 nt, Human
gaccugguacccuccuggcucuu

SEQ ID NO: 2213359 - RNA, 17 nt, Human
gaccuguaacuuuugua

SEQ ID NO: 2213360 - RNA, 13 nt, Human
gaccugguuuuua

SEQ ID NO: 2213361 - RNA, 22 nt, Human
gaccuggugcugccucuaccug

SEQ ID NO: 2213362 - RNA, 17 nt, Human
gaccuggugcugccucu

SEQ ID NO: 2213363 - RNA, 19 nt, Human
gaccuguccuccugguggg

SEQ ID NO: 2213364 - RNA, 12 nt, Human
gaccugugacca

SEQ ID NO: 2213365 - RNA, 21 nt, Human
gaccugucaugccccccucaa

SEQ ID NO: 2213366 - RNA, 14 nt, Human
gaccuguccuccug

SEQ ID NO: 2213367 - RNA, 15 nt, Human
gaccuguccuccugg

SEQ ID NO: 2213368 - RNA, 16 nt, Human
gaccuguccuccuggu

SEQ ID NO: 2213369 - RNA, 12 nt, Human
gaccuguaauca

SEQ ID NO: 2213370 - RNA, 15 nt, Human
gaccugucaugcccc

SEQ ID NO: 2213371 - RNA, 17 nt, Human
gaccugucaugcccccc

SEQ ID NO: 2213372 - RNA, 19 nt, Human
gaccugucaugccccccuc

SEQ ID NO: 2213373 - RNA, 20 nt, Human
gaccugucaugccccccuca

SEQ ID NO: 2213374 - RNA, 19 nt, Human
gaccuguggccaaguucuu

SEQ ID NO: 2213375 - RNA, 21 nt, Human
gaccuguggggauuucuccca

SEQ ID NO: 2213376 - RNA, 20 nt, Human
gaccuguggggauuucuccc

SEQ ID NO: 2213377 - RNA, 23 nt, Human
gaccugugagcccagcuggguca

SEQ ID NO: 2213378 - RNA, 17 nt, Human
gaccugugaccagcacu

SEQ ID NO: 2213379 - RNA, 15 nt, Human
gaccugugaccagca

SEQ ID NO: 2213380 - RNA, 15 nt, Human
gaccugugagcccag

SEQ ID NO: 2213381 - RNA, 19 nt, Human
gaccugugagcccagcugg

SEQ ID NO: 2213382 - RNA, 16 nt, Human
gaccugugagcccagc

SEQ ID NO: 2213383 - RNA, 23 nt, Human
gaccuguggggauuucucccagc

SEQ ID NO: 2213384 - RNA, 22 nt, Human
gaccuguggggauuucucccag

SEQ ID NO: 2213385 - RNA, 14 nt, Human
gaccuguggugcaa

SEQ ID NO: 2213386 - RNA, 19 nt, Human
gaccuguggugcaaaagca

SEQ ID NO: 2213387 - RNA, 19 nt, Human
gaccugugucacuacguga

SEQ ID NO: 2213388 - RNA, 17 nt, Human
gaccuguuagcagacag

SEQ ID NO: 2213389 - RNA, 15 nt, Human
gaccuguugguucca

SEQ ID NO: 2213390 - RNA, 19 nt, Human
gaccuguugguuccaagcc

SEQ ID NO: 2213391 - RNA, 19 nt, Human
gaccuguuagcagacaggc

SEQ ID NO: 2213392 - RNA, 18 nt, Human
gaccuguuagcagacagg

SEQ ID NO: 2213393 - RNA, 20 nt, Human
gacccugcgaaggggcccug

SEQ ID NO: 2213394 - RNA, 19 nt, Human
gacccuugccgucuaccug

SEQ ID NO: 2213395 - RNA, 20 nt, Human
gacccuugccgucuaccuga

SEQ ID NO: 2213396 - RNA, 23 nt, Human
gacccuugccgucuaccugaggg

SEQ ID NO: 2213397 - RNA, 22 nt, Human
gaccuggcacuggaugcagaaa

SEQ ID NO: 2213398 - RNA, 18 nt, Human
gaccuggcacuggaugca

SEQ ID NO: 2213399 - RNA, 15 nt, Human
gaccuggcagcucug

SEQ ID NO: 2213400 - RNA, 10 nt, Human
gaccuggcag

SEQ ID NO: 2213401 - RNA, 21 nt, Human
gacccugcgaaggggcccugg

SEQ ID NO: 2213402 - RNA, 21 nt, Human
gacccuugacaccugcugaga

SEQ ID NO: 2213403 - RNA, 15 nt, Human
gacccuugugguccc

SEQ ID NO: 2213404 - RNA, 17 nt, Human
gaccugguacccuccug

SEQ ID NO: 2213405 - RNA, 19 nt, Human
gaccugguacccuccuggc

SEQ ID NO: 2213406 - RNA, 21 nt, Human
gaccugguacccuccuggcuc

SEQ ID NO: 2213407 - RNA, 18 nt, Human
gaccuggcaaggacacag

SEQ ID NO: 2213408 - RNA, 16 nt, Human
gaccuggcagcucugg

SEQ ID NO: 2213409 - RNA, 18 nt, Human
gaccugggaccuccccug

SEQ ID NO: 2213410 - RNA, 14 nt, Human
gacugaugcuuuca

SEQ ID NO: 2213411 - RNA, 21 nt, Human
gacugauguugagggaacaga

SEQ ID NO: 2213412 - RNA, 18 nt, Human
gacugcacagcggccccu

SEQ ID NO: 2213413 - RNA, 21 nt, Human
gacugcacagcguccugucca

SEQ ID NO: 2213414 - RNA, 15 nt, Human
gacugcacagcggcc

SEQ ID NO: 2213415 - RNA, 20 nt, Human
gacugccagucccccugccc

SEQ ID NO: 2213416 - RNA, 24 nt, Human
gacugcauuauauuuauuacugua

SEQ ID NO: 2213417 - RNA, 14 nt, Human
gacugagcaccugc

SEQ ID NO: 2213418 - RNA, 13 nt, Human
gacugagaaauuu

SEQ ID NO: 2213419 - RNA, 19 nt, Human
gacugagcagacuggugag

SEQ ID NO: 2213420 - RNA, 12 nt, Human
gacugagccagu

SEQ ID NO: 2213421 - RNA, 14 nt, Human
gacugagccagucc

SEQ ID NO: 2213422 - RNA, 17 nt, Human
gacugagccagucccag

SEQ ID NO: 2213423 - RNA, 15 nt, Human
gacugagcagacugg

SEQ ID NO: 2213424 - RNA, 14 nt, Human
gacugagcagacug

SEQ ID NO: 2213425 - RNA, 15 nt, Human
gacugagcaccugcu

SEQ ID NO: 2213426 - RNA, 16 nt, Human
gacugagcaccugcuu

SEQ ID NO: 2213427 - RNA, 13 nt, Human
gacugagcucaag

SEQ ID NO: 2213428 - RNA, 22 nt, Human
gacugagccccgcagaccuccc

SEQ ID NO: 2213429 - RNA, 13 nt, Human
gacugaggccuga

SEQ ID NO: 2213430 - RNA, 14 nt, Human
gacugaggccugag

SEQ ID NO: 2213431 - RNA, 18 nt, Human
gacugaguacguugugca

SEQ ID NO: 2213432 - RNA, 21 nt, Human
gacugaguaagaaaugcugcc

SEQ ID NO: 2213433 - RNA, 19 nt, Human
gacugaguaagaaaugcug

SEQ ID NO: 2213434 - RNA, 16 nt, Human
gacugaggggagggga

SEQ ID NO: 2213435 - RNA, 21 nt, Human
gacugaggccugagcgcuccu

SEQ ID NO: 2213436 - RNA, 23 nt, Human
gacugaggccugagcgcuccugc

SEQ ID NO: 2213437 - RNA, 15 nt, Human
gacugagggacucug

SEQ ID NO: 2213438 - RNA, 21 nt, Human
gacugagggacucugaagccu

SEQ ID NO: 2213439 - RNA, 11 nt, Human
gacugagaaau

SEQ ID NO: 2213440 - RNA, 16 nt, Human
gacugacccugaucag

SEQ ID NO: 2213441 - RNA, 21 nt, Human
gacugaccaauauuguacagu

SEQ ID NO: 2213442 - RNA, 22 nt, Human
gacugaccaauauuguacaguu

SEQ ID NO: 2213443 - RNA, 21 nt, Human
gacucuacagaggccaugggc

SEQ ID NO: 2213444 - RNA, 16 nt, Human
gacucuacacugugaa

SEQ ID NO: 2213445 - RNA, 16 nt, Human
gacugaauuucuuuug

SEQ ID NO: 2213446 - RNA, 15 nt, Human
gacucuacagaggcc

SEQ ID NO: 2213447 - RNA, 19 nt, Human
gacucgguuucuccaaacu

SEQ ID NO: 2213448 - RNA, 20 nt, Human
gacucgucugacugugugug

SEQ ID NO: 2213449 - RNA, 18 nt, Human
gacuacaggcacccacca

SEQ ID NO: 2213450 - RNA, 13 nt, Human
gacuacaggcacc

SEQ ID NO: 2213451 - RNA, 15 nt, Human
gacuacaggcaccca

SEQ ID NO: 2213452 - RNA, 18 nt, Human
gacuccugcaggcagcca

SEQ ID NO: 2213453 - RNA, 19 nt, Human
gacuccugcaggcagccag

SEQ ID NO: 2213454 - RNA, 20 nt, Human
gacuccugcaggcagccagg

SEQ ID NO: 2213455 - RNA, 21 nt, Human
gacuccugcaggcagccaggc

SEQ ID NO: 2213456 - RNA, 16 nt, Human
gacuuauuuauauaaa

SEQ ID NO: 2213457 - RNA, 15 nt, Human
gacuuauuuucucug

SEQ ID NO: 2213458 - RNA, 22 nt, Human
gacuucacacugcaagagccuu

SEQ ID NO: 2213459 - RNA, 16 nt, Human
gacuucacacugcaag

SEQ ID NO: 2213460 - RNA, 17 nt, Human
gacuucacauaagcuca

SEQ ID NO: 2213461 - RNA, 21 nt, Human
gacuucacauaagcucagaau

SEQ ID NO: 2213462 - RNA, 14 nt, Human
gacuucacacugca

SEQ ID NO: 2213463 - RNA, 13 nt, Human
gacuucacacugc

SEQ ID NO: 2213464 - RNA, 17 nt, Human
gacuuaguauauuuucu

SEQ ID NO: 2213465 - RNA, 15 nt, Human
gacuuagcugggaga

SEQ ID NO: 2213466 - RNA, 16 nt, Human
gacuuagggcaccagg

SEQ ID NO: 2213467 - RNA, 17 nt, Human
gacuuagggcaccaggg

SEQ ID NO: 2213468 - RNA, 22 nt, Human
gacuucagggcagggcucugau

SEQ ID NO: 2213469 - RNA, 18 nt, Human
gacuucagggcagggcuc

SEQ ID NO: 2213470 - RNA, 17 nt, Human
gacuucaggggcugccc

SEQ ID NO: 2213471 - RNA, 18 nt, Human
gacuucaggggcugcccg

SEQ ID NO: 2213472 - RNA, 19 nt, Human
gacuucaggggcugcccgc

SEQ ID NO: 2213473 - RNA, 20 nt, Human
gacuucaggggcugcccgcu

SEQ ID NO: 2213474 - RNA, 21 nt, Human
gacuucaggggcugcccgcuc

SEQ ID NO: 2213475 - RNA, 23 nt, Human
gacuucaggggcugcccgcuccc

SEQ ID NO: 2213476 - RNA, 14 nt, Human
gacuucagcucugu

SEQ ID NO: 2213477 - RNA, 14 nt, Human
gacuucagggcagg

SEQ ID NO: 2213478 - RNA, 22 nt, Human
gacuucacgaaguguugcaugg

SEQ ID NO: 2213479 - RNA, 12 nt, Human
gacuucaucccu

SEQ ID NO: 2213480 - RNA, 20 nt, Human
gacuucaucccucuggggcu

SEQ ID NO: 2213481 - RNA, 16 nt, Human
gacuuagaaagcaggg

SEQ ID NO: 2213482 - RNA, 18 nt, Human
gacuuagaaagcaggggc

SEQ ID NO: 2213483 - RNA, 19 nt, Human
gacuuagaaagcaggggcu

SEQ ID NO: 2213484 - RNA, 19 nt, Human
gacuuacaugauucauuuu

SEQ ID NO: 2213485 - RNA, 14 nt, Human
gacuuaccaggaag

SEQ ID NO: 2213486 - RNA, 14 nt, Human
gacuuagaaagcag

SEQ ID NO: 2213487 - RNA, 23 nt, Human
gacuuacuguacaugaaaacaca

SEQ ID NO: 2213488 - RNA, 18 nt, Human
gacuuacuguacaugaaa

SEQ ID NO: 2213489 - RNA, 12 nt, Human
gacuuacuguac

SEQ ID NO: 2213490 - RNA, 18 nt, Human
gacuuacaugauucauuu

SEQ ID NO: 2213491 - RNA, 16 nt, Human
gacuuacaugauucau

SEQ ID NO: 2213492 - RNA, 15 nt, Human
gacuuacaugauuca

SEQ ID NO: 2213493 - RNA, 14 nt, Human
gacuuacaugauuc

SEQ ID NO: 2213494 - RNA, 16 nt, Human
gacuuacuguacauga

SEQ ID NO: 2213495 - RNA, 15 nt, Human
gacuuacuguacaug

SEQ ID NO: 2213496 - RNA, 23 nt, Human
gacuggcuagaguccucacuccc

SEQ ID NO: 2213497 - RNA, 21 nt, Human
gacuggcuagaguccucacuc

SEQ ID NO: 2213498 - RNA, 20 nt, Human
gacuggcuagaguccucacu

SEQ ID NO: 2213499 - RNA, 17 nt, Human
gacuggcuagaguccuc

SEQ ID NO: 2213500 - RNA, 22 nt, Human
gacuggccccugggucagucug

SEQ ID NO: 2213501 - RNA, 16 nt, Human
gacuggccccuggguc

SEQ ID NO: 2213502 - RNA, 14 nt, Human
gacuggccccuggg

SEQ ID NO: 2213503 - RNA, 23 nt, Human
gacuggccaagguuuggggaaga

SEQ ID NO: 2213504 - RNA, 16 nt, Human
gacuggcuggcugcag

SEQ ID NO: 2213505 - RNA, 14 nt, Human
gacuggcuggcugc

SEQ ID NO: 2213506 - RNA, 17 nt, Human
gacuggcuggcugcagu

SEQ ID NO: 2213507 - RNA, 10 nt, Human
gacuggcuuu

SEQ ID NO: 2213508 - RNA, 20 nt, Human
gacuggcuuuuauuaaugca

SEQ ID NO: 2213509 - RNA, 21 nt, Human
gacuggcuuuuauuaaugcac

SEQ ID NO: 2213510 - RNA, 22 nt, Human
gacuggcuuuuauuaaugcacu

SEQ ID NO: 2213511 - RNA, 23 nt, Human
gacuggcuuuuauuaaugcacuu

SEQ ID NO: 2213512 - RNA, 23 nt, Human
gacugggaagauaggcucugcac

SEQ ID NO: 2213513 - RNA, 22 nt, Human
gacugggaagauaggcucugca

SEQ ID NO: 2213514 - RNA, 20 nt, Human
gacugggaagauaggcucug

SEQ ID NO: 2213515 - RNA, 22 nt, Human
gacugcgggaugguccuggggc

SEQ ID NO: 2213516 - RNA, 12 nt, Human
gacugcuaaaua

SEQ ID NO: 2213517 - RNA, 21 nt, Human
gacugcgggaugguccugggg

SEQ ID NO: 2213518 - RNA, 15 nt, Human
gacugccccgugcag

SEQ ID NO: 2213519 - RNA, 20 nt, Human
gacugcgaucuucagagcag

SEQ ID NO: 2213520 - RNA, 18 nt, Human
gacugccccaacuccugg

SEQ ID NO: 2213521 - RNA, 21 nt, Human
gacugcuccccagcccuggcu

SEQ ID NO: 2213522 - RNA, 24 nt, Human
gacugcuccccagcccuggcucug

SEQ ID NO: 2213523 - RNA, 15 nt, Human
gacugcuccccagcc

SEQ ID NO: 2213524 - RNA, 19 nt, Human
gacugcuccccagcccugg

SEQ ID NO: 2213525 - RNA, 20 nt, Human
gacugcuccccagcccuggc

SEQ ID NO: 2213526 - RNA, 14 nt, Human
gacugcuaaauaaa

SEQ ID NO: 2213527 - RNA, 17 nt, Human
gacugcuaaauaaaauu

SEQ ID NO: 2213528 - RNA, 18 nt, Human
gacugcuaaauaaaauuu

SEQ ID NO: 2213529 - RNA, 15 nt, Human
gacugcuagggagug

SEQ ID NO: 2213530 - RNA, 14 nt, Human
gacuggcacaguuu

SEQ ID NO: 2213531 - RNA, 22 nt, Human
gacuggcacaguuuucugagaa

SEQ ID NO: 2213532 - RNA, 18 nt, Human
gacuggcacaguuuucug

SEQ ID NO: 2213533 - RNA, 23 nt, Human
gacagacucacaaccugaaccua

SEQ ID NO: 2213534 - RNA, 18 nt, Human
gacagacaucucugcacc

SEQ ID NO: 2213535 - RNA, 18 nt, Human
gacagaccacaucuuuau

SEQ ID NO: 2213536 - RNA, 22 nt, Human
gacagaccacaucuuuaucugu

SEQ ID NO: 2213537 - RNA, 16 nt, Human
gacagacuccugagga

SEQ ID NO: 2213538 - RNA, 19 nt, Human
gacagacuccugaggacag

SEQ ID NO: 2213539 - RNA, 23 nt, Human
gacagacuccugaggacagcugu

SEQ ID NO: 2213540 - RNA, 22 nt, Human
gacagagacaccugcaccuccc

SEQ ID NO: 2213541 - RNA, 21 nt, Human
gacagagacaccugcaccucc

SEQ ID NO: 2213542 - RNA, 18 nt, Human
gacagagacaccugcacc

SEQ ID NO: 2213543 - RNA, 17 nt, Human
gacagagacaccugcac

SEQ ID NO: 2213544 - RNA, 16 nt, Human
gacagagacaccugca

SEQ ID NO: 2213545 - RNA, 15 nt, Human
gacagagacaccugc

SEQ ID NO: 2213546 - RNA, 23 nt, Human
gacagacacuucuaaaugaagug

SEQ ID NO: 2213547 - RNA, 14 nt, Human
gacagacaggcucu

SEQ ID NO: 2213548 - RNA, 15 nt, Human
gacagacaggcucuu

SEQ ID NO: 2213549 - RNA, 21 nt, Human
gacagacaggcucuuagcagc

SEQ ID NO: 2213550 - RNA, 16 nt, Human
gacagacagcccucca

SEQ ID NO: 2213551 - RNA, 18 nt, Human
gacacuagcccaaugaaa

SEQ ID NO: 2213552 - RNA, 12 nt, Human
gacacuauaucu

SEQ ID NO: 2213553 - RNA, 13 nt, Human
gacacuauaucug

SEQ ID NO: 2213554 - RNA, 12 nt, Human
gacagaggcagc

SEQ ID NO: 2213555 - RNA, 12 nt, Human
gacagaggaggg

SEQ ID NO: 2213556 - RNA, 20 nt, Human
gacagagcugguugggaaga

SEQ ID NO: 2213557 - RNA, 20 nt, Human
gacagagcuacacaggggaa

SEQ ID NO: 2213558 - RNA, 20 nt, Human
gacagagacccucugccacc

SEQ ID NO: 2213559 - RNA, 15 nt, Human
gacagagaccuccug

SEQ ID NO: 2213560 - RNA, 16 nt, Human
gacagagaccuccugc

SEQ ID NO: 2213561 - RNA, 14 nt, Human
gacagagagagaga

SEQ ID NO: 2213562 - RNA, 19 nt, Human
gacagagggaagaaaagag

SEQ ID NO: 2213563 - RNA, 12 nt, Human
gacagaggccug

SEQ ID NO: 2213564 - RNA, 13 nt, Human
gacagaggccugc

SEQ ID NO: 2213565 - RNA, 15 nt, Human
gacagaggccugccc

SEQ ID NO: 2213566 - RNA, 23 nt, Human
gacagaggcagccccauucugcc

SEQ ID NO: 2213567 - RNA, 19 nt, Human
gacagaggccccagccucc

SEQ ID NO: 2213568 - RNA, 18 nt, Human
gacagaggccccagccuc

SEQ ID NO: 2213569 - RNA, 13 nt, Human
gacagaggcccca

SEQ ID NO: 2213570 - RNA, 15 nt, Human
gacagaggaugagcu

SEQ ID NO: 2213571 - RNA, 13 nt, Human
gacagagucuggg

SEQ ID NO: 2213572 - RNA, 16 nt, Human
gacagagggaagaaaa

SEQ ID NO: 2213573 - RNA, 13 nt, Human
gacagagggaaga

SEQ ID NO: 2213574 - RNA, 20 nt, Human
gacagagggaaacacagcag

SEQ ID NO: 2213575 - RNA, 20 nt, Human
gacagaugccccagagcugu

SEQ ID NO: 2213576 - RNA, 15 nt, Human
gacagagucugggug

SEQ ID NO: 2213577 - RNA, 19 nt, Human
gacagagugagacucuguc

SEQ ID NO: 2213578 - RNA, 21 nt, Human
gacagagucucacuguugccc

SEQ ID NO: 2213579 - RNA, 16 nt, Human
gacagagugagacucu

SEQ ID NO: 2213580 - RNA, 21 nt, Human
gaauuucaccuguaaaccuga

SEQ ID NO: 2213581 - RNA, 17 nt, Human
gaauuucaccuguaaac

SEQ ID NO: 2213582 - RNA, 12 nt, Human
gaauuucaccug

SEQ ID NO: 2213583 - RNA, 22 nt, Human
gaauuucccaaagcagugcaug

SEQ ID NO: 2213584 - RNA, 16 nt, Human
gaauuucccaaagcag

SEQ ID NO: 2213585 - RNA, 18 nt, Human
gaauuucccaaagcagug

SEQ ID NO: 2213586 - RNA, 22 nt, Human
gacacgaauauugcugauggug

SEQ ID NO: 2213587 - RNA, 17 nt, Human
gaauuucccaggacccu

SEQ ID NO: 2213588 - RNA, 16 nt, Human
gaauuucccaggaccc

SEQ ID NO: 2213589 - RNA, 15 nt, Human
gaauuucccaggacc

SEQ ID NO: 2213590 - RNA, 14 nt, Human
gaauuucccaggac

SEQ ID NO: 2213591 - RNA, 22 nt, Human
gaauuucccaggacccugaagg

SEQ ID NO: 2213592 - RNA, 15 nt, Human
gacacuaacgacuuc

SEQ ID NO: 2213593 - RNA, 17 nt, Human
gacacuaaguuauagua

SEQ ID NO: 2213594 - RNA, 23 nt, Human
gacacgcucuucuauuuuauucc

SEQ ID NO: 2213595 - RNA, 19 nt, Human
gacacggaucugagaaucu

SEQ ID NO: 2213596 - RNA, 15 nt, Human
gacacggagcccagc

SEQ ID NO: 2213597 - RNA, 20 nt, Human
gacacggaucugagaaucuu

SEQ ID NO: 2213598 - RNA, 18 nt, Human
gacacuaaguuauaguau

SEQ ID NO: 2213599 - RNA, 20 nt, Human
gacacuaaguuauaguauau

SEQ ID NO: 2213600 - RNA, 16 nt, Human
gacacuagaagauuuu

SEQ ID NO: 2213601 - RNA, 17 nt, Human
gacagacacaggcccgg

SEQ ID NO: 2213602 - RNA, 20 nt, Human
gacagacacaggcccggcuc

SEQ ID NO: 2213603 - RNA, 22 nt, Human
gacagacacaggcccggcucca

SEQ ID NO: 2213604 - RNA, 23 nt, Human
gacaggcaaugcuggcuguuggc

SEQ ID NO: 2213605 - RNA, 20 nt, Human
gacaggcauguucucugagg

SEQ ID NO: 2213606 - RNA, 21 nt, Human
gacaggcauguucucugagga

SEQ ID NO: 2213607 - RNA, 20 nt, Human
gacaggcaagcaccuccugc

SEQ ID NO: 2213608 - RNA, 21 nt, Human
gacaggcaagcaccuccugcc

SEQ ID NO: 2213609 - RNA, 18 nt, Human
gacaggcaaugcuggcug

SEQ ID NO: 2213610 - RNA, 19 nt, Human
gacaggcaaugcuggcugu

SEQ ID NO: 2213611 - RNA, 20 nt, Human
gacagcagcucaggcacacu

SEQ ID NO: 2213612 - RNA, 18 nt, Human
gacagcagcucaggcaca

SEQ ID NO: 2213613 - RNA, 16 nt, Human
gacagcagcucaggca

SEQ ID NO: 2213614 - RNA, 15 nt, Human
gacagcagcucaggc

SEQ ID NO: 2213615 - RNA, 23 nt, Human
gacaggaugguucccuugaugaa

SEQ ID NO: 2213616 - RNA, 14 nt, Human
gacagcagcucagg

SEQ ID NO: 2213617 - RNA, 13 nt, Human
gacagcagcucag

SEQ ID NO: 2213618 - RNA, 22 nt, Human
gacagcaacggggaggccaagu

SEQ ID NO: 2213619 - RNA, 19 nt, Human
gacagcaacggggaggcca

SEQ ID NO: 2213620 - RNA, 18 nt, Human
gacagaugucagccgagc

SEQ ID NO: 2213621 - RNA, 17 nt, Human
gacagaugucagccgag

SEQ ID NO: 2213622 - RNA, 13 nt, Human
gacaggcaagcac

SEQ ID NO: 2213623 - RNA, 16 nt, Human
gacagcaggugggaaa

SEQ ID NO: 2213624 - RNA, 12 nt, Human
gacagcaggugg

SEQ ID NO: 2213625 - RNA, 17 nt, Human
gacaggcaagcaccucc

SEQ ID NO: 2213626 - RNA, 18 nt, Human
gacaggcaagcaccuccu

SEQ ID NO: 2213627 - RNA, 14 nt, Human
gacauaacguuuuu

SEQ ID NO: 2213628 - RNA, 22 nt, Human
gacauaacguuuuuccuuuaaa

SEQ ID NO: 2213629 - RNA, 16 nt, Human
gacaucaacugcauca

SEQ ID NO: 2213630 - RNA, 19 nt, Human
gacaucaagcacagaagga

SEQ ID NO: 2213631 - RNA, 16 nt, Human
gacauaacguuuuucc

SEQ ID NO: 2213632 - RNA, 21 nt, Human
gacauaacguuuuuccuuuaa

SEQ ID NO: 2213633 - RNA, 15 nt, Human
gacaucacuuguaca

SEQ ID NO: 2213634 - RNA, 23 nt, Human
gacaucaacugcaucaagaugug

SEQ ID NO: 2213635 - RNA, 22 nt, Human
gacaguuuuccuucucaucugu

SEQ ID NO: 2213636 - RNA, 20 nt, Human
gacaguuuuccauaaagaag

SEQ ID NO: 2213637 - RNA, 12 nt, Human
gacaguuucuua

SEQ ID NO: 2213638 - RNA, 14 nt, Human
gacaguuucuuagc

SEQ ID NO: 2213639 - RNA, 20 nt, Human
gacaguuucuuagcuuuuua

SEQ ID NO: 2213640 - RNA, 21 nt, Human
gacaguuucuuagcuuuuuaa

SEQ ID NO: 2213641 - RNA, 23 nt, Human
gacaguuucuuagcuuuuuaauu

SEQ ID NO: 2213642 - RNA, 11 nt, Human
gacaggcccaa

SEQ ID NO: 2213643 - RNA, 16 nt, Human
gacaggcaaauaaaag

SEQ ID NO: 2213644 - RNA, 14 nt, Human
gacagggcauggcc

SEQ ID NO: 2213645 - RNA, 22 nt, Human
gacaggcauguucucugaggac

SEQ ID NO: 2213646 - RNA, 15 nt, Human
gacagggcauggcca

SEQ ID NO: 2213647 - RNA, 20 nt, Human
gacagggcauggccaggugg

SEQ ID NO: 2213648 - RNA, 15 nt, Human
gacaggcccaagaga

SEQ ID NO: 2213649 - RNA, 22 nt, Human
gacagggcauggccagguggcc

SEQ ID NO: 2213650 - RNA, 14 nt, Human
gacaggcccaagag

SEQ ID NO: 2213651 - RNA, 21 nt, Human
gacaguuauacugucgguuuu

SEQ ID NO: 2213652 - RNA, 14 nt, Human
gacaguucaagaaa

SEQ ID NO: 2213653 - RNA, 14 nt, Human
gacaguucugaaga

SEQ ID NO: 2213654 - RNA, 15 nt, Human
gacaguucauaugua

SEQ ID NO: 2213655 - RNA, 17 nt, Human
gacaguucauauguacc

SEQ ID NO: 2213656 - RNA, 18 nt, Human
gacaguugggugagaaca

SEQ ID NO: 2213657 - RNA, 15 nt, Human
gacaguucugaagaa

SEQ ID NO: 2213658 - RNA, 19 nt, Human
gacaguugggugagaacaa

SEQ ID NO: 2213659 - RNA, 19 nt, Human
gacccccgcccccugcccu

SEQ ID NO: 2213660 - RNA, 12 nt, Human
gacccccuggag

SEQ ID NO: 2213661 - RNA, 10 nt, Human
gacccugagg

SEQ ID NO: 2213662 - RNA, 14 nt, Human
gacccccuuccccu

SEQ ID NO: 2213663 - RNA, 11 nt, Human
gacccugaggc

SEQ ID NO: 2213664 - RNA, 12 nt, Human
gacccugaggcc

SEQ ID NO: 2213665 - RNA, 16 nt, Human
gacccugaggcccaga

SEQ ID NO: 2213666 - RNA, 17 nt, Human
gacccugcccugugggc

SEQ ID NO: 2213667 - RNA, 20 nt, Human
gacccugcccugugggcccc

SEQ ID NO: 2213668 - RNA, 22 nt, Human
gacccugcccugugggccccca

SEQ ID NO: 2213669 - RNA, 11 nt, Human
gacccccgccc

SEQ ID NO: 2213670 - RNA, 15 nt, Human
gacccccgcccccug

SEQ ID NO: 2213671 - RNA, 16 nt, Human
gacccccgcccccugc

SEQ ID NO: 2213672 - RNA, 18 nt, Human
gacccccgcccccugccc

SEQ ID NO: 2213673 - RNA, 18 nt, Human
gaccccagcggcugaguc

SEQ ID NO: 2213674 - RNA, 20 nt, Human
gaccccccaccaccagccgg

SEQ ID NO: 2213675 - RNA, 12 nt, Human
gaccccagagga

SEQ ID NO: 2213676 - RNA, 13 nt, Human
gacccccagcucc

SEQ ID NO: 2213677 - RNA, 23 nt, Human
gacccccagcuccggccuguccu

SEQ ID NO: 2213678 - RNA, 17 nt, Human
gacccccagcuccggcc

SEQ ID NO: 2213679 - RNA, 17 nt, Human
gacccaucacgccugug

SEQ ID NO: 2213680 - RNA, 17 nt, Human
gacccaugcugcccugu

SEQ ID NO: 2213681 - RNA, 20 nt, Human
gacccauucuacacagagca

SEQ ID NO: 2213682 - RNA, 23 nt, Human
gaccccaaacaccuuccagcucc

SEQ ID NO: 2213683 - RNA, 16 nt, Human
gaccccaaagagccug

SEQ ID NO: 2213684 - RNA, 18 nt, Human
gaccccaaagagccugga

SEQ ID NO: 2213685 - RNA, 19 nt, Human
gaccccaaagagccuggag

SEQ ID NO: 2213686 - RNA, 20 nt, Human
gaccccaaagagccuggaga

SEQ ID NO: 2213687 - RNA, 12 nt, Human
gaccccacccaa

SEQ ID NO: 2213688 - RNA, 14 nt, Human
gaccccacccaagc

SEQ ID NO: 2213689 - RNA, 21 nt, Human
gaccccaaagagccuggagaa

SEQ ID NO: 2213690 - RNA, 23 nt, Human
gaccccaaagagccuggagaagc

SEQ ID NO: 2213691 - RNA, 19 nt, Human
gaccccacccaagcuuggc

SEQ ID NO: 2213692 - RNA, 20 nt, Human
gaccccacccaagcuuggca

SEQ ID NO: 2213693 - RNA, 22 nt, Human
gaccccacccaagcuuggcagc

SEQ ID NO: 2213694 - RNA, 10 nt, Human
gacccagacc

SEQ ID NO: 2213695 - RNA, 14 nt, Human
gacccagacccagu

SEQ ID NO: 2213696 - RNA, 23 nt, Human
gacccacuucacacacaggcaac

SEQ ID NO: 2213697 - RNA, 13 nt, Human
gacccagcacugc

SEQ ID NO: 2213698 - RNA, 17 nt, Human
gacccagcacugcccaa

SEQ ID NO: 2213699 - RNA, 16 nt, Human
gacccagacccagugg

SEQ ID NO: 2213700 - RNA, 15 nt, Human
gacccagauccucac

SEQ ID NO: 2213701 - RNA, 16 nt, Human
gacccagauccucaca

SEQ ID NO: 2213702 - RNA, 20 nt, Human
gacccagauccucacaacca

SEQ ID NO: 2213703 - RNA, 19 nt, Human
gacccacuggacucaccuc

SEQ ID NO: 2213704 - RNA, 20 nt, Human
gacccaaaaggcagaagcaa

SEQ ID NO: 2213705 - RNA, 23 nt, Human
gaccagcagcgccuuucccaacu

SEQ ID NO: 2213706 - RNA, 20 nt, Human
gaccagcagcgccuuuccca

SEQ ID NO: 2213707 - RNA, 16 nt, Human
gaccagcagcgccuuu

SEQ ID NO: 2213708 - RNA, 14 nt, Human
gaccagcagcgccu

SEQ ID NO: 2213709 - RNA, 13 nt, Human
gaccagcagcgcc

SEQ ID NO: 2213710 - RNA, 19 nt, Human
gacccaaaaggcagaagca

SEQ ID NO: 2213711 - RNA, 18 nt, Human
gacccaaaaggcagaagc

SEQ ID NO: 2213712 - RNA, 16 nt, Human
gacccagucccugggg

SEQ ID NO: 2213713 - RNA, 12 nt, Human
gacccagugaga

SEQ ID NO: 2213714 - RNA, 22 nt, Human
gacccagugagauuacagagga

SEQ ID NO: 2213715 - RNA, 15 nt, Human
gacccagugccccca

SEQ ID NO: 2213716 - RNA, 23 nt, Human
gacccagccccuugagaaaccuu

SEQ ID NO: 2213717 - RNA, 16 nt, Human
gacccagcccucaucc

SEQ ID NO: 2213718 - RNA, 22 nt, Human
gacccagccccuugagaaaccu

SEQ ID NO: 2213719 - RNA, 23 nt, Human
gacccagugagauuacagaggaa

SEQ ID NO: 2213720 - RNA, 20 nt, Human
gacccagugcccccacugac

SEQ ID NO: 2213721 - RNA, 17 nt, Human
gacccagugcccccacu

SEQ ID NO: 2213722 - RNA, 16 nt, Human
gacccagugcccccac

SEQ ID NO: 2213723 - RNA, 13 nt, Human
gacccaugcugcc

SEQ ID NO: 2213724 - RNA, 14 nt, Human
gacccaguggggag

SEQ ID NO: 2213725 - RNA, 23 nt, Human
gacccaugaguuggggucuggca

SEQ ID NO: 2213726 - RNA, 18 nt, Human
gacccaugcugcccugug

SEQ ID NO: 2213727 - RNA, 19 nt, Human
gacccaugcugcccuguga

SEQ ID NO: 2213728 - RNA, 20 nt, Human
gacccaugcugcccugugag

SEQ ID NO: 2213729 - RNA, 20 nt, Human
gaccagcaacuugucuuuuu

SEQ ID NO: 2213730 - RNA, 17 nt, Human
gaccagcacugucucag

SEQ ID NO: 2213731 - RNA, 20 nt, Human
gaccagcagaucccagcuca

SEQ ID NO: 2213732 - RNA, 18 nt, Human
gaccagcagaucccagcu

SEQ ID NO: 2213733 - RNA, 17 nt, Human
gaccagcagaucccagc

SEQ ID NO: 2213734 - RNA, 16 nt, Human
gaccagcagaucccag

SEQ ID NO: 2213735 - RNA, 20 nt, Human
gaccagcaccaucucuccuc

SEQ ID NO: 2213736 - RNA, 21 nt, Human
gaccagcaccaucucuccucc

SEQ ID NO: 2213737 - RNA, 23 nt, Human
gaccagacaccuugacagggcac

SEQ ID NO: 2213738 - RNA, 24 nt, Human
gaccagacaccuugacagggcaca

SEQ ID NO: 2213739 - RNA, 21 nt, Human
gaccagagcugccaccugccu

SEQ ID NO: 2213740 - RNA, 22 nt, Human
gaccagacaccuugacagggca

SEQ ID NO: 2213741 - RNA, 21 nt, Human
gaccagacaccuugacagggc

SEQ ID NO: 2213742 - RNA, 18 nt, Human
gaccacugcagaagacag

SEQ ID NO: 2213743 - RNA, 16 nt, Human
gaccacugcagaagac

SEQ ID NO: 2213744 - RNA, 21 nt, Human
gaccacaggguucaaaauguc

SEQ ID NO: 2213745 - RNA, 23 nt, Human
gaccacagcaucauuuugcauuc

SEQ ID NO: 2213746 - RNA, 23 nt, Human
gaccacaggguucaaaaugucug

SEQ ID NO: 2213747 - RNA, 18 nt, Human
gaccacauuuuauauuua

SEQ ID NO: 2213748 - RNA, 17 nt, Human
gaccacaucuuuaucug

SEQ ID NO: 2213749 - RNA, 23 nt, Human
gaccacaucuuuaucuguucuug

SEQ ID NO: 2213750 - RNA, 16 nt, Human
gaccaccaccucagag

SEQ ID NO: 2213751 - RNA, 16 nt, Human
gaccacguuucuaaag

SEQ ID NO: 2213752 - RNA, 16 nt, Human
gaccaaggagaugaag

SEQ ID NO: 2213753 - RNA, 19 nt, Human
gaccaaggaccccucaccu

SEQ ID NO: 2213754 - RNA, 17 nt, Human
gaccaaggaccccucac

SEQ ID NO: 2213755 - RNA, 23 nt, Human
gaccaaggcaaggcaggugccuc

SEQ ID NO: 2213756 - RNA, 17 nt, Human
gaccaaggcaaggcagg

SEQ ID NO: 2213757 - RNA, 19 nt, Human
gaccaaggcaaggcaggug

SEQ ID NO: 2213758 - RNA, 21 nt, Human
gaccaaguuauaaaucaaugu

SEQ ID NO: 2213759 - RNA, 18 nt, Human
gaccaaggggugggccac

SEQ ID NO: 2213760 - RNA, 18 nt, Human
gaccaagguuccagcuca

SEQ ID NO: 2213761 - RNA, 20 nt, Human
gaccaauauuauacuaagaa

SEQ ID NO: 2213762 - RNA, 18 nt, Human
gaccaauauucaaaugcg

SEQ ID NO: 2213763 - RNA, 14 nt, Human
gaccaaguuauaaa

SEQ ID NO: 2213764 - RNA, 16 nt, Human
gaccaaggaccccuca

SEQ ID NO: 2213765 - RNA, 13 nt, Human
gaccaaggacccc

SEQ ID NO: 2213766 - RNA, 15 nt, Human
gaccaagcaucuugg

SEQ ID NO: 2213767 - RNA, 20 nt, Human
gaccaagcaucuuggggggg

SEQ ID NO: 2213768 - RNA, 20 nt, Human
gaccaagcaggaagcucaga

SEQ ID NO: 2213769 - RNA, 19 nt, Human
gaccaagcaggaagcucag

SEQ ID NO: 2213770 - RNA, 17 nt, Human
gaccaagcaggaagcuc

SEQ ID NO: 2213771 - RNA, 16 nt, Human
gaccaagcaggaagcu

SEQ ID NO: 2213772 - RNA, 15 nt, Human
gaccaagcaggaagc

SEQ ID NO: 2213773 - RNA, 20 nt, Human
gacauccauaaagaagcaau

SEQ ID NO: 2213774 - RNA, 13 nt, Human
gacaucagcuggu

SEQ ID NO: 2213775 - RNA, 20 nt, Human
gacaucaguggcauggcucc

SEQ ID NO: 2213776 - RNA, 13 nt, Human
gacaucaguggca

SEQ ID NO: 2213777 - RNA, 22 nt, Human
gacaucacuuguacaaaauaaa

SEQ ID NO: 2213778 - RNA, 16 nt, Human
gacaucacuuguacaa

SEQ ID NO: 2213779 - RNA, 17 nt, Human
gacauccaagcuuccuu

SEQ ID NO: 2213780 - RNA, 15 nt, Human
gacauccaagcuucc

SEQ ID NO: 2213781 - RNA, 16 nt, Human
gacauccaagcuuccu

SEQ ID NO: 2213782 - RNA, 19 nt, Human
gacaucaguggcauggcuc

SEQ ID NO: 2213783 - RNA, 17 nt, Human
gacauccauaaagaagc

SEQ ID NO: 2213784 - RNA, 18 nt, Human
gacauccauaaagaagca

SEQ ID NO: 2213785 - RNA, 19 nt, Human
gacauccauaaagaagcaa

SEQ ID NO: 2213786 - RNA, 16 nt, Human
gacauccauaaagaag

SEQ ID NO: 2213787 - RNA, 17 nt, Human
gaccaauauuguacagu

SEQ ID NO: 2213788 - RNA, 18 nt, Human
gaccaauauuguacaguu

SEQ ID NO: 2213789 - RNA, 19 nt, Human
gaccaauauuguacaguuu

SEQ ID NO: 2213790 - RNA, 21 nt, Human
gaccaauauuguacaguuuuu

SEQ ID NO: 2213791 - RNA, 18 nt, Human
gaccacaaaacuuuucua

SEQ ID NO: 2213792 - RNA, 13 nt, Human
gaccaauucaacc

SEQ ID NO: 2213793 - RNA, 21 nt, Human
gaccacacauuuguguaaaca

SEQ ID NO: 2213794 - RNA, 12 nt, Human
gaccacaccucc

SEQ ID NO: 2213795 - RNA, 16 nt, Human
gaccacacccuguacu

SEQ ID NO: 2213796 - RNA, 23 nt, Human
gaccacacuuccuguccagagag

SEQ ID NO: 2213797 - RNA, 11 nt, Human
gaccacagcaa

SEQ ID NO: 2213798 - RNA, 20 nt, Human
gaccacagcaaggcaccugc

SEQ ID NO: 2213799 - RNA, 21 nt, Human
gaccacagcaaggcaccugca

SEQ ID NO: 2213800 - RNA, 22 nt, Human
gaccacacuuccuguccagaga

SEQ ID NO: 2213801 - RNA, 20 nt, Human
gaccacacuuccuguccaga

SEQ ID NO: 2213802 - RNA, 18 nt, Human
gaccacacuuccugucca

SEQ ID NO: 2213803 - RNA, 17 nt, Human
gaccacacuuccugucc

SEQ ID NO: 2213804 - RNA, 16 nt, Human
gaccacagcacagcca

SEQ ID NO: 2213805 - RNA, 15 nt, Human
gaccacagcacagcc

SEQ ID NO: 2213806 - RNA, 14 nt, Human
gaccacagcacagc

SEQ ID NO: 2213807 - RNA, 12 nt, Human
gaccacagcaca

SEQ ID NO: 2213808 - RNA, 20 nt, Human
gaccacaccucccugaacca

SEQ ID NO: 2213809 - RNA, 17 nt, Human
gaccacaccucccugaa

SEQ ID NO: 2213810 - RNA, 14 nt, Human
gaccacacuccagc

SEQ ID NO: 2213811 - RNA, 22 nt, Human
gaccacacuccagcugggauca

SEQ ID NO: 2213812 - RNA, 16 nt, Human
gaccacacuccagcug

SEQ ID NO: 2213813 - RNA, 15 nt, Human
cuugggcccuucccu

SEQ ID NO: 2213814 - RNA, 14 nt, Human
cuugggcccuccug

SEQ ID NO: 2213815 - RNA, 13 nt, Human
cuugggcccuccu

SEQ ID NO: 2213816 - RNA, 12 nt, Human
cuugggcccucc

SEQ ID NO: 2213817 - RNA, 22 nt, Human
cuugggcccagcugggcucugc

SEQ ID NO: 2213818 - RNA, 20 nt, Human
cuugggcccagcugggcucu

SEQ ID NO: 2213819 - RNA, 21 nt, Human
cuugggcccagcugggcucug

SEQ ID NO: 2213820 - RNA, 19 nt, Human
cuugggcccuuugagugca

SEQ ID NO: 2213821 - RNA, 17 nt, Human
cuugggcccuuugagug

SEQ ID NO: 2213822 - RNA, 16 nt, Human
cuugggcccuuugagu

SEQ ID NO: 2213823 - RNA, 14 nt, Human
cuugggcccuuuga

SEQ ID NO: 2213824 - RNA, 22 nt, Human
cuugggcacuuuuuaauucacc

SEQ ID NO: 2213825 - RNA, 13 nt, Human
cuugggcagagcu

SEQ ID NO: 2213826 - RNA, 16 nt, Human
cuugggccauagcucc

SEQ ID NO: 2213827 - RNA, 17 nt, Human
cuugggccauagcuccu

SEQ ID NO: 2213828 - RNA, 14 nt, Human
cuugggcccagcug

SEQ ID NO: 2213829 - RNA, 15 nt, Human
cuugggcccagcugg

SEQ ID NO: 2213830 - RNA, 16 nt, Human
cuugggcccagcuggg

SEQ ID NO: 2213831 - RNA, 18 nt, Human
cuugggcccagcugggcu

SEQ ID NO: 2213832 - RNA, 20 nt, Human
cuugggccacugugaagaga

SEQ ID NO: 2213833 - RNA, 18 nt, Human
cuugggccacugugaaga

SEQ ID NO: 2213834 - RNA, 20 nt, Human
cuugggaugaugccucauga

SEQ ID NO: 2213835 - RNA, 16 nt, Human
cuugcaccucugaccu

SEQ ID NO: 2213836 - RNA, 14 nt, Human
cuuggacuauuaua

SEQ ID NO: 2213837 - RNA, 17 nt, Human
cuuggaccucugcucug

SEQ ID NO: 2213838 - RNA, 22 nt, Human
cuuggacuauuauaauuuaaug

SEQ ID NO: 2213839 - RNA, 19 nt, Human
cuuggaccucugcucugag

SEQ ID NO: 2213840 - RNA, 16 nt, Human
cuuggacucauuuuaa

SEQ ID NO: 2213841 - RNA, 21 nt, Human
cuuggaaguuucauauauugu

SEQ ID NO: 2213842 - RNA, 18 nt, Human
cuuggaaguugcauggca

SEQ ID NO: 2213843 - RNA, 13 nt, Human
cuuggacacugua

SEQ ID NO: 2213844 - RNA, 20 nt, Human
cuuggaauuuguaaccucag

SEQ ID NO: 2213845 - RNA, 22 nt, Human
cuuggaauuuguaaccucagcu

SEQ ID NO: 2213846 - RNA, 16 nt, Human
cuugcugcccuaggcu

SEQ ID NO: 2213847 - RNA, 15 nt, Human
cuuggaagcuucugg

SEQ ID NO: 2213848 - RNA, 16 nt, Human
cuugggaggcuucccc

SEQ ID NO: 2213849 - RNA, 15 nt, Human
cuugggaggcuuccc

SEQ ID NO: 2213850 - RNA, 22 nt, Human
cuugggaggccccacuggggaa

SEQ ID NO: 2213851 - RNA, 21 nt, Human
cuugggaggccccacugggga

SEQ ID NO: 2213852 - RNA, 19 nt, Human
cuugggaggccccacuggg

SEQ ID NO: 2213853 - RNA, 15 nt, Human
cuugggaggccccac

SEQ ID NO: 2213854 - RNA, 14 nt, Human
cuugggaggcccca

SEQ ID NO: 2213855 - RNA, 22 nt, Human
cuugggaggaagcagaauaaag

SEQ ID NO: 2213856 - RNA, 23 nt, Human
cuugggaggaagcagaauaaagc

SEQ ID NO: 2213857 - RNA, 13 nt, Human
cuuggagccccag

SEQ ID NO: 2213858 - RNA, 21 nt, Human
cuugggaggaagcagaauaaa

SEQ ID NO: 2213859 - RNA, 18 nt, Human
cuuggagccccagugcca

SEQ ID NO: 2213860 - RNA, 20 nt, Human
cuugggaggaagcagaauaa

SEQ ID NO: 2213861 - RNA, 22 nt, Human
cuuggagccaauggagacuguc

SEQ ID NO: 2213862 - RNA, 13 nt, Human
cuuggacuugagg

SEQ ID NO: 2213863 - RNA, 14 nt, Human
cuuggacucuugcu

SEQ ID NO: 2213864 - RNA, 15 nt, Human
cuuggacucuugcuc

SEQ ID NO: 2213865 - RNA, 18 nt, Human
cuuggacucuugcucuuu

SEQ ID NO: 2213866 - RNA, 22 nt, Human
cuuggacuucuucucccccgcg

SEQ ID NO: 2213867 - RNA, 12 nt, Human
cuugggcggcug

SEQ ID NO: 2213868 - RNA, 14 nt, Human
cuugggcggcugag

SEQ ID NO: 2213869 - RNA, 15 nt, Human
cuugggcggcugaga

SEQ ID NO: 2213870 - RNA, 18 nt, Human
cuugggcggcugagagcc

SEQ ID NO: 2213871 - RNA, 13 nt, Human
cuugggcucccug

SEQ ID NO: 2213872 - RNA, 22 nt, Human
cuugggcggcugagagccccag

SEQ ID NO: 2213873 - RNA, 21 nt, Human
cuugggcucccuguaaccucu

SEQ ID NO: 2213874 - RNA, 17 nt, Human
cuugggcugagacugga

SEQ ID NO: 2213875 - RNA, 14 nt, Human
cuugggcugagacu

SEQ ID NO: 2213876 - RNA, 16 nt, Human
cuuggggcugaugcag

SEQ ID NO: 2213877 - RNA, 14 nt, Human
cuuggggcuuccua

SEQ ID NO: 2213878 - RNA, 18 nt, Human
cuuggggcucacacaccu

SEQ ID NO: 2213879 - RNA, 15 nt, Human
cuuggggccuaugca

SEQ ID NO: 2213880 - RNA, 18 nt, Human
cuuggggcugaugcaguu

SEQ ID NO: 2213881 - RNA, 17 nt, Human
cuugguuggguccucac

SEQ ID NO: 2213882 - RNA, 16 nt, Human
cuugguuggcuggccu

SEQ ID NO: 2213883 - RNA, 15 nt, Human
cuugguuggcuggcc

SEQ ID NO: 2213884 - RNA, 14 nt, Human
cuugggcugcuccu

SEQ ID NO: 2213885 - RNA, 20 nt, Human
cuuggggcuugacuuuugua

SEQ ID NO: 2213886 - RNA, 21 nt, Human
cuuggggcuugacuuuuguau

SEQ ID NO: 2213887 - RNA, 22 nt, Human
cuugguuucuucaacaggagaa

SEQ ID NO: 2213888 - RNA, 17 nt, Human
cuugguuuccaaaggca

SEQ ID NO: 2213889 - RNA, 14 nt, Human
cuugguugucucca

SEQ ID NO: 2213890 - RNA, 18 nt, Human
cuugguugucuccacaca

SEQ ID NO: 2213891 - RNA, 12 nt, Human
cuuguacaaaau

SEQ ID NO: 2213892 - RNA, 17 nt, Human
cuuguacuuuauuuucu

SEQ ID NO: 2213893 - RNA, 16 nt, Human
cuuguaauucuaaaug

SEQ ID NO: 2213894 - RNA, 23 nt, Human
cuuguaauucuaaaugaauguuu

SEQ ID NO: 2213895 - RNA, 12 nt, Human
cuuguaauuuaa

SEQ ID NO: 2213896 - RNA, 21 nt, Human
cuuguaauuuaaacaggccca

SEQ ID NO: 2213897 - RNA, 22 nt, Human
cuuguaauuuaaacaggcccag

SEQ ID NO: 2213898 - RNA, 13 nt, Human
cuuguacaaaaua

SEQ ID NO: 2213899 - RNA, 23 nt, Human
cuuguaauuuaaacaggcccagc

SEQ ID NO: 2213900 - RNA, 22 nt, Human
cuuguaauuuuuuuaauuuaca

SEQ ID NO: 2213901 - RNA, 13 nt, Human
cuuguaauucuaa

SEQ ID NO: 2213902 - RNA, 15 nt, Human
cuuguaauucuaaau

SEQ ID NO: 2213903 - RNA, 22 nt, Human
cuuguaaugauauagccagaaa

SEQ ID NO: 2213904 - RNA, 15 nt, Human
cuugguuuguaaauu

SEQ ID NO: 2213905 - RNA, 14 nt, Human
cuugguuuguaaau

SEQ ID NO: 2213906 - RNA, 22 nt, Human
cuuguguuuuuaacucaauauu

SEQ ID NO: 2213907 - RNA, 21 nt, Human
cuuguguuucuuuaguuuuug

SEQ ID NO: 2213908 - RNA, 14 nt, Human
cuuguuacuucuga

SEQ ID NO: 2213909 - RNA, 15 nt, Human
cuuguuacuucugag

SEQ ID NO: 2213910 - RNA, 17 nt, Human
cuuguuacuucugaggu

SEQ ID NO: 2213911 - RNA, 20 nt, Human
cuuguucugugaugagggga

SEQ ID NO: 2213912 - RNA, 21 nt, Human
cuuguucugugaugaggggag

SEQ ID NO: 2213913 - RNA, 16 nt, Human
cuuguuaagauaguua

SEQ ID NO: 2213914 - RNA, 16 nt, Human
cuuguggucccacccc

SEQ ID NO: 2213915 - RNA, 19 nt, Human
cuuguggucccaccccaca

SEQ ID NO: 2213916 - RNA, 21 nt, Human
cuuguccccuccucacucccu

SEQ ID NO: 2213917 - RNA, 20 nt, Human
cuuguccccuccucacuccc

SEQ ID NO: 2213918 - RNA, 18 nt, Human
cuuguccccacacuccua

SEQ ID NO: 2213919 - RNA, 20 nt, Human
cuuguccccacacuccuaca

SEQ ID NO: 2213920 - RNA, 17 nt, Human
cuuguccccugccugug

SEQ ID NO: 2213921 - RNA, 21 nt, Human
cuuguccccugccugugccug

SEQ ID NO: 2213922 - RNA, 13 nt, Human
cuuguccccacac

SEQ ID NO: 2213923 - RNA, 14 nt, Human
cuuguccccacacu

SEQ ID NO: 2213924 - RNA, 16 nt, Human
cuuguccccacacucc

SEQ ID NO: 2213925 - RNA, 23 nt, Human
cuuguccuuuuguaccauggugu

SEQ ID NO: 2213926 - RNA, 15 nt, Human
cuuguccuuucccuu

SEQ ID NO: 2213927 - RNA, 14 nt, Human
cuuguccuuucccu

SEQ ID NO: 2213928 - RNA, 18 nt, Human
cuuguccuagcuugggag

SEQ ID NO: 2213929 - RNA, 15 nt, Human
cuuguggucccaccc

SEQ ID NO: 2213930 - RNA, 18 nt, Human
cuuuagaaugagagugug

SEQ ID NO: 2213931 - RNA, 22 nt, Human
cuuuagaaugagagugugaaau

SEQ ID NO: 2213932 - RNA, 16 nt, Human
cuuuaccugagaccag

SEQ ID NO: 2213933 - RNA, 13 nt, Human
cuuuaccugagac

SEQ ID NO: 2213934 - RNA, 14 nt, Human
cuuuagacccuggg

SEQ ID NO: 2213935 - RNA, 16 nt, Human
cuuuagacccugggug

SEQ ID NO: 2213936 - RNA, 23 nt, Human
cuuuagacccugggugggcucug

SEQ ID NO: 2213937 - RNA, 20 nt, Human
cuuuaccuuuuuuauacaua

SEQ ID NO: 2213938 - RNA, 19 nt, Human
cuuuaccuuuuuuauacau

SEQ ID NO: 2213939 - RNA, 23 nt, Human
cuuuaaaaacuauuuaacuugag

SEQ ID NO: 2213940 - RNA, 21 nt, Human
cuuuaaaaagcuccaaaugca

SEQ ID NO: 2213941 - RNA, 14 nt, Human
cuuuaaaaacuauu

SEQ ID NO: 2213942 - RNA, 19 nt, Human
cuuuaaaaacuauuuaacu

SEQ ID NO: 2213943 - RNA, 22 nt, Human
cuuuaaaaaauuaaucugggcc

SEQ ID NO: 2213944 - RNA, 17 nt, Human
cuuuaccuuuuuuauac

SEQ ID NO: 2213945 - RNA, 12 nt, Human
cuuuaaaagaau

SEQ ID NO: 2213946 - RNA, 20 nt, Human
cuuuaaaagacaaaucaaag

SEQ ID NO: 2213947 - RNA, 12 nt, Human
cuuguuucaauu

SEQ ID NO: 2213948 - RNA, 14 nt, Human
cuuguuucuuuuca

SEQ ID NO: 2213949 - RNA, 22 nt, Human
cuuguuucaauuccaccugcaa

SEQ ID NO: 2213950 - RNA, 15 nt, Human
cuuguuuccaauguu

SEQ ID NO: 2213951 - RNA, 16 nt, Human
cuuguuugcucaccug

SEQ ID NO: 2213952 - RNA, 23 nt, Human
cuuguuugauuuuagcugcagaa

SEQ ID NO: 2213953 - RNA, 22 nt, Human
cuuguuugauuuuagcugcaga

SEQ ID NO: 2213954 - RNA, 20 nt, Human
cuuguuugauuuuagcugca

SEQ ID NO: 2213955 - RNA, 19 nt, Human
cuuguuugcucaccugggg

SEQ ID NO: 2213956 - RNA, 18 nt, Human
cuuguuugcucaccuggg

SEQ ID NO: 2213957 - RNA, 20 nt, Human
cuuguuugcucaccuggggu

SEQ ID NO: 2213958 - RNA, 17 nt, Human
cuuuaaaaaaauuuaag

SEQ ID NO: 2213959 - RNA, 18 nt, Human
cuuuaaaaaaauuuaagu

SEQ ID NO: 2213960 - RNA, 19 nt, Human
cuuuaaaaaaauuuaagug

SEQ ID NO: 2213961 - RNA, 20 nt, Human
cuuguugcucaaaaaaugag

SEQ ID NO: 2213962 - RNA, 19 nt, Human
cuuguugcaugauguauuu

SEQ ID NO: 2213963 - RNA, 22 nt, Human
cuuguugcuguugauguuuugu

SEQ ID NO: 2213964 - RNA, 14 nt, Human
cuuguuggagccug

SEQ ID NO: 2213965 - RNA, 23 nt, Human
cuugcucugcuugacaacaucug

SEQ ID NO: 2213966 - RNA, 19 nt, Human
cuugcccuucccugucccu

SEQ ID NO: 2213967 - RNA, 22 nt, Human
cuugcucugcugacagacacag

SEQ ID NO: 2213968 - RNA, 22 nt, Human
cuugcccuguuaaaagaugaaa

SEQ ID NO: 2213969 - RNA, 19 nt, Human
cuugccccaacccccagca

SEQ ID NO: 2213970 - RNA, 20 nt, Human
cuugccccaacccccagcac

SEQ ID NO: 2213971 - RNA, 21 nt, Human
cuugccccaacccccagcacc

SEQ ID NO: 2213972 - RNA, 12 nt, Human
cuugcccuuccc

SEQ ID NO: 2213973 - RNA, 14 nt, Human
cuugcccuucccug

SEQ ID NO: 2213974 - RNA, 15 nt, Human
cuugcccuucccugu

SEQ ID NO: 2213975 - RNA, 16 nt, Human
cuugcccuucccuguc

SEQ ID NO: 2213976 - RNA, 17 nt, Human
cuugcccuucccugucc

SEQ ID NO: 2213977 - RNA, 14 nt, Human
cuugcucuguaauc

SEQ ID NO: 2213978 - RNA, 19 nt, Human
cuugcucuucagugggaga

SEQ ID NO: 2213979 - RNA, 15 nt, Human
cuugcucuguaaucu

SEQ ID NO: 2213980 - RNA, 19 nt, Human
cuugcucuuucuacucuga

SEQ ID NO: 2213981 - RNA, 20 nt, Human
cuugcucuuucuacucugaa

SEQ ID NO: 2213982 - RNA, 22 nt, Human
cuugcucuuucuacucugaacu

SEQ ID NO: 2213983 - RNA, 19 nt, Human
cuugcucuugaugccuggc

SEQ ID NO: 2213984 - RNA, 17 nt, Human
cuugcucuugaugccug

SEQ ID NO: 2213985 - RNA, 18 nt, Human
cuugcucuugaugccugg

SEQ ID NO: 2213986 - RNA, 17 nt, Human
cuugcugagaggggcug

SEQ ID NO: 2213987 - RNA, 19 nt, Human
cuugcugagaggggcuguc

SEQ ID NO: 2213988 - RNA, 21 nt, Human
cuugcugcaguaugaaaauaa

SEQ ID NO: 2213989 - RNA, 23 nt, Human
cuugcugcccuaggcuccgucag

SEQ ID NO: 2213990 - RNA, 20 nt, Human
cuugcugcccugugcuccuc

SEQ ID NO: 2213991 - RNA, 13 nt, Human
cuugcuucccuaa

SEQ ID NO: 2213992 - RNA, 17 nt, Human
cuugcuucccuaaucua

SEQ ID NO: 2213993 - RNA, 20 nt, Human
cuuggaagcuccgcuuucua

SEQ ID NO: 2213994 - RNA, 14 nt, Human
cuuggaagcuccgc

SEQ ID NO: 2213995 - RNA, 20 nt, Human
cuugcuugauuguauggugg

SEQ ID NO: 2213996 - RNA, 19 nt, Human
cuugcccagggcucagccu

SEQ ID NO: 2213997 - RNA, 18 nt, Human
cuugcccagggcucagcc

SEQ ID NO: 2213998 - RNA, 16 nt, Human
cuugcccagggcucag

SEQ ID NO: 2213999 - RNA, 15 nt, Human
cuugcccagggcuca

SEQ ID NO: 2214000 - RNA, 14 nt, Human
cuugcccagggcuc

SEQ ID NO: 2214001 - RNA, 13 nt, Human
cuugcccagggcu

SEQ ID NO: 2214002 - RNA, 23 nt, Human
cuugcccagggcucagccuggug

SEQ ID NO: 2214003 - RNA, 14 nt, Human
cuugcccaguuuca

SEQ ID NO: 2214004 - RNA, 21 nt, Human
cuugcccagggcucagccugg

SEQ ID NO: 2214005 - RNA, 20 nt, Human
cuugcccagggcucagccug

SEQ ID NO: 2214006 - RNA, 20 nt, Human
cuugcccaguuucagggcua

SEQ ID NO: 2214007 - RNA, 13 nt, Human
cuugccccaaccc

SEQ ID NO: 2214008 - RNA, 14 nt, Human
cuugccccaacccc

SEQ ID NO: 2214009 - RNA, 17 nt, Human
cuugccccaacccccag

SEQ ID NO: 2214010 - RNA, 18 nt, Human
cuugccccaacccccagc

SEQ ID NO: 2214011 - RNA, 18 nt, Human
cuugcccuggugccucac

SEQ ID NO: 2214012 - RNA, 14 nt, Human
cuugcccuguuaaa

SEQ ID NO: 2214013 - RNA, 23 nt, Human
cuugccaaugaggucugaaaugg

SEQ ID NO: 2214014 - RNA, 22 nt, Human
cuugccaaugaggucugaaaug

SEQ ID NO: 2214015 - RNA, 20 nt, Human
cuugccacagcucuugagga

SEQ ID NO: 2214016 - RNA, 13 nt, Human
cuugccaccccac

SEQ ID NO: 2214017 - RNA, 18 nt, Human
cuugccaccccacccucc

SEQ ID NO: 2214018 - RNA, 20 nt, Human
cuugccaccccacccucccu

SEQ ID NO: 2214019 - RNA, 14 nt, Human
cuugccacagcucu

SEQ ID NO: 2214020 - RNA, 17 nt, Human
cuugccacuagggcucu

SEQ ID NO: 2214021 - RNA, 23 nt, Human
cuugccaggguuucgagaagcug

SEQ ID NO: 2214022 - RNA, 21 nt, Human
cuugccaccccacccucccug

SEQ ID NO: 2214023 - RNA, 22 nt, Human
cuugccaccccacccucccugg

SEQ ID NO: 2214024 - RNA, 23 nt, Human
cuugccaccccacccucccugga

SEQ ID NO: 2214025 - RNA, 17 nt, Human
cuugcaugaggcuagug

SEQ ID NO: 2214026 - RNA, 15 nt, Human
cuugcauccaacucc

SEQ ID NO: 2214027 - RNA, 17 nt, Human
cuugcaucguggagaca

SEQ ID NO: 2214028 - RNA, 18 nt, Human
cuugcaucucauugcucu

SEQ ID NO: 2214029 - RNA, 20 nt, Human
cuugccaaccuguaauaaau

SEQ ID NO: 2214030 - RNA, 20 nt, Human
cuugcaucguggagacaggg

SEQ ID NO: 2214031 - RNA, 21 nt, Human
cuugccaaccuguaauaaaua

SEQ ID NO: 2214032 - RNA, 22 nt, Human
cuugccaaccuguaauaaauau

SEQ ID NO: 2214033 - RNA, 23 nt, Human
cuugccaaccuguaauaaauaug

SEQ ID NO: 2214034 - RNA, 13 nt, Human
cuugcaugaggcu

SEQ ID NO: 2214035 - RNA, 14 nt, Human
cuugcaugaggcua

SEQ ID NO: 2214036 - RNA, 14 nt, Human
cuucuggccuccca

SEQ ID NO: 2214037 - RNA, 15 nt, Human
cuucuggccucccac

SEQ ID NO: 2214038 - RNA, 19 nt, Human
cuucuggccucccacagac

SEQ ID NO: 2214039 - RNA, 16 nt, Human
cuucuggccucccaca

SEQ ID NO: 2214040 - RNA, 12 nt, Human
cuucuggcucaa

SEQ ID NO: 2214041 - RNA, 14 nt, Human
cuucuggagcccuu

SEQ ID NO: 2214042 - RNA, 16 nt, Human
cuucuggagucuccag

SEQ ID NO: 2214043 - RNA, 18 nt, Human
cuucuggagucuccagug

SEQ ID NO: 2214044 - RNA, 15 nt, Human
cuucuggauucuugg

SEQ ID NO: 2214045 - RNA, 20 nt, Human
cuucuggagucuccaguggu

SEQ ID NO: 2214046 - RNA, 17 nt, Human
cuucuggcacuuggaga

SEQ ID NO: 2214047 - RNA, 18 nt, Human
cuucuggauucuuggccc

SEQ ID NO: 2214048 - RNA, 16 nt, Human
cuucuggauucuuggc

SEQ ID NO: 2214049 - RNA, 17 nt, Human
cuucuggauucuuggcc

SEQ ID NO: 2214050 - RNA, 23 nt, Human
cuugagaagaccucaccuagaaa

SEQ ID NO: 2214051 - RNA, 22 nt, Human
cuugagaaauauggacacuuaa

SEQ ID NO: 2214052 - RNA, 16 nt, Human
cuugagaccucagcca

SEQ ID NO: 2214053 - RNA, 15 nt, Human
cuugagaccucagcc

SEQ ID NO: 2214054 - RNA, 14 nt, Human
cuugagaccucagc

SEQ ID NO: 2214055 - RNA, 13 nt, Human
cuugagacagcuu

SEQ ID NO: 2214056 - RNA, 22 nt, Human
cuugagacacggagcccagccc

SEQ ID NO: 2214057 - RNA, 17 nt, Human
cuugagacacggagccc

SEQ ID NO: 2214058 - RNA, 11 nt, Human
cuugagaaacc

SEQ ID NO: 2214059 - RNA, 12 nt, Human
cuugagaaaccu

SEQ ID NO: 2214060 - RNA, 13 nt, Human
cuugagaaaccuu

SEQ ID NO: 2214061 - RNA, 15 nt, Human
cuucugggagggcag

SEQ ID NO: 2214062 - RNA, 20 nt, Human
cuucuggcuuccuucucuca

SEQ ID NO: 2214063 - RNA, 14 nt, Human
cuucuggcuuccuu

SEQ ID NO: 2214064 - RNA, 14 nt, Human
cuugagcccaggag

SEQ ID NO: 2214065 - RNA, 15 nt, Human
cuugagcccaggagu

SEQ ID NO: 2214066 - RNA, 22 nt, Human
cuugagacuguuuugaauuugg

SEQ ID NO: 2214067 - RNA, 14 nt, Human
cuugagagaccagg

SEQ ID NO: 2214068 - RNA, 17 nt, Human
cuugagacuguuuugaa

SEQ ID NO: 2214069 - RNA, 18 nt, Human
cuugagaccucagccaug

SEQ ID NO: 2214070 - RNA, 13 nt, Human
cuugagcccagga

SEQ ID NO: 2214071 - RNA, 16 nt, Human
cuugagagaccaggca

SEQ ID NO: 2214072 - RNA, 15 nt, Human
cuugagccugggagg

SEQ ID NO: 2214073 - RNA, 12 nt, Human
cuugagccuggg

SEQ ID NO: 2214074 - RNA, 15 nt, Human
cuugaggguugggcu

SEQ ID NO: 2214075 - RNA, 17 nt, Human
cuugaggguugggcugg

SEQ ID NO: 2214076 - RNA, 20 nt, Human
cuugagccgggccccugggc

SEQ ID NO: 2214077 - RNA, 17 nt, Human
cuugagccgggccccug

SEQ ID NO: 2214078 - RNA, 19 nt, Human
cuugagccgggccccuggg

SEQ ID NO: 2214079 - RNA, 19 nt, Human
cuugaguugauucagcucu

SEQ ID NO: 2214080 - RNA, 18 nt, Human
cuugaguugauucagcuc

SEQ ID NO: 2214081 - RNA, 20 nt, Human
cuugaguugauucagcucug

SEQ ID NO: 2214082 - RNA, 21 nt, Human
cuugaguugauucagcucugc

SEQ ID NO: 2214083 - RNA, 15 nt, Human
cuugcaauggcagcc

SEQ ID NO: 2214084 - RNA, 16 nt, Human
cuugcaauggcagccu

SEQ ID NO: 2214085 - RNA, 17 nt, Human
cuugcaauggcagccuu

SEQ ID NO: 2214086 - RNA, 18 nt, Human
cuugcaauggcagccuug

SEQ ID NO: 2214087 - RNA, 22 nt, Human
cuugcagcacucacacaggacc

SEQ ID NO: 2214088 - RNA, 23 nt, Human
cuugcagcacucacacaggaccc

SEQ ID NO: 2214089 - RNA, 12 nt, Human
cuugcagcagga

SEQ ID NO: 2214090 - RNA, 13 nt, Human
cuugcagcaggau

SEQ ID NO: 2214091 - RNA, 23 nt, Human
cuugcagcaggaucuagaggggg

SEQ ID NO: 2214092 - RNA, 19 nt, Human
cuugcauccaacuccagga

SEQ ID NO: 2214093 - RNA, 18 nt, Human
cuugcagcacucacacag

SEQ ID NO: 2214094 - RNA, 18 nt, Human
cuugcacccgccucuccc

SEQ ID NO: 2214095 - RNA, 19 nt, Human
cuugcagcacucacacagg

SEQ ID NO: 2214096 - RNA, 20 nt, Human
cuugcaccccucacucuggc

SEQ ID NO: 2214097 - RNA, 15 nt, Human
cuugcacccgccucu

SEQ ID NO: 2214098 - RNA, 16 nt, Human
cuugcacccgccucuc

SEQ ID NO: 2214099 - RNA, 17 nt, Human
cuugcacccgccucucc

SEQ ID NO: 2214100 - RNA, 21 nt, Human
cuugcagacucuacagaggcc

SEQ ID NO: 2214101 - RNA, 20 nt, Human
cuugcagacucuacagaggc

SEQ ID NO: 2214102 - RNA, 22 nt, Human
cuugcaccccaaagcuuuccug

SEQ ID NO: 2214103 - RNA, 23 nt, Human
cuugcaccccaaagcuuuccugc

SEQ ID NO: 2214104 - RNA, 14 nt, Human
cuugcaccccucac

SEQ ID NO: 2214105 - RNA, 16 nt, Human
cuugcaccccucacuc

SEQ ID NO: 2214106 - RNA, 18 nt, Human
cuugcaccccucacucug

SEQ ID NO: 2214107 - RNA, 22 nt, Human
cuugcacacuccccugcacugg

SEQ ID NO: 2214108 - RNA, 19 nt, Human
cuugcacacuccccugcac

SEQ ID NO: 2214109 - RNA, 23 nt, Human
cuugcacacuccccugcacugga

SEQ ID NO: 2214110 - RNA, 17 nt, Human
cuugcaauuucuaccua

SEQ ID NO: 2214111 - RNA, 14 nt, Human
cuuuugaacccagg

SEQ ID NO: 2214112 - RNA, 13 nt, Human
cuuuugaacccag

SEQ ID NO: 2214113 - RNA, 14 nt, Human
cuuuucuuuuucuc

SEQ ID NO: 2214114 - RNA, 13 nt, Human
cuuuugaaacaau

SEQ ID NO: 2214115 - RNA, 16 nt, Human
cuuuugaaacaauacu

SEQ ID NO: 2214116 - RNA, 14 nt, Human
cuuuugaaaucugu

SEQ ID NO: 2214117 - RNA, 15 nt, Human
cuuuucuuaaaccuu

SEQ ID NO: 2214118 - RNA, 16 nt, Human
cuuuucuuaaaccuuc

SEQ ID NO: 2214119 - RNA, 13 nt, Human
cuuuucugcauuu

SEQ ID NO: 2214120 - RNA, 14 nt, Human
cuuuucugcauuuu

SEQ ID NO: 2214121 - RNA, 20 nt, Human
cuuuucugcauuuugcuauu

SEQ ID NO: 2214122 - RNA, 13 nt, Human
cuuuucugcccug

SEQ ID NO: 2214123 - RNA, 15 nt, Human
cuuuucugcagaggg

SEQ ID NO: 2214124 - RNA, 12 nt, Human
cuuuucugcaga

SEQ ID NO: 2214125 - RNA, 15 nt, Human
cuuuucuguuugcua

SEQ ID NO: 2214126 - RNA, 14 nt, Human
cuuuucugcccugg

SEQ ID NO: 2214127 - RNA, 15 nt, Human
cuuuucugcccuggc

SEQ ID NO: 2214128 - RNA, 17 nt, Human
cuuuucugcccuggcug

SEQ ID NO: 2214129 - RNA, 16 nt, Human
cuuuucugucucugcc

SEQ ID NO: 2214130 - RNA, 17 nt, Human
cuuuucugucucugccu

SEQ ID NO: 2214131 - RNA, 18 nt, Human
cuuuucugucucugccuc

SEQ ID NO: 2214132 - RNA, 21 nt, Human
cuuuucugucucugccucccu

SEQ ID NO: 2214133 - RNA, 21 nt, Human
cuuuguuuguugucagcugaa

SEQ ID NO: 2214134 - RNA, 17 nt, Human
cuuuguuuuacugucuu

SEQ ID NO: 2214135 - RNA, 21 nt, Human
cuuuguugcaaguacugcugu

SEQ ID NO: 2214136 - RNA, 16 nt, Human
cuuuguugcccaggcu

SEQ ID NO: 2214137 - RNA, 17 nt, Human
cuuuguguagcuuugcu

SEQ ID NO: 2214138 - RNA, 20 nt, Human
cuuuguucuuuaggagauuu

SEQ ID NO: 2214139 - RNA, 24 nt, Human
cuuuguuuugauguuuguggccuc

SEQ ID NO: 2214140 - RNA, 19 nt, Human
cuuuguuuugcacacuuug

SEQ ID NO: 2214141 - RNA, 23 nt, Human
cuuuguuuugcacacuuugccau

SEQ ID NO: 2214142 - RNA, 23 nt, Human
cuuuguuuugauguuuguggccu

SEQ ID NO: 2214143 - RNA, 19 nt, Human
cuuuguuuugauguuugug

SEQ ID NO: 2214144 - RNA, 20 nt, Human
cuuuuugagguggcacuuuu

SEQ ID NO: 2214145 - RNA, 18 nt, Human
cuuuuugagguggcacuu

SEQ ID NO: 2214146 - RNA, 13 nt, Human
cuuuuugcuuucg

SEQ ID NO: 2214147 - RNA, 18 nt, Human
cuuuuuuaaaugaagaaa

SEQ ID NO: 2214148 - RNA, 15 nt, Human
cuuuuuggaggugcu

SEQ ID NO: 2214149 - RNA, 11 nt, Human
cuuuuugaaug

SEQ ID NO: 2214150 - RNA, 19 nt, Human
cuuuuugaauguuauuugu

SEQ ID NO: 2214151 - RNA, 23 nt, Human
cuuuuugaaguguaggcagacac

SEQ ID NO: 2214152 - RNA, 12 nt, Human
cuuuuugaagug

SEQ ID NO: 2214153 - RNA, 16 nt, Human
cuuuuuaaaguguuuc

SEQ ID NO: 2214154 - RNA, 13 nt, Human
cuuuuugaagugu

SEQ ID NO: 2214155 - RNA, 21 nt, Human
cuuuuugaaguguaggcagac

SEQ ID NO: 2214156 - RNA, 22 nt, Human
cuuuuugaaguguaggcagaca

SEQ ID NO: 2214157 - RNA, 17 nt, Human
cuuuuucauauguugcu

SEQ ID NO: 2214158 - RNA, 20 nt, Human
cuuuugaacccaggaguuca

SEQ ID NO: 2214159 - RNA, 18 nt, Human
cuuuugaacccaggaguu

SEQ ID NO: 2214160 - RNA, 21 nt, Human
cuuuugaacgcccccccccac

SEQ ID NO: 2214161 - RNA, 20 nt, Human
cuuuugaaguaguuuguaua

SEQ ID NO: 2214162 - RNA, 23 nt, Human
cuuuugaauccaugcuugggugu

SEQ ID NO: 2214163 - RNA, 21 nt, Human
cuuuugaauccaugcuugggu

SEQ ID NO: 2214164 - RNA, 20 nt, Human
cuuuugaauccaugcuuggg

SEQ ID NO: 2214165 - RNA, 19 nt, Human
cuuuugaauccaugcuugg

SEQ ID NO: 2214166 - RNA, 13 nt, Human
cuuuugaauauuc

SEQ ID NO: 2214167 - RNA, 21 nt, Human
cuuuugaauaaaaacuuugcu

SEQ ID NO: 2214168 - RNA, 22 nt, Human
cuuuugaaguaguuuguauaac

SEQ ID NO: 2214169 - RNA, 22 nt, Human
cuuuuguucuugguuuguaaau

SEQ ID NO: 2214170 - RNA, 17 nt, Human
cuuuugacaaaggcaag

SEQ ID NO: 2214171 - RNA, 19 nt, Human
cuuuuuaaaaauagacacu

SEQ ID NO: 2214172 - RNA, 15 nt, Human
cuuuuuauuugcaug

SEQ ID NO: 2214173 - RNA, 16 nt, Human
cuuuuuauuucugcau

SEQ ID NO: 2214174 - RNA, 13 nt, Human
cuuuuuauuucug

SEQ ID NO: 2214175 - RNA, 14 nt, Human
cuuuuuauuugcau

SEQ ID NO: 2214176 - RNA, 13 nt, Human
cuuuuuauuugca

SEQ ID NO: 2214177 - RNA, 13 nt, Human
gaaaaccucuccu

SEQ ID NO: 2214178 - RNA, 14 nt, Human
gaaaacguggcugc

SEQ ID NO: 2214179 - RNA, 14 nt, Human
gaaaacggagcuga

SEQ ID NO: 2214180 - RNA, 13 nt, Human
gaaaacggagcug

SEQ ID NO: 2214181 - RNA, 18 nt, Human
gaaaagggaacugaacau

SEQ ID NO: 2214182 - RNA, 17 nt, Human
gaaaacgguuaaaacug

SEQ ID NO: 2214183 - RNA, 21 nt, Human
gaaaagggagauucagacugu

SEQ ID NO: 2214184 - RNA, 19 nt, Human
gaaaagggaaguugugccu

SEQ ID NO: 2214185 - RNA, 17 nt, Human
gaaaagguaaggugaag

SEQ ID NO: 2214186 - RNA, 19 nt, Human
gaaaacgucuugcuuggga

SEQ ID NO: 2214187 - RNA, 21 nt, Human
gaaaagggucuugggaaauau

SEQ ID NO: 2214188 - RNA, 15 nt, Human
gaaaacauguaauaa

SEQ ID NO: 2214189 - RNA, 13 nt, Human
gaaaacauuccau

SEQ ID NO: 2214190 - RNA, 14 nt, Human
gaaaacaaggaagu

SEQ ID NO: 2214191 - RNA, 19 nt, Human
gaaaacaugcuacacacug

SEQ ID NO: 2214192 - RNA, 14 nt, Human
gaaaaccccagcau

SEQ ID NO: 2214193 - RNA, 22 nt, Human
gaaaacccagagaggaaucaga

SEQ ID NO: 2214194 - RNA, 15 nt, Human
gaaaacccagagagg

SEQ ID NO: 2214195 - RNA, 14 nt, Human
gaaaacccagagag

SEQ ID NO: 2214196 - RNA, 17 nt, Human
gaaaacauuccauccuu

SEQ ID NO: 2214197 - RNA, 21 nt, Human
gaaaaccuaaguccuuuaugu

SEQ ID NO: 2214198 - RNA, 14 nt, Human
gaaaaguacauuua

SEQ ID NO: 2214199 - RNA, 16 nt, Human
gaaaaguacauuuaau

SEQ ID NO: 2214200 - RNA, 20 nt, Human
gaaaaguauguuagugcaaa

SEQ ID NO: 2214201 - RNA, 21 nt, Human
gaaaaguaaggugcaguuccc

SEQ ID NO: 2214202 - RNA, 17 nt, Human
gaaaagguuuuauuuug

SEQ ID NO: 2214203 - RNA, 18 nt, Human
gaaaagguuuuauuuugu

SEQ ID NO: 2214204 - RNA, 14 nt, Human
gaaaagguuuuauu

SEQ ID NO: 2214205 - RNA, 14 nt, Human
gaaaaguauguuag

SEQ ID NO: 2214206 - RNA, 22 nt, Human
gaaaagucaaggguaggguggg

SEQ ID NO: 2214207 - RNA, 13 nt, Human
gaaaagucaaacu

SEQ ID NO: 2214208 - RNA, 14 nt, Human
gaaaagucaaacug

SEQ ID NO: 2214209 - RNA, 16 nt, Human
gaaaauaaaaaguuaa

SEQ ID NO: 2214210 - RNA, 15 nt, Human
gaaaauaaaaaguua

SEQ ID NO: 2214211 - RNA, 19 nt, Human
gaaaauaacaauaaaagac

SEQ ID NO: 2214212 - RNA, 15 nt, Human
cuuuuuuacacaaau

SEQ ID NO: 2214213 - RNA, 20 nt, Human
cuuuuuuaagauuuuucuca

SEQ ID NO: 2214214 - RNA, 21 nt, Human
cuuuuuuaagauuuuucucaa

SEQ ID NO: 2214215 - RNA, 16 nt, Human
cuuuuuuagaguugau

SEQ ID NO: 2214216 - RNA, 11 nt, Human
gaaaaauauga

SEQ ID NO: 2214217 - RNA, 10 nt, Human
gaaaaauaug

SEQ ID NO: 2214218 - RNA, 14 nt, Human
cuuuuuuauacaca

SEQ ID NO: 2214219 - RNA, 19 nt, Human
cuuuuuuauacacauaauu

SEQ ID NO: 2214220 - RNA, 15 nt, Human
cuuuuuuauacacau

SEQ ID NO: 2214221 - RNA, 18 nt, Human
gaaaaauuuaagcauugu

SEQ ID NO: 2214222 - RNA, 17 nt, Human
gaaaaauuuaagcauug

SEQ ID NO: 2214223 - RNA, 16 nt, Human
gaaaaauuuaagcauu

SEQ ID NO: 2214224 - RNA, 15 nt, Human
gaaaaauuccuauug

SEQ ID NO: 2214225 - RNA, 20 nt, Human
gaaaaauuccuauugugauu

SEQ ID NO: 2214226 - RNA, 18 nt, Human
gaaaaauccagaaagaaa

SEQ ID NO: 2214227 - RNA, 17 nt, Human
gaaaaauccagaaagaa

SEQ ID NO: 2214228 - RNA, 13 nt, Human
gaaaaauccucuu

SEQ ID NO: 2214229 - RNA, 18 nt, Human
gaaaaauccucuuccucu

SEQ ID NO: 2214230 - RNA, 11 nt, Human
gaaaaauuccu

SEQ ID NO: 2214231 - RNA, 20 nt, Human
gaaaaauccucuuccucuga

SEQ ID NO: 2214232 - RNA, 15 nt, Human
gaaaaauaugauauu

SEQ ID NO: 2214233 - RNA, 14 nt, Human
gaaaaauauuuaag

SEQ ID NO: 2214234 - RNA, 13 nt, Human
gaaaaauauuuaa

SEQ ID NO: 2214235 - RNA, 19 nt, Human
gaaaaaucacauccuggcc

SEQ ID NO: 2214236 - RNA, 12 nt, Human
gaaaacaaggaa

SEQ ID NO: 2214237 - RNA, 19 nt, Human
gaaaacacuguucucugcc

SEQ ID NO: 2214238 - RNA, 22 nt, Human
gaaaaauuuaagcauuguuugc

SEQ ID NO: 2214239 - RNA, 20 nt, Human
gaaaaauuuaagcauuguuu

SEQ ID NO: 2214240 - RNA, 19 nt, Human
gaaaaauuuaagcauuguu

SEQ ID NO: 2214241 - RNA, 14 nt, Human
gaaaacaaggauga

SEQ ID NO: 2214242 - RNA, 18 nt, Human
gaaaacaugcuacacacu

SEQ ID NO: 2214243 - RNA, 16 nt, Human
gaaaacaugcuacaca

SEQ ID NO: 2214244 - RNA, 20 nt, Human
gaaaacacuguucucugccc

SEQ ID NO: 2214245 - RNA, 21 nt, Human
gaaaacacuguucucugcccu

SEQ ID NO: 2214246 - RNA, 14 nt, Human
cuuugcauuuugga

SEQ ID NO: 2214247 - RNA, 19 nt, Human
cuuugcauuuuaaaaauga

SEQ ID NO: 2214248 - RNA, 22 nt, Human
cuuugcauuuuaaaaaugaaau

SEQ ID NO: 2214249 - RNA, 18 nt, Human
cuuugccacccucaugcu

SEQ ID NO: 2214250 - RNA, 17 nt, Human
cuuugccacccucaugc

SEQ ID NO: 2214251 - RNA, 16 nt, Human
cuuugccacccucaug

SEQ ID NO: 2214252 - RNA, 21 nt, Human
cuuugaccucaaccugugaug

SEQ ID NO: 2214253 - RNA, 21 nt, Human
cuuugcauggagacuugagga

SEQ ID NO: 2214254 - RNA, 21 nt, Human
cuuugcauggaauuuguaagu

SEQ ID NO: 2214255 - RNA, 20 nt, Human
cuuugcauguuccacuaacc

SEQ ID NO: 2214256 - RNA, 22 nt, Human
cuuugcauguuccacuaacccc

SEQ ID NO: 2214257 - RNA, 12 nt, Human
cuuugcauuuua

SEQ ID NO: 2214258 - RNA, 17 nt, Human
cuuugaauuuucugugu

SEQ ID NO: 2214259 - RNA, 19 nt, Human
cuuugacaaagguaaauca

SEQ ID NO: 2214260 - RNA, 18 nt, Human
cuuugaccucaaccugug

SEQ ID NO: 2214261 - RNA, 17 nt, Human
cuuugaccucaaccugu

SEQ ID NO: 2214262 - RNA, 22 nt, Human
cuuugcauaacguauaaaagcc

SEQ ID NO: 2214263 - RNA, 14 nt, Human
cuuugcuugcagua

SEQ ID NO: 2214264 - RNA, 20 nt, Human
cuuugcuucaaauccaucca

SEQ ID NO: 2214265 - RNA, 19 nt, Human
cuuugcuugcaguagauuu

SEQ ID NO: 2214266 - RNA, 15 nt, Human
cuuugcuucccauug

SEQ ID NO: 2214267 - RNA, 14 nt, Human
cuuugcuugaaaga

SEQ ID NO: 2214268 - RNA, 16 nt, Human
cuuugcuuucugcuca

SEQ ID NO: 2214269 - RNA, 15 nt, Human
cuuugcuuucugcuc

SEQ ID NO: 2214270 - RNA, 14 nt, Human
cuuugcuuucugcu

SEQ ID NO: 2214271 - RNA, 13 nt, Human
cuuugcuuucugc

SEQ ID NO: 2214272 - RNA, 12 nt, Human
cuuugcuuucug

SEQ ID NO: 2214273 - RNA, 17 nt, Human
cuuugcuugccucucug

SEQ ID NO: 2214274 - RNA, 20 nt, Human
cuuugcuugccucucuguuu

SEQ ID NO: 2214275 - RNA, 12 nt, Human
cuuuggaaagac

SEQ ID NO: 2214276 - RNA, 11 nt, Human
cuuugcuuugc

SEQ ID NO: 2214277 - RNA, 21 nt, Human
cuuugcuuucugcucagcuuc

SEQ ID NO: 2214278 - RNA, 19 nt, Human
cuuugcuuucugcucagcu

SEQ ID NO: 2214279 - RNA, 17 nt, Human
cuuugcuuucugcucag

SEQ ID NO: 2214280 - RNA, 17 nt, Human
cuuugcuuugcuuucug

SEQ ID NO: 2214281 - RNA, 19 nt, Human
cuuuggaaaaugcauugua

SEQ ID NO: 2214282 - RNA, 16 nt, Human
cuuugcuuugcccagc

SEQ ID NO: 2214283 - RNA, 23 nt, Human
cuuuggaaagacuuuuccaaccc

SEQ ID NO: 2214284 - RNA, 14 nt, Human
cuuuggcagaguuc

SEQ ID NO: 2214285 - RNA, 13 nt, Human
cuuuggcaggugc

SEQ ID NO: 2214286 - RNA, 18 nt, Human
cuuuggcacuggggcacu

SEQ ID NO: 2214287 - RNA, 24 nt, Human
cuuuggcaggugcagcccccacug

SEQ ID NO: 2214288 - RNA, 23 nt, Human
cuuugggaggccaaggugggagg

SEQ ID NO: 2214289 - RNA, 21 nt, Human
cuuuggaaaaugcauuguauc

SEQ ID NO: 2214290 - RNA, 20 nt, Human
cuuuggaaaaugcauuguau

SEQ ID NO: 2214291 - RNA, 15 nt, Human
cuuuggauuugacau

SEQ ID NO: 2214292 - RNA, 13 nt, Human
cuuuggauuugac

SEQ ID NO: 2214293 - RNA, 17 nt, Human
cuuuggaaacaggacca

SEQ ID NO: 2214294 - RNA, 12 nt, Human
cuuuggcacugg

SEQ ID NO: 2214295 - RNA, 17 nt, Human
cuuuggcacuggggcac

SEQ ID NO: 2214296 - RNA, 17 nt, Human
cuuuggauuugacauug

SEQ ID NO: 2214297 - RNA, 16 nt, Human
cuuuggauuugacauu

SEQ ID NO: 2214298 - RNA, 18 nt, Human
cuuugggaggcugaggcg

SEQ ID NO: 2214299 - RNA, 17 nt, Human
cuuugggaggcugaggc

SEQ ID NO: 2214300 - RNA, 14 nt, Human
cuuugggaggcuga

SEQ ID NO: 2214301 - RNA, 17 nt, Human
cuuuggccauuccaaca

SEQ ID NO: 2214302 - RNA, 21 nt, Human
cuuugggccagacaugccaca

SEQ ID NO: 2214303 - RNA, 13 nt, Human
cuuugggcccagg

SEQ ID NO: 2214304 - RNA, 15 nt, Human
cuuugggcccaggga

SEQ ID NO: 2214305 - RNA, 13 nt, Human
cuuugggccagac

SEQ ID NO: 2214306 - RNA, 12 nt, Human
cuuugggccaga

SEQ ID NO: 2214307 - RNA, 17 nt, Human
cuuugggccuggcuccc

SEQ ID NO: 2214308 - RNA, 16 nt, Human
cuuugggcccagggac

SEQ ID NO: 2214309 - RNA, 22 nt, Human
cuuugggcccagggacaccagc

SEQ ID NO: 2214310 - RNA, 23 nt, Human
cuuugggcccagggacaccagcc

SEQ ID NO: 2214311 - RNA, 23 nt, Human
cuuugugaggaagccgcuggggc

SEQ ID NO: 2214312 - RNA, 13 nt, Human
cuuuguggcuucc

SEQ ID NO: 2214313 - RNA, 13 nt, Human
cuuuguggccaag

SEQ ID NO: 2214314 - RNA, 12 nt, Human
cuuuguggccaa

SEQ ID NO: 2214315 - RNA, 11 nt, Human
cuuuguggcca

SEQ ID NO: 2214316 - RNA, 18 nt, Human
cuuugugauuauuucacu

SEQ ID NO: 2214317 - RNA, 23 nt, Human
cuuugugauucaaucuguaaacu

SEQ ID NO: 2214318 - RNA, 22 nt, Human
cuuugugauucaaucuguaaac

SEQ ID NO: 2214319 - RNA, 12 nt, Human
cuuugugauuuu

SEQ ID NO: 2214320 - RNA, 19 nt, Human
cuuugugaggaagccgcug

SEQ ID NO: 2214321 - RNA, 17 nt, Human
cuuugugauuauuucac

SEQ ID NO: 2214322 - RNA, 16 nt, Human
cuuuguucuggcucuu

SEQ ID NO: 2214323 - RNA, 21 nt, Human
cuuuguucuggcucuuccagg

SEQ ID NO: 2214324 - RNA, 22 nt, Human
cuuuguggccaaggagcugcua

SEQ ID NO: 2214325 - RNA, 16 nt, Human
cuuuguguagcuuugc

SEQ ID NO: 2214326 - RNA, 18 nt, Human
cuuuguguagcuuugcuc

SEQ ID NO: 2214327 - RNA, 21 nt, Human
cuuuguggccaaggagcugcu

SEQ ID NO: 2214328 - RNA, 20 nt, Human
cuuuguggccaaggagcugc

SEQ ID NO: 2214329 - RNA, 18 nt, Human
cuuuguggccaaggagcu

SEQ ID NO: 2214330 - RNA, 16 nt, Human
cuuuguggccaaggag

SEQ ID NO: 2214331 - RNA, 15 nt, Human
cuuuguggccaagga

SEQ ID NO: 2214332 - RNA, 14 nt, Human
cuuuguggccaagg

SEQ ID NO: 2214333 - RNA, 22 nt, Human
cuuugaaacaagauaacugaga

SEQ ID NO: 2214334 - RNA, 17 nt, Human
cuuugacaaagguaaau

SEQ ID NO: 2214335 - RNA, 19 nt, Human
cuuucuuuuuuuuuuuuga

SEQ ID NO: 2214336 - RNA, 20 nt, Human
cuuucuuuuucuucuucccu

SEQ ID NO: 2214337 - RNA, 16 nt, Human
cuuucuucuauuuuau

SEQ ID NO: 2214338 - RNA, 14 nt, Human
cuuucuucucugcu

SEQ ID NO: 2214339 - RNA, 21 nt, Human
cuuucuugaucaacaucuuuu

SEQ ID NO: 2214340 - RNA, 22 nt, Human
cuuucuugaucaacaucuuuuc

SEQ ID NO: 2214341 - RNA, 14 nt, Human
cuuucuuggccagu

SEQ ID NO: 2214342 - RNA, 13 nt, Human
cuuucuuggccag

SEQ ID NO: 2214343 - RNA, 21 nt, Human
cuuucuugcugguugucauuu

SEQ ID NO: 2214344 - RNA, 16 nt, Human
cuuucuugcugguugu

SEQ ID NO: 2214345 - RNA, 20 nt, Human
cuuucuugguucauaaauga

SEQ ID NO: 2214346 - RNA, 21 nt, Human
cuuucuugguucauaaaugaa

SEQ ID NO: 2214347 - RNA, 14 nt, Human
cuuucuuuuucuuc

SEQ ID NO: 2214348 - RNA, 15 nt, Human
cuuucuuuuucuucu

SEQ ID NO: 2214349 - RNA, 16 nt, Human
cuuucuuuuucuucuu

SEQ ID NO: 2214350 - RNA, 18 nt, Human
cuuucuuuugauucuucc

SEQ ID NO: 2214351 - RNA, 22 nt, Human
cuuucuugguucauaaaugaau

SEQ ID NO: 2214352 - RNA, 15 nt, Human
cuuucuuuaccugag

SEQ ID NO: 2214353 - RNA, 15 nt, Human
cuuucugcagaaaca

SEQ ID NO: 2214354 - RNA, 11 nt, Human
cuuucugccug

SEQ ID NO: 2214355 - RNA, 14 nt, Human
cuuucugccucuca

SEQ ID NO: 2214356 - RNA, 15 nt, Human
cuuucugccucucaa

SEQ ID NO: 2214357 - RNA, 12 nt, Human
cuuucugccugg

SEQ ID NO: 2214358 - RNA, 14 nt, Human
cuuucugccuggag

SEQ ID NO: 2214359 - RNA, 18 nt, Human
cuuucuguauauacuuuu

SEQ ID NO: 2214360 - RNA, 17 nt, Human
cuuucugcucagcuucu

SEQ ID NO: 2214361 - RNA, 16 nt, Human
cuuucugcucagcuuc

SEQ ID NO: 2214362 - RNA, 14 nt, Human
cuuucugcucagcu

SEQ ID NO: 2214363 - RNA, 13 nt, Human
cuuucugcucagc

SEQ ID NO: 2214364 - RNA, 15 nt, Human
cuuucugccuggagu

SEQ ID NO: 2214365 - RNA, 20 nt, Human
cuuucuguauauacuuuuuu

SEQ ID NO: 2214366 - RNA, 19 nt, Human
cuuucuguauauacuuuuu

SEQ ID NO: 2214367 - RNA, 23 nt, Human
cuuucugucccuucugucccuca

SEQ ID NO: 2214368 - RNA, 18 nt, Human
cuuucugucccuucuguc

SEQ ID NO: 2214369 - RNA, 19 nt, Human
cuuucuguccuuuuggcac

SEQ ID NO: 2214370 - RNA, 16 nt, Human
cuuucuguauugagua

SEQ ID NO: 2214371 - RNA, 14 nt, Human
cuuucugucucucu

SEQ ID NO: 2214372 - RNA, 21 nt, Human
cuuucugugugcaccuuacca

SEQ ID NO: 2214373 - RNA, 12 nt, Human
cuuucugugugc

SEQ ID NO: 2214374 - RNA, 15 nt, Human
cuuucugugugcacc

SEQ ID NO: 2214375 - RNA, 15 nt, Human
cuuucuucuauuuua

SEQ ID NO: 2214376 - RNA, 16 nt, Human
cuuucuuccucugcug

SEQ ID NO: 2214377 - RNA, 13 nt, Human
cuuuagaguagca

SEQ ID NO: 2214378 - RNA, 15 nt, Human
cuuguuggagccugc

SEQ ID NO: 2214379 - RNA, 17 nt, Human
cuuuagaguuagacugu

SEQ ID NO: 2214380 - RNA, 20 nt, Human
cuuuagaguuagacuguugg

SEQ ID NO: 2214381 - RNA, 18 nt, Human
cuuuaggcagcagcuuuu

SEQ ID NO: 2214382 - RNA, 21 nt, Human
cuuuaggagggaguuaucuaa

SEQ ID NO: 2214383 - RNA, 19 nt, Human
cuuuagagaaguauacaua

SEQ ID NO: 2214384 - RNA, 14 nt, Human
cuuuagaguuagac

SEQ ID NO: 2214385 - RNA, 19 nt, Human
cuuuagagcauugccauuc

SEQ ID NO: 2214386 - RNA, 23 nt, Human
cuuuagagcauugccauucccug

SEQ ID NO: 2214387 - RNA, 22 nt, Human
cuuuagagaaguauacauaagu

SEQ ID NO: 2214388 - RNA, 17 nt, Human
cuuuagagcauugccau

SEQ ID NO: 2214389 - RNA, 18 nt, Human
cuuuagagcauugccauu

SEQ ID NO: 2214390 - RNA, 15 nt, Human
cuuuagucgcugagg

SEQ ID NO: 2214391 - RNA, 19 nt, Human
cuuuaguaccugaaaagua

SEQ ID NO: 2214392 - RNA, 21 nt, Human
cuuuccucaggcaaggucugg

SEQ ID NO: 2214393 - RNA, 18 nt, Human
cuuuagggcagcuugccc

SEQ ID NO: 2214394 - RNA, 17 nt, Human
cuuuaguaccugaaaag

SEQ ID NO: 2214395 - RNA, 22 nt, Human
cuuuaguaccugaaaaguaacu

SEQ ID NO: 2214396 - RNA, 19 nt, Human
cuuuccucaaaacuucaga

SEQ ID NO: 2214397 - RNA, 13 nt, Human
cuuuagggcagcu

SEQ ID NO: 2214398 - RNA, 14 nt, Human
cuuuagggcagcuu

SEQ ID NO: 2214399 - RNA, 15 nt, Human
cuuuagggcagcuug

SEQ ID NO: 2214400 - RNA, 16 nt, Human
cuuuagggcagcuugc

SEQ ID NO: 2214401 - RNA, 15 nt, Human
cuuuaggcauuaaau

SEQ ID NO: 2214402 - RNA, 21 nt, Human
cuuuagggacucaauuucucc

SEQ ID NO: 2214403 - RNA, 23 nt, Human
cuuuagggacucaauuucucccc

SEQ ID NO: 2214404 - RNA, 23 nt, Human
cuuuaggcauuaaauuuuagcaa

SEQ ID NO: 2214405 - RNA, 19 nt, Human
cuuuccucuuccccuugcc

SEQ ID NO: 2214406 - RNA, 20 nt, Human
cuuucugaagccucacuuau

SEQ ID NO: 2214407 - RNA, 21 nt, Human
cuuucugauaacuagauggug

SEQ ID NO: 2214408 - RNA, 23 nt, Human
cuuucugauaacuagauggugcu

SEQ ID NO: 2214409 - RNA, 21 nt, Human
cuuucugagcacacuuuagug

SEQ ID NO: 2214410 - RNA, 17 nt, Human
cuuucugagcacacuuu

SEQ ID NO: 2214411 - RNA, 20 nt, Human
cuuucugagcacacuuuagu

SEQ ID NO: 2214412 - RNA, 13 nt, Human
cuuucugaaauaa

SEQ ID NO: 2214413 - RNA, 16 nt, Human
cuuuccucuuuggucu

SEQ ID NO: 2214414 - RNA, 14 nt, Human
cuuuccuccuucca

SEQ ID NO: 2214415 - RNA, 13 nt, Human
cuuuccuccuucc

SEQ ID NO: 2214416 - RNA, 16 nt, Human
cuuuccuccuuccaug

SEQ ID NO: 2214417 - RNA, 16 nt, Human
cuuuccuccuggcaga

SEQ ID NO: 2214418 - RNA, 13 nt, Human
cuuuccucuuccc

SEQ ID NO: 2214419 - RNA, 14 nt, Human
cuuuccucuucccc

SEQ ID NO: 2214420 - RNA, 13 nt, Human
cuuuccucgccug

SEQ ID NO: 2214421 - RNA, 18 nt, Human
cuucguuuacuaugccug

SEQ ID NO: 2214422 - RNA, 21 nt, Human
cuucguuuacuaugccugugu

SEQ ID NO: 2214423 - RNA, 19 nt, Human
cuucguuuacuaugccugu

SEQ ID NO: 2214424 - RNA, 18 nt, Human
cuucguuuauuuucaaga

SEQ ID NO: 2214425 - RNA, 16 nt, Human
cuucguuuauuuucaa

SEQ ID NO: 2214426 - RNA, 15 nt, Human
cuucguuuauuuuca

SEQ ID NO: 2214427 - RNA, 18 nt, Human
cuucuaaacuuccccauc

SEQ ID NO: 2214428 - RNA, 19 nt, Human
cuucuaaacccaauccaaa

SEQ ID NO: 2214429 - RNA, 15 nt, Human
cuucuaaagguguug

SEQ ID NO: 2214430 - RNA, 22 nt, Human
cuucuaaagguguugucccuuc

SEQ ID NO: 2214431 - RNA, 21 nt, Human
cuucuaaagguguugucccuu

SEQ ID NO: 2214432 - RNA, 22 nt, Human
cuucuaaacuuccccaucuucu

SEQ ID NO: 2214433 - RNA, 19 nt, Human
cuucuaaacuuccccaucu

SEQ ID NO: 2214434 - RNA, 14 nt, Human
cuucucagcuccca

SEQ ID NO: 2214435 - RNA, 14 nt, Human
cuucucagaaucua

SEQ ID NO: 2214436 - RNA, 18 nt, Human
cuucucagaaucuaccca

SEQ ID NO: 2214437 - RNA, 21 nt, Human
cuucucaggcucugcccugcc

SEQ ID NO: 2214438 - RNA, 20 nt, Human
cuucucaggcucugcccugc

SEQ ID NO: 2214439 - RNA, 19 nt, Human
cuucucaggcucugcccug

SEQ ID NO: 2214440 - RNA, 16 nt, Human
cuucucaggcucugcc

SEQ ID NO: 2214441 - RNA, 15 nt, Human
cuucucaggcucugc

SEQ ID NO: 2214442 - RNA, 13 nt, Human
cuucucaggcucu

SEQ ID NO: 2214443 - RNA, 22 nt, Human
cuucucaggcaugaacauguac

SEQ ID NO: 2214444 - RNA, 15 nt, Human
cuucucauagcauua

SEQ ID NO: 2214445 - RNA, 13 nt, Human
cuucucauagcau

SEQ ID NO: 2214446 - RNA, 22 nt, Human
cuucucaggcucugcccugccc

SEQ ID NO: 2214447 - RNA, 16 nt, Human
cuucucauacguccac

SEQ ID NO: 2214448 - RNA, 22 nt, Human
cuucucauagcauuaacuaauc

SEQ ID NO: 2214449 - RNA, 21 nt, Human
cuucucauuucaccccucccu

SEQ ID NO: 2214450 - RNA, 21 nt, Human
cuucgggaggucgaggcagga

SEQ ID NO: 2214451 - RNA, 20 nt, Human
cuucgggaggucgaggcagg

SEQ ID NO: 2214452 - RNA, 15 nt, Human
cuucgggcugugccc

SEQ ID NO: 2214453 - RNA, 14 nt, Human
cuucgggcugugcc

SEQ ID NO: 2214454 - RNA, 17 nt, Human
cuucgggcccuucccac

SEQ ID NO: 2214455 - RNA, 16 nt, Human
cuucgggcccuuccca

SEQ ID NO: 2214456 - RNA, 23 nt, Human
cuucgagguggaucacagaggcu

SEQ ID NO: 2214457 - RNA, 17 nt, Human
cuucgagcacuguccag

SEQ ID NO: 2214458 - RNA, 17 nt, Human
cuucggccuccauccug

SEQ ID NO: 2214459 - RNA, 19 nt, Human
cuucggccuccauccugag

SEQ ID NO: 2214460 - RNA, 18 nt, Human
cuucggccuccauccuga

SEQ ID NO: 2214461 - RNA, 14 nt, Human
cuucgacucaggau

SEQ ID NO: 2214462 - RNA, 15 nt, Human
cuucgacucaggauc

SEQ ID NO: 2214463 - RNA, 16 nt, Human
cuucgacucaggaucc

SEQ ID NO: 2214464 - RNA, 13 nt, Human
cuucgacugugac

SEQ ID NO: 2214465 - RNA, 18 nt, Human
cuucgacucaggauccag

SEQ ID NO: 2214466 - RNA, 13 nt, Human
cuucgcuccugug

SEQ ID NO: 2214467 - RNA, 14 nt, Human
cuucgcuccugugu

SEQ ID NO: 2214468 - RNA, 15 nt, Human
cuucgcuccuguguc

SEQ ID NO: 2214469 - RNA, 17 nt, Human
cuuccuugcuuaaggua

SEQ ID NO: 2214470 - RNA, 20 nt, Human
cuuccuuggacucauuuuaa

SEQ ID NO: 2214471 - RNA, 20 nt, Human
cuuccuugcuguccuaggcc

SEQ ID NO: 2214472 - RNA, 19 nt, Human
cuuccuugcuguccuaggc

SEQ ID NO: 2214473 - RNA, 19 nt, Human
cuuccuuggacucauuuua

SEQ ID NO: 2214474 - RNA, 15 nt, Human
cuuccuuuugaggga

SEQ ID NO: 2214475 - RNA, 15 nt, Human
cuucgaaaccuggga

SEQ ID NO: 2214476 - RNA, 15 nt, Human
cuuccuuuucccugc

SEQ ID NO: 2214477 - RNA, 16 nt, Human
cuuccuuuucccugcu

SEQ ID NO: 2214478 - RNA, 17 nt, Human
cuuccuuuucccugcuu

SEQ ID NO: 2214479 - RNA, 19 nt, Human
cuuccuuuucccugcuucc

SEQ ID NO: 2214480 - RNA, 20 nt, Human
cuucgaaagcaucauuauuu

SEQ ID NO: 2214481 - RNA, 22 nt, Human
cuuccuuuucccugcuuccagg

SEQ ID NO: 2214482 - RNA, 17 nt, Human
cuuccuugcuguccuag

SEQ ID NO: 2214483 - RNA, 16 nt, Human
cuuccuugcucugcac

SEQ ID NO: 2214484 - RNA, 17 nt, Human
cuuccuugcucugcacc

SEQ ID NO: 2214485 - RNA, 19 nt, Human
cuuccuugcuaaugcacca

SEQ ID NO: 2214486 - RNA, 14 nt, Human
cuuccuugcucucc

SEQ ID NO: 2214487 - RNA, 15 nt, Human
cuuccuugcucuccc

SEQ ID NO: 2214488 - RNA, 15 nt, Human
cuuccuugcucugca

SEQ ID NO: 2214489 - RNA, 22 nt, Human
cuuccuugaccagcagauccca

SEQ ID NO: 2214490 - RNA, 23 nt, Human
cuuccuugagacacggagcccag

SEQ ID NO: 2214491 - RNA, 20 nt, Human
cuuccuugagacacggagcc

SEQ ID NO: 2214492 - RNA, 18 nt, Human
cuuccuugagacacggag

SEQ ID NO: 2214493 - RNA, 16 nt, Human
cuuccuugaccagcag

SEQ ID NO: 2214494 - RNA, 15 nt, Human
cuuccuugaccagca

SEQ ID NO: 2214495 - RNA, 14 nt, Human
cuuccuugaccagc

SEQ ID NO: 2214496 - RNA, 22 nt, Human
cuuccuugaagaacugcaggcc

SEQ ID NO: 2214497 - RNA, 21 nt, Human
cuuccuucccugggcugugcu

SEQ ID NO: 2214498 - RNA, 11 nt, Human
cuuccuucugc

SEQ ID NO: 2214499 - RNA, 18 nt, Human
cuuccuucugccugagcu

SEQ ID NO: 2214500 - RNA, 21 nt, Human
cuuccuugaagaacugcaggc

SEQ ID NO: 2214501 - RNA, 17 nt, Human
cuuccuucccuggcuug

SEQ ID NO: 2214502 - RNA, 15 nt, Human
cuuccuucccuggcu

SEQ ID NO: 2214503 - RNA, 16 nt, Human
cuuccuucccugggcu

SEQ ID NO: 2214504 - RNA, 18 nt, Human
cuuccuucccugggcugu

SEQ ID NO: 2214505 - RNA, 13 nt, Human
cuuccuucccugg

SEQ ID NO: 2214506 - RNA, 14 nt, Human
cuuccuucccuggc

SEQ ID NO: 2214507 - RNA, 21 nt, Human
cuuccuagaaguuacugaaug

SEQ ID NO: 2214508 - RNA, 22 nt, Human
cuuccuagaaguuacugaaugc

SEQ ID NO: 2214509 - RNA, 23 nt, Human
cuuccuacccacaccucugccag

SEQ ID NO: 2214510 - RNA, 14 nt, Human
cuucucucaccucc

SEQ ID NO: 2214511 - RNA, 15 nt, Human
cuucucuacagacuu

SEQ ID NO: 2214512 - RNA, 15 nt, Human
cuucucuagcuggug

SEQ ID NO: 2214513 - RNA, 17 nt, Human
cuucucuagcugguggu

SEQ ID NO: 2214514 - RNA, 15 nt, Human
cuucucucaccuccu

SEQ ID NO: 2214515 - RNA, 16 nt, Human
cuucucucaccuccua

SEQ ID NO: 2214516 - RNA, 18 nt, Human
cuucucucaccuccuaaa

SEQ ID NO: 2214517 - RNA, 15 nt, Human
cuucugccauauucu

SEQ ID NO: 2214518 - RNA, 17 nt, Human
cuucugccauauucugu

SEQ ID NO: 2214519 - RNA, 20 nt, Human
cuucugccauuucugagauc

SEQ ID NO: 2214520 - RNA, 14 nt, Human
cuucucucaucucu

SEQ ID NO: 2214521 - RNA, 16 nt, Human
cuucucucaucucuua

SEQ ID NO: 2214522 - RNA, 21 nt, Human
cuucugccauauucuguuggc

SEQ ID NO: 2214523 - RNA, 19 nt, Human
cuucugcuacuggcaaaag

SEQ ID NO: 2214524 - RNA, 13 nt, Human
cuucugcuacugg

SEQ ID NO: 2214525 - RNA, 11 nt, Human
cuucugcuacu

SEQ ID NO: 2214526 - RNA, 20 nt, Human
cuucucucagacuuacuuua

SEQ ID NO: 2214527 - RNA, 16 nt, Human
cuucugccuucucaug

SEQ ID NO: 2214528 - RNA, 13 nt, Human
cuucugccuuuuu

SEQ ID NO: 2214529 - RNA, 14 nt, Human
cuucugccuucuca

SEQ ID NO: 2214530 - RNA, 21 nt, Human
cuucugccuuagucucaguuu

SEQ ID NO: 2214531 - RNA, 19 nt, Human
cuucugccuuagucucagu

SEQ ID NO: 2214532 - RNA, 20 nt, Human
cuucugccuuagucucaguu

SEQ ID NO: 2214533 - RNA, 13 nt, Human
cuucuggagcccu

SEQ ID NO: 2214534 - RNA, 11 nt, Human
cuucuggagcc

SEQ ID NO: 2214535 - RNA, 23 nt, Human
cuucugcuuuucugcccuggcug

SEQ ID NO: 2214536 - RNA, 14 nt, Human
cuucugcuuuucug

SEQ ID NO: 2214537 - RNA, 16 nt, Human
cuucugcuuuucugcc

SEQ ID NO: 2214538 - RNA, 17 nt, Human
cuucugcuuuucugccc

SEQ ID NO: 2214539 - RNA, 18 nt, Human
cuucugcuuuucugcccu

SEQ ID NO: 2214540 - RNA, 19 nt, Human
cuucugcuuuucugcccug

SEQ ID NO: 2214541 - RNA, 20 nt, Human
cuucugcuuuucugcccugg

SEQ ID NO: 2214542 - RNA, 21 nt, Human
cuucugcuuuucugcccuggc

SEQ ID NO: 2214543 - RNA, 22 nt, Human
cuucugcuuuucugcccuggcu

SEQ ID NO: 2214544 - RNA, 13 nt, Human
cuucugcuccacc

SEQ ID NO: 2214545 - RNA, 20 nt, Human
cuucugcuacuggcaaaagg

SEQ ID NO: 2214546 - RNA, 18 nt, Human
cuucugcuucagccuccc

SEQ ID NO: 2214547 - RNA, 14 nt, Human
cuucugcuccaccc

SEQ ID NO: 2214548 - RNA, 12 nt, Human
cuucugcuccac

SEQ ID NO: 2214549 - RNA, 10 nt, Human
cuucugcucc

SEQ ID NO: 2214550 - RNA, 18 nt, Human
cuucugcucagcucuggg

SEQ ID NO: 2214551 - RNA, 16 nt, Human
cuucugcucagcucug

SEQ ID NO: 2214552 - RNA, 15 nt, Human
cuucugcucagcucu

SEQ ID NO: 2214553 - RNA, 14 nt, Human
cuucugcucagcuc

SEQ ID NO: 2214554 - RNA, 16 nt, Human
cuucugcuucagccuc

SEQ ID NO: 2214555 - RNA, 17 nt, Human
cuucugcuucagccucc

SEQ ID NO: 2214556 - RNA, 14 nt, Human
cuucuccaucuggc

SEQ ID NO: 2214557 - RNA, 21 nt, Human
cuucuccaucucucuggcccu

SEQ ID NO: 2214558 - RNA, 13 nt, Human
cuucucccacacu

SEQ ID NO: 2214559 - RNA, 16 nt, Human
cuucuccauccacaug

SEQ ID NO: 2214560 - RNA, 20 nt, Human
cuucuccauccuuucugccu

SEQ ID NO: 2214561 - RNA, 22 nt, Human
cuucuccauccuuucugccucu

SEQ ID NO: 2214562 - RNA, 11 nt, Human
cuucuccaucu

SEQ ID NO: 2214563 - RNA, 13 nt, Human
cuucuccaucucu

SEQ ID NO: 2214564 - RNA, 18 nt, Human
cuucuccaucucucuggc

SEQ ID NO: 2214565 - RNA, 19 nt, Human
cuucuccaucucucuggcc

SEQ ID NO: 2214566 - RNA, 17 nt, Human
cuucuccaggcuguauc

SEQ ID NO: 2214567 - RNA, 22 nt, Human
cuucucauuucaccccucccuu

SEQ ID NO: 2214568 - RNA, 19 nt, Human
cuucuccaauucugcccaa

SEQ ID NO: 2214569 - RNA, 13 nt, Human
cuucuccaggguc

SEQ ID NO: 2214570 - RNA, 14 nt, Human
cuucuccauccaca

SEQ ID NO: 2214571 - RNA, 19 nt, Human
cuucuccaggguccacagg

SEQ ID NO: 2214572 - RNA, 20 nt, Human
cuucuccaggucucacgggc

SEQ ID NO: 2214573 - RNA, 16 nt, Human
cuucuccacccugcuc

SEQ ID NO: 2214574 - RNA, 14 nt, Human
cuucuccaggcugu

SEQ ID NO: 2214575 - RNA, 14 nt, Human
cuucuccacccugc

SEQ ID NO: 2214576 - RNA, 15 nt, Human
cuucuccacccugcu

SEQ ID NO: 2214577 - RNA, 14 nt, Human
cuucucccacacug

SEQ ID NO: 2214578 - RNA, 17 nt, Human
cuucuccaucuggcagg

SEQ ID NO: 2214579 - RNA, 16 nt, Human
cuucucccacacugcu

SEQ ID NO: 2214580 - RNA, 18 nt, Human
cuucucccacuuggccaa

SEQ ID NO: 2214581 - RNA, 22 nt, Human
cuucuccuucaccuuugucccc

SEQ ID NO: 2214582 - RNA, 13 nt, Human
cuucucccaugag

SEQ ID NO: 2214583 - RNA, 16 nt, Human
cuucuccccagaguuc

SEQ ID NO: 2214584 - RNA, 12 nt, Human
cuucuccccaga

SEQ ID NO: 2214585 - RNA, 20 nt, Human
cuucucuaaaugaggggccu

SEQ ID NO: 2214586 - RNA, 21 nt, Human
cuucucgaccacgggaagcau

SEQ ID NO: 2214587 - RNA, 11 nt, Human
cuucucuacag

SEQ ID NO: 2214588 - RNA, 13 nt, Human
cuucucuacagac

SEQ ID NO: 2214589 - RNA, 20 nt, Human
cuucuccuuucacaaccuuc

SEQ ID NO: 2214590 - RNA, 22 nt, Human
cuucuccuuucacaaccuucug

SEQ ID NO: 2214591 - RNA, 14 nt, Human
cuucuccuuucaca

SEQ ID NO: 2214592 - RNA, 17 nt, Human
cuucuccuuucacaacc

SEQ ID NO: 2214593 - RNA, 16 nt, Human
cuuccagcacccugca

SEQ ID NO: 2214594 - RNA, 15 nt, Human
cuuccagcacccugc

SEQ ID NO: 2214595 - RNA, 14 nt, Human
cuuccagcacccug

SEQ ID NO: 2214596 - RNA, 16 nt, Human
cuuccaccagccugca

SEQ ID NO: 2214597 - RNA, 15 nt, Human
cuuccaccagccugc

SEQ ID NO: 2214598 - RNA, 14 nt, Human
cuuccaccagccug

SEQ ID NO: 2214599 - RNA, 13 nt, Human
cuuccaccagccu

SEQ ID NO: 2214600 - RNA, 12 nt, Human
cuuccaccagcc

SEQ ID NO: 2214601 - RNA, 19 nt, Human
cuuccagauccuggaaauc

SEQ ID NO: 2214602 - RNA, 13 nt, Human
cuuccaggaaacu

SEQ ID NO: 2214603 - RNA, 15 nt, Human
cuuccagcuccugua

SEQ ID NO: 2214604 - RNA, 12 nt, Human
cuuccagcuccu

SEQ ID NO: 2214605 - RNA, 13 nt, Human
cuuccagcuccug

SEQ ID NO: 2214606 - RNA, 22 nt, Human
cuuccaggggugggacacccug

SEQ ID NO: 2214607 - RNA, 24 nt, Human
cuuccaggggugggacacccugug

SEQ ID NO: 2214608 - RNA, 20 nt, Human
cuucccagcucucccucugg

SEQ ID NO: 2214609 - RNA, 18 nt, Human
cuucccagcucucccucu

SEQ ID NO: 2214610 - RNA, 15 nt, Human
cuucccagcucuccc

SEQ ID NO: 2214611 - RNA, 14 nt, Human
cuucccagcucucc

SEQ ID NO: 2214612 - RNA, 21 nt, Human
cuucccagcagggccacuccc

SEQ ID NO: 2214613 - RNA, 14 nt, Human
cuucccacuggagg

SEQ ID NO: 2214614 - RNA, 15 nt, Human
cuucccacuggaggu

SEQ ID NO: 2214615 - RNA, 15 nt, Human
cuuccagugaggcuc

SEQ ID NO: 2214616 - RNA, 22 nt, Human
cuuccagucuuccugacacuuu

SEQ ID NO: 2214617 - RNA, 20 nt, Human
cuuccaguccaaucucaugg

SEQ ID NO: 2214618 - RNA, 19 nt, Human
cuucccacucuagggcagu

SEQ ID NO: 2214619 - RNA, 20 nt, Human
cuucccacucuagggcagug

SEQ ID NO: 2214620 - RNA, 22 nt, Human
cuucccacucuagggcagugga

SEQ ID NO: 2214621 - RNA, 20 nt, Human
cuuccagguaucuccaggau

SEQ ID NO: 2214622 - RNA, 13 nt, Human
cuuccagucagga

SEQ ID NO: 2214623 - RNA, 17 nt, Human
cuuccaguccaaucuca

SEQ ID NO: 2214624 - RNA, 21 nt, Human
cuuccagucuuccugacacuu

SEQ ID NO: 2214625 - RNA, 20 nt, Human
cuuccagucuuccugacacu

SEQ ID NO: 2214626 - RNA, 14 nt, Human
cuuccagugaggcu

SEQ ID NO: 2214627 - RNA, 22 nt, Human
cuuccagguguuacuguaauuc

SEQ ID NO: 2214628 - RNA, 20 nt, Human
cuuccagguguuacuguaau

SEQ ID NO: 2214629 - RNA, 19 nt, Human
cuuccagguguuacuguaa

SEQ ID NO: 2214630 - RNA, 16 nt, Human
cuuccagguguuacug

SEQ ID NO: 2214631 - RNA, 19 nt, Human
cuuccaggugcccagcuau

SEQ ID NO: 2214632 - RNA, 16 nt, Human
cuuccaggugcccagc

SEQ ID NO: 2214633 - RNA, 14 nt, Human
cuuccagcuccugu

SEQ ID NO: 2214634 - RNA, 18 nt, Human
cuuccagguaucuccagg

SEQ ID NO: 2214635 - RNA, 19 nt, Human
cuuccagguaucuccagga

SEQ ID NO: 2214636 - RNA, 16 nt, Human
cuucccucuccccaag

SEQ ID NO: 2214637 - RNA, 15 nt, Human
cuucccucccuaucu

SEQ ID NO: 2214638 - RNA, 17 nt, Human
cuucccucaccuuggca

SEQ ID NO: 2214639 - RNA, 16 nt, Human
cuucccucaucucucc

SEQ ID NO: 2214640 - RNA, 17 nt, Human
cuucccucaucucuccu

SEQ ID NO: 2214641 - RNA, 15 nt, Human
cuucccucacaccgc

SEQ ID NO: 2214642 - RNA, 16 nt, Human
cuucccgcucagcccu

SEQ ID NO: 2214643 - RNA, 17 nt, Human
cuucccgcucagcccuc

SEQ ID NO: 2214644 - RNA, 23 nt, Human
cuuccccuugcccagggcucagc

SEQ ID NO: 2214645 - RNA, 19 nt, Human
cuuccccuugcccagggcu

SEQ ID NO: 2214646 - RNA, 14 nt, Human
cuuccccuugcccu

SEQ ID NO: 2214647 - RNA, 17 nt, Human
cuuccccuugcccuugc

SEQ ID NO: 2214648 - RNA, 22 nt, Human
cuuccccuugcccuugcccuga

SEQ ID NO: 2214649 - RNA, 23 nt, Human
cuuccccuugcccuugcccugac

SEQ ID NO: 2214650 - RNA, 15 nt, Human
cuucccgcucagccc

SEQ ID NO: 2214651 - RNA, 13 nt, Human
cuuccccuuuccc

SEQ ID NO: 2214652 - RNA, 22 nt, Human
cuucccagcucucccucuggcc

SEQ ID NO: 2214653 - RNA, 21 nt, Human
cuucccagcucucccucuggc

SEQ ID NO: 2214654 - RNA, 18 nt, Human
cuucccaggcuggggcug

SEQ ID NO: 2214655 - RNA, 22 nt, Human
cuucccaggcuggggcugaccu

SEQ ID NO: 2214656 - RNA, 19 nt, Human
cuucccaggaguggaggag

SEQ ID NO: 2214657 - RNA, 11 nt, Human
cuucccagggu

SEQ ID NO: 2214658 - RNA, 19 nt, Human
cuucccaggguagcccgcc

SEQ ID NO: 2214659 - RNA, 21 nt, Human
cuucccaggguagcccgccug

SEQ ID NO: 2214660 - RNA, 21 nt, Human
cuucccagguaagcaggagga

SEQ ID NO: 2214661 - RNA, 14 nt, Human
cuucccaguggcug

SEQ ID NO: 2214662 - RNA, 15 nt, Human
cuucccaguggcugc

SEQ ID NO: 2214663 - RNA, 19 nt, Human
cuucccucugccugucccu

SEQ ID NO: 2214664 - RNA, 18 nt, Human
cuucccucugccuguccc

SEQ ID NO: 2214665 - RNA, 17 nt, Human
cuucccucugccugucc

SEQ ID NO: 2214666 - RNA, 16 nt, Human
cuucccucugccuguc

SEQ ID NO: 2214667 - RNA, 15 nt, Human
cuucccucugccugu

SEQ ID NO: 2214668 - RNA, 13 nt, Human
cuucccucugccu

SEQ ID NO: 2214669 - RNA, 11 nt, Human
cuucccucugc

SEQ ID NO: 2214670 - RNA, 14 nt, Human
cuucccuuuuacau

SEQ ID NO: 2214671 - RNA, 16 nt, Human
cuucccucuguuucuc

SEQ ID NO: 2214672 - RNA, 17 nt, Human
cuucccucuguuucucu

SEQ ID NO: 2214673 - RNA, 21 nt, Human
cuucccucuguuucucuuucc

SEQ ID NO: 2214674 - RNA, 20 nt, Human
cuuccgaaaaauccucuucc

SEQ ID NO: 2214675 - RNA, 21 nt, Human
cuuccgaaaaauccucuuccu

SEQ ID NO: 2214676 - RNA, 22 nt, Human
cuuccgaaaaauccucuuccuc

SEQ ID NO: 2214677 - RNA, 23 nt, Human
cuuccgaaaaauccucuuccucu

SEQ ID NO: 2214678 - RNA, 18 nt, Human
cuuccgcauccuagucuc

SEQ ID NO: 2214679 - RNA, 15 nt, Human
cuuccgcauccuagu

SEQ ID NO: 2214680 - RNA, 17 nt, Human
cuuccgcauccuagucu

SEQ ID NO: 2214681 - RNA, 14 nt, Human
cuuccggagaugua

SEQ ID NO: 2214682 - RNA, 15 nt, Human
cuuccggagauguag

SEQ ID NO: 2214683 - RNA, 15 nt, Human
cuuccggcuccugug

SEQ ID NO: 2214684 - RNA, 18 nt, Human
cuuccuacaagagcagcc

SEQ ID NO: 2214685 - RNA, 24 nt, Human
cuuccuacaagagcagccuguggc

SEQ ID NO: 2214686 - RNA, 18 nt, Human
cuuccggcuccugugcuu

SEQ ID NO: 2214687 - RNA, 23 nt, Human
cuuccuacacccuuggacuugag

SEQ ID NO: 2214688 - RNA, 22 nt, Human
cuuccuacaagagcagccugug

SEQ ID NO: 2214689 - RNA, 21 nt, Human
cuuccuacaagagcagccugu

SEQ ID NO: 2214690 - RNA, 16 nt, Human
cuuccuacccacaccu

SEQ ID NO: 2214691 - RNA, 18 nt, Human
cuuccuacccacaccucu

SEQ ID NO: 2214692 - RNA, 19 nt, Human
cuuccuacccacaccucug

SEQ ID NO: 2214693 - RNA, 22 nt, Human
cuuccuacccacaccucugcca

SEQ ID NO: 2214694 - RNA, 14 nt, Human
cuucagggggccag

SEQ ID NO: 2214695 - RNA, 15 nt, Human
cuucagggggccagg

SEQ ID NO: 2214696 - RNA, 23 nt, Human
cuucagggggccaggugcacaga

SEQ ID NO: 2214697 - RNA, 23 nt, Human
cuucaggggcugcccgcucccag

SEQ ID NO: 2214698 - RNA, 18 nt, Human
cuucagggugaugccagg

SEQ ID NO: 2214699 - RNA, 21 nt, Human
cuucaggguucuccucucccc

SEQ ID NO: 2214700 - RNA, 20 nt, Human
cuucaggguucuccucuccc

SEQ ID NO: 2214701 - RNA, 18 nt, Human
cuucaggguucuccucuc

SEQ ID NO: 2214702 - RNA, 14 nt, Human
cuucaggguucucc

SEQ ID NO: 2214703 - RNA, 23 nt, Human
cuucaggguucuccucuccccuc

SEQ ID NO: 2214704 - RNA, 17 nt, Human
cuucagugcccaccaac

SEQ ID NO: 2214705 - RNA, 11 nt, Human
cuucagugccu

SEQ ID NO: 2214706 - RNA, 12 nt, Human
cuucagugccuu

SEQ ID NO: 2214707 - RNA, 18 nt, Human
cuucauuuccugugucuu

SEQ ID NO: 2214708 - RNA, 14 nt, Human
cuucauuuccuccg

SEQ ID NO: 2214709 - RNA, 18 nt, Human
cuucauuucauuguauga

SEQ ID NO: 2214710 - RNA, 19 nt, Human
cuucauuucauuguaugau

SEQ ID NO: 2214711 - RNA, 15 nt, Human
cuucauuucauugua

SEQ ID NO: 2214712 - RNA, 16 nt, Human
cuucauuucauuguau

SEQ ID NO: 2214713 - RNA, 17 nt, Human
cuucauuucauuguaug

SEQ ID NO: 2214714 - RNA, 13 nt, Human
cuucagugccuua

SEQ ID NO: 2214715 - RNA, 14 nt, Human
cuucagugccuuau

SEQ ID NO: 2214716 - RNA, 16 nt, Human
cuuccaagcaaaggug

SEQ ID NO: 2214717 - RNA, 15 nt, Human
cuuccaagguggucu

SEQ ID NO: 2214718 - RNA, 16 nt, Human
cuuccaagguggucug

SEQ ID NO: 2214719 - RNA, 18 nt, Human
cuuccaagguggucugcu

SEQ ID NO: 2214720 - RNA, 15 nt, Human
cuuccaagagccuga

SEQ ID NO: 2214721 - RNA, 22 nt, Human
cuuccacaagagcccaggccuc

SEQ ID NO: 2214722 - RNA, 23 nt, Human
cuuccacaagagcccaggccucc

SEQ ID NO: 2214723 - RNA, 14 nt, Human
cuuccacaccccca

SEQ ID NO: 2214724 - RNA, 20 nt, Human
cuuccaagguggucugcucg

SEQ ID NO: 2214725 - RNA, 21 nt, Human
cuuccaagguggucugcucgg

SEQ ID NO: 2214726 - RNA, 23 nt, Human
cuuccacacccccaccccuugcu

SEQ ID NO: 2214727 - RNA, 14 nt, Human
cuuccaagagccug

SEQ ID NO: 2214728 - RNA, 18 nt, Human
cuuccaacaggagcuggg

SEQ ID NO: 2214729 - RNA, 19 nt, Human
cuuccaacccauuagccau

SEQ ID NO: 2214730 - RNA, 20 nt, Human
cuuccaaauccccuaagcag

SEQ ID NO: 2214731 - RNA, 19 nt, Human
cuuccaaauccccuaagca

SEQ ID NO: 2214732 - RNA, 13 nt, Human
cuucauuuggaga

SEQ ID NO: 2214733 - RNA, 14 nt, Human
cuucauuuggagau

SEQ ID NO: 2214734 - RNA, 18 nt, Human
cuucauuugggaugcuac

SEQ ID NO: 2214735 - RNA, 16 nt, Human
cuuccaaauccccuaa

SEQ ID NO: 2214736 - RNA, 22 nt, Human
cuucagccuagccgaccucagc

SEQ ID NO: 2214737 - RNA, 21 nt, Human
cuucagccuagccgaccucag

SEQ ID NO: 2214738 - RNA, 20 nt, Human
cuucagccuagccgaccuca

SEQ ID NO: 2214739 - RNA, 13 nt, Human
cuucagccuagcc

SEQ ID NO: 2214740 - RNA, 18 nt, Human
cuucagcgguuuauauaa

SEQ ID NO: 2214741 - RNA, 18 nt, Human
cuucagccaggagcuggg

SEQ ID NO: 2214742 - RNA, 19 nt, Human
cuucagccaggagcugggc

SEQ ID NO: 2214743 - RNA, 14 nt, Human
cuucagccaucaac

SEQ ID NO: 2214744 - RNA, 15 nt, Human
cuucagcccucaccc

SEQ ID NO: 2214745 - RNA, 16 nt, Human
cuucagcccucacccc

SEQ ID NO: 2214746 - RNA, 17 nt, Human
cuucagcccucaccccu

SEQ ID NO: 2214747 - RNA, 19 nt, Human
cuucagcccucaccccugg

SEQ ID NO: 2214748 - RNA, 21 nt, Human
cuuauuguuccaagacauugu

SEQ ID NO: 2214749 - RNA, 14 nt, Human
cuuauuuucucugu

SEQ ID NO: 2214750 - RNA, 16 nt, Human
cuuauuuucauguaua

SEQ ID NO: 2214751 - RNA, 15 nt, Human
cuuauuuucucugug

SEQ ID NO: 2214752 - RNA, 17 nt, Human
cuuauuuuugacagugu

SEQ ID NO: 2214753 - RNA, 21 nt, Human
cuuauuuuuaaaauuuuaaua

SEQ ID NO: 2214754 - RNA, 14 nt, Human
cuuauuuuuuccca

SEQ ID NO: 2214755 - RNA, 15 nt, Human
cuuauuuuuucccaa

SEQ ID NO: 2214756 - RNA, 19 nt, Human
cuuauuuuuucccaaagcc

SEQ ID NO: 2214757 - RNA, 16 nt, Human
cuuauuuuuuucugau

SEQ ID NO: 2214758 - RNA, 17 nt, Human
cuucagccaccucucuu

SEQ ID NO: 2214759 - RNA, 15 nt, Human
cuucagccaccucuc

SEQ ID NO: 2214760 - RNA, 15 nt, Human
cuucagccaggagcu

SEQ ID NO: 2214761 - RNA, 17 nt, Human
cuucagccaggagcugg

SEQ ID NO: 2214762 - RNA, 17 nt, Human
cuuauuuuuuucugauu

SEQ ID NO: 2214763 - RNA, 18 nt, Human
cuuauuuuuuucugauug

SEQ ID NO: 2214764 - RNA, 19 nt, Human
cuuauuuuuuucugauugu

SEQ ID NO: 2214765 - RNA, 20 nt, Human
cuuauuuuuuucugauugua

SEQ ID NO: 2214766 - RNA, 23 nt, Human
cuucagccuagccgaccucagcc

SEQ ID NO: 2214767 - RNA, 11 nt, Human
cuucagcugac

SEQ ID NO: 2214768 - RNA, 15 nt, Human
cuucaggccucccuc

SEQ ID NO: 2214769 - RNA, 12 nt, Human
cuucaggccucc

SEQ ID NO: 2214770 - RNA, 14 nt, Human
cuucaggcucuucu

SEQ ID NO: 2214771 - RNA, 23 nt, Human
cuucaggggagucccgucaggac

SEQ ID NO: 2214772 - RNA, 22 nt, Human
cuucaggggagucccgucagga

SEQ ID NO: 2214773 - RNA, 17 nt, Human
cuucaggggcacuucau

SEQ ID NO: 2214774 - RNA, 19 nt, Human
cuucaggggcacuucauug

SEQ ID NO: 2214775 - RNA, 21 nt, Human
cuucaggggagucccgucagg

SEQ ID NO: 2214776 - RNA, 20 nt, Human
cuucaggccucccucucucu

SEQ ID NO: 2214777 - RNA, 14 nt, Human
cuucaggggcugcc

SEQ ID NO: 2214778 - RNA, 15 nt, Human
cuucaggggcugccc

SEQ ID NO: 2214779 - RNA, 16 nt, Human
cuucaggggcugcccg

SEQ ID NO: 2214780 - RNA, 17 nt, Human
cuucaggggcugcccgc

SEQ ID NO: 2214781 - RNA, 18 nt, Human
cuucaggggcugcccgcu

SEQ ID NO: 2214782 - RNA, 19 nt, Human
cuucaggggcugcccgcuc

SEQ ID NO: 2214783 - RNA, 20 nt, Human
cuucaggggcugcccgcucc

SEQ ID NO: 2214784 - RNA, 22 nt, Human
cuucaggggcugcccgcuccca

SEQ ID NO: 2214785 - RNA, 15 nt, Human
cuucaggcucuucuc

SEQ ID NO: 2214786 - RNA, 16 nt, Human
cuucaggcucuucucc

SEQ ID NO: 2214787 - RNA, 17 nt, Human
cuucaggcucuucuccu

SEQ ID NO: 2214788 - RNA, 18 nt, Human
cuucaggcucuucuccuu

SEQ ID NO: 2214789 - RNA, 22 nt, Human
cuguuuauggccucagcugccu

SEQ ID NO: 2214790 - RNA, 21 nt, Human
cuguuuauggccucagcugcc

SEQ ID NO: 2214791 - RNA, 19 nt, Human
cuguuuauggccucagcug

SEQ ID NO: 2214792 - RNA, 18 nt, Human
cuguuuauggccucagcu

SEQ ID NO: 2214793 - RNA, 17 nt, Human
cuguuuauggccucagc

SEQ ID NO: 2214794 - RNA, 15 nt, Human
cuguuucccagcagu

SEQ ID NO: 2214795 - RNA, 21 nt, Human
cuguuucccagcaguggacuc

SEQ ID NO: 2214796 - RNA, 14 nt, Human
cuguuucucugcug

SEQ ID NO: 2214797 - RNA, 13 nt, Human
cuguuucucugcu

SEQ ID NO: 2214798 - RNA, 15 nt, Human
cuguuuccuuuuaug

SEQ ID NO: 2214799 - RNA, 13 nt, Human
cuguuuccuuuua

SEQ ID NO: 2214800 - RNA, 18 nt, Human
cuguuuguuucugaaagg

SEQ ID NO: 2214801 - RNA, 16 nt, Human
cuguuucucuuuccuu

SEQ ID NO: 2214802 - RNA, 19 nt, Human
cuguuucucuuuccuuggc

SEQ ID NO: 2214803 - RNA, 20 nt, Human
cuguuucucuuuccuuggcu

SEQ ID NO: 2214804 - RNA, 17 nt, Human
cuguuuacaagaaaaaa

SEQ ID NO: 2214805 - RNA, 16 nt, Human
cuguuuacaagaaaaa

SEQ ID NO: 2214806 - RNA, 15 nt, Human
cuguuuacaagaaaa

SEQ ID NO: 2214807 - RNA, 14 nt, Human
cuguuuacaagaaa

SEQ ID NO: 2214808 - RNA, 21 nt, Human
cuguuuaauauuuaaacagca

SEQ ID NO: 2214809 - RNA, 15 nt, Human
cuguuuacaguguuc

SEQ ID NO: 2214810 - RNA, 13 nt, Human
cuguuuacagugu

SEQ ID NO: 2214811 - RNA, 13 nt, Human
cugguugcugugu

SEQ ID NO: 2214812 - RNA, 14 nt, Human
cugguugcugugug

SEQ ID NO: 2214813 - RNA, 15 nt, Human
cugguugcugugugg

SEQ ID NO: 2214814 - RNA, 18 nt, Human
cugguugcugugugguuu

SEQ ID NO: 2214815 - RNA, 17 nt, Human
cugguuggagagcuaga

SEQ ID NO: 2214816 - RNA, 23 nt, Human
cugguuggagagcuagaaccugg

SEQ ID NO: 2214817 - RNA, 23 nt, Human
cugguucugaugaugugccuggg

SEQ ID NO: 2214818 - RNA, 17 nt, Human
cugguugaugccuguga

SEQ ID NO: 2214819 - RNA, 20 nt, Human
cuguuuacaagaaaaaauga

SEQ ID NO: 2214820 - RNA, 18 nt, Human
cuguuuacaagaaaaaau

SEQ ID NO: 2214821 - RNA, 12 nt, Human
cuguuuagauaa

SEQ ID NO: 2214822 - RNA, 16 nt, Human
cuguuuauggccucag

SEQ ID NO: 2214823 - RNA, 15 nt, Human
cuguuuauggccuca

SEQ ID NO: 2214824 - RNA, 14 nt, Human
cuguuuauggccuc

SEQ ID NO: 2214825 - RNA, 13 nt, Human
cuguuuauggccu

SEQ ID NO: 2214826 - RNA, 15 nt, Human
cuguuuauagaauaa

SEQ ID NO: 2214827 - RNA, 20 nt, Human
cuguuuuguggucagcugua

SEQ ID NO: 2214828 - RNA, 14 nt, Human
cuguuuuguucugu

SEQ ID NO: 2214829 - RNA, 21 nt, Human
cuguuuuucagggagguggcu

SEQ ID NO: 2214830 - RNA, 21 nt, Human
cuguuuuucuggguggccucg

SEQ ID NO: 2214831 - RNA, 15 nt, Human
cuguuuuucugggug

SEQ ID NO: 2214832 - RNA, 22 nt, Human
cuguuuugccugaaguuggagu

SEQ ID NO: 2214833 - RNA, 12 nt, Human
cuguuuugaauu

SEQ ID NO: 2214834 - RNA, 17 nt, Human
cuguuuugaaggcaaaa

SEQ ID NO: 2214835 - RNA, 14 nt, Human
cuguuuucuguuuc

SEQ ID NO: 2214836 - RNA, 18 nt, Human
cuguuuucuucuauucca

SEQ ID NO: 2214837 - RNA, 12 nt, Human
cuguuuucuucu

SEQ ID NO: 2214838 - RNA, 14 nt, Human
cuguuuuauacugu

SEQ ID NO: 2214839 - RNA, 13 nt, Human
cuguuuucugagc

SEQ ID NO: 2214840 - RNA, 16 nt, Human
cuguuuuaugacuuca

SEQ ID NO: 2214841 - RNA, 15 nt, Human
cuguuuucugagccc

SEQ ID NO: 2214842 - RNA, 17 nt, Human
cuguuuucugagcccgg

SEQ ID NO: 2214843 - RNA, 19 nt, Human
cuguuuucugagcccgggc

SEQ ID NO: 2214844 - RNA, 20 nt, Human
cuguuuucugagcccgggcu

SEQ ID NO: 2214845 - RNA, 17 nt, Human
cuguuuucucuugagag

SEQ ID NO: 2214846 - RNA, 20 nt, Human
cuguuuguuugacaaagaaa

SEQ ID NO: 2214847 - RNA, 17 nt, Human
cuguuucugcuugcucu

SEQ ID NO: 2214848 - RNA, 22 nt, Human
cuguuuuaaauuuauuucaaaa

SEQ ID NO: 2214849 - RNA, 14 nt, Human
cuguuuuaaguucu

SEQ ID NO: 2214850 - RNA, 12 nt, Human
cuguuuuaaauu

SEQ ID NO: 2214851 - RNA, 19 nt, Human
cuguuuuauaauuuuguga

SEQ ID NO: 2214852 - RNA, 21 nt, Human
cuguuuguuucugaaagggac

SEQ ID NO: 2214853 - RNA, 23 nt, Human
cuguuuguuucugaaagggacgc

SEQ ID NO: 2214854 - RNA, 14 nt, Human
cuguuuucucuuga

SEQ ID NO: 2214855 - RNA, 13 nt, Human
cuguuuucucuug

SEQ ID NO: 2214856 - RNA, 21 nt, Human
cuguuuuauuuuaauucaguu

SEQ ID NO: 2214857 - RNA, 15 nt, Human
cuguuuuaugacuuc

SEQ ID NO: 2214858 - RNA, 14 nt, Human
cuguuuuaugacuu

SEQ ID NO: 2214859 - RNA, 13 nt, Human
cuguuuuaugacu

SEQ ID NO: 2214860 - RNA, 12 nt, Human
cuguuuuaugac

SEQ ID NO: 2214861 - RNA, 18 nt, Human
cuuaauaaauucagauau

SEQ ID NO: 2214862 - RNA, 17 nt, Human
cuuaauaaauucagaua

SEQ ID NO: 2214863 - RNA, 22 nt, Human
cuuaaucagguccucagagaau

SEQ ID NO: 2214864 - RNA, 20 nt, Human
cuuaaucagguccucagaga

SEQ ID NO: 2214865 - RNA, 18 nt, Human
cuuaaucaauuaauuuuu

SEQ ID NO: 2214866 - RNA, 12 nt, Human
cuuaauaaauuc

SEQ ID NO: 2214867 - RNA, 17 nt, Human
cuuaaguuucucagcuc

SEQ ID NO: 2214868 - RNA, 15 nt, Human
cuuaaguuucucagc

SEQ ID NO: 2214869 - RNA, 16 nt, Human
cuuaaguuucucagcu

SEQ ID NO: 2214870 - RNA, 20 nt, Human
cuuaaguuucucagcuccca

SEQ ID NO: 2214871 - RNA, 16 nt, Human
cuuaaguuuauacucu

SEQ ID NO: 2214872 - RNA, 12 nt, Human
cuuaaugagaua

SEQ ID NO: 2214873 - RNA, 14 nt, Human
cuuaaugagauagu

SEQ ID NO: 2214874 - RNA, 18 nt, Human
cuuaauccagcugaugag

SEQ ID NO: 2214875 - RNA, 18 nt, Human
cuuaaugccacuaaauug

SEQ ID NO: 2214876 - RNA, 16 nt, Human
cuuaaucuaaauggaa

SEQ ID NO: 2214877 - RNA, 14 nt, Human
cuuaaucuaaaugg

SEQ ID NO: 2214878 - RNA, 16 nt, Human
cuuaagaacugcuuuc

SEQ ID NO: 2214879 - RNA, 21 nt, Human
cuuaagaagacugcauuauau

SEQ ID NO: 2214880 - RNA, 17 nt, Human
cuuaagagaugccucau

SEQ ID NO: 2214881 - RNA, 13 nt, Human
cuuaagagaauau

SEQ ID NO: 2214882 - RNA, 14 nt, Human
cuuaagagaauauu

SEQ ID NO: 2214883 - RNA, 18 nt, Human
cuuaagagaauauuuuaa

SEQ ID NO: 2214884 - RNA, 23 nt, Human
cuuaagagaauauuuuaaguauu

SEQ ID NO: 2214885 - RNA, 20 nt, Human
cuuaagccuuuugcucacaa

SEQ ID NO: 2214886 - RNA, 23 nt, Human
cuuaagccaucuugguaaauuuc

SEQ ID NO: 2214887 - RNA, 20 nt, Human
cuuaagccaucuugguaaau

SEQ ID NO: 2214888 - RNA, 22 nt, Human
cuuaagccaucuugguaaauuu

SEQ ID NO: 2214889 - RNA, 14 nt, Human
cuuaagcagaagca

SEQ ID NO: 2214890 - RNA, 18 nt, Human
cuuaagcagaagcauuaa

SEQ ID NO: 2214891 - RNA, 15 nt, Human
cuuaagccaucuugg

SEQ ID NO: 2214892 - RNA, 16 nt, Human
cuuaagccaucuuggu

SEQ ID NO: 2214893 - RNA, 17 nt, Human
cuuaagccaucuuggua

SEQ ID NO: 2214894 - RNA, 19 nt, Human
cuuaagccaucuugguaaa

SEQ ID NO: 2214895 - RNA, 19 nt, Human
cuuaacugcauuuuuagac

SEQ ID NO: 2214896 - RNA, 11 nt, Human
cuuaacuauuc

SEQ ID NO: 2214897 - RNA, 22 nt, Human
cuuaacuuaaauuuuaauuuau

SEQ ID NO: 2214898 - RNA, 17 nt, Human
cuuaacuccuuccagug

SEQ ID NO: 2214899 - RNA, 16 nt, Human
cuuaacuggagcccca

SEQ ID NO: 2214900 - RNA, 14 nt, Human
cuuaacuucacaua

SEQ ID NO: 2214901 - RNA, 12 nt, Human
cuuaacuucaca

SEQ ID NO: 2214902 - RNA, 22 nt, Human
cuuaacuucacauauugauuuc

SEQ ID NO: 2214903 - RNA, 17 nt, Human
cuuaacuucacauauug

SEQ ID NO: 2214904 - RNA, 16 nt, Human
cuuaacuucacauauu

SEQ ID NO: 2214905 - RNA, 15 nt, Human
cuuaacuucacauau

SEQ ID NO: 2214906 - RNA, 21 nt, Human
cuuaaaugaaagcauguggca

SEQ ID NO: 2214907 - RNA, 14 nt, Human
cuuaaaaaaugucc

SEQ ID NO: 2214908 - RNA, 13 nt, Human
cuuaaaaaauguc

SEQ ID NO: 2214909 - RNA, 17 nt, Human
cuuaaaaaauaaaaacu

SEQ ID NO: 2214910 - RNA, 16 nt, Human
cuuaaaugagaaggaa

SEQ ID NO: 2214911 - RNA, 13 nt, Human
cuguuuuuuaguu

SEQ ID NO: 2214912 - RNA, 14 nt, Human
cuguuuuuguagug

SEQ ID NO: 2214913 - RNA, 15 nt, Human
cuuaaaaaaaugaca

SEQ ID NO: 2214914 - RNA, 18 nt, Human
cuguuuuuuccugagcuu

SEQ ID NO: 2214915 - RNA, 17 nt, Human
cuguuuuuuccugagcu

SEQ ID NO: 2214916 - RNA, 18 nt, Human
cuuaaaaaacuuguaaau

SEQ ID NO: 2214917 - RNA, 12 nt, Human
cuuaaaaaacuu

SEQ ID NO: 2214918 - RNA, 17 nt, Human
cuuaaaaaaaugacaga

SEQ ID NO: 2214919 - RNA, 20 nt, Human
cuuaaccccaguaagccacu

SEQ ID NO: 2214920 - RNA, 12 nt, Human
cuuaaccaucuu

SEQ ID NO: 2214921 - RNA, 16 nt, Human
cuuaaauuuuaauuua

SEQ ID NO: 2214922 - RNA, 15 nt, Human
cuuaaauucauuuua

SEQ ID NO: 2214923 - RNA, 14 nt, Human
cuuaacggcuccag

SEQ ID NO: 2214924 - RNA, 15 nt, Human
cuuaacggcuccagg

SEQ ID NO: 2214925 - RNA, 16 nt, Human
cuuaacggcuccagga

SEQ ID NO: 2214926 - RNA, 12 nt, Human
cuuauaaauaug

SEQ ID NO: 2214927 - RNA, 17 nt, Human
cuuagguuggcaaaaag

SEQ ID NO: 2214928 - RNA, 18 nt, Human
cuuagguacuuauuccag

SEQ ID NO: 2214929 - RNA, 21 nt, Human
cuuagguggcaagcugugacu

SEQ ID NO: 2214930 - RNA, 20 nt, Human
cuuaggugauccacucgccu

SEQ ID NO: 2214931 - RNA, 21 nt, Human
cuuaggguuaugauuaaguaa

SEQ ID NO: 2214932 - RNA, 13 nt, Human
cuuauaauuuaaa

SEQ ID NO: 2214933 - RNA, 17 nt, Human
cuuauaaauaugaagcu

SEQ ID NO: 2214934 - RNA, 13 nt, Human
cuuauaaauauga

SEQ ID NO: 2214935 - RNA, 23 nt, Human
cuuauagucaauguuucuuuuau

SEQ ID NO: 2214936 - RNA, 13 nt, Human
cuuauagguggcc

SEQ ID NO: 2214937 - RNA, 15 nt, Human
cuuauacauuugaua

SEQ ID NO: 2214938 - RNA, 19 nt, Human
cuuauaggaauugacccac

SEQ ID NO: 2214939 - RNA, 14 nt, Human
cuuauaauuuaaaa

SEQ ID NO: 2214940 - RNA, 16 nt, Human
cuuaucaaaggacacc

SEQ ID NO: 2214941 - RNA, 11 nt, Human
cuuaucaagug

SEQ ID NO: 2214942 - RNA, 12 nt, Human
cuuaucaagugu

SEQ ID NO: 2214943 - RNA, 14 nt, Human
cuuaucaagugucu

SEQ ID NO: 2214944 - RNA, 15 nt, Human
cuuaucaagugucuu

SEQ ID NO: 2214945 - RNA, 16 nt, Human
cuuaucaagugucuuc

SEQ ID NO: 2214946 - RNA, 17 nt, Human
cuuaucaagugucuucc

SEQ ID NO: 2214947 - RNA, 22 nt, Human
cuuaucucagucaugcauaaau

SEQ ID NO: 2214948 - RNA, 23 nt, Human
cuuaucucagucaugcauaaaua

SEQ ID NO: 2214949 - RNA, 17 nt, Human
cuuauauuguaagaaau

SEQ ID NO: 2214950 - RNA, 14 nt, Human
cuuauauuguaaga

SEQ ID NO: 2214951 - RNA, 18 nt, Human
cuuauauuguaagaaaua

SEQ ID NO: 2214952 - RNA, 14 nt, Human
cuuaucaaaggaca

SEQ ID NO: 2214953 - RNA, 14 nt, Human
cuuaucuccaagac

SEQ ID NO: 2214954 - RNA, 13 nt, Human
cuuaucuccaaga

SEQ ID NO: 2214955 - RNA, 16 nt, Human
cuuaucuccaagacca

SEQ ID NO: 2214956 - RNA, 12 nt, Human
cuuaucucucug

SEQ ID NO: 2214957 - RNA, 17 nt, Human
cuuaucugugcgugaaa

SEQ ID NO: 2214958 - RNA, 13 nt, Human
cuuaucucucugu

SEQ ID NO: 2214959 - RNA, 14 nt, Human
cuuaucucucugug

SEQ ID NO: 2214960 - RNA, 21 nt, Human
cuuaucucucugugcugugga

SEQ ID NO: 2214961 - RNA, 22 nt, Human
cuuaucugugcucaggacucag

SEQ ID NO: 2214962 - RNA, 14 nt, Human
cuuaucuuaugcca

SEQ ID NO: 2214963 - RNA, 21 nt, Human
cuuaucugugcgugaaacaca

SEQ ID NO: 2214964 - RNA, 20 nt, Human
cuuaucugugcgugaaacac

SEQ ID NO: 2214965 - RNA, 19 nt, Human
cuuaucugugcgugaaaca

SEQ ID NO: 2214966 - RNA, 15 nt, Human
cuuaucucucugugc

SEQ ID NO: 2214967 - RNA, 16 nt, Human
cuuaucugugcucagg

SEQ ID NO: 2214968 - RNA, 14 nt, Human
cuuaucugugcuca

SEQ ID NO: 2214969 - RNA, 12 nt, Human
cuuauuuucaag

SEQ ID NO: 2214970 - RNA, 19 nt, Human
cuuauuuucaagaaacuga

SEQ ID NO: 2214971 - RNA, 18 nt, Human
cuuauuuucaagaaacug

SEQ ID NO: 2214972 - RNA, 15 nt, Human
cuuauuuucaagaaa

SEQ ID NO: 2214973 - RNA, 14 nt, Human
cuuauuuucaagaa

SEQ ID NO: 2214974 - RNA, 20 nt, Human
cuuauuguuccaagacauug

SEQ ID NO: 2214975 - RNA, 19 nt, Human
cuuauuguuccaagacauu

SEQ ID NO: 2214976 - RNA, 22 nt, Human
cuuauuguuccaagacauuguc

SEQ ID NO: 2214977 - RNA, 15 nt, Human
cuuauuuaaugaaag

SEQ ID NO: 2214978 - RNA, 17 nt, Human
cuuauuguuccaagaca

SEQ ID NO: 2214979 - RNA, 15 nt, Human
cuuauuguuccaaga

SEQ ID NO: 2214980 - RNA, 14 nt, Human
cuuauuguuccaag

SEQ ID NO: 2214981 - RNA, 13 nt, Human
cuuauuguuccaa

SEQ ID NO: 2214982 - RNA, 12 nt, Human
cuuauuguucca

SEQ ID NO: 2214983 - RNA, 23 nt, Human
cuuaugauucagauuguuaucua

SEQ ID NO: 2214984 - RNA, 14 nt, Human
cuuaugccacggga

SEQ ID NO: 2214985 - RNA, 15 nt, Human
cuuaugauugcagau

SEQ ID NO: 2214986 - RNA, 22 nt, Human
cuuaugacaucacuuguacaaa

SEQ ID NO: 2214987 - RNA, 13 nt, Human
cuuaugagauggg

SEQ ID NO: 2214988 - RNA, 21 nt, Human
cuuaugacaucacuuguacaa

SEQ ID NO: 2214989 - RNA, 18 nt, Human
cuuacgauggcacccagu

SEQ ID NO: 2214990 - RNA, 20 nt, Human
cuuaccuuuuuauuugcaug

SEQ ID NO: 2214991 - RNA, 19 nt, Human
cuuacgcccaacccuuccc

SEQ ID NO: 2214992 - RNA, 23 nt, Human
cuuacgaauacuuuugcccuuug

SEQ ID NO: 2214993 - RNA, 19 nt, Human
cuuaccuuuuuauuugcau

SEQ ID NO: 2214994 - RNA, 21 nt, Human
cuuaaugauccguuccauugc

SEQ ID NO: 2214995 - RNA, 15 nt, Human
cuuaaugcuucuuuc

SEQ ID NO: 2214996 - RNA, 18 nt, Human
cuuacuacaugugggagc

SEQ ID NO: 2214997 - RNA, 24 nt, Human
cuuacuaagcuuugccagcugcug

SEQ ID NO: 2214998 - RNA, 19 nt, Human
cuuacuaguuucccuugca

SEQ ID NO: 2214999 - RNA, 15 nt, Human
cuuacgugaguccug

SEQ ID NO: 2215000 - RNA, 21 nt, Human
cuuacuaaacauuuuguuauu

SEQ ID NO: 2215001 - RNA, 22 nt, Human
cuuacuaaacauuuuguuauug

SEQ ID NO: 2215002 - RNA, 21 nt, Human
cuuacuaagcuuugccagcug

SEQ ID NO: 2215003 - RNA, 23 nt, Human
cuuacuaagcuuugccagcugcu

SEQ ID NO: 2215004 - RNA, 14 nt, Human
cuuacuccaggaga

SEQ ID NO: 2215005 - RNA, 20 nt, Human
cuuacuacaugugggagcuu

SEQ ID NO: 2215006 - RNA, 13 nt, Human
cuuacuguacaug

SEQ ID NO: 2215007 - RNA, 16 nt, Human
cuuacuguacaugaaa

SEQ ID NO: 2215008 - RNA, 16 nt, Human
cuuacuguggaggaag

SEQ ID NO: 2215009 - RNA, 17 nt, Human
cuuacuguggaggaagg

SEQ ID NO: 2215010 - RNA, 18 nt, Human
cuuacuguggaggaagga

SEQ ID NO: 2215011 - RNA, 15 nt, Human
cuuacuguaccuguu

SEQ ID NO: 2215012 - RNA, 18 nt, Human
cuuacuguaccuguuccu

SEQ ID NO: 2215013 - RNA, 23 nt, Human
cuuacuguaccuguuccuuagac

SEQ ID NO: 2215014 - RNA, 14 nt, Human
cuuacuuaguguua

SEQ ID NO: 2215015 - RNA, 21 nt, Human
cuuacuguuucugucaggaga

SEQ ID NO: 2215016 - RNA, 14 nt, Human
cuuacuuacccuca

SEQ ID NO: 2215017 - RNA, 16 nt, Human
cuuacuguuucuguca

SEQ ID NO: 2215018 - RNA, 19 nt, Human
cuuacuguuucugucagga

SEQ ID NO: 2215019 - RNA, 19 nt, Human
cuuacuguggaggaaggau

SEQ ID NO: 2215020 - RNA, 13 nt, Human
cuuacuguuucug

SEQ ID NO: 2215021 - RNA, 14 nt, Human
cuuacuguuucugu

SEQ ID NO: 2215022 - RNA, 15 nt, Human
cuuacuguuucuguc

SEQ ID NO: 2215023 - RNA, 20 nt, Human
cuuacuuuccuuuccccagc

SEQ ID NO: 2215024 - RNA, 21 nt, Human
cuuacuuuccuuuccccagcc

SEQ ID NO: 2215025 - RNA, 22 nt, Human
cuuacuuuccuuuccccagccc

SEQ ID NO: 2215026 - RNA, 23 nt, Human
cuuacuuuccuuuccccagccca

SEQ ID NO: 2215027 - RNA, 19 nt, Human
cuuagaugcaguucugaag

SEQ ID NO: 2215028 - RNA, 11 nt, Human
cuuagacaguc

SEQ ID NO: 2215029 - RNA, 16 nt, Human
cuuagacauaacaaaa

SEQ ID NO: 2215030 - RNA, 19 nt, Human
cuuagacagucccugccaa

SEQ ID NO: 2215031 - RNA, 17 nt, Human
cuuagacagucccugcc

SEQ ID NO: 2215032 - RNA, 18 nt, Human
cuuagacagucccugcca

SEQ ID NO: 2215033 - RNA, 15 nt, Human
cuuagaaccuuucuu

SEQ ID NO: 2215034 - RNA, 19 nt, Human
cuuagaacauuuuaauuca

SEQ ID NO: 2215035 - RNA, 16 nt, Human
cuuagaacauuuuaau

SEQ ID NO: 2215036 - RNA, 15 nt, Human
cuuagaacauuuuaa

SEQ ID NO: 2215037 - RNA, 12 nt, Human
cuuagaacauuu

SEQ ID NO: 2215038 - RNA, 15 nt, Human
cuuagaaauuuauuu

SEQ ID NO: 2215039 - RNA, 17 nt, Human
cuuagaaauugcauuuc

SEQ ID NO: 2215040 - RNA, 14 nt, Human
cuuagaaauuuauu

SEQ ID NO: 2215041 - RNA, 15 nt, Human
cuuagaagucacaca

SEQ ID NO: 2215042 - RNA, 14 nt, Human
cuuagacagucccu

SEQ ID NO: 2215043 - RNA, 15 nt, Human
cuuagacagucccug

SEQ ID NO: 2215044 - RNA, 16 nt, Human
cuuagacagucccugc

SEQ ID NO: 2215045 - RNA, 22 nt, Human
cugaaugaaccuucuggccucc

SEQ ID NO: 2215046 - RNA, 16 nt, Human
cugaauucuauuugcu

SEQ ID NO: 2215047 - RNA, 17 nt, Human
cugaaugaaauaucaga

SEQ ID NO: 2215048 - RNA, 23 nt, Human
cugaaugaaacccccacacacac

SEQ ID NO: 2215049 - RNA, 22 nt, Human
cugaaugaaacccccacacaca

SEQ ID NO: 2215050 - RNA, 21 nt, Human
cugaaugaaacccccacacac

SEQ ID NO: 2215051 - RNA, 20 nt, Human
cugaaugaaacccccacaca

SEQ ID NO: 2215052 - RNA, 19 nt, Human
cugaaugaaacccccacac

SEQ ID NO: 2215053 - RNA, 18 nt, Human
cugaaugaaacccccaca

SEQ ID NO: 2215054 - RNA, 17 nt, Human
cugaaugaaacccccac

SEQ ID NO: 2215055 - RNA, 19 nt, Human
cugaaucccccuugccacc

SEQ ID NO: 2215056 - RNA, 20 nt, Human
cugaaucccccuugccaccc

SEQ ID NO: 2215057 - RNA, 21 nt, Human
cugaaucccccuugccacccc

SEQ ID NO: 2215058 - RNA, 22 nt, Human
cugaaucccccuugccacccca

SEQ ID NO: 2215059 - RNA, 15 nt, Human
cugaauagcagaagg

SEQ ID NO: 2215060 - RNA, 18 nt, Human
cugaauaggcgaucacaa

SEQ ID NO: 2215061 - RNA, 17 nt, Human
cugaauauacagcaggu

SEQ ID NO: 2215062 - RNA, 21 nt, Human
cugaauaggcgaucacaacgu

SEQ ID NO: 2215063 - RNA, 23 nt, Human
cugaauaggcgaucacaacgugc

SEQ ID NO: 2215064 - RNA, 21 nt, Human
cugaauauuuauauuucacua

SEQ ID NO: 2215065 - RNA, 20 nt, Human
cugaauauuuauauuucacu

SEQ ID NO: 2215066 - RNA, 16 nt, Human
cugaauauuuauauuu

SEQ ID NO: 2215067 - RNA, 21 nt, Human
cugaauaugaacggugagcau

SEQ ID NO: 2215068 - RNA, 19 nt, Human
cugaauaugaggcauuugg

SEQ ID NO: 2215069 - RNA, 22 nt, Human
cugaaucauucucgauuuaacu

SEQ ID NO: 2215070 - RNA, 20 nt, Human
cugaauccaaacuaauccau

SEQ ID NO: 2215071 - RNA, 19 nt, Human
cugaauccaaacuaaucca

SEQ ID NO: 2215072 - RNA, 15 nt, Human
cugaauuguccccag

SEQ ID NO: 2215073 - RNA, 17 nt, Human
cugaauucuauuugcug

SEQ ID NO: 2215074 - RNA, 23 nt, Human
cugaauucuauuugcugggcuuu

SEQ ID NO: 2215075 - RNA, 16 nt, Human
cugaauuguccccagu

SEQ ID NO: 2215076 - RNA, 19 nt, Human
cugacagacacaggcccgg

SEQ ID NO: 2215077 - RNA, 12 nt, Human
cugacagaggag

SEQ ID NO: 2215078 - RNA, 23 nt, Human
cugacagcugcuccuagagggag

SEQ ID NO: 2215079 - RNA, 19 nt, Human
cugacagcugcuccuagag

SEQ ID NO: 2215080 - RNA, 11 nt, Human
cugacaggcaa

SEQ ID NO: 2215081 - RNA, 21 nt, Human
cugacagacacaggcccggcu

SEQ ID NO: 2215082 - RNA, 19 nt, Human
cugacagacagcccuccau

SEQ ID NO: 2215083 - RNA, 17 nt, Human
cugacagacagcccucc

SEQ ID NO: 2215084 - RNA, 17 nt, Human
cugacauuguuggccaa

SEQ ID NO: 2215085 - RNA, 23 nt, Human
cugacauucaccugccccaacuc

SEQ ID NO: 2215086 - RNA, 17 nt, Human
cugacauucaccugccc

SEQ ID NO: 2215087 - RNA, 23 nt, Human
cugacauuaacaguuuuccauga

SEQ ID NO: 2215088 - RNA, 22 nt, Human
cugacagcugcuccuagaggga

SEQ ID NO: 2215089 - RNA, 16 nt, Human
cugacauucaccugcc

SEQ ID NO: 2215090 - RNA, 21 nt, Human
cugacauuaacaguuuuccau

SEQ ID NO: 2215091 - RNA, 20 nt, Human
cugacaggcaaugcuggcug

SEQ ID NO: 2215092 - RNA, 16 nt, Human
cugacaggcaaugcug

SEQ ID NO: 2215093 - RNA, 17 nt, Human
cugacaggcaaugcugg

SEQ ID NO: 2215094 - RNA, 18 nt, Human
cugacaggcaaugcuggc

SEQ ID NO: 2215095 - RNA, 19 nt, Human
cugacaggcaaugcuggcu

SEQ ID NO: 2215096 - RNA, 21 nt, Human
cugaccacacuuccuguccag

SEQ ID NO: 2215097 - RNA, 14 nt, Human
cugacauuggagcc

SEQ ID NO: 2215098 - RNA, 19 nt, Human
cugacauucucaggaagcc

SEQ ID NO: 2215099 - RNA, 15 nt, Human
cugaccacagcacag

SEQ ID NO: 2215100 - RNA, 14 nt, Human
cugaccacagcaca

SEQ ID NO: 2215101 - RNA, 12 nt, Human
cugaccacagca

SEQ ID NO: 2215102 - RNA, 15 nt, Human
cugacauuggagccu

SEQ ID NO: 2215103 - RNA, 16 nt, Human
cugacauuggagccug

SEQ ID NO: 2215104 - RNA, 22 nt, Human
cugaccacgcuuucuagcuguu

SEQ ID NO: 2215105 - RNA, 22 nt, Human
cugaccacggacguuuccauca

SEQ ID NO: 2215106 - RNA, 23 nt, Human
cugaccacggacguuuccaucag

SEQ ID NO: 2215107 - RNA, 18 nt, Human
cugaccacagcacagcca

SEQ ID NO: 2215108 - RNA, 20 nt, Human
cugacauuguggcacauucu

SEQ ID NO: 2215109 - RNA, 12 nt, Human
cugaccacccuc

SEQ ID NO: 2215110 - RNA, 13 nt, Human
cugaccacccucc

SEQ ID NO: 2215111 - RNA, 14 nt, Human
cugaccacccuccc

SEQ ID NO: 2215112 - RNA, 16 nt, Human
cugaccacccuccccu

SEQ ID NO: 2215113 - RNA, 17 nt, Human
cugaccacccuccccuc

SEQ ID NO: 2215114 - RNA, 16 nt, Human
cugaccauccacucua

SEQ ID NO: 2215115 - RNA, 15 nt, Human
cugaccauccacucu

SEQ ID NO: 2215116 - RNA, 15 nt, Human
cugaccagcagcgcc

SEQ ID NO: 2215117 - RNA, 14 nt, Human
cugaccagcagcgc

SEQ ID NO: 2215118 - RNA, 13 nt, Human
cugaccagcagcg

SEQ ID NO: 2215119 - RNA, 13 nt, Human
cugaccagaacua

SEQ ID NO: 2215120 - RNA, 22 nt, Human
cugaccauccacucuacccucc

SEQ ID NO: 2215121 - RNA, 19 nt, Human
cugaccauccacucuaccc

SEQ ID NO: 2215122 - RNA, 23 nt, Human
cugaccauccacucuacccuccc

SEQ ID NO: 2215123 - RNA, 15 nt, Human
cugaccaugcucauc

SEQ ID NO: 2215124 - RNA, 11 nt, Human
cugacccacug

SEQ ID NO: 2215125 - RNA, 21 nt, Human
cugaaccuggguaacuaggga

SEQ ID NO: 2215126 - RNA, 20 nt, Human
cugaaccggcuuuaccaaac

SEQ ID NO: 2215127 - RNA, 17 nt, Human
cugaaccugaugcugac

SEQ ID NO: 2215128 - RNA, 14 nt, Human
cugaaccugaugcu

SEQ ID NO: 2215129 - RNA, 17 nt, Human
cugaaccggcuuuacca

SEQ ID NO: 2215130 - RNA, 15 nt, Human
cucuuugggaauguu

SEQ ID NO: 2215131 - RNA, 20 nt, Human
cucuuugggaauguuugucu

SEQ ID NO: 2215132 - RNA, 21 nt, Human
cucuuugggaauguuugucuc

SEQ ID NO: 2215133 - RNA, 17 nt, Human
cucuuuggggucagcca

SEQ ID NO: 2215134 - RNA, 19 nt, Human
cucuuuggggucagccagg

SEQ ID NO: 2215135 - RNA, 20 nt, Human
cucuuuggggucagccaggg

SEQ ID NO: 2215136 - RNA, 17 nt, Human
cugaacccugugcuggu

SEQ ID NO: 2215137 - RNA, 18 nt, Human
cugaacccugugcuggug

SEQ ID NO: 2215138 - RNA, 23 nt, Human
cugaacccugugcugguguccug

SEQ ID NO: 2215139 - RNA, 20 nt, Human
cugaacccugugcugguguc

SEQ ID NO: 2215140 - RNA, 18 nt, Human
cucuuugggccuggcucc

SEQ ID NO: 2215141 - RNA, 22 nt, Human
cucuuugcuuugcuuucugcuc

SEQ ID NO: 2215142 - RNA, 20 nt, Human
cucuuugcuuugcuuucugc

SEQ ID NO: 2215143 - RNA, 15 nt, Human
cucuuuggcagucua

SEQ ID NO: 2215144 - RNA, 18 nt, Human
cucuuuggcuccccugua

SEQ ID NO: 2215145 - RNA, 19 nt, Human
cucuuuggucuacacugug

SEQ ID NO: 2215146 - RNA, 21 nt, Human
cucuuuggucuacacugugcu

SEQ ID NO: 2215147 - RNA, 13 nt, Human
cugaacggggaga

SEQ ID NO: 2215148 - RNA, 14 nt, Human
cugaaccuuccauc

SEQ ID NO: 2215149 - RNA, 15 nt, Human
cugaacuuggcgcug

SEQ ID NO: 2215150 - RNA, 16 nt, Human
cugaacuuggcgcugc

SEQ ID NO: 2215151 - RNA, 21 nt, Human
cugaacuuggcgcugccccug

SEQ ID NO: 2215152 - RNA, 20 nt, Human
cugaagagcuauuauauaaa

SEQ ID NO: 2215153 - RNA, 14 nt, Human
cugaagaggcgggc

SEQ ID NO: 2215154 - RNA, 15 nt, Human
cugaagaggcgggcc

SEQ ID NO: 2215155 - RNA, 16 nt, Human
cugaagaggcgggcca

SEQ ID NO: 2215156 - RNA, 21 nt, Human
cugaagagaagggcagggcug

SEQ ID NO: 2215157 - RNA, 22 nt, Human
cugaacuucaggauaauaaagu

SEQ ID NO: 2215158 - RNA, 16 nt, Human
cugaaccuuccaucuc

SEQ ID NO: 2215159 - RNA, 19 nt, Human
cugaagacucauucuucug

SEQ ID NO: 2215160 - RNA, 21 nt, Human
cugaagacucauucuucugua

SEQ ID NO: 2215161 - RNA, 16 nt, Human
cugaauacagaggcaa

SEQ ID NO: 2215162 - RNA, 11 nt, Human
cugaauaauaa

SEQ ID NO: 2215163 - RNA, 15 nt, Human
cugaauaacauuugu

SEQ ID NO: 2215164 - RNA, 20 nt, Human
cugaauaacauuuguguggu

SEQ ID NO: 2215165 - RNA, 18 nt, Human
cugaauacauucugcuuu

SEQ ID NO: 2215166 - RNA, 16 nt, Human
cugaauacauucugcu

SEQ ID NO: 2215167 - RNA, 13 nt, Human
cugaauaauuucu

SEQ ID NO: 2215168 - RNA, 15 nt, Human
cugaauaauuucuua

SEQ ID NO: 2215169 - RNA, 16 nt, Human
cugaauaauuucuuac

SEQ ID NO: 2215170 - RNA, 16 nt, Human
cugaauacaaagugau

SEQ ID NO: 2215171 - RNA, 19 nt, Human
cugaagugaaacugcuugu

SEQ ID NO: 2215172 - RNA, 18 nt, Human
cugaagugagcacagccu

SEQ ID NO: 2215173 - RNA, 19 nt, Human
cugaagugagcacagccua

SEQ ID NO: 2215174 - RNA, 21 nt, Human
cugaagugagcacagccuagg

SEQ ID NO: 2215175 - RNA, 17 nt, Human
cugaagugaaacugcuu

SEQ ID NO: 2215176 - RNA, 13 nt, Human
cugaagugaaacu

SEQ ID NO: 2215177 - RNA, 16 nt, Human
cugaagugcuuagugu

SEQ ID NO: 2215178 - RNA, 19 nt, Human
cugaagugcauccaaaggu

SEQ ID NO: 2215179 - RNA, 22 nt, Human
cugaagugcauccaaaggugcu

SEQ ID NO: 2215180 - RNA, 14 nt, Human
cugaagugcaucca

SEQ ID NO: 2215181 - RNA, 16 nt, Human
cugaagugcauccaaa

SEQ ID NO: 2215182 - RNA, 17 nt, Human
cugaagugcauccaaag

SEQ ID NO: 2215183 - RNA, 18 nt, Human
cugaagugcauccaaagg

SEQ ID NO: 2215184 - RNA, 15 nt, Human
cugaaguggacucuu

SEQ ID NO: 2215185 - RNA, 23 nt, Human
cugaaguggacucuuugguggcu

SEQ ID NO: 2215186 - RNA, 12 nt, Human
cugaauaaaugg

SEQ ID NO: 2215187 - RNA, 14 nt, Human
cugaauaaauggua

SEQ ID NO: 2215188 - RNA, 17 nt, Human
cugaauaaaugguagua

SEQ ID NO: 2215189 - RNA, 12 nt, Human
cugaauaaaugu

SEQ ID NO: 2215190 - RNA, 13 nt, Human
cugaauaaauguc

SEQ ID NO: 2215191 - RNA, 15 nt, Human
cugaauaaaugucuu

SEQ ID NO: 2215192 - RNA, 17 nt, Human
cugaagucacugcacag

SEQ ID NO: 2215193 - RNA, 16 nt, Human
cugaagucacugcaca

SEQ ID NO: 2215194 - RNA, 22 nt, Human
cugaagucacugcacagugcau

SEQ ID NO: 2215195 - RNA, 24 nt, Human
cugaagucuuuguacagacaacaa

SEQ ID NO: 2215196 - RNA, 14 nt, Human
cugaagucacacag

SEQ ID NO: 2215197 - RNA, 20 nt, Human
cugaagaggcgggccagcca

SEQ ID NO: 2215198 - RNA, 15 nt, Human
cugaagguugaagag

SEQ ID NO: 2215199 - RNA, 18 nt, Human
cugaagaggcgggccagc

SEQ ID NO: 2215200 - RNA, 19 nt, Human
cugaagaggcgggccagcc

SEQ ID NO: 2215201 - RNA, 21 nt, Human
cugaagaggcgggccagccag

SEQ ID NO: 2215202 - RNA, 19 nt, Human
cugaagguaaaauugaaag

SEQ ID NO: 2215203 - RNA, 15 nt, Human
cugaagucacacagu

SEQ ID NO: 2215204 - RNA, 16 nt, Human
cugaagucacacagug

SEQ ID NO: 2215205 - RNA, 17 nt, Human
cugaaguagugugcagu

SEQ ID NO: 2215206 - RNA, 22 nt, Human
cucuucagguucuuagugucac

SEQ ID NO: 2215207 - RNA, 15 nt, Human
cucuucagguucuua

SEQ ID NO: 2215208 - RNA, 14 nt, Human
cucuucagguucuu

SEQ ID NO: 2215209 - RNA, 19 nt, Human
cucuucaguuaagccuuug

SEQ ID NO: 2215210 - RNA, 23 nt, Human
cucuucaguuaagccuuuggaaa

SEQ ID NO: 2215211 - RNA, 20 nt, Human
cucuucaguuaagccuuugg

SEQ ID NO: 2215212 - RNA, 20 nt, Human
cucuucaggccucccucucu

SEQ ID NO: 2215213 - RNA, 19 nt, Human
cucuucaggccucccucuc

SEQ ID NO: 2215214 - RNA, 18 nt, Human
cucuucaggccucccucu

SEQ ID NO: 2215215 - RNA, 22 nt, Human
cucuuaaagaaaacccaccccg

SEQ ID NO: 2215216 - RNA, 17 nt, Human
cucuuaacaauuucugu

SEQ ID NO: 2215217 - RNA, 13 nt, Human
cucuuaagaagac

SEQ ID NO: 2215218 - RNA, 20 nt, Human
cucuuaaagcugccuguagu

SEQ ID NO: 2215219 - RNA, 20 nt, Human
cucuuaaagaaaacccaccc

SEQ ID NO: 2215220 - RNA, 20 nt, Human
cucuguugcaagugcaauaa

SEQ ID NO: 2215221 - RNA, 24 nt, Human
cucuuaaaacccaagugccuuagc

SEQ ID NO: 2215222 - RNA, 13 nt, Human
cucuuaaaaccca

SEQ ID NO: 2215223 - RNA, 16 nt, Human
cucuguuccuucacau

SEQ ID NO: 2215224 - RNA, 20 nt, Human
cucuggcagcucagagaggg

SEQ ID NO: 2215225 - RNA, 19 nt, Human
cucuggcagcucagagagg

SEQ ID NO: 2215226 - RNA, 22 nt, Human
cucuguuccuucacauccugug

SEQ ID NO: 2215227 - RNA, 23 nt, Human
cucuguuccccuaguaagugccu

SEQ ID NO: 2215228 - RNA, 19 nt, Human
cucuguucugcacacagca

SEQ ID NO: 2215229 - RNA, 21 nt, Human
cucuguucugcacacagcacg

SEQ ID NO: 2215230 - RNA, 20 nt, Human
cucuguucugcacacagcac

SEQ ID NO: 2215231 - RNA, 15 nt, Human
cucuggagcccacug

SEQ ID NO: 2215232 - RNA, 17 nt, Human
cucuggcagcucagaga

SEQ ID NO: 2215233 - RNA, 18 nt, Human
cucuggcagcucagagag

SEQ ID NO: 2215234 - RNA, 18 nt, Human
cucuucugcuccacccuu

SEQ ID NO: 2215235 - RNA, 16 nt, Human
cucuucugcuccaccc

SEQ ID NO: 2215236 - RNA, 15 nt, Human
cucuucugcuccacc

SEQ ID NO: 2215237 - RNA, 14 nt, Human
cucuucugcuccac

SEQ ID NO: 2215238 - RNA, 20 nt, Human
cucuucugcuccacccuugg

SEQ ID NO: 2215239 - RNA, 19 nt, Human
cucuucugcuccacccuug

SEQ ID NO: 2215240 - RNA, 21 nt, Human
cucuucugcuccacccuuggc

SEQ ID NO: 2215241 - RNA, 20 nt, Human
cucuucugcuuaggagagac

SEQ ID NO: 2215242 - RNA, 14 nt, Human
cucuucuggcucaa

SEQ ID NO: 2215243 - RNA, 11 nt, Human
cucuucuggcu

SEQ ID NO: 2215244 - RNA, 22 nt, Human
cucuucugggagggcagcaggg

SEQ ID NO: 2215245 - RNA, 21 nt, Human
cucuucugggagggcagcagg

SEQ ID NO: 2215246 - RNA, 13 nt, Human
cucuucuccuuuc

SEQ ID NO: 2215247 - RNA, 15 nt, Human
cucuucuccuuucac

SEQ ID NO: 2215248 - RNA, 16 nt, Human
cucuucuccuuucaca

SEQ ID NO: 2215249 - RNA, 12 nt, Human
cucuucuccagg

SEQ ID NO: 2215250 - RNA, 19 nt, Human
cucuucuccacuggaugga

SEQ ID NO: 2215251 - RNA, 16 nt, Human
cucuucuccccagagu

SEQ ID NO: 2215252 - RNA, 15 nt, Human
cucuucuccacugga

SEQ ID NO: 2215253 - RNA, 17 nt, Human
cucuucuccacuggaug

SEQ ID NO: 2215254 - RNA, 14 nt, Human
cucuucuccacugg

SEQ ID NO: 2215255 - RNA, 23 nt, Human
cucuuccagucuuccugacacuu

SEQ ID NO: 2215256 - RNA, 22 nt, Human
cucuuccagucuuccugacacu

SEQ ID NO: 2215257 - RNA, 19 nt, Human
cucuucauacuuuuuuuca

SEQ ID NO: 2215258 - RNA, 19 nt, Human
cucuuccagucuuccugac

SEQ ID NO: 2215259 - RNA, 15 nt, Human
cucuucauaauucua

SEQ ID NO: 2215260 - RNA, 13 nt, Human
cucuucauacuuu

SEQ ID NO: 2215261 - RNA, 23 nt, Human
cucuuccaggcugggagagccuu

SEQ ID NO: 2215262 - RNA, 22 nt, Human
cucuuccaggcugggagagccu

SEQ ID NO: 2215263 - RNA, 21 nt, Human
cucuuccaggcugggagagcc

SEQ ID NO: 2215264 - RNA, 17 nt, Human
cucuuguaaauaaagcc

SEQ ID NO: 2215265 - RNA, 18 nt, Human
cucuuguaaauaaagccc

SEQ ID NO: 2215266 - RNA, 19 nt, Human
cucuuguaaauaaagcccu

SEQ ID NO: 2215267 - RNA, 20 nt, Human
cucuuguaaauaaagcccug

SEQ ID NO: 2215268 - RNA, 23 nt, Human
cucuuguaaauaaagcccuggga

SEQ ID NO: 2215269 - RNA, 24 nt, Human
cucuuguaaauaaagcccugggau

SEQ ID NO: 2215270 - RNA, 20 nt, Human
cucuugugaggaaagucauu

SEQ ID NO: 2215271 - RNA, 15 nt, Human
cucuuguauuaaacu

SEQ ID NO: 2215272 - RNA, 21 nt, Human
cucuuguaauccgaaucucuu

SEQ ID NO: 2215273 - RNA, 16 nt, Human
cucuuggucuucccag

SEQ ID NO: 2215274 - RNA, 23 nt, Human
cucuuguaaugauauagccagaa

SEQ ID NO: 2215275 - RNA, 17 nt, Human
cucuuuccaucuacccu

SEQ ID NO: 2215276 - RNA, 12 nt, Human
cucuuucaucca

SEQ ID NO: 2215277 - RNA, 13 nt, Human
cucuuucauccac

SEQ ID NO: 2215278 - RNA, 11 nt, Human
cucuuucaaag

SEQ ID NO: 2215279 - RNA, 22 nt, Human
cucuuucaagcagucgugccug

SEQ ID NO: 2215280 - RNA, 23 nt, Human
cucuugugcuggauggagcccag

SEQ ID NO: 2215281 - RNA, 12 nt, Human
cucuuucaaaac

SEQ ID NO: 2215282 - RNA, 14 nt, Human
cucuugugcuggau

SEQ ID NO: 2215283 - RNA, 12 nt, Human
cucuuucugggc

SEQ ID NO: 2215284 - RNA, 13 nt, Human
cucuuucuguaua

SEQ ID NO: 2215285 - RNA, 11 nt, Human
cucuuucugua

SEQ ID NO: 2215286 - RNA, 18 nt, Human
cucuuugcuuugcuuucu

SEQ ID NO: 2215287 - RNA, 16 nt, Human
cucuuugcuuugcuuu

SEQ ID NO: 2215288 - RNA, 15 nt, Human
cucuuugcuuugcuu

SEQ ID NO: 2215289 - RNA, 14 nt, Human
cucuuugcuuugcu

SEQ ID NO: 2215290 - RNA, 13 nt, Human
cucuuugcuuugc

SEQ ID NO: 2215291 - RNA, 15 nt, Human
cucuuucucuccuuu

SEQ ID NO: 2215292 - RNA, 12 nt, Human
cucuuugcuuug

SEQ ID NO: 2215293 - RNA, 18 nt, Human
cucuuuggacacucacac

SEQ ID NO: 2215294 - RNA, 15 nt, Human
cucuuuggacacuca

SEQ ID NO: 2215295 - RNA, 18 nt, Human
cucuuucuccuuagucuu

SEQ ID NO: 2215296 - RNA, 17 nt, Human
cucuuucuauuguuucu

SEQ ID NO: 2215297 - RNA, 12 nt, Human
cucuuucucugc

SEQ ID NO: 2215298 - RNA, 19 nt, Human
cucuuucucuccuuucuuu

SEQ ID NO: 2215299 - RNA, 13 nt, Human
cucuuucucugcc

SEQ ID NO: 2215300 - RNA, 15 nt, Human
cucuuucucugccag

SEQ ID NO: 2215301 - RNA, 16 nt, Human
cucuuucucugccagu

SEQ ID NO: 2215302 - RNA, 17 nt, Human
cucuuucucugccagug

SEQ ID NO: 2215303 - RNA, 18 nt, Human
cucuuucucugccaguga

SEQ ID NO: 2215304 - RNA, 21 nt, Human
cucuugaagacacugaaauau

SEQ ID NO: 2215305 - RNA, 20 nt, Human
cucuugaagacacugaaaua

SEQ ID NO: 2215306 - RNA, 19 nt, Human
cucuugaacugagcuugga

SEQ ID NO: 2215307 - RNA, 20 nt, Human
cucuugaagaugcugaaaca

SEQ ID NO: 2215308 - RNA, 18 nt, Human
cucuucuggguuccuucc

SEQ ID NO: 2215309 - RNA, 18 nt, Human
cucuugaacuccugaccu

SEQ ID NO: 2215310 - RNA, 17 nt, Human
cucuugaacugagcuug

SEQ ID NO: 2215311 - RNA, 16 nt, Human
cucuugaacugagcuu

SEQ ID NO: 2215312 - RNA, 16 nt, Human
cucuugaccucaggug

SEQ ID NO: 2215313 - RNA, 15 nt, Human
cucuugagcaguggc

SEQ ID NO: 2215314 - RNA, 18 nt, Human
cucuugagcaguggcugg

SEQ ID NO: 2215315 - RNA, 22 nt, Human
cucuugagcaguggcuggucca

SEQ ID NO: 2215316 - RNA, 13 nt, Human
cucuugaccucag

SEQ ID NO: 2215317 - RNA, 15 nt, Human
cucuugaccucaggu

SEQ ID NO: 2215318 - RNA, 12 nt, Human
cucuuguaaaua

SEQ ID NO: 2215319 - RNA, 14 nt, Human
cucuuguaaauaaa

SEQ ID NO: 2215320 - RNA, 20 nt, Human
cucuugguuuccuuccuugg

SEQ ID NO: 2215321 - RNA, 18 nt, Human
cucuuggucuucccaggc

SEQ ID NO: 2215322 - RNA, 17 nt, Human
cucuugggcugagacug

SEQ ID NO: 2215323 - RNA, 15 nt, Human
cucuuggucuuccca

SEQ ID NO: 2215324 - RNA, 18 nt, Human
cucuugggcugagacugg

SEQ ID NO: 2215325 - RNA, 18 nt, Human
cucuugguccugcugcag

SEQ ID NO: 2215326 - RNA, 19 nt, Human
cucuugguccugcugcagu

SEQ ID NO: 2215327 - RNA, 16 nt, Human
cucuuggccugaucag

SEQ ID NO: 2215328 - RNA, 14 nt, Human
cucuuggcuccacu

SEQ ID NO: 2215329 - RNA, 20 nt, Human
cucuugagaucuugguccug

SEQ ID NO: 2215330 - RNA, 22 nt, Human
cucuuggagccugcagagcugc

SEQ ID NO: 2215331 - RNA, 19 nt, Human
cucuugggaaauaugucaa

SEQ ID NO: 2215332 - RNA, 21 nt, Human
cucuugggaacugaacucacu

SEQ ID NO: 2215333 - RNA, 16 nt, Human
cucuugggcugagacu

SEQ ID NO: 2215334 - RNA, 15 nt, Human
cucuugggcugagac

SEQ ID NO: 2215335 - RNA, 21 nt, Human
cucuggaaaaugugacccaga

SEQ ID NO: 2215336 - RNA, 19 nt, Human
cucuggaaaaugugaccca

SEQ ID NO: 2215337 - RNA, 20 nt, Human
cucuggaaaaugugacccag

SEQ ID NO: 2215338 - RNA, 15 nt, Human
cucugcuuuggaaau

SEQ ID NO: 2215339 - RNA, 14 nt, Human
cucuggaauuugaa

SEQ ID NO: 2215340 - RNA, 21 nt, Human
cucugccugucccucucaggc

SEQ ID NO: 2215341 - RNA, 14 nt, Human
cucugcggacccca

SEQ ID NO: 2215342 - RNA, 15 nt, Human
cucugcggaccccag

SEQ ID NO: 2215343 - RNA, 16 nt, Human
cucugcggaccccagc

SEQ ID NO: 2215344 - RNA, 17 nt, Human
cucugcggaccccagcu

SEQ ID NO: 2215345 - RNA, 19 nt, Human
cucugcggaccccagcugu

SEQ ID NO: 2215346 - RNA, 20 nt, Human
cucugcggaccccagcugug

SEQ ID NO: 2215347 - RNA, 14 nt, Human
cucugccucugaca

SEQ ID NO: 2215348 - RNA, 15 nt, Human
cucugccuccucuuc

SEQ ID NO: 2215349 - RNA, 16 nt, Human
cucugccuccucuuca

SEQ ID NO: 2215350 - RNA, 20 nt, Human
cucugccugucccucucagg

SEQ ID NO: 2215351 - RNA, 19 nt, Human
cucugccugucccucucag

SEQ ID NO: 2215352 - RNA, 18 nt, Human
cucugccugucccucuca

SEQ ID NO: 2215353 - RNA, 16 nt, Human
cucugccugucccucu

SEQ ID NO: 2215354 - RNA, 14 nt, Human
cucugccugucccu

SEQ ID NO: 2215355 - RNA, 13 nt, Human
cucugccuguccc

SEQ ID NO: 2215356 - RNA, 20 nt, Human
cucugccugccccgccccca

SEQ ID NO: 2215357 - RNA, 15 nt, Human
cucuggacggcaggc

SEQ ID NO: 2215358 - RNA, 22 nt, Human
cucuggaccaacccuguuuccu

SEQ ID NO: 2215359 - RNA, 13 nt, Human
cucuggaccagcc

SEQ ID NO: 2215360 - RNA, 14 nt, Human
cucuggaccagccu

SEQ ID NO: 2215361 - RNA, 20 nt, Human
cucuggaccagccuguugga

SEQ ID NO: 2215362 - RNA, 16 nt, Human
cucuggacggcaggcu

SEQ ID NO: 2215363 - RNA, 17 nt, Human
cucuggacggcaggcuc

SEQ ID NO: 2215364 - RNA, 18 nt, Human
cucuggacggcaggcuca

SEQ ID NO: 2215365 - RNA, 13 nt, Human
cucuggacuggcu

SEQ ID NO: 2215366 - RNA, 23 nt, Human
cucuggacggcaggcucacugcc

SEQ ID NO: 2215367 - RNA, 21 nt, Human
cucuggaagagaggaaugccu

SEQ ID NO: 2215368 - RNA, 21 nt, Human
cucuggaaaggggggagcugg

SEQ ID NO: 2215369 - RNA, 22 nt, Human
cucuggaaaggggggagcuggg

SEQ ID NO: 2215370 - RNA, 16 nt, Human
cucuggacaaagcguu

SEQ ID NO: 2215371 - RNA, 15 nt, Human
cucuggacagcccca

SEQ ID NO: 2215372 - RNA, 18 nt, Human
cucuggacagccccaccc

SEQ ID NO: 2215373 - RNA, 20 nt, Human
cucuggaauuugcaagucau

SEQ ID NO: 2215374 - RNA, 16 nt, Human
cucuggaccaacccug

SEQ ID NO: 2215375 - RNA, 15 nt, Human
cucuggagacagccc

SEQ ID NO: 2215376 - RNA, 16 nt, Human
cucuggagacagcccc

SEQ ID NO: 2215377 - RNA, 17 nt, Human
cucuggagacagcccca

SEQ ID NO: 2215378 - RNA, 18 nt, Human
cucuggagacagccccag

SEQ ID NO: 2215379 - RNA, 19 nt, Human
cucuggagacagccccaga

SEQ ID NO: 2215380 - RNA, 19 nt, Human
cucuggacuggcuagaguc

SEQ ID NO: 2215381 - RNA, 16 nt, Human
cucuggacuggcuaga

SEQ ID NO: 2215382 - RNA, 15 nt, Human
cucuggacuggcuag

SEQ ID NO: 2215383 - RNA, 14 nt, Human
cucuggacuggcua

SEQ ID NO: 2215384 - RNA, 12 nt, Human
cucuggagccca

SEQ ID NO: 2215385 - RNA, 15 nt, Human
cucuggagagaaaca

SEQ ID NO: 2215386 - RNA, 19 nt, Human
cucuggagccaaguccaga

SEQ ID NO: 2215387 - RNA, 20 nt, Human
cucuggagacagccccagag

SEQ ID NO: 2215388 - RNA, 24 nt, Human
cucuggagacagccccagagcagg

SEQ ID NO: 2215389 - RNA, 12 nt, Human
cucuggagagaa

SEQ ID NO: 2215390 - RNA, 13 nt, Human
cucuggagagaaa

SEQ ID NO: 2215391 - RNA, 14 nt, Human
cucugccuccucuu

SEQ ID NO: 2215392 - RNA, 20 nt, Human
cucugccucccucacccuga

SEQ ID NO: 2215393 - RNA, 21 nt, Human
cucugccucccucacccugag

SEQ ID NO: 2215394 - RNA, 12 nt, Human
cucugcccugcg

SEQ ID NO: 2215395 - RNA, 23 nt, Human
cucugcccugcccuagcuccaca

SEQ ID NO: 2215396 - RNA, 20 nt, Human
cucugcccugcccuagcucc

SEQ ID NO: 2215397 - RNA, 19 nt, Human
cucugcccugcccuagcuc

SEQ ID NO: 2215398 - RNA, 17 nt, Human
cucugcccugcccuagc

SEQ ID NO: 2215399 - RNA, 16 nt, Human
cucugcccugcccuag

SEQ ID NO: 2215400 - RNA, 15 nt, Human
cucugcccugcccua

SEQ ID NO: 2215401 - RNA, 11 nt, Human
cucugcccugc

SEQ ID NO: 2215402 - RNA, 23 nt, Human
cucugcccuaaugcgcaggcugg

SEQ ID NO: 2215403 - RNA, 14 nt, Human
cucugcccuccaag

SEQ ID NO: 2215404 - RNA, 15 nt, Human
cucugcccuccaaga

SEQ ID NO: 2215405 - RNA, 16 nt, Human
cucugcccuccaagac

SEQ ID NO: 2215406 - RNA, 23 nt, Human
cucugcccuccaagaccuucucc

SEQ ID NO: 2215407 - RNA, 14 nt, Human
cucugccaccuccc

SEQ ID NO: 2215408 - RNA, 13 nt, Human
cucugccaccucc

SEQ ID NO: 2215409 - RNA, 12 nt, Human
cucugccaccuc

SEQ ID NO: 2215410 - RNA, 22 nt, Human
cucugccacccuaccuguucag

SEQ ID NO: 2215411 - RNA, 23 nt, Human
cucugccaccagagaccguccuc

SEQ ID NO: 2215412 - RNA, 17 nt, Human
cucugccacccuaccug

SEQ ID NO: 2215413 - RNA, 18 nt, Human
cucugccacccuaccugu

SEQ ID NO: 2215414 - RNA, 20 nt, Human
cucugccacccuaccuguuc

SEQ ID NO: 2215415 - RNA, 10 nt, Human
cucugccacc

SEQ ID NO: 2215416 - RNA, 11 nt, Human
cucugccacca

SEQ ID NO: 2215417 - RNA, 23 nt, Human
cucugccaacuucuucagagcug

SEQ ID NO: 2215418 - RNA, 14 nt, Human
cucugccaccagag

SEQ ID NO: 2215419 - RNA, 16 nt, Human
cucugccaccagagac

SEQ ID NO: 2215420 - RNA, 17 nt, Human
cucugccaccagagacc

SEQ ID NO: 2215421 - RNA, 18 nt, Human
cucugccaccagagaccg

SEQ ID NO: 2215422 - RNA, 14 nt, Human
cucugccagccaca

SEQ ID NO: 2215423 - RNA, 18 nt, Human
cucugccaccuccccuau

SEQ ID NO: 2215424 - RNA, 22 nt, Human
cucugccagaagauccccucag

SEQ ID NO: 2215425 - RNA, 17 nt, Human
cucugccagaagauccc

SEQ ID NO: 2215426 - RNA, 23 nt, Human
cucugccagaagauccccucagg

SEQ ID NO: 2215427 - RNA, 13 nt, Human
cucugcccagcuu

SEQ ID NO: 2215428 - RNA, 14 nt, Human
cucugcccagcuug

SEQ ID NO: 2215429 - RNA, 14 nt, Human
cucugccccagagg

SEQ ID NO: 2215430 - RNA, 18 nt, Human
cucugcccagcuugggcc

SEQ ID NO: 2215431 - RNA, 15 nt, Human
cucugcccagcuugg

SEQ ID NO: 2215432 - RNA, 17 nt, Human
cucugcccagcuugggc

SEQ ID NO: 2215433 - RNA, 12 nt, Human
cucugccccagc

SEQ ID NO: 2215434 - RNA, 18 nt, Human
cucugccccagaggccuc

SEQ ID NO: 2215435 - RNA, 20 nt, Human
cucugccccagaggccucuc

SEQ ID NO: 2215436 - RNA, 15 nt, Human
cucugccccagaggc

SEQ ID NO: 2215437 - RNA, 16 nt, Human
cucugccccagaggcc

SEQ ID NO: 2215438 - RNA, 18 nt, Human
cucugccccagcucuggc

SEQ ID NO: 2215439 - RNA, 17 nt, Human
cucugccccagcucugg

SEQ ID NO: 2215440 - RNA, 16 nt, Human
cucugccccagcucug

SEQ ID NO: 2215441 - RNA, 13 nt, Human
cucugccccagcu

SEQ ID NO: 2215442 - RNA, 21 nt, Human
cucugccccagcucuggcuuc

SEQ ID NO: 2215443 - RNA, 19 nt, Human
cucugccccagcucuggcu

SEQ ID NO: 2215444 - RNA, 22 nt, Human
cucugccccagaggccucucuc

SEQ ID NO: 2215445 - RNA, 18 nt, Human
cucugagaauuccaagga

SEQ ID NO: 2215446 - RNA, 19 nt, Human
cucugagaauuccaaggag

SEQ ID NO: 2215447 - RNA, 21 nt, Human
cucugagaauuccaaggaguu

SEQ ID NO: 2215448 - RNA, 13 nt, Human
cucugacuucugc

SEQ ID NO: 2215449 - RNA, 14 nt, Human
cucugacuucugcc

SEQ ID NO: 2215450 - RNA, 15 nt, Human
cucugacuucugccu

SEQ ID NO: 2215451 - RNA, 16 nt, Human
cucugacuucugccug

SEQ ID NO: 2215452 - RNA, 17 nt, Human
cucugacuucugccugg

SEQ ID NO: 2215453 - RNA, 18 nt, Human
cucugacuucugccugga

SEQ ID NO: 2215454 - RNA, 19 nt, Human
cucugacuucugccuggag

SEQ ID NO: 2215455 - RNA, 21 nt, Human
cucugacuucugccuggagac

SEQ ID NO: 2215456 - RNA, 12 nt, Human
cucucugcucug

SEQ ID NO: 2215457 - RNA, 16 nt, Human
cucucugcaucugacc

SEQ ID NO: 2215458 - RNA, 12 nt, Human
cucucugccacu

SEQ ID NO: 2215459 - RNA, 13 nt, Human
cucucugcuguac

SEQ ID NO: 2215460 - RNA, 22 nt, Human
cucucugcucugcgugucaccu

SEQ ID NO: 2215461 - RNA, 14 nt, Human
cucucugcucugcg

SEQ ID NO: 2215462 - RNA, 21 nt, Human
cucucugcagccagcccagcc

SEQ ID NO: 2215463 - RNA, 12 nt, Human
cucucugcccua

SEQ ID NO: 2215464 - RNA, 21 nt, Human
cucucugcccuaaugcgcagg

SEQ ID NO: 2215465 - RNA, 13 nt, Human
cucucugcccuaa

SEQ ID NO: 2215466 - RNA, 20 nt, Human
cucugaggcucuuucugggc

SEQ ID NO: 2215467 - RNA, 19 nt, Human
cucugaggcucuuucuggg

SEQ ID NO: 2215468 - RNA, 21 nt, Human
cucugaggcuggauccuagcc

SEQ ID NO: 2215469 - RNA, 13 nt, Human
cucugaggcugua

SEQ ID NO: 2215470 - RNA, 15 nt, Human
cucugaggcuuccag

SEQ ID NO: 2215471 - RNA, 16 nt, Human
cucugaggcuuccaga

SEQ ID NO: 2215472 - RNA, 18 nt, Human
cucugaggcuuccagaga

SEQ ID NO: 2215473 - RNA, 19 nt, Human
cucugaggcuuccagagag

SEQ ID NO: 2215474 - RNA, 21 nt, Human
cucugaggcuuccagagaguc

SEQ ID NO: 2215475 - RNA, 19 nt, Human
cucugagggaaagcccaga

SEQ ID NO: 2215476 - RNA, 12 nt, Human
cucugagggcuu

SEQ ID NO: 2215477 - RNA, 13 nt, Human
cucugagggcuuc

SEQ ID NO: 2215478 - RNA, 17 nt, Human
cucugagggcuuccuuu

SEQ ID NO: 2215479 - RNA, 16 nt, Human
cucugagcaaaugugg

SEQ ID NO: 2215480 - RNA, 18 nt, Human
cucugagccaguucagua

SEQ ID NO: 2215481 - RNA, 13 nt, Human
cucugagcaguga

SEQ ID NO: 2215482 - RNA, 21 nt, Human
cucugagaucuaaggauguca

SEQ ID NO: 2215483 - RNA, 22 nt, Human
cucugagaucuaaggaugucac

SEQ ID NO: 2215484 - RNA, 22 nt, Human
cucugagccccugggacugcug

SEQ ID NO: 2215485 - RNA, 13 nt, Human
cucugagccccug

SEQ ID NO: 2215486 - RNA, 15 nt, Human
cucugagcugugcag

SEQ ID NO: 2215487 - RNA, 15 nt, Human
cucugagccuuggga

SEQ ID NO: 2215488 - RNA, 13 nt, Human
cucugagcgccuc

SEQ ID NO: 2215489 - RNA, 22 nt, Human
cucugcaagaauugaagcagga

SEQ ID NO: 2215490 - RNA, 18 nt, Human
cucugauuugcaaaaaaa

SEQ ID NO: 2215491 - RNA, 20 nt, Human
cucugauuuucaaagcuuuu

SEQ ID NO: 2215492 - RNA, 22 nt, Human
cucugauuuucaaagcuuuuuc

SEQ ID NO: 2215493 - RNA, 14 nt, Human
cucugauuugcaaa

SEQ ID NO: 2215494 - RNA, 15 nt, Human
cucugauuuucaaag

SEQ ID NO: 2215495 - RNA, 19 nt, Human
cucugauuuucaaagcuuu

SEQ ID NO: 2215496 - RNA, 18 nt, Human
cucugauuuucaaagcuu

SEQ ID NO: 2215497 - RNA, 15 nt, Human
cucugaucaaguauu

SEQ ID NO: 2215498 - RNA, 23 nt, Human
cucugauauuccaugaauguauc

SEQ ID NO: 2215499 - RNA, 20 nt, Human
cucugauauuccaugaaugu

SEQ ID NO: 2215500 - RNA, 19 nt, Human
cucugauauuccaugaaug

SEQ ID NO: 2215501 - RNA, 15 nt, Human
cucugauaggccaag

SEQ ID NO: 2215502 - RNA, 18 nt, Human
cucugagggcuuccuuug

SEQ ID NO: 2215503 - RNA, 17 nt, Human
cucugaugaagaggagu

SEQ ID NO: 2215504 - RNA, 15 nt, Human
cucugaucuccaugg

SEQ ID NO: 2215505 - RNA, 22 nt, Human
cucugaucuccauggcuuccuc

SEQ ID NO: 2215506 - RNA, 22 nt, Human
cucugaucccucuacagagcuu

SEQ ID NO: 2215507 - RNA, 17 nt, Human
cucugauccuucuuccu

SEQ ID NO: 2215508 - RNA, 21 nt, Human
cucugaucccucuacagagcu

SEQ ID NO: 2215509 - RNA, 12 nt, Human
cucugaucccuc

SEQ ID NO: 2215510 - RNA, 18 nt, Human
cucugcaauuccccucug

SEQ ID NO: 2215511 - RNA, 19 nt, Human
cucugcaauuccccucugc

SEQ ID NO: 2215512 - RNA, 20 nt, Human
cucugcaauuccccucugcu

SEQ ID NO: 2215513 - RNA, 21 nt, Human
cucugcaauuccccucugcug

SEQ ID NO: 2215514 - RNA, 16 nt, Human
cucugcaaaggaaaua

SEQ ID NO: 2215515 - RNA, 17 nt, Human
cucugcaaucuucucag

SEQ ID NO: 2215516 - RNA, 18 nt, Human
cucugcaaucuucucaga

SEQ ID NO: 2215517 - RNA, 17 nt, Human
cucugcaaugggcacug

SEQ ID NO: 2215518 - RNA, 15 nt, Human
cucugcaauuccccu

SEQ ID NO: 2215519 - RNA, 18 nt, Human
cucugcaaugggcacugg

SEQ ID NO: 2215520 - RNA, 23 nt, Human
cucugcaaugggcacugggauga

SEQ ID NO: 2215521 - RNA, 16 nt, Human
cucugcaauuccccuc

SEQ ID NO: 2215522 - RNA, 17 nt, Human
cucugcaauuccccucu

SEQ ID NO: 2215523 - RNA, 23 nt, Human
cucugcauacucauuaggauggc

SEQ ID NO: 2215524 - RNA, 16 nt, Human
cucugcagugccuugg

SEQ ID NO: 2215525 - RNA, 19 nt, Human
cucugccaacuucuucaga

SEQ ID NO: 2215526 - RNA, 13 nt, Human
cucugcagugccu

SEQ ID NO: 2215527 - RNA, 14 nt, Human
cucugcagugccuu

SEQ ID NO: 2215528 - RNA, 15 nt, Human
cucugcagugccuug

SEQ ID NO: 2215529 - RNA, 22 nt, Human
cucugcaauuccccucugcugc

SEQ ID NO: 2215530 - RNA, 23 nt, Human
cucugcaauuccccucugcugcu

SEQ ID NO: 2215531 - RNA, 23 nt, Human
cucugcaggucccuaauaaagcu

SEQ ID NO: 2215532 - RNA, 18 nt, Human
cucucugcaccguacugu

SEQ ID NO: 2215533 - RNA, 16 nt, Human
cucucugcagccagcc

SEQ ID NO: 2215534 - RNA, 20 nt, Human
cucucugcagccagcccagc

SEQ ID NO: 2215535 - RNA, 19 nt, Human
cucucugcagccagcccag

SEQ ID NO: 2215536 - RNA, 18 nt, Human
cucucugcagccagccca

SEQ ID NO: 2215537 - RNA, 17 nt, Human
cucucugcagccagccc

SEQ ID NO: 2215538 - RNA, 12 nt, Human
cucucugcaggu

SEQ ID NO: 2215539 - RNA, 13 nt, Human
cucucugcagguc

SEQ ID NO: 2215540 - RNA, 14 nt, Human
cucucugcaggucc

SEQ ID NO: 2215541 - RNA, 16 nt, Human
cucucugcaggucccu

SEQ ID NO: 2215542 - RNA, 17 nt, Human
cucucugcaggucccua

SEQ ID NO: 2215543 - RNA, 19 nt, Human
cucucugcaggucccuaau

SEQ ID NO: 2215544 - RNA, 22 nt, Human
cucucugcaggucccuaauaaa

SEQ ID NO: 2215545 - RNA, 20 nt, Human
cucucggaguaucugggaac

SEQ ID NO: 2215546 - RNA, 19 nt, Human
cucucggaguaucugggaa

SEQ ID NO: 2215547 - RNA, 14 nt, Human
cucucggcucccca

SEQ ID NO: 2215548 - RNA, 15 nt, Human
cucucggcuccccau

SEQ ID NO: 2215549 - RNA, 16 nt, Human
cucucggcuccccaug

SEQ ID NO: 2215550 - RNA, 19 nt, Human
cucucggguugugugucug

SEQ ID NO: 2215551 - RNA, 19 nt, Human
cucucggguucaagcaauu

SEQ ID NO: 2215552 - RNA, 21 nt, Human
cucucgguuccacgucccccu

SEQ ID NO: 2215553 - RNA, 17 nt, Human
cucucggcuccccaugu

SEQ ID NO: 2215554 - RNA, 18 nt, Human
cucucggcuccccaugug

SEQ ID NO: 2215555 - RNA, 16 nt, Human
cucucguaacugguuu

SEQ ID NO: 2215556 - RNA, 17 nt, Human
cucucguaacugguuuc

SEQ ID NO: 2215557 - RNA, 19 nt, Human
cucucuacaaacucccacu

SEQ ID NO: 2215558 - RNA, 14 nt, Human
cucucucacuccuu

SEQ ID NO: 2215559 - RNA, 15 nt, Human
cucucucacuccuug

SEQ ID NO: 2215560 - RNA, 16 nt, Human
cucucucacuccuuga

SEQ ID NO: 2215561 - RNA, 14 nt, Human
cucucugacucuca

SEQ ID NO: 2215562 - RNA, 12 nt, Human
cucucucaggcc

SEQ ID NO: 2215563 - RNA, 22 nt, Human
cucucggaaggcuggcugggca

SEQ ID NO: 2215564 - RNA, 19 nt, Human
cucucggaaggcuggcugg

SEQ ID NO: 2215565 - RNA, 18 nt, Human
cucucggaaggcuggcug

SEQ ID NO: 2215566 - RNA, 16 nt, Human
cucucggaaggcuggc

SEQ ID NO: 2215567 - RNA, 23 nt, Human
cucucggaacugcaugcugcugg

SEQ ID NO: 2215568 - RNA, 21 nt, Human
cucucggaacugcaugcugcu

SEQ ID NO: 2215569 - RNA, 20 nt, Human
cucucggaacugcaugcugc

SEQ ID NO: 2215570 - RNA, 19 nt, Human
cucucggaacugcaugcug

SEQ ID NO: 2215571 - RNA, 16 nt, Human
cucucggaacugcaug

SEQ ID NO: 2215572 - RNA, 12 nt, Human
cucucggaacug

SEQ ID NO: 2215573 - RNA, 18 nt, Human
cucucgcaccuuuccaaa

SEQ ID NO: 2215574 - RNA, 13 nt, Human
cucuccuuuguau

SEQ ID NO: 2215575 - RNA, 14 nt, Human
cucuccuuuguaua

SEQ ID NO: 2215576 - RNA, 15 nt, Human
cucuccuuuguauau

SEQ ID NO: 2215577 - RNA, 18 nt, Human
cucuccuuuguauauuau

SEQ ID NO: 2215578 - RNA, 17 nt, Human
cucucgcaccuuuccaa

SEQ ID NO: 2215579 - RNA, 20 nt, Human
cucuccuuuguauauuauuu

SEQ ID NO: 2215580 - RNA, 22 nt, Human
cucuccuuuguauauuauuucu

SEQ ID NO: 2215581 - RNA, 19 nt, Human
cucucgcaccuuuccaaag

SEQ ID NO: 2215582 - RNA, 19 nt, Human
cucuccuuuggccauucca

SEQ ID NO: 2215583 - RNA, 12 nt, Human
cucuccugucca

SEQ ID NO: 2215584 - RNA, 23 nt, Human
cucuccuuucuuuuucuucuucc

SEQ ID NO: 2215585 - RNA, 18 nt, Human
cucuccuguacuuuuucc

SEQ ID NO: 2215586 - RNA, 11 nt, Human
cucuccccagc

SEQ ID NO: 2215587 - RNA, 22 nt, Human
cucuccuguaccucuugagccu

SEQ ID NO: 2215588 - RNA, 18 nt, Human
cucuccuguaccucuuga

SEQ ID NO: 2215589 - RNA, 17 nt, Human
cucuccuguaccucuug

SEQ ID NO: 2215590 - RNA, 13 nt, Human
cucuccuguaccu

SEQ ID NO: 2215591 - RNA, 15 nt, Human
cucuccuguaccucu

SEQ ID NO: 2215592 - RNA, 14 nt, Human
cucuccuguaccuc

SEQ ID NO: 2215593 - RNA, 12 nt, Human
cucuccccacac

SEQ ID NO: 2215594 - RNA, 14 nt, Human
cucucccauuuccu

SEQ ID NO: 2215595 - RNA, 19 nt, Human
cucucccauugucccucug

SEQ ID NO: 2215596 - RNA, 18 nt, Human
cucucccauugucccucu

SEQ ID NO: 2215597 - RNA, 16 nt, Human
cucucccauugucccu

SEQ ID NO: 2215598 - RNA, 13 nt, Human
cucucccauggcu

SEQ ID NO: 2215599 - RNA, 13 nt, Human
cucucccauggag

SEQ ID NO: 2215600 - RNA, 14 nt, Human
cucucccauggagc

SEQ ID NO: 2215601 - RNA, 16 nt, Human
cucucccauggagccc

SEQ ID NO: 2215602 - RNA, 18 nt, Human
cucucccauggagcccca

SEQ ID NO: 2215603 - RNA, 19 nt, Human
cucucccauggagccccag

SEQ ID NO: 2215604 - RNA, 21 nt, Human
cucucccauggagccccagcc

SEQ ID NO: 2215605 - RNA, 22 nt, Human
cucucccauggagccccagccc

SEQ ID NO: 2215606 - RNA, 23 nt, Human
cucucccauggagccccagcccc

SEQ ID NO: 2215607 - RNA, 15 nt, Human
cucuccccacacuaa

SEQ ID NO: 2215608 - RNA, 14 nt, Human
cucuccccacacua

SEQ ID NO: 2215609 - RNA, 13 nt, Human
cucuccccacacu

SEQ ID NO: 2215610 - RNA, 13 nt, Human
cucuccccagcaa

SEQ ID NO: 2215611 - RNA, 21 nt, Human
cucucccauugucccucugcc

SEQ ID NO: 2215612 - RNA, 23 nt, Human
cucuccaagucucaguggcuuca

SEQ ID NO: 2215613 - RNA, 20 nt, Human
cucuccaagucucaguggcu

SEQ ID NO: 2215614 - RNA, 17 nt, Human
cucucaucucuuagcuc

SEQ ID NO: 2215615 - RNA, 13 nt, Human
cucucaugaaccu

SEQ ID NO: 2215616 - RNA, 21 nt, Human
cucucaguuccgauuucccag

SEQ ID NO: 2215617 - RNA, 22 nt, Human
cucucaucaguguccucuugcu

SEQ ID NO: 2215618 - RNA, 18 nt, Human
cucucaucaacugaauga

SEQ ID NO: 2215619 - RNA, 17 nt, Human
cucucaucaacugaaug

SEQ ID NO: 2215620 - RNA, 12 nt, Human
cucucaguuuuu

SEQ ID NO: 2215621 - RNA, 16 nt, Human
cucucaucaacugaau

SEQ ID NO: 2215622 - RNA, 18 nt, Human
cucucagucucugagcag

SEQ ID NO: 2215623 - RNA, 10 nt, Human
cucuccaccu

SEQ ID NO: 2215624 - RNA, 14 nt, Human
cucuccaccuagug

SEQ ID NO: 2215625 - RNA, 17 nt, Human
cucuccaccuaguggcu

SEQ ID NO: 2215626 - RNA, 20 nt, Human
cucuccaccuaguggcuguc

SEQ ID NO: 2215627 - RNA, 22 nt, Human
cucuccaccuaguggcugucca

SEQ ID NO: 2215628 - RNA, 20 nt, Human
cucuccaagugccagaggug

SEQ ID NO: 2215629 - RNA, 22 nt, Human
cucuccaagugccagagguggg

SEQ ID NO: 2215630 - RNA, 14 nt, Human
cucuccaagugcca

SEQ ID NO: 2215631 - RNA, 15 nt, Human
cucuccaagugccag

SEQ ID NO: 2215632 - RNA, 16 nt, Human
cucuccaagugccaga

SEQ ID NO: 2215633 - RNA, 19 nt, Human
cucuccaagugccagaggu

SEQ ID NO: 2215634 - RNA, 18 nt, Human
cucuccaccucagccuug

SEQ ID NO: 2215635 - RNA, 17 nt, Human
cucuccaccucagccuu

SEQ ID NO: 2215636 - RNA, 16 nt, Human
cucuccaccucagccu

SEQ ID NO: 2215637 - RNA, 15 nt, Human
cucuccaccucagcc

SEQ ID NO: 2215638 - RNA, 14 nt, Human
cucuccaccucagc

SEQ ID NO: 2215639 - RNA, 13 nt, Human
cucuccaccucag

SEQ ID NO: 2215640 - RNA, 12 nt, Human
cucuccaccuca

SEQ ID NO: 2215641 - RNA, 23 nt, Human
cucuccaccuaguggcuguccag

SEQ ID NO: 2215642 - RNA, 16 nt, Human
cucuccacugccuucg

SEQ ID NO: 2215643 - RNA, 15 nt, Human
cucuaauaucagcaa

SEQ ID NO: 2215644 - RNA, 19 nt, Human
cucuaagccacucuuccaa

SEQ ID NO: 2215645 - RNA, 14 nt, Human
cucuaagguugggc

SEQ ID NO: 2215646 - RNA, 23 nt, Human
cucuaaggccgaagaaggguccu

SEQ ID NO: 2215647 - RNA, 16 nt, Human
cucuaaguuccacuga

SEQ ID NO: 2215648 - RNA, 18 nt, Human
cucuaaguuccacugagc

SEQ ID NO: 2215649 - RNA, 19 nt, Human
cucuaaguuccacugagcu

SEQ ID NO: 2215650 - RNA, 20 nt, Human
cucuaaguuccacugagcuc

SEQ ID NO: 2215651 - RNA, 21 nt, Human
cucuaaguuccacugagcucc

SEQ ID NO: 2215652 - RNA, 22 nt, Human
cucucaggccagcugcuugggc

SEQ ID NO: 2215653 - RNA, 23 nt, Human
cucucaggccagcugcuugggcu

SEQ ID NO: 2215654 - RNA, 19 nt, Human
cucucaguacuuuggaggc

SEQ ID NO: 2215655 - RNA, 18 nt, Human
cucucaguacuuuggagg

SEQ ID NO: 2215656 - RNA, 13 nt, Human
cucucagucucug

SEQ ID NO: 2215657 - RNA, 15 nt, Human
cucucaggugaccaa

SEQ ID NO: 2215658 - RNA, 17 nt, Human
cucucagucucugagca

SEQ ID NO: 2215659 - RNA, 16 nt, Human
cucucagucucugagc

SEQ ID NO: 2215660 - RNA, 15 nt, Human
cucucagucucugag

SEQ ID NO: 2215661 - RNA, 14 nt, Human
cucucagucucuga

SEQ ID NO: 2215662 - RNA, 11 nt, Human
cucucccaggg

SEQ ID NO: 2215663 - RNA, 13 nt, Human
cucucccaggggc

SEQ ID NO: 2215664 - RNA, 20 nt, Human
cucucccagucuacccagag

SEQ ID NO: 2215665 - RNA, 13 nt, Human
cucucccaucacu

SEQ ID NO: 2215666 - RNA, 13 nt, Human
cucucccaggacc

SEQ ID NO: 2215667 - RNA, 12 nt, Human
cucucccaggac

SEQ ID NO: 2215668 - RNA, 18 nt, Human
cucucccaucacuucccu

SEQ ID NO: 2215669 - RNA, 14 nt, Human
cucucccaucacuu

SEQ ID NO: 2215670 - RNA, 12 nt, Human
cucucccauccc

SEQ ID NO: 2215671 - RNA, 21 nt, Human
cucucccagucuacccagaga

SEQ ID NO: 2215672 - RNA, 22 nt, Human
cucucccagucuacccagagaa

SEQ ID NO: 2215673 - RNA, 13 nt, Human
cucucccaucccc

SEQ ID NO: 2215674 - RNA, 16 nt, Human
cucucccaucccccug

SEQ ID NO: 2215675 - RNA, 18 nt, Human
cucucccaucccccugcc

SEQ ID NO: 2215676 - RNA, 20 nt, Human
cucucccaucccccugcccu

SEQ ID NO: 2215677 - RNA, 20 nt, Human
cucucccaucacuucccuac

SEQ ID NO: 2215678 - RNA, 21 nt, Human
cucuccauucccguggaacgu

SEQ ID NO: 2215679 - RNA, 13 nt, Human
cucuccauaaccc

SEQ ID NO: 2215680 - RNA, 16 nt, Human
cucuccauaaccccac

SEQ ID NO: 2215681 - RNA, 18 nt, Human
cucuccauaaccccaccc

SEQ ID NO: 2215682 - RNA, 15 nt, Human
cucuccaucuucagc

SEQ ID NO: 2215683 - RNA, 17 nt, Human
cucuccaggcgccggcg

SEQ ID NO: 2215684 - RNA, 18 nt, Human
cucuccaggcacccuucu

SEQ ID NO: 2215685 - RNA, 19 nt, Human
cucuccaggcacccuucuu

SEQ ID NO: 2215686 - RNA, 16 nt, Human
cucuccaucuucagcu

SEQ ID NO: 2215687 - RNA, 20 nt, Human
cucuccaccucagccuugga

SEQ ID NO: 2215688 - RNA, 12 nt, Human
cucuccagcccc

SEQ ID NO: 2215689 - RNA, 13 nt, Human
cucuccagccccu

SEQ ID NO: 2215690 - RNA, 13 nt, Human
cucuccaggcacc

SEQ ID NO: 2215691 - RNA, 20 nt, Human
cucuccagauguuuccagac

SEQ ID NO: 2215692 - RNA, 19 nt, Human
cucauugucuguguagagu

SEQ ID NO: 2215693 - RNA, 15 nt, Human
cuccacagccgcagc

SEQ ID NO: 2215694 - RNA, 14 nt, Human
cuccacagccgcag

SEQ ID NO: 2215695 - RNA, 19 nt, Human
cuccacagcaaccccaggc

SEQ ID NO: 2215696 - RNA, 16 nt, Human
cuccacagccauccca

SEQ ID NO: 2215697 - RNA, 23 nt, Human
cuccacagccaucccagccuugg

SEQ ID NO: 2215698 - RNA, 16 nt, Human
cuccacagcaacccca

SEQ ID NO: 2215699 - RNA, 23 nt, Human
cuccaccccccagaaccuguccu

SEQ ID NO: 2215700 - RNA, 22 nt, Human
cuccaccccccagaaccugucc

SEQ ID NO: 2215701 - RNA, 21 nt, Human
cuccaccccccagaaccuguc

SEQ ID NO: 2215702 - RNA, 16 nt, Human
cuccaccccccagaac

SEQ ID NO: 2215703 - RNA, 22 nt, Human
cuccacccccagcugcuugugu

SEQ ID NO: 2215704 - RNA, 22 nt, Human
cuccacaguucgaccugcggcu

SEQ ID NO: 2215705 - RNA, 11 nt, Human
cuccacccugc

SEQ ID NO: 2215706 - RNA, 15 nt, Human
cuccacagcuaccuc

SEQ ID NO: 2215707 - RNA, 15 nt, Human
cuccacaguucagug

SEQ ID NO: 2215708 - RNA, 17 nt, Human
cuccacaguucaguggc

SEQ ID NO: 2215709 - RNA, 23 nt, Human
cuccacaguucaguggcagggcu

SEQ ID NO: 2215710 - RNA, 21 nt, Human
cuccacaguucgaccugcggc

SEQ ID NO: 2215711 - RNA, 13 nt, Human
cuccacaguguug

SEQ ID NO: 2215712 - RNA, 17 nt, Human
cuccaccucagccuugg

SEQ ID NO: 2215713 - RNA, 16 nt, Human
cuccaccucagccuug

SEQ ID NO: 2215714 - RNA, 15 nt, Human
cuccaccugccaggg

SEQ ID NO: 2215715 - RNA, 17 nt, Human
cuccaccugccagggac

SEQ ID NO: 2215716 - RNA, 18 nt, Human
cuccaccugccagggaca

SEQ ID NO: 2215717 - RNA, 21 nt, Human
cuccaccugccagggacagag

SEQ ID NO: 2215718 - RNA, 15 nt, Human
cuccaccucagccuu

SEQ ID NO: 2215719 - RNA, 19 nt, Human
cuccacccucugagcuuug

SEQ ID NO: 2215720 - RNA, 16 nt, Human
cuccacccucugagcu

SEQ ID NO: 2215721 - RNA, 17 nt, Human
cuccacccucugagcuu

SEQ ID NO: 2215722 - RNA, 14 nt, Human
cuccacccucccag

SEQ ID NO: 2215723 - RNA, 18 nt, Human
cuccacccucccagaccu

SEQ ID NO: 2215724 - RNA, 13 nt, Human
cuccacccucuga

SEQ ID NO: 2215725 - RNA, 14 nt, Human
cuccacccucugag

SEQ ID NO: 2215726 - RNA, 12 nt, Human
cuccacccugcu

SEQ ID NO: 2215727 - RNA, 18 nt, Human
cuccaccucagccuugga

SEQ ID NO: 2215728 - RNA, 17 nt, Human
cuccaccugcucccagg

SEQ ID NO: 2215729 - RNA, 21 nt, Human
cuccacucuccucuuccaggc

SEQ ID NO: 2215730 - RNA, 12 nt, Human
cuccacucugcu

SEQ ID NO: 2215731 - RNA, 13 nt, Human
cuccacucugcuu

SEQ ID NO: 2215732 - RNA, 14 nt, Human
cuccacucugcuuc

SEQ ID NO: 2215733 - RNA, 15 nt, Human
cuccacucugcuucu

SEQ ID NO: 2215734 - RNA, 11 nt, Human
cuccacugccu

SEQ ID NO: 2215735 - RNA, 16 nt, Human
cuccacucugcuucuc

SEQ ID NO: 2215736 - RNA, 17 nt, Human
cuccacucugcuucucu

SEQ ID NO: 2215737 - RNA, 20 nt, Human
cuccacucugcuucucugac

SEQ ID NO: 2215738 - RNA, 21 nt, Human
cuccacucugcuucucugacu

SEQ ID NO: 2215739 - RNA, 14 nt, Human
cuccagaccccugg

SEQ ID NO: 2215740 - RNA, 15 nt, Human
cuccagaccccuggc

SEQ ID NO: 2215741 - RNA, 17 nt, Human
cuccagaccccuggcuu

SEQ ID NO: 2215742 - RNA, 18 nt, Human
cuccagaccccuggcuuu

SEQ ID NO: 2215743 - RNA, 19 nt, Human
cuccacucugacuggcaca

SEQ ID NO: 2215744 - RNA, 19 nt, Human
cuccagaccccuggcuuuu

SEQ ID NO: 2215745 - RNA, 20 nt, Human
cuccagaccccuggcuuuuc

SEQ ID NO: 2215746 - RNA, 13 nt, Human
cuccagccugagc

SEQ ID NO: 2215747 - RNA, 17 nt, Human
cuccagccucuguuccc

SEQ ID NO: 2215748 - RNA, 22 nt, Human
cuccagccccuucucagaaucu

SEQ ID NO: 2215749 - RNA, 13 nt, Human
cuccagccucugu

SEQ ID NO: 2215750 - RNA, 11 nt, Human
cuccagccucu

SEQ ID NO: 2215751 - RNA, 19 nt, Human
cuccagcucaccagcccca

SEQ ID NO: 2215752 - RNA, 20 nt, Human
cuccagcucaccagccccag

SEQ ID NO: 2215753 - RNA, 21 nt, Human
cuccagccaaccccuguggag

SEQ ID NO: 2215754 - RNA, 20 nt, Human
cuccagccaaccccugugga

SEQ ID NO: 2215755 - RNA, 19 nt, Human
cuccagccaaccccugugg

SEQ ID NO: 2215756 - RNA, 18 nt, Human
cuccagccaaccccugug

SEQ ID NO: 2215757 - RNA, 11 nt, Human
cuccagccagc

SEQ ID NO: 2215758 - RNA, 12 nt, Human
cuccagccagca

SEQ ID NO: 2215759 - RNA, 13 nt, Human
cuccagccagcaa

SEQ ID NO: 2215760 - RNA, 16 nt, Human
cuccagccagcaauga

SEQ ID NO: 2215761 - RNA, 17 nt, Human
cuccagccaaccccugu

SEQ ID NO: 2215762 - RNA, 14 nt, Human
cuccagccaacccc

SEQ ID NO: 2215763 - RNA, 13 nt, Human
cuccagccaaccc

SEQ ID NO: 2215764 - RNA, 18 nt, Human
cuccagcaccauccgcca

SEQ ID NO: 2215765 - RNA, 23 nt, Human
cuccagccagcaaugauguccag

SEQ ID NO: 2215766 - RNA, 24 nt, Human
cuccagccagcaaugauguccaga

SEQ ID NO: 2215767 - RNA, 20 nt, Human
cuccagccagccagcucauu

SEQ ID NO: 2215768 - RNA, 19 nt, Human
cuccagccccuucucagaa

SEQ ID NO: 2215769 - RNA, 21 nt, Human
cuccagccccuucucagaauc

SEQ ID NO: 2215770 - RNA, 23 nt, Human
cuccagccccuucucagaaucua

SEQ ID NO: 2215771 - RNA, 24 nt, Human
cuccauucccguggaacguuuuuc

SEQ ID NO: 2215772 - RNA, 22 nt, Human
cuccauuaggauuugccccuuc

SEQ ID NO: 2215773 - RNA, 14 nt, Human
cuccaugugggcua

SEQ ID NO: 2215774 - RNA, 20 nt, Human
cuccauucugaccauuucag

SEQ ID NO: 2215775 - RNA, 14 nt, Human
cuccauucugacca

SEQ ID NO: 2215776 - RNA, 22 nt, Human
cuccaucuccaagaaugcugaa

SEQ ID NO: 2215777 - RNA, 15 nt, Human
cuccauuccagucuc

SEQ ID NO: 2215778 - RNA, 17 nt, Human
cuccauugguguugaca

SEQ ID NO: 2215779 - RNA, 22 nt, Human
cucccaaggggcccaaauucuu

SEQ ID NO: 2215780 - RNA, 21 nt, Human
cucccaaggggcccaaauucu

SEQ ID NO: 2215781 - RNA, 23 nt, Human
cucccaaggcugcgucuggaggg

SEQ ID NO: 2215782 - RNA, 14 nt, Human
cucccaagggaugg

SEQ ID NO: 2215783 - RNA, 18 nt, Human
cucccaagggauggugcc

SEQ ID NO: 2215784 - RNA, 22 nt, Human
cucccaaguagcugggauuaca

SEQ ID NO: 2215785 - RNA, 15 nt, Human
cucccaggcauuccc

SEQ ID NO: 2215786 - RNA, 17 nt, Human
cucccaagucuacagag

SEQ ID NO: 2215787 - RNA, 13 nt, Human
cucccaaguggug

SEQ ID NO: 2215788 - RNA, 16 nt, Human
cucccaaguggugccu

SEQ ID NO: 2215789 - RNA, 21 nt, Human
cucccaggccaggcuccuucc

SEQ ID NO: 2215790 - RNA, 17 nt, Human
cucccaggccaggcucc

SEQ ID NO: 2215791 - RNA, 17 nt, Human
cucccaaguggugccua

SEQ ID NO: 2215792 - RNA, 18 nt, Human
cucccaaguggugccuaa

SEQ ID NO: 2215793 - RNA, 22 nt, Human
cucccaggccaggcuccuuccu

SEQ ID NO: 2215794 - RNA, 22 nt, Human
cucccaggccaguaagggaaau

SEQ ID NO: 2215795 - RNA, 22 nt, Human
cucccaggcauuccccaggagg

SEQ ID NO: 2215796 - RNA, 14 nt, Human
cucccaggcgcccc

SEQ ID NO: 2215797 - RNA, 21 nt, Human
cucccaggccgagaagccagu

SEQ ID NO: 2215798 - RNA, 17 nt, Human
cucccagucauuuaaua

SEQ ID NO: 2215799 - RNA, 17 nt, Human
cucccaggcauucccca

SEQ ID NO: 2215800 - RNA, 19 nt, Human
cucccaggcauuccccagg

SEQ ID NO: 2215801 - RNA, 20 nt, Human
cucccaggcauuccccagga

SEQ ID NO: 2215802 - RNA, 21 nt, Human
cucccaggcauuccccaggag

SEQ ID NO: 2215803 - RNA, 13 nt, Human
cuccagcuguuca

SEQ ID NO: 2215804 - RNA, 19 nt, Human
cuccagcuggguuggaaaa

SEQ ID NO: 2215805 - RNA, 11 nt, Human
cuccagcuccu

SEQ ID NO: 2215806 - RNA, 14 nt, Human
cuccagccugagca

SEQ ID NO: 2215807 - RNA, 17 nt, Human
cuccagccugccuggca

SEQ ID NO: 2215808 - RNA, 19 nt, Human
cuccagccugccuggcagg

SEQ ID NO: 2215809 - RNA, 13 nt, Human
cuccagcuccaag

SEQ ID NO: 2215810 - RNA, 19 nt, Human
cuccagccuggacccccag

SEQ ID NO: 2215811 - RNA, 14 nt, Human
cuccagcuccaaga

SEQ ID NO: 2215812 - RNA, 21 nt, Human
cuccagcuccaagaccuguug

SEQ ID NO: 2215813 - RNA, 19 nt, Human
cuccagcuguucagcuggu

SEQ ID NO: 2215814 - RNA, 18 nt, Human
cuccagcuguucagcugg

SEQ ID NO: 2215815 - RNA, 20 nt, Human
cuccaggccacauggggcug

SEQ ID NO: 2215816 - RNA, 11 nt, Human
cuccagcuucu

SEQ ID NO: 2215817 - RNA, 13 nt, Human
cuccaggcaggcu

SEQ ID NO: 2215818 - RNA, 15 nt, Human
cuccaggcaggcuaa

SEQ ID NO: 2215819 - RNA, 20 nt, Human
cuccaucgcugucaucucag

SEQ ID NO: 2215820 - RNA, 17 nt, Human
cuccaucuaaacugccc

SEQ ID NO: 2215821 - RNA, 23 nt, Human
cuccauccugaggcuccacuugg

SEQ ID NO: 2215822 - RNA, 13 nt, Human
cuccaucuccacu

SEQ ID NO: 2215823 - RNA, 14 nt, Human
cuccaucucaugua

SEQ ID NO: 2215824 - RNA, 23 nt, Human
cuccaucucauguaucaucugga

SEQ ID NO: 2215825 - RNA, 18 nt, Human
cuccaucuccaagaaugc

SEQ ID NO: 2215826 - RNA, 21 nt, Human
cuccaucuccaagaaugcuga

SEQ ID NO: 2215827 - RNA, 18 nt, Human
cuccaucuaaacugcccc

SEQ ID NO: 2215828 - RNA, 19 nt, Human
cuccauccuuucugccucu

SEQ ID NO: 2215829 - RNA, 21 nt, Human
cuccauccuuucugccucuca

SEQ ID NO: 2215830 - RNA, 22 nt, Human
cuccauccuuucugccucucaa

SEQ ID NO: 2215831 - RNA, 9 nt, Human
cuccaucuc

SEQ ID NO: 2215832 - RNA, 11 nt, Human
cuccaggcucc

SEQ ID NO: 2215833 - RNA, 13 nt, Human
cuccaggcgccgg

SEQ ID NO: 2215834 - RNA, 14 nt, Human
cuccaggcgccggc

SEQ ID NO: 2215835 - RNA, 18 nt, Human
cuccaggcgccggcgggc

SEQ ID NO: 2215836 - RNA, 20 nt, Human
cuccauccugaggcuccacu

SEQ ID NO: 2215837 - RNA, 21 nt, Human
cuccauccugaggcuccacuu

SEQ ID NO: 2215838 - RNA, 17 nt, Human
cucauugacaagaacug

SEQ ID NO: 2215839 - RNA, 18 nt, Human
cucauuccugccugucuc

SEQ ID NO: 2215840 - RNA, 17 nt, Human
cucauuccugccugucu

SEQ ID NO: 2215841 - RNA, 23 nt, Human
cucauucuucuguacgucugaca

SEQ ID NO: 2215842 - RNA, 13 nt, Human
cucauugaccuga

SEQ ID NO: 2215843 - RNA, 15 nt, Human
cucauugaccugagg

SEQ ID NO: 2215844 - RNA, 18 nt, Human
cucauuggacccuuccau

SEQ ID NO: 2215845 - RNA, 17 nt, Human
cucauuggacccuucca

SEQ ID NO: 2215846 - RNA, 13 nt, Human
cucauuggacccu

SEQ ID NO: 2215847 - RNA, 18 nt, Human
cucauugacaagaacuga

SEQ ID NO: 2215848 - RNA, 20 nt, Human
cucauugcuuggaauucagc

SEQ ID NO: 2215849 - RNA, 16 nt, Human
cucauugaccugaggc

SEQ ID NO: 2215850 - RNA, 19 nt, Human
cucauugcugagccucugc

SEQ ID NO: 2215851 - RNA, 18 nt, Human
cucauugcugagccucug

SEQ ID NO: 2215852 - RNA, 20 nt, Human
cucauugcugagccucugcu

SEQ ID NO: 2215853 - RNA, 19 nt, Human
cucauugcuuacaagccua

SEQ ID NO: 2215854 - RNA, 12 nt, Human
cucauuccccag

SEQ ID NO: 2215855 - RNA, 13 nt, Human
cucauuccccagg

SEQ ID NO: 2215856 - RNA, 17 nt, Human
cucauuccagaggaagg

SEQ ID NO: 2215857 - RNA, 21 nt, Human
cucauuccaccuucccaugcc

SEQ ID NO: 2215858 - RNA, 15 nt, Human
cucauuccagaggaa

SEQ ID NO: 2215859 - RNA, 18 nt, Human
cucauuccaccuucccau

SEQ ID NO: 2215860 - RNA, 17 nt, Human
cucauuccaacagugag

SEQ ID NO: 2215861 - RNA, 18 nt, Human
cucauuccaacagugagu

SEQ ID NO: 2215862 - RNA, 22 nt, Human
cucauucaggaaaacugacaga

SEQ ID NO: 2215863 - RNA, 13 nt, Human
cucauucuucugu

SEQ ID NO: 2215864 - RNA, 14 nt, Human
cucauucuucugua

SEQ ID NO: 2215865 - RNA, 16 nt, Human
cucauuccugccuguc

SEQ ID NO: 2215866 - RNA, 13 nt, Human
cucauuccugccu

SEQ ID NO: 2215867 - RNA, 12 nt, Human
cucauuccugcc

SEQ ID NO: 2215868 - RNA, 21 nt, Human
cucauuccuccaccugccgug

SEQ ID NO: 2215869 - RNA, 14 nt, Human
cucauuccccaggu

SEQ ID NO: 2215870 - RNA, 13 nt, Human
cucauuccccggg

SEQ ID NO: 2215871 - RNA, 14 nt, Human
cucauuccccgggg

SEQ ID NO: 2215872 - RNA, 23 nt, Human
cucauuccccggggcguuucuuu

SEQ ID NO: 2215873 - RNA, 18 nt, Human
cucauuccuccaccugcc

SEQ ID NO: 2215874 - RNA, 16 nt, Human
cucaucgcguccuccu

SEQ ID NO: 2215875 - RNA, 16 nt, Human
cucauccuuguauaaa

SEQ ID NO: 2215876 - RNA, 14 nt, Human
cucauccugcaggc

SEQ ID NO: 2215877 - RNA, 21 nt, Human
cucaucuagguaaauuacagu

SEQ ID NO: 2215878 - RNA, 21 nt, Human
cucauuagcauuuugcuaaau

SEQ ID NO: 2215879 - RNA, 17 nt, Human
cucaucuccccaucauu

SEQ ID NO: 2215880 - RNA, 15 nt, Human
cucauucaaaaguug

SEQ ID NO: 2215881 - RNA, 19 nt, Human
cucauucaaaaguugaaau

SEQ ID NO: 2215882 - RNA, 14 nt, Human
cucaucuaucucaa

SEQ ID NO: 2215883 - RNA, 18 nt, Human
cucaucuaucucaauccu

SEQ ID NO: 2215884 - RNA, 18 nt, Human
cucauuaggauggcuagu

SEQ ID NO: 2215885 - RNA, 17 nt, Human
cucauuaggauggcuag

SEQ ID NO: 2215886 - RNA, 13 nt, Human
cucauccugcagg

SEQ ID NO: 2215887 - RNA, 23 nt, Human
cucauccccaggggucccagcca

SEQ ID NO: 2215888 - RNA, 19 nt, Human
cucaucccacgcacuccau

SEQ ID NO: 2215889 - RNA, 22 nt, Human
cucauccccaggggucccagcc

SEQ ID NO: 2215890 - RNA, 14 nt, Human
cucauccccagggg

SEQ ID NO: 2215891 - RNA, 13 nt, Human
cucauccccaggg

SEQ ID NO: 2215892 - RNA, 16 nt, Human
cucauccagggcucug

SEQ ID NO: 2215893 - RNA, 14 nt, Human
cucaucccacgcac

SEQ ID NO: 2215894 - RNA, 10 nt, Human
cucaucccau

SEQ ID NO: 2215895 - RNA, 19 nt, Human
cucauccaucaucaugugu

SEQ ID NO: 2215896 - RNA, 16 nt, Human
cucauccaucaucaug

SEQ ID NO: 2215897 - RNA, 24 nt, Human
cucauccaccccaucccuccccag

SEQ ID NO: 2215898 - RNA, 15 nt, Human
cucauccagggcucu

SEQ ID NO: 2215899 - RNA, 13 nt, Human
cucauccacccca

SEQ ID NO: 2215900 - RNA, 15 nt, Human
cucauccaccccauc

SEQ ID NO: 2215901 - RNA, 16 nt, Human
cucauccaccccaucc

SEQ ID NO: 2215902 - RNA, 19 nt, Human
cucauccaccccaucccuc

SEQ ID NO: 2215903 - RNA, 20 nt, Human
cucauauuccugcagccugg

SEQ ID NO: 2215904 - RNA, 15 nt, Human
cucauauuccugcag

SEQ ID NO: 2215905 - RNA, 18 nt, Human
cucauauggcccaguguc

SEQ ID NO: 2215906 - RNA, 19 nt, Human
cucauauggcccaguguca

SEQ ID NO: 2215907 - RNA, 24 nt, Human
cucauauuccugcagccuggaggc

SEQ ID NO: 2215908 - RNA, 22 nt, Human
cucauauuccugcagccuggag

SEQ ID NO: 2215909 - RNA, 13 nt, Human
cucauauugugau

SEQ ID NO: 2215910 - RNA, 15 nt, Human
cucauauuuaaagac

SEQ ID NO: 2215911 - RNA, 12 nt, Human
cucauauuuaaa

SEQ ID NO: 2215912 - RNA, 13 nt, Human
cucauauuuaaag

SEQ ID NO: 2215913 - RNA, 21 nt, Human
cucauauugugauucugccuu

SEQ ID NO: 2215914 - RNA, 19 nt, Human
cucauauugugauucugcc

SEQ ID NO: 2215915 - RNA, 23 nt, Human
cucaucauucucugucucaucca

SEQ ID NO: 2215916 - RNA, 16 nt, Human
cucauauuuuguauau

SEQ ID NO: 2215917 - RNA, 12 nt, Human
cucauauuuugu

SEQ ID NO: 2215918 - RNA, 13 nt, Human
cucauauuuugua

SEQ ID NO: 2215919 - RNA, 21 nt, Human
cucauauuuuguauauaucug

SEQ ID NO: 2215920 - RNA, 12 nt, Human
cuaaaagcacac

SEQ ID NO: 2215921 - RNA, 13 nt, Human
cuaaaagauccuu

SEQ ID NO: 2215922 - RNA, 15 nt, Human
cuaaaagauccuuuu

SEQ ID NO: 2215923 - RNA, 20 nt, Human
cuaaaagauccuuuuuaaau

SEQ ID NO: 2215924 - RNA, 23 nt, Human
cuaaaagguaugcaaucaaaucu

SEQ ID NO: 2215925 - RNA, 13 nt, Human
cguuuuuccuuua

SEQ ID NO: 2215926 - RNA, 16 nt, Human
cguuuuugguggaguc

SEQ ID NO: 2215927 - RNA, 16 nt, Human
cuaaaaaaaaaaaagu

SEQ ID NO: 2215928 - RNA, 17 nt, Human
cuaaaagauauaagugc

SEQ ID NO: 2215929 - RNA, 20 nt, Human
cuaaaagauauaagugcugu

SEQ ID NO: 2215930 - RNA, 21 nt, Human
cuaaaagauauaagugcugua

SEQ ID NO: 2215931 - RNA, 17 nt, Human
cucaggggcguguggcu

SEQ ID NO: 2215932 - RNA, 18 nt, Human
cucaggggccagaggaac

SEQ ID NO: 2215933 - RNA, 20 nt, Human
cucaggggccagaggaacug

SEQ ID NO: 2215934 - RNA, 14 nt, Human
cucaggggcuguuu

SEQ ID NO: 2215935 - RNA, 15 nt, Human
cucaggggcuguuug

SEQ ID NO: 2215936 - RNA, 16 nt, Human
cucaggggcuguuuga

SEQ ID NO: 2215937 - RNA, 12 nt, Human
cucagggucccu

SEQ ID NO: 2215938 - RNA, 16 nt, Human
cuaaaagguucaggga

SEQ ID NO: 2215939 - RNA, 13 nt, Human
cuaaaaguaaaca

SEQ ID NO: 2215940 - RNA, 14 nt, Human
cuaaaaguaaacau

SEQ ID NO: 2215941 - RNA, 19 nt, Human
cuaaaagugggcuugauuc

SEQ ID NO: 2215942 - RNA, 15 nt, Human
cuaaaaguaaacauu

SEQ ID NO: 2215943 - RNA, 13 nt, Human
cuaaaagucuucg

SEQ ID NO: 2215944 - RNA, 13 nt, Human
cucaggggccaga

SEQ ID NO: 2215945 - RNA, 17 nt, Human
cucaggggccagaggaa

SEQ ID NO: 2215946 - RNA, 13 nt, Human
cucaggugaccaa

SEQ ID NO: 2215947 - RNA, 20 nt, Human
cucaggucagggugaggaug

SEQ ID NO: 2215948 - RNA, 19 nt, Human
cucaggucagggugaggau

SEQ ID NO: 2215949 - RNA, 20 nt, Human
cucaggucccuggggcuagg

SEQ ID NO: 2215950 - RNA, 17 nt, Human
cucaggucccugcaggg

SEQ ID NO: 2215951 - RNA, 18 nt, Human
cucaggucccugcagggc

SEQ ID NO: 2215952 - RNA, 16 nt, Human
cucaggggugugccug

SEQ ID NO: 2215953 - RNA, 14 nt, Human
cucagggucccugg

SEQ ID NO: 2215954 - RNA, 19 nt, Human
cucaggggcuguuugagga

SEQ ID NO: 2215955 - RNA, 15 nt, Human
cucaggugucccugc

SEQ ID NO: 2215956 - RNA, 16 nt, Human
cucaggugucccugca

SEQ ID NO: 2215957 - RNA, 22 nt, Human
cucagguggggucacucuggca

SEQ ID NO: 2215958 - RNA, 23 nt, Human
cucagguggggucacucuggcag

SEQ ID NO: 2215959 - RNA, 19 nt, Human
cucaguucccuuggccuca

SEQ ID NO: 2215960 - RNA, 18 nt, Human
cucaguucccuuggccuc

SEQ ID NO: 2215961 - RNA, 17 nt, Human
cucaguucccuuggccu

SEQ ID NO: 2215962 - RNA, 16 nt, Human
cucaguucccuuggcc

SEQ ID NO: 2215963 - RNA, 15 nt, Human
cucaguucccuuggc

SEQ ID NO: 2215964 - RNA, 14 nt, Human
cucaguucccuugg

SEQ ID NO: 2215965 - RNA, 18 nt, Human
cucaguucauccauucua

SEQ ID NO: 2215966 - RNA, 20 nt, Human
cucaguucauccauucuauu

SEQ ID NO: 2215967 - RNA, 23 nt, Human
cucaguuacacaaaggaccucag

SEQ ID NO: 2215968 - RNA, 15 nt, Human
cucaguucagaauca

SEQ ID NO: 2215969 - RNA, 16 nt, Human
cucagugugacuccuc

SEQ ID NO: 2215970 - RNA, 22 nt, Human
cucagugucuggcugcagagca

SEQ ID NO: 2215971 - RNA, 21 nt, Human
cucagugucuggcugcagagc

SEQ ID NO: 2215972 - RNA, 17 nt, Human
cucaggugucccugcac

SEQ ID NO: 2215973 - RNA, 18 nt, Human
cucaggugucccugcacu

SEQ ID NO: 2215974 - RNA, 14 nt, Human
cucaggugagaagc

SEQ ID NO: 2215975 - RNA, 20 nt, Human
cucagugucuggcugcagag

SEQ ID NO: 2215976 - RNA, 19 nt, Human
cucaggugucccugcacuu

SEQ ID NO: 2215977 - RNA, 18 nt, Human
cucauaauagacuuccca

SEQ ID NO: 2215978 - RNA, 13 nt, Human
cucauaaugugaa

SEQ ID NO: 2215979 - RNA, 14 nt, Human
cucauaaugugaag

SEQ ID NO: 2215980 - RNA, 17 nt, Human
cucauaaugugaagugu

SEQ ID NO: 2215981 - RNA, 17 nt, Human
cucauaacggaucagaa

SEQ ID NO: 2215982 - RNA, 21 nt, Human
cucaguucagaaucacuucug

SEQ ID NO: 2215983 - RNA, 19 nt, Human
cucauaacggaucagaaau

SEQ ID NO: 2215984 - RNA, 21 nt, Human
cucauaacggaucagaaauac

SEQ ID NO: 2215985 - RNA, 21 nt, Human
cucauaggaaaaguacauuua

SEQ ID NO: 2215986 - RNA, 14 nt, Human
cucauagggaagac

SEQ ID NO: 2215987 - RNA, 23 nt, Human
cucauaggaaaaguacauuuaau

SEQ ID NO: 2215988 - RNA, 15 nt, Human
cucauaaugugaagu

SEQ ID NO: 2215989 - RNA, 19 nt, Human
cucauagggaagaccugcu

SEQ ID NO: 2215990 - RNA, 13 nt, Human
cucauauggccca

SEQ ID NO: 2215991 - RNA, 20 nt, Human
cucauaguaugguggcuggg

SEQ ID NO: 2215992 - RNA, 18 nt, Human
cucauaguaugguggcug

SEQ ID NO: 2215993 - RNA, 19 nt, Human
cucauaguaugguggcugg

SEQ ID NO: 2215994 - RNA, 18 nt, Human
cucuaaaugggaaaguau

SEQ ID NO: 2215995 - RNA, 16 nt, Human
cucuaacagcucagga

SEQ ID NO: 2215996 - RNA, 14 nt, Human
cucuaacagcucag

SEQ ID NO: 2215997 - RNA, 13 nt, Human
cucuaagccacuc

SEQ ID NO: 2215998 - RNA, 22 nt, Human
cucuaacagcucaggaucucuu

SEQ ID NO: 2215999 - RNA, 18 nt, Human
cucuaacagcucaggauc

SEQ ID NO: 2216000 - RNA, 22 nt, Human
cucuaaaugaggggccucaggu

SEQ ID NO: 2216001 - RNA, 12 nt, Human
cucggagccuca

SEQ ID NO: 2216002 - RNA, 18 nt, Human
cucggacuaagccuaccu

SEQ ID NO: 2216003 - RNA, 22 nt, Human
cucggacuaagccuaccugcuc

SEQ ID NO: 2216004 - RNA, 13 nt, Human
cucggacucugcu

SEQ ID NO: 2216005 - RNA, 17 nt, Human
cucggcccccuccaucg

SEQ ID NO: 2216006 - RNA, 15 nt, Human
cucggccucccaaag

SEQ ID NO: 2216007 - RNA, 16 nt, Human
cucggcccccuccauc

SEQ ID NO: 2216008 - RNA, 21 nt, Human
cucggccgucuucacucgccc

SEQ ID NO: 2216009 - RNA, 15 nt, Human
cucggccuggcuccu

SEQ ID NO: 2216010 - RNA, 23 nt, Human
cucggccucccaaagugcuggga

SEQ ID NO: 2216011 - RNA, 22 nt, Human
cucggccucccaaagugcuggg

SEQ ID NO: 2216012 - RNA, 20 nt, Human
cucggccucccaaagugcug

SEQ ID NO: 2216013 - RNA, 18 nt, Human
cucggccucccaaagugc

SEQ ID NO: 2216014 - RNA, 22 nt, Human
cucgcuuggacggcugggcaca

SEQ ID NO: 2216015 - RNA, 14 nt, Human
cucgcuugugcaga

SEQ ID NO: 2216016 - RNA, 22 nt, Human
cucgcuugugcagaaaacauug

SEQ ID NO: 2216017 - RNA, 21 nt, Human
cucgcuauugucaccagggcu

SEQ ID NO: 2216018 - RNA, 20 nt, Human
cucggaaggcuggcugggca

SEQ ID NO: 2216019 - RNA, 16 nt, Human
cucggaaggcuggcug

SEQ ID NO: 2216020 - RNA, 22 nt, Human
cucggaacugcaugcugcugga

SEQ ID NO: 2216021 - RNA, 17 nt, Human
cucgcuuuguugcccag

SEQ ID NO: 2216022 - RNA, 19 nt, Human
cucgcuuucuauguaguuu

SEQ ID NO: 2216023 - RNA, 21 nt, Human
cucggaacugcaugcugcugg

SEQ ID NO: 2216024 - RNA, 19 nt, Human
cucggaacugcaugcugcu

SEQ ID NO: 2216025 - RNA, 19 nt, Human
cucggacuuagcugggaga

SEQ ID NO: 2216026 - RNA, 18 nt, Human
cucggacuuagcugggag

SEQ ID NO: 2216027 - RNA, 12 nt, Human
cucggagaagag

SEQ ID NO: 2216028 - RNA, 20 nt, Human
cucggagaagagcuguucac

SEQ ID NO: 2216029 - RNA, 13 nt, Human
cucggagaagagc

SEQ ID NO: 2216030 - RNA, 21 nt, Human
cucgcauuugucaaugacagu

SEQ ID NO: 2216031 - RNA, 22 nt, Human
cucgcauuugucaaugacaguu

SEQ ID NO: 2216032 - RNA, 19 nt, Human
cucgccaccccuccuuccu

SEQ ID NO: 2216033 - RNA, 22 nt, Human
cucgcauaggaccuuuccacca

SEQ ID NO: 2216034 - RNA, 22 nt, Human
cucgcccaccgcaugcccccuc

SEQ ID NO: 2216035 - RNA, 23 nt, Human
cucgcccaccgcaugcccccucg

SEQ ID NO: 2216036 - RNA, 12 nt, Human
cucgccaugccg

SEQ ID NO: 2216037 - RNA, 13 nt, Human
cucgccaugccgg

SEQ ID NO: 2216038 - RNA, 17 nt, Human
cucgccaugccgggggu

SEQ ID NO: 2216039 - RNA, 18 nt, Human
cucgcccaccgcaugccc

SEQ ID NO: 2216040 - RNA, 14 nt, Human
cucgccccagcagg

SEQ ID NO: 2216041 - RNA, 13 nt, Human
cucgcgacaaugc

SEQ ID NO: 2216042 - RNA, 12 nt, Human
cucgcccgccca

SEQ ID NO: 2216043 - RNA, 14 nt, Human
cucgcccgcccacu

SEQ ID NO: 2216044 - RNA, 15 nt, Human
cucgcccgcccacug

SEQ ID NO: 2216045 - RNA, 16 nt, Human
cucgcccgcccacugu

SEQ ID NO: 2216046 - RNA, 20 nt, Human
cucgcccgcccacuguccug

SEQ ID NO: 2216047 - RNA, 19 nt, Human
cucgcuauugucaccaggg

SEQ ID NO: 2216048 - RNA, 21 nt, Human
cucgcccgcccacuguccugg

SEQ ID NO: 2216049 - RNA, 15 nt, Human
cucgcgacaaugcaa

SEQ ID NO: 2216050 - RNA, 23 nt, Human
cucgacguuuacaagcccccccu

SEQ ID NO: 2216051 - RNA, 15 nt, Human
cucgaaucucugugc

SEQ ID NO: 2216052 - RNA, 16 nt, Human
cucgaaucucugugcc

SEQ ID NO: 2216053 - RNA, 17 nt, Human
cucgaaucucugugccu

SEQ ID NO: 2216054 - RNA, 18 nt, Human
cucgaaucucugugccuu

SEQ ID NO: 2216055 - RNA, 13 nt, Human
cucgaagcgcgcc

SEQ ID NO: 2216056 - RNA, 12 nt, Human
cucgaagcgcgc

SEQ ID NO: 2216057 - RNA, 22 nt, Human
cuccuugggaggccccacuggg

SEQ ID NO: 2216058 - RNA, 15 nt, Human
cuccuugggcacuuu

SEQ ID NO: 2216059 - RNA, 21 nt, Human
cuccuugggaggccccacugg

SEQ ID NO: 2216060 - RNA, 17 nt, Human
cuccuugggaggcccca

SEQ ID NO: 2216061 - RNA, 20 nt, Human
cucgaagcgcgccacucgcu

SEQ ID NO: 2216062 - RNA, 17 nt, Human
cucgaagcgcgccacuc

SEQ ID NO: 2216063 - RNA, 13 nt, Human
cucgaaucucugu

SEQ ID NO: 2216064 - RNA, 14 nt, Human
cucgaaucucugug

SEQ ID NO: 2216065 - RNA, 16 nt, Human
cucgaguuacagacaa

SEQ ID NO: 2216066 - RNA, 21 nt, Human
cuccuugggcacuuuuuaauu

SEQ ID NO: 2216067 - RNA, 20 nt, Human
cucgaguuacagacaaagcg

SEQ ID NO: 2216068 - RNA, 17 nt, Human
cuccugcccacggaguc

SEQ ID NO: 2216069 - RNA, 11 nt, Human
cuccugcccag

SEQ ID NO: 2216070 - RNA, 17 nt, Human
cuccuguugcacccagc

SEQ ID NO: 2216071 - RNA, 23 nt, Human
cuccuguugcacccagcccuggu

SEQ ID NO: 2216072 - RNA, 19 nt, Human
cuccuguugcacccagccc

SEQ ID NO: 2216073 - RNA, 20 nt, Human
cuccuguugcacccagcccu

SEQ ID NO: 2216074 - RNA, 21 nt, Human
cuccuguugcacccagcccug

SEQ ID NO: 2216075 - RNA, 22 nt, Human
cuccuguugcacccagcccugg

SEQ ID NO: 2216076 - RNA, 17 nt, Human
cuccuuaacacugagcu

SEQ ID NO: 2216077 - RNA, 20 nt, Human
cuccuuaacacugagcuguc

SEQ ID NO: 2216078 - RNA, 14 nt, Human
cuccuucaccuuug

SEQ ID NO: 2216079 - RNA, 16 nt, Human
cuccuucaccuuuguc

SEQ ID NO: 2216080 - RNA, 19 nt, Human
cuccuucaccuuugucccc

SEQ ID NO: 2216081 - RNA, 21 nt, Human
cuccuucaccuuuguccccac

SEQ ID NO: 2216082 - RNA, 23 nt, Human
cuccugaggggcaucugccccuc

SEQ ID NO: 2216083 - RNA, 14 nt, Human
cuccugccaaggag

SEQ ID NO: 2216084 - RNA, 22 nt, Human
cuccugcaggcagccaggccac

SEQ ID NO: 2216085 - RNA, 15 nt, Human
cuccugcaggcagcc

SEQ ID NO: 2216086 - RNA, 21 nt, Human
cuccugcaggcagccaggcca

SEQ ID NO: 2216087 - RNA, 15 nt, Human
cuccugugucuugca

SEQ ID NO: 2216088 - RNA, 14 nt, Human
cuccugcccaccug

SEQ ID NO: 2216089 - RNA, 18 nt, Human
cuccugccaguguggaac

SEQ ID NO: 2216090 - RNA, 13 nt, Human
cuccugcccacgg

SEQ ID NO: 2216091 - RNA, 11 nt, Human
cuccugccacc

SEQ ID NO: 2216092 - RNA, 23 nt, Human
cuccugugucuugcaauggcagc

SEQ ID NO: 2216093 - RNA, 11 nt, Human
cuccugugugu

SEQ ID NO: 2216094 - RNA, 17 nt, Human
cuccuugagagaccagg

SEQ ID NO: 2216095 - RNA, 20 nt, Human
cuccuugagagaccaggcaa

SEQ ID NO: 2216096 - RNA, 21 nt, Human
cuccuugauuuuagccuucuc

SEQ ID NO: 2216097 - RNA, 19 nt, Human
cuccuugacuccuuguggu

SEQ ID NO: 2216098 - RNA, 11 nt, Human
cuccuucuucc

SEQ ID NO: 2216099 - RNA, 21 nt, Human
cuccuugaaaacacuguucuc

SEQ ID NO: 2216100 - RNA, 16 nt, Human
cuccuugggaggcccc

SEQ ID NO: 2216101 - RNA, 13 nt, Human
cuccuugggaggc

SEQ ID NO: 2216102 - RNA, 22 nt, Human
cuccuugggaggaagcagaaua

SEQ ID NO: 2216103 - RNA, 23 nt, Human
cuccuugggaggaagcagaauaa

SEQ ID NO: 2216104 - RNA, 18 nt, Human
cuccuugggaggaagcag

SEQ ID NO: 2216105 - RNA, 19 nt, Human
cuccuugggaggaagcaga

SEQ ID NO: 2216106 - RNA, 20 nt, Human
cuccuugggaggaagcagaa

SEQ ID NO: 2216107 - RNA, 21 nt, Human
cuccuugggaggaagcagaau

SEQ ID NO: 2216108 - RNA, 16 nt, Human
cucgaacuggcugcaa

SEQ ID NO: 2216109 - RNA, 18 nt, Human
cuccuugccuccugugua

SEQ ID NO: 2216110 - RNA, 17 nt, Human
cuccuugcuacccagaa

SEQ ID NO: 2216111 - RNA, 13 nt, Human
cuccuugcucugc

SEQ ID NO: 2216112 - RNA, 14 nt, Human
cuccuugcucugca

SEQ ID NO: 2216113 - RNA, 17 nt, Human
cuccuugccuccugugu

SEQ ID NO: 2216114 - RNA, 13 nt, Human
cuccuuggaaauc

SEQ ID NO: 2216115 - RNA, 17 nt, Human
cuccuugcucugcaggc

SEQ ID NO: 2216116 - RNA, 13 nt, Human
cuccuugggagga

SEQ ID NO: 2216117 - RNA, 14 nt, Human
cuccuugggaggaa

SEQ ID NO: 2216118 - RNA, 17 nt, Human
cuccuugggaggaagca

SEQ ID NO: 2216119 - RNA, 15 nt, Human
cuccuuccaccuccc

SEQ ID NO: 2216120 - RNA, 14 nt, Human
cuccuuccaacagg

SEQ ID NO: 2216121 - RNA, 18 nt, Human
cuccuuccaacaggagcu

SEQ ID NO: 2216122 - RNA, 16 nt, Human
cuccuuccaccucccu

SEQ ID NO: 2216123 - RNA, 14 nt, Human
cuccuucagcccuc

SEQ ID NO: 2216124 - RNA, 15 nt, Human
cuccuucagcccuca

SEQ ID NO: 2216125 - RNA, 17 nt, Human
cuccuucagcccucacc

SEQ ID NO: 2216126 - RNA, 20 nt, Human
cuccuucagcccucaccccu

SEQ ID NO: 2216127 - RNA, 12 nt, Human
cuccuucagaca

SEQ ID NO: 2216128 - RNA, 14 nt, Human
cuccuucagacacc

SEQ ID NO: 2216129 - RNA, 13 nt, Human
cuccuucagacac

SEQ ID NO: 2216130 - RNA, 19 nt, Human
cuccuucagacacccucaa

SEQ ID NO: 2216131 - RNA, 13 nt, Human
cuccuucagcccu

SEQ ID NO: 2216132 - RNA, 13 nt, Human
cuccuucucccuu

SEQ ID NO: 2216133 - RNA, 18 nt, Human
cuccuuccaccucccucc

SEQ ID NO: 2216134 - RNA, 21 nt, Human
cuccuucucugucucaugugu

SEQ ID NO: 2216135 - RNA, 16 nt, Human
cuccuucucugucuca

SEQ ID NO: 2216136 - RNA, 20 nt, Human
cuccuucucugucucaugug

SEQ ID NO: 2216137 - RNA, 14 nt, Human
cuccuucuguccua

SEQ ID NO: 2216138 - RNA, 15 nt, Human
cuccuucuguccuac

SEQ ID NO: 2216139 - RNA, 20 nt, Human
cuccuucuguccuacucugu

SEQ ID NO: 2216140 - RNA, 20 nt, Human
cucccaguccaaauguccuc

SEQ ID NO: 2216141 - RNA, 16 nt, Human
cucccaguaccuccug

SEQ ID NO: 2216142 - RNA, 22 nt, Human
cucccagucaccuuguggcaag

SEQ ID NO: 2216143 - RNA, 16 nt, Human
cucccagucuacccag

SEQ ID NO: 2216144 - RNA, 18 nt, Human
cucccagucuacccagag

SEQ ID NO: 2216145 - RNA, 19 nt, Human
cucccagucuacccagaga

SEQ ID NO: 2216146 - RNA, 12 nt, Human
cucccagugucu

SEQ ID NO: 2216147 - RNA, 17 nt, Human
cucccagugucuuccug

SEQ ID NO: 2216148 - RNA, 19 nt, Human
cucccagugucuuccugug

SEQ ID NO: 2216149 - RNA, 20 nt, Human
cucccagugucuuccugugg

SEQ ID NO: 2216150 - RNA, 21 nt, Human
cucccagugucuuccuguggg

SEQ ID NO: 2216151 - RNA, 17 nt, Human
cucccauaaccgcugau

SEQ ID NO: 2216152 - RNA, 20 nt, Human
cucccauaaccgcugauucu

SEQ ID NO: 2216153 - RNA, 14 nt, Human
cucccaucucacac

SEQ ID NO: 2216154 - RNA, 12 nt, Human
cucccuggcucc

SEQ ID NO: 2216155 - RNA, 11 nt, Human
cucccuggcuc

SEQ ID NO: 2216156 - RNA, 21 nt, Human
cucccuggccuguucuguuuu

SEQ ID NO: 2216157 - RNA, 19 nt, Human
cucccuggccuguucuguu

SEQ ID NO: 2216158 - RNA, 16 nt, Human
cucccuggccuguucu

SEQ ID NO: 2216159 - RNA, 15 nt, Human
cucccuggccuguuc

SEQ ID NO: 2216160 - RNA, 15 nt, Human
cucccaucucacaca

SEQ ID NO: 2216161 - RNA, 18 nt, Human
cucccaucucacacauga

SEQ ID NO: 2216162 - RNA, 20 nt, Human
cucccuggcucucagaaggu

SEQ ID NO: 2216163 - RNA, 13 nt, Human
cucccuggcugcc

SEQ ID NO: 2216164 - RNA, 14 nt, Human
cucccuggcugccc

SEQ ID NO: 2216165 - RNA, 15 nt, Human
cucccuggcugcccu

SEQ ID NO: 2216166 - RNA, 17 nt, Human
cucccuggcugcccugg

SEQ ID NO: 2216167 - RNA, 18 nt, Human
cucccuggcugcccuggc

SEQ ID NO: 2216168 - RNA, 19 nt, Human
cucccuggcugcccuggcc

SEQ ID NO: 2216169 - RNA, 20 nt, Human
cucccuggcugcccuggccc

SEQ ID NO: 2216170 - RNA, 18 nt, Human
cucccuggcucucagaag

SEQ ID NO: 2216171 - RNA, 16 nt, Human
cucccuggcucucaga

SEQ ID NO: 2216172 - RNA, 15 nt, Human
cucccuggcucucag

SEQ ID NO: 2216173 - RNA, 15 nt, Human
cucccuggcucccau

SEQ ID NO: 2216174 - RNA, 14 nt, Human
cucccuggcuccca

SEQ ID NO: 2216175 - RNA, 19 nt, Human
cucccuguugaagcucugg

SEQ ID NO: 2216176 - RNA, 19 nt, Human
cucccuguugacgaagucu

SEQ ID NO: 2216177 - RNA, 17 nt, Human
cucccuguucuugggua

SEQ ID NO: 2216178 - RNA, 21 nt, Human
cucccuguugacgaagucucu

SEQ ID NO: 2216179 - RNA, 22 nt, Human
cucccuguugacgaagucucuu

SEQ ID NO: 2216180 - RNA, 12 nt, Human
cucccuguuuga

SEQ ID NO: 2216181 - RNA, 21 nt, Human
cucccuguuugaagccugccc

SEQ ID NO: 2216182 - RNA, 21 nt, Human
cucccuggcugcccuggcccu

SEQ ID NO: 2216183 - RNA, 22 nt, Human
cucccuggcugcccuggcccug

SEQ ID NO: 2216184 - RNA, 11 nt, Human
cucccuggguu

SEQ ID NO: 2216185 - RNA, 14 nt, Human
cucccuggguucag

SEQ ID NO: 2216186 - RNA, 10 nt, Human
cucccuuccu

SEQ ID NO: 2216187 - RNA, 23 nt, Human
cucccuucccaccucucucacuc

SEQ ID NO: 2216188 - RNA, 12 nt, Human
cucccuucaacc

SEQ ID NO: 2216189 - RNA, 18 nt, Human
cucccuucaaccauuccc

SEQ ID NO: 2216190 - RNA, 19 nt, Human
cucccuucaaccauucccc

SEQ ID NO: 2216191 - RNA, 20 nt, Human
cucccuucaaccauucccca

SEQ ID NO: 2216192 - RNA, 20 nt, Human
cuccuagggaaaaguucaua

SEQ ID NO: 2216193 - RNA, 15 nt, Human
cucccuuucuccccu

SEQ ID NO: 2216194 - RNA, 23 nt, Human
cucccuuucuccccugcccccag

SEQ ID NO: 2216195 - RNA, 18 nt, Human
cuccuaucaccuccccuc

SEQ ID NO: 2216196 - RNA, 17 nt, Human
cuccuaucaccuccccu

SEQ ID NO: 2216197 - RNA, 22 nt, Human
cuccuaguacuaacuccuagga

SEQ ID NO: 2216198 - RNA, 17 nt, Human
cucccuuggauuguccc

SEQ ID NO: 2216199 - RNA, 12 nt, Human
cucccuuucaac

SEQ ID NO: 2216200 - RNA, 13 nt, Human
cucccuuucaaca

SEQ ID NO: 2216201 - RNA, 12 nt, Human
cucccuuucucc

SEQ ID NO: 2216202 - RNA, 14 nt, Human
cucccuuucucccc

SEQ ID NO: 2216203 - RNA, 22 nt, Human
cucccuuggaaaccugcccugc

SEQ ID NO: 2216204 - RNA, 14 nt, Human
cucccuuucccuuc

SEQ ID NO: 2216205 - RNA, 15 nt, Human
cucccuuucccuucu

SEQ ID NO: 2216206 - RNA, 17 nt, Human
cucccuucccauaagcu

SEQ ID NO: 2216207 - RNA, 22 nt, Human
cucccuguuugaagccugcccu

SEQ ID NO: 2216208 - RNA, 23 nt, Human
cucccuguuugaagccugcccuu

SEQ ID NO: 2216209 - RNA, 13 nt, Human
cucccuuccucuu

SEQ ID NO: 2216210 - RNA, 17 nt, Human
cucccuuagcucccugu

SEQ ID NO: 2216211 - RNA, 12 nt, Human
cucccuuccuuu

SEQ ID NO: 2216212 - RNA, 19 nt, Human
cucccuuccuuuucccugc

SEQ ID NO: 2216213 - RNA, 15 nt, Human
cucccuucuaccugc

SEQ ID NO: 2216214 - RNA, 20 nt, Human
cucccuuccuuuucccugcu

SEQ ID NO: 2216215 - RNA, 14 nt, Human
cucccuuccucuuu

SEQ ID NO: 2216216 - RNA, 14 nt, Human
cucccuucucccau

SEQ ID NO: 2216217 - RNA, 21 nt, Human
cucccuucuaccugccacuca

SEQ ID NO: 2216218 - RNA, 17 nt, Human
cucccuucuaccugcca

SEQ ID NO: 2216219 - RNA, 18 nt, Human
cucccuucuaccugccac

SEQ ID NO: 2216220 - RNA, 16 nt, Human
cucccuucucuucaca

SEQ ID NO: 2216221 - RNA, 16 nt, Human
cucccuucugcuacug

SEQ ID NO: 2216222 - RNA, 15 nt, Human
cucccuucugcuacu

SEQ ID NO: 2216223 - RNA, 14 nt, Human
cucccuucugcuac

SEQ ID NO: 2216224 - RNA, 13 nt, Human
cucccuucugcua

SEQ ID NO: 2216225 - RNA, 18 nt, Human
cucccuuggaaaccugcc

SEQ ID NO: 2216226 - RNA, 19 nt, Human
cucccuuggaaaccugccc

SEQ ID NO: 2216227 - RNA, 20 nt, Human
cucccuuggaaaccugcccu

SEQ ID NO: 2216228 - RNA, 21 nt, Human
cucccuuggaaaccugcccug

SEQ ID NO: 2216229 - RNA, 14 nt, Human
cuccucacucccuu

SEQ ID NO: 2216230 - RNA, 21 nt, Human
cuccucacucccuucccauaa

SEQ ID NO: 2216231 - RNA, 19 nt, Human
cuccuaucaccuccccucc

SEQ ID NO: 2216232 - RNA, 16 nt, Human
cuccucacucccuucu

SEQ ID NO: 2216233 - RNA, 14 nt, Human
cuccucacuggcca

SEQ ID NO: 2216234 - RNA, 18 nt, Human
cuccucacuggccauccc

SEQ ID NO: 2216235 - RNA, 20 nt, Human
cuccucacuggccaucccuc

SEQ ID NO: 2216236 - RNA, 12 nt, Human
cuccucagaucu

SEQ ID NO: 2216237 - RNA, 14 nt, Human
cuccucccuccugc

SEQ ID NO: 2216238 - RNA, 14 nt, Human
cuccucccucugag

SEQ ID NO: 2216239 - RNA, 15 nt, Human
cuccucccucugagg

SEQ ID NO: 2216240 - RNA, 13 nt, Human
cuccucccugcau

SEQ ID NO: 2216241 - RNA, 15 nt, Human
cuccucccugcaucu

SEQ ID NO: 2216242 - RNA, 14 nt, Human
cuccucccugcauc

SEQ ID NO: 2216243 - RNA, 14 nt, Human
cuccucagaucuuc

SEQ ID NO: 2216244 - RNA, 23 nt, Human
cuccucccugcaucugaccagca

SEQ ID NO: 2216245 - RNA, 12 nt, Human
cuccucccuggc

SEQ ID NO: 2216246 - RNA, 18 nt, Human
cuccucccugcaucugac

SEQ ID NO: 2216247 - RNA, 16 nt, Human
cuccucccugcaucug

SEQ ID NO: 2216248 - RNA, 13 nt, Human
cuccucccuggcu

SEQ ID NO: 2216249 - RNA, 14 nt, Human
cuccucccuggcug

SEQ ID NO: 2216250 - RNA, 17 nt, Human
cuccucccuggcugccc

SEQ ID NO: 2216251 - RNA, 18 nt, Human
cuccucccuggcugcccu

SEQ ID NO: 2216252 - RNA, 19 nt, Human
cuccucccuggcugcccug

SEQ ID NO: 2216253 - RNA, 20 nt, Human
cuccucccuggcugcccugg

SEQ ID NO: 2216254 - RNA, 22 nt, Human
cuccucccuggcugcccuggcc

SEQ ID NO: 2216255 - RNA, 21 nt, Human
cuccucccuggcugcccuggc

SEQ ID NO: 2216256 - RNA, 14 nt, Human
cuccucccuuagcu

SEQ ID NO: 2216257 - RNA, 15 nt, Human
cuccucccuuagcuc

SEQ ID NO: 2216258 - RNA, 20 nt, Human
cuccucccuuagcucccugu

SEQ ID NO: 2216259 - RNA, 12 nt, Human
cuccucuuguaa

SEQ ID NO: 2216260 - RNA, 13 nt, Human
cuccucuuguaaa

SEQ ID NO: 2216261 - RNA, 14 nt, Human
cuccucuuguaaau

SEQ ID NO: 2216262 - RNA, 20 nt, Human
cuccucuuguaaauaaagcc

SEQ ID NO: 2216263 - RNA, 21 nt, Human
cuccucuuguaaauaaagccc

SEQ ID NO: 2216264 - RNA, 22 nt, Human
cuccucuuuccucucuuuguuc

SEQ ID NO: 2216265 - RNA, 19 nt, Human
cuccucuugccacugccuc

SEQ ID NO: 2216266 - RNA, 11 nt, Human
cuccucuccag

SEQ ID NO: 2216267 - RNA, 18 nt, Human
cuccucuugccacugccu

SEQ ID NO: 2216268 - RNA, 13 nt, Human
cuccucucagccc

SEQ ID NO: 2216269 - RNA, 13 nt, Human
cuccucucaguac

SEQ ID NO: 2216270 - RNA, 19 nt, Human
cuccucgcaagcuggguaa

SEQ ID NO: 2216271 - RNA, 22 nt, Human
cuccucccuuccuuuucccugc

SEQ ID NO: 2216272 - RNA, 13 nt, Human
cuccucccuuccu

SEQ ID NO: 2216273 - RNA, 14 nt, Human
cuccucccuuccuu

SEQ ID NO: 2216274 - RNA, 15 nt, Human
cuccucccuuccuuu

SEQ ID NO: 2216275 - RNA, 21 nt, Human
cuccucccuuccuuuucccug

SEQ ID NO: 2216276 - RNA, 17 nt, Human
cuccucgcaagcugggu

SEQ ID NO: 2216277 - RNA, 18 nt, Human
cuccucggcccccuccau

SEQ ID NO: 2216278 - RNA, 19 nt, Human
cuccucggcccccuccauc

SEQ ID NO: 2216279 - RNA, 20 nt, Human
cuccucggcccccuccaucg

SEQ ID NO: 2216280 - RNA, 14 nt, Human
cuccucggccuggc

SEQ ID NO: 2216281 - RNA, 15 nt, Human
cuccucggccuggcu

SEQ ID NO: 2216282 - RNA, 16 nt, Human
cuccucggccuggcuc

SEQ ID NO: 2216283 - RNA, 18 nt, Human
cuccucggccuggcuccu

SEQ ID NO: 2216284 - RNA, 13 nt, Human
cuccucuaagcca

SEQ ID NO: 2216285 - RNA, 19 nt, Human
cuccucuagcugugggggu

SEQ ID NO: 2216286 - RNA, 17 nt, Human
cuccucuagcugugggg

SEQ ID NO: 2216287 - RNA, 18 nt, Human
cuccucuagcuguggggg

SEQ ID NO: 2216288 - RNA, 21 nt, Human
cuccugaguagcuggauuaca

SEQ ID NO: 2216289 - RNA, 17 nt, Human
cuccugaguagcuggga

SEQ ID NO: 2216290 - RNA, 22 nt, Human
cuccugaguagcugggauuaca

SEQ ID NO: 2216291 - RNA, 12 nt, Human
cuccugcaggca

SEQ ID NO: 2216292 - RNA, 13 nt, Human
cuccugcaggcag

SEQ ID NO: 2216293 - RNA, 14 nt, Human
cuccugcaggcagc

SEQ ID NO: 2216294 - RNA, 22 nt, Human
cuccugaggggcaucugccccu

SEQ ID NO: 2216295 - RNA, 21 nt, Human
cuccugaggggcaucugcccc

SEQ ID NO: 2216296 - RNA, 20 nt, Human
cuccugaggggcaucugccc

SEQ ID NO: 2216297 - RNA, 19 nt, Human
cuccugaggggcaucugcc

SEQ ID NO: 2216298 - RNA, 16 nt, Human
cuccugaggggcaucu

SEQ ID NO: 2216299 - RNA, 16 nt, Human
cuccugaggcuuugga

SEQ ID NO: 2216300 - RNA, 17 nt, Human
cuccugaggcuuuggau

SEQ ID NO: 2216301 - RNA, 21 nt, Human
cuccugaggacagcuguccuc

SEQ ID NO: 2216302 - RNA, 18 nt, Human
cuccugaggacagcuguc

SEQ ID NO: 2216303 - RNA, 19 nt, Human
cuccugaggacagcugucc

SEQ ID NO: 2216304 - RNA, 14 nt, Human
cuccugaggacagc

SEQ ID NO: 2216305 - RNA, 15 nt, Human
cuccugaggacagcu

SEQ ID NO: 2216306 - RNA, 16 nt, Human
cuccugaggacagcug

SEQ ID NO: 2216307 - RNA, 17 nt, Human
cuccugaggacagcugu

SEQ ID NO: 2216308 - RNA, 16 nt, Human
cuccugaccugucacc

SEQ ID NO: 2216309 - RNA, 16 nt, Human
cuccugaccugaggcu

SEQ ID NO: 2216310 - RNA, 20 nt, Human
cuccugagaaaaaagguucc

SEQ ID NO: 2216311 - RNA, 15 nt, Human
cuccugagaccccug

SEQ ID NO: 2216312 - RNA, 17 nt, Human
cuccugagaccccuggc

SEQ ID NO: 2216313 - RNA, 18 nt, Human
cuccugagaccccuggcc

SEQ ID NO: 2216314 - RNA, 23 nt, Human
cuccugagaccccuggccuccgg

SEQ ID NO: 2216315 - RNA, 19 nt, Human
cuccugagaccccuggccu

SEQ ID NO: 2216316 - RNA, 20 nt, Human
cuccugagaccccuggccuc

SEQ ID NO: 2216317 - RNA, 21 nt, Human
cuccugagaccccuggccucc

SEQ ID NO: 2216318 - RNA, 22 nt, Human
cuccugagaccccuggccuccg

SEQ ID NO: 2216319 - RNA, 14 nt, Human
cuccugaccuuagg

SEQ ID NO: 2216320 - RNA, 15 nt, Human
cuccugaccugaggc

SEQ ID NO: 2216321 - RNA, 14 nt, Human
cuccugaccugagg

SEQ ID NO: 2216322 - RNA, 14 nt, Human
cuccugaccucagg

SEQ ID NO: 2216323 - RNA, 23 nt, Human
cuccugacccaguccccgugccc

SEQ ID NO: 2216324 - RNA, 15 nt, Human
cuccucuuuccucuc

SEQ ID NO: 2216325 - RNA, 17 nt, Human
cuccucuuuccucucuu

SEQ ID NO: 2216326 - RNA, 16 nt, Human
cuccugacccaguccc

SEQ ID NO: 2216327 - RNA, 22 nt, Human
cugauguugagggaacagacag

SEQ ID NO: 2216328 - RNA, 16 nt, Human
cugauguucaguguaa

SEQ ID NO: 2216329 - RNA, 17 nt, Human
cugauguucaguguaau

SEQ ID NO: 2216330 - RNA, 19 nt, Human
cugauguucaguguaauuu

SEQ ID NO: 2216331 - RNA, 21 nt, Human
cugauguucaguguaauuucu

SEQ ID NO: 2216332 - RNA, 16 nt, Human
cugauuacacaaaaca

SEQ ID NO: 2216333 - RNA, 21 nt, Human
cugauuaaguugucuaaacaa

SEQ ID NO: 2216334 - RNA, 15 nt, Human
cugauguuggaagag

SEQ ID NO: 2216335 - RNA, 23 nt, Human
cugauuagaaaugaccaauauua

SEQ ID NO: 2216336 - RNA, 11 nt, Human
cugauuagaaa

SEQ ID NO: 2216337 - RNA, 14 nt, Human
cugauucaacuaaa

SEQ ID NO: 2216338 - RNA, 13 nt, Human
cugauuagaaaug

SEQ ID NO: 2216339 - RNA, 14 nt, Human
cugauuacaccagc

SEQ ID NO: 2216340 - RNA, 19 nt, Human
cugauuagaaaugaccaau

SEQ ID NO: 2216341 - RNA, 21 nt, Human
cugauguuccuagugaaagag

SEQ ID NO: 2216342 - RNA, 20 nt, Human
cugauguuccuagugaaaga

SEQ ID NO: 2216343 - RNA, 18 nt, Human
cugauguuccuagugaaa

SEQ ID NO: 2216344 - RNA, 13 nt, Human
cugauguuccuag

SEQ ID NO: 2216345 - RNA, 22 nt, Human
cugauucauaauaaauaucugu

SEQ ID NO: 2216346 - RNA, 20 nt, Human
cugauucacugcauggcucc

SEQ ID NO: 2216347 - RNA, 15 nt, Human
cugauucacugcaug

SEQ ID NO: 2216348 - RNA, 18 nt, Human
cugauucacugcauggcu

SEQ ID NO: 2216349 - RNA, 16 nt, Human
cugauucggcugucuc

SEQ ID NO: 2216350 - RNA, 22 nt, Human
cugauucccaagcucugcuccu

SEQ ID NO: 2216351 - RNA, 19 nt, Human
cugauucccaagcucugcu

SEQ ID NO: 2216352 - RNA, 20 nt, Human
cugauucccaagcucugcuc

SEQ ID NO: 2216353 - RNA, 17 nt, Human
cugauucccaagcucug

SEQ ID NO: 2216354 - RNA, 18 nt, Human
cugauucccaagcucugc

SEQ ID NO: 2216355 - RNA, 15 nt, Human
cugauucccaagcuc

SEQ ID NO: 2216356 - RNA, 17 nt, Human
cugauucaacuaaaaaa

SEQ ID NO: 2216357 - RNA, 15 nt, Human
cugauucaacuaaaa

SEQ ID NO: 2216358 - RNA, 18 nt, Human
cugauucaacuaaaaaaa

SEQ ID NO: 2216359 - RNA, 13 nt, Human
cugauucacugca

SEQ ID NO: 2216360 - RNA, 17 nt, Human
cugaucaugcauuguug

SEQ ID NO: 2216361 - RNA, 15 nt, Human
cugaucaugcauugu

SEQ ID NO: 2216362 - RNA, 14 nt, Human
cugaucaugcauug

SEQ ID NO: 2216363 - RNA, 12 nt, Human
cugaucaugcau

SEQ ID NO: 2216364 - RNA, 19 nt, Human
cugaucagucuaagauggg

SEQ ID NO: 2216365 - RNA, 22 nt, Human
cugaucagugggccuccaagga

SEQ ID NO: 2216366 - RNA, 16 nt, Human
cugauaguuacuguug

SEQ ID NO: 2216367 - RNA, 17 nt, Human
cugauaguuacuguugu

SEQ ID NO: 2216368 - RNA, 18 nt, Human
cugauaguuacuguugug

SEQ ID NO: 2216369 - RNA, 19 nt, Human
cugauaguuacuguuguga

SEQ ID NO: 2216370 - RNA, 21 nt, Human
cugauaguuacuguugugacc

SEQ ID NO: 2216371 - RNA, 22 nt, Human
cugauaguuacuguugugaccu

SEQ ID NO: 2216372 - RNA, 18 nt, Human
cugauccagccucucccc

SEQ ID NO: 2216373 - RNA, 16 nt, Human
cugaucaugcauuguu

SEQ ID NO: 2216374 - RNA, 13 nt, Human
cugauccagagca

SEQ ID NO: 2216375 - RNA, 15 nt, Human
cugauccagagcaca

SEQ ID NO: 2216376 - RNA, 21 nt, Human
cugauccagagcacagaucug

SEQ ID NO: 2216377 - RNA, 20 nt, Human
cugauccagcccugaguucc

SEQ ID NO: 2216378 - RNA, 12 nt, Human
cugauaccucaa

SEQ ID NO: 2216379 - RNA, 15 nt, Human
cugauacccagagca

SEQ ID NO: 2216380 - RNA, 14 nt, Human
cugauaaagaaaga

SEQ ID NO: 2216381 - RNA, 21 nt, Human
cugauaaagaugagugagcau

SEQ ID NO: 2216382 - RNA, 15 nt, Human
cugauagcucuuugg

SEQ ID NO: 2216383 - RNA, 15 nt, Human
cugauaguuacuguu

SEQ ID NO: 2216384 - RNA, 22 nt, Human
cugauagcucuuuggcagucua

SEQ ID NO: 2216385 - RNA, 17 nt, Human
cugauaggccaaguuug

SEQ ID NO: 2216386 - RNA, 17 nt, Human
cugauagggauacaugc

SEQ ID NO: 2216387 - RNA, 19 nt, Human
cugauagggauacaugcuc

SEQ ID NO: 2216388 - RNA, 21 nt, Human
cugaucgugcuaaauuuucag

SEQ ID NO: 2216389 - RNA, 13 nt, Human
cugaucuccaugg

SEQ ID NO: 2216390 - RNA, 14 nt, Human
cugaucuccauggc

SEQ ID NO: 2216391 - RNA, 20 nt, Human
cugaucuccauggcuuccuc

SEQ ID NO: 2216392 - RNA, 19 nt, Human
cugaucgugcuaaauuuuc

SEQ ID NO: 2216393 - RNA, 17 nt, Human
cugaucgugcuaaauuu

SEQ ID NO: 2216394 - RNA, 15 nt, Human
cugaucgugcuaaau

SEQ ID NO: 2216395 - RNA, 22 nt, Human
cugaucgugacgcugaauaaau

SEQ ID NO: 2216396 - RNA, 14 nt, Human
cugaucgugacgcu

SEQ ID NO: 2216397 - RNA, 21 nt, Human
cugaucgugacgcugaauaaa

SEQ ID NO: 2216398 - RNA, 20 nt, Human
cugaucgccaaccuuucccc

SEQ ID NO: 2216399 - RNA, 23 nt, Human
cugauccugugaaguaaggaugu

SEQ ID NO: 2216400 - RNA, 21 nt, Human
cugauccuggaggcccaguuc

SEQ ID NO: 2216401 - RNA, 20 nt, Human
cugauccugugaaguaagga

SEQ ID NO: 2216402 - RNA, 19 nt, Human
cugauccuggaggcccagu

SEQ ID NO: 2216403 - RNA, 13 nt, Human
cugaucccucuac

SEQ ID NO: 2216404 - RNA, 12 nt, Human
cugaucccucua

SEQ ID NO: 2216405 - RNA, 13 nt, Human
cugauguucagug

SEQ ID NO: 2216406 - RNA, 20 nt, Human
cugauguuacaucacagugu

SEQ ID NO: 2216407 - RNA, 14 nt, Human
cugauguucagugu

SEQ ID NO: 2216408 - RNA, 15 nt, Human
cugauguucagugua

SEQ ID NO: 2216409 - RNA, 13 nt, Human
cugauguguacau

SEQ ID NO: 2216410 - RNA, 15 nt, Human
cugauguccucacca

SEQ ID NO: 2216411 - RNA, 22 nt, Human
cugaucuccauggcuuccuccu

SEQ ID NO: 2216412 - RNA, 18 nt, Human
cugaugucaauuucugug

SEQ ID NO: 2216413 - RNA, 19 nt, Human
cugaugucaauuucugugu

SEQ ID NO: 2216414 - RNA, 20 nt, Human
cugaugucaauuucuguguu

SEQ ID NO: 2216415 - RNA, 22 nt, Human
cugaugucaauuucuguguugc

SEQ ID NO: 2216416 - RNA, 18 nt, Human
cugaguggcaggggacag

SEQ ID NO: 2216417 - RNA, 13 nt, Human
cugaguggcaggg

SEQ ID NO: 2216418 - RNA, 16 nt, Human
cugaguggcaggggac

SEQ ID NO: 2216419 - RNA, 16 nt, Human
cugagugccuuuuggu

SEQ ID NO: 2216420 - RNA, 15 nt, Human
cugagugccuuuugg

SEQ ID NO: 2216421 - RNA, 16 nt, Human
cugaguggacuggagu

SEQ ID NO: 2216422 - RNA, 19 nt, Human
cugagugccuggccaaagg

SEQ ID NO: 2216423 - RNA, 21 nt, Human
cugaguggacuggaguggagc

SEQ ID NO: 2216424 - RNA, 22 nt, Human
cugaguggacuggaguggagca

SEQ ID NO: 2216425 - RNA, 18 nt, Human
cugaguggaucuccaagg

SEQ ID NO: 2216426 - RNA, 22 nt, Human
cugagugggggaucacagccuc

SEQ ID NO: 2216427 - RNA, 13 nt, Human
cugauaaagauga

SEQ ID NO: 2216428 - RNA, 23 nt, Human
cugauaaaaccauguagaaaauu

SEQ ID NO: 2216429 - RNA, 19 nt, Human
cugauaaaaccauguagaa

SEQ ID NO: 2216430 - RNA, 19 nt, Human
cugagugcagccguuugag

SEQ ID NO: 2216431 - RNA, 13 nt, Human
cugagugccuggc

SEQ ID NO: 2216432 - RNA, 14 nt, Human
cugagugccuggcc

SEQ ID NO: 2216433 - RNA, 16 nt, Human
cugagugccuggccaa

SEQ ID NO: 2216434 - RNA, 14 nt, Human
cugagugccuuuug

SEQ ID NO: 2216435 - RNA, 18 nt, Human
cugagugaaccuguauaa

SEQ ID NO: 2216436 - RNA, 15 nt, Human
cugagucuccugugc

SEQ ID NO: 2216437 - RNA, 16 nt, Human
cugagucuccugugcc

SEQ ID NO: 2216438 - RNA, 17 nt, Human
cugagugaaccuguaua

SEQ ID NO: 2216439 - RNA, 16 nt, Human
cugagucucccaaggc

SEQ ID NO: 2216440 - RNA, 17 nt, Human
cugagucucccaaggcu

SEQ ID NO: 2216441 - RNA, 13 nt, Human
cugagucuccugu

SEQ ID NO: 2216442 - RNA, 14 nt, Human
cugagucuccugug

SEQ ID NO: 2216443 - RNA, 13 nt, Human
cugagucugaagg

SEQ ID NO: 2216444 - RNA, 14 nt, Human
cugagucugaaggc

SEQ ID NO: 2216445 - RNA, 15 nt, Human
cugagucugaaggcu

SEQ ID NO: 2216446 - RNA, 16 nt, Human
cugagucugaaggcug

SEQ ID NO: 2216447 - RNA, 18 nt, Human
cugaccauuucagggguc

SEQ ID NO: 2216448 - RNA, 18 nt, Human
cugacccaggccgcagcu

SEQ ID NO: 2216449 - RNA, 22 nt, Human
cugaccaugcucaucugcuggu

SEQ ID NO: 2216450 - RNA, 10 nt, Human
cugacccagu

SEQ ID NO: 2216451 - RNA, 19 nt, Human
cugacccaggccgcagcuc

SEQ ID NO: 2216452 - RNA, 21 nt, Human
cugacccaggccgcagcucuu

SEQ ID NO: 2216453 - RNA, 20 nt, Human
cugaccaugcucaucugcug

SEQ ID NO: 2216454 - RNA, 21 nt, Human
cugaccaugcucaucugcugg

SEQ ID NO: 2216455 - RNA, 17 nt, Human
cugacccagucccuggg

SEQ ID NO: 2216456 - RNA, 16 nt, Human
cugacccagucccugg

SEQ ID NO: 2216457 - RNA, 15 nt, Human
cugacccagucccug

SEQ ID NO: 2216458 - RNA, 14 nt, Human
cugacccagucccu

SEQ ID NO: 2216459 - RNA, 13 nt, Human
cugacccaguccc

SEQ ID NO: 2216460 - RNA, 12 nt, Human
cugacccagucc

SEQ ID NO: 2216461 - RNA, 23 nt, Human
cugacccaggccgcagcucuugc

SEQ ID NO: 2216462 - RNA, 11 nt, Human
cugacccaguc

SEQ ID NO: 2216463 - RNA, 18 nt, Human
cugacccagucccugggg

SEQ ID NO: 2216464 - RNA, 13 nt, Human
cugacccagugag

SEQ ID NO: 2216465 - RNA, 12 nt, Human
cugacccagugc

SEQ ID NO: 2216466 - RNA, 18 nt, Human
cugacccagugcccccac

SEQ ID NO: 2216467 - RNA, 13 nt, Human
cugacccagugcc

SEQ ID NO: 2216468 - RNA, 18 nt, Human
cugagggaccaacugggc

SEQ ID NO: 2216469 - RNA, 16 nt, Human
cugagggaccaacugg

SEQ ID NO: 2216470 - RNA, 12 nt, Human
cugagggaccaa

SEQ ID NO: 2216471 - RNA, 21 nt, Human
cugaggcuuuggauuugacau

SEQ ID NO: 2216472 - RNA, 19 nt, Human
cugagggaaagcccagaaa

SEQ ID NO: 2216473 - RNA, 23 nt, Human
cugagggaaagcccagaaaagga

SEQ ID NO: 2216474 - RNA, 18 nt, Human
cugaggcuuuggauuuga

SEQ ID NO: 2216475 - RNA, 17 nt, Human
cugaggcuuuggauuug

SEQ ID NO: 2216476 - RNA, 15 nt, Human
cugaggcuuuggauu

SEQ ID NO: 2216477 - RNA, 14 nt, Human
cugaggcuuuggau

SEQ ID NO: 2216478 - RNA, 21 nt, Human
cugacccagugcccccacuga

SEQ ID NO: 2216479 - RNA, 20 nt, Human
cugacccagugcccccacug

SEQ ID NO: 2216480 - RNA, 23 nt, Human
cugacccagugcccccacugacc

SEQ ID NO: 2216481 - RNA, 14 nt, Human
cugacccagugaga

SEQ ID NO: 2216482 - RNA, 15 nt, Human
cugagggaccagcca

SEQ ID NO: 2216483 - RNA, 13 nt, Human
cugagggaccagc

SEQ ID NO: 2216484 - RNA, 21 nt, Human
cugagggaccaacugggccca

SEQ ID NO: 2216485 - RNA, 20 nt, Human
cugagggaccaacugggccc

SEQ ID NO: 2216486 - RNA, 19 nt, Human
cugagggaccaacugggcc

SEQ ID NO: 2216487 - RNA, 16 nt, Human
cugagggcagucgaua

SEQ ID NO: 2216488 - RNA, 21 nt, Human
cugagggauggacugaugcuu

SEQ ID NO: 2216489 - RNA, 20 nt, Human
cugagggcagaaagguucug

SEQ ID NO: 2216490 - RNA, 23 nt, Human
cugagggcagaaagguucugccc

SEQ ID NO: 2216491 - RNA, 13 nt, Human
cugagggccacac

SEQ ID NO: 2216492 - RNA, 14 nt, Human
cugagggccacacu

SEQ ID NO: 2216493 - RNA, 15 nt, Human
cugagggccacacua

SEQ ID NO: 2216494 - RNA, 16 nt, Human
cugagggccacacuau

SEQ ID NO: 2216495 - RNA, 13 nt, Human
cugagggccccuc

SEQ ID NO: 2216496 - RNA, 15 nt, Human
cugagggccccucug

SEQ ID NO: 2216497 - RNA, 16 nt, Human
cugagggccccucugc

SEQ ID NO: 2216498 - RNA, 17 nt, Human
cugagggccccucugcc

SEQ ID NO: 2216499 - RNA, 18 nt, Human
cugagggccccucugccc

SEQ ID NO: 2216500 - RNA, 19 nt, Human
cugagggccccucugccca

SEQ ID NO: 2216501 - RNA, 20 nt, Human
cugagggccccucugcccag

SEQ ID NO: 2216502 - RNA, 21 nt, Human
cugagggccccucugcccagc

SEQ ID NO: 2216503 - RNA, 22 nt, Human
cugagggccccucugcccagcu

SEQ ID NO: 2216504 - RNA, 16 nt, Human
cugagggcgaggggag

SEQ ID NO: 2216505 - RNA, 14 nt, Human
cugagggcuuccuu

SEQ ID NO: 2216506 - RNA, 16 nt, Human
cugagggcuuccuuug

SEQ ID NO: 2216507 - RNA, 15 nt, Human
cugaguccuuaaaca

SEQ ID NO: 2216508 - RNA, 21 nt, Human
cugaguccuuaaacagggcau

SEQ ID NO: 2216509 - RNA, 22 nt, Human
cugaguccuuaaacagggcauc

SEQ ID NO: 2216510 - RNA, 23 nt, Human
cugagucguacagaaagcugccu

SEQ ID NO: 2216511 - RNA, 21 nt, Human
cugagucguacagaaagcugc

SEQ ID NO: 2216512 - RNA, 15 nt, Human
cugagucucccaagg

SEQ ID NO: 2216513 - RNA, 20 nt, Human
cugagucguacagaaagcug

SEQ ID NO: 2216514 - RNA, 19 nt, Human
cugagucguacagaaagcu

SEQ ID NO: 2216515 - RNA, 18 nt, Human
cugagucguacagaaagc

SEQ ID NO: 2216516 - RNA, 17 nt, Human
cugagucguacagaaag

SEQ ID NO: 2216517 - RNA, 11 nt, Human
cugcacccagg

SEQ ID NO: 2216518 - RNA, 15 nt, Human
cugcaccccccuggg

SEQ ID NO: 2216519 - RNA, 14 nt, Human
cugcaccccccugg

SEQ ID NO: 2216520 - RNA, 12 nt, Human
cugcacccaggg

SEQ ID NO: 2216521 - RNA, 13 nt, Human
cugcacccagggg

SEQ ID NO: 2216522 - RNA, 21 nt, Human
cugcacagugcaucucagccc

SEQ ID NO: 2216523 - RNA, 21 nt, Human
cugcacauuaaggagaaaucu

SEQ ID NO: 2216524 - RNA, 13 nt, Human
cugcaccaaccca

SEQ ID NO: 2216525 - RNA, 16 nt, Human
cugcaccaacccagcc

SEQ ID NO: 2216526 - RNA, 17 nt, Human
cugcaccaacccagccg

SEQ ID NO: 2216527 - RNA, 21 nt, Human
cugcaccaacccagccgcugc

SEQ ID NO: 2216528 - RNA, 23 nt, Human
cugcaccaacccagccgcugccc

SEQ ID NO: 2216529 - RNA, 18 nt, Human
cugcacccucaggcaggu

SEQ ID NO: 2216530 - RNA, 16 nt, Human
cugcacccucaggcag

SEQ ID NO: 2216531 - RNA, 12 nt, Human
cugcacccucca

SEQ ID NO: 2216532 - RNA, 13 nt, Human
cugcacccuccac

SEQ ID NO: 2216533 - RNA, 14 nt, Human
cugcacccuccacc

SEQ ID NO: 2216534 - RNA, 15 nt, Human
cugcacccuccaccc

SEQ ID NO: 2216535 - RNA, 17 nt, Human
cugcaccccccugggcu

SEQ ID NO: 2216536 - RNA, 16 nt, Human
cugcaccccccugggc

SEQ ID NO: 2216537 - RNA, 13 nt, Human
cugcacccccucc

SEQ ID NO: 2216538 - RNA, 14 nt, Human
cugcacccccuccu

SEQ ID NO: 2216539 - RNA, 16 nt, Human
cugcacccccuccugc

SEQ ID NO: 2216540 - RNA, 17 nt, Human
cugcacccccuccugcu

SEQ ID NO: 2216541 - RNA, 18 nt, Human
cugcacccccuccugcug

SEQ ID NO: 2216542 - RNA, 19 nt, Human
cugcacccccuccugcugc

SEQ ID NO: 2216543 - RNA, 17 nt, Human
cugcacccucaggcagg

SEQ ID NO: 2216544 - RNA, 16 nt, Human
cugcacaagcugcacc

SEQ ID NO: 2216545 - RNA, 15 nt, Human
cugcacaagcugcac

SEQ ID NO: 2216546 - RNA, 14 nt, Human
cugcacaagcugca

SEQ ID NO: 2216547 - RNA, 13 nt, Human
cugcacaagcugc

SEQ ID NO: 2216548 - RNA, 18 nt, Human
cugcacaagcugcacccu

SEQ ID NO: 2216549 - RNA, 13 nt, Human
cugcacagcggcc

SEQ ID NO: 2216550 - RNA, 19 nt, Human
cugcacagcggccccugca

SEQ ID NO: 2216551 - RNA, 16 nt, Human
cugcacagggcagcug

SEQ ID NO: 2216552 - RNA, 18 nt, Human
cugcacagugcaucucag

SEQ ID NO: 2216553 - RNA, 21 nt, Human
cugcacagggcagcugggccc

SEQ ID NO: 2216554 - RNA, 22 nt, Human
cugcacagggcagcugggccca

SEQ ID NO: 2216555 - RNA, 17 nt, Human
cugcacagggcagcugg

SEQ ID NO: 2216556 - RNA, 18 nt, Human
cugcacagggcagcuggg

SEQ ID NO: 2216557 - RNA, 19 nt, Human
cugcacagggcagcugggc

SEQ ID NO: 2216558 - RNA, 20 nt, Human
cugcacagggcagcugggcc

SEQ ID NO: 2216559 - RNA, 14 nt, Human
cugcaaaaugagac

SEQ ID NO: 2216560 - RNA, 12 nt, Human
cugcaaaaugag

SEQ ID NO: 2216561 - RNA, 19 nt, Human
cugcaaaaugaggaaugua

SEQ ID NO: 2216562 - RNA, 21 nt, Human
cugcaaaaugaggaauguaua

SEQ ID NO: 2216563 - RNA, 18 nt, Human
cugcaaaaggacucucag

SEQ ID NO: 2216564 - RNA, 15 nt, Human
cugauuggacauuuu

SEQ ID NO: 2216565 - RNA, 14 nt, Human
cugauuggcucacc

SEQ ID NO: 2216566 - RNA, 16 nt, Human
cugauuggcucaccca

SEQ ID NO: 2216567 - RNA, 17 nt, Human
cugcaaaaggacucuca

SEQ ID NO: 2216568 - RNA, 17 nt, Human
cugauucggcugucuca

SEQ ID NO: 2216569 - RNA, 23 nt, Human
cugauucggcugucucagacucu

SEQ ID NO: 2216570 - RNA, 14 nt, Human
cugauucucagggu

SEQ ID NO: 2216571 - RNA, 15 nt, Human
cugauucucaggguc

SEQ ID NO: 2216572 - RNA, 17 nt, Human
cugauucucagggucuc

SEQ ID NO: 2216573 - RNA, 18 nt, Human
cugauucucagggucucu

SEQ ID NO: 2216574 - RNA, 20 nt, Human
cugauucucagggucucugc

SEQ ID NO: 2216575 - RNA, 21 nt, Human
cugauucucagggucucugcu

SEQ ID NO: 2216576 - RNA, 13 nt, Human
cugcaaaauuuua

SEQ ID NO: 2216577 - RNA, 11 nt, Human
cugcaaaauuu

SEQ ID NO: 2216578 - RNA, 22 nt, Human
cugcaaaaugaggaauguauau

SEQ ID NO: 2216579 - RNA, 22 nt, Human
cugcaaacaccaacauguuggg

SEQ ID NO: 2216580 - RNA, 23 nt, Human
cugcaaacaugggguuggcuggg

SEQ ID NO: 2216581 - RNA, 23 nt, Human
cugcaaaauuugaugccaggaca

SEQ ID NO: 2216582 - RNA, 18 nt, Human
cugcaaaccugaccccug

SEQ ID NO: 2216583 - RNA, 13 nt, Human
cugcaaacgcugc

SEQ ID NO: 2216584 - RNA, 20 nt, Human
cugcaaaccugaccccugcu

SEQ ID NO: 2216585 - RNA, 16 nt, Human
cugcaaacgcugccug

SEQ ID NO: 2216586 - RNA, 15 nt, Human
cugcaaacgcugccu

SEQ ID NO: 2216587 - RNA, 17 nt, Human
cugcaaacgcugccugc

SEQ ID NO: 2216588 - RNA, 15 nt, Human
cugcaauccugucuu

SEQ ID NO: 2216589 - RNA, 16 nt, Human
cugcaauccugucuuu

SEQ ID NO: 2216590 - RNA, 21 nt, Human
cugcacaaagcccuuccaugu

SEQ ID NO: 2216591 - RNA, 16 nt, Human
cugcacaaacucacca

SEQ ID NO: 2216592 - RNA, 20 nt, Human
cugcaauugcuuaggauguu

SEQ ID NO: 2216593 - RNA, 18 nt, Human
cugcacaaagcccuucca

SEQ ID NO: 2216594 - RNA, 20 nt, Human
cugcacaaagcccuuccaug

SEQ ID NO: 2216595 - RNA, 13 nt, Human
cugcacaaagccc

SEQ ID NO: 2216596 - RNA, 20 nt, Human
cugcaauuucauaugcugua

SEQ ID NO: 2216597 - RNA, 18 nt, Human
cugcaauuucauaugcug

SEQ ID NO: 2216598 - RNA, 21 nt, Human
cugcaaugaagucucugaagu

SEQ ID NO: 2216599 - RNA, 18 nt, Human
cugcaaugaagucucuga

SEQ ID NO: 2216600 - RNA, 22 nt, Human
cugcaaucuucucagaaggcaa

SEQ ID NO: 2216601 - RNA, 23 nt, Human
cugcaauccugucuuucugagca

SEQ ID NO: 2216602 - RNA, 17 nt, Human
cugcaaugggcacuggg

SEQ ID NO: 2216603 - RNA, 21 nt, Human
cugcaaugggcacugggauga

SEQ ID NO: 2216604 - RNA, 18 nt, Human
cugcaaugugggcagaga

SEQ ID NO: 2216605 - RNA, 15 nt, Human
cugcaauguuuuccu

SEQ ID NO: 2216606 - RNA, 16 nt, Human
cugcaauguuuuccuu

SEQ ID NO: 2216607 - RNA, 23 nt, Human
cugcaauuaaagugauacugaaa

SEQ ID NO: 2216608 - RNA, 15 nt, Human
cugcaauuccccucu

SEQ ID NO: 2216609 - RNA, 16 nt, Human
cugcaauuccccucug

SEQ ID NO: 2216610 - RNA, 17 nt, Human
cugcaauuccccucugc

SEQ ID NO: 2216611 - RNA, 20 nt, Human
cugcaauuccccucugcugc

SEQ ID NO: 2216612 - RNA, 15 nt, Human
cugcaauugcuuagg

SEQ ID NO: 2216613 - RNA, 16 nt, Human
cugcaauugcuuagga

SEQ ID NO: 2216614 - RNA, 17 nt, Human
cugcagagacagagagg

SEQ ID NO: 2216615 - RNA, 13 nt, Human
cugcagaaggaaa

SEQ ID NO: 2216616 - RNA, 14 nt, Human
cugcagagagaagc

SEQ ID NO: 2216617 - RNA, 23 nt, Human
cugcagaagacaguauggcagcu

SEQ ID NO: 2216618 - RNA, 23 nt, Human
cugcagaacguauugguccagcu

SEQ ID NO: 2216619 - RNA, 21 nt, Human
cugcagaacguauugguccag

SEQ ID NO: 2216620 - RNA, 20 nt, Human
cugcagaacguauuggucca

SEQ ID NO: 2216621 - RNA, 13 nt, Human
cugcagaagacag

SEQ ID NO: 2216622 - RNA, 20 nt, Human
cugcagagcaggaaacauga

SEQ ID NO: 2216623 - RNA, 18 nt, Human
cugcagagcagugggccu

SEQ ID NO: 2216624 - RNA, 23 nt, Human
cugcagagcagugggccuggcca

SEQ ID NO: 2216625 - RNA, 21 nt, Human
cugcagagcagugggccuggc

SEQ ID NO: 2216626 - RNA, 13 nt, Human
cugcagaggggca

SEQ ID NO: 2216627 - RNA, 14 nt, Human
cugcagaggggcag

SEQ ID NO: 2216628 - RNA, 15 nt, Human
cugcagaggggcagg

SEQ ID NO: 2216629 - RNA, 17 nt, Human
cugcagaggggcaggcc

SEQ ID NO: 2216630 - RNA, 19 nt, Human
cugcagaggggcaggcccu

SEQ ID NO: 2216631 - RNA, 21 nt, Human
cugcagagcugcgggcugggu

SEQ ID NO: 2216632 - RNA, 12 nt, Human
cugcagagcugc

SEQ ID NO: 2216633 - RNA, 14 nt, Human
cugcacuugcagac

SEQ ID NO: 2216634 - RNA, 15 nt, Human
cugcacuuacuugcu

SEQ ID NO: 2216635 - RNA, 17 nt, Human
cugcacccucccuccga

SEQ ID NO: 2216636 - RNA, 16 nt, Human
cugcacuuacuugcuu

SEQ ID NO: 2216637 - RNA, 21 nt, Human
cugcacccuccacccuguccc

SEQ ID NO: 2216638 - RNA, 19 nt, Human
cugcacuuauacccaugaa

SEQ ID NO: 2216639 - RNA, 16 nt, Human
cugcacuugcagacuc

SEQ ID NO: 2216640 - RNA, 17 nt, Human
cugcacuugcagacucu

SEQ ID NO: 2216641 - RNA, 17 nt, Human
cugcaccggcuggccug

SEQ ID NO: 2216642 - RNA, 18 nt, Human
cugcaccggcuggccugg

SEQ ID NO: 2216643 - RNA, 19 nt, Human
cugcaccggcuggccuggc

SEQ ID NO: 2216644 - RNA, 20 nt, Human
cugcaccggcuggccuggcc

SEQ ID NO: 2216645 - RNA, 16 nt, Human
cugcacccuccacccu

SEQ ID NO: 2216646 - RNA, 17 nt, Human
cugcacccuccacccug

SEQ ID NO: 2216647 - RNA, 18 nt, Human
cugcacccuccacccugu

SEQ ID NO: 2216648 - RNA, 20 nt, Human
cugcacccuccacccugucc

SEQ ID NO: 2216649 - RNA, 23 nt, Human
cugcagaggggcuuucuggagag

SEQ ID NO: 2216650 - RNA, 23 nt, Human
cugcagaggggcaggcccugcac

SEQ ID NO: 2216651 - RNA, 16 nt, Human
cugcagaggucugugc

SEQ ID NO: 2216652 - RNA, 17 nt, Human
cugcagaggucugugcu

SEQ ID NO: 2216653 - RNA, 18 nt, Human
cugcagaggucugugcug

SEQ ID NO: 2216654 - RNA, 19 nt, Human
cugcagaggucugugcuga

SEQ ID NO: 2216655 - RNA, 21 nt, Human
cugcagaggucugugcugagg

SEQ ID NO: 2216656 - RNA, 22 nt, Human
cugcagaggggcuuucuggaga

SEQ ID NO: 2216657 - RNA, 20 nt, Human
cugcagaggggcuuucugga

SEQ ID NO: 2216658 - RNA, 19 nt, Human
cugcagaggggcuuucugg

SEQ ID NO: 2216659 - RNA, 21 nt, Human
cugcagaggggcaggcccugc

SEQ ID NO: 2216660 - RNA, 22 nt, Human
cugcagaggggcaggcccugca

SEQ ID NO: 2216661 - RNA, 22 nt, Human
cugcagaggucugugcugaggc

SEQ ID NO: 2216662 - RNA, 23 nt, Human
cugcagaggucugugcugaggcc

SEQ ID NO: 2216663 - RNA, 17 nt, Human
cugcagaguuuccaaaa

SEQ ID NO: 2216664 - RNA, 15 nt, Human
cugcagccaggccac

SEQ ID NO: 2216665 - RNA, 17 nt, Human
cugcagauuugggcugg

SEQ ID NO: 2216666 - RNA, 11 nt, Human
cugcagccuca

SEQ ID NO: 2216667 - RNA, 24 nt, Human
cugcagcccggcgccaccauccug

SEQ ID NO: 2216668 - RNA, 18 nt, Human
cugcagauuugggcugga

SEQ ID NO: 2216669 - RNA, 12 nt, Human
cugcagcccagg

SEQ ID NO: 2216670 - RNA, 16 nt, Human
cugcagcccagggacc

SEQ ID NO: 2216671 - RNA, 23 nt, Human
cugcagccaggccacuggccccu

SEQ ID NO: 2216672 - RNA, 22 nt, Human
cugcagccaggccacuggcccc

SEQ ID NO: 2216673 - RNA, 17 nt, Human
cugcagccaggccacug

SEQ ID NO: 2216674 - RNA, 16 nt, Human
cugcagccaggccacu

SEQ ID NO: 2216675 - RNA, 22 nt, Human
cugcagccucaaccuccugggc

SEQ ID NO: 2216676 - RNA, 21 nt, Human
cugcaggcccuggccuccccu

SEQ ID NO: 2216677 - RNA, 19 nt, Human
cugcagccucaaccuccug

SEQ ID NO: 2216678 - RNA, 20 nt, Human
cugcagccucaaccuccugg

SEQ ID NO: 2216679 - RNA, 22 nt, Human
cugcagggaguccgaaagggac

SEQ ID NO: 2216680 - RNA, 16 nt, Human
cugcagggccaagcac

SEQ ID NO: 2216681 - RNA, 13 nt, Human
cugcagggccagg

SEQ ID NO: 2216682 - RNA, 23 nt, Human
cugcagggaaaauuauuugcaua

SEQ ID NO: 2216683 - RNA, 15 nt, Human
cugcagggacugcca

SEQ ID NO: 2216684 - RNA, 17 nt, Human
cugcagggacugccagu

SEQ ID NO: 2216685 - RNA, 22 nt, Human
cugcagggaaaauuauuugcau

SEQ ID NO: 2216686 - RNA, 12 nt, Human
cugcagggaaaa

SEQ ID NO: 2216687 - RNA, 17 nt, Human
cugcuccccucccuccu

SEQ ID NO: 2216688 - RNA, 13 nt, Human
cugcuccccuccc

SEQ ID NO: 2216689 - RNA, 14 nt, Human
cugcucccugaagc

SEQ ID NO: 2216690 - RNA, 15 nt, Human
cugcuccagcuguuc

SEQ ID NO: 2216691 - RNA, 22 nt, Human
cugcuccagaccugauccugga

SEQ ID NO: 2216692 - RNA, 21 nt, Human
cugcuccagaccugauccugg

SEQ ID NO: 2216693 - RNA, 16 nt, Human
cugcuccucuccccag

SEQ ID NO: 2216694 - RNA, 17 nt, Human
cugcuccucuccccagc

SEQ ID NO: 2216695 - RNA, 14 nt, Human
cugcuccucuccag

SEQ ID NO: 2216696 - RNA, 15 nt, Human
cugcuccucuccagg

SEQ ID NO: 2216697 - RNA, 16 nt, Human
cugcuccucuccaggc

SEQ ID NO: 2216698 - RNA, 17 nt, Human
cugcuccucuccaggca

SEQ ID NO: 2216699 - RNA, 15 nt, Human
cugcucccugaagcc

SEQ ID NO: 2216700 - RNA, 16 nt, Human
cugcucccugaagcca

SEQ ID NO: 2216701 - RNA, 17 nt, Human
cugcucccugaagccag

SEQ ID NO: 2216702 - RNA, 18 nt, Human
cugcucccugaagccagc

SEQ ID NO: 2216703 - RNA, 19 nt, Human
cugcucccugaagccagcc

SEQ ID NO: 2216704 - RNA, 20 nt, Human
cugcucccugaagccagccu

SEQ ID NO: 2216705 - RNA, 21 nt, Human
cugcucccugaagccagccuu

SEQ ID NO: 2216706 - RNA, 22 nt, Human
cugcucccugaagccagccuuc

SEQ ID NO: 2216707 - RNA, 20 nt, Human
cugcucuccuuccuggagcc

SEQ ID NO: 2216708 - RNA, 21 nt, Human
cugcucugaauuaguccuugc

SEQ ID NO: 2216709 - RNA, 22 nt, Human
cugcucugaauuaguccuugcu

SEQ ID NO: 2216710 - RNA, 16 nt, Human
cugcucuccuuccugg

SEQ ID NO: 2216711 - RNA, 19 nt, Human
cugcucgggcccaggccau

SEQ ID NO: 2216712 - RNA, 22 nt, Human
cugcucgggcccaggccaucuu

SEQ ID NO: 2216713 - RNA, 17 nt, Human
cugcucuccuuccugga

SEQ ID NO: 2216714 - RNA, 19 nt, Human
cugcucuccuuccuggagc

SEQ ID NO: 2216715 - RNA, 16 nt, Human
cugcucgccuuagcac

SEQ ID NO: 2216716 - RNA, 13 nt, Human
cugcucgggccca

SEQ ID NO: 2216717 - RNA, 14 nt, Human
cugcucgggcccag

SEQ ID NO: 2216718 - RNA, 15 nt, Human
cugcucgggcccagg

SEQ ID NO: 2216719 - RNA, 16 nt, Human
cugcucgggcccaggc

SEQ ID NO: 2216720 - RNA, 17 nt, Human
cugcucgggcccaggcc

SEQ ID NO: 2216721 - RNA, 18 nt, Human
cugcuccucuccccagca

SEQ ID NO: 2216722 - RNA, 13 nt, Human
cugcuccuggagc

SEQ ID NO: 2216723 - RNA, 15 nt, Human
cugcuccuggagccu

SEQ ID NO: 2216724 - RNA, 19 nt, Human
cugcuccuggagccuuuga

SEQ ID NO: 2216725 - RNA, 20 nt, Human
cugcuccuggagccuuugaa

SEQ ID NO: 2216726 - RNA, 15 nt, Human
cugcucgccuuagca

SEQ ID NO: 2216727 - RNA, 18 nt, Human
cugcuccuuccuucaccu

SEQ ID NO: 2216728 - RNA, 20 nt, Human
cugcggaaugaaccacaucu

SEQ ID NO: 2216729 - RNA, 17 nt, Human
cugccuuaucuugcacc

SEQ ID NO: 2216730 - RNA, 15 nt, Human
cugccuuagagccag

SEQ ID NO: 2216731 - RNA, 17 nt, Human
cugccuuagagccaggc

SEQ ID NO: 2216732 - RNA, 19 nt, Human
cugccuuagagccaggcac

SEQ ID NO: 2216733 - RNA, 16 nt, Human
cugccuuagucucagu

SEQ ID NO: 2216734 - RNA, 20 nt, Human
cugccuuagucucaguuugu

SEQ ID NO: 2216735 - RNA, 23 nt, Human
cugccuuagucucaguuugugug

SEQ ID NO: 2216736 - RNA, 15 nt, Human
cugccuuaucuugca

SEQ ID NO: 2216737 - RNA, 15 nt, Human
cugcgguccacccag

SEQ ID NO: 2216738 - RNA, 22 nt, Human
cugcgguagaugggagggaggc

SEQ ID NO: 2216739 - RNA, 21 nt, Human
cugcggguggggcuuggggcu

SEQ ID NO: 2216740 - RNA, 20 nt, Human
cugcggagagaggccuuguc

SEQ ID NO: 2216741 - RNA, 23 nt, Human
cugcggaccccagcugugagccu

SEQ ID NO: 2216742 - RNA, 13 nt, Human
cugcggguggggc

SEQ ID NO: 2216743 - RNA, 21 nt, Human
cugcggaaugaaccacaucuu

SEQ ID NO: 2216744 - RNA, 17 nt, Human
cugcgcuugcuuuucug

SEQ ID NO: 2216745 - RNA, 14 nt, Human
cugcggaaaaggaa

SEQ ID NO: 2216746 - RNA, 13 nt, Human
cugcggaccccag

SEQ ID NO: 2216747 - RNA, 14 nt, Human
cugcggaccccagc

SEQ ID NO: 2216748 - RNA, 15 nt, Human
cugcggaccccagcu

SEQ ID NO: 2216749 - RNA, 16 nt, Human
cugcggaccccagcug

SEQ ID NO: 2216750 - RNA, 20 nt, Human
cugcggaccccagcugugag

SEQ ID NO: 2216751 - RNA, 20 nt, Human
cugcguggggacagggcucg

SEQ ID NO: 2216752 - RNA, 19 nt, Human
cugcgugucaccugugcuu

SEQ ID NO: 2216753 - RNA, 17 nt, Human
cugcgguccacccagga

SEQ ID NO: 2216754 - RNA, 16 nt, Human
cugcgguccacccagg

SEQ ID NO: 2216755 - RNA, 23 nt, Human
cugcuaaauaaaauuuguugcau

SEQ ID NO: 2216756 - RNA, 12 nt, Human
cugcuaaauaaa

SEQ ID NO: 2216757 - RNA, 15 nt, Human
cugcuaaauaaaauu

SEQ ID NO: 2216758 - RNA, 20 nt, Human
cugcguuuuggaagcucuga

SEQ ID NO: 2216759 - RNA, 18 nt, Human
cugcguucuugugacaga

SEQ ID NO: 2216760 - RNA, 14 nt, Human
cugcuccagcuguu

SEQ ID NO: 2216761 - RNA, 15 nt, Human
cugcuccagaccuga

SEQ ID NO: 2216762 - RNA, 14 nt, Human
cugcuccagaccug

SEQ ID NO: 2216763 - RNA, 13 nt, Human
cugcuccagaccu

SEQ ID NO: 2216764 - RNA, 17 nt, Human
cugcuaaguauuuccca

SEQ ID NO: 2216765 - RNA, 20 nt, Human
cugcuaacuuggagccccag

SEQ ID NO: 2216766 - RNA, 21 nt, Human
cugcuaacuuggagccccagu

SEQ ID NO: 2216767 - RNA, 23 nt, Human
cugcuaacuuggagccccagugc

SEQ ID NO: 2216768 - RNA, 18 nt, Human
cugcuaaguauuucccag

SEQ ID NO: 2216769 - RNA, 12 nt, Human
cugccucagguu

SEQ ID NO: 2216770 - RNA, 12 nt, Human
cugccucauuua

SEQ ID NO: 2216771 - RNA, 18 nt, Human
cugccucagguuccuaug

SEQ ID NO: 2216772 - RNA, 13 nt, Human
cugccucagguuc

SEQ ID NO: 2216773 - RNA, 17 nt, Human
cugccucagguuccuau

SEQ ID NO: 2216774 - RNA, 23 nt, Human
cugccucaggaggcaggaccuuc

SEQ ID NO: 2216775 - RNA, 22 nt, Human
cugccucaggaggcaggaccuu

SEQ ID NO: 2216776 - RNA, 18 nt, Human
cugccucucccuggcccu

SEQ ID NO: 2216777 - RNA, 17 nt, Human
cugccucucccuggccc

SEQ ID NO: 2216778 - RNA, 19 nt, Human
cugccucucccuggcccuc

SEQ ID NO: 2216779 - RNA, 13 nt, Human
cugccuccacucc

SEQ ID NO: 2216780 - RNA, 14 nt, Human
cugccuccacuccc

SEQ ID NO: 2216781 - RNA, 15 nt, Human
cugccuccacuccca

SEQ ID NO: 2216782 - RNA, 16 nt, Human
cugccucucccuggcc

SEQ ID NO: 2216783 - RNA, 13 nt, Human
cugccucauuuag

SEQ ID NO: 2216784 - RNA, 12 nt, Human
cugccuccaccc

SEQ ID NO: 2216785 - RNA, 15 nt, Human
cugccuccacccucu

SEQ ID NO: 2216786 - RNA, 16 nt, Human
cugccuccacccucug

SEQ ID NO: 2216787 - RNA, 17 nt, Human
cugccuccacccucuga

SEQ ID NO: 2216788 - RNA, 18 nt, Human
cugccuccacccucugag

SEQ ID NO: 2216789 - RNA, 20 nt, Human
cugccuccacccucugagcu

SEQ ID NO: 2216790 - RNA, 21 nt, Human
cugccuccacccucugagcuu

SEQ ID NO: 2216791 - RNA, 14 nt, Human
cugccucagccucc

SEQ ID NO: 2216792 - RNA, 14 nt, Human
cugccucaggacug

SEQ ID NO: 2216793 - RNA, 13 nt, Human
cugccucaggacu

SEQ ID NO: 2216794 - RNA, 11 nt, Human
cugccucagga

SEQ ID NO: 2216795 - RNA, 14 nt, Human
cugccucagcccgc

SEQ ID NO: 2216796 - RNA, 12 nt, Human
cugccucaggac

SEQ ID NO: 2216797 - RNA, 12 nt, Human
cugccucagccu

SEQ ID NO: 2216798 - RNA, 23 nt, Human
cugccucacuuccuacaagagca

SEQ ID NO: 2216799 - RNA, 14 nt, Human
cugccucacuuccu

SEQ ID NO: 2216800 - RNA, 23 nt, Human
cugccucacagcuggccgucacu

SEQ ID NO: 2216801 - RNA, 13 nt, Human
cugccucagccuc

SEQ ID NO: 2216802 - RNA, 16 nt, Human
cugccuaaguggcugc

SEQ ID NO: 2216803 - RNA, 15 nt, Human
cugccuaaguggcug

SEQ ID NO: 2216804 - RNA, 14 nt, Human
cugccuaaguggcu

SEQ ID NO: 2216805 - RNA, 21 nt, Human
cugcccugggauguccacaga

SEQ ID NO: 2216806 - RNA, 24 nt, Human
cugccucaaugugaaucagacccu

SEQ ID NO: 2216807 - RNA, 15 nt, Human
cugccucacagcugg

SEQ ID NO: 2216808 - RNA, 21 nt, Human
cugccucaaugugaaucagac

SEQ ID NO: 2216809 - RNA, 18 nt, Human
cugccuaaguggcugcug

SEQ ID NO: 2216810 - RNA, 13 nt, Human
cugccuauuuuaa

SEQ ID NO: 2216811 - RNA, 15 nt, Human
cugccuaagugcagc

SEQ ID NO: 2216812 - RNA, 16 nt, Human
cugcccugccacuuug

SEQ ID NO: 2216813 - RNA, 11 nt, Human
cugcccuggga

SEQ ID NO: 2216814 - RNA, 13 nt, Human
cugcccugggagg

SEQ ID NO: 2216815 - RNA, 12 nt, Human
cugcccugggag

SEQ ID NO: 2216816 - RNA, 19 nt, Human
cugcccugggauguccaca

SEQ ID NO: 2216817 - RNA, 21 nt, Human
cugcccuggcugcugccccca

SEQ ID NO: 2216818 - RNA, 18 nt, Human
cugcccuggcugcugccc

SEQ ID NO: 2216819 - RNA, 20 nt, Human
cugcccuggcugcugccccc

SEQ ID NO: 2216820 - RNA, 22 nt, Human
cugcccugggaggcagugaugg

SEQ ID NO: 2216821 - RNA, 15 nt, Human
cugcccugggaggca

SEQ ID NO: 2216822 - RNA, 14 nt, Human
cugccucuucucua

SEQ ID NO: 2216823 - RNA, 23 nt, Human
cugccugaagucacacagugagu

SEQ ID NO: 2216824 - RNA, 13 nt, Human
cugccucuucucu

SEQ ID NO: 2216825 - RNA, 19 nt, Human
cugccucuuagacuucugc

SEQ ID NO: 2216826 - RNA, 20 nt, Human
cugccucuguuugacaaacc

SEQ ID NO: 2216827 - RNA, 22 nt, Human
cugccucuuagacuucugcuuu

SEQ ID NO: 2216828 - RNA, 23 nt, Human
cugccucuuagacuucugcuuuc

SEQ ID NO: 2216829 - RNA, 15 nt, Human
cugccucuucccccu

SEQ ID NO: 2216830 - RNA, 21 nt, Human
cugccucuucccccugcuucc

SEQ ID NO: 2216831 - RNA, 22 nt, Human
cugccucuucccccugcuucca

SEQ ID NO: 2216832 - RNA, 12 nt, Human
cugccucuuccu

SEQ ID NO: 2216833 - RNA, 18 nt, Human
cugccucucgguggccag

SEQ ID NO: 2216834 - RNA, 14 nt, Human
cugccucucugcag

SEQ ID NO: 2216835 - RNA, 12 nt, Human
cugccucucugc

SEQ ID NO: 2216836 - RNA, 13 nt, Human
cugccucucugca

SEQ ID NO: 2216837 - RNA, 13 nt, Human
cugccugcccagg

SEQ ID NO: 2216838 - RNA, 14 nt, Human
cugccugcccaggc

SEQ ID NO: 2216839 - RNA, 16 nt, Human
cugccugcccacccgu

SEQ ID NO: 2216840 - RNA, 15 nt, Human
cugccugcccacccg

SEQ ID NO: 2216841 - RNA, 16 nt, Human
cugccuuaaaaccaaa

SEQ ID NO: 2216842 - RNA, 17 nt, Human
cugccuuaaaaccaaag

SEQ ID NO: 2216843 - RNA, 18 nt, Human
cugccuuaaaaccaaaga

SEQ ID NO: 2216844 - RNA, 19 nt, Human
cugccuuaaaaccaaagag

SEQ ID NO: 2216845 - RNA, 22 nt, Human
cugccuuaaaaccaaagagggc

SEQ ID NO: 2216846 - RNA, 20 nt, Human
cugccuuaaagucaguaacu

SEQ ID NO: 2216847 - RNA, 15 nt, Human
cugccugcccaggcc

SEQ ID NO: 2216848 - RNA, 14 nt, Human
cugccugcccaccc

SEQ ID NO: 2216849 - RNA, 13 nt, Human
cugccugcccacc

SEQ ID NO: 2216850 - RNA, 16 nt, Human
cugccugcccacacag

SEQ ID NO: 2216851 - RNA, 16 nt, Human
cugccugauggaccug

SEQ ID NO: 2216852 - RNA, 12 nt, Human
cugccugagcuu

SEQ ID NO: 2216853 - RNA, 23 nt, Human
cugccugacauuuggaguguucc

SEQ ID NO: 2216854 - RNA, 20 nt, Human
cugccugacauuuggagugu

SEQ ID NO: 2216855 - RNA, 15 nt, Human
cugccugagggcccc

SEQ ID NO: 2216856 - RNA, 16 nt, Human
cugccugagggccccu

SEQ ID NO: 2216857 - RNA, 17 nt, Human
cugccugagggccccuc

SEQ ID NO: 2216858 - RNA, 18 nt, Human
cugccugagggccccucu

SEQ ID NO: 2216859 - RNA, 20 nt, Human
cugccugagggccccucugc

SEQ ID NO: 2216860 - RNA, 21 nt, Human
cugccugagggccccucugcc

SEQ ID NO: 2216861 - RNA, 22 nt, Human
cugccugagggccccucugccc

SEQ ID NO: 2216862 - RNA, 23 nt, Human
cugccugagggccccucugccca

SEQ ID NO: 2216863 - RNA, 11 nt, Human
cugcaggggcu

SEQ ID NO: 2216864 - RNA, 14 nt, Human
cugcagggccagga

SEQ ID NO: 2216865 - RNA, 15 nt, Human
cugcagggccaggac

SEQ ID NO: 2216866 - RNA, 16 nt, Human
cugcagggccaggacu

SEQ ID NO: 2216867 - RNA, 17 nt, Human
cugcagggccaggacug

SEQ ID NO: 2216868 - RNA, 21 nt, Human
cugcagggccaggacugagcc

SEQ ID NO: 2216869 - RNA, 22 nt, Human
cugcagggcccucccuuuuccc

SEQ ID NO: 2216870 - RNA, 13 nt, Human
cugccacacuuca

SEQ ID NO: 2216871 - RNA, 14 nt, Human
cugcaggggcucug

SEQ ID NO: 2216872 - RNA, 17 nt, Human
cugccacacuucaggcu

SEQ ID NO: 2216873 - RNA, 22 nt, Human
cugccacacuucaggcucuucu

SEQ ID NO: 2216874 - RNA, 19 nt, Human
cugccaccacgcccggcua

SEQ ID NO: 2216875 - RNA, 18 nt, Human
cugccaccaaaggccagg

SEQ ID NO: 2216876 - RNA, 22 nt, Human
cugccaccaaaggccaggguca

SEQ ID NO: 2216877 - RNA, 18 nt, Human
cugccaccaccagaaagc

SEQ ID NO: 2216878 - RNA, 14 nt, Human
cugccaccagagac

SEQ ID NO: 2216879 - RNA, 23 nt, Human
cugccacagccuccccugccagg

SEQ ID NO: 2216880 - RNA, 12 nt, Human
cugcaggggcuc

SEQ ID NO: 2216881 - RNA, 15 nt, Human
cugccaccaaaggcc

SEQ ID NO: 2216882 - RNA, 22 nt, Human
cugccacagccuccccugccag

SEQ ID NO: 2216883 - RNA, 21 nt, Human
cugccacagccuccccugcca

SEQ ID NO: 2216884 - RNA, 13 nt, Human
cugccaccaggcc

SEQ ID NO: 2216885 - RNA, 15 nt, Human
cugccaccagagacc

SEQ ID NO: 2216886 - RNA, 21 nt, Human
cugccaccagagaccguccuc

SEQ ID NO: 2216887 - RNA, 14 nt, Human
cugccaccaggcca

SEQ ID NO: 2216888 - RNA, 15 nt, Human
cugccaccaggccac

SEQ ID NO: 2216889 - RNA, 17 nt, Human
cugccaccaggccaccu

SEQ ID NO: 2216890 - RNA, 18 nt, Human
cugccaccaggccaccuc

SEQ ID NO: 2216891 - RNA, 23 nt, Human
cugccaccaggccaccuccccag

SEQ ID NO: 2216892 - RNA, 22 nt, Human
cugccaccagagaccguccuca

SEQ ID NO: 2216893 - RNA, 12 nt, Human
cugccaccaguc

SEQ ID NO: 2216894 - RNA, 19 nt, Human
cugccagccagcagccagc

SEQ ID NO: 2216895 - RNA, 18 nt, Human
cugccagccagcagccag

SEQ ID NO: 2216896 - RNA, 16 nt, Human
cugccagccagcagcc

SEQ ID NO: 2216897 - RNA, 15 nt, Human
cugccagccagcagc

SEQ ID NO: 2216898 - RNA, 14 nt, Human
cugccagccagcag

SEQ ID NO: 2216899 - RNA, 13 nt, Human
cugccagccagca

SEQ ID NO: 2216900 - RNA, 12 nt, Human
cugccagccagc

SEQ ID NO: 2216901 - RNA, 12 nt, Human
cugccagccaca

SEQ ID NO: 2216902 - RNA, 18 nt, Human
cugccacccaccucccug

SEQ ID NO: 2216903 - RNA, 15 nt, Human
cugccacccugggga

SEQ ID NO: 2216904 - RNA, 17 nt, Human
cugccacccaccucccu

SEQ ID NO: 2216905 - RNA, 15 nt, Human
cugccacccaccucc

SEQ ID NO: 2216906 - RNA, 14 nt, Human
cugccacccaccuc

SEQ ID NO: 2216907 - RNA, 19 nt, Human
cugccaccauccugcugcu

SEQ ID NO: 2216908 - RNA, 14 nt, Human
cugccaccagucac

SEQ ID NO: 2216909 - RNA, 17 nt, Human
cugccaccagucacugu

SEQ ID NO: 2216910 - RNA, 14 nt, Human
cugccaccauccug

SEQ ID NO: 2216911 - RNA, 17 nt, Human
cugccaccauccugcug

SEQ ID NO: 2216912 - RNA, 16 nt, Human
cugccacccuggggag

SEQ ID NO: 2216913 - RNA, 20 nt, Human
cugccacccuggggagaaag

SEQ ID NO: 2216914 - RNA, 20 nt, Human
cugccagccuggcuucugga

SEQ ID NO: 2216915 - RNA, 19 nt, Human
cugccagccuggcuucugg

SEQ ID NO: 2216916 - RNA, 16 nt, Human
cugccagccuggcuuc

SEQ ID NO: 2216917 - RNA, 15 nt, Human
cugccagccuggcuu

SEQ ID NO: 2216918 - RNA, 14 nt, Human
cugccagccuggcu

SEQ ID NO: 2216919 - RNA, 13 nt, Human
cugccagccuggc

SEQ ID NO: 2216920 - RNA, 12 nt, Human
cugccagccugg

SEQ ID NO: 2216921 - RNA, 23 nt, Human
cugccagccagcagccagcucuc

SEQ ID NO: 2216922 - RNA, 20 nt, Human
cugccagccagcagccagcu

SEQ ID NO: 2216923 - RNA, 19 nt, Human
cugccagccgagauagcca

SEQ ID NO: 2216924 - RNA, 15 nt, Human
cugccaggaagccag

SEQ ID NO: 2216925 - RNA, 16 nt, Human
cugccaggaagccagc

SEQ ID NO: 2216926 - RNA, 18 nt, Human
cugccaggaagccagcag

SEQ ID NO: 2216927 - RNA, 19 nt, Human
cugccaggaagccagcagg

SEQ ID NO: 2216928 - RNA, 19 nt, Human
cugccaugccagcuuaucu

SEQ ID NO: 2216929 - RNA, 13 nt, Human
cugccaggcaggg

SEQ ID NO: 2216930 - RNA, 12 nt, Human
cugccaggcagg

SEQ ID NO: 2216931 - RNA, 17 nt, Human
cugccaugccagcuuau

SEQ ID NO: 2216932 - RNA, 15 nt, Human
cugccaggcaggggu

SEQ ID NO: 2216933 - RNA, 23 nt, Human
cugccagccuggcuucuggagcc

SEQ ID NO: 2216934 - RNA, 22 nt, Human
cugccagccuggcuucuggagc

SEQ ID NO: 2216935 - RNA, 15 nt, Human
cugccaggagcuuug

SEQ ID NO: 2216936 - RNA, 10 nt, Human
cugcccuccc

SEQ ID NO: 2216937 - RNA, 14 nt, Human
cugcccuccauccc

SEQ ID NO: 2216938 - RNA, 22 nt, Human
cugcccuccagcucuuuccucc

SEQ ID NO: 2216939 - RNA, 14 nt, Human
cugcccuccccucu

SEQ ID NO: 2216940 - RNA, 15 nt, Human
cugcccuccaucccg

SEQ ID NO: 2216941 - RNA, 17 nt, Human
cugcccuccccagagca

SEQ ID NO: 2216942 - RNA, 21 nt, Human
cugcccgggaaggucaccagc

SEQ ID NO: 2216943 - RNA, 22 nt, Human
cugcccggcgcccucuguccug

SEQ ID NO: 2216944 - RNA, 23 nt, Human
cugcccggcgcccucuguccuga

SEQ ID NO: 2216945 - RNA, 20 nt, Human
cugcccuccccucucugcac

SEQ ID NO: 2216946 - RNA, 21 nt, Human
cugcccuccccagagcacugg

SEQ ID NO: 2216947 - RNA, 20 nt, Human
cugcccuccuuguccaccca

SEQ ID NO: 2216948 - RNA, 18 nt, Human
cugcccuccuuguccacc

SEQ ID NO: 2216949 - RNA, 16 nt, Human
cugcccucguggccag

SEQ ID NO: 2216950 - RNA, 11 nt, Human
cugcccggcug

SEQ ID NO: 2216951 - RNA, 11 nt, Human
cugccccuggc

SEQ ID NO: 2216952 - RNA, 15 nt, Human
cugcccggcgcccuc

SEQ ID NO: 2216953 - RNA, 16 nt, Human
cugcccggcgcccucu

SEQ ID NO: 2216954 - RNA, 17 nt, Human
cugcccggcgcccucug

SEQ ID NO: 2216955 - RNA, 20 nt, Human
cugcccggcgcccucugucc

SEQ ID NO: 2216956 - RNA, 21 nt, Human
cugcccggcgcccucuguccu

SEQ ID NO: 2216957 - RNA, 15 nt, Human
cugcccggcugcgga

SEQ ID NO: 2216958 - RNA, 19 nt, Human
cugcccuccaagaccuucu

SEQ ID NO: 2216959 - RNA, 17 nt, Human
cugcccucguggccagc

SEQ ID NO: 2216960 - RNA, 17 nt, Human
cugcccugcacgucaug

SEQ ID NO: 2216961 - RNA, 20 nt, Human
cugcccugcacgucauggga

SEQ ID NO: 2216962 - RNA, 13 nt, Human
cugcccugccacu

SEQ ID NO: 2216963 - RNA, 11 nt, Human
cugcccugccc

SEQ ID NO: 2216964 - RNA, 13 nt, Human
cugcccugcccac

SEQ ID NO: 2216965 - RNA, 14 nt, Human
cugcccugcccacc

SEQ ID NO: 2216966 - RNA, 15 nt, Human
cugcccugcccaccu

SEQ ID NO: 2216967 - RNA, 16 nt, Human
cugcccugcccaccug

SEQ ID NO: 2216968 - RNA, 19 nt, Human
cugccauuugcacccuccg

SEQ ID NO: 2216969 - RNA, 17 nt, Human
cugccauggaggcacac

SEQ ID NO: 2216970 - RNA, 16 nt, Human
cugccauuucugagau

SEQ ID NO: 2216971 - RNA, 21 nt, Human
cugccauuugcacccuccgcc

SEQ ID NO: 2216972 - RNA, 20 nt, Human
cugccauuugcacccuccgc

SEQ ID NO: 2216973 - RNA, 22 nt, Human
cugcccaaagugcuuccaaggc

SEQ ID NO: 2216974 - RNA, 17 nt, Human
cugcccaaaaauauggu

SEQ ID NO: 2216975 - RNA, 17 nt, Human
cugcccaaccugcucuc

SEQ ID NO: 2216976 - RNA, 20 nt, Human
cugcccaacccuucccucac

SEQ ID NO: 2216977 - RNA, 17 nt, Human
cugcccaacccuucccu

SEQ ID NO: 2216978 - RNA, 19 nt, Human
cugcccaggagagccagcc

SEQ ID NO: 2216979 - RNA, 18 nt, Human
cugcccaggagagccagc

SEQ ID NO: 2216980 - RNA, 17 nt, Human
cugcccaggagagccag

SEQ ID NO: 2216981 - RNA, 12 nt, Human
cugcccaggaga

SEQ ID NO: 2216982 - RNA, 22 nt, Human
cugcccaggagagccagcccuc

SEQ ID NO: 2216983 - RNA, 21 nt, Human
cugcccaggagagccagcccu

SEQ ID NO: 2216984 - RNA, 23 nt, Human
cugcccaggagagccagcccucc

SEQ ID NO: 2216985 - RNA, 13 nt, Human
cugcccaggcccc

SEQ ID NO: 2216986 - RNA, 15 nt, Human
cugcccagcuugggc

SEQ ID NO: 2216987 - RNA, 16 nt, Human
cugcccagcuugggcc

SEQ ID NO: 2216988 - RNA, 17 nt, Human
cugcccagcuugggccc

SEQ ID NO: 2216989 - RNA, 19 nt, Human
cugcccagcuugggcccag

SEQ ID NO: 2216990 - RNA, 20 nt, Human
cugcccagcuugggcccagc

SEQ ID NO: 2216991 - RNA, 11 nt, Human
cugcccaggag

SEQ ID NO: 2216992 - RNA, 21 nt, Human
cugcccaggacggggccggcc

SEQ ID NO: 2216993 - RNA, 20 nt, Human
cugcccaggacggggccggc

SEQ ID NO: 2216994 - RNA, 23 nt, Human
cugcccagcuugggcccagcugg

SEQ ID NO: 2216995 - RNA, 21 nt, Human
cugcccagcuugggcccagcu

SEQ ID NO: 2216996 - RNA, 22 nt, Human
cugcccagcuugggcccagcug

SEQ ID NO: 2216997 - RNA, 19 nt, Human
cugcccaggccugccuguu

SEQ ID NO: 2216998 - RNA, 16 nt, Human
cugcccaggggagccc

SEQ ID NO: 2216999 - RNA, 17 nt, Human
cugcccaggggagcccu

SEQ ID NO: 2217000 - RNA, 18 nt, Human
cugcccaggggagcccuc

SEQ ID NO: 2217001 - RNA, 22 nt, Human
cugcccaggggagcccuccacg

SEQ ID NO: 2217002 - RNA, 18 nt, Human
cugcccaggccugccugu

SEQ ID NO: 2217003 - RNA, 18 nt, Human
cugcccagucccccaacc

SEQ ID NO: 2217004 - RNA, 19 nt, Human
cugcccagucccccaaccc

SEQ ID NO: 2217005 - RNA, 21 nt, Human
cugcccaggggugcccccucc

SEQ ID NO: 2217006 - RNA, 22 nt, Human
cugcccaggggugcccccuccu

SEQ ID NO: 2217007 - RNA, 13 nt, Human
cugcccagucccc

SEQ ID NO: 2217008 - RNA, 14 nt, Human
cugcccaguccccc

SEQ ID NO: 2217009 - RNA, 13 nt, Human
cugcccaggggug

SEQ ID NO: 2217010 - RNA, 14 nt, Human
cugcccaggggugc

SEQ ID NO: 2217011 - RNA, 15 nt, Human
cugcccaggggugcc

SEQ ID NO: 2217012 - RNA, 16 nt, Human
cugcccaggggugccc

SEQ ID NO: 2217013 - RNA, 17 nt, Human
cugcccaggggugcccc

SEQ ID NO: 2217014 - RNA, 18 nt, Human
cugcccaggggugccccc

SEQ ID NO: 2217015 - RNA, 19 nt, Human
cugcccaggggugcccccu

SEQ ID NO: 2217016 - RNA, 20 nt, Human
cugcccaggggugcccccuc

SEQ ID NO: 2217017 - RNA, 14 nt, Human
cugccccuggcagc

SEQ ID NO: 2217018 - RNA, 15 nt, Human
cugccccuggcagcc

SEQ ID NO: 2217019 - RNA, 16 nt, Human
cugccccuggcagccc

SEQ ID NO: 2217020 - RNA, 17 nt, Human
cugccccuggcagcccc

SEQ ID NO: 2217021 - RNA, 17 nt, Human
cuggccaacaugguaaa

SEQ ID NO: 2217022 - RNA, 22 nt, Human
cuggccagaugcaccagcccuu

SEQ ID NO: 2217023 - RNA, 21 nt, Human
cuggccagaugcaccagcccu

SEQ ID NO: 2217024 - RNA, 18 nt, Human
cuggcccacagcaggugc

SEQ ID NO: 2217025 - RNA, 17 nt, Human
cuggccagaugcaccag

SEQ ID NO: 2217026 - RNA, 18 nt, Human
cuggccagaugcaccagc

SEQ ID NO: 2217027 - RNA, 19 nt, Human
cuggccagaugcaccagcc

SEQ ID NO: 2217028 - RNA, 20 nt, Human
cuggccagaugcaccagccc

SEQ ID NO: 2217029 - RNA, 16 nt, Human
cuggccagaugcacca

SEQ ID NO: 2217030 - RNA, 16 nt, Human
cuggccaacgggguga

SEQ ID NO: 2217031 - RNA, 23 nt, Human
cuggccaacaucgugaaacccug

SEQ ID NO: 2217032 - RNA, 19 nt, Human
cuggcauugucccugugcc

SEQ ID NO: 2217033 - RNA, 21 nt, Human
cuggcauuauguccacugugu

SEQ ID NO: 2217034 - RNA, 16 nt, Human
cuggcauugucccugu

SEQ ID NO: 2217035 - RNA, 17 nt, Human
cuggcauugucccugug

SEQ ID NO: 2217036 - RNA, 20 nt, Human
cuggcauuagaauuauuuaa

SEQ ID NO: 2217037 - RNA, 13 nt, Human
cuggcacugcugu

SEQ ID NO: 2217038 - RNA, 14 nt, Human
cuggcacugcugug

SEQ ID NO: 2217039 - RNA, 22 nt, Human
cuggcauuagaauuauuuaaac

SEQ ID NO: 2217040 - RNA, 16 nt, Human
cuggcacugcugugcu

SEQ ID NO: 2217041 - RNA, 19 nt, Human
cuggcauuauguccacugu

SEQ ID NO: 2217042 - RNA, 20 nt, Human
cuggcacugacugggcauag

SEQ ID NO: 2217043 - RNA, 19 nt, Human
cuggagggcuggaaucugg

SEQ ID NO: 2217044 - RNA, 19 nt, Human
cuggcacugaauuaaucau

SEQ ID NO: 2217045 - RNA, 17 nt, Human
cuggcacugcuuccagu

SEQ ID NO: 2217046 - RNA, 15 nt, Human
cuggcacugcuucca

SEQ ID NO: 2217047 - RNA, 16 nt, Human
cuggcacugcuuccag

SEQ ID NO: 2217048 - RNA, 19 nt, Human
cuggccucccacagacuca

SEQ ID NO: 2217049 - RNA, 13 nt, Human
cuggccucccacc

SEQ ID NO: 2217050 - RNA, 15 nt, Human
cuggccucccacccg

SEQ ID NO: 2217051 - RNA, 17 nt, Human
cuggccucccacccgau

SEQ ID NO: 2217052 - RNA, 22 nt, Human
cuggccucccacccgaugcugc

SEQ ID NO: 2217053 - RNA, 23 nt, Human
cuggccucccacccgaugcugcu

SEQ ID NO: 2217054 - RNA, 17 nt, Human
cuggccucccacagacu

SEQ ID NO: 2217055 - RNA, 17 nt, Human
cuggccuagucccuucc

SEQ ID NO: 2217056 - RNA, 22 nt, Human
cuggccucaagugauucuccug

SEQ ID NO: 2217057 - RNA, 23 nt, Human
cuggccuagcauacguacacauu

SEQ ID NO: 2217058 - RNA, 21 nt, Human
cuggccuaggagauaucugag

SEQ ID NO: 2217059 - RNA, 23 nt, Human
cuggccuaggagauaucugaggg

SEQ ID NO: 2217060 - RNA, 12 nt, Human
cuggccuagucc

SEQ ID NO: 2217061 - RNA, 23 nt, Human
cuggccuagucccuuccacaccc

SEQ ID NO: 2217062 - RNA, 17 nt, Human
cuggccucuggcucuca

SEQ ID NO: 2217063 - RNA, 13 nt, Human
cuggccucugugc

SEQ ID NO: 2217064 - RNA, 11 nt, Human
cuggccucugu

SEQ ID NO: 2217065 - RNA, 12 nt, Human
cuggccucgccu

SEQ ID NO: 2217066 - RNA, 16 nt, Human
cuggccucgccuggcc

SEQ ID NO: 2217067 - RNA, 17 nt, Human
cuggccucgccuggccu

SEQ ID NO: 2217068 - RNA, 18 nt, Human
cuggccucgccuggccug

SEQ ID NO: 2217069 - RNA, 19 nt, Human
cuggccucgccuggccuga

SEQ ID NO: 2217070 - RNA, 20 nt, Human
cuggccucgccuggccugag

SEQ ID NO: 2217071 - RNA, 16 nt, Human
cuggccuccccugcca

SEQ ID NO: 2217072 - RNA, 17 nt, Human
cuggccuccccugccac

SEQ ID NO: 2217073 - RNA, 18 nt, Human
cuggccuccccugccacc

SEQ ID NO: 2217074 - RNA, 21 nt, Human
cuggccuccccugccaccagg

SEQ ID NO: 2217075 - RNA, 20 nt, Human
cuggccuccggcgucagccu

SEQ ID NO: 2217076 - RNA, 21 nt, Human
cuggccuccggcgucagccuc

SEQ ID NO: 2217077 - RNA, 22 nt, Human
cuggccuccggcgucagccucc

SEQ ID NO: 2217078 - RNA, 13 nt, Human
cuggcccacugca

SEQ ID NO: 2217079 - RNA, 12 nt, Human
cuggcccacugc

SEQ ID NO: 2217080 - RNA, 20 nt, Human
cuggcccagccggccucucu

SEQ ID NO: 2217081 - RNA, 23 nt, Human
cuggcccagccggccucucuggc

SEQ ID NO: 2217082 - RNA, 21 nt, Human
cuggcccagccggccucucug

SEQ ID NO: 2217083 - RNA, 22 nt, Human
cuggcccagccggccucucugg

SEQ ID NO: 2217084 - RNA, 12 nt, Human
cuggcccagcgg

SEQ ID NO: 2217085 - RNA, 13 nt, Human
cuggcccagcggc

SEQ ID NO: 2217086 - RNA, 17 nt, Human
cuggccuagcauacgua

SEQ ID NO: 2217087 - RNA, 15 nt, Human
cuggcccagggccca

SEQ ID NO: 2217088 - RNA, 14 nt, Human
cuggcccagggccc

SEQ ID NO: 2217089 - RNA, 13 nt, Human
cuggcccagggcc

SEQ ID NO: 2217090 - RNA, 11 nt, Human
cuggcccaggg

SEQ ID NO: 2217091 - RNA, 22 nt, Human
cuggcccagcucccccgggagg

SEQ ID NO: 2217092 - RNA, 12 nt, Human
cuggcccagggc

SEQ ID NO: 2217093 - RNA, 14 nt, Human
cuggcccagcggcc

SEQ ID NO: 2217094 - RNA, 17 nt, Human
cuggcccagcggccccu

SEQ ID NO: 2217095 - RNA, 18 nt, Human
cuggcccagcggccccuc

SEQ ID NO: 2217096 - RNA, 19 nt, Human
cuggcccagcggccccucc

SEQ ID NO: 2217097 - RNA, 12 nt, Human
cuggcccagcuc

SEQ ID NO: 2217098 - RNA, 13 nt, Human
cuggcccagcucc

SEQ ID NO: 2217099 - RNA, 14 nt, Human
cuggcccagcuccc

SEQ ID NO: 2217100 - RNA, 15 nt, Human
cuggcccagcucccc

SEQ ID NO: 2217101 - RNA, 18 nt, Human
cuggcacaaacucuuggu

SEQ ID NO: 2217102 - RNA, 12 nt, Human
cuggcacacauc

SEQ ID NO: 2217103 - RNA, 16 nt, Human
cuggcacagaaaccuc

SEQ ID NO: 2217104 - RNA, 21 nt, Human
cuggcacacaucaggaguuca

SEQ ID NO: 2217105 - RNA, 21 nt, Human
cuggcacacaguaggugcuca

SEQ ID NO: 2217106 - RNA, 15 nt, Human
cuggcacagaaaccu

SEQ ID NO: 2217107 - RNA, 18 nt, Human
cuggcaaagacagaagcc

SEQ ID NO: 2217108 - RNA, 20 nt, Human
cuggcaaagcuuuuagaaau

SEQ ID NO: 2217109 - RNA, 19 nt, Human
cuggcaaagcuuuuagaaa

SEQ ID NO: 2217110 - RNA, 12 nt, Human
cuggcaaaggcc

SEQ ID NO: 2217111 - RNA, 18 nt, Human
cuggcaaagggagcagaa

SEQ ID NO: 2217112 - RNA, 22 nt, Human
cuggcaaugaaaaauucucagu

SEQ ID NO: 2217113 - RNA, 21 nt, Human
cuggcaaugaaaaauucucag

SEQ ID NO: 2217114 - RNA, 19 nt, Human
cuggcaaacuucagacuga

SEQ ID NO: 2217115 - RNA, 22 nt, Human
cuggcaaacaugaaaaaucggc

SEQ ID NO: 2217116 - RNA, 16 nt, Human
cuggcaaacaugaaaa

SEQ ID NO: 2217117 - RNA, 21 nt, Human
cuggcaaaaggaucuuugugg

SEQ ID NO: 2217118 - RNA, 23 nt, Human
cuggcaaaaggaucuuuguggcc

SEQ ID NO: 2217119 - RNA, 20 nt, Human
cuggcaaaaggaucuuugug

SEQ ID NO: 2217120 - RNA, 20 nt, Human
cuggauuggguuaugaauau

SEQ ID NO: 2217121 - RNA, 22 nt, Human
cuggauugaucggagccuccuc

SEQ ID NO: 2217122 - RNA, 19 nt, Human
cuggcaaaaggaucuuugu

SEQ ID NO: 2217123 - RNA, 13 nt, Human
cuggauuuuguca

SEQ ID NO: 2217124 - RNA, 23 nt, Human
cuggcacuauaauguaagcucua

SEQ ID NO: 2217125 - RNA, 15 nt, Human
cuggcacagugucug

SEQ ID NO: 2217126 - RNA, 19 nt, Human
cuggcacagugucugggcu

SEQ ID NO: 2217127 - RNA, 20 nt, Human
cuggcacagugucugggcug

SEQ ID NO: 2217128 - RNA, 21 nt, Human
cuggcacagugucugggcuga

SEQ ID NO: 2217129 - RNA, 13 nt, Human
cuggcacugcuuc

SEQ ID NO: 2217130 - RNA, 14 nt, Human
cuggcacugcuucc

SEQ ID NO: 2217131 - RNA, 17 nt, Human
cuggcacagggcagugg

SEQ ID NO: 2217132 - RNA, 12 nt, Human
cuggcacagucu

SEQ ID NO: 2217133 - RNA, 12 nt, Human
cuggcacagugu

SEQ ID NO: 2217134 - RNA, 14 nt, Human
cuggcacagugucu

SEQ ID NO: 2217135 - RNA, 19 nt, Human
cuggcacaguuuucugaga

SEQ ID NO: 2217136 - RNA, 18 nt, Human
cuggcacaguuuucugag

SEQ ID NO: 2217137 - RNA, 20 nt, Human
cuggauguuuuuucccuguu

SEQ ID NO: 2217138 - RNA, 15 nt, Human
cuggaugucugccaa

SEQ ID NO: 2217139 - RNA, 16 nt, Human
cuggauucauuuccug

SEQ ID NO: 2217140 - RNA, 18 nt, Human
cuggauucauuuccugcc

SEQ ID NO: 2217141 - RNA, 19 nt, Human
cuggauucauuuccugccc

SEQ ID NO: 2217142 - RNA, 14 nt, Human
cuggauucccagga

SEQ ID NO: 2217143 - RNA, 13 nt, Human
cuggauucccagg

SEQ ID NO: 2217144 - RNA, 23 nt, Human
cuggauuauucaaaaugauguau

SEQ ID NO: 2217145 - RNA, 19 nt, Human
cuggaugucugccaauuuu

SEQ ID NO: 2217146 - RNA, 17 nt, Human
cuggauuauauuaugaa

SEQ ID NO: 2217147 - RNA, 20 nt, Human
cuggaugguucccagagggu

SEQ ID NO: 2217148 - RNA, 19 nt, Human
cuggaugguucccagaggg

SEQ ID NO: 2217149 - RNA, 16 nt, Human
cuggauggggcugcac

SEQ ID NO: 2217150 - RNA, 23 nt, Human
cuggauuaaacuuaaucuaaaug

SEQ ID NO: 2217151 - RNA, 13 nt, Human
cuggauuaaacuu

SEQ ID NO: 2217152 - RNA, 21 nt, Human
cuggauggaggaaaaccaagc

SEQ ID NO: 2217153 - RNA, 21 nt, Human
cuggagggcuagaacuggaga

SEQ ID NO: 2217154 - RNA, 19 nt, Human
cuggagggcuagaaucugg

SEQ ID NO: 2217155 - RNA, 20 nt, Human
cuggagggcuagaaucugga

SEQ ID NO: 2217156 - RNA, 22 nt, Human
cuggagggcuagaaucuggaga

SEQ ID NO: 2217157 - RNA, 22 nt, Human
cuggagggaaugaaccuggagg

SEQ ID NO: 2217158 - RNA, 23 nt, Human
cuggagggaaugaaccuggaggg

SEQ ID NO: 2217159 - RNA, 20 nt, Human
cuggagggcuagaaccuaga

SEQ ID NO: 2217160 - RNA, 19 nt, Human
cuggagggcuagaaccugg

SEQ ID NO: 2217161 - RNA, 20 nt, Human
cuggagggcuagaaccugga

SEQ ID NO: 2217162 - RNA, 21 nt, Human
cuggagggcuagaaccuggag

SEQ ID NO: 2217163 - RNA, 22 nt, Human
cuggagggcuagaaccuggaga

SEQ ID NO: 2217164 - RNA, 22 nt, Human
cuggagggcuagaaccuggcag

SEQ ID NO: 2217165 - RNA, 18 nt, Human
cuggaugggcugcagcag

SEQ ID NO: 2217166 - RNA, 20 nt, Human
cuggaugggcugcagcagag

SEQ ID NO: 2217167 - RNA, 21 nt, Human
cuggauggauuugaagcaaag

SEQ ID NO: 2217168 - RNA, 15 nt, Human
cuggauggcaccaga

SEQ ID NO: 2217169 - RNA, 16 nt, Human
cuggauggcaccagag

SEQ ID NO: 2217170 - RNA, 23 nt, Human
cuggauggcaccagaggcugcag

SEQ ID NO: 2217171 - RNA, 15 nt, Human
cuggauggggcugca

SEQ ID NO: 2217172 - RNA, 21 nt, Human
cuggaggccgggugcucaggg

SEQ ID NO: 2217173 - RNA, 19 nt, Human
cuggagggaaugaaccugg

SEQ ID NO: 2217174 - RNA, 21 nt, Human
cuggagggaaugaaccuggag

SEQ ID NO: 2217175 - RNA, 14 nt, Human
cuggaggaggagca

SEQ ID NO: 2217176 - RNA, 14 nt, Human
cuggaggagagaag

SEQ ID NO: 2217177 - RNA, 17 nt, Human
cuggaggagagaagaau

SEQ ID NO: 2217178 - RNA, 22 nt, Human
cuggagccagacucuggucuuc

SEQ ID NO: 2217179 - RNA, 16 nt, Human
cuggagccagacucug

SEQ ID NO: 2217180 - RNA, 21 nt, Human
cuggagccagacucuggucuu

SEQ ID NO: 2217181 - RNA, 13 nt, Human
cuggagcccacug

SEQ ID NO: 2217182 - RNA, 15 nt, Human
cuggagccacuaacu

SEQ ID NO: 2217183 - RNA, 17 nt, Human
cuggagccaaguccaga

SEQ ID NO: 2217184 - RNA, 19 nt, Human
cuggagccaaguccagauu

SEQ ID NO: 2217185 - RNA, 16 nt, Human
cuggagccacuaacua

SEQ ID NO: 2217186 - RNA, 18 nt, Human
cuggagccacuaacuaga

SEQ ID NO: 2217187 - RNA, 17 nt, Human
cuggagccaacugcugc

SEQ ID NO: 2217188 - RNA, 22 nt, Human
cuggagcaucugacucacaaga

SEQ ID NO: 2217189 - RNA, 23 nt, Human
cuggagcaucugacucacaagaa

SEQ ID NO: 2217190 - RNA, 18 nt, Human
cuggagccaacugcugcu

SEQ ID NO: 2217191 - RNA, 20 nt, Human
cuggagccaacugcugcuuu

SEQ ID NO: 2217192 - RNA, 15 nt, Human
cuggagccaagucca

SEQ ID NO: 2217193 - RNA, 16 nt, Human
cuggagccaaguccag

SEQ ID NO: 2217194 - RNA, 15 nt, Human
cuggagcccacugua

SEQ ID NO: 2217195 - RNA, 16 nt, Human
cuggagcccacuguac

SEQ ID NO: 2217196 - RNA, 17 nt, Human
cuggagcccacuguacu

SEQ ID NO: 2217197 - RNA, 20 nt, Human
cuggagcccacuguacuugc

SEQ ID NO: 2217198 - RNA, 23 nt, Human
cuggagccuguguaacagcuccu

SEQ ID NO: 2217199 - RNA, 24 nt, Human
cuggagccuguguaacagcuccuu

SEQ ID NO: 2217200 - RNA, 19 nt, Human
cuggagcuggcgucugucu

SEQ ID NO: 2217201 - RNA, 17 nt, Human
cuggaggaaaacugaga

SEQ ID NO: 2217202 - RNA, 14 nt, Human
cuggaggaaaacug

SEQ ID NO: 2217203 - RNA, 19 nt, Human
cuggaggaaaacugagacu

SEQ ID NO: 2217204 - RNA, 19 nt, Human
cuggaggacuagaaccugg

SEQ ID NO: 2217205 - RNA, 20 nt, Human
cuggaggacuagaaccugga

SEQ ID NO: 2217206 - RNA, 21 nt, Human
cuggaggacuagaaccuggag

SEQ ID NO: 2217207 - RNA, 22 nt, Human
cuggaggacuagaaccuggagg

SEQ ID NO: 2217208 - RNA, 13 nt, Human
cuggaggagagaa

SEQ ID NO: 2217209 - RNA, 21 nt, Human
cuggagcccacuguacuugcu

SEQ ID NO: 2217210 - RNA, 16 nt, Human
cuggagcccagaggag

SEQ ID NO: 2217211 - RNA, 17 nt, Human
cuggagcccagaggagg

SEQ ID NO: 2217212 - RNA, 12 nt, Human
cuggagccugug

SEQ ID NO: 2217213 - RNA, 13 nt, Human
cuggagccugugu

SEQ ID NO: 2217214 - RNA, 14 nt, Human
cuggagccugugua

SEQ ID NO: 2217215 - RNA, 15 nt, Human
cuggagccuguguaa

SEQ ID NO: 2217216 - RNA, 16 nt, Human
cuggagccuguguaac

SEQ ID NO: 2217217 - RNA, 17 nt, Human
cuggagccuguguaaca

SEQ ID NO: 2217218 - RNA, 18 nt, Human
cuggagccuguguaacag

SEQ ID NO: 2217219 - RNA, 19 nt, Human
cuggagccuguguaacagc

SEQ ID NO: 2217220 - RNA, 22 nt, Human
cuggagccuguguaacagcucc

SEQ ID NO: 2217221 - RNA, 23 nt, Human
cuggacuagagggaccucuccca

SEQ ID NO: 2217222 - RNA, 21 nt, Human
cuggacuagagggaccucucc

SEQ ID NO: 2217223 - RNA, 20 nt, Human
cuggacuagagggaccucuc

SEQ ID NO: 2217224 - RNA, 23 nt, Human
cuggacggggacuggggaugugg

SEQ ID NO: 2217225 - RNA, 22 nt, Human
cuggacucaggaugcccagggc

SEQ ID NO: 2217226 - RNA, 20 nt, Human
cuggacucaggaugcccagg

SEQ ID NO: 2217227 - RNA, 19 nt, Human
cuggacucaggaugcccag

SEQ ID NO: 2217228 - RNA, 13 nt, Human
cuggacucaggau

SEQ ID NO: 2217229 - RNA, 16 nt, Human
cuggacucaccucccc

SEQ ID NO: 2217230 - RNA, 20 nt, Human
cuggacggcauuccugcuua

SEQ ID NO: 2217231 - RNA, 15 nt, Human
cuggacggggacugg

SEQ ID NO: 2217232 - RNA, 18 nt, Human
cuggacggggacugggga

SEQ ID NO: 2217233 - RNA, 19 nt, Human
cuggacggcauuccugcuu

SEQ ID NO: 2217234 - RNA, 17 nt, Human
cuggacggcauuccugc

SEQ ID NO: 2217235 - RNA, 15 nt, Human
cuggacggcauuccu

SEQ ID NO: 2217236 - RNA, 21 nt, Human
cuggaccaacccuguuuccug

SEQ ID NO: 2217237 - RNA, 22 nt, Human
cuggaccaacccuguuuccuga

SEQ ID NO: 2217238 - RNA, 23 nt, Human
cuggaccaacccuguuuccugag

SEQ ID NO: 2217239 - RNA, 15 nt, Human
cuggaccacugggca

SEQ ID NO: 2217240 - RNA, 14 nt, Human
cuggaccacugggc

SEQ ID NO: 2217241 - RNA, 18 nt, Human
cuggacauuugccuugcu

SEQ ID NO: 2217242 - RNA, 18 nt, Human
cuggacauccucuucugc

SEQ ID NO: 2217243 - RNA, 17 nt, Human
cuggacauuuuuucagu

SEQ ID NO: 2217244 - RNA, 23 nt, Human
cuggacaugaagauucuuuccca

SEQ ID NO: 2217245 - RNA, 18 nt, Human
cuggacauagagagggag

SEQ ID NO: 2217246 - RNA, 23 nt, Human
cuggacauagagagggagaagaa

SEQ ID NO: 2217247 - RNA, 20 nt, Human
cuggacaguaucacugucuu

SEQ ID NO: 2217248 - RNA, 17 nt, Human
cuggacauagagaggga

SEQ ID NO: 2217249 - RNA, 19 nt, Human
cuggacaguaucacugucu

SEQ ID NO: 2217250 - RNA, 23 nt, Human
cuggagcaccaggcacgaaccca

SEQ ID NO: 2217251 - RNA, 15 nt, Human
cuggagcaccaggca

SEQ ID NO: 2217252 - RNA, 14 nt, Human
cuggagcaccaggc

SEQ ID NO: 2217253 - RNA, 23 nt, Human
cuggagaguucaauggcugcuga

SEQ ID NO: 2217254 - RNA, 20 nt, Human
cuggagaguucaauggcugc

SEQ ID NO: 2217255 - RNA, 13 nt, Human
cuggagcaccagg

SEQ ID NO: 2217256 - RNA, 13 nt, Human
cuggagcagacca

SEQ ID NO: 2217257 - RNA, 15 nt, Human
cuggagcagaccacc

SEQ ID NO: 2217258 - RNA, 18 nt, Human
cuggagcagaccaccccg

SEQ ID NO: 2217259 - RNA, 22 nt, Human
cuggagcagaccaccccgccug

SEQ ID NO: 2217260 - RNA, 12 nt, Human
cuggagcaggcc

SEQ ID NO: 2217261 - RNA, 16 nt, Human
cuggagcaggccuugc

SEQ ID NO: 2217262 - RNA, 21 nt, Human
cuggagcaggccuugcgcugu

SEQ ID NO: 2217263 - RNA, 12 nt, Human
cuggagcaucug

SEQ ID NO: 2217264 - RNA, 16 nt, Human
cuggagcaucugacuc

SEQ ID NO: 2217265 - RNA, 17 nt, Human
cuggagcaucugacuca

SEQ ID NO: 2217266 - RNA, 21 nt, Human
cuggagagguuauaggucacu

SEQ ID NO: 2217267 - RNA, 12 nt, Human
cuggagagguua

SEQ ID NO: 2217268 - RNA, 22 nt, Human
cuggagaggcccucuggagugg

SEQ ID NO: 2217269 - RNA, 23 nt, Human
cuggagaggagggaugcugccug

SEQ ID NO: 2217270 - RNA, 22 nt, Human
cuggagagcuagaaccuggagg

SEQ ID NO: 2217271 - RNA, 23 nt, Human
cuggagagcuagaaccuggaggg

SEQ ID NO: 2217272 - RNA, 13 nt, Human
cuggagagcuaga

SEQ ID NO: 2217273 - RNA, 19 nt, Human
cuggagagcuagaaccugg

SEQ ID NO: 2217274 - RNA, 20 nt, Human
cuggagagcuagaaccugga

SEQ ID NO: 2217275 - RNA, 22 nt, Human
cuggagagcuagaaccuggaga

SEQ ID NO: 2217276 - RNA, 21 nt, Human
cuggagacuuagggcaccagg

SEQ ID NO: 2217277 - RNA, 12 nt, Human
cuggagagaagu

SEQ ID NO: 2217278 - RNA, 14 nt, Human
cuggagagaaacaa

SEQ ID NO: 2217279 - RNA, 22 nt, Human
cuggagagaaacaauaaagaga

SEQ ID NO: 2217280 - RNA, 22 nt, Human
cuggagagccagaaccuggagg

SEQ ID NO: 2217281 - RNA, 23 nt, Human
cuggagagccagaaccuggaggg

SEQ ID NO: 2217282 - RNA, 17 nt, Human
cuggagagaaguuucug

SEQ ID NO: 2217283 - RNA, 19 nt, Human
cuggagagccagaaccugg

SEQ ID NO: 2217284 - RNA, 21 nt, Human
cugcuuugggcugcccuggug

SEQ ID NO: 2217285 - RNA, 22 nt, Human
cugcuuugggcugcccuggugc

SEQ ID NO: 2217286 - RNA, 23 nt, Human
cugcuuugggcugcccuggugcu

SEQ ID NO: 2217287 - RNA, 15 nt, Human
cugcuuuucccuaag

SEQ ID NO: 2217288 - RNA, 18 nt, Human
cugcuuuucacugcugca

SEQ ID NO: 2217289 - RNA, 14 nt, Human
cugcuuuuaccaug

SEQ ID NO: 2217290 - RNA, 17 nt, Human
cugcuuuucacugcugc

SEQ ID NO: 2217291 - RNA, 21 nt, Human
cugcuuuucccuaagccaagg

SEQ ID NO: 2217292 - RNA, 18 nt, Human
cugcuuuucccuaagcca

SEQ ID NO: 2217293 - RNA, 15 nt, Human
cugcuuuucacugcu

SEQ ID NO: 2217294 - RNA, 17 nt, Human
cugcuuuuaccaugccc

SEQ ID NO: 2217295 - RNA, 19 nt, Human
cugcuuugggcugcccugg

SEQ ID NO: 2217296 - RNA, 20 nt, Human
cugcuuugggcugcccuggu

SEQ ID NO: 2217297 - RNA, 18 nt, Human
cugcuuugggcugcccug

SEQ ID NO: 2217298 - RNA, 12 nt, Human
cugcuuuccaca

SEQ ID NO: 2217299 - RNA, 14 nt, Human
cugcuuuccccugu

SEQ ID NO: 2217300 - RNA, 15 nt, Human
cugcuuuccccugug

SEQ ID NO: 2217301 - RNA, 16 nt, Human
cugcuuuccccugugg

SEQ ID NO: 2217302 - RNA, 17 nt, Human
cugcuuuccccuguggg

SEQ ID NO: 2217303 - RNA, 18 nt, Human
cugcuuuccccugugggg

SEQ ID NO: 2217304 - RNA, 22 nt, Human
cugcuuucuccauuguaaacca

SEQ ID NO: 2217305 - RNA, 19 nt, Human
cugcuuuccccugugggga

SEQ ID NO: 2217306 - RNA, 20 nt, Human
cugcuuuccccuguggggau

SEQ ID NO: 2217307 - RNA, 21 nt, Human
cugcuuuccccuguggggauc

SEQ ID NO: 2217308 - RNA, 16 nt, Human
cugcuuucuccauugu

SEQ ID NO: 2217309 - RNA, 22 nt, Human
cugcucugaggcuuccagagag

SEQ ID NO: 2217310 - RNA, 20 nt, Human
cugcucugaggcuuccagag

SEQ ID NO: 2217311 - RNA, 21 nt, Human
cugcucugaggcuuccagaga

SEQ ID NO: 2217312 - RNA, 12 nt, Human
cugcucugauga

SEQ ID NO: 2217313 - RNA, 13 nt, Human
cugcucugaggcu

SEQ ID NO: 2217314 - RNA, 18 nt, Human
cugcucugaggcuuccag

SEQ ID NO: 2217315 - RNA, 19 nt, Human
cugcucugaggcuuccaga

SEQ ID NO: 2217316 - RNA, 14 nt, Human
cugcucuuucucug

SEQ ID NO: 2217317 - RNA, 15 nt, Human
cugcucuuucucugc

SEQ ID NO: 2217318 - RNA, 16 nt, Human
cugcucuuucucugcc

SEQ ID NO: 2217319 - RNA, 17 nt, Human
cugcucuuucucugcca

SEQ ID NO: 2217320 - RNA, 18 nt, Human
cugcucuuucucugccag

SEQ ID NO: 2217321 - RNA, 19 nt, Human
cugcucuuucucugccagu

SEQ ID NO: 2217322 - RNA, 20 nt, Human
cugcucuuucucugccagug

SEQ ID NO: 2217323 - RNA, 21 nt, Human
cugcucuuucucugccaguga

SEQ ID NO: 2217324 - RNA, 14 nt, Human
cugcucuuguuucu

SEQ ID NO: 2217325 - RNA, 22 nt, Human
cugcucuuucucugccagugac

SEQ ID NO: 2217326 - RNA, 18 nt, Human
cugcugaaacaacaaaua

SEQ ID NO: 2217327 - RNA, 13 nt, Human
cugcugaaacaac

SEQ ID NO: 2217328 - RNA, 17 nt, Human
cugcuuuccaaagccaa

SEQ ID NO: 2217329 - RNA, 15 nt, Human
cugcuuuccaaagcc

SEQ ID NO: 2217330 - RNA, 23 nt, Human
cugcuuuuccuuggggcaggcag

SEQ ID NO: 2217331 - RNA, 22 nt, Human
cugcuuuuccuuggggcaggca

SEQ ID NO: 2217332 - RNA, 21 nt, Human
cugcuuuuccuuggggcaggc

SEQ ID NO: 2217333 - RNA, 14 nt, Human
cugcuuuucugccc

SEQ ID NO: 2217334 - RNA, 15 nt, Human
cugcuuuucugcccu

SEQ ID NO: 2217335 - RNA, 16 nt, Human
cugcuuuucugcccug

SEQ ID NO: 2217336 - RNA, 17 nt, Human
cugcuuuucugcccugg

SEQ ID NO: 2217337 - RNA, 15 nt, Human
cuggaagcacagcuu

SEQ ID NO: 2217338 - RNA, 18 nt, Human
cuggaagcacagcuucau

SEQ ID NO: 2217339 - RNA, 15 nt, Human
cuggaagcacauguu

SEQ ID NO: 2217340 - RNA, 18 nt, Human
cugcuuuucugcccuggc

SEQ ID NO: 2217341 - RNA, 12 nt, Human
cuggaagcacau

SEQ ID NO: 2217342 - RNA, 23 nt, Human
cuggaagcauguaggagaaucca

SEQ ID NO: 2217343 - RNA, 21 nt, Human
cuggaagugcuaauuuugaaa

SEQ ID NO: 2217344 - RNA, 23 nt, Human
cuggaauaauccuaaacauauga

SEQ ID NO: 2217345 - RNA, 20 nt, Human
cuggaaguuuugcauuuaug

SEQ ID NO: 2217346 - RNA, 17 nt, Human
cuggaaguuuugcauuu

SEQ ID NO: 2217347 - RNA, 15 nt, Human
cuggaauacaugaaa

SEQ ID NO: 2217348 - RNA, 14 nt, Human
cuggaauaaguuca

SEQ ID NO: 2217349 - RNA, 14 nt, Human
cuggaaugcagugg

SEQ ID NO: 2217350 - RNA, 15 nt, Human
cuggaaugcaguggu

SEQ ID NO: 2217351 - RNA, 14 nt, Human
cuggaauguaauca

SEQ ID NO: 2217352 - RNA, 20 nt, Human
cuggaauggaaggguucugg

SEQ ID NO: 2217353 - RNA, 15 nt, Human
cuggaauguaaucaa

SEQ ID NO: 2217354 - RNA, 20 nt, Human
cuggaauguaaucaauguuu

SEQ ID NO: 2217355 - RNA, 19 nt, Human
cuggacagccccacccugg

SEQ ID NO: 2217356 - RNA, 18 nt, Human
cuggacagccccacccug

SEQ ID NO: 2217357 - RNA, 16 nt, Human
cuggacagccccaccc

SEQ ID NO: 2217358 - RNA, 15 nt, Human
cuggacagccccacc

SEQ ID NO: 2217359 - RNA, 14 nt, Human
cuggacagccccac

SEQ ID NO: 2217360 - RNA, 13 nt, Human
cuggacagcccca

SEQ ID NO: 2217361 - RNA, 21 nt, Human
cuggaauguaaucaauguuuc

SEQ ID NO: 2217362 - RNA, 18 nt, Human
cuggacacucagaccuga

SEQ ID NO: 2217363 - RNA, 16 nt, Human
cugggcacacgccucc

SEQ ID NO: 2217364 - RNA, 17 nt, Human
cugggcacacgccuccc

SEQ ID NO: 2217365 - RNA, 22 nt, Human
cugggcacacgccucccacugg

SEQ ID NO: 2217366 - RNA, 23 nt, Human
cugggcacacgccucccacuggg

SEQ ID NO: 2217367 - RNA, 20 nt, Human
cugggcaaugugauaaaacc

SEQ ID NO: 2217368 - RNA, 10 nt, Human
cugggccccu

SEQ ID NO: 2217369 - RNA, 20 nt, Human
cugggccccucaucugcuca

SEQ ID NO: 2217370 - RNA, 21 nt, Human
cugggccccucaucugcucag

SEQ ID NO: 2217371 - RNA, 12 nt, Human
cugggccccugc

SEQ ID NO: 2217372 - RNA, 16 nt, Human
cugggccccugccucu

SEQ ID NO: 2217373 - RNA, 17 nt, Human
cugggccccugccucuc

SEQ ID NO: 2217374 - RNA, 13 nt, Human
cugggagggccca

SEQ ID NO: 2217375 - RNA, 22 nt, Human
cugggagggcagcagggcuacc

SEQ ID NO: 2217376 - RNA, 22 nt, Human
cugggagggguuuucgaagcuc

SEQ ID NO: 2217377 - RNA, 20 nt, Human
cugggagggcccacuucagg

SEQ ID NO: 2217378 - RNA, 23 nt, Human
cugggaguugaucgccuuuccca

SEQ ID NO: 2217379 - RNA, 16 nt, Human
cugggagugagcuggu

SEQ ID NO: 2217380 - RNA, 13 nt, Human
cugggagugagcu

SEQ ID NO: 2217381 - RNA, 12 nt, Human
cugggagugagc

SEQ ID NO: 2217382 - RNA, 21 nt, Human
cugggauuacaggcgugagcc

SEQ ID NO: 2217383 - RNA, 20 nt, Human
cugggauuacaggcuccugc

SEQ ID NO: 2217384 - RNA, 19 nt, Human
cugggauuacaggcuccug

SEQ ID NO: 2217385 - RNA, 23 nt, Human
cugggauuacaggcuccugccac

SEQ ID NO: 2217386 - RNA, 19 nt, Human
cugggcaaugauggcaauu

SEQ ID NO: 2217387 - RNA, 22 nt, Human
cugggauuacaggcuccugcca

SEQ ID NO: 2217388 - RNA, 21 nt, Human
cugggauuacaggcuccugcc

SEQ ID NO: 2217389 - RNA, 22 nt, Human
cugggaggcauggcccuggggu

SEQ ID NO: 2217390 - RNA, 22 nt, Human
cugggaggcggagaguacagug

SEQ ID NO: 2217391 - RNA, 22 nt, Human
cugggaggcucuggagcccacu

SEQ ID NO: 2217392 - RNA, 23 nt, Human
cugggagggauagaggggggcug

SEQ ID NO: 2217393 - RNA, 13 nt, Human
cugggagggcagc

SEQ ID NO: 2217394 - RNA, 11 nt, Human
cugggagggca

SEQ ID NO: 2217395 - RNA, 18 nt, Human
cugggaggucaaggcugc

SEQ ID NO: 2217396 - RNA, 20 nt, Human
cugggagggcagcagggcua

SEQ ID NO: 2217397 - RNA, 19 nt, Human
cugggagggcagcagggcu

SEQ ID NO: 2217398 - RNA, 17 nt, Human
cugggagggcagcaggg

SEQ ID NO: 2217399 - RNA, 15 nt, Human
cugggagggcagcag

SEQ ID NO: 2217400 - RNA, 14 nt, Human
cugggaggaagcag

SEQ ID NO: 2217401 - RNA, 13 nt, Human
cugggaggaagca

SEQ ID NO: 2217402 - RNA, 14 nt, Human
cugggaggcaguga

SEQ ID NO: 2217403 - RNA, 15 nt, Human
cugggaggaagcagg

SEQ ID NO: 2217404 - RNA, 13 nt, Human
cugggaggcaugg

SEQ ID NO: 2217405 - RNA, 19 nt, Human
cugggaggcauggcccugg

SEQ ID NO: 2217406 - RNA, 16 nt, Human
cugggaggcagugaug

SEQ ID NO: 2217407 - RNA, 15 nt, Human
cugggaggcucugga

SEQ ID NO: 2217408 - RNA, 16 nt, Human
cugggaggcucuggag

SEQ ID NO: 2217409 - RNA, 22 nt, Human
cugggaggaaaagaaaagaggg

SEQ ID NO: 2217410 - RNA, 13 nt, Human
cugggaggaaaag

SEQ ID NO: 2217411 - RNA, 14 nt, Human
cugggagcucugca

SEQ ID NO: 2217412 - RNA, 15 nt, Human
cugggagcucugcag

SEQ ID NO: 2217413 - RNA, 22 nt, Human
cugggaagauaggcucugcaca

SEQ ID NO: 2217414 - RNA, 21 nt, Human
cugggaagauaggcucugcac

SEQ ID NO: 2217415 - RNA, 20 nt, Human
cugggaagauaggcucugca

SEQ ID NO: 2217416 - RNA, 18 nt, Human
cugggaagauaggcucug

SEQ ID NO: 2217417 - RNA, 24 nt, Human
cugggaagauaggcucugcacaga

SEQ ID NO: 2217418 - RNA, 13 nt, Human
cugggagcucugc

SEQ ID NO: 2217419 - RNA, 13 nt, Human
cugggaagggaag

SEQ ID NO: 2217420 - RNA, 23 nt, Human
cugggagcuccacucugcuucuc

SEQ ID NO: 2217421 - RNA, 17 nt, Human
cugggaagauaggcucu

SEQ ID NO: 2217422 - RNA, 19 nt, Human
cugggaagacgccugagcu

SEQ ID NO: 2217423 - RNA, 21 nt, Human
cugggaacugcagaccugucc

SEQ ID NO: 2217424 - RNA, 23 nt, Human
cugggaacugcagaccuguccuc

SEQ ID NO: 2217425 - RNA, 20 nt, Human
cugggaacucaccuggggcu

SEQ ID NO: 2217426 - RNA, 18 nt, Human
cugggaacugcagaccug

SEQ ID NO: 2217427 - RNA, 19 nt, Human
cugggaacugcagaccugu

SEQ ID NO: 2217428 - RNA, 20 nt, Human
cugggaacugcagaccuguc

SEQ ID NO: 2217429 - RNA, 15 nt, Human
cugggaacugcagac

SEQ ID NO: 2217430 - RNA, 17 nt, Human
cugggaacucaccuggg

SEQ ID NO: 2217431 - RNA, 23 nt, Human
cugggaaauggcuugaagccaag

SEQ ID NO: 2217432 - RNA, 22 nt, Human
cugggaacccaaguccaagcau

SEQ ID NO: 2217433 - RNA, 15 nt, Human
cuggcuuuucacugc

SEQ ID NO: 2217434 - RNA, 16 nt, Human
cuggcuuuucacugcu

SEQ ID NO: 2217435 - RNA, 20 nt, Human
cuggcuucuggagcccuugg

SEQ ID NO: 2217436 - RNA, 16 nt, Human
cuggcuucuggagccc

SEQ ID NO: 2217437 - RNA, 15 nt, Human
cuggcuucuggagcc

SEQ ID NO: 2217438 - RNA, 14 nt, Human
cuggcuucuggagc

SEQ ID NO: 2217439 - RNA, 18 nt, Human
cuggcuuccuucucucaa

SEQ ID NO: 2217440 - RNA, 16 nt, Human
cuggcuucgcaaaaug

SEQ ID NO: 2217441 - RNA, 12 nt, Human
cuggcuucuccu

SEQ ID NO: 2217442 - RNA, 16 nt, Human
cuggcuucuccuuugg

SEQ ID NO: 2217443 - RNA, 17 nt, Human
cugggaaauaagagaga

SEQ ID NO: 2217444 - RNA, 16 nt, Human
cugggaaauaagagag

SEQ ID NO: 2217445 - RNA, 16 nt, Human
cugggaaauauucccu

SEQ ID NO: 2217446 - RNA, 18 nt, Human
cugggaaauauucccuag

SEQ ID NO: 2217447 - RNA, 19 nt, Human
cugggaaaugagaaggcag

SEQ ID NO: 2217448 - RNA, 20 nt, Human
cugggaaaugagaaggcagc

SEQ ID NO: 2217449 - RNA, 19 nt, Human
cugggaacaccauagguca

SEQ ID NO: 2217450 - RNA, 23 nt, Human
cugggaaaugagaaggcagccac

SEQ ID NO: 2217451 - RNA, 21 nt, Human
cugggaaaugagaaggcagcc

SEQ ID NO: 2217452 - RNA, 22 nt, Human
cugggaaaugagaaggcagcca

SEQ ID NO: 2217453 - RNA, 17 nt, Human
cuggcuuuucacugcug

SEQ ID NO: 2217454 - RNA, 19 nt, Human
cuggcuuuucacugcuggc

SEQ ID NO: 2217455 - RNA, 20 nt, Human
cuggcuuuucacugcuggcu

SEQ ID NO: 2217456 - RNA, 22 nt, Human
cuggcuuuucacugcuggcugc

SEQ ID NO: 2217457 - RNA, 20 nt, Human
cuggcuguuggcugggggcc

SEQ ID NO: 2217458 - RNA, 14 nt, Human
cuggcuucacagau

SEQ ID NO: 2217459 - RNA, 13 nt, Human
cuggcuucaggag

SEQ ID NO: 2217460 - RNA, 12 nt, Human
cuggcuuccagg

SEQ ID NO: 2217461 - RNA, 14 nt, Human
cuggcuuccaggua

SEQ ID NO: 2217462 - RNA, 15 nt, Human
cuggcuuccagguau

SEQ ID NO: 2217463 - RNA, 23 nt, Human
cuggcuuccagguaucuccagga

SEQ ID NO: 2217464 - RNA, 16 nt, Human
cuggcuuccagguauc

SEQ ID NO: 2217465 - RNA, 22 nt, Human
cuggcuuccagguaucuccagg

SEQ ID NO: 2217466 - RNA, 23 nt, Human
cuggcuggggccuaucagugugc

SEQ ID NO: 2217467 - RNA, 24 nt, Human
cuggcuggggccuaucagugugcc

SEQ ID NO: 2217468 - RNA, 13 nt, Human
cuggcuggggccu

SEQ ID NO: 2217469 - RNA, 18 nt, Human
cuggcuggggccuaucag

SEQ ID NO: 2217470 - RNA, 21 nt, Human
cuggcuggggccuaucagugu

SEQ ID NO: 2217471 - RNA, 22 nt, Human
cuggcuggggccuaucagugug

SEQ ID NO: 2217472 - RNA, 21 nt, Human
cuggcuggguggcaccagcag

SEQ ID NO: 2217473 - RNA, 22 nt, Human
cuggcuggguggcaccagcagc

SEQ ID NO: 2217474 - RNA, 19 nt, Human
cuggcuguuggcugggggc

SEQ ID NO: 2217475 - RNA, 14 nt, Human
cuggcugccuuaga

SEQ ID NO: 2217476 - RNA, 19 nt, Human
cuggcugccuuagaaccuu

SEQ ID NO: 2217477 - RNA, 20 nt, Human
cuggcugcccuggcccugag

SEQ ID NO: 2217478 - RNA, 23 nt, Human
cuggcugcccuggcccugaggug

SEQ ID NO: 2217479 - RNA, 15 nt, Human
cuggcugccuccacu

SEQ ID NO: 2217480 - RNA, 16 nt, Human
cuggcugccuccacuc

SEQ ID NO: 2217481 - RNA, 18 nt, Human
cuggcugccuccacuccc

SEQ ID NO: 2217482 - RNA, 20 nt, Human
cuggcugccuccacucccac

SEQ ID NO: 2217483 - RNA, 21 nt, Human
cuggcugccuccacucccacu

SEQ ID NO: 2217484 - RNA, 22 nt, Human
cuggcugccuccacucccacuu

SEQ ID NO: 2217485 - RNA, 17 nt, Human
cuggcugggcauggacg

SEQ ID NO: 2217486 - RNA, 15 nt, Human
cuggcugggcaugga

SEQ ID NO: 2217487 - RNA, 14 nt, Human
cuggcugggcaugg

SEQ ID NO: 2217488 - RNA, 12 nt, Human
cuggcugcugcc

SEQ ID NO: 2217489 - RNA, 13 nt, Human
cuggcugcugccc

SEQ ID NO: 2217490 - RNA, 14 nt, Human
cuggcugcugcccc

SEQ ID NO: 2217491 - RNA, 15 nt, Human
cuggcugcugccccc

SEQ ID NO: 2217492 - RNA, 20 nt, Human
cuggcucuugugcuggaugg

SEQ ID NO: 2217493 - RNA, 17 nt, Human
cuggcucuugugcugga

SEQ ID NO: 2217494 - RNA, 22 nt, Human
cuggcucuuuggagaucaagga

SEQ ID NO: 2217495 - RNA, 13 nt, Human
cuggcugaacccu

SEQ ID NO: 2217496 - RNA, 16 nt, Human
cuggcugaacccugug

SEQ ID NO: 2217497 - RNA, 17 nt, Human
cuggcugaacccugugc

SEQ ID NO: 2217498 - RNA, 18 nt, Human
cuggcugaacccugugcu

SEQ ID NO: 2217499 - RNA, 19 nt, Human
cuggcugaacccugugcug

SEQ ID NO: 2217500 - RNA, 20 nt, Human
cuggcugaacccugugcugg

SEQ ID NO: 2217501 - RNA, 21 nt, Human
cuggcugaacccugugcuggu

SEQ ID NO: 2217502 - RNA, 23 nt, Human
cuggcugaacccugugcuggugu

SEQ ID NO: 2217503 - RNA, 12 nt, Human
cuggcugaagga

SEQ ID NO: 2217504 - RNA, 13 nt, Human
cuggcugaaggac

SEQ ID NO: 2217505 - RNA, 14 nt, Human
cuggcugaaggacu

SEQ ID NO: 2217506 - RNA, 15 nt, Human
cuggcugaaggacug

SEQ ID NO: 2217507 - RNA, 16 nt, Human
cuggcugaaggacugu

SEQ ID NO: 2217508 - RNA, 17 nt, Human
cuggcugaaggacugug

SEQ ID NO: 2217509 - RNA, 19 nt, Human
cuggcugaccccaaagagc

SEQ ID NO: 2217510 - RNA, 22 nt, Human
cuggcugaccccaaagagccug

SEQ ID NO: 2217511 - RNA, 23 nt, Human
cuggcugaccccaaagagccugg

SEQ ID NO: 2217512 - RNA, 12 nt, Human
cuggcugagccc

SEQ ID NO: 2217513 - RNA, 14 nt, Human
cuggcugagcccug

SEQ ID NO: 2217514 - RNA, 16 nt, Human
cuggcugagccuggcu

SEQ ID NO: 2217515 - RNA, 17 nt, Human
cuggcugagccuggcug

SEQ ID NO: 2217516 - RNA, 13 nt, Human
cuggcugcccugg

SEQ ID NO: 2217517 - RNA, 14 nt, Human
cuggcugcccuggc

SEQ ID NO: 2217518 - RNA, 15 nt, Human
cuggcugcccuggcc

SEQ ID NO: 2217519 - RNA, 16 nt, Human
cuggcugcccuggccc

SEQ ID NO: 2217520 - RNA, 17 nt, Human
cuggcugcccuggcccu

SEQ ID NO: 2217521 - RNA, 18 nt, Human
cuggcugcccuggcccug

SEQ ID NO: 2217522 - RNA, 19 nt, Human
cuggcugcccuggcccuga

SEQ ID NO: 2217523 - RNA, 17 nt, Human
cuggcucuuccaggcug

SEQ ID NO: 2217524 - RNA, 13 nt, Human
cuggccugagcug

SEQ ID NO: 2217525 - RNA, 20 nt, Human
cuggccucugugccuucuuu

SEQ ID NO: 2217526 - RNA, 16 nt, Human
cuggccucugugccuu

SEQ ID NO: 2217527 - RNA, 15 nt, Human
cuggccucugugccu

SEQ ID NO: 2217528 - RNA, 14 nt, Human
cuggccucugugcc

SEQ ID NO: 2217529 - RNA, 20 nt, Human
cuggcucuuccaggcuggga

SEQ ID NO: 2217530 - RNA, 20 nt, Human
cuggcucuugauaccccccu

SEQ ID NO: 2217531 - RNA, 21 nt, Human
cuggcucuugauaccccccuc

SEQ ID NO: 2217532 - RNA, 22 nt, Human
cuggcucuugauaccccccucu

SEQ ID NO: 2217533 - RNA, 23 nt, Human
cuggcucuugauaccccccucug

SEQ ID NO: 2217534 - RNA, 18 nt, Human
cuggcucuuccaggcugg

SEQ ID NO: 2217535 - RNA, 19 nt, Human
cuggcucuuccaggcuggg

SEQ ID NO: 2217536 - RNA, 23 nt, Human
cugggcguaguggcucacaccug

SEQ ID NO: 2217537 - RNA, 17 nt, Human
cugggcucaagcagucu

SEQ ID NO: 2217538 - RNA, 16 nt, Human
cugggcgcccuggaag

SEQ ID NO: 2217539 - RNA, 18 nt, Human
cugggcgcccuggaagcc

SEQ ID NO: 2217540 - RNA, 13 nt, Human
cugggcgacagag

SEQ ID NO: 2217541 - RNA, 14 nt, Human
cugggcgcccugga

SEQ ID NO: 2217542 - RNA, 15 nt, Human
cugggcgcccuggaa

SEQ ID NO: 2217543 - RNA, 18 nt, Human
cugggcuucaguggcagc

SEQ ID NO: 2217544 - RNA, 17 nt, Human
cugggcuucaguggcag

SEQ ID NO: 2217545 - RNA, 19 nt, Human
cugggcuucaguggcagcu

SEQ ID NO: 2217546 - RNA, 20 nt, Human
cugggcuucaguggcagcug

SEQ ID NO: 2217547 - RNA, 21 nt, Human
cugggcuucaguggcagcugc

SEQ ID NO: 2217548 - RNA, 22 nt, Human
cugggcuucaguggcagcugcu

SEQ ID NO: 2217549 - RNA, 23 nt, Human
cugggcuucaguggcagcugcuu

SEQ ID NO: 2217550 - RNA, 13 nt, Human
cugggcuugggga

SEQ ID NO: 2217551 - RNA, 13 nt, Human
cugggcucaagca

SEQ ID NO: 2217552 - RNA, 20 nt, Human
cugggggccaugagcuccag

SEQ ID NO: 2217553 - RNA, 21 nt, Human
cugggcuuggggaccagagcu

SEQ ID NO: 2217554 - RNA, 17 nt, Human
cugggcuuggggaccag

SEQ ID NO: 2217555 - RNA, 20 nt, Human
cugggcuuggggaccagagc

SEQ ID NO: 2217556 - RNA, 21 nt, Human
cuggguacuuguggacacagc

SEQ ID NO: 2217557 - RNA, 23 nt, Human
cuggguacuuguggacacagcuc

SEQ ID NO: 2217558 - RNA, 15 nt, Human
cuggguagcuguaag

SEQ ID NO: 2217559 - RNA, 14 nt, Human
cuggguagcuguaa

SEQ ID NO: 2217560 - RNA, 13 nt, Human
cuggguagcugua

SEQ ID NO: 2217561 - RNA, 20 nt, Human
cuggguacuuguggacacag

SEQ ID NO: 2217562 - RNA, 23 nt, Human
cugggguggggaccucaggccug

SEQ ID NO: 2217563 - RNA, 21 nt, Human
cugggguggggaccucaggcc

SEQ ID NO: 2217564 - RNA, 22 nt, Human
cugggguggggaccucaggccu

SEQ ID NO: 2217565 - RNA, 13 nt, Human
cugggggccucag

SEQ ID NO: 2217566 - RNA, 17 nt, Human
cugggggccucagugcc

SEQ ID NO: 2217567 - RNA, 23 nt, Human
cugggggccaugagcuccagacc

SEQ ID NO: 2217568 - RNA, 22 nt, Human
cugggggccaugagcuccagac

SEQ ID NO: 2217569 - RNA, 17 nt, Human
cuggggugccgccugcc

SEQ ID NO: 2217570 - RNA, 18 nt, Human
cuggggugccgccugccc

SEQ ID NO: 2217571 - RNA, 19 nt, Human
cuggggugccgccugcccg

SEQ ID NO: 2217572 - RNA, 18 nt, Human
cugggggccucagugcca

SEQ ID NO: 2217573 - RNA, 17 nt, Human
cugggguggggaccuca

SEQ ID NO: 2217574 - RNA, 18 nt, Human
cugggguggggaccucag

SEQ ID NO: 2217575 - RNA, 19 nt, Human
cugggguggggaccucagg

SEQ ID NO: 2217576 - RNA, 18 nt, Human
cuggucucaaacuccuga

SEQ ID NO: 2217577 - RNA, 23 nt, Human
cuggucgcuccugcccacggagu

SEQ ID NO: 2217578 - RNA, 16 nt, Human
cuggucgcuccugccc

SEQ ID NO: 2217579 - RNA, 18 nt, Human
cuggucgcuccugcccac

SEQ ID NO: 2217580 - RNA, 12 nt, Human
cugguggacagu

SEQ ID NO: 2217581 - RNA, 23 nt, Human
cuggugcuguggccagggugaga

SEQ ID NO: 2217582 - RNA, 19 nt, Human
cuggugcuguggccagggu

SEQ ID NO: 2217583 - RNA, 20 nt, Human
cuggugcuguggccagggug

SEQ ID NO: 2217584 - RNA, 20 nt, Human
cuggugcuggauauuuucaa

SEQ ID NO: 2217585 - RNA, 14 nt, Human
cuggugcugcugcu

SEQ ID NO: 2217586 - RNA, 12 nt, Human
cuggugcugugg

SEQ ID NO: 2217587 - RNA, 16 nt, Human
cuggugcuguggccag

SEQ ID NO: 2217588 - RNA, 17 nt, Human
cuggugcuguggccagg

SEQ ID NO: 2217589 - RNA, 18 nt, Human
cuggugcuguggccaggg

SEQ ID NO: 2217590 - RNA, 18 nt, Human
cugguggacaguccuggg

SEQ ID NO: 2217591 - RNA, 17 nt, Human
cugguggacaguccugg

SEQ ID NO: 2217592 - RNA, 16 nt, Human
cugguggacaguccug

SEQ ID NO: 2217593 - RNA, 15 nt, Human
cugguggacaguccu

SEQ ID NO: 2217594 - RNA, 21 nt, Human
cugguggacaguccugggaga

SEQ ID NO: 2217595 - RNA, 19 nt, Human
cugguggacaguccuggga

SEQ ID NO: 2217596 - RNA, 15 nt, Human
cugguggagaaagca

SEQ ID NO: 2217597 - RNA, 18 nt, Human
cugguggagaaagcacug

SEQ ID NO: 2217598 - RNA, 21 nt, Human
cugguggagaaagcacugacc

SEQ ID NO: 2217599 - RNA, 19 nt, Human
cugguggcagugggagcug

SEQ ID NO: 2217600 - RNA, 23 nt, Human
cugguggcagugggagcugccug

SEQ ID NO: 2217601 - RNA, 24 nt, Human
cuggugggaucugugcccagagau

SEQ ID NO: 2217602 - RNA, 21 nt, Human
cugguggccccguuucuggug

SEQ ID NO: 2217603 - RNA, 22 nt, Human
cugguggccccguuucuggugg

SEQ ID NO: 2217604 - RNA, 12 nt, Human
cugguggcccag

SEQ ID NO: 2217605 - RNA, 11 nt, Human
cugguggccca

SEQ ID NO: 2217606 - RNA, 22 nt, Human
cugguggagaaagcacugaccu

SEQ ID NO: 2217607 - RNA, 23 nt, Human
cugguggagaaagcacugaccug

SEQ ID NO: 2217608 - RNA, 14 nt, Human
cugguggcccagga

SEQ ID NO: 2217609 - RNA, 13 nt, Human
cugguggcccagg

SEQ ID NO: 2217610 - RNA, 20 nt, Human
cugguggccccguuucuggu

SEQ ID NO: 2217611 - RNA, 17 nt, Human
cuggugggccuccucug

SEQ ID NO: 2217612 - RNA, 12 nt, Human
cuggugggccuc

SEQ ID NO: 2217613 - RNA, 13 nt, Human
cuggugggccaac

SEQ ID NO: 2217614 - RNA, 22 nt, Human
cuggugggguguguuccaacug

SEQ ID NO: 2217615 - RNA, 16 nt, Human
cugguggguccagggg

SEQ ID NO: 2217616 - RNA, 17 nt, Human
cugguggguccaggggc

SEQ ID NO: 2217617 - RNA, 22 nt, Human
cugguggguccaggggccccuc

SEQ ID NO: 2217618 - RNA, 18 nt, Human
cugguggucuguuggcag

SEQ ID NO: 2217619 - RNA, 20 nt, Human
cugguggucuguuggcaggc

SEQ ID NO: 2217620 - RNA, 22 nt, Human
cugguggucuguuggcaggcug

SEQ ID NO: 2217621 - RNA, 23 nt, Human
cugguggucuguuggcaggcugg

SEQ ID NO: 2217622 - RNA, 12 nt, Human
cugguucucauc

SEQ ID NO: 2217623 - RNA, 14 nt, Human
cugguucucaucuu

SEQ ID NO: 2217624 - RNA, 15 nt, Human
cugguucucaucuuu

SEQ ID NO: 2217625 - RNA, 16 nt, Human
cugguucucaucuuuc

SEQ ID NO: 2217626 - RNA, 20 nt, Human
cugguucucaucuuucuuga

SEQ ID NO: 2217627 - RNA, 13 nt, Human
cuggguuggaggg

SEQ ID NO: 2217628 - RNA, 13 nt, Human
cuggguuggaaaa

SEQ ID NO: 2217629 - RNA, 18 nt, Human
cuggguuggaaaacagua

SEQ ID NO: 2217630 - RNA, 15 nt, Human
cugguccauagagag

SEQ ID NO: 2217631 - RNA, 17 nt, Human
cugguccauagagagca

SEQ ID NO: 2217632 - RNA, 19 nt, Human
cuggguccaaauaaaaacu

SEQ ID NO: 2217633 - RNA, 20 nt, Human
cuggguccaaauaaaaacua

SEQ ID NO: 2217634 - RNA, 21 nt, Human
cuggguccaaauaaaaacuaa

SEQ ID NO: 2217635 - RNA, 23 nt, Human
cuggguccaaauaaaaacuaaau

SEQ ID NO: 2217636 - RNA, 19 nt, Human
cuggguucuacccaggugc

SEQ ID NO: 2217637 - RNA, 12 nt, Human
cugggucagugg

SEQ ID NO: 2217638 - RNA, 18 nt, Human
cugggucagucugguggg

SEQ ID NO: 2217639 - RNA, 21 nt, Human
cugggucagucuggugggagg

SEQ ID NO: 2217640 - RNA, 13 nt, Human
cuggguccaaaua

SEQ ID NO: 2217641 - RNA, 14 nt, Human
cuggguccaaauaa

SEQ ID NO: 2217642 - RNA, 15 nt, Human
cuggguccaaauaaa

SEQ ID NO: 2217643 - RNA, 16 nt, Human
cuggguccaaauaaaa

SEQ ID NO: 2217644 - RNA, 13 nt, Human
cugggucagucug

SEQ ID NO: 2217645 - RNA, 17 nt, Human
cugggucagucuggugg

SEQ ID NO: 2217646 - RNA, 15 nt, Human
cuggucccacucagu

SEQ ID NO: 2217647 - RNA, 18 nt, Human
cuggucccacucagucca

SEQ ID NO: 2217648 - RNA, 18 nt, Human
cugguccauagagagcaa

SEQ ID NO: 2217649 - RNA, 17 nt, Human
cugguccuuccaggccc

SEQ ID NO: 2217650 - RNA, 16 nt, Human
cugguccuuccaggcc

SEQ ID NO: 2217651 - RNA, 19 nt, Human
cugguccuuccaggccccc

SEQ ID NO: 2217652 - RNA, 13 nt, Human
cuggucgcuccug

SEQ ID NO: 2217653 - RNA, 14 nt, Human
cuggucgcuccugc

SEQ ID NO: 2217654 - RNA, 15 nt, Human
cuggucgcuccugcc

SEQ ID NO: 2217655 - RNA, 13 nt, Human
cugguccagggcu

SEQ ID NO: 2217656 - RNA, 14 nt, Human
cugguccagggcua

SEQ ID NO: 2217657 - RNA, 14 nt, Human
cugguccugugugc

SEQ ID NO: 2217658 - RNA, 21 nt, Human
cugguccugaggguccccacc

SEQ ID NO: 2217659 - RNA, 19 nt, Human
ccuccugccgacuccuggg

SEQ ID NO: 2217660 - RNA, 21 nt, Human
ccuccuggacauuuuuucagu

SEQ ID NO: 2217661 - RNA, 17 nt, Human
ccuccugggaucugcuc

SEQ ID NO: 2217662 - RNA, 13 nt, Human
ccuccugggcuaa

SEQ ID NO: 2217663 - RNA, 13 nt, Human
ccuccuggacucc

SEQ ID NO: 2217664 - RNA, 12 nt, Human
ccuccugccucc

SEQ ID NO: 2217665 - RNA, 19 nt, Human
ccuccugcccaguccccca

SEQ ID NO: 2217666 - RNA, 18 nt, Human
ccuccugccgacuccugg

SEQ ID NO: 2217667 - RNA, 17 nt, Human
ccuccugggaaugaagc

SEQ ID NO: 2217668 - RNA, 13 nt, Human
ccuccugugugug

SEQ ID NO: 2217669 - RNA, 14 nt, Human
ccuccugggccccu

SEQ ID NO: 2217670 - RNA, 21 nt, Human
ccuccugggcccucucugcuc

SEQ ID NO: 2217671 - RNA, 18 nt, Human
ccuccugggaucugcucg

SEQ ID NO: 2217672 - RNA, 15 nt, Human
ccuccugugugugcg

SEQ ID NO: 2217673 - RNA, 22 nt, Human
ccuccugugugugcgccuacag

SEQ ID NO: 2217674 - RNA, 23 nt, Human
ccuccugcccaggagagccagcc

SEQ ID NO: 2217675 - RNA, 21 nt, Human
ccuccugcccaggagagccag

SEQ ID NO: 2217676 - RNA, 15 nt, Human
ccuccugcccagucc

SEQ ID NO: 2217677 - RNA, 17 nt, Human
ccuccugcccagucccc

SEQ ID NO: 2217678 - RNA, 19 nt, Human
ccuccugcccaggagagcc

SEQ ID NO: 2217679 - RNA, 16 nt, Human
ccuccugcccaggaga

SEQ ID NO: 2217680 - RNA, 15 nt, Human
ccuccugcccaggag

SEQ ID NO: 2217681 - RNA, 14 nt, Human
ccuccugcccagga

SEQ ID NO: 2217682 - RNA, 13 nt, Human
ccuccugccucga

SEQ ID NO: 2217683 - RNA, 21 nt, Human
ccuccucugccaccuccccua

SEQ ID NO: 2217684 - RNA, 18 nt, Human
ccuccugaguagcuggga

SEQ ID NO: 2217685 - RNA, 13 nt, Human
ccuccugcccagg

SEQ ID NO: 2217686 - RNA, 12 nt, Human
ccuccugcccag

SEQ ID NO: 2217687 - RNA, 17 nt, Human
ccuccugcccaccuguc

SEQ ID NO: 2217688 - RNA, 14 nt, Human
ccuccugcccaccu

SEQ ID NO: 2217689 - RNA, 12 nt, Human
ccuccugcccac

SEQ ID NO: 2217690 - RNA, 19 nt, Human
ccuccugcagaccacgccc

SEQ ID NO: 2217691 - RNA, 20 nt, Human
ccuccucugccaccuccccu

SEQ ID NO: 2217692 - RNA, 18 nt, Human
ccuccucugccaccuccc

SEQ ID NO: 2217693 - RNA, 15 nt, Human
ccuccucugccaccu

SEQ ID NO: 2217694 - RNA, 14 nt, Human
ccuccucugccacc

SEQ ID NO: 2217695 - RNA, 13 nt, Human
ccuccucugccac

SEQ ID NO: 2217696 - RNA, 12 nt, Human
ccuccucugcca

SEQ ID NO: 2217697 - RNA, 14 nt, Human
ccuccuccuggacu

SEQ ID NO: 2217698 - RNA, 14 nt, Human
ccuccucccuuagc

SEQ ID NO: 2217699 - RNA, 15 nt, Human
ccuccucccuuagcu

SEQ ID NO: 2217700 - RNA, 16 nt, Human
ccuccucccuuagcuc

SEQ ID NO: 2217701 - RNA, 14 nt, Human
ccuccucccuuuuu

SEQ ID NO: 2217702 - RNA, 15 nt, Human
ccuccucccuuuuuc

SEQ ID NO: 2217703 - RNA, 17 nt, Human
ccuccucccuuuuuccu

SEQ ID NO: 2217704 - RNA, 22 nt, Human
ccuccucccuuuuuccuugucc

SEQ ID NO: 2217705 - RNA, 12 nt, Human
ccuccuccugac

SEQ ID NO: 2217706 - RNA, 16 nt, Human
ccuccccucucugcac

SEQ ID NO: 2217707 - RNA, 16 nt, Human
ccuccccucucuugca

SEQ ID NO: 2217708 - RNA, 17 nt, Human
ccuccccucucuugcac

SEQ ID NO: 2217709 - RNA, 13 nt, Human
ccucccggugccc

SEQ ID NO: 2217710 - RNA, 14 nt, Human
ccucccgggcccuc

SEQ ID NO: 2217711 - RNA, 16 nt, Human
ccucccgggcccuccc

SEQ ID NO: 2217712 - RNA, 17 nt, Human
ccucccgggcccucccu

SEQ ID NO: 2217713 - RNA, 19 nt, Human
ccucccgggcccucccuug

SEQ ID NO: 2217714 - RNA, 20 nt, Human
ccuccccuccuugccuccug

SEQ ID NO: 2217715 - RNA, 24 nt, Human
ccucaguccuccccucacagccuc

SEQ ID NO: 2217716 - RNA, 22 nt, Human
ccucaguccuccccucacagcc

SEQ ID NO: 2217717 - RNA, 23 nt, Human
ccucaguccuccccucacagccu

SEQ ID NO: 2217718 - RNA, 17 nt, Human
ccuccccucuccuuccu

SEQ ID NO: 2217719 - RNA, 15 nt, Human
ccucccucccucuuu

SEQ ID NO: 2217720 - RNA, 13 nt, Human
ccucccucccucu

SEQ ID NO: 2217721 - RNA, 15 nt, Human
ccucccuagccagca

SEQ ID NO: 2217722 - RNA, 16 nt, Human
ccucccggugcccaag

SEQ ID NO: 2217723 - RNA, 14 nt, Human
ccucccucacccug

SEQ ID NO: 2217724 - RNA, 21 nt, Human
ccucccgggcccucccuugga

SEQ ID NO: 2217725 - RNA, 20 nt, Human
ccucccgucuacucauuccc

SEQ ID NO: 2217726 - RNA, 21 nt, Human
ccucccuagccagcacuugua

SEQ ID NO: 2217727 - RNA, 18 nt, Human
ccucccuagugacccgga

SEQ ID NO: 2217728 - RNA, 20 nt, Human
ccucccugcaucugaccagc

SEQ ID NO: 2217729 - RNA, 14 nt, Human
ccucccugcaucug

SEQ ID NO: 2217730 - RNA, 22 nt, Human
ccucccugcaucugaccagcag

SEQ ID NO: 2217731 - RNA, 21 nt, Human
ccucccugcaucugaccagca

SEQ ID NO: 2217732 - RNA, 14 nt, Human
ccuccuccccacuu

SEQ ID NO: 2217733 - RNA, 13 nt, Human
ccuccuccccacu

SEQ ID NO: 2217734 - RNA, 16 nt, Human
ccuccucccugcaucu

SEQ ID NO: 2217735 - RNA, 12 nt, Human
ccuccucccuua

SEQ ID NO: 2217736 - RNA, 17 nt, Human
ccuccucccugcaucug

SEQ ID NO: 2217737 - RNA, 14 nt, Human
ccuccucccugcau

SEQ ID NO: 2217738 - RNA, 13 nt, Human
ccuccucccugca

SEQ ID NO: 2217739 - RNA, 18 nt, Human
ccuccucccuccugccga

SEQ ID NO: 2217740 - RNA, 13 nt, Human
ccucccugaacca

SEQ ID NO: 2217741 - RNA, 13 nt, Human
ccucccuccucug

SEQ ID NO: 2217742 - RNA, 20 nt, Human
ccucccugaaaauguuuuuc

SEQ ID NO: 2217743 - RNA, 20 nt, Human
ccucccugaaccaucccuga

SEQ ID NO: 2217744 - RNA, 19 nt, Human
ccucccugaagccuuugca

SEQ ID NO: 2217745 - RNA, 16 nt, Human
ccucccuccucugucc

SEQ ID NO: 2217746 - RNA, 14 nt, Human
ccucccucccggca

SEQ ID NO: 2217747 - RNA, 19 nt, Human
ccucccucacccugagccc

SEQ ID NO: 2217748 - RNA, 19 nt, Human
ccucccucccggcauggga

SEQ ID NO: 2217749 - RNA, 16 nt, Human
ccucccucccucuuuc

SEQ ID NO: 2217750 - RNA, 16 nt, Human
ccucagccagagaagc

SEQ ID NO: 2217751 - RNA, 15 nt, Human
ccucagccagagaag

SEQ ID NO: 2217752 - RNA, 11 nt, Human
ccucagccaga

SEQ ID NO: 2217753 - RNA, 11 nt, Human
ccucaggccug

SEQ ID NO: 2217754 - RNA, 14 nt, Human
ccucaggccugggg

SEQ ID NO: 2217755 - RNA, 21 nt, Human
ccucaggccugggggcugggc

SEQ ID NO: 2217756 - RNA, 14 nt, Human
ccucagggucccug

SEQ ID NO: 2217757 - RNA, 16 nt, Human
ccucagcauccuggca

SEQ ID NO: 2217758 - RNA, 17 nt, Human
ccucagcauccuggcac

SEQ ID NO: 2217759 - RNA, 22 nt, Human
ccucagaacccuuggcuugccc

SEQ ID NO: 2217760 - RNA, 23 nt, Human
ccucagaacaaagugagacaguc

SEQ ID NO: 2217761 - RNA, 14 nt, Human
ccucagcauccugg

SEQ ID NO: 2217762 - RNA, 21 nt, Human
ccucacuaucccggcugcccu

SEQ ID NO: 2217763 - RNA, 21 nt, Human
ccucacuaggcuucugguuga

SEQ ID NO: 2217764 - RNA, 20 nt, Human
ccucagaaaacaaggaugaa

SEQ ID NO: 2217765 - RNA, 18 nt, Human
ccucagaaacacuggggc

SEQ ID NO: 2217766 - RNA, 22 nt, Human
ccucacuaucccggcugcccuu

SEQ ID NO: 2217767 - RNA, 21 nt, Human
ccucagaacccuuggcuugcc

SEQ ID NO: 2217768 - RNA, 16 nt, Human
ccucagaacccuuggc

SEQ ID NO: 2217769 - RNA, 19 nt, Human
ccucagaaacacuggggcu

SEQ ID NO: 2217770 - RNA, 20 nt, Human
ccucagaaacacuggggcug

SEQ ID NO: 2217771 - RNA, 21 nt, Human
ccucagaaacacuggggcugg

SEQ ID NO: 2217772 - RNA, 21 nt, Human
ccucagaacaaagugagacag

SEQ ID NO: 2217773 - RNA, 11 nt, Human
ccucagguggc

SEQ ID NO: 2217774 - RNA, 19 nt, Human
ccucaggucagggugagga

SEQ ID NO: 2217775 - RNA, 22 nt, Human
ccucaggugauccacccaccuc

SEQ ID NO: 2217776 - RNA, 17 nt, Human
ccucaggugauccaccc

SEQ ID NO: 2217777 - RNA, 19 nt, Human
ccucaggugauccacccac

SEQ ID NO: 2217778 - RNA, 16 nt, Human
ccucaggugagaagca

SEQ ID NO: 2217779 - RNA, 23 nt, Human
ccucagguaaucgaccugccucg

SEQ ID NO: 2217780 - RNA, 22 nt, Human
ccucagguaaucgaccugccuc

SEQ ID NO: 2217781 - RNA, 21 nt, Human
ccucagguaaucgaccugccu

SEQ ID NO: 2217782 - RNA, 15 nt, Human
ccucagggucccugg

SEQ ID NO: 2217783 - RNA, 18 nt, Human
ccucagguggccaugccu

SEQ ID NO: 2217784 - RNA, 21 nt, Human
ccucagguggccaugccucag

SEQ ID NO: 2217785 - RNA, 23 nt, Human
ccucagguggccagccuggaucu

SEQ ID NO: 2217786 - RNA, 15 nt, Human
ccucaggugggccgc

SEQ ID NO: 2217787 - RNA, 18 nt, Human
ccucaggugggccgcagg

SEQ ID NO: 2217788 - RNA, 15 nt, Human
ccucagguuccuaug

SEQ ID NO: 2217789 - RNA, 15 nt, Human
ccucagguggccaug

SEQ ID NO: 2217790 - RNA, 16 nt, Human
ccucagguggccaugc

SEQ ID NO: 2217791 - RNA, 12 nt, Human
ccucagguggcc

SEQ ID NO: 2217792 - RNA, 20 nt, Human
ccucaggucagggugaggau

SEQ ID NO: 2217793 - RNA, 21 nt, Human
ccucagguggccagccuggau

SEQ ID NO: 2217794 - RNA, 19 nt, Human
ccucagguuugccugaggg

SEQ ID NO: 2217795 - RNA, 23 nt, Human
ccucagguugcugguugcugugu

SEQ ID NO: 2217796 - RNA, 21 nt, Human
ccucagguugcugguugcugu

SEQ ID NO: 2217797 - RNA, 22 nt, Human
ccucagguugcugguugcugug

SEQ ID NO: 2217798 - RNA, 23 nt, Human
ccucagguuccuauggcuggcca

SEQ ID NO: 2217799 - RNA, 16 nt, Human
ccucagguugcugguu

SEQ ID NO: 2217800 - RNA, 17 nt, Human
ccucagguugcugguug

SEQ ID NO: 2217801 - RNA, 18 nt, Human
ccucagguugcugguugc

SEQ ID NO: 2217802 - RNA, 15 nt, Human
ccucaguaagacgac

SEQ ID NO: 2217803 - RNA, 21 nt, Human
ccucaguaaguaucuggagga

SEQ ID NO: 2217804 - RNA, 15 nt, Human
ccucagucuggcccu

SEQ ID NO: 2217805 - RNA, 11 nt, Human
ccucaguccuc

SEQ ID NO: 2217806 - RNA, 12 nt, Human
ccucaguccucc

SEQ ID NO: 2217807 - RNA, 16 nt, Human
ccucaguccuccccuc

SEQ ID NO: 2217808 - RNA, 17 nt, Human
ccucaguccuccccuca

SEQ ID NO: 2217809 - RNA, 18 nt, Human
ccucaguccuccccucac

SEQ ID NO: 2217810 - RNA, 19 nt, Human
ccucaguccuccccucaca

SEQ ID NO: 2217811 - RNA, 20 nt, Human
ccucaguccuccccucacag

SEQ ID NO: 2217812 - RNA, 21 nt, Human
ccucaguccuccccucacagc

SEQ ID NO: 2217813 - RNA, 14 nt, Human
ccucagucucccuc

SEQ ID NO: 2217814 - RNA, 21 nt, Human
ccuccccucucuugcacccgc

SEQ ID NO: 2217815 - RNA, 12 nt, Human
ccucucccaggg

SEQ ID NO: 2217816 - RNA, 19 nt, Human
ccucuccacugccuucgau

SEQ ID NO: 2217817 - RNA, 18 nt, Human
ccucucaggugaccaaaa

SEQ ID NO: 2217818 - RNA, 12 nt, Human
ccucuccacugc

SEQ ID NO: 2217819 - RNA, 13 nt, Human
ccucuccacugcc

SEQ ID NO: 2217820 - RNA, 14 nt, Human
ccucuccacugccu

SEQ ID NO: 2217821 - RNA, 16 nt, Human
ccucuccacugccuuc

SEQ ID NO: 2217822 - RNA, 13 nt, Human
ccucucccauccc

SEQ ID NO: 2217823 - RNA, 14 nt, Human
ccucucccaucccc

SEQ ID NO: 2217824 - RNA, 12 nt, Human
ccucucccauca

SEQ ID NO: 2217825 - RNA, 21 nt, Human
ccucuccccagcccagagaca

SEQ ID NO: 2217826 - RNA, 20 nt, Human
ccucuccccagcccagagac

SEQ ID NO: 2217827 - RNA, 19 nt, Human
ccucuccccagcccagaga

SEQ ID NO: 2217828 - RNA, 18 nt, Human
ccucuccccagcccagag

SEQ ID NO: 2217829 - RNA, 15 nt, Human
ccucucccauccccc

SEQ ID NO: 2217830 - RNA, 16 nt, Human
ccucucccaucccccu

SEQ ID NO: 2217831 - RNA, 17 nt, Human
ccucucccaucccccug

SEQ ID NO: 2217832 - RNA, 18 nt, Human
ccucucccaucccccugc

SEQ ID NO: 2217833 - RNA, 19 nt, Human
ccucucccaucccccugcc

SEQ ID NO: 2217834 - RNA, 20 nt, Human
ccucucccaucccccugccc

SEQ ID NO: 2217835 - RNA, 21 nt, Human
ccucucccaucccccugcccu

SEQ ID NO: 2217836 - RNA, 22 nt, Human
ccucucccaucccccugcccuc

SEQ ID NO: 2217837 - RNA, 17 nt, Human
ccuccuguguagcuggg

SEQ ID NO: 2217838 - RNA, 15 nt, Human
ccuccuguugcaccc

SEQ ID NO: 2217839 - RNA, 16 nt, Human
ccuccuguugcaccca

SEQ ID NO: 2217840 - RNA, 17 nt, Human
ccuccuguugcacccag

SEQ ID NO: 2217841 - RNA, 18 nt, Human
ccuccuguugcacccagc

SEQ ID NO: 2217842 - RNA, 19 nt, Human
ccuccuguugcacccagcc

SEQ ID NO: 2217843 - RNA, 21 nt, Human
ccuccuguugcacccagcccu

SEQ ID NO: 2217844 - RNA, 22 nt, Human
ccuccuguugcacccagcccug

SEQ ID NO: 2217845 - RNA, 23 nt, Human
ccuccugugugugcgccuacagg

SEQ ID NO: 2217846 - RNA, 20 nt, Human
ccuccuuaucaaaggacacc

SEQ ID NO: 2217847 - RNA, 18 nt, Human
ccuccuuaucaaaggaca

SEQ ID NO: 2217848 - RNA, 22 nt, Human
ccucccucacccugagccccuu

SEQ ID NO: 2217849 - RNA, 16 nt, Human
ccucucacuaaacuuu

SEQ ID NO: 2217850 - RNA, 12 nt, Human
ccuccuucagac

SEQ ID NO: 2217851 - RNA, 23 nt, Human
ccuccuguugcacccagcccugg

SEQ ID NO: 2217852 - RNA, 21 nt, Human
ccucucaggcaugccugugug

SEQ ID NO: 2217853 - RNA, 20 nt, Human
ccucucaggcaugccugugu

SEQ ID NO: 2217854 - RNA, 14 nt, Human
ccucucaggcaugc

SEQ ID NO: 2217855 - RNA, 13 nt, Human
ccucucagcucca

SEQ ID NO: 2217856 - RNA, 16 nt, Human
ccucucagcuccaggu

SEQ ID NO: 2217857 - RNA, 18 nt, Human
ccucucagcuccaggugg

SEQ ID NO: 2217858 - RNA, 14 nt, Human
ccucucagagcuac

SEQ ID NO: 2217859 - RNA, 15 nt, Human
ccucucagagcuacu

SEQ ID NO: 2217860 - RNA, 21 nt, Human
ccucucagagcuacuugggcc

SEQ ID NO: 2217861 - RNA, 22 nt, Human
ccucucagagcuacuugggcca

SEQ ID NO: 2217862 - RNA, 23 nt, Human
ccucucagagcuacuugggccau

SEQ ID NO: 2217863 - RNA, 12 nt, Human
ccucucacuguc

SEQ ID NO: 2217864 - RNA, 17 nt, Human
ccucucaccuguacucu

SEQ ID NO: 2217865 - RNA, 13 nt, Human
ccucucacugucu

SEQ ID NO: 2217866 - RNA, 14 nt, Human
ccucucacugucug

SEQ ID NO: 2217867 - RNA, 15 nt, Human
ccucucacugucuga

SEQ ID NO: 2217868 - RNA, 19 nt, Human
ccucucacugucugagagu

SEQ ID NO: 2217869 - RNA, 21 nt, Human
ccucucuugguuuccuuccuu

SEQ ID NO: 2217870 - RNA, 15 nt, Human
ccucucuuuguucuc

SEQ ID NO: 2217871 - RNA, 19 nt, Human
ccucucuugguuuccuucc

SEQ ID NO: 2217872 - RNA, 18 nt, Human
ccucucuugguuuccuuc

SEQ ID NO: 2217873 - RNA, 17 nt, Human
ccucucuugcacccgcc

SEQ ID NO: 2217874 - RNA, 18 nt, Human
ccucucuugcacccgccu

SEQ ID NO: 2217875 - RNA, 21 nt, Human
ccucucuugcacccgccucuc

SEQ ID NO: 2217876 - RNA, 23 nt, Human
ccucucuugcacccgccucuccc

SEQ ID NO: 2217877 - RNA, 11 nt, Human
ccucucuugca

SEQ ID NO: 2217878 - RNA, 13 nt, Human
ccucucuugcacc

SEQ ID NO: 2217879 - RNA, 14 nt, Human
ccucucuugcaccc

SEQ ID NO: 2217880 - RNA, 20 nt, Human
ccucucuuauagaauauuua

SEQ ID NO: 2217881 - RNA, 19 nt, Human
ccucucuggccucccaccc

SEQ ID NO: 2217882 - RNA, 10 nt, Human
ccucucuguu

SEQ ID NO: 2217883 - RNA, 22 nt, Human
ccucucuggccucccacccgau

SEQ ID NO: 2217884 - RNA, 13 nt, Human
ccucucuggccuc

SEQ ID NO: 2217885 - RNA, 15 nt, Human
ccucucuggccuccc

SEQ ID NO: 2217886 - RNA, 16 nt, Human
ccucucuggccuccca

SEQ ID NO: 2217887 - RNA, 17 nt, Human
ccucucuggccucccac

SEQ ID NO: 2217888 - RNA, 18 nt, Human
ccucucuggccucccacc

SEQ ID NO: 2217889 - RNA, 23 nt, Human
ccucugaaaaccaauguucucuc

SEQ ID NO: 2217890 - RNA, 18 nt, Human
ccucucuuuguucucagc

SEQ ID NO: 2217891 - RNA, 19 nt, Human
ccucucuuuguucucagcu

SEQ ID NO: 2217892 - RNA, 20 nt, Human
ccucucuuuguucucagcuc

SEQ ID NO: 2217893 - RNA, 21 nt, Human
ccucucuuuguucucagcucc

SEQ ID NO: 2217894 - RNA, 22 nt, Human
ccucucuuuguucucagcuccc

SEQ ID NO: 2217895 - RNA, 23 nt, Human
ccucucuuuguucucagcucccc

SEQ ID NO: 2217896 - RNA, 18 nt, Human
ccucugaaaacggcccuc

SEQ ID NO: 2217897 - RNA, 20 nt, Human
ccucugaaaacggcccucuu

SEQ ID NO: 2217898 - RNA, 16 nt, Human
ccucugacacacagcu

SEQ ID NO: 2217899 - RNA, 15 nt, Human
ccucugacacacagc

SEQ ID NO: 2217900 - RNA, 16 nt, Human
ccucuccugccuacuc

SEQ ID NO: 2217901 - RNA, 15 nt, Human
ccucuccugccuacu

SEQ ID NO: 2217902 - RNA, 14 nt, Human
ccucuccugccuac

SEQ ID NO: 2217903 - RNA, 13 nt, Human
ccucuccugccua

SEQ ID NO: 2217904 - RNA, 16 nt, Human
ccucuccccugauuac

SEQ ID NO: 2217905 - RNA, 20 nt, Human
ccucuccccccccccuccaa

SEQ ID NO: 2217906 - RNA, 18 nt, Human
ccucuccccuaccacugu

SEQ ID NO: 2217907 - RNA, 23 nt, Human
ccucuccccuaccacugucuucu

SEQ ID NO: 2217908 - RNA, 19 nt, Human
ccucuccccauucggugug

SEQ ID NO: 2217909 - RNA, 19 nt, Human
ccucuccccccccccucca

SEQ ID NO: 2217910 - RNA, 23 nt, Human
ccucuccccagguccagcucugg

SEQ ID NO: 2217911 - RNA, 19 nt, Human
ccucucccauugucccucu

SEQ ID NO: 2217912 - RNA, 21 nt, Human
ccucuccccagguccagcucu

SEQ ID NO: 2217913 - RNA, 17 nt, Human
ccucuccugccuacuca

SEQ ID NO: 2217914 - RNA, 11 nt, Human
ccucuccugga

SEQ ID NO: 2217915 - RNA, 12 nt, Human
ccucuccuggag

SEQ ID NO: 2217916 - RNA, 13 nt, Human
ccucuccuggagg

SEQ ID NO: 2217917 - RNA, 13 nt, Human
ccucucugcccua

SEQ ID NO: 2217918 - RNA, 14 nt, Human
ccucuccuggagga

SEQ ID NO: 2217919 - RNA, 15 nt, Human
ccucuccuggaggau

SEQ ID NO: 2217920 - RNA, 16 nt, Human
ccucucugcucugcgu

SEQ ID NO: 2217921 - RNA, 22 nt, Human
ccucucugccgcaauacaggaa

SEQ ID NO: 2217922 - RNA, 15 nt, Human
ccucucugcucugcg

SEQ ID NO: 2217923 - RNA, 12 nt, Human
ccucucugcucu

SEQ ID NO: 2217924 - RNA, 15 nt, Human
ccucuggacggcagg

SEQ ID NO: 2217925 - RNA, 16 nt, Human
ccucuggacggcaggc

SEQ ID NO: 2217926 - RNA, 21 nt, Human
ccucuggacggcaggcucacu

SEQ ID NO: 2217927 - RNA, 22 nt, Human
ccucuggacggcaggcucacug

SEQ ID NO: 2217928 - RNA, 23 nt, Human
ccucuggacggcaggcucacugc

SEQ ID NO: 2217929 - RNA, 24 nt, Human
ccucugccaccagagaccguccuc

SEQ ID NO: 2217930 - RNA, 17 nt, Human
ccucugccaccagagac

SEQ ID NO: 2217931 - RNA, 19 nt, Human
ccucugccaccagagaccg

SEQ ID NO: 2217932 - RNA, 11 nt, Human
ccucugccacc

SEQ ID NO: 2217933 - RNA, 13 nt, Human
ccucugccaccag

SEQ ID NO: 2217934 - RNA, 20 nt, Human
ccucugccaaaggaugugau

SEQ ID NO: 2217935 - RNA, 22 nt, Human
ccucugccaaaggaugugauau

SEQ ID NO: 2217936 - RNA, 17 nt, Human
ccucuggacuggcuaga

SEQ ID NO: 2217937 - RNA, 16 nt, Human
ccucuggacuggcuag

SEQ ID NO: 2217938 - RNA, 15 nt, Human
ccucuggacuggcua

SEQ ID NO: 2217939 - RNA, 14 nt, Human
ccucuggacuggcu

SEQ ID NO: 2217940 - RNA, 17 nt, Human
ccucuggaggggugugg

SEQ ID NO: 2217941 - RNA, 18 nt, Human
ccucuggacuggcuagag

SEQ ID NO: 2217942 - RNA, 21 nt, Human
ccucuggaguggccacuaagc

SEQ ID NO: 2217943 - RNA, 16 nt, Human
ccucuggaguggccac

SEQ ID NO: 2217944 - RNA, 16 nt, Human
ccucuggauggcacca

SEQ ID NO: 2217945 - RNA, 21 nt, Human
ccucuggauggcaccagaggc

SEQ ID NO: 2217946 - RNA, 21 nt, Human
ccucuggcauuagaauuauuu

SEQ ID NO: 2217947 - RNA, 23 nt, Human
ccucuggcauuagaauuauuuaa

SEQ ID NO: 2217948 - RNA, 15 nt, Human
ccucuggaguggcca

SEQ ID NO: 2217949 - RNA, 14 nt, Human
ccucuggaguggcc

SEQ ID NO: 2217950 - RNA, 13 nt, Human
ccucuggaguggc

SEQ ID NO: 2217951 - RNA, 20 nt, Human
ccucuggagggguguggcuc

SEQ ID NO: 2217952 - RNA, 22 nt, Human
ccucuggagggguguggcuccu

SEQ ID NO: 2217953 - RNA, 16 nt, Human
ccucugggcaggaccu

SEQ ID NO: 2217954 - RNA, 14 nt, Human
ccucugggcacugg

SEQ ID NO: 2217955 - RNA, 23 nt, Human
ccucugggaaaugagaaggcagc

SEQ ID NO: 2217956 - RNA, 12 nt, Human
ccucugggacug

SEQ ID NO: 2217957 - RNA, 16 nt, Human
ccucuggucgcuccug

SEQ ID NO: 2217958 - RNA, 20 nt, Human
ccucugggucagugguccac

SEQ ID NO: 2217959 - RNA, 17 nt, Human
ccucugggucagugguc

SEQ ID NO: 2217960 - RNA, 23 nt, Human
ccucuggcuagaggccagcccca

SEQ ID NO: 2217961 - RNA, 22 nt, Human
ccucuggcuagaggccagcccc

SEQ ID NO: 2217962 - RNA, 13 nt, Human
ccucuggcuagag

SEQ ID NO: 2217963 - RNA, 12 nt, Human
ccucuggcuaga

SEQ ID NO: 2217964 - RNA, 18 nt, Human
ccucuggcccugccuucu

SEQ ID NO: 2217965 - RNA, 15 nt, Human
ccucuggcccugccu

SEQ ID NO: 2217966 - RNA, 13 nt, Human
ccucuggcccugc

SEQ ID NO: 2217967 - RNA, 12 nt, Human
ccucuggcccug

SEQ ID NO: 2217968 - RNA, 15 nt, Human
ccucuggccaggaug

SEQ ID NO: 2217969 - RNA, 12 nt, Human
ccucuggccagg

SEQ ID NO: 2217970 - RNA, 18 nt, Human
ccucuggauugugggaau

SEQ ID NO: 2217971 - RNA, 23 nt, Human
ccucuggcuggcuaacuggaagc

SEQ ID NO: 2217972 - RNA, 22 nt, Human
ccucuggcuggcuaacuggaag

SEQ ID NO: 2217973 - RNA, 24 nt, Human
ccucuggcuagaggccagccccac

SEQ ID NO: 2217974 - RNA, 17 nt, Human
ccucuggcccugccuuc

SEQ ID NO: 2217975 - RNA, 17 nt, Human
ccucuggcuccagcugg

SEQ ID NO: 2217976 - RNA, 16 nt, Human
ccucuggcuccagcug

SEQ ID NO: 2217977 - RNA, 19 nt, Human
ccucugcacaagcugcacc

SEQ ID NO: 2217978 - RNA, 17 nt, Human
ccucugcacaagcugca

SEQ ID NO: 2217979 - RNA, 20 nt, Human
ccucugcacaagcugcaccc

SEQ ID NO: 2217980 - RNA, 20 nt, Human
ccucugcacuacugacaugu

SEQ ID NO: 2217981 - RNA, 21 nt, Human
ccucugcacuacugacaugug

SEQ ID NO: 2217982 - RNA, 15 nt, Human
ccucugcacaagcug

SEQ ID NO: 2217983 - RNA, 11 nt, Human
ccucugcacaa

SEQ ID NO: 2217984 - RNA, 17 nt, Human
ccucugacacacagcuc

SEQ ID NO: 2217985 - RNA, 18 nt, Human
ccucugacacacagcucu

SEQ ID NO: 2217986 - RNA, 22 nt, Human
ccucugcagcugaccucuguug

SEQ ID NO: 2217987 - RNA, 17 nt, Human
ccucugcagugccuugg

SEQ ID NO: 2217988 - RNA, 19 nt, Human
ccucugccaaaggauguga

SEQ ID NO: 2217989 - RNA, 16 nt, Human
ccucugcagugccuug

SEQ ID NO: 2217990 - RNA, 17 nt, Human
ccucugcagcugaccuc

SEQ ID NO: 2217991 - RNA, 19 nt, Human
ccucugcagcugaccucug

SEQ ID NO: 2217992 - RNA, 22 nt, Human
ccucugcacuccccugcugggu

SEQ ID NO: 2217993 - RNA, 12 nt, Human
ccucugcagcug

SEQ ID NO: 2217994 - RNA, 13 nt, Human
ccucugcagcuga

SEQ ID NO: 2217995 - RNA, 15 nt, Human
ccucugcagcugacc

SEQ ID NO: 2217996 - RNA, 16 nt, Human
ccucugcagcugaccu

SEQ ID NO: 2217997 - RNA, 14 nt, Human
ccucugcacucccc

SEQ ID NO: 2217998 - RNA, 19 nt, Human
ccucugcacuccccugcug

SEQ ID NO: 2217999 - RNA, 20 nt, Human
ccucugcacuccccugcugg

SEQ ID NO: 2218000 - RNA, 21 nt, Human
ccucugcacuccccugcuggg

SEQ ID NO: 2218001 - RNA, 15 nt, Human
ccucucaguacuuug

SEQ ID NO: 2218002 - RNA, 16 nt, Human
ccucugguuuggggcg

SEQ ID NO: 2218003 - RNA, 16 nt, Human
ccucuggucugggugc

SEQ ID NO: 2218004 - RNA, 18 nt, Human
ccucugguuuggggcgag

SEQ ID NO: 2218005 - RNA, 21 nt, Human
ccucugguuuggggcgaggca

SEQ ID NO: 2218006 - RNA, 23 nt, Human
ccucugguuuggggcgaggcaga

SEQ ID NO: 2218007 - RNA, 23 nt, Human
ccucuguacagagcccacgcccc

SEQ ID NO: 2218008 - RNA, 17 nt, Human
ccucuguacagagccca

SEQ ID NO: 2218009 - RNA, 18 nt, Human
ccucuguacagagcccac

SEQ ID NO: 2218010 - RNA, 14 nt, Human
ccucuguacagagc

SEQ ID NO: 2218011 - RNA, 17 nt, Human
ccucuggucgcuccugc

SEQ ID NO: 2218012 - RNA, 19 nt, Human
ccucuggucgcuccugccc

SEQ ID NO: 2218013 - RNA, 20 nt, Human
ccucuggucgcuccugccca

SEQ ID NO: 2218014 - RNA, 21 nt, Human
ccucuggucgcuccugcccac

SEQ ID NO: 2218015 - RNA, 15 nt, Human
ccucuguacagagcc

SEQ ID NO: 2218016 - RNA, 16 nt, Human
ccucuguacagagccc

SEQ ID NO: 2218017 - RNA, 23 nt, Human
ccucuguccagggcccugagcuc

SEQ ID NO: 2218018 - RNA, 21 nt, Human
ccucuguccagggcccugagc

SEQ ID NO: 2218019 - RNA, 20 nt, Human
ccucuguccagggcccugag

SEQ ID NO: 2218020 - RNA, 18 nt, Human
ccucuguccagggcccug

SEQ ID NO: 2218021 - RNA, 14 nt, Human
ccucuguccccuuc

SEQ ID NO: 2218022 - RNA, 17 nt, Human
ccucuguccccuucucu

SEQ ID NO: 2218023 - RNA, 18 nt, Human
ccucuguccccuucucuc

SEQ ID NO: 2218024 - RNA, 19 nt, Human
ccucuguccccuucucuca

SEQ ID NO: 2218025 - RNA, 21 nt, Human
ccucuguccccuucucucauc

SEQ ID NO: 2218026 - RNA, 22 nt, Human
ccucuguccccuucucucaucu

SEQ ID NO: 2218027 - RNA, 11 nt, Human
ccucuguccug

SEQ ID NO: 2218028 - RNA, 13 nt, Human
ccucuguccugac

SEQ ID NO: 2218029 - RNA, 14 nt, Human
ccucuguccugacu

SEQ ID NO: 2218030 - RNA, 16 nt, Human
ccucuguccugacuuc

SEQ ID NO: 2218031 - RNA, 13 nt, Human
ccucugucugccc

SEQ ID NO: 2218032 - RNA, 17 nt, Human
ccucugucacugcaggc

SEQ ID NO: 2218033 - RNA, 19 nt, Human
ccucugucacugcaggcac

SEQ ID NO: 2218034 - RNA, 16 nt, Human
ccucugucagucacag

SEQ ID NO: 2218035 - RNA, 15 nt, Human
ccucugucagucaca

SEQ ID NO: 2218036 - RNA, 21 nt, Human
ccucugucagucacagccacc

SEQ ID NO: 2218037 - RNA, 19 nt, Human
ccucugucagucacagcca

SEQ ID NO: 2218038 - RNA, 18 nt, Human
ccucugucagucacagcc

SEQ ID NO: 2218039 - RNA, 15 nt, Human
ccucuguccagggcc

SEQ ID NO: 2218040 - RNA, 14 nt, Human
ccucuguccagggc

SEQ ID NO: 2218041 - RNA, 21 nt, Human
ccucuguccaggcacugagau

SEQ ID NO: 2218042 - RNA, 20 nt, Human
ccucuguccaggcacugaga

SEQ ID NO: 2218043 - RNA, 17 nt, Human
ccucuguccaggcacug

SEQ ID NO: 2218044 - RNA, 19 nt, Human
ccucuguccaggcacugag

SEQ ID NO: 2218045 - RNA, 15 nt, Human
ccucuguccaggcac

SEQ ID NO: 2218046 - RNA, 22 nt, Human
ccucuuaaagcugccuguaguu

SEQ ID NO: 2218047 - RNA, 21 nt, Human
ccucuuaaagcugccuguagu

SEQ ID NO: 2218048 - RNA, 20 nt, Human
ccucuuaaagcugccuguag

SEQ ID NO: 2218049 - RNA, 19 nt, Human
ccucuuaaagcugccugua

SEQ ID NO: 2218050 - RNA, 17 nt, Human
ccucuuaaagcugccug

SEQ ID NO: 2218051 - RNA, 19 nt, Human
ccucuuaaagaaaacccac

SEQ ID NO: 2218052 - RNA, 20 nt, Human
ccucuuaaagaaaacccacc

SEQ ID NO: 2218053 - RNA, 19 nt, Human
ccucuuaaaaaauaaaaac

SEQ ID NO: 2218054 - RNA, 18 nt, Human
ccucuuaaaaaauaaaaa

SEQ ID NO: 2218055 - RNA, 17 nt, Human
ccucuuaaaaaauaaaa

SEQ ID NO: 2218056 - RNA, 21 nt, Human
ccucuguuugacaaaccucua

SEQ ID NO: 2218057 - RNA, 23 nt, Human
ccucuuaaagcugccuguaguua

SEQ ID NO: 2218058 - RNA, 21 nt, Human
ccucuuaauguaugauuacau

SEQ ID NO: 2218059 - RNA, 14 nt, Human
ccucuuagaaaaac

SEQ ID NO: 2218060 - RNA, 15 nt, Human
ccucuuaugggcugg

SEQ ID NO: 2218061 - RNA, 16 nt, Human
ccucuuaugggcuggg

SEQ ID NO: 2218062 - RNA, 14 nt, Human
ccucuuaugggcug

SEQ ID NO: 2218063 - RNA, 23 nt, Human
ccucuuagaugcaguucugaaga

SEQ ID NO: 2218064 - RNA, 21 nt, Human
ccucuguucugcacacagcac

SEQ ID NO: 2218065 - RNA, 19 nt, Human
ccucugugugcuccuccuu

SEQ ID NO: 2218066 - RNA, 16 nt, Human
ccucuguucaguguaa

SEQ ID NO: 2218067 - RNA, 22 nt, Human
ccucuguucaguguaaauaguu

SEQ ID NO: 2218068 - RNA, 15 nt, Human
ccucuguuguccucc

SEQ ID NO: 2218069 - RNA, 18 nt, Human
ccucuguuguccuccccu

SEQ ID NO: 2218070 - RNA, 23 nt, Human
ccucuguuguccuccccuugggc

SEQ ID NO: 2218071 - RNA, 21 nt, Human
ccucuguuucucuuuccuugg

SEQ ID NO: 2218072 - RNA, 16 nt, Human
ccucuguuugacaaac

SEQ ID NO: 2218073 - RNA, 15 nt, Human
ccucugugcugugug

SEQ ID NO: 2218074 - RNA, 18 nt, Human
ccucuguguauuugcuuu

SEQ ID NO: 2218075 - RNA, 16 nt, Human
ccucugugaccucagg

SEQ ID NO: 2218076 - RNA, 14 nt, Human
ccucugugucacug

SEQ ID NO: 2218077 - RNA, 16 nt, Human
ccucugugucacuggc

SEQ ID NO: 2218078 - RNA, 17 nt, Human
ccucugugucacuggcu

SEQ ID NO: 2218079 - RNA, 18 nt, Human
ccucugugucacuggcug

SEQ ID NO: 2218080 - RNA, 19 nt, Human
ccucugugucacuggcugc

SEQ ID NO: 2218081 - RNA, 21 nt, Human
ccucugugucacuggcugccu

SEQ ID NO: 2218082 - RNA, 22 nt, Human
ccucugugucacuggcugccuc

SEQ ID NO: 2218083 - RNA, 23 nt, Human
ccucugugucacuggcugccucc

SEQ ID NO: 2218084 - RNA, 13 nt, Human
ccucuguguccuu

SEQ ID NO: 2218085 - RNA, 19 nt, Human
ccucuguguccuucccugc

SEQ ID NO: 2218086 - RNA, 20 nt, Human
ccucuguguccuucccugca

SEQ ID NO: 2218087 - RNA, 21 nt, Human
ccucugugccuucuuuugauu

SEQ ID NO: 2218088 - RNA, 13 nt, Human
ccucugugcugug

SEQ ID NO: 2218089 - RNA, 16 nt, Human
ccucugugcugugugu

SEQ ID NO: 2218090 - RNA, 14 nt, Human
ccucugugccuucu

SEQ ID NO: 2218091 - RNA, 17 nt, Human
ccucugugaccucaggc

SEQ ID NO: 2218092 - RNA, 21 nt, Human
ccucugugaccaaugucuuga

SEQ ID NO: 2218093 - RNA, 22 nt, Human
ccucugucuuggcuuucauguu

SEQ ID NO: 2218094 - RNA, 15 nt, Human
ccucugugaccucag

SEQ ID NO: 2218095 - RNA, 19 nt, Human
ccucugugaccaaugucuu

SEQ ID NO: 2218096 - RNA, 18 nt, Human
ccucugugaccaaugucu

SEQ ID NO: 2218097 - RNA, 20 nt, Human
ccucugucuuggcuuucaug

SEQ ID NO: 2218098 - RNA, 22 nt, Human
ccucugucuugugaaggcaggg

SEQ ID NO: 2218099 - RNA, 14 nt, Human
ccucugucugcccu

SEQ ID NO: 2218100 - RNA, 16 nt, Human
ccucugucugcccuuc

SEQ ID NO: 2218101 - RNA, 22 nt, Human
ccucugucugcccuucacccca

SEQ ID NO: 2218102 - RNA, 13 nt, Human
ccugaaccuagga

SEQ ID NO: 2218103 - RNA, 19 nt, Human
ccugaacugggaccuuuag

SEQ ID NO: 2218104 - RNA, 14 nt, Human
ccugaagaacagua

SEQ ID NO: 2218105 - RNA, 16 nt, Human
ccugaagaaccagucc

SEQ ID NO: 2218106 - RNA, 13 nt, Human
ccugaagaaccag

SEQ ID NO: 2218107 - RNA, 21 nt, Human
ccugaacaagaauuggaagcu

SEQ ID NO: 2218108 - RNA, 18 nt, Human
ccugaacauccuuccuuc

SEQ ID NO: 2218109 - RNA, 20 nt, Human
ccugaacauccuuccuuccc

SEQ ID NO: 2218110 - RNA, 21 nt, Human
ccugaacauccuuccuuccca

SEQ ID NO: 2218111 - RNA, 21 nt, Human
ccugaagacucauucuucugu

SEQ ID NO: 2218112 - RNA, 20 nt, Human
ccugaagcuaucguaaaauu

SEQ ID NO: 2218113 - RNA, 17 nt, Human
ccugaagaaccaguccc

SEQ ID NO: 2218114 - RNA, 22 nt, Human
ccugaagcuaucguaaaauuaa

SEQ ID NO: 2218115 - RNA, 23 nt, Human
ccugaagcuaucguaaaauuaag

SEQ ID NO: 2218116 - RNA, 15 nt, Human
ccugaagucacacag

SEQ ID NO: 2218117 - RNA, 13 nt, Human
ccugaaggccccg

SEQ ID NO: 2218118 - RNA, 16 nt, Human
ccugaagucacacagu

SEQ ID NO: 2218119 - RNA, 17 nt, Human
ccugaagucacacagug

SEQ ID NO: 2218120 - RNA, 23 nt, Human
ccugaauguauugaacuuggaaa

SEQ ID NO: 2218121 - RNA, 14 nt, Human
ccugaauucuauuu

SEQ ID NO: 2218122 - RNA, 18 nt, Human
ccugaauucuauuugcug

SEQ ID NO: 2218123 - RNA, 15 nt, Human
ccugaauucuuuuuc

SEQ ID NO: 2218124 - RNA, 21 nt, Human
ccugaauucuauuugcugggc

SEQ ID NO: 2218125 - RNA, 19 nt, Human
ccugaauuuauuauuguuc

SEQ ID NO: 2218126 - RNA, 13 nt, Human
ccugaaugaaaua

SEQ ID NO: 2218127 - RNA, 22 nt, Human
ccugaaucccccuugccacccc

SEQ ID NO: 2218128 - RNA, 20 nt, Human
ccugaaugguuccaugccug

SEQ ID NO: 2218129 - RNA, 21 nt, Human
ccugaaugguuccaugccuga

SEQ ID NO: 2218130 - RNA, 22 nt, Human
ccugaaugguuccaugccugag

SEQ ID NO: 2218131 - RNA, 23 nt, Human
ccugaaugguuccaugccugagg

SEQ ID NO: 2218132 - RNA, 21 nt, Human
ccugaaggaacauuccuuagu

SEQ ID NO: 2218133 - RNA, 21 nt, Human
ccugaauccaaacuaauccau

SEQ ID NO: 2218134 - RNA, 19 nt, Human
ccugaaucccccuugccac

SEQ ID NO: 2218135 - RNA, 20 nt, Human
ccugaaucccccuugccacc

SEQ ID NO: 2218136 - RNA, 20 nt, Human
ccugaauccaaacuaaucca

SEQ ID NO: 2218137 - RNA, 17 nt, Human
ccugaauccaaacuaau

SEQ ID NO: 2218138 - RNA, 23 nt, Human
ccucuuugucuaaaacaauaaaa

SEQ ID NO: 2218139 - RNA, 18 nt, Human
ccugaaagaggaaugaag

SEQ ID NO: 2218140 - RNA, 17 nt, Human
ccugaaaacacugugca

SEQ ID NO: 2218141 - RNA, 23 nt, Human
ccugaaagaggaaugaaguacuc

SEQ ID NO: 2218142 - RNA, 15 nt, Human
ccugaaagaggcuga

SEQ ID NO: 2218143 - RNA, 19 nt, Human
ccugaaagaggcugaggcc

SEQ ID NO: 2218144 - RNA, 22 nt, Human
ccugaaagaggcugaggccugg

SEQ ID NO: 2218145 - RNA, 17 nt, Human
ccugaacaagaauugga

SEQ ID NO: 2218146 - RNA, 16 nt, Human
ccugaacaagaauugg

SEQ ID NO: 2218147 - RNA, 15 nt, Human
ccugaacaagaauug

SEQ ID NO: 2218148 - RNA, 13 nt, Human
ccugaacaagaau

SEQ ID NO: 2218149 - RNA, 15 nt, Human
ccugaaauuucagau

SEQ ID NO: 2218150 - RNA, 14 nt, Human
ccugaaauuucaga

SEQ ID NO: 2218151 - RNA, 14 nt, Human
ccugaaauuucacc

SEQ ID NO: 2218152 - RNA, 19 nt, Human
ccucuuccggagauguagc

SEQ ID NO: 2218153 - RNA, 18 nt, Human
ccucuuccgugacgucac

SEQ ID NO: 2218154 - RNA, 20 nt, Human
ccucuuccggagauguagca

SEQ ID NO: 2218155 - RNA, 21 nt, Human
ccucuuccccuugcccuugcc

SEQ ID NO: 2218156 - RNA, 13 nt, Human
ccucuucaccccc

SEQ ID NO: 2218157 - RNA, 17 nt, Human
ccucuucaccccccacu

SEQ ID NO: 2218158 - RNA, 13 nt, Human
ccucuucaaauua

SEQ ID NO: 2218159 - RNA, 14 nt, Human
ccucuuagcugagu

SEQ ID NO: 2218160 - RNA, 17 nt, Human
ccucuuagcugagugga

SEQ ID NO: 2218161 - RNA, 21 nt, Human
ccucuuaaagaaaacccaccc

SEQ ID NO: 2218162 - RNA, 20 nt, Human
ccucuuagacuucugcuuuc

SEQ ID NO: 2218163 - RNA, 22 nt, Human
ccucuuagacuucugcuuucca

SEQ ID NO: 2218164 - RNA, 17 nt, Human
ccucuuaugggcugggu

SEQ ID NO: 2218165 - RNA, 15 nt, Human
ccucuuccucccuca

SEQ ID NO: 2218166 - RNA, 16 nt, Human
ccucuuccucccucau

SEQ ID NO: 2218167 - RNA, 19 nt, Human
ccucuuccucccucauucc

SEQ ID NO: 2218168 - RNA, 11 nt, Human
ccucuuccucu

SEQ ID NO: 2218169 - RNA, 12 nt, Human
ccucuuccucug

SEQ ID NO: 2218170 - RNA, 13 nt, Human
ccucuuccucuga

SEQ ID NO: 2218171 - RNA, 22 nt, Human
ccucuuugucuaaaacaauaaa

SEQ ID NO: 2218172 - RNA, 19 nt, Human
ccucuuugucuaaaacaau

SEQ ID NO: 2218173 - RNA, 15 nt, Human
ccucuuugucuaaaa

SEQ ID NO: 2218174 - RNA, 14 nt, Human
ccucuuugucuaaa

SEQ ID NO: 2218175 - RNA, 22 nt, Human
ccucuuuggucuacacugugcu

SEQ ID NO: 2218176 - RNA, 23 nt, Human
ccugaucgccaaccuuuccccca

SEQ ID NO: 2218177 - RNA, 19 nt, Human
ccugaucugacauccccac

SEQ ID NO: 2218178 - RNA, 14 nt, Human
ccugaggcugagac

SEQ ID NO: 2218179 - RNA, 17 nt, Human
ccugaggcuccugugcu

SEQ ID NO: 2218180 - RNA, 18 nt, Human
ccugaggcuccugugcua

SEQ ID NO: 2218181 - RNA, 12 nt, Human
ccugaggcuccu

SEQ ID NO: 2218182 - RNA, 20 nt, Human
ccugaggcuccacuuggucu

SEQ ID NO: 2218183 - RNA, 18 nt, Human
ccugaggcuccacuuggu

SEQ ID NO: 2218184 - RNA, 14 nt, Human
ccugaugcucccuc

SEQ ID NO: 2218185 - RNA, 13 nt, Human
ccugaugcucccu

SEQ ID NO: 2218186 - RNA, 16 nt, Human
ccugaugacagagcga

SEQ ID NO: 2218187 - RNA, 15 nt, Human
ccugaugcagucacg

SEQ ID NO: 2218188 - RNA, 16 nt, Human
ccugaugcagucacgu

SEQ ID NO: 2218189 - RNA, 16 nt, Human
ccugaugcucauauca

SEQ ID NO: 2218190 - RNA, 13 nt, Human
ccugaugacagag

SEQ ID NO: 2218191 - RNA, 23 nt, Human
ccugaugcucccuccccugcccu

SEQ ID NO: 2218192 - RNA, 20 nt, Human
ccugaugcucccuccccugc

SEQ ID NO: 2218193 - RNA, 19 nt, Human
ccugaugcucccuccccug

SEQ ID NO: 2218194 - RNA, 16 nt, Human
ccugaugcucccuccc

SEQ ID NO: 2218195 - RNA, 14 nt, Human
ccugaugcuucuuc

SEQ ID NO: 2218196 - RNA, 17 nt, Human
ccugauguuaaaauucc

SEQ ID NO: 2218197 - RNA, 16 nt, Human
ccugauucaacuaaaa

SEQ ID NO: 2218198 - RNA, 23 nt, Human
ccugauugugucucuugguccug

SEQ ID NO: 2218199 - RNA, 16 nt, Human
ccugauguuaaaauuc

SEQ ID NO: 2218200 - RNA, 23 nt, Human
ccugauggucagcucccuucucu

SEQ ID NO: 2218201 - RNA, 17 nt, Human
ccugauggccaggccag

SEQ ID NO: 2218202 - RNA, 21 nt, Human
ccugaugguacaggaaagcuc

SEQ ID NO: 2218203 - RNA, 16 nt, Human
ccugauggucagcucc

SEQ ID NO: 2218204 - RNA, 17 nt, Human
ccugauggucagcuccc

SEQ ID NO: 2218205 - RNA, 18 nt, Human
ccugauggucagcucccu

SEQ ID NO: 2218206 - RNA, 20 nt, Human
ccugauggucagcucccuuc

SEQ ID NO: 2218207 - RNA, 21 nt, Human
ccugauggucagcucccuucu

SEQ ID NO: 2218208 - RNA, 22 nt, Human
ccugauggucagcucccuucuc

SEQ ID NO: 2218209 - RNA, 17 nt, Human
ccugaugcuucuucaga

SEQ ID NO: 2218210 - RNA, 18 nt, Human
ccugaugcuucuucagag

SEQ ID NO: 2218211 - RNA, 21 nt, Human
ccugaugcugacauucaccug

SEQ ID NO: 2218212 - RNA, 13 nt, Human
ccugaugcugaca

SEQ ID NO: 2218213 - RNA, 23 nt, Human
ccugaugcugacauucaccugcc

SEQ ID NO: 2218214 - RNA, 18 nt, Human
ccugaugguacaggaaag

SEQ ID NO: 2218215 - RNA, 20 nt, Human
ccugauggcaggauggccug

SEQ ID NO: 2218216 - RNA, 23 nt, Human
ccugauggcaggauggccuggcc

SEQ ID NO: 2218217 - RNA, 13 nt, Human
ccugaugcugacu

SEQ ID NO: 2218218 - RNA, 17 nt, Human
ccugauggaccugucac

SEQ ID NO: 2218219 - RNA, 21 nt, Human
ccugauggcacuuagcuauca

SEQ ID NO: 2218220 - RNA, 12 nt, Human
ccugaggcccag

SEQ ID NO: 2218221 - RNA, 18 nt, Human
ccugaggcagguccccag

SEQ ID NO: 2218222 - RNA, 21 nt, Human
ccugaauuuuguugcuguuuu

SEQ ID NO: 2218223 - RNA, 13 nt, Human
ccugaggcccaga

SEQ ID NO: 2218224 - RNA, 14 nt, Human
ccugaggcccagag

SEQ ID NO: 2218225 - RNA, 12 nt, Human
ccugacaacacu

SEQ ID NO: 2218226 - RNA, 14 nt, Human
ccugacaacacuca

SEQ ID NO: 2218227 - RNA, 15 nt, Human
ccugacaacacucau

SEQ ID NO: 2218228 - RNA, 16 nt, Human
ccugacaacacucauu

SEQ ID NO: 2218229 - RNA, 23 nt, Human
ccugaggcccuucucuccagccc

SEQ ID NO: 2218230 - RNA, 19 nt, Human
ccugaggcagguccccaga

SEQ ID NO: 2218231 - RNA, 21 nt, Human
ccugaggcccuucucuccagc

SEQ ID NO: 2218232 - RNA, 22 nt, Human
ccugaggcccuucucuccagcc

SEQ ID NO: 2218233 - RNA, 16 nt, Human
ccugaggcccuucucu

SEQ ID NO: 2218234 - RNA, 17 nt, Human
ccugaggcccuucucuc

SEQ ID NO: 2218235 - RNA, 19 nt, Human
ccugaggcccuucucucca

SEQ ID NO: 2218236 - RNA, 20 nt, Human
ccugaggcccuucucuccag

SEQ ID NO: 2218237 - RNA, 22 nt, Human
ccucuguccugacuucaggggc

SEQ ID NO: 2218238 - RNA, 18 nt, Human
ccuagagccugccuggag

SEQ ID NO: 2218239 - RNA, 19 nt, Human
ccuagagccugccuggagc

SEQ ID NO: 2218240 - RNA, 13 nt, Human
ccuagagccugcc

SEQ ID NO: 2218241 - RNA, 14 nt, Human
ccuagagccugccu

SEQ ID NO: 2218242 - RNA, 17 nt, Human
ccuagagccugccugga

SEQ ID NO: 2218243 - RNA, 15 nt, Human
ccuagagcacacugu

SEQ ID NO: 2218244 - RNA, 23 nt, Human
ccuagagaagcuaaaaccugagc

SEQ ID NO: 2218245 - RNA, 16 nt, Human
ccuagagacagaagca

SEQ ID NO: 2218246 - RNA, 21 nt, Human
ccuagagacagaagcaggcug

SEQ ID NO: 2218247 - RNA, 16 nt, Human
ccuaucaccuccccuc

SEQ ID NO: 2218248 - RNA, 15 nt, Human
ccuaucaccuccccu

SEQ ID NO: 2218249 - RNA, 17 nt, Human
ccuaucaccuauuucca

SEQ ID NO: 2218250 - RNA, 16 nt, Human
ccuaucaccuauuucc

SEQ ID NO: 2218251 - RNA, 16 nt, Human
ccuagagggaggggcc

SEQ ID NO: 2218252 - RNA, 15 nt, Human
ccuagagggaggggc

SEQ ID NO: 2218253 - RNA, 13 nt, Human
ccuagagggaggg

SEQ ID NO: 2218254 - RNA, 14 nt, Human
ccuauccacccagc

SEQ ID NO: 2218255 - RNA, 13 nt, Human
ccuauccacccag

SEQ ID NO: 2218256 - RNA, 12 nt, Human
ccuauccaccca

SEQ ID NO: 2218257 - RNA, 11 nt, Human
ccuauggaugu

SEQ ID NO: 2218258 - RNA, 17 nt, Human
ccuauggggauggucca

SEQ ID NO: 2218259 - RNA, 21 nt, Human
ccuauggcuggccacugcaca

SEQ ID NO: 2218260 - RNA, 23 nt, Human
ccuauggcuggccacugcacaga

SEQ ID NO: 2218261 - RNA, 18 nt, Human
ccuauggcuggccacugc

SEQ ID NO: 2218262 - RNA, 19 nt, Human
ccuauggcuggccacugca

SEQ ID NO: 2218263 - RNA, 18 nt, Human
ccuaucaccuccccuccu

SEQ ID NO: 2218264 - RNA, 17 nt, Human
ccuaucaccuccccucc

SEQ ID NO: 2218265 - RNA, 20 nt, Human
ccuaucagaguugcugcaaa

SEQ ID NO: 2218266 - RNA, 17 nt, Human
ccuaucagaaguuucuc

SEQ ID NO: 2218267 - RNA, 21 nt, Human
ccuaucagccugucucuucca

SEQ ID NO: 2218268 - RNA, 12 nt, Human
ccuaucagugug

SEQ ID NO: 2218269 - RNA, 16 nt, Human
ccuaucagugugcccc

SEQ ID NO: 2218270 - RNA, 17 nt, Human
ccuaucagugugccccc

SEQ ID NO: 2218271 - RNA, 18 nt, Human
ccuaucagugugcccccc

SEQ ID NO: 2218272 - RNA, 20 nt, Human
ccuaucagugugccccccau

SEQ ID NO: 2218273 - RNA, 22 nt, Human
ccuaucagugugccccccaucc

SEQ ID NO: 2218274 - RNA, 24 nt, Human
ccuaucagugugccccccauccug

SEQ ID NO: 2218275 - RNA, 15 nt, Human
ccucacaggccccag

SEQ ID NO: 2218276 - RNA, 17 nt, Human
ccucacaguccuuacca

SEQ ID NO: 2218277 - RNA, 22 nt, Human
ccucaaugugaaucagacccua

SEQ ID NO: 2218278 - RNA, 14 nt, Human
ccucaaugugacca

SEQ ID NO: 2218279 - RNA, 21 nt, Human
ccucaaugugaaucagacccu

SEQ ID NO: 2218280 - RNA, 20 nt, Human
ccucaaugugaaucagaccc

SEQ ID NO: 2218281 - RNA, 20 nt, Human
ccucaauucccccuggccac

SEQ ID NO: 2218282 - RNA, 16 nt, Human
ccucaaugugaccagg

SEQ ID NO: 2218283 - RNA, 22 nt, Human
ccuaugguauaaugguugacug

SEQ ID NO: 2218284 - RNA, 18 nt, Human
ccuaugggagucaagugu

SEQ ID NO: 2218285 - RNA, 18 nt, Human
ccuauguaguccgugcug

SEQ ID NO: 2218286 - RNA, 16 nt, Human
ccuauguaguccgugc

SEQ ID NO: 2218287 - RNA, 18 nt, Human
ccuaugucauuucauuuc

SEQ ID NO: 2218288 - RNA, 14 nt, Human
ccuauguauuugca

SEQ ID NO: 2218289 - RNA, 14 nt, Human
ccuauguccuaagg

SEQ ID NO: 2218290 - RNA, 15 nt, Human
ccuauguccuaagga

SEQ ID NO: 2218291 - RNA, 19 nt, Human
ccuauguccuaaggacaca

SEQ ID NO: 2218292 - RNA, 20 nt, Human
ccuauguccuaaggacacac

SEQ ID NO: 2218293 - RNA, 21 nt, Human
ccuauguccuaaggacacacu

SEQ ID NO: 2218294 - RNA, 22 nt, Human
ccuauguccuaaggacacacua

SEQ ID NO: 2218295 - RNA, 23 nt, Human
ccuauguccuaaggacacacuaa

SEQ ID NO: 2218296 - RNA, 20 nt, Human
ccuaugugauuuuaacucug

SEQ ID NO: 2218297 - RNA, 15 nt, Human
ccucaauaagccuug

SEQ ID NO: 2218298 - RNA, 17 nt, Human
ccuaugugauuuuaacu

SEQ ID NO: 2218299 - RNA, 24 nt, Human
ccuauguccuaaggacacacuaau

SEQ ID NO: 2218300 - RNA, 18 nt, Human
ccucaauccagcuauguu

SEQ ID NO: 2218301 - RNA, 23 nt, Human
ccucaaugccaguaacgcgucuu

SEQ ID NO: 2218302 - RNA, 13 nt, Human
ccucaauccagcu

SEQ ID NO: 2218303 - RNA, 16 nt, Human
ccucaauaagccuugu

SEQ ID NO: 2218304 - RNA, 18 nt, Human
ccucaauaagccuugucg

SEQ ID NO: 2218305 - RNA, 14 nt, Human
ccucaccugggcac

SEQ ID NO: 2218306 - RNA, 16 nt, Human
ccucaccugagagcca

SEQ ID NO: 2218307 - RNA, 22 nt, Human
ccucaccucuggacuggcuaga

SEQ ID NO: 2218308 - RNA, 20 nt, Human
ccucaccucuggacuggcua

SEQ ID NO: 2218309 - RNA, 18 nt, Human
ccucaccucuggacuggc

SEQ ID NO: 2218310 - RNA, 13 nt, Human
ccucaccucugga

SEQ ID NO: 2218311 - RNA, 12 nt, Human
ccucaccucugg

SEQ ID NO: 2218312 - RNA, 14 nt, Human
ccucaccuccucua

SEQ ID NO: 2218313 - RNA, 21 nt, Human
ccucacccgaggcugcccacu

SEQ ID NO: 2218314 - RNA, 19 nt, Human
ccucacccgaggcugccca

SEQ ID NO: 2218315 - RNA, 21 nt, Human
ccucaccccuguccucacugc

SEQ ID NO: 2218316 - RNA, 22 nt, Human
ccucaccccuguccucacugcu

SEQ ID NO: 2218317 - RNA, 18 nt, Human
ccucaccccugcccuggg

SEQ ID NO: 2218318 - RNA, 15 nt, Human
ccucaccccuguccu

SEQ ID NO: 2218319 - RNA, 19 nt, Human
ccucaccccuguccucacu

SEQ ID NO: 2218320 - RNA, 20 nt, Human
ccucaccccuguccucacug

SEQ ID NO: 2218321 - RNA, 20 nt, Human
ccucaccccugguucucauc

SEQ ID NO: 2218322 - RNA, 21 nt, Human
ccucaccccugguucucaucu

SEQ ID NO: 2218323 - RNA, 22 nt, Human
ccucaccccugguucucaucuu

SEQ ID NO: 2218324 - RNA, 23 nt, Human
ccucaccccugguucucaucuuu

SEQ ID NO: 2218325 - RNA, 18 nt, Human
ccucaccuugcaacacac

SEQ ID NO: 2218326 - RNA, 17 nt, Human
ccucaccuugcaacaca

SEQ ID NO: 2218327 - RNA, 22 nt, Human
ccucaccugggcaccuggggag

SEQ ID NO: 2218328 - RNA, 19 nt, Human
ccucaccugggcaccuggg

SEQ ID NO: 2218329 - RNA, 18 nt, Human
ccucaccugggcaccugg

SEQ ID NO: 2218330 - RNA, 15 nt, Human
ccucaccuguagcag

SEQ ID NO: 2218331 - RNA, 21 nt, Human
ccucaccuugcaacacacaga

SEQ ID NO: 2218332 - RNA, 19 nt, Human
ccucaccuugcaacacaca

SEQ ID NO: 2218333 - RNA, 15 nt, Human
ccucaccuuggcacc

SEQ ID NO: 2218334 - RNA, 21 nt, Human
ccucaccuuggcaccagacac

SEQ ID NO: 2218335 - RNA, 16 nt, Human
ccucaccuuggcacca

SEQ ID NO: 2218336 - RNA, 17 nt, Human
ccucaccuuucccaucu

SEQ ID NO: 2218337 - RNA, 17 nt, Human
ccucacgcaccucccau

SEQ ID NO: 2218338 - RNA, 22 nt, Human
ccucaccuugcaacacacagac

SEQ ID NO: 2218339 - RNA, 19 nt, Human
ccucaccuuuucccgggga

SEQ ID NO: 2218340 - RNA, 14 nt, Human
ccucacgcaccucc

SEQ ID NO: 2218341 - RNA, 21 nt, Human
ccucacggugccuuuuuucac

SEQ ID NO: 2218342 - RNA, 12 nt, Human
ccucaccccacu

SEQ ID NO: 2218343 - RNA, 20 nt, Human
ccucacaguccuuaccagca

SEQ ID NO: 2218344 - RNA, 22 nt, Human
ccucacaguccuuaccagcaga

SEQ ID NO: 2218345 - RNA, 16 nt, Human
ccucaccccgucuggg

SEQ ID NO: 2218346 - RNA, 24 nt, Human
ccucaccccacuuaucccucucca

SEQ ID NO: 2218347 - RNA, 15 nt, Human
ccucacccccucggg

SEQ ID NO: 2218348 - RNA, 14 nt, Human
ccucaccccugccc

SEQ ID NO: 2218349 - RNA, 13 nt, Human
ccucaccccugcc

SEQ ID NO: 2218350 - RNA, 17 nt, Human
ccucaccccgucugggg

SEQ ID NO: 2218351 - RNA, 17 nt, Human
ccucaccccugcccugg

SEQ ID NO: 2218352 - RNA, 16 nt, Human
ccucaccccugcccug

SEQ ID NO: 2218353 - RNA, 15 nt, Human
ccucaccccugguuc

SEQ ID NO: 2218354 - RNA, 15 nt, Human
ccucaccccacugug

SEQ ID NO: 2218355 - RNA, 19 nt, Human
ccucacccccagcuuugcu

SEQ ID NO: 2218356 - RNA, 17 nt, Human
ccucacccccagcuuug

SEQ ID NO: 2218357 - RNA, 23 nt, Human
ccucacccacuuuggccuccguu

SEQ ID NO: 2218358 - RNA, 22 nt, Human
ccucaccccacuuaucccucuc

SEQ ID NO: 2218359 - RNA, 17 nt, Human
ccuagagggaggggccu

SEQ ID NO: 2218360 - RNA, 21 nt, Human
ccuaaaccaaaaacugaaagu

SEQ ID NO: 2218361 - RNA, 12 nt, Human
ccuaaaacaaau

SEQ ID NO: 2218362 - RNA, 14 nt, Human
ccuaaaaacacaga

SEQ ID NO: 2218363 - RNA, 18 nt, Human
ccuaaaaaagauauauua

SEQ ID NO: 2218364 - RNA, 13 nt, Human
ccuaaaacaaaag

SEQ ID NO: 2218365 - RNA, 22 nt, Human
ccguuugagaagaaaacaucua

SEQ ID NO: 2218366 - RNA, 23 nt, Human
ccguuuccuuucauuuacugugg

SEQ ID NO: 2218367 - RNA, 13 nt, Human
ccguuucuucccu

SEQ ID NO: 2218368 - RNA, 15 nt, Human
ccguuucuucccugu

SEQ ID NO: 2218369 - RNA, 12 nt, Human
ccuaaaaaagau

SEQ ID NO: 2218370 - RNA, 14 nt, Human
ccuaaaaaagauau

SEQ ID NO: 2218371 - RNA, 23 nt, Human
ccguuucauuuagucaugugacc

SEQ ID NO: 2218372 - RNA, 17 nt, Human
ccguggggccgccgccu

SEQ ID NO: 2218373 - RNA, 20 nt, Human
ccguuguuuacuuaaagauu

SEQ ID NO: 2218374 - RNA, 12 nt, Human
ccgugggcgggg

SEQ ID NO: 2218375 - RNA, 18 nt, Human
ccgugggcggggccuugc

SEQ ID NO: 2218376 - RNA, 19 nt, Human
ccgugggcggggccuugcg

SEQ ID NO: 2218377 - RNA, 14 nt, Human
ccgugggcucccug

SEQ ID NO: 2218378 - RNA, 15 nt, Human
ccguggcuucccgcu

SEQ ID NO: 2218379 - RNA, 21 nt, Human
ccguggcuucccgcucagccc

SEQ ID NO: 2218380 - RNA, 13 nt, Human
ccgugggccuggg

SEQ ID NO: 2218381 - RNA, 23 nt, Human
ccguggcuucccgcucagcccuc

SEQ ID NO: 2218382 - RNA, 20 nt, Human
ccgggcacucagaagacacu

SEQ ID NO: 2218383 - RNA, 19 nt, Human
ccgggccuggagaacuaga

SEQ ID NO: 2218384 - RNA, 18 nt, Human
ccgggcccucccuuggaa

SEQ ID NO: 2218385 - RNA, 15 nt, Human
ccgggcccugaguaa

SEQ ID NO: 2218386 - RNA, 23 nt, Human
ccgggccgaauccccucccuguc

SEQ ID NO: 2218387 - RNA, 13 nt, Human
ccgggccuggggc

SEQ ID NO: 2218388 - RNA, 14 nt, Human
ccgggccccugggc

SEQ ID NO: 2218389 - RNA, 16 nt, Human
ccgggccccugggcuu

SEQ ID NO: 2218390 - RNA, 19 nt, Human
ccgggccccugggcuuggc

SEQ ID NO: 2218391 - RNA, 21 nt, Human
ccgggccccugggcuuggccu

SEQ ID NO: 2218392 - RNA, 23 nt, Human
ccgggccccugggcuuggccugc

SEQ ID NO: 2218393 - RNA, 13 nt, Human
ccgggcccucccu

SEQ ID NO: 2218394 - RNA, 14 nt, Human
ccgggcccucccuu

SEQ ID NO: 2218395 - RNA, 17 nt, Human
ccgggcccucccuugga

SEQ ID NO: 2218396 - RNA, 14 nt, Human
ccgugccuucagcu

SEQ ID NO: 2218397 - RNA, 15 nt, Human
ccgugccuucagcuc

SEQ ID NO: 2218398 - RNA, 14 nt, Human
ccgugccuccacca

SEQ ID NO: 2218399 - RNA, 15 nt, Human
ccgggcgcggccagc

SEQ ID NO: 2218400 - RNA, 17 nt, Human
ccgggcgcggccagccc

SEQ ID NO: 2218401 - RNA, 19 nt, Human
ccgggcgcggccagccccg

SEQ ID NO: 2218402 - RNA, 16 nt, Human
ccgugccuucagcucu

SEQ ID NO: 2218403 - RNA, 17 nt, Human
ccgugccuucagcucua

SEQ ID NO: 2218404 - RNA, 23 nt, Human
ccgugccuccaccaccacuggcc

SEQ ID NO: 2218405 - RNA, 17 nt, Human
ccgugccuccaccacca

SEQ ID NO: 2218406 - RNA, 22 nt, Human
ccgugccuccaccaccacuggc

SEQ ID NO: 2218407 - RNA, 19 nt, Human
ccuaaaguagacuucauuu

SEQ ID NO: 2218408 - RNA, 13 nt, Human
ccuaauuccacag

SEQ ID NO: 2218409 - RNA, 12 nt, Human
ccuaaagagaua

SEQ ID NO: 2218410 - RNA, 11 nt, Human
ccuaaacugua

SEQ ID NO: 2218411 - RNA, 18 nt, Human
ccuaaaacaaaagcucau

SEQ ID NO: 2218412 - RNA, 14 nt, Human
ccuaaacuaucuuu

SEQ ID NO: 2218413 - RNA, 12 nt, Human
ccuaaagaaaaa

SEQ ID NO: 2218414 - RNA, 11 nt, Human
ccuaccccacc

SEQ ID NO: 2218415 - RNA, 23 nt, Human
ccuaccccacaccaggccguccu

SEQ ID NO: 2218416 - RNA, 20 nt, Human
ccuaccccacaccaggccgu

SEQ ID NO: 2218417 - RNA, 21 nt, Human
ccuaccccacaccaggccguc

SEQ ID NO: 2218418 - RNA, 13 nt, Human
ccuaccccacacc

SEQ ID NO: 2218419 - RNA, 18 nt, Human
ccuaccccacaccaggcc

SEQ ID NO: 2218420 - RNA, 19 nt, Human
ccuaccccacaccaggccg

SEQ ID NO: 2218421 - RNA, 14 nt, Human
ccuaauuucuccuc

SEQ ID NO: 2218422 - RNA, 15 nt, Human
ccuaauuucuccucc

SEQ ID NO: 2218423 - RNA, 16 nt, Human
ccuaauuucuccuccc

SEQ ID NO: 2218424 - RNA, 17 nt, Human
ccuaauuucuccucccu

SEQ ID NO: 2218425 - RNA, 18 nt, Human
ccuaauuucuccucccuu

SEQ ID NO: 2218426 - RNA, 17 nt, Human
ccuaauuccacagcugc

SEQ ID NO: 2218427 - RNA, 16 nt, Human
ccuaauuccacagcug

SEQ ID NO: 2218428 - RNA, 15 nt, Human
ccuaauuccacagcu

SEQ ID NO: 2218429 - RNA, 14 nt, Human
ccuaauuccacagc

SEQ ID NO: 2218430 - RNA, 13 nt, Human
ccuaccccaccac

SEQ ID NO: 2218431 - RNA, 19 nt, Human
ccuacccccuccucucugc

SEQ ID NO: 2218432 - RNA, 20 nt, Human
ccuaccccgcagacaccuug

SEQ ID NO: 2218433 - RNA, 14 nt, Human
ccuaccccaccacg

SEQ ID NO: 2218434 - RNA, 17 nt, Human
ccuacccccuccucucu

SEQ ID NO: 2218435 - RNA, 21 nt, Human
ccuaccccgcagacaccuugg

SEQ ID NO: 2218436 - RNA, 14 nt, Human
ccuaccccucccag

SEQ ID NO: 2218437 - RNA, 15 nt, Human
ccuaccccucccagc

SEQ ID NO: 2218438 - RNA, 16 nt, Human
ccuaccccucccagcu

SEQ ID NO: 2218439 - RNA, 17 nt, Human
ccuaccccucccagcug

SEQ ID NO: 2218440 - RNA, 18 nt, Human
ccuaccccucccagcuga

SEQ ID NO: 2218441 - RNA, 21 nt, Human
ccuaccccucccagcugacag

SEQ ID NO: 2218442 - RNA, 14 nt, Human
ccuacccucgggcc

SEQ ID NO: 2218443 - RNA, 18 nt, Human
ccuacccucgggcccacc

SEQ ID NO: 2218444 - RNA, 22 nt, Human
ccuaccucagguugcugguugc

SEQ ID NO: 2218445 - RNA, 23 nt, Human
ccuaccucagguugcugguugcu

SEQ ID NO: 2218446 - RNA, 19 nt, Human
ccuacccucgggcccaccu

SEQ ID NO: 2218447 - RNA, 23 nt, Human
ccuacccucgggcccaccuggcc

SEQ ID NO: 2218448 - RNA, 14 nt, Human
ccuaccucagguug

SEQ ID NO: 2218449 - RNA, 19 nt, Human
ccuaccucagguugcuggu

SEQ ID NO: 2218450 - RNA, 19 nt, Human
ccuaccuucauuucaggag

SEQ ID NO: 2218451 - RNA, 23 nt, Human
ccuaccuguucagugucccgggc

SEQ ID NO: 2218452 - RNA, 16 nt, Human
ccuaccugcucuccaa

SEQ ID NO: 2218453 - RNA, 13 nt, Human
ccuaccuguucag

SEQ ID NO: 2218454 - RNA, 17 nt, Human
ccuaccuguucaguguc

SEQ ID NO: 2218455 - RNA, 22 nt, Human
ccuaccuguucagugucccggg

SEQ ID NO: 2218456 - RNA, 20 nt, Human
ccuagagaacgcagcccuag

SEQ ID NO: 2218457 - RNA, 13 nt, Human
ccuacgcugaaga

SEQ ID NO: 2218458 - RNA, 17 nt, Human
ccuagagaacgcagccc

SEQ ID NO: 2218459 - RNA, 18 nt, Human
ccuagagaacgcagcccu

SEQ ID NO: 2218460 - RNA, 19 nt, Human
ccuagagaacgcagcccua

SEQ ID NO: 2218461 - RNA, 21 nt, Human
ccuaccugauuggugcaaccc

SEQ ID NO: 2218462 - RNA, 12 nt, Human
ccuaccugguaa

SEQ ID NO: 2218463 - RNA, 16 nt, Human
ccuaccugugccugac

SEQ ID NO: 2218464 - RNA, 15 nt, Human
ccuaccugugccuga

SEQ ID NO: 2218465 - RNA, 14 nt, Human
ccuaccugugccug

SEQ ID NO: 2218466 - RNA, 12 nt, Human
ccuaccugcucu

SEQ ID NO: 2218467 - RNA, 13 nt, Human
ccuaccugcucuc

SEQ ID NO: 2218468 - RNA, 19 nt, Human
ccggaauccuguccucagc

SEQ ID NO: 2218469 - RNA, 22 nt, Human
ccggaagccaaaccucugugag

SEQ ID NO: 2218470 - RNA, 20 nt, Human
ccggaauccuguccucagcu

SEQ ID NO: 2218471 - RNA, 22 nt, Human
ccggaauccuguccucagcuuc

SEQ ID NO: 2218472 - RNA, 18 nt, Human
ccgcuuggagcagagggg

SEQ ID NO: 2218473 - RNA, 17 nt, Human
ccgcuuggagcagaggg

SEQ ID NO: 2218474 - RNA, 11 nt, Human
ccggaagccaa

SEQ ID NO: 2218475 - RNA, 23 nt, Human
ccgcuuucuacccagcgagcccu

SEQ ID NO: 2218476 - RNA, 15 nt, Human
ccgcuuggagcagag

SEQ ID NO: 2218477 - RNA, 21 nt, Human
ccgcuugccucggcuccugcu

SEQ ID NO: 2218478 - RNA, 22 nt, Human
ccgcuugccucggcuccugcug

SEQ ID NO: 2218479 - RNA, 13 nt, Human
ccgcuugccucgg

SEQ ID NO: 2218480 - RNA, 14 nt, Human
ccgcuugccucggc

SEQ ID NO: 2218481 - RNA, 18 nt, Human
ccgcuugccucggcuccu

SEQ ID NO: 2218482 - RNA, 20 nt, Human
ccgcuugccucggcuccugc

SEQ ID NO: 2218483 - RNA, 21 nt, Human
ccgcccuugccgaaccaggag

SEQ ID NO: 2218484 - RNA, 15 nt, Human
ccgccgacuuuguac

SEQ ID NO: 2218485 - RNA, 18 nt, Human
ccgcccugcuccucccug

SEQ ID NO: 2218486 - RNA, 19 nt, Human
ccgcccugcuccucccugg

SEQ ID NO: 2218487 - RNA, 21 nt, Human
ccgcccugcuccucccuggcu

SEQ ID NO: 2218488 - RNA, 22 nt, Human
ccgcccugcuccucccuggcug

SEQ ID NO: 2218489 - RNA, 13 nt, Human
ccgcccugccacu

SEQ ID NO: 2218490 - RNA, 14 nt, Human
ccgcccugccacuc

SEQ ID NO: 2218491 - RNA, 15 nt, Human
ccgcccugccacuca

SEQ ID NO: 2218492 - RNA, 14 nt, Human
ccgcccugcuccuc

SEQ ID NO: 2218493 - RNA, 15 nt, Human
ccgcccugcuccucc

SEQ ID NO: 2218494 - RNA, 16 nt, Human
ccgcuguucacccaca

SEQ ID NO: 2218495 - RNA, 15 nt, Human
ccgcuguucacccac

SEQ ID NO: 2218496 - RNA, 14 nt, Human
ccgcuguucaccca

SEQ ID NO: 2218497 - RNA, 20 nt, Human
ccgcugugagccccuggucc

SEQ ID NO: 2218498 - RNA, 15 nt, Human
ccgcugugagccccu

SEQ ID NO: 2218499 - RNA, 18 nt, Human
ccgcugugagccccuggu

SEQ ID NO: 2218500 - RNA, 19 nt, Human
ccgcugugagccccugguc

SEQ ID NO: 2218501 - RNA, 21 nt, Human
ccgcuguucacccacagggcu

SEQ ID NO: 2218502 - RNA, 19 nt, Human
ccgcuguucacccacaggg

SEQ ID NO: 2218503 - RNA, 18 nt, Human
ccgcuguucacccacagg

SEQ ID NO: 2218504 - RNA, 15 nt, Human
ccgcuucugccugca

SEQ ID NO: 2218505 - RNA, 15 nt, Human
ccgggcacucagaag

SEQ ID NO: 2218506 - RNA, 12 nt, Human
ccggcuggaaau

SEQ ID NO: 2218507 - RNA, 15 nt, Human
ccgggaggggcccgc

SEQ ID NO: 2218508 - RNA, 16 nt, Human
ccgggaggggcccgcu

SEQ ID NO: 2218509 - RNA, 22 nt, Human
ccgggaggggcccgcuugccuc

SEQ ID NO: 2218510 - RNA, 22 nt, Human
ccgggagggugcggcugugcag

SEQ ID NO: 2218511 - RNA, 19 nt, Human
ccgggauauauauucucuc

SEQ ID NO: 2218512 - RNA, 13 nt, Human
ccggcuggccugg

SEQ ID NO: 2218513 - RNA, 22 nt, Human
ccgggaggcagagguugcagug

SEQ ID NO: 2218514 - RNA, 14 nt, Human
ccggcucuuuccuu

SEQ ID NO: 2218515 - RNA, 15 nt, Human
ccggcugcagaggcc

SEQ ID NO: 2218516 - RNA, 16 nt, Human
ccggacacuccuagag

SEQ ID NO: 2218517 - RNA, 17 nt, Human
ccggacacuccuagaga

SEQ ID NO: 2218518 - RNA, 22 nt, Human
ccggcugcuuuucccuaagcca

SEQ ID NO: 2218519 - RNA, 17 nt, Human
ccggcucuuuccuugcu

SEQ ID NO: 2218520 - RNA, 12 nt, Human
ccggcugcccuu

SEQ ID NO: 2218521 - RNA, 12 nt, Human
ccggcuggccug

SEQ ID NO: 2218522 - RNA, 19 nt, Human
ccgccgacuuuguaccccc

SEQ ID NO: 2218523 - RNA, 20 nt, Human
ccguggggccgccgccucuu

SEQ ID NO: 2218524 - RNA, 21 nt, Human
cccuuuugcggaugggagggg

SEQ ID NO: 2218525 - RNA, 18 nt, Human
cccuuuucuuuucuaccc

SEQ ID NO: 2218526 - RNA, 23 nt, Human
cccuuuucuuuucuacccuagcc

SEQ ID NO: 2218527 - RNA, 20 nt, Human
cccuuuuggcccccgagcug

SEQ ID NO: 2218528 - RNA, 14 nt, Human
cccuuuuggccccc

SEQ ID NO: 2218529 - RNA, 22 nt, Human
cccuuuuggcccccgagcuggg

SEQ ID NO: 2218530 - RNA, 13 nt, Human
cccuuuucuguuu

SEQ ID NO: 2218531 - RNA, 16 nt, Human
cccuuuucuacaguua

SEQ ID NO: 2218532 - RNA, 18 nt, Human
cccuuuucagcuucugcu

SEQ ID NO: 2218533 - RNA, 15 nt, Human
cccuuuucagcuucu

SEQ ID NO: 2218534 - RNA, 16 nt, Human
cccuuuucagcuucug

SEQ ID NO: 2218535 - RNA, 11 nt, Human
cccuuuuccuu

SEQ ID NO: 2218536 - RNA, 18 nt, Human
cccuuuuuacuccccuug

SEQ ID NO: 2218537 - RNA, 23 nt, Human
cccuuuuuccuuguccccacacu

SEQ ID NO: 2218538 - RNA, 15 nt, Human
cccuuuuucuccagc

SEQ ID NO: 2218539 - RNA, 16 nt, Human
cccuuuuuccuugucc

SEQ ID NO: 2218540 - RNA, 23 nt, Human
cccuuuuuacuccccuugagcug

SEQ ID NO: 2218541 - RNA, 16 nt, Human
cccuuuuuacuccccu

SEQ ID NO: 2218542 - RNA, 17 nt, Human
cccuuuuuuggcugcug

SEQ ID NO: 2218543 - RNA, 18 nt, Human
cccuuuuuuggcugcuga

SEQ ID NO: 2218544 - RNA, 19 nt, Human
ccgagaagcaagaaagaaa

SEQ ID NO: 2218545 - RNA, 14 nt, Human
ccgagaagccagug

SEQ ID NO: 2218546 - RNA, 23 nt, Human
ccgagagagcaccccucucugca

SEQ ID NO: 2218547 - RNA, 18 nt, Human
ccgagauagccaaggcca

SEQ ID NO: 2218548 - RNA, 17 nt, Human
ccgagaaggaagccucc

SEQ ID NO: 2218549 - RNA, 19 nt, Human
ccgagauagccaaggccaa

SEQ ID NO: 2218550 - RNA, 22 nt, Human
ccgagauagccaaggccaaagg

SEQ ID NO: 2218551 - RNA, 13 nt, Human
ccgagaagcaaga

SEQ ID NO: 2218552 - RNA, 22 nt, Human
ccgacuuuguaccccccaaccc

SEQ ID NO: 2218553 - RNA, 16 nt, Human
ccgacuugcuguuuug

SEQ ID NO: 2218554 - RNA, 23 nt, Human
ccgacuugcuguuuuguucugug

SEQ ID NO: 2218555 - RNA, 21 nt, Human
ccgacuugaauuuucccacug

SEQ ID NO: 2218556 - RNA, 22 nt, Human
ccgacuugaauuuucccacugc

SEQ ID NO: 2218557 - RNA, 23 nt, Human
ccgacuugaauuuucccacugca

SEQ ID NO: 2218558 - RNA, 19 nt, Human
cccuuuuuuggcugcugaa

SEQ ID NO: 2218559 - RNA, 15 nt, Human
cccuuuuugaagugu

SEQ ID NO: 2218560 - RNA, 20 nt, Human
ccgacuugaauuuucccacu

SEQ ID NO: 2218561 - RNA, 16 nt, Human
cccuuuuucuccagcu

SEQ ID NO: 2218562 - RNA, 23 nt, Human
cccuuuuugaaguguaggcagac

SEQ ID NO: 2218563 - RNA, 14 nt, Human
ccgaggcuggagcu

SEQ ID NO: 2218564 - RNA, 20 nt, Human
ccgagcucguguauccuggg

SEQ ID NO: 2218565 - RNA, 21 nt, Human
ccgagcucguguauccugggg

SEQ ID NO: 2218566 - RNA, 17 nt, Human
ccgaggcuggagcuggc

SEQ ID NO: 2218567 - RNA, 18 nt, Human
ccgagggaugaugccaca

SEQ ID NO: 2218568 - RNA, 16 nt, Human
ccgagggaugaugcca

SEQ ID NO: 2218569 - RNA, 19 nt, Human
ccgagggaugaugccacac

SEQ ID NO: 2218570 - RNA, 20 nt, Human
ccgagggaugaugccacacc

SEQ ID NO: 2218571 - RNA, 15 nt, Human
ccgagggcgaccccg

SEQ ID NO: 2218572 - RNA, 16 nt, Human
ccgagggcgaccccgu

SEQ ID NO: 2218573 - RNA, 17 nt, Human
ccgaggccuucucugaa

SEQ ID NO: 2218574 - RNA, 19 nt, Human
ccgagcucguguauccugg

SEQ ID NO: 2218575 - RNA, 19 nt, Human
ccgagccuggcuccaaacc

SEQ ID NO: 2218576 - RNA, 19 nt, Human
ccgagcgcuuucuggaaaa

SEQ ID NO: 2218577 - RNA, 21 nt, Human
ccgagccucugucacugcagg

SEQ ID NO: 2218578 - RNA, 18 nt, Human
ccgagcgcuuucuggaaa

SEQ ID NO: 2218579 - RNA, 16 nt, Human
ccgagccgggccuggg

SEQ ID NO: 2218580 - RNA, 19 nt, Human
ccgagccgggccuggggcu

SEQ ID NO: 2218581 - RNA, 16 nt, Human
ccgagccuggcuccaa

SEQ ID NO: 2218582 - RNA, 21 nt, Human
ccgagcaaagaucaaaauaaa

SEQ ID NO: 2218583 - RNA, 23 nt, Human
ccgagcaaagaucaaaauaaaaa

SEQ ID NO: 2218584 - RNA, 18 nt, Human
ccgagcaaagucuaaagu

SEQ ID NO: 2218585 - RNA, 20 nt, Human
ccgagcaaagucuaaaguuu

SEQ ID NO: 2218586 - RNA, 18 nt, Human
ccgagaucacgccacugc

SEQ ID NO: 2218587 - RNA, 19 nt, Human
ccgccccuuccccgaggga

SEQ ID NO: 2218588 - RNA, 17 nt, Human
ccgccccuuccccgagg

SEQ ID NO: 2218589 - RNA, 11 nt, Human
ccgcccugcca

SEQ ID NO: 2218590 - RNA, 12 nt, Human
ccgcccugccac

SEQ ID NO: 2218591 - RNA, 15 nt, Human
ccgaugcuccagcca

SEQ ID NO: 2218592 - RNA, 14 nt, Human
ccgaugcuccagcc

SEQ ID NO: 2218593 - RNA, 14 nt, Human
ccgauccuuccucc

SEQ ID NO: 2218594 - RNA, 22 nt, Human
ccgaugcuccagccaaccccug

SEQ ID NO: 2218595 - RNA, 19 nt, Human
ccgaugcuccagccaaccc

SEQ ID NO: 2218596 - RNA, 11 nt, Human
ccgaugcugcu

SEQ ID NO: 2218597 - RNA, 13 nt, Human
ccgaugcugcuuu

SEQ ID NO: 2218598 - RNA, 14 nt, Human
ccgccccgccccac

SEQ ID NO: 2218599 - RNA, 17 nt, Human
ccgaugcugcuuucccc

SEQ ID NO: 2218600 - RNA, 21 nt, Human
ccgagucucuucuccacugga

SEQ ID NO: 2218601 - RNA, 16 nt, Human
ccgaggguccuggcuc

SEQ ID NO: 2218602 - RNA, 22 nt, Human
ccgagucucuucuccacuggau

SEQ ID NO: 2218603 - RNA, 13 nt, Human
ccgaggggcggga

SEQ ID NO: 2218604 - RNA, 23 nt, Human
ccgaggggcgggacccaggcacc

SEQ ID NO: 2218605 - RNA, 18 nt, Human
ccgaggggcucaggaaaa

SEQ ID NO: 2218606 - RNA, 16 nt, Human
ccgaggggcucaggaa

SEQ ID NO: 2218607 - RNA, 17 nt, Human
ccgagucugucucuguc

SEQ ID NO: 2218608 - RNA, 16 nt, Human
ccgagugaaccuaccu

SEQ ID NO: 2218609 - RNA, 14 nt, Human
ccgagucugucucu

SEQ ID NO: 2218610 - RNA, 15 nt, Human
ccgaguuuccccaga

SEQ ID NO: 2218611 - RNA, 13 nt, Human
ccgauccuuccuc

SEQ ID NO: 2218612 - RNA, 19 nt, Human
cccuuaccucggugccuuc

SEQ ID NO: 2218613 - RNA, 21 nt, Human
cccuuaccacugcucugauga

SEQ ID NO: 2218614 - RNA, 17 nt, Human
cccuuaccacugcucug

SEQ ID NO: 2218615 - RNA, 22 nt, Human
cccuuaccccuuagccucccug

SEQ ID NO: 2218616 - RNA, 20 nt, Human
cccuuccuacagauagucaa

SEQ ID NO: 2218617 - RNA, 17 nt, Human
cccuuaccccuuagccu

SEQ ID NO: 2218618 - RNA, 19 nt, Human
cccuuacagccucugacuu

SEQ ID NO: 2218619 - RNA, 20 nt, Human
cccuuaccaugugccugauc

SEQ ID NO: 2218620 - RNA, 13 nt, Human
cccuuccucucca

SEQ ID NO: 2218621 - RNA, 15 nt, Human
cccuuccucuccacc

SEQ ID NO: 2218622 - RNA, 16 nt, Human
cccuuccucuccacug

SEQ ID NO: 2218623 - RNA, 17 nt, Human
cccuuccucuccacugc

SEQ ID NO: 2218624 - RNA, 15 nt, Human
cccuugaugaagaag

SEQ ID NO: 2218625 - RNA, 20 nt, Human
cccuuccucuccacugccuu

SEQ ID NO: 2218626 - RNA, 17 nt, Human
cccuuccucuccacccu

SEQ ID NO: 2218627 - RNA, 18 nt, Human
cccuuccucuccacccuc

SEQ ID NO: 2218628 - RNA, 16 nt, Human
cccuugaugaagaagu

SEQ ID NO: 2218629 - RNA, 23 nt, Human
cccuugcaguucagcaccacccu

SEQ ID NO: 2218630 - RNA, 21 nt, Human
cccuugcaguucagcaccacc

SEQ ID NO: 2218631 - RNA, 13 nt, Human
cccuugccacccc

SEQ ID NO: 2218632 - RNA, 18 nt, Human
cccuugccaccccacccu

SEQ ID NO: 2218633 - RNA, 15 nt, Human
cccuugcccugaccu

SEQ ID NO: 2218634 - RNA, 16 nt, Human
cccuugcccugaccuc

SEQ ID NO: 2218635 - RNA, 19 nt, Human
cccuugcaguucagcacca

SEQ ID NO: 2218636 - RNA, 19 nt, Human
cccuugcagcuaguuuucu

SEQ ID NO: 2218637 - RNA, 16 nt, Human
cccuugcagcuaguuu

SEQ ID NO: 2218638 - RNA, 22 nt, Human
cccuugcacuaaaguauguaaa

SEQ ID NO: 2218639 - RNA, 17 nt, Human
cccuugccgucuaccug

SEQ ID NO: 2218640 - RNA, 18 nt, Human
cccuugccgucuaccuga

SEQ ID NO: 2218641 - RNA, 15 nt, Human
cccuuggcucaaucc

SEQ ID NO: 2218642 - RNA, 19 nt, Human
cccuuggccugucucaucc

SEQ ID NO: 2218643 - RNA, 22 nt, Human
cccuuggcugugaggccccugg

SEQ ID NO: 2218644 - RNA, 14 nt, Human
cccuuggcugugag

SEQ ID NO: 2218645 - RNA, 23 nt, Human
cccuuggcugugaggccccugga

SEQ ID NO: 2218646 - RNA, 22 nt, Human
cccuugccgucuaccugagggg

SEQ ID NO: 2218647 - RNA, 19 nt, Human
cccuugcccugaccuccca

SEQ ID NO: 2218648 - RNA, 20 nt, Human
cccuugcccugaccucccag

SEQ ID NO: 2218649 - RNA, 21 nt, Human
cccuugcccugaccucccagc

SEQ ID NO: 2218650 - RNA, 16 nt, Human
cccuugcccuugcccu

SEQ ID NO: 2218651 - RNA, 17 nt, Human
cccuugcccuugcccug

SEQ ID NO: 2218652 - RNA, 18 nt, Human
cccuugcccuugcccuga

SEQ ID NO: 2218653 - RNA, 21 nt, Human
cccuugcccuugcccugaccu

SEQ ID NO: 2218654 - RNA, 16 nt, Human
cccuuggccugucuca

SEQ ID NO: 2218655 - RNA, 13 nt, Human
cccuuuccugcgg

SEQ ID NO: 2218656 - RNA, 14 nt, Human
cccuuuccucaggc

SEQ ID NO: 2218657 - RNA, 21 nt, Human
cccuuuccuuccuucccuggc

SEQ ID NO: 2218658 - RNA, 18 nt, Human
cccuuuccuuccuucccu

SEQ ID NO: 2218659 - RNA, 18 nt, Human
cccuuuccuuccaucccu

SEQ ID NO: 2218660 - RNA, 15 nt, Human
cccuuuccuuccauc

SEQ ID NO: 2218661 - RNA, 13 nt, Human
cccuuuccuucca

SEQ ID NO: 2218662 - RNA, 23 nt, Human
cccuugugcgugggugaagccgc

SEQ ID NO: 2218663 - RNA, 15 nt, Human
cccuuggguucugau

SEQ ID NO: 2218664 - RNA, 20 nt, Human
cccuuguggucccaccccac

SEQ ID NO: 2218665 - RNA, 18 nt, Human
cccuuguggucccacccc

SEQ ID NO: 2218666 - RNA, 18 nt, Human
cccuuggggagcaggcuc

SEQ ID NO: 2218667 - RNA, 18 nt, Human
cccuugggcggcugagag

SEQ ID NO: 2218668 - RNA, 14 nt, Human
cccuugugguccca

SEQ ID NO: 2218669 - RNA, 16 nt, Human
cccuuguggucccacc

SEQ ID NO: 2218670 - RNA, 17 nt, Human
cccuuucuuggccaguu

SEQ ID NO: 2218671 - RNA, 15 nt, Human
cccuuucuuggccag

SEQ ID NO: 2218672 - RNA, 14 nt, Human
cccuuucuuggcca

SEQ ID NO: 2218673 - RNA, 20 nt, Human
cccuuugacgccaucccagc

SEQ ID NO: 2218674 - RNA, 22 nt, Human
cccuuucugggcaccggggccu

SEQ ID NO: 2218675 - RNA, 12 nt, Human
cccuuucugugu

SEQ ID NO: 2218676 - RNA, 14 nt, Human
cccuuucuggcucu

SEQ ID NO: 2218677 - RNA, 14 nt, Human
cccuuucuccccug

SEQ ID NO: 2218678 - RNA, 22 nt, Human
cccuuucuccccugcccccagg

SEQ ID NO: 2218679 - RNA, 20 nt, Human
cccuuugggaggcugaggcg

SEQ ID NO: 2218680 - RNA, 16 nt, Human
cccuuugggaggcuga

SEQ ID NO: 2218681 - RNA, 23 nt, Human
cccuuugcugugaggcuguccug

SEQ ID NO: 2218682 - RNA, 16 nt, Human
cccuuucuuggccagu

SEQ ID NO: 2218683 - RNA, 17 nt, Human
cccuuugcccagaaaga

SEQ ID NO: 2218684 - RNA, 14 nt, Human
cccuuugagugcag

SEQ ID NO: 2218685 - RNA, 12 nt, Human
cccuuugagugc

SEQ ID NO: 2218686 - RNA, 20 nt, Human
cccuuugguuuuuuucuucu

SEQ ID NO: 2218687 - RNA, 14 nt, Human
cccuuugugcugug

SEQ ID NO: 2218688 - RNA, 15 nt, Human
cccuuugugcugugg

SEQ ID NO: 2218689 - RNA, 18 nt, Human
cccuuugggcccagggac

SEQ ID NO: 2218690 - RNA, 14 nt, Human
cccuuugggcccag

SEQ ID NO: 2218691 - RNA, 15 nt, Human
cccuuugggcccagg

SEQ ID NO: 2218692 - RNA, 17 nt, Human
cccuuugggcccaggga

SEQ ID NO: 2218693 - RNA, 16 nt, Human
cccuuggguucugaua

SEQ ID NO: 2218694 - RNA, 17 nt, Human
ccccacugccugcccac

SEQ ID NO: 2218695 - RNA, 16 nt, Human
ccccacugccugccca

SEQ ID NO: 2218696 - RNA, 22 nt, Human
ccccacuggggaaauaacagcu

SEQ ID NO: 2218697 - RNA, 14 nt, Human
ccccacuggggaaa

SEQ ID NO: 2218698 - RNA, 15 nt, Human
ccccacugccugccc

SEQ ID NO: 2218699 - RNA, 12 nt, Human
ccccacugccug

SEQ ID NO: 2218700 - RNA, 16 nt, Human
ccccacugccuacugc

SEQ ID NO: 2218701 - RNA, 19 nt, Human
ccccacugccuacugcauc

SEQ ID NO: 2218702 - RNA, 18 nt, Human
ccccacugcaggccccgc

SEQ ID NO: 2218703 - RNA, 16 nt, Human
ccccacugcaggcccc

SEQ ID NO: 2218704 - RNA, 12 nt, Human
ccccacugcagg

SEQ ID NO: 2218705 - RNA, 15 nt, Human
ccccacugaccagaa

SEQ ID NO: 2218706 - RNA, 22 nt, Human
ccccaccccuuccccacugccu

SEQ ID NO: 2218707 - RNA, 18 nt, Human
ccccaccccuuccccacu

SEQ ID NO: 2218708 - RNA, 13 nt, Human
ccccaccccuugc

SEQ ID NO: 2218709 - RNA, 15 nt, Human
ccccaccccuugcuc

SEQ ID NO: 2218710 - RNA, 17 nt, Human
ccccaccccuuccccac

SEQ ID NO: 2218711 - RNA, 15 nt, Human
ccccaccccuucccc

SEQ ID NO: 2218712 - RNA, 13 nt, Human
ccccaccccuucc

SEQ ID NO: 2218713 - RNA, 20 nt, Human
ccccaccccugggggcucuc

SEQ ID NO: 2218714 - RNA, 12 nt, Human
ccccaccccugg

SEQ ID NO: 2218715 - RNA, 23 nt, Human
ccccaccccugcccccagccccg

SEQ ID NO: 2218716 - RNA, 19 nt, Human
ccccaccccugggggcucu

SEQ ID NO: 2218717 - RNA, 22 nt, Human
ccccaccccggggacccuguga

SEQ ID NO: 2218718 - RNA, 13 nt, Human
ccccaccccugcc

SEQ ID NO: 2218719 - RNA, 14 nt, Human
ccccaccccugccc

SEQ ID NO: 2218720 - RNA, 17 nt, Human
ccccaccccugccccca

SEQ ID NO: 2218721 - RNA, 15 nt, Human
ccccacugacagccu

SEQ ID NO: 2218722 - RNA, 13 nt, Human
ccccacucugugc

SEQ ID NO: 2218723 - RNA, 21 nt, Human
ccccacugacagccucccacc

SEQ ID NO: 2218724 - RNA, 14 nt, Human
ccccacugaccaga

SEQ ID NO: 2218725 - RNA, 18 nt, Human
ccccaccccuugcucuca

SEQ ID NO: 2218726 - RNA, 13 nt, Human
ccccacccucagc

SEQ ID NO: 2218727 - RNA, 12 nt, Human
ccccacucugug

SEQ ID NO: 2218728 - RNA, 15 nt, Human
ccccagccucccuga

SEQ ID NO: 2218729 - RNA, 14 nt, Human
ccccagccucuggc

SEQ ID NO: 2218730 - RNA, 15 nt, Human
ccccagccucuggca

SEQ ID NO: 2218731 - RNA, 21 nt, Human
ccccagccuaagaugaagagg

SEQ ID NO: 2218732 - RNA, 13 nt, Human
ccccagccucccu

SEQ ID NO: 2218733 - RNA, 19 nt, Human
ccccagccuaagaugaaga

SEQ ID NO: 2218734 - RNA, 16 nt, Human
ccccagccgcucggag

SEQ ID NO: 2218735 - RNA, 19 nt, Human
ccccagcgagagucccugc

SEQ ID NO: 2218736 - RNA, 12 nt, Human
ccccagccuucu

SEQ ID NO: 2218737 - RNA, 16 nt, Human
ccccagccucuggcau

SEQ ID NO: 2218738 - RNA, 18 nt, Human
ccccagcgucccagucuc

SEQ ID NO: 2218739 - RNA, 17 nt, Human
ccccagcuaagaaccug

SEQ ID NO: 2218740 - RNA, 21 nt, Human
ccccagcuaagaaccuggaac

SEQ ID NO: 2218741 - RNA, 19 nt, Human
ccccagcuaagaaccugga

SEQ ID NO: 2218742 - RNA, 12 nt, Human
ccccagcccugu

SEQ ID NO: 2218743 - RNA, 19 nt, Human
ccccagcccuggcucugca

SEQ ID NO: 2218744 - RNA, 13 nt, Human
ccccagcccuggc

SEQ ID NO: 2218745 - RNA, 16 nt, Human
ccccagcccuggcucu

SEQ ID NO: 2218746 - RNA, 14 nt, Human
ccccagcccugugg

SEQ ID NO: 2218747 - RNA, 13 nt, Human
ccccagcccugug

SEQ ID NO: 2218748 - RNA, 15 nt, Human
ccccagcccugugga

SEQ ID NO: 2218749 - RNA, 19 nt, Human
ccccagcccuccuuaucaa

SEQ ID NO: 2218750 - RNA, 14 nt, Human
ccccacuggugaca

SEQ ID NO: 2218751 - RNA, 12 nt, Human
ccccacugguga

SEQ ID NO: 2218752 - RNA, 13 nt, Human
ccccacuggugac

SEQ ID NO: 2218753 - RNA, 23 nt, Human
ccccaggcaggcugugcgcugac

SEQ ID NO: 2218754 - RNA, 12 nt, Human
ccccaggccagg

SEQ ID NO: 2218755 - RNA, 18 nt, Human
ccccaggcaggcugugcg

SEQ ID NO: 2218756 - RNA, 14 nt, Human
ccccaggcaggcug

SEQ ID NO: 2218757 - RNA, 13 nt, Human
ccccaggccaggc

SEQ ID NO: 2218758 - RNA, 15 nt, Human
ccccaggccaggcca

SEQ ID NO: 2218759 - RNA, 22 nt, Human
ccccaggccaggccaccaggau

SEQ ID NO: 2218760 - RNA, 11 nt, Human
ccccaggcagg

SEQ ID NO: 2218761 - RNA, 16 nt, Human
ccccaggaccagcuca

SEQ ID NO: 2218762 - RNA, 14 nt, Human
cccccaagccugca

SEQ ID NO: 2218763 - RNA, 13 nt, Human
cccccaagccugc

SEQ ID NO: 2218764 - RNA, 19 nt, Human
cccccaagcuguuuucuuc

SEQ ID NO: 2218765 - RNA, 14 nt, Human
cccccaaccccuga

SEQ ID NO: 2218766 - RNA, 16 nt, Human
cccccaaccccugagg

SEQ ID NO: 2218767 - RNA, 18 nt, Human
cccccaaccccugaggaa

SEQ ID NO: 2218768 - RNA, 23 nt, Human
cccccaaccaaguggcucccaca

SEQ ID NO: 2218769 - RNA, 14 nt, Human
cccccaaccccagc

SEQ ID NO: 2218770 - RNA, 22 nt, Human
cccccaacacugugcccuggug

SEQ ID NO: 2218771 - RNA, 23 nt, Human
cccccaacacugugcccuggugg

SEQ ID NO: 2218772 - RNA, 14 nt, Human
ccccaggaggccag

SEQ ID NO: 2218773 - RNA, 15 nt, Human
ccccaggaggccagc

SEQ ID NO: 2218774 - RNA, 21 nt, Human
ccccaggaggccagccuugac

SEQ ID NO: 2218775 - RNA, 22 nt, Human
ccccaggaggccagccuugacc

SEQ ID NO: 2218776 - RNA, 12 nt, Human
ccccagcucugg

SEQ ID NO: 2218777 - RNA, 13 nt, Human
ccccagcuccggc

SEQ ID NO: 2218778 - RNA, 14 nt, Human
ccccagcugugagc

SEQ ID NO: 2218779 - RNA, 15 nt, Human
ccccagcugugagcc

SEQ ID NO: 2218780 - RNA, 16 nt, Human
ccccagcugugagccu

SEQ ID NO: 2218781 - RNA, 19 nt, Human
ccccagcugugagccuugg

SEQ ID NO: 2218782 - RNA, 21 nt, Human
ccccagcugugagccuuggcu

SEQ ID NO: 2218783 - RNA, 23 nt, Human
ccccagcgucccagucucuggca

SEQ ID NO: 2218784 - RNA, 11 nt, Human
ccccagcuccg

SEQ ID NO: 2218785 - RNA, 11 nt, Human
ccccagcuacc

SEQ ID NO: 2218786 - RNA, 22 nt, Human
ccccagcuacccuuuuucucca

SEQ ID NO: 2218787 - RNA, 14 nt, Human
ccccagcucaaugg

SEQ ID NO: 2218788 - RNA, 23 nt, Human
ccccaggaagccgugcccugccc

SEQ ID NO: 2218789 - RNA, 12 nt, Human
ccccaggaagcc

SEQ ID NO: 2218790 - RNA, 11 nt, Human
ccccaggacca

SEQ ID NO: 2218791 - RNA, 13 nt, Human
ccccagcuuugcc

SEQ ID NO: 2218792 - RNA, 14 nt, Human
ccccagcuuugccc

SEQ ID NO: 2218793 - RNA, 24 nt, Human
ccccagcuuugcccaacaccagcc

SEQ ID NO: 2218794 - RNA, 13 nt, Human
ccccaggaggcca

SEQ ID NO: 2218795 - RNA, 15 nt, Human
ccccaggaccagcuc

SEQ ID NO: 2218796 - RNA, 13 nt, Human
ccccaggaccagc

SEQ ID NO: 2218797 - RNA, 12 nt, Human
cccccccuucca

SEQ ID NO: 2218798 - RNA, 13 nt, Human
cccccccuuccac

SEQ ID NO: 2218799 - RNA, 14 nt, Human
ccccccaugcacug

SEQ ID NO: 2218800 - RNA, 13 nt, Human
ccccccagcacug

SEQ ID NO: 2218801 - RNA, 14 nt, Human
ccccccagcacuga

SEQ ID NO: 2218802 - RNA, 12 nt, Human
ccccccagccuc

SEQ ID NO: 2218803 - RNA, 13 nt, Human
ccccccagccucu

SEQ ID NO: 2218804 - RNA, 11 nt, Human
ccccccacucu

SEQ ID NO: 2218805 - RNA, 13 nt, Human
ccccccaccccug

SEQ ID NO: 2218806 - RNA, 12 nt, Human
ccccccaccccu

SEQ ID NO: 2218807 - RNA, 14 nt, Human
cccccaugcacugu

SEQ ID NO: 2218808 - RNA, 18 nt, Human
ccccccagaaccuguccu

SEQ ID NO: 2218809 - RNA, 12 nt, Human
ccccccacugca

SEQ ID NO: 2218810 - RNA, 12 nt, Human
ccccccagcacu

SEQ ID NO: 2218811 - RNA, 12 nt, Human
ccccccacucuc

SEQ ID NO: 2218812 - RNA, 13 nt, Human
ccccccacucugu

SEQ ID NO: 2218813 - RNA, 16 nt, Human
cccccaggcugcugga

SEQ ID NO: 2218814 - RNA, 18 nt, Human
cccccagcuuugcccaac

SEQ ID NO: 2218815 - RNA, 17 nt, Human
cccccaggacugggcca

SEQ ID NO: 2218816 - RNA, 20 nt, Human
cccccaggggaaagaugagc

SEQ ID NO: 2218817 - RNA, 15 nt, Human
cccccaguccccacc

SEQ ID NO: 2218818 - RNA, 22 nt, Human
cccccauccccauccuccagcu

SEQ ID NO: 2218819 - RNA, 20 nt, Human
cccccaguccccaccccugc

SEQ ID NO: 2218820 - RNA, 22 nt, Human
cccccaguccccaccccugccc

SEQ ID NO: 2218821 - RNA, 19 nt, Human
cccccauccuccccuuccc

SEQ ID NO: 2218822 - RNA, 23 nt, Human
cccccauccccauccuccagcuu

SEQ ID NO: 2218823 - RNA, 13 nt, Human
cccccauccuggc

SEQ ID NO: 2218824 - RNA, 15 nt, Human
cccccauccuggccc

SEQ ID NO: 2218825 - RNA, 16 nt, Human
cccccaucucuucugg

SEQ ID NO: 2218826 - RNA, 18 nt, Human
cccccaugcacugugaag

SEQ ID NO: 2218827 - RNA, 17 nt, Human
cccccauccuggcccau

SEQ ID NO: 2218828 - RNA, 23 nt, Human
cccccaaggggcagucuggaggg

SEQ ID NO: 2218829 - RNA, 16 nt, Human
cccccaaggggcaguc

SEQ ID NO: 2218830 - RNA, 13 nt, Human
cccccaauccaug

SEQ ID NO: 2218831 - RNA, 11 nt, Human
cccccacacac

SEQ ID NO: 2218832 - RNA, 13 nt, Human
cccccagcacuga

SEQ ID NO: 2218833 - RNA, 19 nt, Human
cccccacacacacacacau

SEQ ID NO: 2218834 - RNA, 14 nt, Human
cccccacacacaca

SEQ ID NO: 2218835 - RNA, 12 nt, Human
cccccacacaca

SEQ ID NO: 2218836 - RNA, 15 nt, Human
cccccagcacugagg

SEQ ID NO: 2218837 - RNA, 17 nt, Human
cccccagcacugaggaa

SEQ ID NO: 2218838 - RNA, 18 nt, Human
cccccagcacugaggaag

SEQ ID NO: 2218839 - RNA, 13 nt, Human
cccccagcccagg

SEQ ID NO: 2218840 - RNA, 14 nt, Human
cccccagcccaggg

SEQ ID NO: 2218841 - RNA, 21 nt, Human
cccccagcccagggcuccugc

SEQ ID NO: 2218842 - RNA, 14 nt, Human
cccccagcuguggg

SEQ ID NO: 2218843 - RNA, 23 nt, Human
cccccagcuuugcuaccaaagca

SEQ ID NO: 2218844 - RNA, 11 nt, Human
cccccaggacu

SEQ ID NO: 2218845 - RNA, 12 nt, Human
cccccaggacug

SEQ ID NO: 2218846 - RNA, 13 nt, Human
cccccaggacugg

SEQ ID NO: 2218847 - RNA, 15 nt, Human
cccccaggacugggc

SEQ ID NO: 2218848 - RNA, 11 nt, Human
cccccagcugu

SEQ ID NO: 2218849 - RNA, 13 nt, Human
cccccagcccugu

SEQ ID NO: 2218850 - RNA, 14 nt, Human
cccccagcccugug

SEQ ID NO: 2218851 - RNA, 12 nt, Human
cccccagcccug

SEQ ID NO: 2218852 - RNA, 13 nt, Human
cccccagccccgg

SEQ ID NO: 2218853 - RNA, 12 nt, Human
cccccagcccca

SEQ ID NO: 2218854 - RNA, 13 nt, Human
cccccugcccucc

SEQ ID NO: 2218855 - RNA, 12 nt, Human
cccccugcccuc

SEQ ID NO: 2218856 - RNA, 13 nt, Human
cccccucugccgc

SEQ ID NO: 2218857 - RNA, 16 nt, Human
cccccugcccucgugg

SEQ ID NO: 2218858 - RNA, 19 nt, Human
cccccugcccucguggcca

SEQ ID NO: 2218859 - RNA, 20 nt, Human
cccccugcccucguggccag

SEQ ID NO: 2218860 - RNA, 12 nt, Human
cccccugcuggc

SEQ ID NO: 2218861 - RNA, 24 nt, Human
cccccugccggccggggcugagac

SEQ ID NO: 2218862 - RNA, 15 nt, Human
cccccugcuggcucu

SEQ ID NO: 2218863 - RNA, 22 nt, Human
cccccugcccucguggccagcc

SEQ ID NO: 2218864 - RNA, 12 nt, Human
cccccugcccug

SEQ ID NO: 2218865 - RNA, 13 nt, Human
cccccugcccugc

SEQ ID NO: 2218866 - RNA, 14 nt, Human
cccccugcccugca

SEQ ID NO: 2218867 - RNA, 16 nt, Human
cccccucugcccugcg

SEQ ID NO: 2218868 - RNA, 22 nt, Human
cccccugccccccagccucugg

SEQ ID NO: 2218869 - RNA, 14 nt, Human
cccccucugcccug

SEQ ID NO: 2218870 - RNA, 13 nt, Human
cccccucugcccu

SEQ ID NO: 2218871 - RNA, 16 nt, Human
ccccgucacagccuca

SEQ ID NO: 2218872 - RNA, 14 nt, Human
ccccgucacagccu

SEQ ID NO: 2218873 - RNA, 10 nt, Human
cccccugggc

SEQ ID NO: 2218874 - RNA, 22 nt, Human
cccccuggccucugugccuucu

SEQ ID NO: 2218875 - RNA, 19 nt, Human
cccccuggccucugugccu

SEQ ID NO: 2218876 - RNA, 15 nt, Human
cccccuggccucugu

SEQ ID NO: 2218877 - RNA, 18 nt, Human
cccccugcuggcucuucu

SEQ ID NO: 2218878 - RNA, 20 nt, Human
cccccugcuggcucuucugc

SEQ ID NO: 2218879 - RNA, 12 nt, Human
cccccuggagag

SEQ ID NO: 2218880 - RNA, 14 nt, Human
ccccgucucuacua

SEQ ID NO: 2218881 - RNA, 21 nt, Human
ccccgucaccaucucaggcca

SEQ ID NO: 2218882 - RNA, 21 nt, Human
ccccgucucugguuccucccc

SEQ ID NO: 2218883 - RNA, 20 nt, Human
ccccgucccccucuggcucc

SEQ ID NO: 2218884 - RNA, 16 nt, Human
ccccgucccccucugg

SEQ ID NO: 2218885 - RNA, 11 nt, Human
ccccccuucca

SEQ ID NO: 2218886 - RNA, 12 nt, Human
ccccccuuccac

SEQ ID NO: 2218887 - RNA, 13 nt, Human
ccccccuuccacu

SEQ ID NO: 2218888 - RNA, 15 nt, Human
cccccgagcuggggg

SEQ ID NO: 2218889 - RNA, 13 nt, Human
cccccgagcuggg

SEQ ID NO: 2218890 - RNA, 11 nt, Human
ccccccccucc

SEQ ID NO: 2218891 - RNA, 12 nt, Human
ccccccucuguc

SEQ ID NO: 2218892 - RNA, 14 nt, Human
ccccccucaccagg

SEQ ID NO: 2218893 - RNA, 13 nt, Human
cccccgcccccug

SEQ ID NO: 2218894 - RNA, 14 nt, Human
cccccgcccccugc

SEQ ID NO: 2218895 - RNA, 16 nt, Human
cccccgcccccugccc

SEQ ID NO: 2218896 - RNA, 18 nt, Human
cccccgccccgccccaca

SEQ ID NO: 2218897 - RNA, 11 nt, Human
cccccgccccg

SEQ ID NO: 2218898 - RNA, 12 nt, Human
cccccgcccccu

SEQ ID NO: 2218899 - RNA, 13 nt, Human
cccccgcccaggc

SEQ ID NO: 2218900 - RNA, 18 nt, Human
cccccgcccaggcuggcc

SEQ ID NO: 2218901 - RNA, 12 nt, Human
cccccgccacuc

SEQ ID NO: 2218902 - RNA, 21 nt, Human
cccccgagcugggggccauga

SEQ ID NO: 2218903 - RNA, 15 nt, Human
cccccuccuugcucu

SEQ ID NO: 2218904 - RNA, 14 nt, Human
cccccuccugcugc

SEQ ID NO: 2218905 - RNA, 15 nt, Human
cccccuccugcugca

SEQ ID NO: 2218906 - RNA, 22 nt, Human
cccccuccucucccaucccccu

SEQ ID NO: 2218907 - RNA, 13 nt, Human
cccccuccucucu

SEQ ID NO: 2218908 - RNA, 12 nt, Human
cccccuccugcu

SEQ ID NO: 2218909 - RNA, 13 nt, Human
cccccuccugcug

SEQ ID NO: 2218910 - RNA, 16 nt, Human
cccccuccugcugcag

SEQ ID NO: 2218911 - RNA, 22 nt, Human
cccccucgggucuccucacucc

SEQ ID NO: 2218912 - RNA, 13 nt, Human
cccccucgugcca

SEQ ID NO: 2218913 - RNA, 18 nt, Human
cccccucgugccagucgc

SEQ ID NO: 2218914 - RNA, 21 nt, Human
cccccgcugucagccauuccu

SEQ ID NO: 2218915 - RNA, 13 nt, Human
cccccggcccccu

SEQ ID NO: 2218916 - RNA, 21 nt, Human
cccccgcgcgcgucccccugc

SEQ ID NO: 2218917 - RNA, 23 nt, Human
cccccgcuguaaugaaacaccuu

SEQ ID NO: 2218918 - RNA, 14 nt, Human
cccccggcccccug

SEQ ID NO: 2218919 - RNA, 15 nt, Human
cccccggcccccugg

SEQ ID NO: 2218920 - RNA, 15 nt, Human
cccccgggaggggcc

SEQ ID NO: 2218921 - RNA, 18 nt, Human
cccccgggaggggcccgc

SEQ ID NO: 2218922 - RNA, 12 nt, Human
ccccuagcccag

SEQ ID NO: 2218923 - RNA, 17 nt, Human
ccccucagggucccugg

SEQ ID NO: 2218924 - RNA, 18 nt, Human
ccccucagggucccuggu

SEQ ID NO: 2218925 - RNA, 20 nt, Human
ccccucagggucccuggugg

SEQ ID NO: 2218926 - RNA, 18 nt, Human
ccccuaaugccugcggag

SEQ ID NO: 2218927 - RNA, 23 nt, Human
ccccuaaugacaucaccacaguu

SEQ ID NO: 2218928 - RNA, 15 nt, Human
ccccuaccacugucu

SEQ ID NO: 2218929 - RNA, 20 nt, Human
ccccuaccacugucuucuuc

SEQ ID NO: 2218930 - RNA, 13 nt, Human
ccccuaccccaca

SEQ ID NO: 2218931 - RNA, 20 nt, Human
ccccuaccccacaccaggcc

SEQ ID NO: 2218932 - RNA, 22 nt, Human
ccccuaccccacaccaggccgu

SEQ ID NO: 2218933 - RNA, 22 nt, Human
ccccuacccccuccucucugcc

SEQ ID NO: 2218934 - RNA, 19 nt, Human
ccccgugcagacuggaggg

SEQ ID NO: 2218935 - RNA, 15 nt, Human
ccccgugcagacugg

SEQ ID NO: 2218936 - RNA, 14 nt, Human
ccccgucuguggcu

SEQ ID NO: 2218937 - RNA, 22 nt, Human
ccccgucugggguucagccccu

SEQ ID NO: 2218938 - RNA, 21 nt, Human
ccccgucugggguucagcccc

SEQ ID NO: 2218939 - RNA, 20 nt, Human
ccccgucugggguucagccc

SEQ ID NO: 2218940 - RNA, 14 nt, Human
ccccguuucuggug

SEQ ID NO: 2218941 - RNA, 19 nt, Human
ccccuccccuaaugccugc

SEQ ID NO: 2218942 - RNA, 14 nt, Human
ccccucccccuucu

SEQ ID NO: 2218943 - RNA, 13 nt, Human
ccccuccccugcu

SEQ ID NO: 2218944 - RNA, 21 nt, Human
ccccuccccggcccuaccagc

SEQ ID NO: 2218945 - RNA, 15 nt, Human
ccccuccccugcugc

SEQ ID NO: 2218946 - RNA, 18 nt, Human
ccccucccccaaccccca

SEQ ID NO: 2218947 - RNA, 16 nt, Human
ccccucccccaacccc

SEQ ID NO: 2218948 - RNA, 21 nt, Human
ccccucccccaacccccaccc

SEQ ID NO: 2218949 - RNA, 14 nt, Human
ccccucccagggcc

SEQ ID NO: 2218950 - RNA, 11 nt, Human
ccccucccauc

SEQ ID NO: 2218951 - RNA, 13 nt, Human
ccccucccaucug

SEQ ID NO: 2218952 - RNA, 13 nt, Human
ccccuagcccagg

SEQ ID NO: 2218953 - RNA, 17 nt, Human
ccccuagcccaggagag

SEQ ID NO: 2218954 - RNA, 15 nt, Human
ccccuccccagggga

SEQ ID NO: 2218955 - RNA, 14 nt, Human
ccccucccaucugg

SEQ ID NO: 2218956 - RNA, 11 nt, Human
ccccucccauu

SEQ ID NO: 2218957 - RNA, 15 nt, Human
ccccucccccaaccc

SEQ ID NO: 2218958 - RNA, 20 nt, Human
ccccuccccauuagcuuuca

SEQ ID NO: 2218959 - RNA, 13 nt, Human
ccccucccauuag

SEQ ID NO: 2218960 - RNA, 21 nt, Human
cccugguggcagugggagcug

SEQ ID NO: 2218961 - RNA, 15 nt, Human
cccugguggcagugg

SEQ ID NO: 2218962 - RNA, 21 nt, Human
cccugguuuccugcccuggga

SEQ ID NO: 2218963 - RNA, 16 nt, Human
cccugguggcaguggg

SEQ ID NO: 2218964 - RNA, 19 nt, Human
cccugguggcagugggagc

SEQ ID NO: 2218965 - RNA, 20 nt, Human
cccuguccccucccccuucc

SEQ ID NO: 2218966 - RNA, 10 nt, Human
cccugucccu

SEQ ID NO: 2218967 - RNA, 12 nt, Human
cccugucccucc

SEQ ID NO: 2218968 - RNA, 13 nt, Human
cccugucccuccc

SEQ ID NO: 2218969 - RNA, 14 nt, Human
cccugucccuccca

SEQ ID NO: 2218970 - RNA, 15 nt, Human
cccugucccucccac

SEQ ID NO: 2218971 - RNA, 16 nt, Human
cccugucccucccacc

SEQ ID NO: 2218972 - RNA, 15 nt, Human
cccugucccccagcu

SEQ ID NO: 2218973 - RNA, 16 nt, Human
cccugucccccagcuc

SEQ ID NO: 2218974 - RNA, 17 nt, Human
cccugucccccagcucu

SEQ ID NO: 2218975 - RNA, 18 nt, Human
cccugucccccagcucug

SEQ ID NO: 2218976 - RNA, 19 nt, Human
cccugucccccagcucugg

SEQ ID NO: 2218977 - RNA, 13 nt, Human
cccuguccccuca

SEQ ID NO: 2218978 - RNA, 18 nt, Human
cccuguccccucagcucc

SEQ ID NO: 2218979 - RNA, 19 nt, Human
cccuguccccucagcucca

SEQ ID NO: 2218980 - RNA, 16 nt, Human
cccugugggcccccaa

SEQ ID NO: 2218981 - RNA, 17 nt, Human
cccugucccucccaccu

SEQ ID NO: 2218982 - RNA, 18 nt, Human
cccugucccucccaccuc

SEQ ID NO: 2218983 - RNA, 19 nt, Human
cccugucccucccaccucu

SEQ ID NO: 2218984 - RNA, 20 nt, Human
cccugucccucccaccucug

SEQ ID NO: 2218985 - RNA, 23 nt, Human
cccugucccucccaccucuguga

SEQ ID NO: 2218986 - RNA, 18 nt, Human
cccuguacaauauuuaaa

SEQ ID NO: 2218987 - RNA, 22 nt, Human
ccccucccgucuacucauuccc

SEQ ID NO: 2218988 - RNA, 17 nt, Human
cccuguacaauauuuaa

SEQ ID NO: 2218989 - RNA, 18 nt, Human
ccccuccccugcugcagg

SEQ ID NO: 2218990 - RNA, 17 nt, Human
ccccucccgccccuucc

SEQ ID NO: 2218991 - RNA, 23 nt, Human
cccugguuuccugcccugggagg

SEQ ID NO: 2218992 - RNA, 22 nt, Human
cccugguuuccugcccugggag

SEQ ID NO: 2218993 - RNA, 21 nt, Human
cccuguccaaacugccuaagc

SEQ ID NO: 2218994 - RNA, 19 nt, Human
cccuguaccuuuugaggag

SEQ ID NO: 2218995 - RNA, 18 nt, Human
cccuguacuguucugugu

SEQ ID NO: 2218996 - RNA, 13 nt, Human
cccugucccccag

SEQ ID NO: 2218997 - RNA, 21 nt, Human
cccugucccucccaccucugu

SEQ ID NO: 2218998 - RNA, 22 nt, Human
cccugucccucccaccucugug

SEQ ID NO: 2218999 - RNA, 12 nt, Human
cccuguggggau

SEQ ID NO: 2219000 - RNA, 14 nt, Human
cccuguggggaucu

SEQ ID NO: 2219001 - RNA, 18 nt, Human
cccugugggcccccaaau

SEQ ID NO: 2219002 - RNA, 15 nt, Human
cccuguggggaucuc

SEQ ID NO: 2219003 - RNA, 20 nt, Human
cccuguggggaucucagggg

SEQ ID NO: 2219004 - RNA, 23 nt, Human
cccuguggggaucucaggggcug

SEQ ID NO: 2219005 - RNA, 11 nt, Human
cccuguugcua

SEQ ID NO: 2219006 - RNA, 11 nt, Human
cccuguuuaau

SEQ ID NO: 2219007 - RNA, 14 nt, Human
cccuguuuaauauu

SEQ ID NO: 2219008 - RNA, 16 nt, Human
cccuguuuaauauuua

SEQ ID NO: 2219009 - RNA, 17 nt, Human
cccuguuuaauauuuaa

SEQ ID NO: 2219010 - RNA, 18 nt, Human
cccuguuuaauauuuaaa

SEQ ID NO: 2219011 - RNA, 19 nt, Human
cccuguuuaauauuuaaac

SEQ ID NO: 2219012 - RNA, 16 nt, Human
cccuguuuguuucuga

SEQ ID NO: 2219013 - RNA, 14 nt, Human
cccuuacaguagga

SEQ ID NO: 2219014 - RNA, 17 nt, Human
cccuuacagccucugac

SEQ ID NO: 2219015 - RNA, 18 nt, Human
cccuuacagccucugacu

SEQ ID NO: 2219016 - RNA, 15 nt, Human
cccuuacacguaccu

SEQ ID NO: 2219017 - RNA, 16 nt, Human
cccuuacacguaccuc

SEQ ID NO: 2219018 - RNA, 14 nt, Human
cccuuacacuuacu

SEQ ID NO: 2219019 - RNA, 15 nt, Human
cccuuacagccucug

SEQ ID NO: 2219020 - RNA, 14 nt, Human
cccuguuuccugag

SEQ ID NO: 2219021 - RNA, 20 nt, Human
cccuguuugaagccugcccu

SEQ ID NO: 2219022 - RNA, 21 nt, Human
cccuguuuaauauuuaaacag

SEQ ID NO: 2219023 - RNA, 15 nt, Human
cccuguuuguuucug

SEQ ID NO: 2219024 - RNA, 23 nt, Human
ccugggaggcggagaguacagug

SEQ ID NO: 2219025 - RNA, 23 nt, Human
ccuggcugagguuccucugccug

SEQ ID NO: 2219026 - RNA, 14 nt, Human
ccugggaggcggag

SEQ ID NO: 2219027 - RNA, 16 nt, Human
ccugggaggcggagag

SEQ ID NO: 2219028 - RNA, 20 nt, Human
ccugggaggucaaggcugca

SEQ ID NO: 2219029 - RNA, 16 nt, Human
ccugggaucccucauc

SEQ ID NO: 2219030 - RNA, 20 nt, Human
ccugggaucccucauccuca

SEQ ID NO: 2219031 - RNA, 13 nt, Human
ccugggaggcagu

SEQ ID NO: 2219032 - RNA, 19 nt, Human
ccuggcugagguuccucug

SEQ ID NO: 2219033 - RNA, 20 nt, Human
ccuggcugagguuccucugc

SEQ ID NO: 2219034 - RNA, 21 nt, Human
ccuggcugagguuccucugcc

SEQ ID NO: 2219035 - RNA, 22 nt, Human
ccuggcugagguuccucugccu

SEQ ID NO: 2219036 - RNA, 16 nt, Human
ccuggcugaaggacug

SEQ ID NO: 2219037 - RNA, 19 nt, Human
ccuggcugaaggacuguga

SEQ ID NO: 2219038 - RNA, 20 nt, Human
ccuggcugaaggacugugac

SEQ ID NO: 2219039 - RNA, 22 nt, Human
ccuggcugaccccaaagagccu

SEQ ID NO: 2219040 - RNA, 23 nt, Human
ccuggcugaccccaaagagccug

SEQ ID NO: 2219041 - RNA, 18 nt, Human
ccuggcugagccuggcug

SEQ ID NO: 2219042 - RNA, 19 nt, Human
ccuggcugagccuggcugg

SEQ ID NO: 2219043 - RNA, 16 nt, Human
ccuggcugagguuccu

SEQ ID NO: 2219044 - RNA, 13 nt, Human
ccugggaggcucu

SEQ ID NO: 2219045 - RNA, 21 nt, Human
ccugggaggcucuggagccca

SEQ ID NO: 2219046 - RNA, 20 nt, Human
ccugggcaccuggggagugg

SEQ ID NO: 2219047 - RNA, 15 nt, Human
ccugggcaccugggg

SEQ ID NO: 2219048 - RNA, 14 nt, Human
ccugggcagaagga

SEQ ID NO: 2219049 - RNA, 22 nt, Human
ccugggauguccacagaugccu

SEQ ID NO: 2219050 - RNA, 20 nt, Human
ccugggauguccacagaugc

SEQ ID NO: 2219051 - RNA, 21 nt, Human
ccugggaugagaguuuuggau

SEQ ID NO: 2219052 - RNA, 15 nt, Human
ccugggaucugcucg

SEQ ID NO: 2219053 - RNA, 13 nt, Human
ccugggcaaagcc

SEQ ID NO: 2219054 - RNA, 21 nt, Human
ccugggauguggcugcagcag

SEQ ID NO: 2219055 - RNA, 23 nt, Human
ccugggauguggcugcagcagcg

SEQ ID NO: 2219056 - RNA, 21 nt, Human
ccugggcaaaugaauggcuca

SEQ ID NO: 2219057 - RNA, 23 nt, Human
ccugggcaaaugaauggcucacu

SEQ ID NO: 2219058 - RNA, 12 nt, Human
ccugggcagaag

SEQ ID NO: 2219059 - RNA, 13 nt, Human
ccuggcucuugug

SEQ ID NO: 2219060 - RNA, 20 nt, Human
ccuggcucuugugcuggaug

SEQ ID NO: 2219061 - RNA, 13 nt, Human
ccuggcugaagga

SEQ ID NO: 2219062 - RNA, 14 nt, Human
ccuggcugaaggac

SEQ ID NO: 2219063 - RNA, 20 nt, Human
ccuggcucugaccgaaacag

SEQ ID NO: 2219064 - RNA, 11 nt, Human
ccuggcucuga

SEQ ID NO: 2219065 - RNA, 16 nt, Human
ccuggcucucagaagg

SEQ ID NO: 2219066 - RNA, 22 nt, Human
ccuggcucugcaaugggcacug

SEQ ID NO: 2219067 - RNA, 21 nt, Human
ccuggcgggaugggccaccgc

SEQ ID NO: 2219068 - RNA, 13 nt, Human
ccuggcgggaugg

SEQ ID NO: 2219069 - RNA, 17 nt, Human
ccuggcgggaugggcca

SEQ ID NO: 2219070 - RNA, 19 nt, Human
ccuggcgggaugggccacc

SEQ ID NO: 2219071 - RNA, 20 nt, Human
ccuggcgggaugggccaccg

SEQ ID NO: 2219072 - RNA, 13 nt, Human
ccuggcucagagc

SEQ ID NO: 2219073 - RNA, 16 nt, Human
ccuggcucagagccag

SEQ ID NO: 2219074 - RNA, 17 nt, Human
ccuggcucagagccagu

SEQ ID NO: 2219075 - RNA, 12 nt, Human
ccuggcggggug

SEQ ID NO: 2219076 - RNA, 14 nt, Human
ccuggccuuucaua

SEQ ID NO: 2219077 - RNA, 20 nt, Human
ccuggcgacugccccugccu

SEQ ID NO: 2219078 - RNA, 14 nt, Human
ccuggccccucagg

SEQ ID NO: 2219079 - RNA, 16 nt, Human
ccuggccccucagggu

SEQ ID NO: 2219080 - RNA, 15 nt, Human
ccuggccuuucauau

SEQ ID NO: 2219081 - RNA, 22 nt, Human
ccuggccaggcagaucugugcc

SEQ ID NO: 2219082 - RNA, 14 nt, Human
ccuggccaggcaga

SEQ ID NO: 2219083 - RNA, 21 nt, Human
ccuggccaggcacccccugga

SEQ ID NO: 2219084 - RNA, 14 nt, Human
ccuggccagggccu

SEQ ID NO: 2219085 - RNA, 15 nt, Human
ccuggccagggccug

SEQ ID NO: 2219086 - RNA, 19 nt, Human
ccuggccagggccuggaag

SEQ ID NO: 2219087 - RNA, 14 nt, Human
ccuggccccauguc

SEQ ID NO: 2219088 - RNA, 18 nt, Human
ccuggccccauggucagc

SEQ ID NO: 2219089 - RNA, 15 nt, Human
ccuggccaucccaca

SEQ ID NO: 2219090 - RNA, 14 nt, Human
ccuggccaucccac

SEQ ID NO: 2219091 - RNA, 20 nt, Human
ccuggccagggccuggaaga

SEQ ID NO: 2219092 - RNA, 23 nt, Human
ccuggccagggccuggaagacag

SEQ ID NO: 2219093 - RNA, 21 nt, Human
ccuggccccaugucucucaga

SEQ ID NO: 2219094 - RNA, 20 nt, Human
ccuggccccaugucucucag

SEQ ID NO: 2219095 - RNA, 18 nt, Human
ccuggccccaugucucuc

SEQ ID NO: 2219096 - RNA, 17 nt, Human
ccuggccccaugucucu

SEQ ID NO: 2219097 - RNA, 15 nt, Human
ccuggccccaugucu

SEQ ID NO: 2219098 - RNA, 14 nt, Human
ccuggcccccagcu

SEQ ID NO: 2219099 - RNA, 12 nt, Human
ccuggcccccag

SEQ ID NO: 2219100 - RNA, 21 nt, Human
ccuggcccccacccucugcca

SEQ ID NO: 2219101 - RNA, 22 nt, Human
ccuggccaggagcucuucaggc

SEQ ID NO: 2219102 - RNA, 12 nt, Human
ccuggccaggca

SEQ ID NO: 2219103 - RNA, 13 nt, Human
ccuggccaggcac

SEQ ID NO: 2219104 - RNA, 21 nt, Human
ccuggccaggagcucuucagg

SEQ ID NO: 2219105 - RNA, 20 nt, Human
ccuggccaggagcucuucag

SEQ ID NO: 2219106 - RNA, 19 nt, Human
ccuggccaggagcucuuca

SEQ ID NO: 2219107 - RNA, 18 nt, Human
ccuggccaggagcucuuc

SEQ ID NO: 2219108 - RNA, 16 nt, Human
ccuggccaggagcucu

SEQ ID NO: 2219109 - RNA, 15 nt, Human
ccuggccaggagcuc

SEQ ID NO: 2219110 - RNA, 14 nt, Human
ccuggccaggagcu

SEQ ID NO: 2219111 - RNA, 18 nt, Human
ccuggcaugggaaugaau

SEQ ID NO: 2219112 - RNA, 22 nt, Human
ccuggacuagagggaccucucc

SEQ ID NO: 2219113 - RNA, 15 nt, Human
ccuggacuagaggga

SEQ ID NO: 2219114 - RNA, 14 nt, Human
ccuggacuccugca

SEQ ID NO: 2219115 - RNA, 17 nt, Human
ccuggacugugugcuca

SEQ ID NO: 2219116 - RNA, 20 nt, Human
ccuggacugugugcucagga

SEQ ID NO: 2219117 - RNA, 14 nt, Human
ccuggacccugugg

SEQ ID NO: 2219118 - RNA, 13 nt, Human
ccuggacccugug

SEQ ID NO: 2219119 - RNA, 21 nt, Human
ccuggaccugcccugggccac

SEQ ID NO: 2219120 - RNA, 23 nt, Human
ccuggaccugcccugggccacac

SEQ ID NO: 2219121 - RNA, 13 nt, Human
ccuggaccugccu

SEQ ID NO: 2219122 - RNA, 14 nt, Human
ccuggaccugccuc

SEQ ID NO: 2219123 - RNA, 16 nt, Human
ccuggaccugccuccu

SEQ ID NO: 2219124 - RNA, 20 nt, Human
ccuggaccugccuccugccu

SEQ ID NO: 2219125 - RNA, 22 nt, Human
ccuggaccugccuccugccugc

SEQ ID NO: 2219126 - RNA, 23 nt, Human
ccuggaccugccuccugccugcc

SEQ ID NO: 2219127 - RNA, 22 nt, Human
ccuggaaaggcucagucucagg

SEQ ID NO: 2219128 - RNA, 21 nt, Human
ccuggaaaggcucagucucag

SEQ ID NO: 2219129 - RNA, 20 nt, Human
ccuggaaaggcucagucuca

SEQ ID NO: 2219130 - RNA, 17 nt, Human
ccuggaaaggcucaguc

SEQ ID NO: 2219131 - RNA, 15 nt, Human
ccuggaaaggcucag

SEQ ID NO: 2219132 - RNA, 23 nt, Human
ccuggaaaggcucagucucagga

SEQ ID NO: 2219133 - RNA, 18 nt, Human
ccuggacauagagaggga

SEQ ID NO: 2219134 - RNA, 20 nt, Human
ccuggacauccucuucugcu

SEQ ID NO: 2219135 - RNA, 24 nt, Human
ccuggacaugaagauucuuuccca

SEQ ID NO: 2219136 - RNA, 20 nt, Human
ccuggacauuugccuugcug

SEQ ID NO: 2219137 - RNA, 21 nt, Human
ccuggacauuugccuugcugg

SEQ ID NO: 2219138 - RNA, 23 nt, Human
ccuggacaugaagauucuuuccc

SEQ ID NO: 2219139 - RNA, 21 nt, Human
ccuggacaugaagauucuuuc

SEQ ID NO: 2219140 - RNA, 19 nt, Human
ccuggacauuuuuucaguc

SEQ ID NO: 2219141 - RNA, 20 nt, Human
ccuggacauuuuuucaguca

SEQ ID NO: 2219142 - RNA, 12 nt, Human
ccuggaccccca

SEQ ID NO: 2219143 - RNA, 15 nt, Human
ccuggacccccagcu

SEQ ID NO: 2219144 - RNA, 16 nt, Human
ccuggacccccagcuu

SEQ ID NO: 2219145 - RNA, 17 nt, Human
ccuggacccccagcuuu

SEQ ID NO: 2219146 - RNA, 14 nt, Human
ccuggacuguuuuc

SEQ ID NO: 2219147 - RNA, 17 nt, Human
ccuggacugggagguag

SEQ ID NO: 2219148 - RNA, 18 nt, Human
ccuggacugggagguaga

SEQ ID NO: 2219149 - RNA, 13 nt, Human
ccuggacugggag

SEQ ID NO: 2219150 - RNA, 14 nt, Human
ccuggacugggagg

SEQ ID NO: 2219151 - RNA, 21 nt, Human
ccuggagauccuccugcagac

SEQ ID NO: 2219152 - RNA, 18 nt, Human
ccuggagcagaccacccc

SEQ ID NO: 2219153 - RNA, 13 nt, Human
ccuggagcaggcc

SEQ ID NO: 2219154 - RNA, 14 nt, Human
ccuggagcaggccu

SEQ ID NO: 2219155 - RNA, 15 nt, Human
ccuggagcaggccuu

SEQ ID NO: 2219156 - RNA, 12 nt, Human
ccuggagccccu

SEQ ID NO: 2219157 - RNA, 11 nt, Human
ccuggagcccc

SEQ ID NO: 2219158 - RNA, 13 nt, Human
ccuggagccccug

SEQ ID NO: 2219159 - RNA, 14 nt, Human
ccuggagcccagag

SEQ ID NO: 2219160 - RNA, 17 nt, Human
ccuggagcccagaggag

SEQ ID NO: 2219161 - RNA, 13 nt, Human
ccuggagcccaga

SEQ ID NO: 2219162 - RNA, 16 nt, Human
ccuggagccagacucu

SEQ ID NO: 2219163 - RNA, 22 nt, Human
ccuggagccagacucuggucuu

SEQ ID NO: 2219164 - RNA, 18 nt, Human
ccuggagcaggccuugcg

SEQ ID NO: 2219165 - RNA, 19 nt, Human
ccuggagcaggccuugcgc

SEQ ID NO: 2219166 - RNA, 15 nt, Human
ccuggagccaacugc

SEQ ID NO: 2219167 - RNA, 18 nt, Human
ccuggagccaacugcugc

SEQ ID NO: 2219168 - RNA, 20 nt, Human
ccuggcacugcuuccaguga

SEQ ID NO: 2219169 - RNA, 17 nt, Human
ccuggcacugcuuccag

SEQ ID NO: 2219170 - RNA, 12 nt, Human
ccuggcagccgu

SEQ ID NO: 2219171 - RNA, 18 nt, Human
ccuggcagccgugccuuc

SEQ ID NO: 2219172 - RNA, 19 nt, Human
ccuggcagccgugccuuca

SEQ ID NO: 2219173 - RNA, 16 nt, Human
ccuggcaugggaauga

SEQ ID NO: 2219174 - RNA, 17 nt, Human
ccuggcaugggaaugaa

SEQ ID NO: 2219175 - RNA, 13 nt, Human
ccuggcagaacug

SEQ ID NO: 2219176 - RNA, 14 nt, Human
ccuggcagccccug

SEQ ID NO: 2219177 - RNA, 16 nt, Human
ccuggcagccccuguu

SEQ ID NO: 2219178 - RNA, 21 nt, Human
ccuggcacugcuuccagugag

SEQ ID NO: 2219179 - RNA, 17 nt, Human
ccuggagccccugggug

SEQ ID NO: 2219180 - RNA, 14 nt, Human
ccuggagccccugg

SEQ ID NO: 2219181 - RNA, 16 nt, Human
ccuggagccccugggu

SEQ ID NO: 2219182 - RNA, 15 nt, Human
ccugcuuccugucuu

SEQ ID NO: 2219183 - RNA, 22 nt, Human
ccugcuuccugucuuugggaga

SEQ ID NO: 2219184 - RNA, 14 nt, Human
ccugcuucuccagc

SEQ ID NO: 2219185 - RNA, 15 nt, Human
ccugcuucuccagcc

SEQ ID NO: 2219186 - RNA, 16 nt, Human
ccugcuucuccagccu

SEQ ID NO: 2219187 - RNA, 17 nt, Human
ccugcuucuccagccug

SEQ ID NO: 2219188 - RNA, 20 nt, Human
ccugcuucuccagccuggac

SEQ ID NO: 2219189 - RNA, 22 nt, Human
ccugcuucuccagccuggaccc

SEQ ID NO: 2219190 - RNA, 18 nt, Human
ccugcuggucacagccuc

SEQ ID NO: 2219191 - RNA, 20 nt, Human
ccugcuggucacagccuccu

SEQ ID NO: 2219192 - RNA, 12 nt, Human
ccugcugucccc

SEQ ID NO: 2219193 - RNA, 22 nt, Human
ccugcuuccaggaaacuccaca

SEQ ID NO: 2219194 - RNA, 19 nt, Human
ccugcugguucaggguugg

SEQ ID NO: 2219195 - RNA, 13 nt, Human
ccugcugguucag

SEQ ID NO: 2219196 - RNA, 17 nt, Human
ccugcuggucacagccu

SEQ ID NO: 2219197 - RNA, 19 nt, Human
ccugcuccucccuggcugc

SEQ ID NO: 2219198 - RNA, 20 nt, Human
ccugcuccucccuggcugcc

SEQ ID NO: 2219199 - RNA, 21 nt, Human
ccugcuggguguggcgcagca

SEQ ID NO: 2219200 - RNA, 16 nt, Human
ccugcucccccacccc

SEQ ID NO: 2219201 - RNA, 14 nt, Human
ccugcucccccacc

SEQ ID NO: 2219202 - RNA, 23 nt, Human
ccugcucccccacccccucccca

SEQ ID NO: 2219203 - RNA, 18 nt, Human
ccugcucccccacccccu

SEQ ID NO: 2219204 - RNA, 15 nt, Human
ccugcucccucccau

SEQ ID NO: 2219205 - RNA, 15 nt, Human
ccugcuccucccugg

SEQ ID NO: 2219206 - RNA, 16 nt, Human
ccugcuccucccuggc

SEQ ID NO: 2219207 - RNA, 17 nt, Human
ccugcuccucccuggcu

SEQ ID NO: 2219208 - RNA, 18 nt, Human
ccugcuccucccuggcug

SEQ ID NO: 2219209 - RNA, 18 nt, Human
ccugcuuugggcugcccu

SEQ ID NO: 2219210 - RNA, 17 nt, Human
ccugcuuugggcugccc

SEQ ID NO: 2219211 - RNA, 17 nt, Human
ccuggaaaccacagucc

SEQ ID NO: 2219212 - RNA, 12 nt, Human
ccuggaaaccac

SEQ ID NO: 2219213 - RNA, 15 nt, Human
ccuggaaaccacagu

SEQ ID NO: 2219214 - RNA, 16 nt, Human
ccuggaaaccacaguc

SEQ ID NO: 2219215 - RNA, 20 nt, Human
ccugcuuuuuauggccugug

SEQ ID NO: 2219216 - RNA, 21 nt, Human
ccugcuuggguggagaagcca

SEQ ID NO: 2219217 - RNA, 22 nt, Human
ccugcuuggguggagaagccau

SEQ ID NO: 2219218 - RNA, 23 nt, Human
ccugcuuggguggagaagccauu

SEQ ID NO: 2219219 - RNA, 20 nt, Human
ccugcuuggguggagaagcc

SEQ ID NO: 2219220 - RNA, 22 nt, Human
ccugauuuaggagaagccagga

SEQ ID NO: 2219221 - RNA, 21 nt, Human
ccugauuuaggagaagccagg

SEQ ID NO: 2219222 - RNA, 20 nt, Human
ccugauuuaggagaagccag

SEQ ID NO: 2219223 - RNA, 19 nt, Human
ccugauuuaggagaagcca

SEQ ID NO: 2219224 - RNA, 18 nt, Human
ccugauuuaggagaagcc

SEQ ID NO: 2219225 - RNA, 14 nt, Human
ccugauuuacaguu

SEQ ID NO: 2219226 - RNA, 17 nt, Human
ccugauuuacaguuuca

SEQ ID NO: 2219227 - RNA, 20 nt, Human
ccugauuuacaguuucaaaa

SEQ ID NO: 2219228 - RNA, 22 nt, Human
ccugauuugcugggcaguuuuu

SEQ ID NO: 2219229 - RNA, 17 nt, Human
ccugauuugcugggcag

SEQ ID NO: 2219230 - RNA, 19 nt, Human
ccugcaaagcccagcuuga

SEQ ID NO: 2219231 - RNA, 16 nt, Human
ccugauuuuuuuuccu

SEQ ID NO: 2219232 - RNA, 18 nt, Human
ccugcaacaccuuguuuc

SEQ ID NO: 2219233 - RNA, 23 nt, Human
ccugcgucucauacucaccucac

SEQ ID NO: 2219234 - RNA, 22 nt, Human
ccugcguccuccucaccucaug

SEQ ID NO: 2219235 - RNA, 23 nt, Human
ccugcgucgaagcuuugaaggcc

SEQ ID NO: 2219236 - RNA, 19 nt, Human
ccugcaacaccuuguuucc

SEQ ID NO: 2219237 - RNA, 16 nt, Human
ccugcaaccugauugu

SEQ ID NO: 2219238 - RNA, 22 nt, Human
ccugcuccagcuguucagcugg

SEQ ID NO: 2219239 - RNA, 12 nt, Human
ccugcucccagc

SEQ ID NO: 2219240 - RNA, 13 nt, Human
ccugcucccagca

SEQ ID NO: 2219241 - RNA, 14 nt, Human
ccugcucccagcag

SEQ ID NO: 2219242 - RNA, 15 nt, Human
ccugcucccagcagc

SEQ ID NO: 2219243 - RNA, 16 nt, Human
ccugcucccagcagcc

SEQ ID NO: 2219244 - RNA, 23 nt, Human
ccugcucccagcagcccuaagga

SEQ ID NO: 2219245 - RNA, 12 nt, Human
ccugcucccagg

SEQ ID NO: 2219246 - RNA, 16 nt, Human
ccugcucccaggccag

SEQ ID NO: 2219247 - RNA, 14 nt, Human
ccugcuccagcugu

SEQ ID NO: 2219248 - RNA, 13 nt, Human
ccugcuccagcug

SEQ ID NO: 2219249 - RNA, 12 nt, Human
ccugcuccagcu

SEQ ID NO: 2219250 - RNA, 22 nt, Human
ccugcuccagaccugauccugg

SEQ ID NO: 2219251 - RNA, 16 nt, Human
ccugcuccagaccuga

SEQ ID NO: 2219252 - RNA, 12 nt, Human
ccugcgugggga

SEQ ID NO: 2219253 - RNA, 13 nt, Human
ccugcguggggac

SEQ ID NO: 2219254 - RNA, 15 nt, Human
ccugcguggggacag

SEQ ID NO: 2219255 - RNA, 16 nt, Human
ccugcguggggacagg

SEQ ID NO: 2219256 - RNA, 17 nt, Human
ccugcguggggacaggg

SEQ ID NO: 2219257 - RNA, 22 nt, Human
ccugcguuuuggaagcucugaa

SEQ ID NO: 2219258 - RNA, 19 nt, Human
ccugcguucuugugacaga

SEQ ID NO: 2219259 - RNA, 13 nt, Human
ccuguagucccag

SEQ ID NO: 2219260 - RNA, 14 nt, Human
ccuguagucccagc

SEQ ID NO: 2219261 - RNA, 18 nt, Human
ccuguagucccagccacu

SEQ ID NO: 2219262 - RNA, 19 nt, Human
ccuguagucccagccacuc

SEQ ID NO: 2219263 - RNA, 15 nt, Human
ccuguaguuaggaaa

SEQ ID NO: 2219264 - RNA, 14 nt, Human
ccuguaguuaggaa

SEQ ID NO: 2219265 - RNA, 13 nt, Human
ccuguaguccuag

SEQ ID NO: 2219266 - RNA, 16 nt, Human
ccuguagucccagcua

SEQ ID NO: 2219267 - RNA, 15 nt, Human
ccuguagucccagcu

SEQ ID NO: 2219268 - RNA, 19 nt, Human
ccuguaguuaggaaauaaa

SEQ ID NO: 2219269 - RNA, 18 nt, Human
ccuguaguuaggaaauaa

SEQ ID NO: 2219270 - RNA, 17 nt, Human
ccuguaguuaggaaaua

SEQ ID NO: 2219271 - RNA, 16 nt, Human
ccuguaguuaggaaau

SEQ ID NO: 2219272 - RNA, 22 nt, Human
ccuguaguuaggaaauaaaacc

SEQ ID NO: 2219273 - RNA, 21 nt, Human
ccuguaguuaggaaauaaaac

SEQ ID NO: 2219274 - RNA, 23 nt, Human
ccuguaguuaggaaauaaaaccu

SEQ ID NO: 2219275 - RNA, 18 nt, Human
ccuguaguugcguggacu

SEQ ID NO: 2219276 - RNA, 19 nt, Human
ccugucaaacaaagccaga

SEQ ID NO: 2219277 - RNA, 18 nt, Human
ccugucaaacaaagccag

SEQ ID NO: 2219278 - RNA, 17 nt, Human
ccuguauuuucuuucuc

SEQ ID NO: 2219279 - RNA, 22 nt, Human
ccugucaaacaaagccagaagc

SEQ ID NO: 2219280 - RNA, 20 nt, Human
ccugucaaacaaagccagaa

SEQ ID NO: 2219281 - RNA, 23 nt, Human
ccugucaaacaaagccagaagcu

SEQ ID NO: 2219282 - RNA, 19 nt, Human
ccuguaguugcguggacuc

SEQ ID NO: 2219283 - RNA, 16 nt, Human
ccuguaugucuccagu

SEQ ID NO: 2219284 - RNA, 17 nt, Human
ccuguaugucuccagua

SEQ ID NO: 2219285 - RNA, 13 nt, Human
ccuguauguuguc

SEQ ID NO: 2219286 - RNA, 14 nt, Human
ccuguauguugucc

SEQ ID NO: 2219287 - RNA, 22 nt, Human
ccuguauucucaaacacaguua

SEQ ID NO: 2219288 - RNA, 23 nt, Human
ccuguacucaggaggcugagggg

SEQ ID NO: 2219289 - RNA, 17 nt, Human
ccuguacucgcuugugc

SEQ ID NO: 2219290 - RNA, 18 nt, Human
ccuguacucgcuugugca

SEQ ID NO: 2219291 - RNA, 19 nt, Human
ccuguacucgcuugugcag

SEQ ID NO: 2219292 - RNA, 20 nt, Human
ccuguacucgcuugugcaga

SEQ ID NO: 2219293 - RNA, 15 nt, Human
ccuguacucuuccga

SEQ ID NO: 2219294 - RNA, 16 nt, Human
ccuguacucuuccgaa

SEQ ID NO: 2219295 - RNA, 17 nt, Human
ccuguacuguucugugu

SEQ ID NO: 2219296 - RNA, 22 nt, Human
ccuguacucaggaggcugaggg

SEQ ID NO: 2219297 - RNA, 21 nt, Human
ccuguacucaggaggcugagg

SEQ ID NO: 2219298 - RNA, 15 nt, Human
ccuguacucaggagg

SEQ ID NO: 2219299 - RNA, 14 nt, Human
ccuguacucaggag

SEQ ID NO: 2219300 - RNA, 13 nt, Human
ccuguacucagga

SEQ ID NO: 2219301 - RNA, 23 nt, Human
ccuguaccuuuugaggagcccca

SEQ ID NO: 2219302 - RNA, 12 nt, Human
ccuguacacuga

SEQ ID NO: 2219303 - RNA, 22 nt, Human
ccuguaccuuuugaggagcccc

SEQ ID NO: 2219304 - RNA, 23 nt, Human
ccuguagagugggagcugagugg

SEQ ID NO: 2219305 - RNA, 18 nt, Human
ccuguacuguucuguguc

SEQ ID NO: 2219306 - RNA, 15 nt, Human
ccuguagcacuuacu

SEQ ID NO: 2219307 - RNA, 19 nt, Human
ccuguagagugggagcuga

SEQ ID NO: 2219308 - RNA, 21 nt, Human
ccuguagagugggagcugagu

SEQ ID NO: 2219309 - RNA, 16 nt, Human
ccuguaaucccagcag

SEQ ID NO: 2219310 - RNA, 21 nt, Human
ccuguaaucccagcacuuugg

SEQ ID NO: 2219311 - RNA, 23 nt, Human
ccuguaaucccagcacuuuggga

SEQ ID NO: 2219312 - RNA, 18 nt, Human
ccuguaaucccagcacuu

SEQ ID NO: 2219313 - RNA, 20 nt, Human
ccuguaaucccagcacuugg

SEQ ID NO: 2219314 - RNA, 20 nt, Human
ccuguaauccuagcacuuug

SEQ ID NO: 2219315 - RNA, 21 nt, Human
ccuguacacugaauauuuaua

SEQ ID NO: 2219316 - RNA, 21 nt, Human
ccuguacaauauuuaaaauuu

SEQ ID NO: 2219317 - RNA, 18 nt, Human
ccuguaauuuuuuucuua

SEQ ID NO: 2219318 - RNA, 15 nt, Human
ccuguacaauauuua

SEQ ID NO: 2219319 - RNA, 23 nt, Human
ccuguaaucccagcuacucagga

SEQ ID NO: 2219320 - RNA, 18 nt, Human
ccuguaaucccagcuacu

SEQ ID NO: 2219321 - RNA, 16 nt, Human
ccuguaaucccagcua

SEQ ID NO: 2219322 - RNA, 15 nt, Human
ccuguaaucccagcu

SEQ ID NO: 2219323 - RNA, 23 nt, Human
ccuguaauuguuguuuguaugua

SEQ ID NO: 2219324 - RNA, 23 nt, Human
ccuguaauuccuaccucccugca

SEQ ID NO: 2219325 - RNA, 14 nt, Human
ccugguggcagcuc

SEQ ID NO: 2219326 - RNA, 16 nt, Human
ccugguggcagcucac

SEQ ID NO: 2219327 - RNA, 17 nt, Human
ccugguggcagcucacc

SEQ ID NO: 2219328 - RNA, 18 nt, Human
ccugguggcagcucaccu

SEQ ID NO: 2219329 - RNA, 20 nt, Human
ccugguggacaguccuggga

SEQ ID NO: 2219330 - RNA, 12 nt, Human
ccugguggagaa

SEQ ID NO: 2219331 - RNA, 22 nt, Human
ccugguggagaaagcacugacc

SEQ ID NO: 2219332 - RNA, 19 nt, Human
ccugguggacaguccuggg

SEQ ID NO: 2219333 - RNA, 18 nt, Human
ccugguggacaguccugg

SEQ ID NO: 2219334 - RNA, 17 nt, Human
ccugguggacaguccug

SEQ ID NO: 2219335 - RNA, 14 nt, Human
ccugguggacaguc

SEQ ID NO: 2219336 - RNA, 12 nt, Human
ccugguggacag

SEQ ID NO: 2219337 - RNA, 12 nt, Human
ccugguggcagc

SEQ ID NO: 2219338 - RNA, 13 nt, Human
ccugguggcagcu

SEQ ID NO: 2219339 - RNA, 13 nt, Human
ccuggugcuggau

SEQ ID NO: 2219340 - RNA, 13 nt, Human
ccuggugcugcug

SEQ ID NO: 2219341 - RNA, 13 nt, Human
ccugggcagaaag

SEQ ID NO: 2219342 - RNA, 17 nt, Human
ccugggcaccuggggag

SEQ ID NO: 2219343 - RNA, 15 nt, Human
ccuggugcugccucu

SEQ ID NO: 2219344 - RNA, 12 nt, Human
ccuggugcugcu

SEQ ID NO: 2219345 - RNA, 20 nt, Human
ccuggugcugccucuaccug

SEQ ID NO: 2219346 - RNA, 18 nt, Human
ccuggugcugccacacuu

SEQ ID NO: 2219347 - RNA, 21 nt, Human
ccuggugcugccacacuucag

SEQ ID NO: 2219348 - RNA, 15 nt, Human
ccuggugcugccaca

SEQ ID NO: 2219349 - RNA, 15 nt, Human
ccugugcccuuauuc

SEQ ID NO: 2219350 - RNA, 15 nt, Human
ccugugccuccucac

SEQ ID NO: 2219351 - RNA, 18 nt, Human
ccugugccuaacaccagc

SEQ ID NO: 2219352 - RNA, 23 nt, Human
ccugugcccacaucccaggcuuc

SEQ ID NO: 2219353 - RNA, 21 nt, Human
ccugugccacccaccagggcg

SEQ ID NO: 2219354 - RNA, 19 nt, Human
ccugugccacccaccaggg

SEQ ID NO: 2219355 - RNA, 20 nt, Human
ccugugcauguaugucuugg

SEQ ID NO: 2219356 - RNA, 14 nt, Human
ccugugcauguaug

SEQ ID NO: 2219357 - RNA, 17 nt, Human
ccugugcauguaugucu

SEQ ID NO: 2219358 - RNA, 21 nt, Human
ccugugcagccgcugagcgag

SEQ ID NO: 2219359 - RNA, 20 nt, Human
ccugugcagccgcugagcga

SEQ ID NO: 2219360 - RNA, 18 nt, Human
ccugugcagccgcugagc

SEQ ID NO: 2219361 - RNA, 17 nt, Human
ccugugccucugggacu

SEQ ID NO: 2219362 - RNA, 15 nt, Human
ccugugccucuggga

SEQ ID NO: 2219363 - RNA, 22 nt, Human
ccugugcugcccgucuucagcc

SEQ ID NO: 2219364 - RNA, 21 nt, Human
ccugugccuccucacccccag

SEQ ID NO: 2219365 - RNA, 20 nt, Human
ccugugccuccucaccccca

SEQ ID NO: 2219366 - RNA, 19 nt, Human
ccugugccucugggacugg

SEQ ID NO: 2219367 - RNA, 19 nt, Human
ccugugaggugcagagugc

SEQ ID NO: 2219368 - RNA, 17 nt, Human
ccugugaggcaggggcg

SEQ ID NO: 2219369 - RNA, 23 nt, Human
ccugugaggugcagagugcccag

SEQ ID NO: 2219370 - RNA, 17 nt, Human
ccugugauggggcccug

SEQ ID NO: 2219371 - RNA, 18 nt, Human
ccugugauggggcccugc

SEQ ID NO: 2219372 - RNA, 19 nt, Human
ccugugauggggcccugcc

SEQ ID NO: 2219373 - RNA, 22 nt, Human
ccugugauggggcccugccucc

SEQ ID NO: 2219374 - RNA, 20 nt, Human
ccugugauggggcccugccu

SEQ ID NO: 2219375 - RNA, 21 nt, Human
ccugugauggggcccugccuc

SEQ ID NO: 2219376 - RNA, 16 nt, Human
ccuguccucccauccc

SEQ ID NO: 2219377 - RNA, 22 nt, Human
ccuguccuccaacaccaagcac

SEQ ID NO: 2219378 - RNA, 21 nt, Human
ccuguccuccaacaccaagca

SEQ ID NO: 2219379 - RNA, 15 nt, Human
ccuguccucagcuuc

SEQ ID NO: 2219380 - RNA, 13 nt, Human
ccuguccuccaac

SEQ ID NO: 2219381 - RNA, 13 nt, Human
ccugucccuccca

SEQ ID NO: 2219382 - RNA, 22 nt, Human
ccuguccucacugcucccugaa

SEQ ID NO: 2219383 - RNA, 23 nt, Human
ccuguccuccucggaucaccgag

SEQ ID NO: 2219384 - RNA, 15 nt, Human
ccuguccuccucgga

SEQ ID NO: 2219385 - RNA, 14 nt, Human
ccuguccuccucgg

SEQ ID NO: 2219386 - RNA, 13 nt, Human
ccuguccuccucg

SEQ ID NO: 2219387 - RNA, 17 nt, Human
ccuguccucccaucccc

SEQ ID NO: 2219388 - RNA, 21 nt, Human
ccuguccucccauccccugga

SEQ ID NO: 2219389 - RNA, 22 nt, Human
ccuguccucccauccccuggac

SEQ ID NO: 2219390 - RNA, 23 nt, Human
ccuguccucccauccccuggacu

SEQ ID NO: 2219391 - RNA, 18 nt, Human
ccugugacuucagcucug

SEQ ID NO: 2219392 - RNA, 14 nt, Human
ccuguccuccuggu

SEQ ID NO: 2219393 - RNA, 16 nt, Human
ccuguccuccuggugg

SEQ ID NO: 2219394 - RNA, 17 nt, Human
ccuguccuccugguggg

SEQ ID NO: 2219395 - RNA, 22 nt, Human
ccuguccuccugguggguccag

SEQ ID NO: 2219396 - RNA, 14 nt, Human
ccugugaggcaggg

SEQ ID NO: 2219397 - RNA, 13 nt, Human
ccugugaggcagg

SEQ ID NO: 2219398 - RNA, 20 nt, Human
ccugugagcccagcuggguc

SEQ ID NO: 2219399 - RNA, 20 nt, Human
ccugugaguacuacaguccu

SEQ ID NO: 2219400 - RNA, 17 nt, Human
ccugugagcccagcugg

SEQ ID NO: 2219401 - RNA, 15 nt, Human
ccugugagcccagcu

SEQ ID NO: 2219402 - RNA, 22 nt, Human
ccugugagcuaggaauuguguu

SEQ ID NO: 2219403 - RNA, 16 nt, Human
ccuguccagccugggc

SEQ ID NO: 2219404 - RNA, 14 nt, Human
ccuguccagccugg

SEQ ID NO: 2219405 - RNA, 12 nt, Human
ccuguccagccu

SEQ ID NO: 2219406 - RNA, 13 nt, Human
ccuguccagagag

SEQ ID NO: 2219407 - RNA, 22 nt, Human
ccuguccagccugggcagccag

SEQ ID NO: 2219408 - RNA, 13 nt, Human
ccuguccagcucc

SEQ ID NO: 2219409 - RNA, 15 nt, Human
ccuguccagcuccaa

SEQ ID NO: 2219410 - RNA, 14 nt, Human
ccuguccagcucca

SEQ ID NO: 2219411 - RNA, 23 nt, Human
ccuguccaaccuaaccccuuucc

SEQ ID NO: 2219412 - RNA, 18 nt, Human
ccuguccacacccagcuc

SEQ ID NO: 2219413 - RNA, 16 nt, Human
ccuguccacacccagc

SEQ ID NO: 2219414 - RNA, 22 nt, Human
ccuguccacacccagcucagca

SEQ ID NO: 2219415 - RNA, 19 nt, Human
ccuguccacacccagcuca

SEQ ID NO: 2219416 - RNA, 21 nt, Human
ccuguccacacccagcucagc

SEQ ID NO: 2219417 - RNA, 19 nt, Human
ccuguccaaccuaaccccu

SEQ ID NO: 2219418 - RNA, 12 nt, Human
ccuguccaaccu

SEQ ID NO: 2219419 - RNA, 23 nt, Human
ccuguccaaacugccuaagcccu

SEQ ID NO: 2219420 - RNA, 19 nt, Human
ccuguccaaacugccuaag

SEQ ID NO: 2219421 - RNA, 17 nt, Human
ccuguccaaacugccua

SEQ ID NO: 2219422 - RNA, 19 nt, Human
ccuguccagcuccaaccug

SEQ ID NO: 2219423 - RNA, 16 nt, Human
ccugucccccugacaa

SEQ ID NO: 2219424 - RNA, 17 nt, Human
ccugucccccugacaac

SEQ ID NO: 2219425 - RNA, 18 nt, Human
ccuguccccgcacugggc

SEQ ID NO: 2219426 - RNA, 14 nt, Human
ccuguccccucagc

SEQ ID NO: 2219427 - RNA, 15 nt, Human
ccuguccccucagcu

SEQ ID NO: 2219428 - RNA, 16 nt, Human
ccuguccccucagcuc

SEQ ID NO: 2219429 - RNA, 17 nt, Human
ccuguccccucagcucc

SEQ ID NO: 2219430 - RNA, 18 nt, Human
ccuguccccucagcucca

SEQ ID NO: 2219431 - RNA, 21 nt, Human
ccuguccccucagcuccagac

SEQ ID NO: 2219432 - RNA, 19 nt, Human
ccuguggaaucuggaguga

SEQ ID NO: 2219433 - RNA, 12 nt, Human
ccuucaggguga

SEQ ID NO: 2219434 - RNA, 18 nt, Human
ccuucagggugaugccag

SEQ ID NO: 2219435 - RNA, 19 nt, Human
ccuucagggugaugccagg

SEQ ID NO: 2219436 - RNA, 20 nt, Human
ccuucagggugaugccaggu

SEQ ID NO: 2219437 - RNA, 18 nt, Human
ccuucacaaagcccaagg

SEQ ID NO: 2219438 - RNA, 12 nt, Human
ccuucacaaagc

SEQ ID NO: 2219439 - RNA, 20 nt, Human
ccuucaauuccugggcccca

SEQ ID NO: 2219440 - RNA, 16 nt, Human
ccuucaauuccugggc

SEQ ID NO: 2219441 - RNA, 15 nt, Human
ccuucaauuccuggg

SEQ ID NO: 2219442 - RNA, 14 nt, Human
ccuucaauuccugg

SEQ ID NO: 2219443 - RNA, 19 nt, Human
ccuucaaguuagcucagga

SEQ ID NO: 2219444 - RNA, 17 nt, Human
ccuucaaguuagcucag

SEQ ID NO: 2219445 - RNA, 16 nt, Human
ccuucaauaaaguauc

SEQ ID NO: 2219446 - RNA, 22 nt, Human
ccuucaauaaaugguauagcaa

SEQ ID NO: 2219447 - RNA, 14 nt, Human
ccuucaauaaagua

SEQ ID NO: 2219448 - RNA, 13 nt, Human
ccuucagugccuu

SEQ ID NO: 2219449 - RNA, 14 nt, Human
ccuucagugccuua

SEQ ID NO: 2219450 - RNA, 17 nt, Human
ccuucaguacccucuca

SEQ ID NO: 2219451 - RNA, 19 nt, Human
ccuucaguacccucucagc

SEQ ID NO: 2219452 - RNA, 20 nt, Human
ccuucaguacccucucagcu

SEQ ID NO: 2219453 - RNA, 23 nt, Human
ccuucaguacccucucagcucca

SEQ ID NO: 2219454 - RNA, 20 nt, Human
ccuucagucuugaauuucua

SEQ ID NO: 2219455 - RNA, 24 nt, Human
ccuucaguacccucucagcuccag

SEQ ID NO: 2219456 - RNA, 15 nt, Human
ccuucagugccuuau

SEQ ID NO: 2219457 - RNA, 21 nt, Human
ccuucagucuugaauuucuaa

SEQ ID NO: 2219458 - RNA, 18 nt, Human
ccuucaguuaugauuuuu

SEQ ID NO: 2219459 - RNA, 20 nt, Human
ccuucagugccuuauggaac

SEQ ID NO: 2219460 - RNA, 16 nt, Human
ccuuccaccucccucc

SEQ ID NO: 2219461 - RNA, 15 nt, Human
ccuuccacaccccca

SEQ ID NO: 2219462 - RNA, 18 nt, Human
ccuuccacacccccaccc

SEQ ID NO: 2219463 - RNA, 14 nt, Human
ccuucaucuccagg

SEQ ID NO: 2219464 - RNA, 13 nt, Human
ccuucaucuggaa

SEQ ID NO: 2219465 - RNA, 15 nt, Human
ccuucaucuccaggg

SEQ ID NO: 2219466 - RNA, 14 nt, Human
ccuucaucuggaac

SEQ ID NO: 2219467 - RNA, 17 nt, Human
ccuucaucuccagggag

SEQ ID NO: 2219468 - RNA, 19 nt, Human
ccuuccaugucgccucugc

SEQ ID NO: 2219469 - RNA, 20 nt, Human
ccuuccaugucgccucugca

SEQ ID NO: 2219470 - RNA, 21 nt, Human
ccuuccaugucgccucugcau

SEQ ID NO: 2219471 - RNA, 23 nt, Human
ccuuccaugucgccucugcauuc

SEQ ID NO: 2219472 - RNA, 18 nt, Human
ccuuccaggggugggaca

SEQ ID NO: 2219473 - RNA, 22 nt, Human
ccuuccaggggugggacacccu

SEQ ID NO: 2219474 - RNA, 21 nt, Human
ccuuccacggauccauguagc

SEQ ID NO: 2219475 - RNA, 20 nt, Human
ccuuccacgcugucuccaga

SEQ ID NO: 2219476 - RNA, 20 nt, Human
ccuuccacggauccauguag

SEQ ID NO: 2219477 - RNA, 19 nt, Human
ccuuccacgcugucuccag

SEQ ID NO: 2219478 - RNA, 18 nt, Human
ccuuccacgcugucucca

SEQ ID NO: 2219479 - RNA, 17 nt, Human
ccuuccacugagggcag

SEQ ID NO: 2219480 - RNA, 15 nt, Human
ccuuccacugagggc

SEQ ID NO: 2219481 - RNA, 15 nt, Human
ccuuccagggguggg

SEQ ID NO: 2219482 - RNA, 16 nt, Human
ccuuccagggguggga

SEQ ID NO: 2219483 - RNA, 14 nt, Human
ccuuccucuuucca

SEQ ID NO: 2219484 - RNA, 18 nt, Human
ccuuccucugcagcugac

SEQ ID NO: 2219485 - RNA, 16 nt, Human
ccuuccucugcagcug

SEQ ID NO: 2219486 - RNA, 17 nt, Human
ccuuccucugcagcuga

SEQ ID NO: 2219487 - RNA, 14 nt, Human
ccuuccugccacca

SEQ ID NO: 2219488 - RNA, 20 nt, Human
ccuuccaugucggccucuaa

SEQ ID NO: 2219489 - RNA, 16 nt, Human
ccuucccaaaggacuc

SEQ ID NO: 2219490 - RNA, 19 nt, Human
ccuuccaugucggccucua

SEQ ID NO: 2219491 - RNA, 16 nt, Human
ccuuccauguggagaa

SEQ ID NO: 2219492 - RNA, 14 nt, Human
ccuuccucugaggc

SEQ ID NO: 2219493 - RNA, 12 nt, Human
ccuuccucugca

SEQ ID NO: 2219494 - RNA, 15 nt, Human
ccuuccucugcagcu

SEQ ID NO: 2219495 - RNA, 18 nt, Human
ccuucccaaaggacucca

SEQ ID NO: 2219496 - RNA, 21 nt, Human
ccuucccaaaggacuccaccc

SEQ ID NO: 2219497 - RNA, 15 nt, Human
ccuucgauacaccgg

SEQ ID NO: 2219498 - RNA, 18 nt, Human
ccuuccugccaccugcug

SEQ ID NO: 2219499 - RNA, 11 nt, Human
ccuuccugccc

SEQ ID NO: 2219500 - RNA, 17 nt, Human
ccuuccugccaccugcu

SEQ ID NO: 2219501 - RNA, 17 nt, Human
ccuuccugccaccaguc

SEQ ID NO: 2219502 - RNA, 16 nt, Human
ccuuccugccaccagu

SEQ ID NO: 2219503 - RNA, 20 nt, Human
ccuucgauacaccgggccug

SEQ ID NO: 2219504 - RNA, 22 nt, Human
ccuucgauacaccgggccugga

SEQ ID NO: 2219505 - RNA, 23 nt, Human
ccuucgauacaccgggccuggag

SEQ ID NO: 2219506 - RNA, 13 nt, Human
ccuucgccaccug

SEQ ID NO: 2219507 - RNA, 20 nt, Human
ccuguggccaaguucuuagu

SEQ ID NO: 2219508 - RNA, 23 nt, Human
ccuguggcaucuuugccuugggc

SEQ ID NO: 2219509 - RNA, 18 nt, Human
ccuguggcaucuuugccu

SEQ ID NO: 2219510 - RNA, 15 nt, Human
ccuguggccccaccc

SEQ ID NO: 2219511 - RNA, 16 nt, Human
ccuguggccccacccu

SEQ ID NO: 2219512 - RNA, 17 nt, Human
ccuguggccccacccug

SEQ ID NO: 2219513 - RNA, 14 nt, Human
ccuuaccagcagag

SEQ ID NO: 2219514 - RNA, 18 nt, Human
ccuguggccccacccugg

SEQ ID NO: 2219515 - RNA, 20 nt, Human
ccuguggccccacccugggc

SEQ ID NO: 2219516 - RNA, 22 nt, Human
ccuguggccccacccugggccc

SEQ ID NO: 2219517 - RNA, 19 nt, Human
ccuguggcaggcagcgcca

SEQ ID NO: 2219518 - RNA, 22 nt, Human
ccuguggcaggcagcgccaagc

SEQ ID NO: 2219519 - RNA, 24 nt, Human
ccuguggaagggacuaggagcacu

SEQ ID NO: 2219520 - RNA, 14 nt, Human
ccuguggcaggcag

SEQ ID NO: 2219521 - RNA, 15 nt, Human
ccuguggcaggcagc

SEQ ID NO: 2219522 - RNA, 18 nt, Human
ccuguggcaggcagcgcc

SEQ ID NO: 2219523 - RNA, 20 nt, Human
ccuguggaagggacuaggag

SEQ ID NO: 2219524 - RNA, 19 nt, Human
ccuguggaagggacuagga

SEQ ID NO: 2219525 - RNA, 16 nt, Human
ccuguggaagggacua

SEQ ID NO: 2219526 - RNA, 24 nt, Human
ccugugcugguguccugaccaccc

SEQ ID NO: 2219527 - RNA, 23 nt, Human
ccugugcugcccgucuucagccu

SEQ ID NO: 2219528 - RNA, 12 nt, Human
ccugugcuggug

SEQ ID NO: 2219529 - RNA, 14 nt, Human
ccugugcugguguc

SEQ ID NO: 2219530 - RNA, 17 nt, Human
ccugugcugguguccug

SEQ ID NO: 2219531 - RNA, 18 nt, Human
ccugugcugguguccuga

SEQ ID NO: 2219532 - RNA, 21 nt, Human
ccugugcugguguccugacca

SEQ ID NO: 2219533 - RNA, 22 nt, Human
ccugugcuucgggcccuuccca

SEQ ID NO: 2219534 - RNA, 22 nt, Human
ccugugcugguguccugaccac

SEQ ID NO: 2219535 - RNA, 23 nt, Human
ccugugcugguguccugaccacc

SEQ ID NO: 2219536 - RNA, 14 nt, Human
ccuuaccugccagg

SEQ ID NO: 2219537 - RNA, 14 nt, Human
ccuuaccucuuccg

SEQ ID NO: 2219538 - RNA, 20 nt, Human
ccuuaccuccugcccaggag

SEQ ID NO: 2219539 - RNA, 18 nt, Human
ccuuaccuccugcccagg

SEQ ID NO: 2219540 - RNA, 17 nt, Human
ccuuaccuccugcccag

SEQ ID NO: 2219541 - RNA, 16 nt, Human
ccuuaccuccugccca

SEQ ID NO: 2219542 - RNA, 14 nt, Human
ccuuaccuccugcc

SEQ ID NO: 2219543 - RNA, 13 nt, Human
ccuuaccuccugc

SEQ ID NO: 2219544 - RNA, 20 nt, Human
ccuuaccucggugccuuccu

SEQ ID NO: 2219545 - RNA, 17 nt, Human
ccuuaccagcagagcac

SEQ ID NO: 2219546 - RNA, 17 nt, Human
ccuuacccuccuuggga

SEQ ID NO: 2219547 - RNA, 15 nt, Human
ccuuaccagcagagc

SEQ ID NO: 2219548 - RNA, 16 nt, Human
ccuuaccagcagagca

SEQ ID NO: 2219549 - RNA, 14 nt, Human
ccuuagaaccuuuc

SEQ ID NO: 2219550 - RNA, 15 nt, Human
ccuuagaaccuuucu

SEQ ID NO: 2219551 - RNA, 16 nt, Human
ccuuagaaccuuucuu

SEQ ID NO: 2219552 - RNA, 18 nt, Human
ccuuagaaccuuucuuac

SEQ ID NO: 2219553 - RNA, 16 nt, Human
ccuuagacagucccug

SEQ ID NO: 2219554 - RNA, 17 nt, Human
ccuuagacagucccugc

SEQ ID NO: 2219555 - RNA, 21 nt, Human
ccuuagacagucccugccaau

SEQ ID NO: 2219556 - RNA, 20 nt, Human
ccuuagaacauuuuaauuca

SEQ ID NO: 2219557 - RNA, 18 nt, Human
ccuuagacagucccugcc

SEQ ID NO: 2219558 - RNA, 19 nt, Human
ccuuagacagucccugcca

SEQ ID NO: 2219559 - RNA, 16 nt, Human
ccuuagagacaucaaa

SEQ ID NO: 2219560 - RNA, 15 nt, Human
ccuuagagccaggca

SEQ ID NO: 2219561 - RNA, 16 nt, Human
ccuuagaccuuccaua

SEQ ID NO: 2219562 - RNA, 16 nt, Human
ccuuagauuagcucug

SEQ ID NO: 2219563 - RNA, 16 nt, Human
ccuuagagccaggcac

SEQ ID NO: 2219564 - RNA, 17 nt, Human
ccuuagagccaggcaca

SEQ ID NO: 2219565 - RNA, 18 nt, Human
ccuuagagccaggcacac

SEQ ID NO: 2219566 - RNA, 15 nt, Human
ccuuauuguaccucu

SEQ ID NO: 2219567 - RNA, 16 nt, Human
ccuuauuguaccucuc

SEQ ID NO: 2219568 - RNA, 18 nt, Human
ccuuagauuagcucugga

SEQ ID NO: 2219569 - RNA, 21 nt, Human
ccuuagauuagcucuggacca

SEQ ID NO: 2219570 - RNA, 15 nt, Human
ccuucaaagcaaaug

SEQ ID NO: 2219571 - RNA, 18 nt, Human
ccuuauuuucaagaaacu

SEQ ID NO: 2219572 - RNA, 14 nt, Human
ccuuauuuucaaga

SEQ ID NO: 2219573 - RNA, 16 nt, Human
ccuuauuuuuucccaa

SEQ ID NO: 2219574 - RNA, 15 nt, Human
ccuuauuuuuuccca

SEQ ID NO: 2219575 - RNA, 19 nt, Human
ccuucaaagcaaaugucuu

SEQ ID NO: 2219576 - RNA, 14 nt, Human
ccuucaaccauucc

SEQ ID NO: 2219577 - RNA, 19 nt, Human
ccuucaagaacucugggcu

SEQ ID NO: 2219578 - RNA, 13 nt, Human
ccuucaagaccuu

SEQ ID NO: 2219579 - RNA, 18 nt, Human
ccuucaagaccuucacca

SEQ ID NO: 2219580 - RNA, 24 nt, Human
ccuucaacugaaaagacucagugu

SEQ ID NO: 2219581 - RNA, 13 nt, Human
ccuucaacugaaa

SEQ ID NO: 2219582 - RNA, 22 nt, Human
ccuucaagaccuucaccaaaca

SEQ ID NO: 2219583 - RNA, 23 nt, Human
ccuucaagaucauguaccccaau

SEQ ID NO: 2219584 - RNA, 19 nt, Human
ccuucagugccuuauggaa

SEQ ID NO: 2219585 - RNA, 11 nt, Human
ccuuuggcuuc

SEQ ID NO: 2219586 - RNA, 13 nt, Human
ccuugacagggca

SEQ ID NO: 2219587 - RNA, 15 nt, Human
ccuuggcaugccuuc

SEQ ID NO: 2219588 - RNA, 18 nt, Human
ccuuggcaucuagagcuu

SEQ ID NO: 2219589 - RNA, 19 nt, Human
ccuuggcaucacagggcag

SEQ ID NO: 2219590 - RNA, 23 nt, Human
ccuuggcaccagacacccaggac

SEQ ID NO: 2219591 - RNA, 22 nt, Human
ccuuggcaccagacacccagga

SEQ ID NO: 2219592 - RNA, 21 nt, Human
ccuuggcaccagacacccagg

SEQ ID NO: 2219593 - RNA, 20 nt, Human
ccuuggcaccagacacccag

SEQ ID NO: 2219594 - RNA, 15 nt, Human
ccuuggcaccagaca

SEQ ID NO: 2219595 - RNA, 14 nt, Human
ccuugaucuguaua

SEQ ID NO: 2219596 - RNA, 19 nt, Human
ccuuggauuguccccgacc

SEQ ID NO: 2219597 - RNA, 23 nt, Human
ccuugaguugauucagcucugca

SEQ ID NO: 2219598 - RNA, 22 nt, Human
ccuugaguugauucagcucugc

SEQ ID NO: 2219599 - RNA, 15 nt, Human
ccuugaccaggccug

SEQ ID NO: 2219600 - RNA, 16 nt, Human
ccuugaccaggccugg

SEQ ID NO: 2219601 - RNA, 21 nt, Human
ccuugaccauucuccaccugc

SEQ ID NO: 2219602 - RNA, 14 nt, Human
ccuugacagggcac

SEQ ID NO: 2219603 - RNA, 14 nt, Human
ccuugacaccugcu

SEQ ID NO: 2219604 - RNA, 23 nt, Human
ccuugacaaagucaagccacaug

SEQ ID NO: 2219605 - RNA, 12 nt, Human
ccuugaaugugg

SEQ ID NO: 2219606 - RNA, 21 nt, Human
ccuugacaaagucaagccaca

SEQ ID NO: 2219607 - RNA, 15 nt, Human
ccuugacagggcaca

SEQ ID NO: 2219608 - RNA, 17 nt, Human
ccuugacagggcacacc

SEQ ID NO: 2219609 - RNA, 19 nt, Human
ccuugaccauucuccaccu

SEQ ID NO: 2219610 - RNA, 20 nt, Human
ccuugaccauucuccaccug

SEQ ID NO: 2219611 - RNA, 14 nt, Human
ccuucuuuuucuuc

SEQ ID NO: 2219612 - RNA, 16 nt, Human
ccuucuuuuucuucuu

SEQ ID NO: 2219613 - RNA, 15 nt, Human
ccuugaaaacacugu

SEQ ID NO: 2219614 - RNA, 13 nt, Human
ccuucuuugauaa

SEQ ID NO: 2219615 - RNA, 17 nt, Human
ccuucgcgguggaaggc

SEQ ID NO: 2219616 - RNA, 20 nt, Human
ccuucgcgguggaaggcccg

SEQ ID NO: 2219617 - RNA, 18 nt, Human
ccuucuuugcuugccucu

SEQ ID NO: 2219618 - RNA, 18 nt, Human
ccuucuuugauaauguua

SEQ ID NO: 2219619 - RNA, 19 nt, Human
ccuucuuugauaauguuaa

SEQ ID NO: 2219620 - RNA, 20 nt, Human
ccuucuuugauaauguuaaa

SEQ ID NO: 2219621 - RNA, 21 nt, Human
ccuucuuugauaauguuaaau

SEQ ID NO: 2219622 - RNA, 13 nt, Human
ccuucgcuccugu

SEQ ID NO: 2219623 - RNA, 14 nt, Human
ccuucgcuccugug

SEQ ID NO: 2219624 - RNA, 15 nt, Human
ccuucgcuccugugu

SEQ ID NO: 2219625 - RNA, 18 nt, Human
ccuucgcuccugugucuu

SEQ ID NO: 2219626 - RNA, 14 nt, Human
ccuugaacugggua

SEQ ID NO: 2219627 - RNA, 22 nt, Human
ccuugaaaacacuguucucugc

SEQ ID NO: 2219628 - RNA, 19 nt, Human
ccuugaaaacacuguucuc

SEQ ID NO: 2219629 - RNA, 21 nt, Human
ccuugaaaacacuguucucug

SEQ ID NO: 2219630 - RNA, 16 nt, Human
ccuugaacuggguacu

SEQ ID NO: 2219631 - RNA, 17 nt, Human
ccuugaacuuugaccuc

SEQ ID NO: 2219632 - RNA, 17 nt, Human
ccuugaaugaugccaug

SEQ ID NO: 2219633 - RNA, 19 nt, Human
ccuugaacuuugaccucug

SEQ ID NO: 2219634 - RNA, 16 nt, Human
cguuugagaagaaaac

SEQ ID NO: 2219635 - RNA, 17 nt, Human
cguuugaccuuuuaugu

SEQ ID NO: 2219636 - RNA, 12 nt, Human
cguuucuucccu

SEQ ID NO: 2219637 - RNA, 13 nt, Human
cguuucuucccug

SEQ ID NO: 2219638 - RNA, 21 nt, Human
cguuugagaagaaaacaucua

SEQ ID NO: 2219639 - RNA, 23 nt, Human
cguuuuuauaaaaaauggugccu

SEQ ID NO: 2219640 - RNA, 23 nt, Human
cguuuugugugguggcaccuccu

SEQ ID NO: 2219641 - RNA, 15 nt, Human
cguuuuggaagcucu

SEQ ID NO: 2219642 - RNA, 20 nt, Human
cguuuugaagcuacugugug

SEQ ID NO: 2219643 - RNA, 13 nt, Human
cguuuugaagcua

SEQ ID NO: 2219644 - RNA, 15 nt, Human
cguuuucuguuugga

SEQ ID NO: 2219645 - RNA, 11 nt, Human
cguuuccauca

SEQ ID NO: 2219646 - RNA, 22 nt, Human
cguuuccaucagguuccauccc

SEQ ID NO: 2219647 - RNA, 20 nt, Human
cguuuccugagaagugucua

SEQ ID NO: 2219648 - RNA, 18 nt, Human
cguuucuccaccuagacu

SEQ ID NO: 2219649 - RNA, 22 nt, Human
cguuucuccaccuagacuguaa

SEQ ID NO: 2219650 - RNA, 20 nt, Human
cguuucuaugacacaugcaa

SEQ ID NO: 2219651 - RNA, 21 nt, Human
cguuucuaaaggcuaccuuug

SEQ ID NO: 2219652 - RNA, 19 nt, Human
cguuucuaaaggcuaccuu

SEQ ID NO: 2219653 - RNA, 14 nt, Human
cguucugcucauca

SEQ ID NO: 2219654 - RNA, 12 nt, Human
cguucucugccu

SEQ ID NO: 2219655 - RNA, 12 nt, Human
cguucugugcac

SEQ ID NO: 2219656 - RNA, 20 nt, Human
cguucuguuuacaucaguuu

SEQ ID NO: 2219657 - RNA, 17 nt, Human
cguucugcuggccugga

SEQ ID NO: 2219658 - RNA, 18 nt, Human
cguucugcuggccuggau

SEQ ID NO: 2219659 - RNA, 18 nt, Human
cguuccuuacugcagaau

SEQ ID NO: 2219660 - RNA, 15 nt, Human
cguucucacacccac

SEQ ID NO: 2219661 - RNA, 16 nt, Human
cguucucacacccacc

SEQ ID NO: 2219662 - RNA, 18 nt, Human
cguucucacacccaccgu

SEQ ID NO: 2219663 - RNA, 14 nt, Human
cguucucacaccca

SEQ ID NO: 2219664 - RNA, 20 nt, Human
cguuccuauugucauuaaag

SEQ ID NO: 2219665 - RNA, 22 nt, Human
cguuccuucaaagcaaaugucu

SEQ ID NO: 2219666 - RNA, 17 nt, Human
cguuccuauugucauua

SEQ ID NO: 2219667 - RNA, 20 nt, Human
cguuccaugaugcugggauu

SEQ ID NO: 2219668 - RNA, 22 nt, Human
cguuucagugucaaauaaacac

SEQ ID NO: 2219669 - RNA, 22 nt, Human
cguuucagcgacuccguuggcc

SEQ ID NO: 2219670 - RNA, 22 nt, Human
cguuucauuuagucaugugacc

SEQ ID NO: 2219671 - RNA, 15 nt, Human
cguuucaaaaacaca

SEQ ID NO: 2219672 - RNA, 23 nt, Human
cguuucagugucaaauaaacacu

SEQ ID NO: 2219673 - RNA, 13 nt, Human
cguuucaaaaaca

SEQ ID NO: 2219674 - RNA, 15 nt, Human
cguuuauuuucaaga

SEQ ID NO: 2219675 - RNA, 14 nt, Human
cguuuauuuucaag

SEQ ID NO: 2219676 - RNA, 20 nt, Human
cguuuacuaugccugugucu

SEQ ID NO: 2219677 - RNA, 20 nt, Human
cguuuacuuaucuuaugcca

SEQ ID NO: 2219678 - RNA, 12 nt, Human
cguucuguuuac

SEQ ID NO: 2219679 - RNA, 21 nt, Human
cguggcugcccacacacccca

SEQ ID NO: 2219680 - RNA, 13 nt, Human
cguggcucugcug

SEQ ID NO: 2219681 - RNA, 14 nt, Human
cguggcucugcugg

SEQ ID NO: 2219682 - RNA, 15 nt, Human
cguggcucugcuggc

SEQ ID NO: 2219683 - RNA, 12 nt, Human
cguggcugcuuc

SEQ ID NO: 2219684 - RNA, 14 nt, Human
cguggcugcuucaa

SEQ ID NO: 2219685 - RNA, 15 nt, Human
cguggcugcuucaag

SEQ ID NO: 2219686 - RNA, 19 nt, Human
cguggcugcggcacccuug

SEQ ID NO: 2219687 - RNA, 17 nt, Human
cguggcugcuucaagga

SEQ ID NO: 2219688 - RNA, 13 nt, Human
cguuccaguuccc

SEQ ID NO: 2219689 - RNA, 21 nt, Human
cguuccagccggcauggcugg

SEQ ID NO: 2219690 - RNA, 10 nt, Human
cguuccagcc

SEQ ID NO: 2219691 - RNA, 11 nt, Human
cguuccagccg

SEQ ID NO: 2219692 - RNA, 20 nt, Human
cguggccuuccccagccucu

SEQ ID NO: 2219693 - RNA, 23 nt, Human
cguggccucuugagcaguggcug

SEQ ID NO: 2219694 - RNA, 15 nt, Human
cguggccucuugagc

SEQ ID NO: 2219695 - RNA, 16 nt, Human
cguggccucuugagca

SEQ ID NO: 2219696 - RNA, 22 nt, Human
cguggcuaagaguguccuagga

SEQ ID NO: 2219697 - RNA, 14 nt, Human
cguggcucagccag

SEQ ID NO: 2219698 - RNA, 18 nt, Human
cguggcucagccagcacu

SEQ ID NO: 2219699 - RNA, 15 nt, Human
cguggcucagccagc

SEQ ID NO: 2219700 - RNA, 15 nt, Human
cgugccuguguccau

SEQ ID NO: 2219701 - RNA, 23 nt, Human
cgugccuccuuccaccucccucc

SEQ ID NO: 2219702 - RNA, 16 nt, Human
cgugccuuuugcaccc

SEQ ID NO: 2219703 - RNA, 17 nt, Human
cgugccuuuugcacccc

SEQ ID NO: 2219704 - RNA, 19 nt, Human
cgugccuuuugcaccccuc

SEQ ID NO: 2219705 - RNA, 20 nt, Human
cgugccuuuugcaccccucc

SEQ ID NO: 2219706 - RNA, 21 nt, Human
cgugccuuuugcaccccuccc

SEQ ID NO: 2219707 - RNA, 23 nt, Human
cguggccccagccuggcccagcu

SEQ ID NO: 2219708 - RNA, 13 nt, Human
cgugccuucagcu

SEQ ID NO: 2219709 - RNA, 15 nt, Human
cgugccuucagcucu

SEQ ID NO: 2219710 - RNA, 16 nt, Human
cgugccuucagcucua

SEQ ID NO: 2219711 - RNA, 18 nt, Human
cgugccuucagcucuaca

SEQ ID NO: 2219712 - RNA, 16 nt, Human
cgugccuggccacgcc

SEQ ID NO: 2219713 - RNA, 12 nt, Human
cgugccuguguc

SEQ ID NO: 2219714 - RNA, 14 nt, Human
cgugccugugucca

SEQ ID NO: 2219715 - RNA, 12 nt, Human
cgugccuggcca

SEQ ID NO: 2219716 - RNA, 22 nt, Human
cgugccuccaccaccacuggcc

SEQ ID NO: 2219717 - RNA, 23 nt, Human
cgugccuccaccaccacuggcca

SEQ ID NO: 2219718 - RNA, 19 nt, Human
cgugccuccuuccaccucc

SEQ ID NO: 2219719 - RNA, 20 nt, Human
cgugccuccuuccaccuccc

SEQ ID NO: 2219720 - RNA, 17 nt, Human
cuaaaaaaaaaaaagua

SEQ ID NO: 2219721 - RNA, 16 nt, Human
cggugcuguccucagg

SEQ ID NO: 2219722 - RNA, 16 nt, Human
cggugcuccaggcagg

SEQ ID NO: 2219723 - RNA, 17 nt, Human
cggugcuguccucaggu

SEQ ID NO: 2219724 - RNA, 21 nt, Human
cggugcuguccucagguggcc

SEQ ID NO: 2219725 - RNA, 15 nt, Human
cggggccccagggcu

SEQ ID NO: 2219726 - RNA, 17 nt, Human
cggggccucgggaccuc

SEQ ID NO: 2219727 - RNA, 13 nt, Human
cggugcuccaggc

SEQ ID NO: 2219728 - RNA, 14 nt, Human
cggugcuccaggca

SEQ ID NO: 2219729 - RNA, 15 nt, Human
cggugcuccaggcag

SEQ ID NO: 2219730 - RNA, 22 nt, Human
cggugcuguccucagguggcca

SEQ ID NO: 2219731 - RNA, 13 nt, Human
cgguggaggccag

SEQ ID NO: 2219732 - RNA, 14 nt, Human
cgguggaggccagg

SEQ ID NO: 2219733 - RNA, 15 nt, Human
cgguggaggccaggg

SEQ ID NO: 2219734 - RNA, 11 nt, Human
cgguggccucu

SEQ ID NO: 2219735 - RNA, 14 nt, Human
cgguggcccugucc

SEQ ID NO: 2219736 - RNA, 16 nt, Human
cgguggcccugucccu

SEQ ID NO: 2219737 - RNA, 19 nt, Human
cguagaucaccagaauaaa

SEQ ID NO: 2219738 - RNA, 18 nt, Human
cguagaucaccagaauaa

SEQ ID NO: 2219739 - RNA, 14 nt, Human
cggggcagcugcca

SEQ ID NO: 2219740 - RNA, 15 nt, Human
cggggcacugcaggg

SEQ ID NO: 2219741 - RNA, 18 nt, Human
cggggaguuucuuuccug

SEQ ID NO: 2219742 - RNA, 19 nt, Human
cggggaguuucuuuccugc

SEQ ID NO: 2219743 - RNA, 19 nt, Human
cggggcaugcuggggcaag

SEQ ID NO: 2219744 - RNA, 17 nt, Human
cggggcaugcuggggca

SEQ ID NO: 2219745 - RNA, 16 nt, Human
cggggcaugcuggggc

SEQ ID NO: 2219746 - RNA, 19 nt, Human
cggggcagcugccagagaa

SEQ ID NO: 2219747 - RNA, 14 nt, Human
cggggccccagggc

SEQ ID NO: 2219748 - RNA, 23 nt, Human
cggugcuaucucccccagcccca

SEQ ID NO: 2219749 - RNA, 17 nt, Human
cguaguagggucaggcc

SEQ ID NO: 2219750 - RNA, 17 nt, Human
cguaggggagggguugc

SEQ ID NO: 2219751 - RNA, 14 nt, Human
cguaggggaggggu

SEQ ID NO: 2219752 - RNA, 13 nt, Human
cguaguucccuga

SEQ ID NO: 2219753 - RNA, 14 nt, Human
cguaguucccugaa

SEQ ID NO: 2219754 - RNA, 23 nt, Human
cguaggggagggguugccacagg

SEQ ID NO: 2219755 - RNA, 20 nt, Human
cguagccaaggugggcugag

SEQ ID NO: 2219756 - RNA, 21 nt, Human
cguagauucccaucauacacu

SEQ ID NO: 2219757 - RNA, 16 nt, Human
cguagccagcugcucc

SEQ ID NO: 2219758 - RNA, 19 nt, Human
cguagccagcugcucccca

SEQ ID NO: 2219759 - RNA, 16 nt, Human
cguagcugcaaaggac

SEQ ID NO: 2219760 - RNA, 22 nt, Human
cguagcuucuaccaugaacaga

SEQ ID NO: 2219761 - RNA, 16 nt, Human
cguauaaaagccuguu

SEQ ID NO: 2219762 - RNA, 17 nt, Human
cguauaaaagccuguuu

SEQ ID NO: 2219763 - RNA, 21 nt, Human
cguauaaaagccuguuuaaga

SEQ ID NO: 2219764 - RNA, 22 nt, Human
cguauaaaagccuguuuaagag

SEQ ID NO: 2219765 - RNA, 13 nt, Human
cguaugcauguga

SEQ ID NO: 2219766 - RNA, 15 nt, Human
cguauguaaauguau

SEQ ID NO: 2219767 - RNA, 16 nt, Human
cguaugucuguuacca

SEQ ID NO: 2219768 - RNA, 15 nt, Human
cguauugguccagcu

SEQ ID NO: 2219769 - RNA, 20 nt, Human
cguaugucuguuaccauguc

SEQ ID NO: 2219770 - RNA, 22 nt, Human
cguauaugucucaggucccugc

SEQ ID NO: 2219771 - RNA, 22 nt, Human
cguaguucccugaaaacccaga

SEQ ID NO: 2219772 - RNA, 12 nt, Human
cguauagcugua

SEQ ID NO: 2219773 - RNA, 15 nt, Human
cguauagcuguauug

SEQ ID NO: 2219774 - RNA, 16 nt, Human
cguauagcuguauuga

SEQ ID NO: 2219775 - RNA, 17 nt, Human
cgucaacgugcauuuua

SEQ ID NO: 2219776 - RNA, 18 nt, Human
cgucaccaucucaggcca

SEQ ID NO: 2219777 - RNA, 14 nt, Human
cgucaccaccucuc

SEQ ID NO: 2219778 - RNA, 16 nt, Human
cgucaccaucucaggc

SEQ ID NO: 2219779 - RNA, 21 nt, Human
cgucaccaucucaggccaccu

SEQ ID NO: 2219780 - RNA, 20 nt, Human
cgucaccaucucaggccacc

SEQ ID NO: 2219781 - RNA, 12 nt, Human
cgucaccucaga

SEQ ID NO: 2219782 - RNA, 17 nt, Human
cgucagaagcacccagg

SEQ ID NO: 2219783 - RNA, 12 nt, Human
cgucagccucca

SEQ ID NO: 2219784 - RNA, 13 nt, Human
cgucagccuccag

SEQ ID NO: 2219785 - RNA, 14 nt, Human
cgucagccuccagc

SEQ ID NO: 2219786 - RNA, 11 nt, Human
cguccagggag

SEQ ID NO: 2219787 - RNA, 21 nt, Human
cgucccccucuggcuccagcu

SEQ ID NO: 2219788 - RNA, 14 nt, Human
cgucccccucuggc

SEQ ID NO: 2219789 - RNA, 15 nt, Human
cgucauguuccucaa

SEQ ID NO: 2219790 - RNA, 20 nt, Human
cgucauggcuuaauguuuau

SEQ ID NO: 2219791 - RNA, 15 nt, Human
cgucaugcuuguguu

SEQ ID NO: 2219792 - RNA, 19 nt, Human
cgucauggcuuaauguuua

SEQ ID NO: 2219793 - RNA, 21 nt, Human
cguccagccgccauugccacc

SEQ ID NO: 2219794 - RNA, 19 nt, Human
cguccaggagccugugccu

SEQ ID NO: 2219795 - RNA, 22 nt, Human
cguccacggcucuagguggggc

SEQ ID NO: 2219796 - RNA, 22 nt, Human
cguccaccaugggguccuacca

SEQ ID NO: 2219797 - RNA, 16 nt, Human
cguccacggcucuagg

SEQ ID NO: 2219798 - RNA, 19 nt, Human
cgucaucacuuuucaguga

SEQ ID NO: 2219799 - RNA, 17 nt, Human
cgucaucuaguuuuaaa

SEQ ID NO: 2219800 - RNA, 20 nt, Human
cgucaucauuuuuccuuccc

SEQ ID NO: 2219801 - RNA, 14 nt, Human
cgucaucuaguuuu

SEQ ID NO: 2219802 - RNA, 17 nt, Human
cgucaguaucaggccug

SEQ ID NO: 2219803 - RNA, 15 nt, Human
cgucagugccuaccc

SEQ ID NO: 2219804 - RNA, 15 nt, Human
cgucaguauuuuccc

SEQ ID NO: 2219805 - RNA, 19 nt, Human
cgucagcuggcacugucuc

SEQ ID NO: 2219806 - RNA, 20 nt, Human
cgucagccuccagccucugu

SEQ ID NO: 2219807 - RNA, 20 nt, Human
cgucagggcccaagucccug

SEQ ID NO: 2219808 - RNA, 15 nt, Human
cgucagccuccagcc

SEQ ID NO: 2219809 - RNA, 16 nt, Human
cgucagccuccagccu

SEQ ID NO: 2219810 - RNA, 17 nt, Human
cgucagccuccagccuc

SEQ ID NO: 2219811 - RNA, 18 nt, Human
cgucagccuccagccucu

SEQ ID NO: 2219812 - RNA, 15 nt, Human
cgucgcccucccagg

SEQ ID NO: 2219813 - RNA, 13 nt, Human
cgucgcacagucu

SEQ ID NO: 2219814 - RNA, 16 nt, Human
cgucgcacagucucuc

SEQ ID NO: 2219815 - RNA, 16 nt, Human
cgucgcccucccaggc

SEQ ID NO: 2219816 - RNA, 18 nt, Human
cgucggggggacagcucc

SEQ ID NO: 2219817 - RNA, 16 nt, Human
cgucgaggggcucuca

SEQ ID NO: 2219818 - RNA, 21 nt, Human
cguccuccucaccucaugccc

SEQ ID NO: 2219819 - RNA, 17 nt, Human
cgucgaggggcucucag

SEQ ID NO: 2219820 - RNA, 17 nt, Human
cguccuccucaccucau

SEQ ID NO: 2219821 - RNA, 17 nt, Human
cguccucccgggcccuc

SEQ ID NO: 2219822 - RNA, 18 nt, Human
cguccucccgggcccucc

SEQ ID NO: 2219823 - RNA, 22 nt, Human
cguccucccccugccagugccu

SEQ ID NO: 2219824 - RNA, 17 nt, Human
cguccucccccugccag

SEQ ID NO: 2219825 - RNA, 14 nt, Human
cguccucccgggcc

SEQ ID NO: 2219826 - RNA, 16 nt, Human
cguccucccgggcccu

SEQ ID NO: 2219827 - RNA, 16 nt, Human
cguccucccccugcca

SEQ ID NO: 2219828 - RNA, 15 nt, Human
cguccucccccugcc

SEQ ID NO: 2219829 - RNA, 13 nt, Human
cguccucccccug

SEQ ID NO: 2219830 - RNA, 22 nt, Human
cguccucaccccuguccucacu

SEQ ID NO: 2219831 - RNA, 20 nt, Human
cguccggcaguucugggugc

SEQ ID NO: 2219832 - RNA, 19 nt, Human
cguccgcccugcuccuccc

SEQ ID NO: 2219833 - RNA, 22 nt, Human
cguccgcccugcuccucccugg

SEQ ID NO: 2219834 - RNA, 15 nt, Human
cguccgcgcgccagc

SEQ ID NO: 2219835 - RNA, 14 nt, Human
cguccucaccccug

SEQ ID NO: 2219836 - RNA, 17 nt, Human
cguccucaccccugucc

SEQ ID NO: 2219837 - RNA, 20 nt, Human
cguccucaccccuguccuca

SEQ ID NO: 2219838 - RNA, 22 nt, Human
cgucccccucuggcuccagcug

SEQ ID NO: 2219839 - RNA, 17 nt, Human
cgucccauauccugccu

SEQ ID NO: 2219840 - RNA, 15 nt, Human
cgucccauauccugc

SEQ ID NO: 2219841 - RNA, 13 nt, Human
cgucccccugggg

SEQ ID NO: 2219842 - RNA, 11 nt, Human
cguccccuguc

SEQ ID NO: 2219843 - RNA, 13 nt, Human
cgucccugcccau

SEQ ID NO: 2219844 - RNA, 14 nt, Human
cgucccugcccaug

SEQ ID NO: 2219845 - RNA, 12 nt, Human
cguccgcccugc

SEQ ID NO: 2219846 - RNA, 15 nt, Human
cguccgcccugcucc

SEQ ID NO: 2219847 - RNA, 14 nt, Human
cguccccugucccc

SEQ ID NO: 2219848 - RNA, 19 nt, Human
cgucuaagucaugagcuga

SEQ ID NO: 2219849 - RNA, 14 nt, Human
cgucuaccugaggg

SEQ ID NO: 2219850 - RNA, 22 nt, Human
cgucucucccucccuuugaaau

SEQ ID NO: 2219851 - RNA, 13 nt, Human
cgucucucuccca

SEQ ID NO: 2219852 - RNA, 14 nt, Human
cgucucucucccau

SEQ ID NO: 2219853 - RNA, 18 nt, Human
cgucucucucccauggag

SEQ ID NO: 2219854 - RNA, 23 nt, Human
cgucugcuaacuuggagccccag

SEQ ID NO: 2219855 - RNA, 16 nt, Human
cgucugacccucucca

SEQ ID NO: 2219856 - RNA, 23 nt, Human
cgucucucucccauggagcccca

SEQ ID NO: 2219857 - RNA, 15 nt, Human
cgucuggaaguccaa

SEQ ID NO: 2219858 - RNA, 14 nt, Human
cgucuggaggggcc

SEQ ID NO: 2219859 - RNA, 18 nt, Human
cgucuggaggggccccug

SEQ ID NO: 2219860 - RNA, 20 nt, Human
cgucuggaggggccccugcu

SEQ ID NO: 2219861 - RNA, 23 nt, Human
cgucuggaggggccccugcuucu

SEQ ID NO: 2219862 - RNA, 13 nt, Human
cgucugacaggca

SEQ ID NO: 2219863 - RNA, 14 nt, Human
cgucugacaggcaa

SEQ ID NO: 2219864 - RNA, 23 nt, Human
cgucugggguucagccccuccuc

SEQ ID NO: 2219865 - RNA, 19 nt, Human
cgucugggguucagccccu

SEQ ID NO: 2219866 - RNA, 18 nt, Human
cgucugggguucagcccc

SEQ ID NO: 2219867 - RNA, 17 nt, Human
cgucugggguucagccc

SEQ ID NO: 2219868 - RNA, 24 nt, Human
cgucuggaggggccccugcuucuc

SEQ ID NO: 2219869 - RNA, 14 nt, Human
cgucugggagaaau

SEQ ID NO: 2219870 - RNA, 21 nt, Human
cgucugggagaaauugacaga

SEQ ID NO: 2219871 - RNA, 22 nt, Human
cgucugggagaaauugacagau

SEQ ID NO: 2219872 - RNA, 15 nt, Human
cgucuguauauuuug

SEQ ID NO: 2219873 - RNA, 21 nt, Human
cgucuguggcuuucagccucu

SEQ ID NO: 2219874 - RNA, 24 nt, Human
cgugaaacacaccaggcugugggc

SEQ ID NO: 2219875 - RNA, 22 nt, Human
cgugaaacacaccaggcugugg

SEQ ID NO: 2219876 - RNA, 20 nt, Human
cgugaaacacaccaggcugu

SEQ ID NO: 2219877 - RNA, 16 nt, Human
cgugaaacacaccagg

SEQ ID NO: 2219878 - RNA, 16 nt, Human
cgugaaagcagaugag

SEQ ID NO: 2219879 - RNA, 15 nt, Human
cgugaaacacaccag

SEQ ID NO: 2219880 - RNA, 12 nt, Human
cgugaaacacac

SEQ ID NO: 2219881 - RNA, 17 nt, Human
cgucuguuuauaaacau

SEQ ID NO: 2219882 - RNA, 18 nt, Human
cgucugucuucacagcuc

SEQ ID NO: 2219883 - RNA, 14 nt, Human
cgucuguucccccu

SEQ ID NO: 2219884 - RNA, 19 nt, Human
cgucuguggcuuucagccu

SEQ ID NO: 2219885 - RNA, 12 nt, Human
cgugacaacacu

SEQ ID NO: 2219886 - RNA, 19 nt, Human
cgugaaggccgagaagcaa

SEQ ID NO: 2219887 - RNA, 13 nt, Human
cgugaagggauuu

SEQ ID NO: 2219888 - RNA, 13 nt, Human
cgugaaacccugu

SEQ ID NO: 2219889 - RNA, 20 nt, Human
cgugcacacaccagagccca

SEQ ID NO: 2219890 - RNA, 21 nt, Human
cgugcacacaccagagcccac

SEQ ID NO: 2219891 - RNA, 19 nt, Human
cgugccguuacucuccaac

SEQ ID NO: 2219892 - RNA, 17 nt, Human
cgugccguuacucucca

SEQ ID NO: 2219893 - RNA, 13 nt, Human
cgugccuccacca

SEQ ID NO: 2219894 - RNA, 14 nt, Human
cgugccuccaccac

SEQ ID NO: 2219895 - RNA, 17 nt, Human
cgugccuccaccaccac

SEQ ID NO: 2219896 - RNA, 18 nt, Human
cgugccuccaccaccacu

SEQ ID NO: 2219897 - RNA, 20 nt, Human
cgugccuccaccaccacugg

SEQ ID NO: 2219898 - RNA, 21 nt, Human
cgugccuccaccaccacuggc

SEQ ID NO: 2219899 - RNA, 16 nt, Human
cgugcccaguggcugc

SEQ ID NO: 2219900 - RNA, 20 nt, Human
cgugcccaguggcugcuccu

SEQ ID NO: 2219901 - RNA, 17 nt, Human
cgugccccgccuccccg

SEQ ID NO: 2219902 - RNA, 22 nt, Human
cgugccagucgcgcugccugug

SEQ ID NO: 2219903 - RNA, 19 nt, Human
cgugcccaggggcccacag

SEQ ID NO: 2219904 - RNA, 21 nt, Human
cgugccagucgcgcugccugu

SEQ ID NO: 2219905 - RNA, 19 nt, Human
cgugcauaccacuuuuguu

SEQ ID NO: 2219906 - RNA, 15 nt, Human
cgugcaccuguacuc

SEQ ID NO: 2219907 - RNA, 17 nt, Human
cgugaaguauacuguau

SEQ ID NO: 2219908 - RNA, 22 nt, Human
cgugcacacaccagagcccacc

SEQ ID NO: 2219909 - RNA, 18 nt, Human
cgugcauaccacuuuugu

SEQ ID NO: 2219910 - RNA, 14 nt, Human
cgugcauaccacuu

SEQ ID NO: 2219911 - RNA, 21 nt, Human
cgcgucgcccucccaggcucu

SEQ ID NO: 2219912 - RNA, 12 nt, Human
cgcgucuccugu

SEQ ID NO: 2219913 - RNA, 13 nt, Human
cgcgucuccuguu

SEQ ID NO: 2219914 - RNA, 12 nt, Human
cgcgucuuccug

SEQ ID NO: 2219915 - RNA, 13 nt, Human
cgcgucuuccuga

SEQ ID NO: 2219916 - RNA, 14 nt, Human
cgcgucuuccugag

SEQ ID NO: 2219917 - RNA, 16 nt, Human
cgcgucuuccugagug

SEQ ID NO: 2219918 - RNA, 22 nt, Human
cgcgacuaauuucaaaaugcuu

SEQ ID NO: 2219919 - RNA, 12 nt, Human
cgcccugccacu

SEQ ID NO: 2219920 - RNA, 15 nt, Human
cgcgacuaauuucaa

SEQ ID NO: 2219921 - RNA, 16 nt, Human
cgcgugcacacaccag

SEQ ID NO: 2219922 - RNA, 19 nt, Human
cgcgugcacacaccagagc

SEQ ID NO: 2219923 - RNA, 19 nt, Human
cgcgugcacguggagagcu

SEQ ID NO: 2219924 - RNA, 21 nt, Human
cgcgucuccuguuuuucuggg

SEQ ID NO: 2219925 - RNA, 19 nt, Human
cgcgugcccucgcugcuuc

SEQ ID NO: 2219926 - RNA, 20 nt, Human
cgcgugcacacaccagagcc

SEQ ID NO: 2219927 - RNA, 13 nt, Human
cgcuagaggccug

SEQ ID NO: 2219928 - RNA, 14 nt, Human
cgcuagaggccuga

SEQ ID NO: 2219929 - RNA, 15 nt, Human
cgcuagaggccugag

SEQ ID NO: 2219930 - RNA, 17 nt, Human
cgcuagaggccugagga

SEQ ID NO: 2219931 - RNA, 20 nt, Human
cgcuagaugggcauggggug

SEQ ID NO: 2219932 - RNA, 23 nt, Human
cgcuagaugggcauggggugggc

SEQ ID NO: 2219933 - RNA, 23 nt, Human
cgcguguguggguggauauaaau

SEQ ID NO: 2219934 - RNA, 21 nt, Human
cgcuaagagggagggagggcu

SEQ ID NO: 2219935 - RNA, 15 nt, Human
cgcuaagagggaggg

SEQ ID NO: 2219936 - RNA, 16 nt, Human
cgcuaagagggaggga

SEQ ID NO: 2219937 - RNA, 14 nt, Human
cgcuaagagggagg

SEQ ID NO: 2219938 - RNA, 13 nt, Human
cgcccucccaggc

SEQ ID NO: 2219939 - RNA, 12 nt, Human
cgcccucccagg

SEQ ID NO: 2219940 - RNA, 17 nt, Human
cgcccguccugccugug

SEQ ID NO: 2219941 - RNA, 22 nt, Human
cgcccuccccuccccugcugca

SEQ ID NO: 2219942 - RNA, 14 nt, Human
cgcccuccccuccc

SEQ ID NO: 2219943 - RNA, 16 nt, Human
cgcccuccccuccccu

SEQ ID NO: 2219944 - RNA, 18 nt, Human
cgcccuccccuccccugc

SEQ ID NO: 2219945 - RNA, 20 nt, Human
cgcccuccccuccccugcug

SEQ ID NO: 2219946 - RNA, 12 nt, Human
cgcccccugccc

SEQ ID NO: 2219947 - RNA, 14 nt, Human
cgcccccuccucua

SEQ ID NO: 2219948 - RNA, 19 nt, Human
cgcccccuccgcccugcca

SEQ ID NO: 2219949 - RNA, 20 nt, Human
cgcccccuccgcccugccac

SEQ ID NO: 2219950 - RNA, 18 nt, Human
cgcccccaguccccaccc

SEQ ID NO: 2219951 - RNA, 22 nt, Human
cgcccccaguccccaccccugc

SEQ ID NO: 2219952 - RNA, 23 nt, Human
cgcccccggguuuggcgggccaa

SEQ ID NO: 2219953 - RNA, 17 nt, Human
cgcccccuccgcccugc

SEQ ID NO: 2219954 - RNA, 14 nt, Human
cgcccucuguccug

SEQ ID NO: 2219955 - RNA, 16 nt, Human
cgcccucuguccugac

SEQ ID NO: 2219956 - RNA, 17 nt, Human
cgcccucuguccugacu

SEQ ID NO: 2219957 - RNA, 11 nt, Human
cgcccugccac

SEQ ID NO: 2219958 - RNA, 14 nt, Human
cgcccugccacuca

SEQ ID NO: 2219959 - RNA, 16 nt, Human
cgcgacaaugcaaacc

SEQ ID NO: 2219960 - RNA, 17 nt, Human
cgcgacaaugcaaacca

SEQ ID NO: 2219961 - RNA, 12 nt, Human
cgcccccaccuc

SEQ ID NO: 2219962 - RNA, 14 nt, Human
cgcccccaccucca

SEQ ID NO: 2219963 - RNA, 14 nt, Human
cgccccagccucug

SEQ ID NO: 2219964 - RNA, 23 nt, Human
cgcccaggaucagauugcaugug

SEQ ID NO: 2219965 - RNA, 12 nt, Human
cgccccagccuc

SEQ ID NO: 2219966 - RNA, 15 nt, Human
cgcccccacugguga

SEQ ID NO: 2219967 - RNA, 15 nt, Human
cgcccaggagacauc

SEQ ID NO: 2219968 - RNA, 17 nt, Human
cgcccaggaucagauug

SEQ ID NO: 2219969 - RNA, 12 nt, Human
cgcccaggcugg

SEQ ID NO: 2219970 - RNA, 20 nt, Human
cgcccaggcuggagugcaau

SEQ ID NO: 2219971 - RNA, 19 nt, Human
cgcccaggcuggagugcaa

SEQ ID NO: 2219972 - RNA, 20 nt, Human
cgcccagcugcaccugccag

SEQ ID NO: 2219973 - RNA, 18 nt, Human
cgcccagcugcaccugcc

SEQ ID NO: 2219974 - RNA, 23 nt, Human
cgcccagcugcaccugccagccu

SEQ ID NO: 2219975 - RNA, 11 nt, Human
cgcccaggaga

SEQ ID NO: 2219976 - RNA, 15 nt, Human
cgcccagcugcaccu

SEQ ID NO: 2219977 - RNA, 17 nt, Human
cgcagacaccuuggaca

SEQ ID NO: 2219978 - RNA, 13 nt, Human
cgcagacaggacc

SEQ ID NO: 2219979 - RNA, 14 nt, Human
cgcagacaggacca

SEQ ID NO: 2219980 - RNA, 15 nt, Human
ccuuucuccuuugua

SEQ ID NO: 2219981 - RNA, 17 nt, Human
ccuuucucgauuuuauc

SEQ ID NO: 2219982 - RNA, 14 nt, Human
ccuuucuccuuugu

SEQ ID NO: 2219983 - RNA, 20 nt, Human
ccuuucuccccugcccccag

SEQ ID NO: 2219984 - RNA, 11 nt, Human
ccuuucugugu

SEQ ID NO: 2219985 - RNA, 13 nt, Human
ccuuucugugugc

SEQ ID NO: 2219986 - RNA, 14 nt, Human
ccuuucuggcucuc

SEQ ID NO: 2219987 - RNA, 17 nt, Human
ccuuucucuucucuguu

SEQ ID NO: 2219988 - RNA, 15 nt, Human
ccuuguuacuucuga

SEQ ID NO: 2219989 - RNA, 15 nt, Human
ccuuguguguaugug

SEQ ID NO: 2219990 - RNA, 17 nt, Human
ccuuguguguaugugua

SEQ ID NO: 2219991 - RNA, 20 nt, Human
ccuuuaaaauuuuuuuagaa

SEQ ID NO: 2219992 - RNA, 21 nt, Human
ccuuuaaaauuuuuuuagaaa

SEQ ID NO: 2219993 - RNA, 12 nt, Human
ccuuuaaaauuu

SEQ ID NO: 2219994 - RNA, 20 nt, Human
ccuuuaaaaaaauuuaagug

SEQ ID NO: 2219995 - RNA, 18 nt, Human
ccuuuaaaguaugaaucu

SEQ ID NO: 2219996 - RNA, 22 nt, Human
ccuuuaaaguaugaaucuaugc

SEQ ID NO: 2219997 - RNA, 23 nt, Human
ccuuuaaaguaugaaucuaugcc

SEQ ID NO: 2219998 - RNA, 13 nt, Human
ccuuuaagagaaa

SEQ ID NO: 2219999 - RNA, 21 nt, Human
ccuuggcaugccuuccagcac

SEQ ID NO: 2220000 - RNA, 18 nt, Human
ccuuggccagaagucaag

SEQ ID NO: 2220001 - RNA, 20 nt, Human
ccuuggcaugccuuccagca

SEQ ID NO: 2220002 - RNA, 17 nt, Human
ccuuggcaugccuucca

SEQ ID NO: 2220003 - RNA, 22 nt, Human
ccuuggcucaauccucuaagcu

SEQ ID NO: 2220004 - RNA, 18 nt, Human
ccuuggcucaauccucua

SEQ ID NO: 2220005 - RNA, 15 nt, Human
ccuuggcucagacau

SEQ ID NO: 2220006 - RNA, 12 nt, Human
ccuuggcucaga

SEQ ID NO: 2220007 - RNA, 12 nt, Human
ccuuggcugcag

SEQ ID NO: 2220008 - RNA, 13 nt, Human
ccuuggcugcagg

SEQ ID NO: 2220009 - RNA, 19 nt, Human
ccuuggcucccauucacuc

SEQ ID NO: 2220010 - RNA, 23 nt, Human
ccuugugucuacagagaaccugg

SEQ ID NO: 2220011 - RNA, 20 nt, Human
ccuuguggucccaccccaca

SEQ ID NO: 2220012 - RNA, 16 nt, Human
ccuuguggucccaccc

SEQ ID NO: 2220013 - RNA, 19 nt, Human
ccuuguggucccaccccac

SEQ ID NO: 2220014 - RNA, 15 nt, Human
ccuuuggcagaguuc

SEQ ID NO: 2220015 - RNA, 18 nt, Human
ccuuuggcaggugcagcc

SEQ ID NO: 2220016 - RNA, 16 nt, Human
ccuuuggaugaccaga

SEQ ID NO: 2220017 - RNA, 14 nt, Human
ccuuuggagaccau

SEQ ID NO: 2220018 - RNA, 15 nt, Human
ccuuuggccauucca

SEQ ID NO: 2220019 - RNA, 19 nt, Human
ccuuuggaugaccagaaca

SEQ ID NO: 2220020 - RNA, 12 nt, Human
ccuuuggcucug

SEQ ID NO: 2220021 - RNA, 20 nt, Human
ccuuuggcaggugcagcccc

SEQ ID NO: 2220022 - RNA, 19 nt, Human
ccuuuggcaggugcagccc

SEQ ID NO: 2220023 - RNA, 16 nt, Human
ccuuugcuugaaagaa

SEQ ID NO: 2220024 - RNA, 13 nt, Human
ccuuugcugugag

SEQ ID NO: 2220025 - RNA, 17 nt, Human
ccuuugcugugaggcug

SEQ ID NO: 2220026 - RNA, 22 nt, Human
ccuuugcugugaggcuguccug

SEQ ID NO: 2220027 - RNA, 23 nt, Human
ccuuugcugugaggcuguccugu

SEQ ID NO: 2220028 - RNA, 13 nt, Human
ccuuugcacugag

SEQ ID NO: 2220029 - RNA, 14 nt, Human
ccuuugcacugagg

SEQ ID NO: 2220030 - RNA, 16 nt, Human
ccuuugcacugagggc

SEQ ID NO: 2220031 - RNA, 19 nt, Human
ccuuugcacugagggccac

SEQ ID NO: 2220032 - RNA, 17 nt, Human
ccuuugcacugagggcc

SEQ ID NO: 2220033 - RNA, 18 nt, Human
ccuuugcacugagggcca

SEQ ID NO: 2220034 - RNA, 12 nt, Human
ccuuugcaggca

SEQ ID NO: 2220035 - RNA, 15 nt, Human
ccuuugcauggagug

SEQ ID NO: 2220036 - RNA, 13 nt, Human
ccuuugcaggcau

SEQ ID NO: 2220037 - RNA, 21 nt, Human
ccuuugccccaccuuuauuaa

SEQ ID NO: 2220038 - RNA, 16 nt, Human
ccuuugcccagaaaga

SEQ ID NO: 2220039 - RNA, 19 nt, Human
ccuuugcugaggccuccag

SEQ ID NO: 2220040 - RNA, 22 nt, Human
ccuuugaguuuccucaggcugc

SEQ ID NO: 2220041 - RNA, 17 nt, Human
ccuuugauaaaauaaau

SEQ ID NO: 2220042 - RNA, 21 nt, Human
ccuuugauuaaagacuccagu

SEQ ID NO: 2220043 - RNA, 22 nt, Human
ccuuugagugcaguccugauca

SEQ ID NO: 2220044 - RNA, 19 nt, Human
ccuuugagugcaguccuga

SEQ ID NO: 2220045 - RNA, 20 nt, Human
ccuuugaauccucucucugu

SEQ ID NO: 2220046 - RNA, 13 nt, Human
ccuuugagacagu

SEQ ID NO: 2220047 - RNA, 15 nt, Human
ccuuugagacaguuu

SEQ ID NO: 2220048 - RNA, 17 nt, Human
ccuuugagacaguuucu

SEQ ID NO: 2220049 - RNA, 19 nt, Human
ccuuugagacaguuucuua

SEQ ID NO: 2220050 - RNA, 22 nt, Human
ccuuugagcccacaaagccuua

SEQ ID NO: 2220051 - RNA, 23 nt, Human
ccuuugacgccaucccagcccca

SEQ ID NO: 2220052 - RNA, 14 nt, Human
ccuuugacaaaggu

SEQ ID NO: 2220053 - RNA, 15 nt, Human
ccuuucuuggccagu

SEQ ID NO: 2220054 - RNA, 13 nt, Human
ccuuucuuggcca

SEQ ID NO: 2220055 - RNA, 13 nt, Human
ccuuucuugguuc

SEQ ID NO: 2220056 - RNA, 18 nt, Human
ccuuucuugguucauaaa

SEQ ID NO: 2220057 - RNA, 15 nt, Human
ccuuucuuuuucuuc

SEQ ID NO: 2220058 - RNA, 16 nt, Human
ccuuucuuuuucuucu

SEQ ID NO: 2220059 - RNA, 17 nt, Human
ccuuucuuuuucuucuu

SEQ ID NO: 2220060 - RNA, 23 nt, Human
ccuuucuuuuucuucuucccucc

SEQ ID NO: 2220061 - RNA, 12 nt, Human
ccuuugaagagg

SEQ ID NO: 2220062 - RNA, 16 nt, Human
ccuuugaauccucucu

SEQ ID NO: 2220063 - RNA, 14 nt, Human
ccuuugaauccucu

SEQ ID NO: 2220064 - RNA, 13 nt, Human
ccuuugaagagga

SEQ ID NO: 2220065 - RNA, 14 nt, Human
ccuuugaagaggaa

SEQ ID NO: 2220066 - RNA, 23 nt, Human
ccuuugaagaggaaaaugaauaa

SEQ ID NO: 2220067 - RNA, 20 nt, Human
cgauccaccugucucagccu

SEQ ID NO: 2220068 - RNA, 16 nt, Human
cgaggcuggagcuggc

SEQ ID NO: 2220069 - RNA, 15 nt, Human
cgaggcuggagcugg

SEQ ID NO: 2220070 - RNA, 13 nt, Human
cgagggaugaugc

SEQ ID NO: 2220071 - RNA, 22 nt, Human
cgaggcugcccacuauggucau

SEQ ID NO: 2220072 - RNA, 18 nt, Human
cgaggccuucucugaagg

SEQ ID NO: 2220073 - RNA, 19 nt, Human
cgaggccuucucugaagga

SEQ ID NO: 2220074 - RNA, 11 nt, Human
cgaggaagccc

SEQ ID NO: 2220075 - RNA, 19 nt, Human
cgaggaaccagagccaugg

SEQ ID NO: 2220076 - RNA, 13 nt, Human
cgaggacagggag

SEQ ID NO: 2220077 - RNA, 16 nt, Human
cgaggaaccagagcca

SEQ ID NO: 2220078 - RNA, 15 nt, Human
cgaggaaccagagcc

SEQ ID NO: 2220079 - RNA, 14 nt, Human
cgaggaaccagagc

SEQ ID NO: 2220080 - RNA, 22 nt, Human
cgagcuggugcauuacagagag

SEQ ID NO: 2220081 - RNA, 14 nt, Human
cgagcuuuucuaaa

SEQ ID NO: 2220082 - RNA, 14 nt, Human
cgaggaaacucaga

SEQ ID NO: 2220083 - RNA, 12 nt, Human
cgaggacaggga

SEQ ID NO: 2220084 - RNA, 14 nt, Human
ccuuuggcucugga

SEQ ID NO: 2220085 - RNA, 15 nt, Human
ccuuuggcucuggag

SEQ ID NO: 2220086 - RNA, 16 nt, Human
ccuuuggcucuggaga

SEQ ID NO: 2220087 - RNA, 19 nt, Human
ccuuuggcucuggagacag

SEQ ID NO: 2220088 - RNA, 15 nt, Human
ccuuuguauucucuc

SEQ ID NO: 2220089 - RNA, 20 nt, Human
ccuuuguauucucuccugua

SEQ ID NO: 2220090 - RNA, 18 nt, Human
ccuuuguauucucuccug

SEQ ID NO: 2220091 - RNA, 23 nt, Human
cgagcuggugcauuacagagagg

SEQ ID NO: 2220092 - RNA, 21 nt, Human
cgagcuggugcauuacagaga

SEQ ID NO: 2220093 - RNA, 15 nt, Human
cgagcuggugcauua

SEQ ID NO: 2220094 - RNA, 14 nt, Human
cgagcuggugcauu

SEQ ID NO: 2220095 - RNA, 13 nt, Human
cgagcuggugcau

SEQ ID NO: 2220096 - RNA, 23 nt, Human
cgagcugggggccaugagcucca

SEQ ID NO: 2220097 - RNA, 20 nt, Human
cgagcugggggccaugagcu

SEQ ID NO: 2220098 - RNA, 16 nt, Human
cgagcugggggccaug

SEQ ID NO: 2220099 - RNA, 15 nt, Human
cgagcugggggccau

SEQ ID NO: 2220100 - RNA, 13 nt, Human
cgagcugggggcc

SEQ ID NO: 2220101 - RNA, 12 nt, Human
cgagcugggggc

SEQ ID NO: 2220102 - RNA, 15 nt, Human
cgagcuggauguccc

SEQ ID NO: 2220103 - RNA, 21 nt, Human
cgagcucguguauccuggggc

SEQ ID NO: 2220104 - RNA, 22 nt, Human
cgagcucguguauccuggggcu

SEQ ID NO: 2220105 - RNA, 12 nt, Human
ccuuuguauauu

SEQ ID NO: 2220106 - RNA, 14 nt, Human
ccuuuguauauuau

SEQ ID NO: 2220107 - RNA, 19 nt, Human
ccuuuguauauuauuucua

SEQ ID NO: 2220108 - RNA, 18 nt, Human
cgagcgcuuucuggaaaa

SEQ ID NO: 2220109 - RNA, 17 nt, Human
cgagcucguguauccug

SEQ ID NO: 2220110 - RNA, 23 nt, Human
cgagcgcuuucuggaaaagagga

SEQ ID NO: 2220111 - RNA, 18 nt, Human
cgagcucguguauccugg

SEQ ID NO: 2220112 - RNA, 19 nt, Human
cgagcucguguauccuggg

SEQ ID NO: 2220113 - RNA, 20 nt, Human
cgagcucguguauccugggg

SEQ ID NO: 2220114 - RNA, 19 nt, Human
cgaucgcggcggagcuggc

SEQ ID NO: 2220115 - RNA, 22 nt, Human
cgauccaccugucucagccucc

SEQ ID NO: 2220116 - RNA, 13 nt, Human
cgauccuuccucc

SEQ ID NO: 2220117 - RNA, 19 nt, Human
cgaucggggcacugcaggg

SEQ ID NO: 2220118 - RNA, 21 nt, Human
cgaugaauuuggagacucugu

SEQ ID NO: 2220119 - RNA, 17 nt, Human
cgaucucuuauuuuaca

SEQ ID NO: 2220120 - RNA, 19 nt, Human
cgaucuggguucacugcaa

SEQ ID NO: 2220121 - RNA, 21 nt, Human
cgauucuucugcuucagccuc

SEQ ID NO: 2220122 - RNA, 21 nt, Human
cgauugcaggagucccugcca

SEQ ID NO: 2220123 - RNA, 11 nt, Human
cgauucuggau

SEQ ID NO: 2220124 - RNA, 13 nt, Human
cgauucuucugcu

SEQ ID NO: 2220125 - RNA, 19 nt, Human
cgauucuucugcuucagcc

SEQ ID NO: 2220126 - RNA, 15 nt, Human
cgauuggcuuuaaac

SEQ ID NO: 2220127 - RNA, 14 nt, Human
cgauuuaauucucu

SEQ ID NO: 2220128 - RNA, 15 nt, Human
cgauuuaauucucuu

SEQ ID NO: 2220129 - RNA, 18 nt, Human
cgauuuaauucucuugaa

SEQ ID NO: 2220130 - RNA, 21 nt, Human
cgcaagccuguaaucccagcu

SEQ ID NO: 2220131 - RNA, 20 nt, Human
cgcaagccuguaaucccagc

SEQ ID NO: 2220132 - RNA, 14 nt, Human
cgcaagucugcagc

SEQ ID NO: 2220133 - RNA, 15 nt, Human
cgcaagucugcagcc

SEQ ID NO: 2220134 - RNA, 13 nt, Human
cgauuggcuuuaa

SEQ ID NO: 2220135 - RNA, 23 nt, Human
cgauugcaggagucccugccauc

SEQ ID NO: 2220136 - RNA, 12 nt, Human
cgauuucuguuu

SEQ ID NO: 2220137 - RNA, 18 nt, Human
cgcaaugugcccccagac

SEQ ID NO: 2220138 - RNA, 20 nt, Human
cgcaaugugcccccagacgc

SEQ ID NO: 2220139 - RNA, 10 nt, Human
cgcacacaca

SEQ ID NO: 2220140 - RNA, 22 nt, Human
cgcacaauaguaaccuggguaa

SEQ ID NO: 2220141 - RNA, 21 nt, Human
cgcacaaggcugaccaagaga

SEQ ID NO: 2220142 - RNA, 16 nt, Human
cgcacaaggcugacca

SEQ ID NO: 2220143 - RNA, 11 nt, Human
cgcaaugugac

SEQ ID NO: 2220144 - RNA, 13 nt, Human
cgcacacacacac

SEQ ID NO: 2220145 - RNA, 13 nt, Human
cgcacacacacaa

SEQ ID NO: 2220146 - RNA, 17 nt, Human
cgcacuuuccuccuggc

SEQ ID NO: 2220147 - RNA, 13 nt, Human
cgcagaagcagac

SEQ ID NO: 2220148 - RNA, 18 nt, Human
cgcucagcaugcauccuu

SEQ ID NO: 2220149 - RNA, 16 nt, Human
cgcuccugucugccag

SEQ ID NO: 2220150 - RNA, 17 nt, Human
cgcuauugucaccaggg

SEQ ID NO: 2220151 - RNA, 13 nt, Human
cgcuccugugucu

SEQ ID NO: 2220152 - RNA, 20 nt, Human
cgcuccugucugccagccag

SEQ ID NO: 2220153 - RNA, 17 nt, Human
cgcuccugucugccagc

SEQ ID NO: 2220154 - RNA, 21 nt, Human
cgcuccugucugccagccagc

SEQ ID NO: 2220155 - RNA, 17 nt, Human
cgcucuccuuucuuucu

SEQ ID NO: 2220156 - RNA, 17 nt, Human
cggaaaccuugguguag

SEQ ID NO: 2220157 - RNA, 21 nt, Human
cgcucgcuuccgcauccuagu

SEQ ID NO: 2220158 - RNA, 12 nt, Human
cgcucggaggcc

SEQ ID NO: 2220159 - RNA, 14 nt, Human
cgcucggaggcccc

SEQ ID NO: 2220160 - RNA, 15 nt, Human
cgcucggaggcccca

SEQ ID NO: 2220161 - RNA, 16 nt, Human
cgcucggaggccccaa

SEQ ID NO: 2220162 - RNA, 19 nt, Human
cgcucggaggccccaaagg

SEQ ID NO: 2220163 - RNA, 20 nt, Human
cgcucggaggccccaaagga

SEQ ID NO: 2220164 - RNA, 13 nt, Human
cggaaagcagcuc

SEQ ID NO: 2220165 - RNA, 12 nt, Human
cggaaagcagcu

SEQ ID NO: 2220166 - RNA, 15 nt, Human
cggaacaagccuaaa

SEQ ID NO: 2220167 - RNA, 17 nt, Human
cggaacccaagcuuaga

SEQ ID NO: 2220168 - RNA, 19 nt, Human
cggaacccaagcuuagaac

SEQ ID NO: 2220169 - RNA, 20 nt, Human
cggaaccgcccaggaucaga

SEQ ID NO: 2220170 - RNA, 12 nt, Human
cggacacccccu

SEQ ID NO: 2220171 - RNA, 14 nt, Human
cggacacccccucg

SEQ ID NO: 2220172 - RNA, 13 nt, Human
cggacaaguuuua

SEQ ID NO: 2220173 - RNA, 15 nt, Human
cggacagccacggcc

SEQ ID NO: 2220174 - RNA, 16 nt, Human
cggacagccacggcca

SEQ ID NO: 2220175 - RNA, 18 nt, Human
cggacagccacggccagg

SEQ ID NO: 2220176 - RNA, 21 nt, Human
cggaauccuguccucagcuuc

SEQ ID NO: 2220177 - RNA, 20 nt, Human
cggaagaccugaagaguggu

SEQ ID NO: 2220178 - RNA, 20 nt, Human
cggaaagcagcucaaaggca

SEQ ID NO: 2220179 - RNA, 16 nt, Human
cggaacugcaugcugc

SEQ ID NO: 2220180 - RNA, 18 nt, Human
cggaacugcaugcugcug

SEQ ID NO: 2220181 - RNA, 17 nt, Human
cggaacugcaugcugcu

SEQ ID NO: 2220182 - RNA, 20 nt, Human
cggaaugaaccacaucuugc

SEQ ID NO: 2220183 - RNA, 16 nt, Human
cggcaauuuccggcca

SEQ ID NO: 2220184 - RNA, 14 nt, Human
cggcacagggucug

SEQ ID NO: 2220185 - RNA, 18 nt, Human
cggcacagggucugcucu

SEQ ID NO: 2220186 - RNA, 19 nt, Human
cggcacagggucugcucuu

SEQ ID NO: 2220187 - RNA, 22 nt, Human
cggcaggacaacgaggaagccc

SEQ ID NO: 2220188 - RNA, 14 nt, Human
cggcaggcucacug

SEQ ID NO: 2220189 - RNA, 17 nt, Human
cggcaggcucacugcca

SEQ ID NO: 2220190 - RNA, 18 nt, Human
cggcaggcucacugccag

SEQ ID NO: 2220191 - RNA, 19 nt, Human
cggcaggcucacugccagg

SEQ ID NO: 2220192 - RNA, 23 nt, Human
cggcaggcucacugccaggccag

SEQ ID NO: 2220193 - RNA, 20 nt, Human
cggcaggcucacugccaggc

SEQ ID NO: 2220194 - RNA, 22 nt, Human
cggcaggcucacugccaggcca

SEQ ID NO: 2220195 - RNA, 14 nt, Human
cggcaggggccugg

SEQ ID NO: 2220196 - RNA, 23 nt, Human
cggauuauuuuuucagaccgaaa

SEQ ID NO: 2220197 - RNA, 23 nt, Human
cggauuggcuuguguguuucacu

SEQ ID NO: 2220198 - RNA, 24 nt, Human
cggauuccaaagaguagaauugca

SEQ ID NO: 2220199 - RNA, 13 nt, Human
cggaugugcuuuu

SEQ ID NO: 2220200 - RNA, 14 nt, Human
cggauuauuuuuuc

SEQ ID NO: 2220201 - RNA, 16 nt, Human
cggauuauuuuuucag

SEQ ID NO: 2220202 - RNA, 17 nt, Human
cggauuauuuuuucaga

SEQ ID NO: 2220203 - RNA, 18 nt, Human
cggauuauuuuuucagac

SEQ ID NO: 2220204 - RNA, 19 nt, Human
cggauuauuuuuucagacc

SEQ ID NO: 2220205 - RNA, 20 nt, Human
cggauuauuuuuucagaccg

SEQ ID NO: 2220206 - RNA, 22 nt, Human
cggauuauuuuuucagaccgaa

SEQ ID NO: 2220207 - RNA, 12 nt, Human
cggcaacaucaa

SEQ ID NO: 2220208 - RNA, 15 nt, Human
cggauuuggggugga

SEQ ID NO: 2220209 - RNA, 16 nt, Human
cggauuuauuuuucca

SEQ ID NO: 2220210 - RNA, 17 nt, Human
cggcaaccccaguucug

SEQ ID NO: 2220211 - RNA, 19 nt, Human
cggcaaccccaguucugcu

SEQ ID NO: 2220212 - RNA, 20 nt, Human
cggcaaccccaguucugcuc

SEQ ID NO: 2220213 - RNA, 21 nt, Human
cggcaaccccaguucugcucc

SEQ ID NO: 2220214 - RNA, 22 nt, Human
cggcaaccccaguucugcuccu

SEQ ID NO: 2220215 - RNA, 23 nt, Human
cggcaaccccaguucugcuccuc

SEQ ID NO: 2220216 - RNA, 14 nt, Human
cggauccugggugg

SEQ ID NO: 2220217 - RNA, 16 nt, Human
cggaucuuuggacaga

SEQ ID NO: 2220218 - RNA, 18 nt, Human
cggacguuuccaucaggu

SEQ ID NO: 2220219 - RNA, 20 nt, Human
cggacuaagccuaccugcuc

SEQ ID NO: 2220220 - RNA, 21 nt, Human
cggacuaagccuaccugcucu

SEQ ID NO: 2220221 - RNA, 19 nt, Human
cggaucuuuggacagaagc

SEQ ID NO: 2220222 - RNA, 14 nt, Human
cggaucugagaauc

SEQ ID NO: 2220223 - RNA, 16 nt, Human
cggaucugagaaucuu

SEQ ID NO: 2220224 - RNA, 15 nt, Human
cggaucuguugcaaa

SEQ ID NO: 2220225 - RNA, 14 nt, Human
cggacguuccagcc

SEQ ID NO: 2220226 - RNA, 15 nt, Human
cggacguuccagccg

SEQ ID NO: 2220227 - RNA, 16 nt, Human
cggacguuccagccgg

SEQ ID NO: 2220228 - RNA, 15 nt, Human
cggacguuuccauca

SEQ ID NO: 2220229 - RNA, 16 nt, Human
cggacguuuccaucag

SEQ ID NO: 2220230 - RNA, 14 nt, Human
cggaccccagcugu

SEQ ID NO: 2220231 - RNA, 20 nt, Human
cggaccccagcugugagccu

SEQ ID NO: 2220232 - RNA, 21 nt, Human
cggaccuuggcagcccaggcc

SEQ ID NO: 2220233 - RNA, 22 nt, Human
cggaccccagcugugagccuug

SEQ ID NO: 2220234 - RNA, 14 nt, Human
cggaccuuucagcu

SEQ ID NO: 2220235 - RNA, 16 nt, Human
cggacacuccuagaga

SEQ ID NO: 2220236 - RNA, 14 nt, Human
cggacacuccuaga

SEQ ID NO: 2220237 - RNA, 15 nt, Human
cggacacuccuagag

SEQ ID NO: 2220238 - RNA, 12 nt, Human
cggaccccagcu

SEQ ID NO: 2220239 - RNA, 13 nt, Human
cggaccccagcug

SEQ ID NO: 2220240 - RNA, 22 nt, Human
cggggagggugacaguggccgc

SEQ ID NO: 2220241 - RNA, 17 nt, Human
cgggcaugggcacuccc

SEQ ID NO: 2220242 - RNA, 23 nt, Human
cggggaggccaagugcaggcugg

SEQ ID NO: 2220243 - RNA, 17 nt, Human
cggggaguuucuuuccu

SEQ ID NO: 2220244 - RNA, 15 nt, Human
cggggagggugacag

SEQ ID NO: 2220245 - RNA, 15 nt, Human
cgggcaugggcacuc

SEQ ID NO: 2220246 - RNA, 15 nt, Human
cgggcaugacacgaa

SEQ ID NO: 2220247 - RNA, 12 nt, Human
cgggcaugacac

SEQ ID NO: 2220248 - RNA, 14 nt, Human
cgggaggggcccgc

SEQ ID NO: 2220249 - RNA, 15 nt, Human
cgggaggggcccgcu

SEQ ID NO: 2220250 - RNA, 23 nt, Human
cgggaggcugagacaggagaauc

SEQ ID NO: 2220251 - RNA, 20 nt, Human
cgggaggcugagacaggaga

SEQ ID NO: 2220252 - RNA, 16 nt, Human
cgggaggucgaggcag

SEQ ID NO: 2220253 - RNA, 17 nt, Human
cgggaggucgaggcagg

SEQ ID NO: 2220254 - RNA, 19 nt, Human
cgggaggggcccgcuugcc

SEQ ID NO: 2220255 - RNA, 15 nt, Human
cgggcagcacagcaa

SEQ ID NO: 2220256 - RNA, 12 nt, Human
cggcugggcaca

SEQ ID NO: 2220257 - RNA, 20 nt, Human
cggcugggcacacgccuccc

SEQ ID NO: 2220258 - RNA, 16 nt, Human
cggcugggcacacgcc

SEQ ID NO: 2220259 - RNA, 17 nt, Human
cggcugggcacacgccu

SEQ ID NO: 2220260 - RNA, 17 nt, Human
cggcugguuuuguaaga

SEQ ID NO: 2220261 - RNA, 22 nt, Human
cggcugguuuuguaagaugcug

SEQ ID NO: 2220262 - RNA, 23 nt, Human
cggcugguuuuguaagaugcugg

SEQ ID NO: 2220263 - RNA, 16 nt, Human
cggcugucucagacuc

SEQ ID NO: 2220264 - RNA, 13 nt, Human
cgggaggcugaga

SEQ ID NO: 2220265 - RNA, 17 nt, Human
cgggagcgguggcccug

SEQ ID NO: 2220266 - RNA, 20 nt, Human
cgggagcgguggcccugucc

SEQ ID NO: 2220267 - RNA, 16 nt, Human
cgggaggcugagacag

SEQ ID NO: 2220268 - RNA, 17 nt, Human
cgggaggcugagacagg

SEQ ID NO: 2220269 - RNA, 18 nt, Human
cgggaggcugagacagga

SEQ ID NO: 2220270 - RNA, 19 nt, Human
cgggaggcugagacaggag

SEQ ID NO: 2220271 - RNA, 22 nt, Human
cgggaggcggagcuugcaguga

SEQ ID NO: 2220272 - RNA, 20 nt, Human
cgggaggauguucugggaca

SEQ ID NO: 2220273 - RNA, 21 nt, Human
cgggagccugaucaccugccc

SEQ ID NO: 2220274 - RNA, 22 nt, Human
cgggagccugaucaccugcccu

SEQ ID NO: 2220275 - RNA, 14 nt, Human
cggccucccaaagu

SEQ ID NO: 2220276 - RNA, 23 nt, Human
cggccugaugcucccuccccugc

SEQ ID NO: 2220277 - RNA, 19 nt, Human
cggccugaugcucccuccc

SEQ ID NO: 2220278 - RNA, 14 nt, Human
cggccugcucccag

SEQ ID NO: 2220279 - RNA, 13 nt, Human
cggccugcuccca

SEQ ID NO: 2220280 - RNA, 19 nt, Human
cggccuucaacugaaaaga

SEQ ID NO: 2220281 - RNA, 15 nt, Human
cggccugguguucug

SEQ ID NO: 2220282 - RNA, 21 nt, Human
cggccuguccuccaacaccaa

SEQ ID NO: 2220283 - RNA, 15 nt, Human
cggccuuuggcuuca

SEQ ID NO: 2220284 - RNA, 15 nt, Human
cggccuguccuccaa

SEQ ID NO: 2220285 - RNA, 12 nt, Human
cggccuguccuc

SEQ ID NO: 2220286 - RNA, 15 nt, Human
cggccugcucccagc

SEQ ID NO: 2220287 - RNA, 18 nt, Human
cggccugcucccagcagc

SEQ ID NO: 2220288 - RNA, 19 nt, Human
cggccugcucccagcagcc

SEQ ID NO: 2220289 - RNA, 13 nt, Human
cggccuggcuccu

SEQ ID NO: 2220290 - RNA, 15 nt, Human
cggcuggccuggccc

SEQ ID NO: 2220291 - RNA, 16 nt, Human
cggcuggccuggcccc

SEQ ID NO: 2220292 - RNA, 18 nt, Human
cggcuggccuggccccuc

SEQ ID NO: 2220293 - RNA, 20 nt, Human
cggcaguucugggugcuccc

SEQ ID NO: 2220294 - RNA, 16 nt, Human
cggcaguucugggugc

SEQ ID NO: 2220295 - RNA, 17 nt, Human
cggcagguucacaggcg

SEQ ID NO: 2220296 - RNA, 20 nt, Human
cggcagguucacaggcgagg

SEQ ID NO: 2220297 - RNA, 20 nt, Human
cggcccauccccaggcaccu

SEQ ID NO: 2220298 - RNA, 15 nt, Human
cggcaggggccugga

SEQ ID NO: 2220299 - RNA, 17 nt, Human
cggcaggggccuggaga

SEQ ID NO: 2220300 - RNA, 18 nt, Human
cggcaggggccuggagau

SEQ ID NO: 2220301 - RNA, 19 nt, Human
cggcaggggccuggagauc

SEQ ID NO: 2220302 - RNA, 21 nt, Human
cggcaguucugggugcucccu

SEQ ID NO: 2220303 - RNA, 18 nt, Human
cggcccccagagcgcccc

SEQ ID NO: 2220304 - RNA, 21 nt, Human
cggcccccagagcgccccucc

SEQ ID NO: 2220305 - RNA, 12 nt, Human
cggccccagcca

SEQ ID NO: 2220306 - RNA, 14 nt, Human
cggccccagccaga

SEQ ID NO: 2220307 - RNA, 16 nt, Human
cggccccagccagagu

SEQ ID NO: 2220308 - RNA, 22 nt, Human
cggccccagccagaguuccugc

SEQ ID NO: 2220309 - RNA, 20 nt, Human
cggcccccgcgcgcgucccc

SEQ ID NO: 2220310 - RNA, 15 nt, Human
cggcccccuggucuc

SEQ ID NO: 2220311 - RNA, 17 nt, Human
cggcccccuccaucggg

SEQ ID NO: 2220312 - RNA, 18 nt, Human
cggcccccuggucucugg

SEQ ID NO: 2220313 - RNA, 14 nt, Human
cggccccggcccca

SEQ ID NO: 2220314 - RNA, 15 nt, Human
cggccccggccccag

SEQ ID NO: 2220315 - RNA, 19 nt, Human
cggccccggccccagccag

SEQ ID NO: 2220316 - RNA, 17 nt, Human
cggccccgucuguggcu

SEQ ID NO: 2220317 - RNA, 15 nt, Human
cggccccucccgccc

SEQ ID NO: 2220318 - RNA, 22 nt, Human
cggccccugcauccccuuggcu

SEQ ID NO: 2220319 - RNA, 17 nt, Human
cggccuccauccugagg

SEQ ID NO: 2220320 - RNA, 16 nt, Human
cggccuccauccugag

SEQ ID NO: 2220321 - RNA, 20 nt, Human
cccauucucucuccugucca

SEQ ID NO: 2220322 - RNA, 18 nt, Human
cccauucucucuccuguc

SEQ ID NO: 2220323 - RNA, 17 nt, Human
cccauucucucuccugu

SEQ ID NO: 2220324 - RNA, 13 nt, Human
cccauucugccug

SEQ ID NO: 2220325 - RNA, 22 nt, Human
ccccaaauggaaaugggcagag

SEQ ID NO: 2220326 - RNA, 21 nt, Human
cccauucugccuccauucuga

SEQ ID NO: 2220327 - RNA, 19 nt, Human
cccauucucucuccugucc

SEQ ID NO: 2220328 - RNA, 16 nt, Human
ccccaacacugugccc

SEQ ID NO: 2220329 - RNA, 17 nt, Human
ccccaacacugugcccu

SEQ ID NO: 2220330 - RNA, 18 nt, Human
ccccaacacugugcccug

SEQ ID NO: 2220331 - RNA, 19 nt, Human
ccccaacacugugcccugg

SEQ ID NO: 2220332 - RNA, 20 nt, Human
ccccaacacugugcccuggu

SEQ ID NO: 2220333 - RNA, 21 nt, Human
ccccaacacugugcccuggug

SEQ ID NO: 2220334 - RNA, 22 nt, Human
ccccaacagcgacauagcccau

SEQ ID NO: 2220335 - RNA, 22 nt, Human
ccccaacacugugcccuggugg

SEQ ID NO: 2220336 - RNA, 20 nt, Human
ccccaacagcgacauagccc

SEQ ID NO: 2220337 - RNA, 22 nt, Human
ccccaacaucucccucccacau

SEQ ID NO: 2220338 - RNA, 19 nt, Human
ccccaacaucucccuccca

SEQ ID NO: 2220339 - RNA, 12 nt, Human
ccccaacagugu

SEQ ID NO: 2220340 - RNA, 21 nt, Human
ccccacccccuucagugccca

SEQ ID NO: 2220341 - RNA, 19 nt, Human
ccccaccccggggacccug

SEQ ID NO: 2220342 - RNA, 23 nt, Human
ccccaccccggggacccugugac

SEQ ID NO: 2220343 - RNA, 17 nt, Human
ccccacccccuucagug

SEQ ID NO: 2220344 - RNA, 12 nt, Human
ccccacccccuu

SEQ ID NO: 2220345 - RNA, 23 nt, Human
ccccacccccuccccaggggaga

SEQ ID NO: 2220346 - RNA, 17 nt, Human
ccccacccccuccccag

SEQ ID NO: 2220347 - RNA, 16 nt, Human
ccccacccaagcuugg

SEQ ID NO: 2220348 - RNA, 18 nt, Human
ccccacccaagcuuggca

SEQ ID NO: 2220349 - RNA, 19 nt, Human
ccccacccaagcuuggcag

SEQ ID NO: 2220350 - RNA, 20 nt, Human
ccccacccaagcuuggcagc

SEQ ID NO: 2220351 - RNA, 14 nt, Human
ccccacccaagggc

SEQ ID NO: 2220352 - RNA, 20 nt, Human
ccccacccaagggccuggcc

SEQ ID NO: 2220353 - RNA, 23 nt, Human
ccccaagacuugguguccuuucc

SEQ ID NO: 2220354 - RNA, 16 nt, Human
ccccaagaaagccuca

SEQ ID NO: 2220355 - RNA, 16 nt, Human
ccccaagcuguuuucu

SEQ ID NO: 2220356 - RNA, 14 nt, Human
ccccaagcuguuuu

SEQ ID NO: 2220357 - RNA, 14 nt, Human
ccccaagccuggca

SEQ ID NO: 2220358 - RNA, 13 nt, Human
ccccaagccuggc

SEQ ID NO: 2220359 - RNA, 15 nt, Human
ccccaaggagggaga

SEQ ID NO: 2220360 - RNA, 17 nt, Human
ccccaagcuguuuucuu

SEQ ID NO: 2220361 - RNA, 22 nt, Human
ccccaagggcaaaauucccagg

SEQ ID NO: 2220362 - RNA, 13 nt, Human
ccccaaggcugcg

SEQ ID NO: 2220363 - RNA, 15 nt, Human
cccauggagccccag

SEQ ID NO: 2220364 - RNA, 16 nt, Human
cccauggagccccagc

SEQ ID NO: 2220365 - RNA, 17 nt, Human
cccauggcccucccagu

SEQ ID NO: 2220366 - RNA, 22 nt, Human
cccaugggaagacgaggcccuc

SEQ ID NO: 2220367 - RNA, 15 nt, Human
cccaugggcacugcu

SEQ ID NO: 2220368 - RNA, 21 nt, Human
cccauggagccccagcccccu

SEQ ID NO: 2220369 - RNA, 17 nt, Human
cccauggcuuaaugcuu

SEQ ID NO: 2220370 - RNA, 21 nt, Human
cccaugggaagacgaggcccu

SEQ ID NO: 2220371 - RNA, 14 nt, Human
cccaugggcucuga

SEQ ID NO: 2220372 - RNA, 21 nt, Human
cccaugggcacugcugggugg

SEQ ID NO: 2220373 - RNA, 16 nt, Human
cccaugggcacugcug

SEQ ID NO: 2220374 - RNA, 17 nt, Human
cccaugggcacugcugg

SEQ ID NO: 2220375 - RNA, 18 nt, Human
cccaugggcacugcuggg

SEQ ID NO: 2220376 - RNA, 20 nt, Human
cccaugggcacugcugggug

SEQ ID NO: 2220377 - RNA, 21 nt, Human
cccauucgguguggugcagug

SEQ ID NO: 2220378 - RNA, 16 nt, Human
cccaugggcucugaca

SEQ ID NO: 2220379 - RNA, 18 nt, Human
cccauuccugaagaacca

SEQ ID NO: 2220380 - RNA, 18 nt, Human
cccauucuacacagagca

SEQ ID NO: 2220381 - RNA, 19 nt, Human
cccauucuacacagagcag

SEQ ID NO: 2220382 - RNA, 14 nt, Human
cccauuccugggaa

SEQ ID NO: 2220383 - RNA, 18 nt, Human
cccaguggccucaacccu

SEQ ID NO: 2220384 - RNA, 13 nt, Human
cccaguggccuca

SEQ ID NO: 2220385 - RNA, 17 nt, Human
cccaguggccacucagc

SEQ ID NO: 2220386 - RNA, 22 nt, Human
cccaguggccacucagcuuccu

SEQ ID NO: 2220387 - RNA, 21 nt, Human
cccaguggccucaacccuccc

SEQ ID NO: 2220388 - RNA, 19 nt, Human
cccaguggccucaacccuc

SEQ ID NO: 2220389 - RNA, 19 nt, Human
cccauggagccagcucccu

SEQ ID NO: 2220390 - RNA, 13 nt, Human
cccauggagcccc

SEQ ID NO: 2220391 - RNA, 14 nt, Human
cccauggagcccca

SEQ ID NO: 2220392 - RNA, 13 nt, Human
cccauggagccag

SEQ ID NO: 2220393 - RNA, 17 nt, Human
cccaugcugcccuguga

SEQ ID NO: 2220394 - RNA, 18 nt, Human
cccaugcugcccugugag

SEQ ID NO: 2220395 - RNA, 15 nt, Human
cccagugcacccacu

SEQ ID NO: 2220396 - RNA, 14 nt, Human
cccagugcacccac

SEQ ID NO: 2220397 - RNA, 22 nt, Human
cccagugccaagcacagugccu

SEQ ID NO: 2220398 - RNA, 16 nt, Human
cccaguggccacucag

SEQ ID NO: 2220399 - RNA, 15 nt, Human
cccaugcugcccugu

SEQ ID NO: 2220400 - RNA, 16 nt, Human
cccaugcugcccugug

SEQ ID NO: 2220401 - RNA, 17 nt, Human
cccagugccgagaagga

SEQ ID NO: 2220402 - RNA, 18 nt, Human
cccagugccgagaaggaa

SEQ ID NO: 2220403 - RNA, 15 nt, Human
cccagugcccacagg

SEQ ID NO: 2220404 - RNA, 20 nt, Human
cccagugcccacaggaucag

SEQ ID NO: 2220405 - RNA, 14 nt, Human
cccaguggcugcug

SEQ ID NO: 2220406 - RNA, 17 nt, Human
ccccaggaggccagccu

SEQ ID NO: 2220407 - RNA, 22 nt, Human
ccccucagggucccugguggca

SEQ ID NO: 2220408 - RNA, 24 nt, Human
cccaggaguucgaggcugcaguca

SEQ ID NO: 2220409 - RNA, 23 nt, Human
cccaggagguggagguugcagug

SEQ ID NO: 2220410 - RNA, 22 nt, Human
cccaggaguggaggaggccugg

SEQ ID NO: 2220411 - RNA, 18 nt, Human
cccaggagggagggggcu

SEQ ID NO: 2220412 - RNA, 14 nt, Human
cccaggagggaggg

SEQ ID NO: 2220413 - RNA, 13 nt, Human
cccaggaggccag

SEQ ID NO: 2220414 - RNA, 22 nt, Human
cccaggaggccagccuugacca

SEQ ID NO: 2220415 - RNA, 21 nt, Human
cccaggagccccgaggccuuc

SEQ ID NO: 2220416 - RNA, 21 nt, Human
cccagcucucccucuggcccu

SEQ ID NO: 2220417 - RNA, 17 nt, Human
cccaggagcugcccaga

SEQ ID NO: 2220418 - RNA, 19 nt, Human
cccagcucucccucuggcc

SEQ ID NO: 2220419 - RNA, 18 nt, Human
cccagcucucccucuggc

SEQ ID NO: 2220420 - RNA, 17 nt, Human
cccagcucucccucugg

SEQ ID NO: 2220421 - RNA, 16 nt, Human
cccagcucucccucug

SEQ ID NO: 2220422 - RNA, 15 nt, Human
cccagcucucccucu

SEQ ID NO: 2220423 - RNA, 14 nt, Human
cccagcucucccuc

SEQ ID NO: 2220424 - RNA, 13 nt, Human
cccagcucucccu

SEQ ID NO: 2220425 - RNA, 12 nt, Human
cccagcucuccc

SEQ ID NO: 2220426 - RNA, 18 nt, Human
cccaggagccccgaggcc

SEQ ID NO: 2220427 - RNA, 23 nt, Human
cccaggaguuugaggcugcagcg

SEQ ID NO: 2220428 - RNA, 22 nt, Human
cccaggaguuugaggcugcagc

SEQ ID NO: 2220429 - RNA, 11 nt, Human
cccaggcaggu

SEQ ID NO: 2220430 - RNA, 13 nt, Human
cccaggcaggucu

SEQ ID NO: 2220431 - RNA, 14 nt, Human
cccaggcaggccac

SEQ ID NO: 2220432 - RNA, 23 nt, Human
cccaggaucagauugcaugugac

SEQ ID NO: 2220433 - RNA, 20 nt, Human
cccaggcaaaucaguuacua

SEQ ID NO: 2220434 - RNA, 15 nt, Human
cccaggcagggccaa

SEQ ID NO: 2220435 - RNA, 23 nt, Human
cccaggcagggccaacccuucuc

SEQ ID NO: 2220436 - RNA, 17 nt, Human
cccaggcaggucuugaa

SEQ ID NO: 2220437 - RNA, 20 nt, Human
cccaggcauuccccaggagg

SEQ ID NO: 2220438 - RNA, 21 nt, Human
cccaggcauuccccaggaggc

SEQ ID NO: 2220439 - RNA, 22 nt, Human
cccaggcauuccccaggaggcc

SEQ ID NO: 2220440 - RNA, 23 nt, Human
cccaggcauuccccaggaggcca

SEQ ID NO: 2220441 - RNA, 21 nt, Human
cccaggcauugccaagggcuu

SEQ ID NO: 2220442 - RNA, 14 nt, Human
cccaggcauugcca

SEQ ID NO: 2220443 - RNA, 13 nt, Human
cccaggccaggcc

SEQ ID NO: 2220444 - RNA, 23 nt, Human
cccaggccaggcuccuuccuguc

SEQ ID NO: 2220445 - RNA, 14 nt, Human
cccaggccaguaag

SEQ ID NO: 2220446 - RNA, 21 nt, Human
cccaggccaggcuccuuccug

SEQ ID NO: 2220447 - RNA, 19 nt, Human
cccaggccaggcuccuucc

SEQ ID NO: 2220448 - RNA, 18 nt, Human
cccaggccaggcuccuuc

SEQ ID NO: 2220449 - RNA, 22 nt, Human
cccaggccaggccaccaggaug

SEQ ID NO: 2220450 - RNA, 17 nt, Human
cccaggccaggccacca

SEQ ID NO: 2220451 - RNA, 20 nt, Human
cccaggccaggccaccagga

SEQ ID NO: 2220452 - RNA, 22 nt, Human
cccaggccaucuuccagguggg

SEQ ID NO: 2220453 - RNA, 14 nt, Human
cccaggccaucuuc

SEQ ID NO: 2220454 - RNA, 18 nt, Human
cccaggccaucuuccagg

SEQ ID NO: 2220455 - RNA, 20 nt, Human
cccaggccaucuuccaggug

SEQ ID NO: 2220456 - RNA, 21 nt, Human
cccaggccaucuuccaggugg

SEQ ID NO: 2220457 - RNA, 18 nt, Human
cccaggccccaggaagcc

SEQ ID NO: 2220458 - RNA, 17 nt, Human
cccaggccccaggaagc

SEQ ID NO: 2220459 - RNA, 13 nt, Human
cccaggccccagg

SEQ ID NO: 2220460 - RNA, 11 nt, Human
cccaggccccu

SEQ ID NO: 2220461 - RNA, 16 nt, Human
cccaggccccugccac

SEQ ID NO: 2220462 - RNA, 18 nt, Human
cccaggccccugccaccc

SEQ ID NO: 2220463 - RNA, 21 nt, Human
cccaggccccugccacccugg

SEQ ID NO: 2220464 - RNA, 22 nt, Human
cccaggccccugccacccuggg

SEQ ID NO: 2220465 - RNA, 15 nt, Human
cccagguccucugau

SEQ ID NO: 2220466 - RNA, 20 nt, Human
cccagguccucugauaccca

SEQ ID NO: 2220467 - RNA, 13 nt, Human
cccagguccucac

SEQ ID NO: 2220468 - RNA, 18 nt, Human
cccagguccagcucugga

SEQ ID NO: 2220469 - RNA, 17 nt, Human
cccagguccagcucugg

SEQ ID NO: 2220470 - RNA, 22 nt, Human
cccaggguggacuuagaaagca

SEQ ID NO: 2220471 - RNA, 22 nt, Human
cccaggugcuaggaacacuccu

SEQ ID NO: 2220472 - RNA, 13 nt, Human
cccaggugccagu

SEQ ID NO: 2220473 - RNA, 16 nt, Human
cccagguggcugaccc

SEQ ID NO: 2220474 - RNA, 23 nt, Human
cccagguggcugacccagucccu

SEQ ID NO: 2220475 - RNA, 22 nt, Human
cccagguggcugacccaguccc

SEQ ID NO: 2220476 - RNA, 19 nt, Human
cccagguggcugacccagu

SEQ ID NO: 2220477 - RNA, 18 nt, Human
cccagguggcugacccag

SEQ ID NO: 2220478 - RNA, 23 nt, Human
cccaggugcuaggaacacuccuu

SEQ ID NO: 2220479 - RNA, 22 nt, Human
cccagugacacuucagagagcu

SEQ ID NO: 2220480 - RNA, 19 nt, Human
cccagugacacuucagaga

SEQ ID NO: 2220481 - RNA, 19 nt, Human
cccagugagauuacagagg

SEQ ID NO: 2220482 - RNA, 19 nt, Human
cccagugagcacucccaag

SEQ ID NO: 2220483 - RNA, 21 nt, Human
cccagugagcacucccaaguc

SEQ ID NO: 2220484 - RNA, 13 nt, Human
cccagugcccaca

SEQ ID NO: 2220485 - RNA, 18 nt, Human
cccagugacacuucagag

SEQ ID NO: 2220486 - RNA, 13 nt, Human
cccagugacacuu

SEQ ID NO: 2220487 - RNA, 12 nt, Human
cccagugacacu

SEQ ID NO: 2220488 - RNA, 17 nt, Human
cccagucuguuccccau

SEQ ID NO: 2220489 - RNA, 19 nt, Human
cccaguccccaccccugcc

SEQ ID NO: 2220490 - RNA, 20 nt, Human
cccaguccccaccccugccc

SEQ ID NO: 2220491 - RNA, 20 nt, Human
cccagucuggaaugcagugg

SEQ ID NO: 2220492 - RNA, 23 nt, Human
cccaguauucuagguagugcccu

SEQ ID NO: 2220493 - RNA, 16 nt, Human
cccaguagaccuuguu

SEQ ID NO: 2220494 - RNA, 13 nt, Human
cccagucagccuc

SEQ ID NO: 2220495 - RNA, 14 nt, Human
cccagucagccucu

SEQ ID NO: 2220496 - RNA, 15 nt, Human
cccagucagccucuc

SEQ ID NO: 2220497 - RNA, 16 nt, Human
cccagucagccucucu

SEQ ID NO: 2220498 - RNA, 17 nt, Human
cccagucagccucucuc

SEQ ID NO: 2220499 - RNA, 18 nt, Human
cccagucagccucucucc

SEQ ID NO: 2220500 - RNA, 19 nt, Human
cccagucagccucucuccc

SEQ ID NO: 2220501 - RNA, 19 nt, Human
cccaguccaaauguccucc

SEQ ID NO: 2220502 - RNA, 20 nt, Human
cccagucagccucucuccca

SEQ ID NO: 2220503 - RNA, 21 nt, Human
cccagucagccucucucccag

SEQ ID NO: 2220504 - RNA, 23 nt, Human
cccaguccaaauguccuccagaa

SEQ ID NO: 2220505 - RNA, 22 nt, Human
cccagucagccucucucccagu

SEQ ID NO: 2220506 - RNA, 13 nt, Human
cccaguccccacc

SEQ ID NO: 2220507 - RNA, 14 nt, Human
cccaguccccaccc

SEQ ID NO: 2220508 - RNA, 15 nt, Human
cccaguccccacccc

SEQ ID NO: 2220509 - RNA, 18 nt, Human
cccaguccccaccccugc

SEQ ID NO: 2220510 - RNA, 15 nt, Human
cccaggccguggcug

SEQ ID NO: 2220511 - RNA, 18 nt, Human
cccaggccgcagcucuug

SEQ ID NO: 2220512 - RNA, 21 nt, Human
cccaggccgggguggagcaug

SEQ ID NO: 2220513 - RNA, 16 nt, Human
cccaggccgcagcucu

SEQ ID NO: 2220514 - RNA, 17 nt, Human
cccaggccgcagcucuu

SEQ ID NO: 2220515 - RNA, 21 nt, Human
cccaggccgcagcucuugccc

SEQ ID NO: 2220516 - RNA, 18 nt, Human
cccaggccgagaagccag

SEQ ID NO: 2220517 - RNA, 13 nt, Human
cccaggccgcagc

SEQ ID NO: 2220518 - RNA, 14 nt, Human
cccaggccgcagcu

SEQ ID NO: 2220519 - RNA, 22 nt, Human
cccaggccccgaggacccagac

SEQ ID NO: 2220520 - RNA, 23 nt, Human
cccaggccccgaggacccagacc

SEQ ID NO: 2220521 - RNA, 17 nt, Human
cccaggccuccuacagc

SEQ ID NO: 2220522 - RNA, 18 nt, Human
cccaggccuccuacagcu

SEQ ID NO: 2220523 - RNA, 13 nt, Human
cccaggccucugu

SEQ ID NO: 2220524 - RNA, 15 nt, Human
cccaggccugccugu

SEQ ID NO: 2220525 - RNA, 16 nt, Human
cccaggccugccuguu

SEQ ID NO: 2220526 - RNA, 18 nt, Human
cccaggcgccccuucccc

SEQ ID NO: 2220527 - RNA, 13 nt, Human
cccaggggagagg

SEQ ID NO: 2220528 - RNA, 17 nt, Human
cccaggggaccacaccu

SEQ ID NO: 2220529 - RNA, 14 nt, Human
cccaggcugagccu

SEQ ID NO: 2220530 - RNA, 13 nt, Human
cccaggcgggagc

SEQ ID NO: 2220531 - RNA, 22 nt, Human
cccaggcgggagcgguggcccu

SEQ ID NO: 2220532 - RNA, 23 nt, Human
cccaggcgggagcgguggcccug

SEQ ID NO: 2220533 - RNA, 24 nt, Human
cccaggggagagggucuggagaag

SEQ ID NO: 2220534 - RNA, 14 nt, Human
cccaggggagcccu

SEQ ID NO: 2220535 - RNA, 15 nt, Human
cccaggggagcccuc

SEQ ID NO: 2220536 - RNA, 16 nt, Human
cccaggggagcccucc

SEQ ID NO: 2220537 - RNA, 23 nt, Human
cccaggggagagggucuggagaa

SEQ ID NO: 2220538 - RNA, 22 nt, Human
cccaggggagagggucuggaga

SEQ ID NO: 2220539 - RNA, 21 nt, Human
cccaggggagagggucuggag

SEQ ID NO: 2220540 - RNA, 15 nt, Human
cccaggggagagggu

SEQ ID NO: 2220541 - RNA, 23 nt, Human
cccaggggcauguauuggccugg

SEQ ID NO: 2220542 - RNA, 17 nt, Human
cccaggggcccacaggg

SEQ ID NO: 2220543 - RNA, 22 nt, Human
cccaggggcauguauuggccug

SEQ ID NO: 2220544 - RNA, 19 nt, Human
cccaggggagcccuccacg

SEQ ID NO: 2220545 - RNA, 19 nt, Human
cccaggggucccagccacc

SEQ ID NO: 2220546 - RNA, 18 nt, Human
cccaggggucccagccac

SEQ ID NO: 2220547 - RNA, 16 nt, Human
cccaggggucccagcc

SEQ ID NO: 2220548 - RNA, 15 nt, Human
cccaggggucccagc

SEQ ID NO: 2220549 - RNA, 21 nt, Human
cccaggggcuggcuucaggag

SEQ ID NO: 2220550 - RNA, 18 nt, Human
cccaggggcccacaggga

SEQ ID NO: 2220551 - RNA, 20 nt, Human
cccaggggucccagccaccc

SEQ ID NO: 2220552 - RNA, 17 nt, Human
cccaggggugcccccuc

SEQ ID NO: 2220553 - RNA, 18 nt, Human
cccaggggugcccccucc

SEQ ID NO: 2220554 - RNA, 19 nt, Human
cccaggggugcccccuccu

SEQ ID NO: 2220555 - RNA, 21 nt, Human
cccaggggugcccccuccucu

SEQ ID NO: 2220556 - RNA, 22 nt, Human
cccaggggugcccccuccucuc

SEQ ID NO: 2220557 - RNA, 23 nt, Human
cccaggggugcccccuccucucc

SEQ ID NO: 2220558 - RNA, 13 nt, Human
cccaggguagccc

SEQ ID NO: 2220559 - RNA, 15 nt, Human
cccaggguagcccgc

SEQ ID NO: 2220560 - RNA, 16 nt, Human
cccaggguagcccgcc

SEQ ID NO: 2220561 - RNA, 17 nt, Human
cccaggguagcccgccu

SEQ ID NO: 2220562 - RNA, 15 nt, Human
cccagggucuucccu

SEQ ID NO: 2220563 - RNA, 19 nt, Human
cccaggguagcccgccugc

SEQ ID NO: 2220564 - RNA, 21 nt, Human
cccaggguagcccgccugcca

SEQ ID NO: 2220565 - RNA, 22 nt, Human
cccaggguagcccgccugccag

SEQ ID NO: 2220566 - RNA, 23 nt, Human
cccaggguagcccgccugccagu

SEQ ID NO: 2220567 - RNA, 18 nt, Human
cccagggucuucccuacc

SEQ ID NO: 2220568 - RNA, 16 nt, Human
cccagggucuucccua

SEQ ID NO: 2220569 - RNA, 23 nt, Human
cccagggucuucccuaccucagg

SEQ ID NO: 2220570 - RNA, 15 nt, Human
cccagcggccccucc

SEQ ID NO: 2220571 - RNA, 14 nt, Human
cccagcggccccuc

SEQ ID NO: 2220572 - RNA, 15 nt, Human
cccagccuggcccag

SEQ ID NO: 2220573 - RNA, 16 nt, Human
cccagccuggcccagc

SEQ ID NO: 2220574 - RNA, 19 nt, Human
cccagcgagcccugguggc

SEQ ID NO: 2220575 - RNA, 23 nt, Human
cccagcgagcccugguggcagug

SEQ ID NO: 2220576 - RNA, 17 nt, Human
cccagcgagcccuggug

SEQ ID NO: 2220577 - RNA, 18 nt, Human
cccagcgagcccuggugg

SEQ ID NO: 2220578 - RNA, 15 nt, Human
cccagcgagcccugg

SEQ ID NO: 2220579 - RNA, 12 nt, Human
cccagccuggcc

SEQ ID NO: 2220580 - RNA, 13 nt, Human
cccagccuggccc

SEQ ID NO: 2220581 - RNA, 14 nt, Human
cccagccuggccca

SEQ ID NO: 2220582 - RNA, 14 nt, Human
cccagcuaccucaa

SEQ ID NO: 2220583 - RNA, 22 nt, Human
cccagcuacccuuuuucuccag

SEQ ID NO: 2220584 - RNA, 22 nt, Human
cccagcuaccucaaccaaugcc

SEQ ID NO: 2220585 - RNA, 17 nt, Human
cccagcuacucagaagc

SEQ ID NO: 2220586 - RNA, 22 nt, Human
cccagcuaagaaccuggaacuu

SEQ ID NO: 2220587 - RNA, 18 nt, Human
cccagcuaaucuguaggg

SEQ ID NO: 2220588 - RNA, 19 nt, Human
cccagcuaaucuguagggc

SEQ ID NO: 2220589 - RNA, 20 nt, Human
cccagcuaaucuguagggcu

SEQ ID NO: 2220590 - RNA, 23 nt, Human
cccagcuaaucuguagggcugga

SEQ ID NO: 2220591 - RNA, 14 nt, Human
cccagcuaauuuuu

SEQ ID NO: 2220592 - RNA, 18 nt, Human
cccagcggccccucccac

SEQ ID NO: 2220593 - RNA, 19 nt, Human
cccagcggccccucccaca

SEQ ID NO: 2220594 - RNA, 20 nt, Human
cccagcggccccucccacac

SEQ ID NO: 2220595 - RNA, 16 nt, Human
cccagcuaagaaccug

SEQ ID NO: 2220596 - RNA, 20 nt, Human
cccagcuaagaaccuggaac

SEQ ID NO: 2220597 - RNA, 19 nt, Human
cccagcuaagaaccuggaa

SEQ ID NO: 2220598 - RNA, 18 nt, Human
cccagcuaagaaccugga

SEQ ID NO: 2220599 - RNA, 17 nt, Human
cccagcuaagaaccugg

SEQ ID NO: 2220600 - RNA, 23 nt, Human
cccagcucuagacaacccugcaa

SEQ ID NO: 2220601 - RNA, 14 nt, Human
cccagcucuagaca

SEQ ID NO: 2220602 - RNA, 19 nt, Human
cccagcucccccgggaggg

SEQ ID NO: 2220603 - RNA, 15 nt, Human
cccagcucccuagga

SEQ ID NO: 2220604 - RNA, 17 nt, Human
cccagcuccggccuguc

SEQ ID NO: 2220605 - RNA, 15 nt, Human
cccagcuccccaaga

SEQ ID NO: 2220606 - RNA, 16 nt, Human
cccagcucccccggga

SEQ ID NO: 2220607 - RNA, 21 nt, Human
cccagcuacucaagaggcuga

SEQ ID NO: 2220608 - RNA, 23 nt, Human
cccagcuacucagaagccugagg

SEQ ID NO: 2220609 - RNA, 22 nt, Human
cccagcuacucagaagccugag

SEQ ID NO: 2220610 - RNA, 21 nt, Human
cccagcuacucagaagccuga

SEQ ID NO: 2220611 - RNA, 22 nt, Human
cccagccccuagcccaggagag

SEQ ID NO: 2220612 - RNA, 18 nt, Human
cccagccccuucugaccc

SEQ ID NO: 2220613 - RNA, 20 nt, Human
cccagccccuagcccaggag

SEQ ID NO: 2220614 - RNA, 14 nt, Human
cccagcccuggcuc

SEQ ID NO: 2220615 - RNA, 15 nt, Human
cccagcccuggcucu

SEQ ID NO: 2220616 - RNA, 16 nt, Human
cccagcccuggcucug

SEQ ID NO: 2220617 - RNA, 18 nt, Human
cccagcccuggcucugca

SEQ ID NO: 2220618 - RNA, 14 nt, Human
cccagcccuggucu

SEQ ID NO: 2220619 - RNA, 18 nt, Human
cccagcccuggucucagc

SEQ ID NO: 2220620 - RNA, 19 nt, Human
cccagcccuggucucagca

SEQ ID NO: 2220621 - RNA, 22 nt, Human
cccagcccuuugggaggcugag

SEQ ID NO: 2220622 - RNA, 21 nt, Human
cccagcccuuugggaggcuga

SEQ ID NO: 2220623 - RNA, 14 nt, Human
cccagccgcucgga

SEQ ID NO: 2220624 - RNA, 15 nt, Human
cccagcccuguggaa

SEQ ID NO: 2220625 - RNA, 21 nt, Human
cccagcccuggucucagcagc

SEQ ID NO: 2220626 - RNA, 16 nt, Human
cccagcccuguggaag

SEQ ID NO: 2220627 - RNA, 14 nt, Human
cccagccgcugccc

SEQ ID NO: 2220628 - RNA, 17 nt, Human
cccagccgcugcccggc

SEQ ID NO: 2220629 - RNA, 14 nt, Human
cccagccggccucu

SEQ ID NO: 2220630 - RNA, 15 nt, Human
cccagccggccucuc

SEQ ID NO: 2220631 - RNA, 16 nt, Human
cccagccggccucucu

SEQ ID NO: 2220632 - RNA, 17 nt, Human
cccagccggccucucug

SEQ ID NO: 2220633 - RNA, 12 nt, Human
cccagccugcua

SEQ ID NO: 2220634 - RNA, 10 nt, Human
cccagccugg

SEQ ID NO: 2220635 - RNA, 22 nt, Human
cccagccggccucucuggccuc

SEQ ID NO: 2220636 - RNA, 23 nt, Human
cccagccggccucucuggccucc

SEQ ID NO: 2220637 - RNA, 18 nt, Human
cccagccggccucucugg

SEQ ID NO: 2220638 - RNA, 19 nt, Human
cccagccggccucucuggc

SEQ ID NO: 2220639 - RNA, 20 nt, Human
cccagccggccucucuggcc

SEQ ID NO: 2220640 - RNA, 21 nt, Human
cccagccggccucucuggccu

SEQ ID NO: 2220641 - RNA, 19 nt, Human
cccagcaagugagagcugg

SEQ ID NO: 2220642 - RNA, 20 nt, Human
cccagcaagugagagcuggg

SEQ ID NO: 2220643 - RNA, 21 nt, Human
cccagcaagugagagcugggu

SEQ ID NO: 2220644 - RNA, 22 nt, Human
cccagcaagugagagcugggug

SEQ ID NO: 2220645 - RNA, 23 nt, Human
cccagcaagugagagcugggugu

SEQ ID NO: 2220646 - RNA, 11 nt, Human
cccagccccuu

SEQ ID NO: 2220647 - RNA, 13 nt, Human
cccagccccuagc

SEQ ID NO: 2220648 - RNA, 15 nt, Human
cccagccccggggug

SEQ ID NO: 2220649 - RNA, 14 nt, Human
cccagccccuagcc

SEQ ID NO: 2220650 - RNA, 17 nt, Human
cccagccccuagcccag

SEQ ID NO: 2220651 - RNA, 18 nt, Human
cccagccccuagcccagg

SEQ ID NO: 2220652 - RNA, 19 nt, Human
cccagccccuagcccagga

SEQ ID NO: 2220653 - RNA, 12 nt, Human
cccaaggggcag

SEQ ID NO: 2220654 - RNA, 15 nt, Human
cccaagugugaacaa

SEQ ID NO: 2220655 - RNA, 15 nt, Human
cccaaguggugccua

SEQ ID NO: 2220656 - RNA, 23 nt, Human
cccaagggccuggccugagcugg

SEQ ID NO: 2220657 - RNA, 18 nt, Human
cccaagggccuggccuga

SEQ ID NO: 2220658 - RNA, 19 nt, Human
cccaagggccuggccugag

SEQ ID NO: 2220659 - RNA, 16 nt, Human
cccaacaccagccccu

SEQ ID NO: 2220660 - RNA, 17 nt, Human
cccaacaccagccccug

SEQ ID NO: 2220661 - RNA, 20 nt, Human
cccaacaccagccccugccc

SEQ ID NO: 2220662 - RNA, 16 nt, Human
cccaaauuugauugau

SEQ ID NO: 2220663 - RNA, 17 nt, Human
cccaagggccuggccug

SEQ ID NO: 2220664 - RNA, 19 nt, Human
cccaaauuugauugauuug

SEQ ID NO: 2220665 - RNA, 23 nt, Human
cccaaauggaaaugggcagagca

SEQ ID NO: 2220666 - RNA, 19 nt, Human
cccaaucccagcuaccuca

SEQ ID NO: 2220667 - RNA, 23 nt, Human
cccaaugcacuuuguucuggcuc

SEQ ID NO: 2220668 - RNA, 12 nt, Human
cccaauauuaua

SEQ ID NO: 2220669 - RNA, 15 nt, Human
cccaauauuauaauu

SEQ ID NO: 2220670 - RNA, 17 nt, Human
cccaauauuauaauuuu

SEQ ID NO: 2220671 - RNA, 11 nt, Human
cccaauauuau

SEQ ID NO: 2220672 - RNA, 21 nt, Human
cccaauaaacauuaagauuga

SEQ ID NO: 2220673 - RNA, 22 nt, Human
cccaaguuuuaggacaaacagc

SEQ ID NO: 2220674 - RNA, 23 nt, Human
cccaaguuuuaggacaaacagcu

SEQ ID NO: 2220675 - RNA, 16 nt, Human
cccaagugugaacaaa

SEQ ID NO: 2220676 - RNA, 20 nt, Human
cccaaucccagcuaccucaa

SEQ ID NO: 2220677 - RNA, 15 nt, Human
cccaaugcugauguc

SEQ ID NO: 2220678 - RNA, 15 nt, Human
cccaauuaggaagug

SEQ ID NO: 2220679 - RNA, 14 nt, Human
cccaauuaggaagu

SEQ ID NO: 2220680 - RNA, 16 nt, Human
cccaauguaggagcug

SEQ ID NO: 2220681 - RNA, 21 nt, Human
cccaauucuuacaaacaugug

SEQ ID NO: 2220682 - RNA, 15 nt, Human
cccaauuucagacuc

SEQ ID NO: 2220683 - RNA, 14 nt, Human
cccaauuggaggaa

SEQ ID NO: 2220684 - RNA, 14 nt, Human
cccacacaccccaa

SEQ ID NO: 2220685 - RNA, 22 nt, Human
cccacaaagccuuaucaagugu

SEQ ID NO: 2220686 - RNA, 13 nt, Human
cccacacacucgc

SEQ ID NO: 2220687 - RNA, 19 nt, Human
cccaauuaggaaguguaac

SEQ ID NO: 2220688 - RNA, 13 nt, Human
cccacaaagccuu

SEQ ID NO: 2220689 - RNA, 18 nt, Human
cccaauuuugcagggagc

SEQ ID NO: 2220690 - RNA, 12 nt, Human
cccacacccugg

SEQ ID NO: 2220691 - RNA, 14 nt, Human
cccacacccagcua

SEQ ID NO: 2220692 - RNA, 20 nt, Human
cccacaccaggccguccucc

SEQ ID NO: 2220693 - RNA, 15 nt, Human
cccacacacucgccc

SEQ ID NO: 2220694 - RNA, 23 nt, Human
cccacacggaggcaucugcaccc

SEQ ID NO: 2220695 - RNA, 16 nt, Human
cccacaccucugccag

SEQ ID NO: 2220696 - RNA, 19 nt, Human
cccacaccuccacaguuca

SEQ ID NO: 2220697 - RNA, 15 nt, Human
cccacaccucugcca

SEQ ID NO: 2220698 - RNA, 22 nt, Human
cccacacggaggcaucugcacc

SEQ ID NO: 2220699 - RNA, 22 nt, Human
cccacaccucaguucccuuggc

SEQ ID NO: 2220700 - RNA, 13 nt, Human
cccacaccucagu

SEQ ID NO: 2220701 - RNA, 15 nt, Human
cccacaccguguaaa

SEQ ID NO: 2220702 - RNA, 15 nt, Human
cccacaccuccacag

SEQ ID NO: 2220703 - RNA, 24 nt, Human
cccacaccuccacaguucaguggc

SEQ ID NO: 2220704 - RNA, 20 nt, Human
cccagagggccugcaaggga

SEQ ID NO: 2220705 - RNA, 18 nt, Human
cccagagggccugcaagg

SEQ ID NO: 2220706 - RNA, 14 nt, Human
cccacacuaaccug

SEQ ID NO: 2220707 - RNA, 13 nt, Human
cccacacucacuc

SEQ ID NO: 2220708 - RNA, 14 nt, Human
cccacacucacucc

SEQ ID NO: 2220709 - RNA, 16 nt, Human
cccacacucacuccug

SEQ ID NO: 2220710 - RNA, 23 nt, Human
cccagagugugggaagggagagc

SEQ ID NO: 2220711 - RNA, 23 nt, Human
cccagaguugcugggagcugaaa

SEQ ID NO: 2220712 - RNA, 16 nt, Human
cccagagugugggaag

SEQ ID NO: 2220713 - RNA, 17 nt, Human
cccagagugugaaacuu

SEQ ID NO: 2220714 - RNA, 15 nt, Human
cccagagugugaaac

SEQ ID NO: 2220715 - RNA, 22 nt, Human
cccagagguaacagaacagcuu

SEQ ID NO: 2220716 - RNA, 13 nt, Human
cccagagguaaca

SEQ ID NO: 2220717 - RNA, 18 nt, Human
cccagagguaacagaaca

SEQ ID NO: 2220718 - RNA, 20 nt, Human
cccagagguaacagaacagc

SEQ ID NO: 2220719 - RNA, 23 nt, Human
cccagagguaacagaacagcuuc

SEQ ID NO: 2220720 - RNA, 20 nt, Human
cccagauugcaacaggcugg

SEQ ID NO: 2220721 - RNA, 20 nt, Human
cccagaucuggucccuugca

SEQ ID NO: 2220722 - RNA, 21 nt, Human
cccagaugggggaaagcacag

SEQ ID NO: 2220723 - RNA, 22 nt, Human
cccagauguuuuacgucuggga

SEQ ID NO: 2220724 - RNA, 19 nt, Human
cccagauguuuuacgucug

SEQ ID NO: 2220725 - RNA, 21 nt, Human
cccagauguuuuacgucuggg

SEQ ID NO: 2220726 - RNA, 19 nt, Human
cccagaucuggucccuugc

SEQ ID NO: 2220727 - RNA, 18 nt, Human
cccagaucuggucccuug

SEQ ID NO: 2220728 - RNA, 16 nt, Human
cccagaucccagaagg

SEQ ID NO: 2220729 - RNA, 12 nt, Human
cccagauccuca

SEQ ID NO: 2220730 - RNA, 14 nt, Human
cccagaucccagaa

SEQ ID NO: 2220731 - RNA, 16 nt, Human
cccagaucagcuccua

SEQ ID NO: 2220732 - RNA, 14 nt, Human
cccagaguuuuuau

SEQ ID NO: 2220733 - RNA, 21 nt, Human
cccagaguuuuuauguagcag

SEQ ID NO: 2220734 - RNA, 14 nt, Human
cccagauaccagcc

SEQ ID NO: 2220735 - RNA, 18 nt, Human
cccagauaccagccccug

SEQ ID NO: 2220736 - RNA, 21 nt, Human
cccagauugcaacaggcuggg

SEQ ID NO: 2220737 - RNA, 22 nt, Human
cccagauugcaacaggcugggc

SEQ ID NO: 2220738 - RNA, 16 nt, Human
cccagcaagugagagc

SEQ ID NO: 2220739 - RNA, 18 nt, Human
cccagcaagugagagcug

SEQ ID NO: 2220740 - RNA, 13 nt, Human
cccaggcaggcug

SEQ ID NO: 2220741 - RNA, 22 nt, Human
ccaucuggguccuugcaccccu

SEQ ID NO: 2220742 - RNA, 23 nt, Human
ccaucuggguccuugcaccccuc

SEQ ID NO: 2220743 - RNA, 12 nt, Human
ccaugaagacag

SEQ ID NO: 2220744 - RNA, 19 nt, Human
ccaugaagacaggacagug

SEQ ID NO: 2220745 - RNA, 17 nt, Human
ccaugaagacaggacag

SEQ ID NO: 2220746 - RNA, 16 nt, Human
ccaugaagacaggaca

SEQ ID NO: 2220747 - RNA, 13 nt, Human
ccaugaagacagg

SEQ ID NO: 2220748 - RNA, 16 nt, Human
ccaucuggcagggugg

SEQ ID NO: 2220749 - RNA, 14 nt, Human
ccaucuggcagggu

SEQ ID NO: 2220750 - RNA, 16 nt, Human
ccaucugggagucccc

SEQ ID NO: 2220751 - RNA, 17 nt, Human
ccaucugggaguccccu

SEQ ID NO: 2220752 - RNA, 16 nt, Human
ccaucugggcuccucc

SEQ ID NO: 2220753 - RNA, 17 nt, Human
ccaucuggguccuugca

SEQ ID NO: 2220754 - RNA, 18 nt, Human
ccaucuggguccuugcac

SEQ ID NO: 2220755 - RNA, 12 nt, Human
ccaucugggcuc

SEQ ID NO: 2220756 - RNA, 22 nt, Human
ccaucugggaguccccuuuucu

SEQ ID NO: 2220757 - RNA, 22 nt, Human
ccaucugggcuccuaaccuucc

SEQ ID NO: 2220758 - RNA, 22 nt, Human
ccaugaagagauuuuucaugau

SEQ ID NO: 2220759 - RNA, 18 nt, Human
ccaugaagagauuuuuca

SEQ ID NO: 2220760 - RNA, 14 nt, Human
ccaugaagacagga

SEQ ID NO: 2220761 - RNA, 15 nt, Human
ccaugaagacaggau

SEQ ID NO: 2220762 - RNA, 14 nt, Human
ccaugaagauguag

SEQ ID NO: 2220763 - RNA, 14 nt, Human
ccaugauggcaaca

SEQ ID NO: 2220764 - RNA, 21 nt, Human
ccaugauggcaacagaucugg

SEQ ID NO: 2220765 - RNA, 19 nt, Human
ccaugauggcaacagaucu

SEQ ID NO: 2220766 - RNA, 16 nt, Human
ccaugauggcaacaga

SEQ ID NO: 2220767 - RNA, 15 nt, Human
ccaugauggcaacag

SEQ ID NO: 2220768 - RNA, 14 nt, Human
ccaugauucgccca

SEQ ID NO: 2220769 - RNA, 23 nt, Human
ccaugauucuauuuauauguaca

SEQ ID NO: 2220770 - RNA, 17 nt, Human
ccaugauguggaguggg

SEQ ID NO: 2220771 - RNA, 22 nt, Human
ccaugauguggaguggggcagu

SEQ ID NO: 2220772 - RNA, 19 nt, Human
ccaugauggugcugaccuc

SEQ ID NO: 2220773 - RNA, 22 nt, Human
ccaugauggugcugaccucugg

SEQ ID NO: 2220774 - RNA, 18 nt, Human
ccaugauguagugccucu

SEQ ID NO: 2220775 - RNA, 15 nt, Human
ccaugauguggagug

SEQ ID NO: 2220776 - RNA, 18 nt, Human
ccaugcaauauuuccuca

SEQ ID NO: 2220777 - RNA, 19 nt, Human
ccaugcaauauuuccucau

SEQ ID NO: 2220778 - RNA, 11 nt, Human
ccaugcacugu

SEQ ID NO: 2220779 - RNA, 17 nt, Human
ccaugcacugugaagga

SEQ ID NO: 2220780 - RNA, 16 nt, Human
ccaugcacugugaagg

SEQ ID NO: 2220781 - RNA, 15 nt, Human
ccaugcacugugaag

SEQ ID NO: 2220782 - RNA, 13 nt, Human
ccaugcacuguga

SEQ ID NO: 2220783 - RNA, 21 nt, Human
ccaugauuaaccacuucagcu

SEQ ID NO: 2220784 - RNA, 19 nt, Human
ccaugauuaaccacuucag

SEQ ID NO: 2220785 - RNA, 18 nt, Human
ccaugauguuuuccauga

SEQ ID NO: 2220786 - RNA, 16 nt, Human
ccaugauguuuagaaa

SEQ ID NO: 2220787 - RNA, 21 nt, Human
ccaugccucagcccugacccu

SEQ ID NO: 2220788 - RNA, 15 nt, Human
ccaugccucagcccu

SEQ ID NO: 2220789 - RNA, 16 nt, Human
ccaugccucagcccug

SEQ ID NO: 2220790 - RNA, 12 nt, Human
ccaugccucagc

SEQ ID NO: 2220791 - RNA, 14 nt, Human
ccaugccucagccc

SEQ ID NO: 2220792 - RNA, 18 nt, Human
ccaugcccagcucagagg

SEQ ID NO: 2220793 - RNA, 20 nt, Human
ccaugcguguuucugacucu

SEQ ID NO: 2220794 - RNA, 22 nt, Human
ccaugcgcucagggccaugcug

SEQ ID NO: 2220795 - RNA, 13 nt, Human
ccaugcucaucug

SEQ ID NO: 2220796 - RNA, 16 nt, Human
ccaugcucaucugcug

SEQ ID NO: 2220797 - RNA, 22 nt, Human
ccaugcgcccccuccgcccugc

SEQ ID NO: 2220798 - RNA, 13 nt, Human
ccaugcgcucagg

SEQ ID NO: 2220799 - RNA, 15 nt, Human
ccaugcgcucagggc

SEQ ID NO: 2220800 - RNA, 16 nt, Human
ccaugcgcucagggcc

SEQ ID NO: 2220801 - RNA, 20 nt, Human
ccaugccaaagcuagggugg

SEQ ID NO: 2220802 - RNA, 12 nt, Human
ccaugcagagcg

SEQ ID NO: 2220803 - RNA, 20 nt, Human
ccaugcacugugaaggaccc

SEQ ID NO: 2220804 - RNA, 19 nt, Human
ccaugcacugugaaggacc

SEQ ID NO: 2220805 - RNA, 21 nt, Human
ccaugcacugugaaggacccu

SEQ ID NO: 2220806 - RNA, 21 nt, Human
ccaugcccaccugcccaucac

SEQ ID NO: 2220807 - RNA, 18 nt, Human
ccaugcccaccugcccau

SEQ ID NO: 2220808 - RNA, 17 nt, Human
ccaugcccaccugccca

SEQ ID NO: 2220809 - RNA, 16 nt, Human
ccaugcccaccugccc

SEQ ID NO: 2220810 - RNA, 15 nt, Human
ccaugcccaccugcc

SEQ ID NO: 2220811 - RNA, 13 nt, Human
ccaugcccaccug

SEQ ID NO: 2220812 - RNA, 14 nt, Human
ccaugcugcccugu

SEQ ID NO: 2220813 - RNA, 20 nt, Human
ccaugcugaggccugggccg

SEQ ID NO: 2220814 - RNA, 18 nt, Human
ccaugcugaggccugggc

SEQ ID NO: 2220815 - RNA, 19 nt, Human
ccaugcugaggccugggcc

SEQ ID NO: 2220816 - RNA, 12 nt, Human
ccaugcuggagc

SEQ ID NO: 2220817 - RNA, 13 nt, Human
ccaugcuggagcc

SEQ ID NO: 2220818 - RNA, 14 nt, Human
ccaugcuggagccu

SEQ ID NO: 2220819 - RNA, 15 nt, Human
ccaugcuggagccug

SEQ ID NO: 2220820 - RNA, 16 nt, Human
ccaugcuggagccugu

SEQ ID NO: 2220821 - RNA, 16 nt, Human
ccaugcugggaagacg

SEQ ID NO: 2220822 - RNA, 21 nt, Human
ccaugcuggagccuguguaac

SEQ ID NO: 2220823 - RNA, 22 nt, Human
ccaugcuggagccuguguaaca

SEQ ID NO: 2220824 - RNA, 17 nt, Human
ccaugcuggagccugug

SEQ ID NO: 2220825 - RNA, 18 nt, Human
ccaugcuggagccugugu

SEQ ID NO: 2220826 - RNA, 19 nt, Human
ccaugcuggagccugugua

SEQ ID NO: 2220827 - RNA, 20 nt, Human
ccaugcuggagccuguguaa

SEQ ID NO: 2220828 - RNA, 11 nt, Human
ccaugcugccc

SEQ ID NO: 2220829 - RNA, 13 nt, Human
ccaugcugcccug

SEQ ID NO: 2220830 - RNA, 17 nt, Human
ccaugcucaucugcugg

SEQ ID NO: 2220831 - RNA, 18 nt, Human
ccaugcucaucugcuggu

SEQ ID NO: 2220832 - RNA, 20 nt, Human
ccaugcucaucugcuggucc

SEQ ID NO: 2220833 - RNA, 13 nt, Human
ccauacuggccuc

SEQ ID NO: 2220834 - RNA, 24 nt, Human
ccauaccuuccuucccugggcugu

SEQ ID NO: 2220835 - RNA, 14 nt, Human
ccauacuggccucg

SEQ ID NO: 2220836 - RNA, 17 nt, Human
ccauacuggccucgccu

SEQ ID NO: 2220837 - RNA, 18 nt, Human
ccauacuggccucgccug

SEQ ID NO: 2220838 - RNA, 19 nt, Human
ccauacuuugucugaaaaa

SEQ ID NO: 2220839 - RNA, 20 nt, Human
ccauacuggccucgccuggc

SEQ ID NO: 2220840 - RNA, 21 nt, Human
ccauacuggccucgccuggcc

SEQ ID NO: 2220841 - RNA, 22 nt, Human
ccauacuggccucgccuggccu

SEQ ID NO: 2220842 - RNA, 17 nt, Human
ccauacuuaucucucug

SEQ ID NO: 2220843 - RNA, 23 nt, Human
ccauacuaauuauacccccugca

SEQ ID NO: 2220844 - RNA, 13 nt, Human
ccauacuaauuau

SEQ ID NO: 2220845 - RNA, 12 nt, Human
ccauacuaauua

SEQ ID NO: 2220846 - RNA, 22 nt, Human
ccauaccacccaaugcugaugu

SEQ ID NO: 2220847 - RNA, 23 nt, Human
ccauaccuuccuucccugggcug

SEQ ID NO: 2220848 - RNA, 20 nt, Human
ccagugaggcucugcccuug

SEQ ID NO: 2220849 - RNA, 17 nt, Human
ccagugaggcucugccc

SEQ ID NO: 2220850 - RNA, 16 nt, Human
ccagugaaccaaagag

SEQ ID NO: 2220851 - RNA, 18 nt, Human
ccagugaggcucugcccu

SEQ ID NO: 2220852 - RNA, 19 nt, Human
ccagugaggcucugcccuu

SEQ ID NO: 2220853 - RNA, 18 nt, Human
ccauauccuuacccuccu

SEQ ID NO: 2220854 - RNA, 18 nt, Human
ccauauccccucuccccc

SEQ ID NO: 2220855 - RNA, 13 nt, Human
ccauauccugccu

SEQ ID NO: 2220856 - RNA, 18 nt, Human
ccaucaaggguacacugc

SEQ ID NO: 2220857 - RNA, 23 nt, Human
ccauauaaguuugaaggaaacag

SEQ ID NO: 2220858 - RNA, 19 nt, Human
ccauauaaguuugaaggaa

SEQ ID NO: 2220859 - RNA, 22 nt, Human
ccauauaaguuugaaggaaaca

SEQ ID NO: 2220860 - RNA, 15 nt, Human
ccauauaaguuugaa

SEQ ID NO: 2220861 - RNA, 16 nt, Human
ccauauaaguuugaag

SEQ ID NO: 2220862 - RNA, 18 nt, Human
ccauaugaccucaugcau

SEQ ID NO: 2220863 - RNA, 19 nt, Human
ccauaugaccucaugcauc

SEQ ID NO: 2220864 - RNA, 13 nt, Human
ccaucacaggguu

SEQ ID NO: 2220865 - RNA, 20 nt, Human
ccaucacaggguugggccca

SEQ ID NO: 2220866 - RNA, 22 nt, Human
ccaucagaaacacccucacacu

SEQ ID NO: 2220867 - RNA, 13 nt, Human
ccaucaccagaca

SEQ ID NO: 2220868 - RNA, 12 nt, Human
ccauccucugua

SEQ ID NO: 2220869 - RNA, 19 nt, Human
ccauccucuguacagagcc

SEQ ID NO: 2220870 - RNA, 14 nt, Human
ccaucucucccucc

SEQ ID NO: 2220871 - RNA, 23 nt, Human
ccaucugcgugacaauaaaacau

SEQ ID NO: 2220872 - RNA, 17 nt, Human
ccaucuccuuucaggga

SEQ ID NO: 2220873 - RNA, 16 nt, Human
ccaucuccuuucaggg

SEQ ID NO: 2220874 - RNA, 23 nt, Human
ccaucucgccaccccuccuuccu

SEQ ID NO: 2220875 - RNA, 22 nt, Human
ccaucucgccaccccuccuucc

SEQ ID NO: 2220876 - RNA, 20 nt, Human
ccaucucgccaccccuccuu

SEQ ID NO: 2220877 - RNA, 14 nt, Human
ccaucucgccaccc

SEQ ID NO: 2220878 - RNA, 18 nt, Human
ccaucuccuuucagggaa

SEQ ID NO: 2220879 - RNA, 15 nt, Human
ccaucacaugaccac

SEQ ID NO: 2220880 - RNA, 23 nt, Human
ccaucagaaacacccucacacug

SEQ ID NO: 2220881 - RNA, 21 nt, Human
ccaucagcuuaggggcugcug

SEQ ID NO: 2220882 - RNA, 17 nt, Human
ccaucaggacucuugug

SEQ ID NO: 2220883 - RNA, 24 nt, Human
ccaucagcuguaagaagagacugg

SEQ ID NO: 2220884 - RNA, 19 nt, Human
ccaucagcuguaagaagag

SEQ ID NO: 2220885 - RNA, 22 nt, Human
ccaucauugaaaucuuuuugcu

SEQ ID NO: 2220886 - RNA, 17 nt, Human
ccaucagugcucccuca

SEQ ID NO: 2220887 - RNA, 12 nt, Human
ccaucagugcuc

SEQ ID NO: 2220888 - RNA, 17 nt, Human
ccaucagguuccauccc

SEQ ID NO: 2220889 - RNA, 18 nt, Human
ccaucaguguacccccgc

SEQ ID NO: 2220890 - RNA, 22 nt, Human
ccaucaguguacccccgcccag

SEQ ID NO: 2220891 - RNA, 23 nt, Human
ccaucaguguacccccgcccagg

SEQ ID NO: 2220892 - RNA, 16 nt, Human
ccauccacucuacccu

SEQ ID NO: 2220893 - RNA, 17 nt, Human
ccauccacaugggagcc

SEQ ID NO: 2220894 - RNA, 20 nt, Human
ccauccaaauaagaaaccua

SEQ ID NO: 2220895 - RNA, 15 nt, Human
ccauccaaggccagg

SEQ ID NO: 2220896 - RNA, 15 nt, Human
ccaucauaggaaggg

SEQ ID NO: 2220897 - RNA, 16 nt, Human
ccaucaguuagagcug

SEQ ID NO: 2220898 - RNA, 16 nt, Human
ccaucaucaugugugu

SEQ ID NO: 2220899 - RNA, 14 nt, Human
ccaucaucccagcu

SEQ ID NO: 2220900 - RNA, 21 nt, Human
ccauccuccccuucccugcaa

SEQ ID NO: 2220901 - RNA, 18 nt, Human
ccauccuccccuucccug

SEQ ID NO: 2220902 - RNA, 17 nt, Human
ccauccuccccuucccu

SEQ ID NO: 2220903 - RNA, 21 nt, Human
ccauccagggaugccaucugu

SEQ ID NO: 2220904 - RNA, 15 nt, Human
ccauccuccccuucc

SEQ ID NO: 2220905 - RNA, 12 nt, Human
ccauccaggcag

SEQ ID NO: 2220906 - RNA, 13 nt, Human
ccauccaggcagu

SEQ ID NO: 2220907 - RNA, 22 nt, Human
ccauccacucuacccucccacc

SEQ ID NO: 2220908 - RNA, 19 nt, Human
ccauccacucuacccuccc

SEQ ID NO: 2220909 - RNA, 12 nt, Human
ccauccagaggc

SEQ ID NO: 2220910 - RNA, 20 nt, Human
ccauccucuguacagagccc

SEQ ID NO: 2220911 - RNA, 12 nt, Human
cccaaagaagga

SEQ ID NO: 2220912 - RNA, 23 nt, Human
cccaaacuguugauuauuagcca

SEQ ID NO: 2220913 - RNA, 12 nt, Human
cccaaaccucca

SEQ ID NO: 2220914 - RNA, 22 nt, Human
cccaaaccaccagaagcccaga

SEQ ID NO: 2220915 - RNA, 18 nt, Human
cccaaaccaccagaagcc

SEQ ID NO: 2220916 - RNA, 17 nt, Human
cccaaaccaccagaagc

SEQ ID NO: 2220917 - RNA, 16 nt, Human
cccaaacaccuuccag

SEQ ID NO: 2220918 - RNA, 19 nt, Human
cccaaacaccuuccagcuc

SEQ ID NO: 2220919 - RNA, 21 nt, Human
cccaaacaccuuccagcuccu

SEQ ID NO: 2220920 - RNA, 22 nt, Human
cccaaacaccuuccagcuccug

SEQ ID NO: 2220921 - RNA, 21 nt, Human
cccaaagaauguuuauagcaa

SEQ ID NO: 2220922 - RNA, 18 nt, Human
cccaaagagccuggagaa

SEQ ID NO: 2220923 - RNA, 19 nt, Human
cccaaagagccuggagaag

SEQ ID NO: 2220924 - RNA, 16 nt, Human
cccaaagcagugcaug

SEQ ID NO: 2220925 - RNA, 12 nt, Human
cccaaagaugca

SEQ ID NO: 2220926 - RNA, 15 nt, Human
cccaaagaugcagcc

SEQ ID NO: 2220927 - RNA, 22 nt, Human
ccauuuugggguacccacugcu

SEQ ID NO: 2220928 - RNA, 15 nt, Human
ccauucuggaaguga

SEQ ID NO: 2220929 - RNA, 12 nt, Human
ccauucuggaag

SEQ ID NO: 2220930 - RNA, 20 nt, Human
ccauuuugggguacccacug

SEQ ID NO: 2220931 - RNA, 23 nt, Human
ccauuuuggauucuuauggacaa

SEQ ID NO: 2220932 - RNA, 17 nt, Human
cccaaacaaauaugcaa

SEQ ID NO: 2220933 - RNA, 23 nt, Human
cccaaaagucaaaaggugccugu

SEQ ID NO: 2220934 - RNA, 22 nt, Human
cccaaaagucaaaaggugccug

SEQ ID NO: 2220935 - RNA, 20 nt, Human
cccaaacaaauaugcaaaag

SEQ ID NO: 2220936 - RNA, 18 nt, Human
cccaaaaggcagaagcaa

SEQ ID NO: 2220937 - RNA, 13 nt, Human
cccaaaaggcaga

SEQ ID NO: 2220938 - RNA, 15 nt, Human
ccauggacucuacac

SEQ ID NO: 2220939 - RNA, 17 nt, Human
ccaugcuuagucacugc

SEQ ID NO: 2220940 - RNA, 22 nt, Human
ccauggacucuacacugugaac

SEQ ID NO: 2220941 - RNA, 23 nt, Human
ccauggacuucacauaagcucag

SEQ ID NO: 2220942 - RNA, 19 nt, Human
ccauggacaggcuggcucc

SEQ ID NO: 2220943 - RNA, 18 nt, Human
ccauggacaggcuggcuc

SEQ ID NO: 2220944 - RNA, 16 nt, Human
ccauggacaggcuggc

SEQ ID NO: 2220945 - RNA, 16 nt, Human
ccaugcuuagucacug

SEQ ID NO: 2220946 - RNA, 24 nt, Human
ccaugcuggagccuguguaacagc

SEQ ID NO: 2220947 - RNA, 21 nt, Human
ccaugcugggaagacgccuga

SEQ ID NO: 2220948 - RNA, 24 nt, Human
ccaugcuguugauugcuaaaugua

SEQ ID NO: 2220949 - RNA, 21 nt, Human
ccaugcuguugauugcuaaau

SEQ ID NO: 2220950 - RNA, 22 nt, Human
ccaugcuguugauugcuaaaug

SEQ ID NO: 2220951 - RNA, 20 nt, Human
ccaugcuguugauugcuaaa

SEQ ID NO: 2220952 - RNA, 13 nt, Human
ccauggacuuugu

SEQ ID NO: 2220953 - RNA, 14 nt, Human
ccauggacuuuguu

SEQ ID NO: 2220954 - RNA, 15 nt, Human
ccauucuccaccugc

SEQ ID NO: 2220955 - RNA, 16 nt, Human
ccauucuccaccugcc

SEQ ID NO: 2220956 - RNA, 21 nt, Human
ccauucugccugcccaggccc

SEQ ID NO: 2220957 - RNA, 14 nt, Human
ccauucuccaccug

SEQ ID NO: 2220958 - RNA, 19 nt, Human
ccauucugccugcccaggc

SEQ ID NO: 2220959 - RNA, 20 nt, Human
ccauucugccugcccaggcc

SEQ ID NO: 2220960 - RNA, 16 nt, Human
ccauucugccugccca

SEQ ID NO: 2220961 - RNA, 17 nt, Human
ccauucuccaccugcca

SEQ ID NO: 2220962 - RNA, 17 nt, Human
ccauucugccugcccag

SEQ ID NO: 2220963 - RNA, 18 nt, Human
ccauucugccugcccagg

SEQ ID NO: 2220964 - RNA, 21 nt, Human
cccacaaaggagagcuagcag

SEQ ID NO: 2220965 - RNA, 21 nt, Human
ccaggcugguuucgaacuccu

SEQ ID NO: 2220966 - RNA, 18 nt, Human
ccaggcuugccugcaggc

SEQ ID NO: 2220967 - RNA, 19 nt, Human
ccaggcuuuuuuaucaugu

SEQ ID NO: 2220968 - RNA, 17 nt, Human
ccagggaagcugucccu

SEQ ID NO: 2220969 - RNA, 19 nt, Human
ccagggcacuucacagagu

SEQ ID NO: 2220970 - RNA, 18 nt, Human
ccagggaagcuggccgag

SEQ ID NO: 2220971 - RNA, 17 nt, Human
ccagggaagcuggccga

SEQ ID NO: 2220972 - RNA, 17 nt, Human
ccagggaagagaaagug

SEQ ID NO: 2220973 - RNA, 20 nt, Human
ccagggccacucugccucug

SEQ ID NO: 2220974 - RNA, 19 nt, Human
ccagggccacucugccucu

SEQ ID NO: 2220975 - RNA, 17 nt, Human
ccagggccacucugccu

SEQ ID NO: 2220976 - RNA, 22 nt, Human
ccagggccacgugccaggcccg

SEQ ID NO: 2220977 - RNA, 21 nt, Human
ccagggccacgugccaggccc

SEQ ID NO: 2220978 - RNA, 19 nt, Human
ccagggccacgugccaggc

SEQ ID NO: 2220979 - RNA, 17 nt, Human
ccagggccacgugccag

SEQ ID NO: 2220980 - RNA, 13 nt, Human
ccagggccacgug

SEQ ID NO: 2220981 - RNA, 13 nt, Human
ccagggcagggcc

SEQ ID NO: 2220982 - RNA, 14 nt, Human
ccagggcagggcca

SEQ ID NO: 2220983 - RNA, 17 nt, Human
ccaggcuugccugcagg

SEQ ID NO: 2220984 - RNA, 20 nt, Human
ccaggcuguaucccaugagc

SEQ ID NO: 2220985 - RNA, 19 nt, Human
ccaggcuggucucaaacuc

SEQ ID NO: 2220986 - RNA, 21 nt, Human
ccaggcuggucucgaacuccu

SEQ ID NO: 2220987 - RNA, 20 nt, Human
ccaggcccccaagccugcag

SEQ ID NO: 2220988 - RNA, 19 nt, Human
ccaggcccccaagccugca

SEQ ID NO: 2220989 - RNA, 17 nt, Human
ccaggccccaggaagcc

SEQ ID NO: 2220990 - RNA, 16 nt, Human
ccaggccccaggaagc

SEQ ID NO: 2220991 - RNA, 13 nt, Human
ccaggccccugcc

SEQ ID NO: 2220992 - RNA, 23 nt, Human
ccaggccccgaggacccagaccc

SEQ ID NO: 2220993 - RNA, 21 nt, Human
ccaggccccgaggacccagac

SEQ ID NO: 2220994 - RNA, 22 nt, Human
ccaggccccgaggacccagacc

SEQ ID NO: 2220995 - RNA, 19 nt, Human
ccaggccccgaggacccag

SEQ ID NO: 2220996 - RNA, 20 nt, Human
ccaggccccgaggacccaga

SEQ ID NO: 2220997 - RNA, 12 nt, Human
ccagggaagggg

SEQ ID NO: 2220998 - RNA, 17 nt, Human
ccaggugccaguuaugg

SEQ ID NO: 2220999 - RNA, 12 nt, Human
ccaggugccuug

SEQ ID NO: 2221000 - RNA, 14 nt, Human
ccaggugccuugga

SEQ ID NO: 2221001 - RNA, 15 nt, Human
ccaggugcccagcua

SEQ ID NO: 2221002 - RNA, 13 nt, Human
ccaggugcccagc

SEQ ID NO: 2221003 - RNA, 19 nt, Human
ccaggugcuaggaacacuc

SEQ ID NO: 2221004 - RNA, 15 nt, Human
ccaggucucacgggc

SEQ ID NO: 2221005 - RNA, 16 nt, Human
ccaggucucacgggca

SEQ ID NO: 2221006 - RNA, 23 nt, Human
ccaggucucacgggcaugggcac

SEQ ID NO: 2221007 - RNA, 22 nt, Human
ccagguccucugauacccagag

SEQ ID NO: 2221008 - RNA, 13 nt, Human
ccagguccucuga

SEQ ID NO: 2221009 - RNA, 14 nt, Human
ccagguccucugau

SEQ ID NO: 2221010 - RNA, 20 nt, Human
ccaggucuuggagcugagcc

SEQ ID NO: 2221011 - RNA, 21 nt, Human
ccaggucuuggagcugagccu

SEQ ID NO: 2221012 - RNA, 22 nt, Human
ccaggucuuggagcugagccuc

SEQ ID NO: 2221013 - RNA, 23 nt, Human
ccaggucuuggagcugagccucu

SEQ ID NO: 2221014 - RNA, 14 nt, Human
ccaggucuccucca

SEQ ID NO: 2221015 - RNA, 15 nt, Human
ccaggucuccuccac

SEQ ID NO: 2221016 - RNA, 16 nt, Human
ccaggucuccuccacc

SEQ ID NO: 2221017 - RNA, 19 nt, Human
ccaggucuccuccaccgcc

SEQ ID NO: 2221018 - RNA, 21 nt, Human
ccaggucuccuccaccgccau

SEQ ID NO: 2221019 - RNA, 19 nt, Human
ccaggucuuggagcugagc

SEQ ID NO: 2221020 - RNA, 15 nt, Human
ccagggcucagccug

SEQ ID NO: 2221021 - RNA, 14 nt, Human
ccagggcucagccu

SEQ ID NO: 2221022 - RNA, 13 nt, Human
ccagggcucagcc

SEQ ID NO: 2221023 - RNA, 12 nt, Human
ccagggcucagc

SEQ ID NO: 2221024 - RNA, 20 nt, Human
ccagggcucagccugguggg

SEQ ID NO: 2221025 - RNA, 16 nt, Human
ccagggcucagccugg

SEQ ID NO: 2221026 - RNA, 11 nt, Human
ccagggcucag

SEQ ID NO: 2221027 - RNA, 21 nt, Human
ccagggcuauagcucaggacc

SEQ ID NO: 2221028 - RNA, 19 nt, Human
ccagggcuaugggagcagc

SEQ ID NO: 2221029 - RNA, 19 nt, Human
ccagggcuagugacuugug

SEQ ID NO: 2221030 - RNA, 21 nt, Human
ccagggccuggaagacagaga

SEQ ID NO: 2221031 - RNA, 17 nt, Human
ccagggcuauagcucag

SEQ ID NO: 2221032 - RNA, 16 nt, Human
ccagggcuagugacuu

SEQ ID NO: 2221033 - RNA, 16 nt, Human
ccagggccuggaagac

SEQ ID NO: 2221034 - RNA, 17 nt, Human
ccagggccuggaagaca

SEQ ID NO: 2221035 - RNA, 19 nt, Human
ccagggccuggaagacaga

SEQ ID NO: 2221036 - RNA, 20 nt, Human
ccagggccuggaagacagag

SEQ ID NO: 2221037 - RNA, 18 nt, Human
ccagguccagcucuggag

SEQ ID NO: 2221038 - RNA, 16 nt, Human
ccagguccagcucugg

SEQ ID NO: 2221039 - RNA, 17 nt, Human
ccagguccagcucugga

SEQ ID NO: 2221040 - RNA, 19 nt, Human
ccagguccagcucuggagg

SEQ ID NO: 2221041 - RNA, 20 nt, Human
ccagggcuaugggagcagcu

SEQ ID NO: 2221042 - RNA, 20 nt, Human
ccaggucacccuuugcugug

SEQ ID NO: 2221043 - RNA, 16 nt, Human
ccagguccacggucug

SEQ ID NO: 2221044 - RNA, 13 nt, Human
ccagguccagcuc

SEQ ID NO: 2221045 - RNA, 14 nt, Human
ccagguccagcucu

SEQ ID NO: 2221046 - RNA, 15 nt, Human
ccagguccagcucug

SEQ ID NO: 2221047 - RNA, 21 nt, Human
ccaguagcuugggacaaauca

SEQ ID NO: 2221048 - RNA, 14 nt, Human
ccaguaucuauaua

SEQ ID NO: 2221049 - RNA, 13 nt, Human
ccaguaucgcuca

SEQ ID NO: 2221050 - RNA, 16 nt, Human
ccaguacgugcuaaca

SEQ ID NO: 2221051 - RNA, 17 nt, Human
ccaguaccuuugucaca

SEQ ID NO: 2221052 - RNA, 22 nt, Human
ccaguagaccuuguuacuucug

SEQ ID NO: 2221053 - RNA, 16 nt, Human
ccaguaccuuugucac

SEQ ID NO: 2221054 - RNA, 18 nt, Human
ccaguaccuccugucucu

SEQ ID NO: 2221055 - RNA, 20 nt, Human
ccaguaccuccugucucugg

SEQ ID NO: 2221056 - RNA, 22 nt, Human
ccaguaccuccugucucuggcc

SEQ ID NO: 2221057 - RNA, 12 nt, Human
ccagucuugugu

SEQ ID NO: 2221058 - RNA, 17 nt, Human
ccagucuuccugacacu

SEQ ID NO: 2221059 - RNA, 16 nt, Human
ccagucuguuccccau

SEQ ID NO: 2221060 - RNA, 18 nt, Human
ccaguaucuauauaugug

SEQ ID NO: 2221061 - RNA, 21 nt, Human
ccagucuguggaucagagaug

SEQ ID NO: 2221062 - RNA, 15 nt, Human
ccagugaaccaaaga

SEQ ID NO: 2221063 - RNA, 22 nt, Human
ccagucuuccugacacuuuaau

SEQ ID NO: 2221064 - RNA, 20 nt, Human
ccagugaaaucaguuacucu

SEQ ID NO: 2221065 - RNA, 16 nt, Human
ccagugaauucuugaa

SEQ ID NO: 2221066 - RNA, 20 nt, Human
ccagugaauucuugaaggaa

SEQ ID NO: 2221067 - RNA, 16 nt, Human
ccagguuaucugggca

SEQ ID NO: 2221068 - RNA, 21 nt, Human
ccagguguuacuguaauuccu

SEQ ID NO: 2221069 - RNA, 17 nt, Human
ccagguguuacuguaau

SEQ ID NO: 2221070 - RNA, 14 nt, Human
ccagguucagcuug

SEQ ID NO: 2221071 - RNA, 22 nt, Human
ccagguguguccaccugggcau

SEQ ID NO: 2221072 - RNA, 16 nt, Human
ccaggugugcacgugg

SEQ ID NO: 2221073 - RNA, 23 nt, Human
ccaggugugcacguggcaugugg

SEQ ID NO: 2221074 - RNA, 20 nt, Human
ccagguggggugaggcagug

SEQ ID NO: 2221075 - RNA, 22 nt, Human
ccaggugcuacacccuuuucca

SEQ ID NO: 2221076 - RNA, 13 nt, Human
ccaggugccuugg

SEQ ID NO: 2221077 - RNA, 23 nt, Human
ccagguggggugaggcagugggu

SEQ ID NO: 2221078 - RNA, 16 nt, Human
ccaguaacucaucugu

SEQ ID NO: 2221079 - RNA, 15 nt, Human
ccaguaacucaucug

SEQ ID NO: 2221080 - RNA, 21 nt, Human
ccaguaacgcgucuuccugag

SEQ ID NO: 2221081 - RNA, 18 nt, Human
ccaguaagggaaauagaa

SEQ ID NO: 2221082 - RNA, 19 nt, Human
ccaguaacgcgucuuccug

SEQ ID NO: 2221083 - RNA, 20 nt, Human
ccaguaacgcgucuuccuga

SEQ ID NO: 2221084 - RNA, 15 nt, Human
ccaggagccccgagg

SEQ ID NO: 2221085 - RNA, 18 nt, Human
ccaggagcauccaccucc

SEQ ID NO: 2221086 - RNA, 20 nt, Human
ccaggagcauccaccuccuu

SEQ ID NO: 2221087 - RNA, 23 nt, Human
ccaggagcauccaccuccuucuc

SEQ ID NO: 2221088 - RNA, 15 nt, Human
ccaggagcagccaca

SEQ ID NO: 2221089 - RNA, 16 nt, Human
ccaggagcagccacau

SEQ ID NO: 2221090 - RNA, 14 nt, Human
ccaggaggacugcc

SEQ ID NO: 2221091 - RNA, 14 nt, Human
ccaggaggccagcc

SEQ ID NO: 2221092 - RNA, 13 nt, Human
ccaggaggccagc

SEQ ID NO: 2221093 - RNA, 12 nt, Human
ccaggaggccag

SEQ ID NO: 2221094 - RNA, 19 nt, Human
ccaggagccuccugcccuu

SEQ ID NO: 2221095 - RNA, 18 nt, Human
ccaggagccuccugcccu

SEQ ID NO: 2221096 - RNA, 13 nt, Human
ccaggagccuccu

SEQ ID NO: 2221097 - RNA, 14 nt, Human
ccaggagccuccug

SEQ ID NO: 2221098 - RNA, 13 nt, Human
ccaggcauggugg

SEQ ID NO: 2221099 - RNA, 12 nt, Human
ccaggcagucgg

SEQ ID NO: 2221100 - RNA, 17 nt, Human
ccaggcagucgggggcu

SEQ ID NO: 2221101 - RNA, 19 nt, Human
ccaggcagucgggggcugg

SEQ ID NO: 2221102 - RNA, 20 nt, Human
ccaggcagucgggggcuggc

SEQ ID NO: 2221103 - RNA, 21 nt, Human
ccaggcagucgggggcuggcc

SEQ ID NO: 2221104 - RNA, 22 nt, Human
ccaggcagucgggggcuggccu

SEQ ID NO: 2221105 - RNA, 23 nt, Human
ccaggcagucgggggcuggccua

SEQ ID NO: 2221106 - RNA, 14 nt, Human
ccaggcauucccca

SEQ ID NO: 2221107 - RNA, 20 nt, Human
ccaggcauccuccacaauag

SEQ ID NO: 2221108 - RNA, 24 nt, Human
ccaggcagucgggggcuggccuag

SEQ ID NO: 2221109 - RNA, 24 nt, Human
ccaggcauuccccaggaggccagc

SEQ ID NO: 2221110 - RNA, 15 nt, Human
ccaggccccaggaag

SEQ ID NO: 2221111 - RNA, 16 nt, Human
ccaggcauugccaagg

SEQ ID NO: 2221112 - RNA, 23 nt, Human
ccaggcauuccccaggaggccag

SEQ ID NO: 2221113 - RNA, 22 nt, Human
ccaggcauuccccaggaggcca

SEQ ID NO: 2221114 - RNA, 12 nt, Human
ccagcugccucc

SEQ ID NO: 2221115 - RNA, 10 nt, Human
ccagcugccu

SEQ ID NO: 2221116 - RNA, 13 nt, Human
ccagcugccucuu

SEQ ID NO: 2221117 - RNA, 16 nt, Human
ccagcugcgcuugcuu

SEQ ID NO: 2221118 - RNA, 17 nt, Human
ccagcugcgcuugcuuu

SEQ ID NO: 2221119 - RNA, 18 nt, Human
ccagcugcgcuugcuuuu

SEQ ID NO: 2221120 - RNA, 18 nt, Human
ccagcugccgaccagagc

SEQ ID NO: 2221121 - RNA, 20 nt, Human
ccagcugccgaccagagccc

SEQ ID NO: 2221122 - RNA, 19 nt, Human
ccagcugccgaccagagcc

SEQ ID NO: 2221123 - RNA, 16 nt, Human
ccagcugccccagcca

SEQ ID NO: 2221124 - RNA, 18 nt, Human
ccagcugccccagccaga

SEQ ID NO: 2221125 - RNA, 19 nt, Human
ccagcugcacugaugcugc

SEQ ID NO: 2221126 - RNA, 18 nt, Human
ccagcugcacugaugcug

SEQ ID NO: 2221127 - RNA, 14 nt, Human
ccagcugcacugau

SEQ ID NO: 2221128 - RNA, 14 nt, Human
ccagcucuggucca

SEQ ID NO: 2221129 - RNA, 17 nt, Human
ccagcucugguccauag

SEQ ID NO: 2221130 - RNA, 21 nt, Human
ccagcucugguccauagagag

SEQ ID NO: 2221131 - RNA, 22 nt, Human
ccagcucugguccauagagagc

SEQ ID NO: 2221132 - RNA, 24 nt, Human
ccagcuggagaaauaugguacuca

SEQ ID NO: 2221133 - RNA, 23 nt, Human
ccagcugcuugggcuucauccuc

SEQ ID NO: 2221134 - RNA, 20 nt, Human
ccagcuggcagcagagugug

SEQ ID NO: 2221135 - RNA, 15 nt, Human
ccagcuggcagcaga

SEQ ID NO: 2221136 - RNA, 14 nt, Human
ccagcuggcagcag

SEQ ID NO: 2221137 - RNA, 16 nt, Human
ccagcugggcucugca

SEQ ID NO: 2221138 - RNA, 18 nt, Human
ccagcugggcucugcaau

SEQ ID NO: 2221139 - RNA, 13 nt, Human
ccagcuggcagca

SEQ ID NO: 2221140 - RNA, 21 nt, Human
ccagcugcuccccucccuccu

SEQ ID NO: 2221141 - RNA, 19 nt, Human
ccagcugcuccccucccuc

SEQ ID NO: 2221142 - RNA, 17 nt, Human
ccagcugcuccccuccc

SEQ ID NO: 2221143 - RNA, 16 nt, Human
ccagcugcuccccucc

SEQ ID NO: 2221144 - RNA, 14 nt, Human
ccagcugcuccccu

SEQ ID NO: 2221145 - RNA, 14 nt, Human
ccagcugcucccca

SEQ ID NO: 2221146 - RNA, 12 nt, Human
ccagcugcuccc

SEQ ID NO: 2221147 - RNA, 21 nt, Human
ccagcugcgcuugcuuuucug

SEQ ID NO: 2221148 - RNA, 19 nt, Human
ccagcugcgcuugcuuuuc

SEQ ID NO: 2221149 - RNA, 20 nt, Human
ccagcugcgcuugcuuuucu

SEQ ID NO: 2221150 - RNA, 20 nt, Human
ccagcugcuugggcuucauc

SEQ ID NO: 2221151 - RNA, 22 nt, Human
ccagagcccaccuuggcucaag

SEQ ID NO: 2221152 - RNA, 18 nt, Human
ccagagcauuuccaacac

SEQ ID NO: 2221153 - RNA, 20 nt, Human
ccagagcauuuccaacacca

SEQ ID NO: 2221154 - RNA, 11 nt, Human
ccagagcccag

SEQ ID NO: 2221155 - RNA, 16 nt, Human
ccagagcccaccuugg

SEQ ID NO: 2221156 - RNA, 22 nt, Human
ccagagcauuacgugagccagg

SEQ ID NO: 2221157 - RNA, 23 nt, Human
ccagagcauuacgugagccaggu

SEQ ID NO: 2221158 - RNA, 12 nt, Human
ccagagcagggu

SEQ ID NO: 2221159 - RNA, 14 nt, Human
ccagagcagggugu

SEQ ID NO: 2221160 - RNA, 20 nt, Human
ccagagcauuacgugagcca

SEQ ID NO: 2221161 - RNA, 21 nt, Human
ccagagcauuacgugagccag

SEQ ID NO: 2221162 - RNA, 19 nt, Human
ccagccuugaccauucucc

SEQ ID NO: 2221163 - RNA, 20 nt, Human
ccagccuugaccauucucca

SEQ ID NO: 2221164 - RNA, 15 nt, Human
ccagagcccagcucc

SEQ ID NO: 2221165 - RNA, 14 nt, Human
ccagagcccagcuc

SEQ ID NO: 2221166 - RNA, 13 nt, Human
ccagagcccagcu

SEQ ID NO: 2221167 - RNA, 12 nt, Human
ccagagcccagc

SEQ ID NO: 2221168 - RNA, 21 nt, Human
ccagccuuccucugcagcuga

SEQ ID NO: 2221169 - RNA, 22 nt, Human
ccagccuuccucugcagcugac

SEQ ID NO: 2221170 - RNA, 18 nt, Human
ccagccuucuuccauccc

SEQ ID NO: 2221171 - RNA, 19 nt, Human
ccagccuucuuccauccca

SEQ ID NO: 2221172 - RNA, 22 nt, Human
ccagccuucuuccaucccagga

SEQ ID NO: 2221173 - RNA, 18 nt, Human
ccagccuucuuugcuugc

SEQ ID NO: 2221174 - RNA, 19 nt, Human
ccagccuucuuugcuugcc

SEQ ID NO: 2221175 - RNA, 14 nt, Human
ccagcucuggcuuc

SEQ ID NO: 2221176 - RNA, 12 nt, Human
ccagcucuggcu

SEQ ID NO: 2221177 - RNA, 19 nt, Human
ccagcucuggaggggaggg

SEQ ID NO: 2221178 - RNA, 11 nt, Human
ccagcucuggu

SEQ ID NO: 2221179 - RNA, 12 nt, Human
ccagcucugguc

SEQ ID NO: 2221180 - RNA, 13 nt, Human
ccagcucuggucc

SEQ ID NO: 2221181 - RNA, 14 nt, Human
ccagcgagcccugg

SEQ ID NO: 2221182 - RNA, 22 nt, Human
ccagccuugaccauucuccacc

SEQ ID NO: 2221183 - RNA, 15 nt, Human
ccagcgagcccuggu

SEQ ID NO: 2221184 - RNA, 16 nt, Human
ccagcgagcccuggug

SEQ ID NO: 2221185 - RNA, 20 nt, Human
ccaggaauguuaaagucagu

SEQ ID NO: 2221186 - RNA, 22 nt, Human
ccaggaauuucccaggacccug

SEQ ID NO: 2221187 - RNA, 23 nt, Human
ccaggaauuucccaggacccuga

SEQ ID NO: 2221188 - RNA, 21 nt, Human
ccaggaauuucccaggacccu

SEQ ID NO: 2221189 - RNA, 20 nt, Human
ccaggaauuucccaggaccc

SEQ ID NO: 2221190 - RNA, 19 nt, Human
ccaggaauuucccaggacc

SEQ ID NO: 2221191 - RNA, 18 nt, Human
ccaggaauuucccaggac

SEQ ID NO: 2221192 - RNA, 19 nt, Human
ccaggaaugccuccucccu

SEQ ID NO: 2221193 - RNA, 14 nt, Human
ccaggaauuuccca

SEQ ID NO: 2221194 - RNA, 17 nt, Human
ccaggaauuucccagga

SEQ ID NO: 2221195 - RNA, 16 nt, Human
ccaggaauuucccagg

SEQ ID NO: 2221196 - RNA, 11 nt, Human
ccaggaagccg

SEQ ID NO: 2221197 - RNA, 16 nt, Human
ccagcuggggcguggg

SEQ ID NO: 2221198 - RNA, 19 nt, Human
ccagcuggggcguggggag

SEQ ID NO: 2221199 - RNA, 20 nt, Human
ccaggaagccagcaggcucu

SEQ ID NO: 2221200 - RNA, 22 nt, Human
ccaggaagccagcaggcucuca

SEQ ID NO: 2221201 - RNA, 15 nt, Human
ccaggaagccgugcc

SEQ ID NO: 2221202 - RNA, 20 nt, Human
ccaggaagccgugcccugcc

SEQ ID NO: 2221203 - RNA, 18 nt, Human
ccaggaaggcggggcuuc

SEQ ID NO: 2221204 - RNA, 15 nt, Human
ccaggaaggcggggc

SEQ ID NO: 2221205 - RNA, 20 nt, Human
ccagcuggggcguggggagg

SEQ ID NO: 2221206 - RNA, 22 nt, Human
ccaggaaggggguccacccagc

SEQ ID NO: 2221207 - RNA, 21 nt, Human
ccaggaaggggguccacccag

SEQ ID NO: 2221208 - RNA, 16 nt, Human
ccagcuggcagcagag

SEQ ID NO: 2221209 - RNA, 16 nt, Human
ccagcugggcucugcc

SEQ ID NO: 2221210 - RNA, 19 nt, Human
ccagcugggcucugcaauu

SEQ ID NO: 2221211 - RNA, 17 nt, Human
ccagcugggcucugcca

SEQ ID NO: 2221212 - RNA, 21 nt, Human
ccagcugggcucugccacccu

SEQ ID NO: 2221213 - RNA, 22 nt, Human
ccagcugggcucugccacccua

SEQ ID NO: 2221214 - RNA, 23 nt, Human
ccagcugggcucugccacccuac

SEQ ID NO: 2221215 - RNA, 17 nt, Human
ccagcuggggccaggcu

SEQ ID NO: 2221216 - RNA, 18 nt, Human
ccagcuggggccaggcug

SEQ ID NO: 2221217 - RNA, 19 nt, Human
ccagcuggggccaggcugg

SEQ ID NO: 2221218 - RNA, 20 nt, Human
ccagcuggggccaggcuggg

SEQ ID NO: 2221219 - RNA, 21 nt, Human
ccagcuggggccaggcugggu

SEQ ID NO: 2221220 - RNA, 22 nt, Human
ccagcuggggccaggcuggguc

SEQ ID NO: 2221221 - RNA, 23 nt, Human
ccagcuggggccaggcugggucg

SEQ ID NO: 2221222 - RNA, 22 nt, Human
ccaggacucccuccucaccucu

SEQ ID NO: 2221223 - RNA, 18 nt, Human
ccaggacucccuccucac

SEQ ID NO: 2221224 - RNA, 17 nt, Human
ccaggacucccuccuca

SEQ ID NO: 2221225 - RNA, 16 nt, Human
ccaggacucccuccuc

SEQ ID NO: 2221226 - RNA, 23 nt, Human
ccaggacucccuccucaccucug

SEQ ID NO: 2221227 - RNA, 22 nt, Human
ccaggacuccccaggccaggcc

SEQ ID NO: 2221228 - RNA, 14 nt, Human
ccaggacucccucc

SEQ ID NO: 2221229 - RNA, 19 nt, Human
ccaggacuccccaggccag

SEQ ID NO: 2221230 - RNA, 21 nt, Human
ccaggacuccccaggccaggc

SEQ ID NO: 2221231 - RNA, 21 nt, Human
ccaggacuauauuugggccug

SEQ ID NO: 2221232 - RNA, 15 nt, Human
ccaggacuccccagg

SEQ ID NO: 2221233 - RNA, 17 nt, Human
ccaggacuccccaggcc

SEQ ID NO: 2221234 - RNA, 20 nt, Human
ccaggacuauauuugggccu

SEQ ID NO: 2221235 - RNA, 20 nt, Human
ccaggacuauagcccagguc

SEQ ID NO: 2221236 - RNA, 22 nt, Human
ccaggacuauagcccagguccu

SEQ ID NO: 2221237 - RNA, 21 nt, Human
ccaggacggggccggccaggu

SEQ ID NO: 2221238 - RNA, 23 nt, Human
ccaggacggggccggccaggugg

SEQ ID NO: 2221239 - RNA, 18 nt, Human
ccaggacuauagcccagg

SEQ ID NO: 2221240 - RNA, 19 nt, Human
ccaggacuauagcccaggu

SEQ ID NO: 2221241 - RNA, 13 nt, Human
ccaggacaggacc

SEQ ID NO: 2221242 - RNA, 22 nt, Human
ccaggacaccacacccagccuc

SEQ ID NO: 2221243 - RNA, 23 nt, Human
ccaggacaccacacccagccuca

SEQ ID NO: 2221244 - RNA, 14 nt, Human
ccaggacaggacca

SEQ ID NO: 2221245 - RNA, 17 nt, Human
ccaggacaccacaccca

SEQ ID NO: 2221246 - RNA, 18 nt, Human
ccaggacaccacacccag

SEQ ID NO: 2221247 - RNA, 19 nt, Human
ccaggacaccacacccagc

SEQ ID NO: 2221248 - RNA, 20 nt, Human
ccaggacaccacacccagcc

SEQ ID NO: 2221249 - RNA, 21 nt, Human
ccaggacaccacacccagccu

SEQ ID NO: 2221250 - RNA, 13 nt, Human
ccaggacaggccc

SEQ ID NO: 2221251 - RNA, 17 nt, Human
ccaggacaggcccggcg

SEQ ID NO: 2221252 - RNA, 15 nt, Human
ccaggacaggcccgg

SEQ ID NO: 2221253 - RNA, 14 nt, Human
ccaggacaggcccg

SEQ ID NO: 2221254 - RNA, 20 nt, Human
ccaggacggggccggccagg

SEQ ID NO: 2221255 - RNA, 24 nt, Human
ccagaaacuguucccaccugcugg

SEQ ID NO: 2221256 - RNA, 12 nt, Human
ccagaaagaaaa

SEQ ID NO: 2221257 - RNA, 21 nt, Human
ccacuucaggguucuccucuc

SEQ ID NO: 2221258 - RNA, 13 nt, Human
ccacuucaauaga

SEQ ID NO: 2221259 - RNA, 16 nt, Human
ccagaaaggagacuag

SEQ ID NO: 2221260 - RNA, 14 nt, Human
ccagaaaggagacu

SEQ ID NO: 2221261 - RNA, 23 nt, Human
ccagaaauaaaguuggugacaga

SEQ ID NO: 2221262 - RNA, 21 nt, Human
ccagaaauaaaguuggugaca

SEQ ID NO: 2221263 - RNA, 16 nt, Human
ccagaaaucauuuuac

SEQ ID NO: 2221264 - RNA, 22 nt, Human
ccagaaauccaucuaaauaccu

SEQ ID NO: 2221265 - RNA, 17 nt, Human
ccagaacacacuccauc

SEQ ID NO: 2221266 - RNA, 22 nt, Human
ccagaacaagguucccucugag

SEQ ID NO: 2221267 - RNA, 13 nt, Human
ccagaaauuagaa

SEQ ID NO: 2221268 - RNA, 22 nt, Human
ccagaaaugucuaaaugcugaa

SEQ ID NO: 2221269 - RNA, 17 nt, Human
ccagaaauuagaaaccu

SEQ ID NO: 2221270 - RNA, 14 nt, Human
ccacuucagcugac

SEQ ID NO: 2221271 - RNA, 13 nt, Human
ccacuucagcuga

SEQ ID NO: 2221272 - RNA, 21 nt, Human
ccacuuagaaauugcauuucc

SEQ ID NO: 2221273 - RNA, 22 nt, Human
ccacuuaccuucaauaaaguau

SEQ ID NO: 2221274 - RNA, 21 nt, Human
ccacuuaccuucaauaaagua

SEQ ID NO: 2221275 - RNA, 17 nt, Human
ccacuucaagugaccac

SEQ ID NO: 2221276 - RNA, 22 nt, Human
ccacuuauuccccauucuuccu

SEQ ID NO: 2221277 - RNA, 17 nt, Human
ccacuuaucccucucca

SEQ ID NO: 2221278 - RNA, 13 nt, Human
ccacugcaggccc

SEQ ID NO: 2221279 - RNA, 14 nt, Human
ccacucccaggcag

SEQ ID NO: 2221280 - RNA, 14 nt, Human
ccacucccagugcu

SEQ ID NO: 2221281 - RNA, 23 nt, Human
ccacugcacuccagccuggguga

SEQ ID NO: 2221282 - RNA, 19 nt, Human
ccacuuaaaaaauguccau

SEQ ID NO: 2221283 - RNA, 17 nt, Human
ccacuuaaaaaaugucc

SEQ ID NO: 2221284 - RNA, 17 nt, Human
ccacugcaggccccgcu

SEQ ID NO: 2221285 - RNA, 14 nt, Human
ccacugcaggcccc

SEQ ID NO: 2221286 - RNA, 21 nt, Human
ccacuuaaaaaauguccauga

SEQ ID NO: 2221287 - RNA, 13 nt, Human
ccacuuaaaaugu

SEQ ID NO: 2221288 - RNA, 12 nt, Human
ccacuuaccuag

SEQ ID NO: 2221289 - RNA, 19 nt, Human
ccacuuaccuucaauaaag

SEQ ID NO: 2221290 - RNA, 14 nt, Human
ccacuuaccuucaa

SEQ ID NO: 2221291 - RNA, 13 nt, Human
ccacuuaccuuca

SEQ ID NO: 2221292 - RNA, 19 nt, Human
ccacuuagaaauugcauuu

SEQ ID NO: 2221293 - RNA, 13 nt, Human
ccacucccaggca

SEQ ID NO: 2221294 - RNA, 15 nt, Human
ccacucccaggcagc

SEQ ID NO: 2221295 - RNA, 17 nt, Human
ccacucccacuucccug

SEQ ID NO: 2221296 - RNA, 21 nt, Human
ccacucccacuucccugacac

SEQ ID NO: 2221297 - RNA, 22 nt, Human
ccacucccacuucccugacacu

SEQ ID NO: 2221298 - RNA, 23 nt, Human
ccacucccacuucccugacacug

SEQ ID NO: 2221299 - RNA, 20 nt, Human
ccacuccagcuccuucgcuu

SEQ ID NO: 2221300 - RNA, 11 nt, Human
ccacucccacu

SEQ ID NO: 2221301 - RNA, 12 nt, Human
ccacucccacuu

SEQ ID NO: 2221302 - RNA, 18 nt, Human
ccacugcagaagacagua

SEQ ID NO: 2221303 - RNA, 13 nt, Human
ccacugcagaaga

SEQ ID NO: 2221304 - RNA, 24 nt, Human
ccagaagauccccucaggacugca

SEQ ID NO: 2221305 - RNA, 18 nt, Human
ccagaagauccccucagg

SEQ ID NO: 2221306 - RNA, 22 nt, Human
ccagaagauccccucaggacug

SEQ ID NO: 2221307 - RNA, 22 nt, Human
ccagaagauagcuucaccccaa

SEQ ID NO: 2221308 - RNA, 19 nt, Human
ccagaagaauauucaggac

SEQ ID NO: 2221309 - RNA, 20 nt, Human
ccagaagaauauucaggacu

SEQ ID NO: 2221310 - RNA, 19 nt, Human
ccagaacacacuccaucag

SEQ ID NO: 2221311 - RNA, 16 nt, Human
ccagaagaauauucag

SEQ ID NO: 2221312 - RNA, 17 nt, Human
ccagaagaauauucagg

SEQ ID NO: 2221313 - RNA, 18 nt, Human
ccagaagaauauucagga

SEQ ID NO: 2221314 - RNA, 22 nt, Human
ccagaacacacuccaucagcuu

SEQ ID NO: 2221315 - RNA, 16 nt, Human
ccagaagccaaagacu

SEQ ID NO: 2221316 - RNA, 13 nt, Human
ccagaagcccaga

SEQ ID NO: 2221317 - RNA, 12 nt, Human
ccagaagcccag

SEQ ID NO: 2221318 - RNA, 22 nt, Human
ccagaaguuugagaucagccug

SEQ ID NO: 2221319 - RNA, 14 nt, Human
ccagaagcccagaa

SEQ ID NO: 2221320 - RNA, 20 nt, Human
ccagaaguuugucaagucaa

SEQ ID NO: 2221321 - RNA, 16 nt, Human
ccagaauaaacccagc

SEQ ID NO: 2221322 - RNA, 22 nt, Human
ccagaauaaacuggcagcucag

SEQ ID NO: 2221323 - RNA, 12 nt, Human
ccagaaguguga

SEQ ID NO: 2221324 - RNA, 23 nt, Human
ccagaaguuugagaucagccugg

SEQ ID NO: 2221325 - RNA, 17 nt, Human
ccagacagacaacacug

SEQ ID NO: 2221326 - RNA, 22 nt, Human
ccagacagacaucucugcaccc

SEQ ID NO: 2221327 - RNA, 23 nt, Human
ccagacacugaccauccacucua

SEQ ID NO: 2221328 - RNA, 15 nt, Human
ccagacacucugcuc

SEQ ID NO: 2221329 - RNA, 14 nt, Human
ccagacacaggccc

SEQ ID NO: 2221330 - RNA, 18 nt, Human
ccagacacagaagaggcu

SEQ ID NO: 2221331 - RNA, 13 nt, Human
ccagacacucugc

SEQ ID NO: 2221332 - RNA, 19 nt, Human
ccagaccccucuggccagg

SEQ ID NO: 2221333 - RNA, 14 nt, Human
ccagacagccugua

SEQ ID NO: 2221334 - RNA, 12 nt, Human
ccagacagccug

SEQ ID NO: 2221335 - RNA, 13 nt, Human
ccagacagccugu

SEQ ID NO: 2221336 - RNA, 21 nt, Human
ccagacagcaacggggaggcc

SEQ ID NO: 2221337 - RNA, 19 nt, Human
ccagacagacaucucugca

SEQ ID NO: 2221338 - RNA, 18 nt, Human
ccagacagacaucucugc

SEQ ID NO: 2221339 - RNA, 23 nt, Human
ccagaccccucuggccaggaugg

SEQ ID NO: 2221340 - RNA, 22 nt, Human
ccagaccccucuggccaggaug

SEQ ID NO: 2221341 - RNA, 21 nt, Human
ccagaccccucuggccaggau

SEQ ID NO: 2221342 - RNA, 20 nt, Human
ccagaccccucuggccagga

SEQ ID NO: 2221343 - RNA, 14 nt, Human
ccagaccccuggcu

SEQ ID NO: 2221344 - RNA, 24 nt, Human
ccagaccccucuggccaggaugga

SEQ ID NO: 2221345 - RNA, 15 nt, Human
ccagagcagaugcag

SEQ ID NO: 2221346 - RNA, 16 nt, Human
ccagagcagaugcaga

SEQ ID NO: 2221347 - RNA, 17 nt, Human
ccagagcagaugcagag

SEQ ID NO: 2221348 - RNA, 18 nt, Human
ccagagcagaugcagaga

SEQ ID NO: 2221349 - RNA, 20 nt, Human
ccagagcagaugcagagagc

SEQ ID NO: 2221350 - RNA, 22 nt, Human
ccagagcagaugcagagagcca

SEQ ID NO: 2221351 - RNA, 23 nt, Human
ccagagcagaugcagagagccau

SEQ ID NO: 2221352 - RNA, 14 nt, Human
ccagagcaggaagc

SEQ ID NO: 2221353 - RNA, 15 nt, Human
ccagagcaggaagca

SEQ ID NO: 2221354 - RNA, 12 nt, Human
ccagagcaggag

SEQ ID NO: 2221355 - RNA, 14 nt, Human
ccagagcaggaggc

SEQ ID NO: 2221356 - RNA, 15 nt, Human
ccagagcaggaggcc

SEQ ID NO: 2221357 - RNA, 19 nt, Human
ccagagcaggaggccccug

SEQ ID NO: 2221358 - RNA, 21 nt, Human
ccagagcaggaggccccuggc

SEQ ID NO: 2221359 - RNA, 23 nt, Human
ccagagcaggaggccccuggccc

SEQ ID NO: 2221360 - RNA, 15 nt, Human
ccagaccccuggcuu

SEQ ID NO: 2221361 - RNA, 16 nt, Human
ccagaccccuggcuuu

SEQ ID NO: 2221362 - RNA, 14 nt, Human
ccagagcagaugca

SEQ ID NO: 2221363 - RNA, 17 nt, Human
ccagaccccuggcuuuu

SEQ ID NO: 2221364 - RNA, 23 nt, Human
ccagaauggucuuucuaaugugu

SEQ ID NO: 2221365 - RNA, 16 nt, Human
ccagaaugcuuuagga

SEQ ID NO: 2221366 - RNA, 13 nt, Human
ccagaauuucaaa

SEQ ID NO: 2221367 - RNA, 12 nt, Human
ccagaauuuccc

SEQ ID NO: 2221368 - RNA, 19 nt, Human
ccagaauuucccaaagcag

SEQ ID NO: 2221369 - RNA, 18 nt, Human
ccagaauuucccaaagca

SEQ ID NO: 2221370 - RNA, 21 nt, Human
ccagaauuucccaaagcagug

SEQ ID NO: 2221371 - RNA, 21 nt, Human
ccagacaccuugacagggcac

SEQ ID NO: 2221372 - RNA, 21 nt, Human
ccacuauggucaucuuuuucu

SEQ ID NO: 2221373 - RNA, 14 nt, Human
ccacuaucugggug

SEQ ID NO: 2221374 - RNA, 14 nt, Human
ccacuagugcaaau

SEQ ID NO: 2221375 - RNA, 16 nt, Human
ccacuagugcaaauca

SEQ ID NO: 2221376 - RNA, 17 nt, Human
ccacuagugcaaaucau

SEQ ID NO: 2221377 - RNA, 20 nt, Human
ccacuaggacucugaggcuc

SEQ ID NO: 2221378 - RNA, 19 nt, Human
ccacuaggacucugaggcu

SEQ ID NO: 2221379 - RNA, 13 nt, Human
ccacucaggaggc

SEQ ID NO: 2221380 - RNA, 13 nt, Human
ccacucagcuucc

SEQ ID NO: 2221381 - RNA, 15 nt, Human
ccacucagcuccgug

SEQ ID NO: 2221382 - RNA, 11 nt, Human
ccacucagcuc

SEQ ID NO: 2221383 - RNA, 20 nt, Human
ccacucaggccaacaagcca

SEQ ID NO: 2221384 - RNA, 13 nt, Human
ccacucaggccaa

SEQ ID NO: 2221385 - RNA, 20 nt, Human
ccacucaggaggcugaggca

SEQ ID NO: 2221386 - RNA, 14 nt, Human
ccacucagcuuccu

SEQ ID NO: 2221387 - RNA, 18 nt, Human
ccacucaggcauuugacu

SEQ ID NO: 2221388 - RNA, 20 nt, Human
ccacuccagaccccuggcuu

SEQ ID NO: 2221389 - RNA, 21 nt, Human
ccacuccagaccccuggcuuu

SEQ ID NO: 2221390 - RNA, 22 nt, Human
ccacuccagaccccuggcuuuu

SEQ ID NO: 2221391 - RNA, 18 nt, Human
ccacuaggacucugaggc

SEQ ID NO: 2221392 - RNA, 16 nt, Human
ccacuaggacucugag

SEQ ID NO: 2221393 - RNA, 17 nt, Human
ccacuacaccuggcuga

SEQ ID NO: 2221394 - RNA, 21 nt, Human
ccacuagaacucuccaucuua

SEQ ID NO: 2221395 - RNA, 17 nt, Human
ccacuagacccacugga

SEQ ID NO: 2221396 - RNA, 15 nt, Human
ccacuagacccacug

SEQ ID NO: 2221397 - RNA, 17 nt, Human
ccacuacauucuguuaa

SEQ ID NO: 2221398 - RNA, 16 nt, Human
ccacuacauucuguua

SEQ ID NO: 2221399 - RNA, 22 nt, Human
ccacuacaugcagcccaugccc

SEQ ID NO: 2221400 - RNA, 22 nt, Human
ccacuacacuccagccugagca

SEQ ID NO: 2221401 - RNA, 21 nt, Human
ccacuacacuccagccugagc

SEQ ID NO: 2221402 - RNA, 20 nt, Human
ccacuacacuccagccugag

SEQ ID NO: 2221403 - RNA, 11 nt, Human
ccacuacauuc

SEQ ID NO: 2221404 - RNA, 14 nt, Human
ccacuacauucugu

SEQ ID NO: 2221405 - RNA, 15 nt, Human
ccacuacauucuguu

SEQ ID NO: 2221406 - RNA, 21 nt, Human
ccaccugguuccggaauccug

SEQ ID NO: 2221407 - RNA, 20 nt, Human
ccaccugucaaacaaagcca

SEQ ID NO: 2221408 - RNA, 19 nt, Human
ccaccugucaaacaaagcc

SEQ ID NO: 2221409 - RNA, 11 nt, Human
ccaccugucuc

SEQ ID NO: 2221410 - RNA, 17 nt, Human
ccaccugguggccucug

SEQ ID NO: 2221411 - RNA, 15 nt, Human
ccaccugguggccuc

SEQ ID NO: 2221412 - RNA, 15 nt, Human
ccacccccaccaagg

SEQ ID NO: 2221413 - RNA, 21 nt, Human
ccacccccaccaagggcgcaa

SEQ ID NO: 2221414 - RNA, 23 nt, Human
ccaccccaugucaccggauccug

SEQ ID NO: 2221415 - RNA, 13 nt, Human
ccacccccacacc

SEQ ID NO: 2221416 - RNA, 14 nt, Human
ccacccccacaccu

SEQ ID NO: 2221417 - RNA, 12 nt, Human
ccacccccacca

SEQ ID NO: 2221418 - RNA, 22 nt, Human
ccaccccagugcacccacucug

SEQ ID NO: 2221419 - RNA, 18 nt, Human
ccaccccauccaguucau

SEQ ID NO: 2221420 - RNA, 18 nt, Human
ccaccccauuuucugugg

SEQ ID NO: 2221421 - RNA, 12 nt, Human
ccacccccacac

SEQ ID NO: 2221422 - RNA, 15 nt, Human
ccacccccacccaag

SEQ ID NO: 2221423 - RNA, 18 nt, Human
ccaccugucucagccucc

SEQ ID NO: 2221424 - RNA, 16 nt, Human
ccaccugucucagccu

SEQ ID NO: 2221425 - RNA, 15 nt, Human
ccaccugucucagcc

SEQ ID NO: 2221426 - RNA, 12 nt, Human
ccaccugucuca

SEQ ID NO: 2221427 - RNA, 23 nt, Human
ccaccugucucagccucccagag

SEQ ID NO: 2221428 - RNA, 20 nt, Human
ccaccugucucagccuccca

SEQ ID NO: 2221429 - RNA, 16 nt, Human
ccacgcuggagugcag

SEQ ID NO: 2221430 - RNA, 13 nt, Human
ccacgcuggagug

SEQ ID NO: 2221431 - RNA, 22 nt, Human
ccaccugucaaacaaagccaga

SEQ ID NO: 2221432 - RNA, 15 nt, Human
ccacggccgcuccag

SEQ ID NO: 2221433 - RNA, 16 nt, Human
ccacggccgcuccagg

SEQ ID NO: 2221434 - RNA, 18 nt, Human
ccacggccgcuccagggg

SEQ ID NO: 2221435 - RNA, 23 nt, Human
ccacggccaggccagagggagug

SEQ ID NO: 2221436 - RNA, 20 nt, Human
ccacggccgcuccaggggug

SEQ ID NO: 2221437 - RNA, 17 nt, Human
ccacggucuguucuuga

SEQ ID NO: 2221438 - RNA, 18 nt, Human
ccacgggaaguuuagaga

SEQ ID NO: 2221439 - RNA, 14 nt, Human
ccacgguguucugu

SEQ ID NO: 2221440 - RNA, 18 nt, Human
ccacgcuggagugcagug

SEQ ID NO: 2221441 - RNA, 19 nt, Human
ccacgcuggagugcaguga

SEQ ID NO: 2221442 - RNA, 16 nt, Human
ccacggccaggccaga

SEQ ID NO: 2221443 - RNA, 18 nt, Human
ccacggccaggccagagg

SEQ ID NO: 2221444 - RNA, 19 nt, Human
ccaccccagugcacccacu

SEQ ID NO: 2221445 - RNA, 17 nt, Human
ccaccccagugcaccca

SEQ ID NO: 2221446 - RNA, 18 nt, Human
ccaccccagcugcucccc

SEQ ID NO: 2221447 - RNA, 19 nt, Human
ccaccccagaaauggugaa

SEQ ID NO: 2221448 - RNA, 17 nt, Human
ccaccccacccccuuca

SEQ ID NO: 2221449 - RNA, 13 nt, Human
ccaccccagcugc

SEQ ID NO: 2221450 - RNA, 14 nt, Human
ccaccccagccuaa

SEQ ID NO: 2221451 - RNA, 12 nt, Human
ccaccccagccu

SEQ ID NO: 2221452 - RNA, 13 nt, Human
ccaccccacacuu

SEQ ID NO: 2221453 - RNA, 14 nt, Human
ccaccccacccccu

SEQ ID NO: 2221454 - RNA, 12 nt, Human
ccaccccacacu

SEQ ID NO: 2221455 - RNA, 15 nt, Human
ccaccccacacacgc

SEQ ID NO: 2221456 - RNA, 18 nt, Human
ccacggcucuaggugggg

SEQ ID NO: 2221457 - RNA, 21 nt, Human
ccacggucuguucuugaagca

SEQ ID NO: 2221458 - RNA, 17 nt, Human
ccacgguggucacugga

SEQ ID NO: 2221459 - RNA, 15 nt, Human
ccacgucccccuggg

SEQ ID NO: 2221460 - RNA, 22 nt, Human
ccacgucccccuggggcuucuc

SEQ ID NO: 2221461 - RNA, 15 nt, Human
ccacguccugucagu

SEQ ID NO: 2221462 - RNA, 19 nt, Human
ccacuacacuccagccuga

SEQ ID NO: 2221463 - RNA, 18 nt, Human
ccacuacacuccagccug

SEQ ID NO: 2221464 - RNA, 14 nt, Human
ccacuacacuccag

SEQ ID NO: 2221465 - RNA, 15 nt, Human
ccacuacaccuggcu

SEQ ID NO: 2221466 - RNA, 16 nt, Human
ccacuacaccuggcug

SEQ ID NO: 2221467 - RNA, 22 nt, Human
ccacuaagcagaggaggggccg

SEQ ID NO: 2221468 - RNA, 13 nt, Human
ccacuacaccugg

SEQ ID NO: 2221469 - RNA, 14 nt, Human
ccacuacaccuggc

SEQ ID NO: 2221470 - RNA, 21 nt, Human
ccacuaagcagaggaggggcc

SEQ ID NO: 2221471 - RNA, 19 nt, Human
ccacuaagcagaggagggg

SEQ ID NO: 2221472 - RNA, 16 nt, Human
ccacguccugucagug

SEQ ID NO: 2221473 - RNA, 18 nt, Human
ccacguccugucagugcc

SEQ ID NO: 2221474 - RNA, 17 nt, Human
ccacagggcuaagagcu

SEQ ID NO: 2221475 - RNA, 14 nt, Human
ccacagggcuaaga

SEQ ID NO: 2221476 - RNA, 20 nt, Human
ccacagggcuaagagcuagc

SEQ ID NO: 2221477 - RNA, 22 nt, Human
ccacaggguucaaaaugucugu

SEQ ID NO: 2221478 - RNA, 18 nt, Human
ccacaggguucaaaaugu

SEQ ID NO: 2221479 - RNA, 11 nt, Human
ccacagggucu

SEQ ID NO: 2221480 - RNA, 22 nt, Human
ccacagguucaugccaccaugg

SEQ ID NO: 2221481 - RNA, 23 nt, Human
ccacagguguuuauacagcucag

SEQ ID NO: 2221482 - RNA, 17 nt, Human
ccacaguagucuugaug

SEQ ID NO: 2221483 - RNA, 17 nt, Human
ccacaggugggaggagu

SEQ ID NO: 2221484 - RNA, 14 nt, Human
ccacagucaaagaa

SEQ ID NO: 2221485 - RNA, 15 nt, Human
ccacaguagucuuga

SEQ ID NO: 2221486 - RNA, 16 nt, Human
ccacaguaaguuccua

SEQ ID NO: 2221487 - RNA, 22 nt, Human
ccacaggccugagauuucaucu

SEQ ID NO: 2221488 - RNA, 14 nt, Human
ccacaggccugaga

SEQ ID NO: 2221489 - RNA, 19 nt, Human
ccacaggccugagauuuca

SEQ ID NO: 2221490 - RNA, 11 nt, Human
ccacaggccug

SEQ ID NO: 2221491 - RNA, 12 nt, Human
ccacaggccuga

SEQ ID NO: 2221492 - RNA, 13 nt, Human
ccacaggccuccc

SEQ ID NO: 2221493 - RNA, 15 nt, Human
ccacaggccucccug

SEQ ID NO: 2221494 - RNA, 16 nt, Human
ccacaggccucccugu

SEQ ID NO: 2221495 - RNA, 18 nt, Human
ccacaggccucccuguuu

SEQ ID NO: 2221496 - RNA, 16 nt, Human
ccacagggaacccugc

SEQ ID NO: 2221497 - RNA, 14 nt, Human
ccacagugcugucu

SEQ ID NO: 2221498 - RNA, 12 nt, Human
ccacagugcugu

SEQ ID NO: 2221499 - RNA, 22 nt, Human
ccacagugacucgggcuccugu

SEQ ID NO: 2221500 - RNA, 23 nt, Human
ccacagugacucgggcuccugug

SEQ ID NO: 2221501 - RNA, 16 nt, Human
ccacagucaaagaagg

SEQ ID NO: 2221502 - RNA, 21 nt, Human
ccacagugacucgggcuccug

SEQ ID NO: 2221503 - RNA, 12 nt, Human
ccacagugucug

SEQ ID NO: 2221504 - RNA, 21 nt, Human
ccacaguguuggcgagaggag

SEQ ID NO: 2221505 - RNA, 22 nt, Human
ccacaguguuggcgagaggagg

SEQ ID NO: 2221506 - RNA, 23 nt, Human
ccacaguguuggcgagaggaggg

SEQ ID NO: 2221507 - RNA, 15 nt, Human
ccacaguucaguggc

SEQ ID NO: 2221508 - RNA, 22 nt, Human
ccacaguucaguggcagggcuc

SEQ ID NO: 2221509 - RNA, 12 nt, Human
ccacaucccagg

SEQ ID NO: 2221510 - RNA, 22 nt, Human
ccacauccacacacgcaggaac

SEQ ID NO: 2221511 - RNA, 22 nt, Human
ccacaguuuccucaucugucca

SEQ ID NO: 2221512 - RNA, 20 nt, Human
ccacaguuuccucaucuguc

SEQ ID NO: 2221513 - RNA, 20 nt, Human
ccacauccuccguccagccg

SEQ ID NO: 2221514 - RNA, 19 nt, Human
ccacauccuccguccagcc

SEQ ID NO: 2221515 - RNA, 14 nt, Human
ccacaucuacguuu

SEQ ID NO: 2221516 - RNA, 23 nt, Human
ccacaucuaagccugaaggggcg

SEQ ID NO: 2221517 - RNA, 22 nt, Human
ccacaucuaagccugaaggggc

SEQ ID NO: 2221518 - RNA, 15 nt, Human
ccacaucuaagccug

SEQ ID NO: 2221519 - RNA, 13 nt, Human
ccacauccuccac

SEQ ID NO: 2221520 - RNA, 17 nt, Human
ccacaucccuuugaaac

SEQ ID NO: 2221521 - RNA, 13 nt, Human
ccacaucccaggc

SEQ ID NO: 2221522 - RNA, 15 nt, Human
ccacaucccaggcuu

SEQ ID NO: 2221523 - RNA, 18 nt, Human
ccacaucccaggcuucac

SEQ ID NO: 2221524 - RNA, 20 nt, Human
ccacaucccgggacgcagca

SEQ ID NO: 2221525 - RNA, 22 nt, Human
ccacauugggcagcgcccuucc

SEQ ID NO: 2221526 - RNA, 13 nt, Human
ccacauuuggaau

SEQ ID NO: 2221527 - RNA, 14 nt, Human
ccacauuguuuuaa

SEQ ID NO: 2221528 - RNA, 16 nt, Human
ccacauuguuuuaaaa

SEQ ID NO: 2221529 - RNA, 21 nt, Human
ccaccaacauacucccaucug

SEQ ID NO: 2221530 - RNA, 19 nt, Human
ccacauuuggaauacuuuu

SEQ ID NO: 2221531 - RNA, 16 nt, Human
ccacauuuuauauuua

SEQ ID NO: 2221532 - RNA, 22 nt, Human
ccacauuuggaauacuuuuugu

SEQ ID NO: 2221533 - RNA, 21 nt, Human
ccaccauggccagccaacuuu

SEQ ID NO: 2221534 - RNA, 17 nt, Human
ccaccauggccagccaa

SEQ ID NO: 2221535 - RNA, 16 nt, Human
ccaccauggccagcca

SEQ ID NO: 2221536 - RNA, 22 nt, Human
ccaccaugcccagcucagaggg

SEQ ID NO: 2221537 - RNA, 15 nt, Human
ccaccaacucuugca

SEQ ID NO: 2221538 - RNA, 17 nt, Human
ccaccaagacuuguuuu

SEQ ID NO: 2221539 - RNA, 17 nt, Human
ccaccaagagggacgcc

SEQ ID NO: 2221540 - RNA, 21 nt, Human
ccaccaagccuggucagccca

SEQ ID NO: 2221541 - RNA, 21 nt, Human
ccaccaagagggacgccuggg

SEQ ID NO: 2221542 - RNA, 21 nt, Human
ccaccaacccaucagaaggag

SEQ ID NO: 2221543 - RNA, 14 nt, Human
ccaccaacucuugc

SEQ ID NO: 2221544 - RNA, 12 nt, Human
ccaccaacccau

SEQ ID NO: 2221545 - RNA, 15 nt, Human
ccaccaacaucccau

SEQ ID NO: 2221546 - RNA, 15 nt, Human
ccaccaacccucaga

SEQ ID NO: 2221547 - RNA, 17 nt, Human
ccacaugcggagaacaa

SEQ ID NO: 2221548 - RNA, 19 nt, Human
ccacaucuugcucugcuga

SEQ ID NO: 2221549 - RNA, 18 nt, Human
ccacaucuugcucugcug

SEQ ID NO: 2221550 - RNA, 17 nt, Human
ccacaucuugcucugcu

SEQ ID NO: 2221551 - RNA, 16 nt, Human
ccacaugugcacaugc

SEQ ID NO: 2221552 - RNA, 16 nt, Human
ccacauuccugaugcu

SEQ ID NO: 2221553 - RNA, 15 nt, Human
ccacaugugacacau

SEQ ID NO: 2221554 - RNA, 19 nt, Human
ccacaugugacacauaugc

SEQ ID NO: 2221555 - RNA, 19 nt, Human
ccacauggggcugggcagc

SEQ ID NO: 2221556 - RNA, 20 nt, Human
ccacauggggcugggcagcu

SEQ ID NO: 2221557 - RNA, 21 nt, Human
ccacauggggcugggcagcua

SEQ ID NO: 2221558 - RNA, 14 nt, Human
ccacaugucaccgu

SEQ ID NO: 2221559 - RNA, 16 nt, Human
ccacaugggaggcuca

SEQ ID NO: 2221560 - RNA, 21 nt, Human
ccacauggcuuccuccugcgc

SEQ ID NO: 2221561 - RNA, 17 nt, Human
ccacauggcuuccuccu

SEQ ID NO: 2221562 - RNA, 13 nt, Human
ccacacagagugg

SEQ ID NO: 2221563 - RNA, 13 nt, Human
ccaauauuauaau

SEQ ID NO: 2221564 - RNA, 15 nt, Human
ccacaccaaaccucu

SEQ ID NO: 2221565 - RNA, 15 nt, Human
ccaauauguauugua

SEQ ID NO: 2221566 - RNA, 22 nt, Human
ccaauagggcugagcucucugu

SEQ ID NO: 2221567 - RNA, 15 nt, Human
ccaauauuaaaucug

SEQ ID NO: 2221568 - RNA, 16 nt, Human
ccaauauguauuguaa

SEQ ID NO: 2221569 - RNA, 22 nt, Human
ccaauauguauuguaaacaugu

SEQ ID NO: 2221570 - RNA, 12 nt, Human
ccaauauuauaa

SEQ ID NO: 2221571 - RNA, 18 nt, Human
ccaauauuaaaucugcug

SEQ ID NO: 2221572 - RNA, 20 nt, Human
ccacacagacuugggcaggg

SEQ ID NO: 2221573 - RNA, 20 nt, Human
ccacacccagcccacuucug

SEQ ID NO: 2221574 - RNA, 15 nt, Human
ccacacccagcccac

SEQ ID NO: 2221575 - RNA, 14 nt, Human
ccacaccaggccgu

SEQ ID NO: 2221576 - RNA, 13 nt, Human
ccacaccacaucu

SEQ ID NO: 2221577 - RNA, 23 nt, Human
ccacaccaagcugugccacccug

SEQ ID NO: 2221578 - RNA, 18 nt, Human
ccacaccaagcugugcca

SEQ ID NO: 2221579 - RNA, 20 nt, Human
ccacaccaagcugugccacc

SEQ ID NO: 2221580 - RNA, 14 nt, Human
ccacaccaagcagc

SEQ ID NO: 2221581 - RNA, 12 nt, Human
ccacaccaagcu

SEQ ID NO: 2221582 - RNA, 13 nt, Human
ccacaccaagcug

SEQ ID NO: 2221583 - RNA, 14 nt, Human
ccacaccaagcugu

SEQ ID NO: 2221584 - RNA, 21 nt, Human
ccacacccagcccacuucugc

SEQ ID NO: 2221585 - RNA, 22 nt, Human
ccacacccagcccacuucugcc

SEQ ID NO: 2221586 - RNA, 16 nt, Human
ccacacccucacugcu

SEQ ID NO: 2221587 - RNA, 13 nt, Human
ccacacccccacc

SEQ ID NO: 2221588 - RNA, 15 nt, Human
ccacacccccacccc

SEQ ID NO: 2221589 - RNA, 20 nt, Human
ccacacccccaccccuugcu

SEQ ID NO: 2221590 - RNA, 11 nt, Human
ccacacccucc

SEQ ID NO: 2221591 - RNA, 13 nt, Human
ccacacccagccu

SEQ ID NO: 2221592 - RNA, 14 nt, Human
ccacacccagccuc

SEQ ID NO: 2221593 - RNA, 15 nt, Human
ccacacccagccuca

SEQ ID NO: 2221594 - RNA, 16 nt, Human
ccacacccagccucag

SEQ ID NO: 2221595 - RNA, 17 nt, Human
ccacacccagccucagu

SEQ ID NO: 2221596 - RNA, 19 nt, Human
ccacacccagccucagucc

SEQ ID NO: 2221597 - RNA, 16 nt, Human
ccacacccagcucagc

SEQ ID NO: 2221598 - RNA, 23 nt, Human
ccacacuaaccuggguucccuuu

SEQ ID NO: 2221599 - RNA, 22 nt, Human
ccacacuaaccuggguucccuu

SEQ ID NO: 2221600 - RNA, 16 nt, Human
ccacacuaaccugggu

SEQ ID NO: 2221601 - RNA, 19 nt, Human
ccacacgcuccucccucug

SEQ ID NO: 2221602 - RNA, 24 nt, Human
ccacacucacuccugagaccccug

SEQ ID NO: 2221603 - RNA, 17 nt, Human
ccacacuauuaccauga

SEQ ID NO: 2221604 - RNA, 18 nt, Human
ccacacuauuaccaugag

SEQ ID NO: 2221605 - RNA, 20 nt, Human
ccacacuauuaccaugagaa

SEQ ID NO: 2221606 - RNA, 17 nt, Human
ccacacucacuccugag

SEQ ID NO: 2221607 - RNA, 18 nt, Human
ccacacccucucccagga

SEQ ID NO: 2221608 - RNA, 17 nt, Human
ccacaccuggcacugcu

SEQ ID NO: 2221609 - RNA, 19 nt, Human
ccacacccuguacuguucu

SEQ ID NO: 2221610 - RNA, 15 nt, Human
ccacacccucuccca

SEQ ID NO: 2221611 - RNA, 21 nt, Human
ccacacccucccccgccacuc

SEQ ID NO: 2221612 - RNA, 16 nt, Human
ccacacccuguacugu

SEQ ID NO: 2221613 - RNA, 18 nt, Human
ccacaccuggcacugcug

SEQ ID NO: 2221614 - RNA, 19 nt, Human
ccacaccuggcacugcugu

SEQ ID NO: 2221615 - RNA, 22 nt, Human
ccacacguaaugaaacuuggau

SEQ ID NO: 2221616 - RNA, 17 nt, Human
ccacagcuuccccucuc

SEQ ID NO: 2221617 - RNA, 16 nt, Human
ccacagcugcuggaga

SEQ ID NO: 2221618 - RNA, 12 nt, Human
ccacagcugcug

SEQ ID NO: 2221619 - RNA, 13 nt, Human
ccacagcugcugg

SEQ ID NO: 2221620 - RNA, 14 nt, Human
ccacagcugcugga

SEQ ID NO: 2221621 - RNA, 12 nt, Human
ccacacuccagc

SEQ ID NO: 2221622 - RNA, 14 nt, Human
ccacagcugcucaa

SEQ ID NO: 2221623 - RNA, 14 nt, Human
ccacacucagcaca

SEQ ID NO: 2221624 - RNA, 20 nt, Human
ccacaggaaccacaagacug

SEQ ID NO: 2221625 - RNA, 22 nt, Human
ccacagcuuuuuaccaaguuuc

SEQ ID NO: 2221626 - RNA, 19 nt, Human
ccacaggaagccugcaguc

SEQ ID NO: 2221627 - RNA, 22 nt, Human
ccacaggaagccugcaguccug

SEQ ID NO: 2221628 - RNA, 23 nt, Human
ccacaggcccuuccucuccacug

SEQ ID NO: 2221629 - RNA, 19 nt, Human
ccacaggcccuuuccucag

SEQ ID NO: 2221630 - RNA, 16 nt, Human
ccacaggcccacagua

SEQ ID NO: 2221631 - RNA, 17 nt, Human
ccacaggccgcccugcg

SEQ ID NO: 2221632 - RNA, 23 nt, Human
ccacaggcccuuuccucaggcaa

SEQ ID NO: 2221633 - RNA, 12 nt, Human
ccacaggccucc

SEQ ID NO: 2221634 - RNA, 16 nt, Human
ccacaggccgcccugc

SEQ ID NO: 2221635 - RNA, 21 nt, Human
ccacaggcccuuuccucaggc

SEQ ID NO: 2221636 - RNA, 22 nt, Human
ccacaggcccuuuccucaggca

SEQ ID NO: 2221637 - RNA, 17 nt, Human
ccacaggcccuuccucu

SEQ ID NO: 2221638 - RNA, 18 nt, Human
ccacaggcccuuccucuc

SEQ ID NO: 2221639 - RNA, 19 nt, Human
ccacaggcccuuccucucc

SEQ ID NO: 2221640 - RNA, 22 nt, Human
ccacaggcccuuccucuccacu

SEQ ID NO: 2221641 - RNA, 15 nt, Human
ccacaggcccuuccu

SEQ ID NO: 2221642 - RNA, 16 nt, Human
ccacaggcccuuccuc

SEQ ID NO: 2221643 - RNA, 14 nt, Human
ccacaggcagcuuu

SEQ ID NO: 2221644 - RNA, 12 nt, Human
ccacaggcagcu

SEQ ID NO: 2221645 - RNA, 13 nt, Human
ccacaggcagcuu

SEQ ID NO: 2221646 - RNA, 17 nt, Human
ccacaggacacagucag

SEQ ID NO: 2221647 - RNA, 20 nt, Human
ccacaggagugggaaaacac

SEQ ID NO: 2221648 - RNA, 16 nt, Human
ccacaggaucagucug

SEQ ID NO: 2221649 - RNA, 16 nt, Human
ccacaggacacaguca

SEQ ID NO: 2221650 - RNA, 17 nt, Human
ccacaggaagugaagaa

SEQ ID NO: 2221651 - RNA, 23 nt, Human
ccacaggaagccugcaguccugg

SEQ ID NO: 2221652 - RNA, 21 nt, Human
ccacaggacauuucucuaaga

SEQ ID NO: 2221653 - RNA, 16 nt, Human
ccacaggacauuucuc

SEQ ID NO: 2221654 - RNA, 16 nt, Human
ccaauauucauagcag

SEQ ID NO: 2221655 - RNA, 18 nt, Human
ccacccaggagggagggg

SEQ ID NO: 2221656 - RNA, 17 nt, Human
ccacccaggagggaggg

SEQ ID NO: 2221657 - RNA, 23 nt, Human
ccacccaggagggagggggcuau

SEQ ID NO: 2221658 - RNA, 21 nt, Human
ccacccauccuaccaaugcau

SEQ ID NO: 2221659 - RNA, 12 nt, Human
ccaccccaacau

SEQ ID NO: 2221660 - RNA, 14 nt, Human
ccacccaucgcugu

SEQ ID NO: 2221661 - RNA, 17 nt, Human
ccacccaucgcugugug

SEQ ID NO: 2221662 - RNA, 23 nt, Human
ccacccaggagccccgaggccuu

SEQ ID NO: 2221663 - RNA, 14 nt, Human
ccacccaggaggga

SEQ ID NO: 2221664 - RNA, 15 nt, Human
ccacccaagcuuggc

SEQ ID NO: 2221665 - RNA, 16 nt, Human
ccacccaagcuuggca

SEQ ID NO: 2221666 - RNA, 12 nt, Human
ccacccaggagg

SEQ ID NO: 2221667 - RNA, 14 nt, Human
ccacccaagcuugg

SEQ ID NO: 2221668 - RNA, 21 nt, Human
ccacccaggagccccgaggcc

SEQ ID NO: 2221669 - RNA, 17 nt, Human
ccaccaugucugcccca

SEQ ID NO: 2221670 - RNA, 14 nt, Human
ccaccauuccugga

SEQ ID NO: 2221671 - RNA, 14 nt, Human
ccaccaugucugcc

SEQ ID NO: 2221672 - RNA, 17 nt, Human
ccaccaugcccagucga

SEQ ID NO: 2221673 - RNA, 19 nt, Human
ccaccaugggguccuacca

SEQ ID NO: 2221674 - RNA, 21 nt, Human
ccaccauuccuggaaaccaca

SEQ ID NO: 2221675 - RNA, 15 nt, Human
ccaccauuccuggaa

SEQ ID NO: 2221676 - RNA, 16 nt, Human
ccaccauuccuggaaa

SEQ ID NO: 2221677 - RNA, 17 nt, Human
ccacccccacccaaggg

SEQ ID NO: 2221678 - RNA, 16 nt, Human
ccaagccagaggcugg

SEQ ID NO: 2221679 - RNA, 17 nt, Human
ccaagccagaggcuggg

SEQ ID NO: 2221680 - RNA, 19 nt, Human
ccaagccagaggcuggguu

SEQ ID NO: 2221681 - RNA, 18 nt, Human
ccaagccaagggaaccug

SEQ ID NO: 2221682 - RNA, 20 nt, Human
ccaagccaagggaaccugug

SEQ ID NO: 2221683 - RNA, 22 nt, Human
ccaagccaagggaaccuguguc

SEQ ID NO: 2221684 - RNA, 23 nt, Human
ccaagccaagggaaccugugucc

SEQ ID NO: 2221685 - RNA, 17 nt, Human
ccaagcccgacuugcug

SEQ ID NO: 2221686 - RNA, 18 nt, Human
ccaagcccgacuugcugu

SEQ ID NO: 2221687 - RNA, 22 nt, Human
ccaagcccgacuugcuguuuug

SEQ ID NO: 2221688 - RNA, 23 nt, Human
ccaagcccuggagccaacugcug

SEQ ID NO: 2221689 - RNA, 13 nt, Human
ccaagccguggcu

SEQ ID NO: 2221690 - RNA, 22 nt, Human
ccaagccuacuuuugccauuga

SEQ ID NO: 2221691 - RNA, 20 nt, Human
ccaagcgaggucaacagaga

SEQ ID NO: 2221692 - RNA, 22 nt, Human
ccaagccuuggggauucuucca

SEQ ID NO: 2221693 - RNA, 19 nt, Human
ccaagccuuggcucuaccc

SEQ ID NO: 2221694 - RNA, 20 nt, Human
ccaagccuggucagcccaaa

SEQ ID NO: 2221695 - RNA, 19 nt, Human
ccaagccuggucagcccaa

SEQ ID NO: 2221696 - RNA, 13 nt, Human
ccaagccugacca

SEQ ID NO: 2221697 - RNA, 14 nt, Human
ccaagccugcaacu

SEQ ID NO: 2221698 - RNA, 15 nt, Human
ccaagccuggcaagg

SEQ ID NO: 2221699 - RNA, 18 nt, Human
ccaagcucacaguuccuc

SEQ ID NO: 2221700 - RNA, 17 nt, Human
ccaagcucacaguuccu

SEQ ID NO: 2221701 - RNA, 13 nt, Human
ccaagcucacagu

SEQ ID NO: 2221702 - RNA, 18 nt, Human
ccaagcucaaagcgugga

SEQ ID NO: 2221703 - RNA, 16 nt, Human
ccaagcuauccuggcu

SEQ ID NO: 2221704 - RNA, 22 nt, Human
ccaagcuagaauucccucucuc

SEQ ID NO: 2221705 - RNA, 17 nt, Human
ccaagcucaaagcgugg

SEQ ID NO: 2221706 - RNA, 14 nt, Human
ccaagcucccaggc

SEQ ID NO: 2221707 - RNA, 21 nt, Human
ccaagcgaggucaacagagaa

SEQ ID NO: 2221708 - RNA, 15 nt, Human
ccaagcuagaauucc

SEQ ID NO: 2221709 - RNA, 17 nt, Human
ccaagcuagaauucccu

SEQ ID NO: 2221710 - RNA, 15 nt, Human
ccaagcucccaggca

SEQ ID NO: 2221711 - RNA, 16 nt, Human
ccaagcucccaggcau

SEQ ID NO: 2221712 - RNA, 22 nt, Human
ccaagcucccaggcauucccca

SEQ ID NO: 2221713 - RNA, 17 nt, Human
ccaaggccaaaggaagc

SEQ ID NO: 2221714 - RNA, 22 nt, Human
ccaagcauaccaacacgagcag

SEQ ID NO: 2221715 - RNA, 17 nt, Human
ccaagcauuuagaugua

SEQ ID NO: 2221716 - RNA, 13 nt, Human
ccaagcaucuugg

SEQ ID NO: 2221717 - RNA, 22 nt, Human
ccaagcaucuuggggggguggc

SEQ ID NO: 2221718 - RNA, 23 nt, Human
ccaagcaucuuggggggguggcc

SEQ ID NO: 2221719 - RNA, 23 nt, Human
ccaagcauuuaauguagccaugg

SEQ ID NO: 2221720 - RNA, 18 nt, Human
ccaaggccagaguggccu

SEQ ID NO: 2221721 - RNA, 15 nt, Human
ccaaggccagagugg

SEQ ID NO: 2221722 - RNA, 22 nt, Human
ccaagcucacaguuccucgccc

SEQ ID NO: 2221723 - RNA, 19 nt, Human
ccaagcucacaguuccucg

SEQ ID NO: 2221724 - RNA, 12 nt, Human
ccaagcucagaa

SEQ ID NO: 2221725 - RNA, 19 nt, Human
ccaaggccagaguggccug

SEQ ID NO: 2221726 - RNA, 21 nt, Human
ccaagggaaagaaaaggaagg

SEQ ID NO: 2221727 - RNA, 14 nt, Human
ccaagcucagaagg

SEQ ID NO: 2221728 - RNA, 17 nt, Human
ccaagggaaaggggugc

SEQ ID NO: 2221729 - RNA, 21 nt, Human
ccaagggaaaggggugcuuuu

SEQ ID NO: 2221730 - RNA, 22 nt, Human
ccaagggaaaggggugcuuuua

SEQ ID NO: 2221731 - RNA, 18 nt, Human
ccaaggccaaaggaagca

SEQ ID NO: 2221732 - RNA, 21 nt, Human
ccaaggccaaaggaagcacau

SEQ ID NO: 2221733 - RNA, 24 nt, Human
ccaagggaguuaggcuauucacaa

SEQ ID NO: 2221734 - RNA, 21 nt, Human
ccaagggaucugguccuaccc

SEQ ID NO: 2221735 - RNA, 19 nt, Human
ccaagggaugaaagagaag

SEQ ID NO: 2221736 - RNA, 13 nt, Human
ccaagggaucugg

SEQ ID NO: 2221737 - RNA, 16 nt, Human
ccaagggaaccugugu

SEQ ID NO: 2221738 - RNA, 17 nt, Human
ccaagggaaccuguguc

SEQ ID NO: 2221739 - RNA, 18 nt, Human
ccaagggaaccugugucc

SEQ ID NO: 2221740 - RNA, 19 nt, Human
ccaagggaaccuguguccg

SEQ ID NO: 2221741 - RNA, 15 nt, Human
ccaagggccuggccu

SEQ ID NO: 2221742 - RNA, 24 nt, Human
ccaagggcaaaauucccagggaag

SEQ ID NO: 2221743 - RNA, 18 nt, Human
ccaagggcaaaauuccca

SEQ ID NO: 2221744 - RNA, 20 nt, Human
ccaagggaugaaagagaagg

SEQ ID NO: 2221745 - RNA, 22 nt, Human
ccaagggcaaaauucccaggga

SEQ ID NO: 2221746 - RNA, 16 nt, Human
ccaaggggcagucugg

SEQ ID NO: 2221747 - RNA, 15 nt, Human
ccaaggggcagucug

SEQ ID NO: 2221748 - RNA, 19 nt, Human
ccaaggggaaucagaacuc

SEQ ID NO: 2221749 - RNA, 21 nt, Human
ccaagggcuuuguuuugcaca

SEQ ID NO: 2221750 - RNA, 22 nt, Human
ccaaggggaauguuugccucug

SEQ ID NO: 2221751 - RNA, 20 nt, Human
ccaaggggcagucuggaggg

SEQ ID NO: 2221752 - RNA, 23 nt, Human
ccaaggguucagagacucagggc

SEQ ID NO: 2221753 - RNA, 20 nt, Human
ccaaggguucagagacucag

SEQ ID NO: 2221754 - RNA, 19 nt, Human
ccaagggccuggccugagc

SEQ ID NO: 2221755 - RNA, 14 nt, Human
ccaagggcuucugc

SEQ ID NO: 2221756 - RNA, 17 nt, Human
ccaagggcuucugcacc

SEQ ID NO: 2221757 - RNA, 19 nt, Human
ccaagggcuucugcacccu

SEQ ID NO: 2221758 - RNA, 20 nt, Human
ccaagggcuucugcacccuc

SEQ ID NO: 2221759 - RNA, 21 nt, Human
ccaagggcuucugcacccucc

SEQ ID NO: 2221760 - RNA, 22 nt, Human
ccaagggcuucugcacccucca

SEQ ID NO: 2221761 - RNA, 23 nt, Human
ccaagggcuucugcacccuccac

SEQ ID NO: 2221762 - RNA, 16 nt, Human
ccaagggccuggccug

SEQ ID NO: 2221763 - RNA, 18 nt, Human
ccaagggccuggccugag

SEQ ID NO: 2221764 - RNA, 13 nt, Human
ccaaggugggagg

SEQ ID NO: 2221765 - RNA, 18 nt, Human
ccaaggugggaggauugc

SEQ ID NO: 2221766 - RNA, 18 nt, Human
ccaaggggugggccacag

SEQ ID NO: 2221767 - RNA, 17 nt, Human
ccaaggucuucagccau

SEQ ID NO: 2221768 - RNA, 23 nt, Human
ccaagguuuggggaagaacgaag

SEQ ID NO: 2221769 - RNA, 19 nt, Human
ccaagguuuuauaaggcug

SEQ ID NO: 2221770 - RNA, 19 nt, Human
ccaaggucuucagccauca

SEQ ID NO: 2221771 - RNA, 15 nt, Human
ccaagguggcacggu

SEQ ID NO: 2221772 - RNA, 20 nt, Human
ccaagguuuuauaaggcuga

SEQ ID NO: 2221773 - RNA, 21 nt, Human
ccaagguuuuauaaggcugau

SEQ ID NO: 2221774 - RNA, 16 nt, Human
ccaagguggcacggug

SEQ ID NO: 2221775 - RNA, 20 nt, Human
ccaaguagcugggauuacag

SEQ ID NO: 2221776 - RNA, 21 nt, Human
ccaagucagcuuugccuucca

SEQ ID NO: 2221777 - RNA, 14 nt, Human
ccaaguccaaaugu

SEQ ID NO: 2221778 - RNA, 23 nt, Human
ccaaguccaaauguuuacaggga

SEQ ID NO: 2221779 - RNA, 13 nt, Human
ccaaguccagauu

SEQ ID NO: 2221780 - RNA, 20 nt, Human
ccaagucagcuuugccuucc

SEQ ID NO: 2221781 - RNA, 14 nt, Human
ccaaguauuuauua

SEQ ID NO: 2221782 - RNA, 20 nt, Human
ccaagucaagugaaaaagga

SEQ ID NO: 2221783 - RNA, 18 nt, Human
ccaauagggcugagcucu

SEQ ID NO: 2221784 - RNA, 22 nt, Human
ccaauaguuguugauuggcagg

SEQ ID NO: 2221785 - RNA, 18 nt, Human
ccaauagauuccccauug

SEQ ID NO: 2221786 - RNA, 14 nt, Human
ccaauaacacacag

SEQ ID NO: 2221787 - RNA, 22 nt, Human
ccaauaaaugugaaauucuguc

SEQ ID NO: 2221788 - RNA, 14 nt, Human
ccaauaaaccaggu

SEQ ID NO: 2221789 - RNA, 16 nt, Human
ccaauaacacacagcu

SEQ ID NO: 2221790 - RNA, 13 nt, Human
ccaauaaaccagg

SEQ ID NO: 2221791 - RNA, 13 nt, Human
ccaauaaacagga

SEQ ID NO: 2221792 - RNA, 22 nt, Human
ccaauaaaagcaauuccaaccu

SEQ ID NO: 2221793 - RNA, 23 nt, Human
ccaauaaaagcaauuccaaccuu

SEQ ID NO: 2221794 - RNA, 14 nt, Human
ccaaguuuauauac

SEQ ID NO: 2221795 - RNA, 21 nt, Human
ccaaguuuacucaacccucuc

SEQ ID NO: 2221796 - RNA, 19 nt, Human
ccaaguuccgucaguccaa

SEQ ID NO: 2221797 - RNA, 15 nt, Human
ccaaguucucaccuc

SEQ ID NO: 2221798 - RNA, 14 nt, Human
ccaagucuacagag

SEQ ID NO: 2221799 - RNA, 17 nt, Human
ccaagucuacagaguga

SEQ ID NO: 2221800 - RNA, 14 nt, Human
ccaagucucagugg

SEQ ID NO: 2221801 - RNA, 22 nt, Human
ccaaguuauaaaucaaugucac

SEQ ID NO: 2221802 - RNA, 18 nt, Human
ccaaguuguggugcugac

SEQ ID NO: 2221803 - RNA, 22 nt, Human
ccaaguuguggugcugacaaag

SEQ ID NO: 2221804 - RNA, 17 nt, Human
ccaaguuuacucaaccc

SEQ ID NO: 2221805 - RNA, 22 nt, Human
ccaaguugauuuaguguuuuua

SEQ ID NO: 2221806 - RNA, 12 nt, Human
ccaagucccugu

SEQ ID NO: 2221807 - RNA, 13 nt, Human
ccaagucccuguu

SEQ ID NO: 2221808 - RNA, 15 nt, Human
ccaagucccuguuuu

SEQ ID NO: 2221809 - RNA, 15 nt, Human
ccaaguccugaagag

SEQ ID NO: 2221810 - RNA, 22 nt, Human
ccaagucccuguuuucugagcc

SEQ ID NO: 2221811 - RNA, 23 nt, Human
ccaagucccuguuuucugagccc

SEQ ID NO: 2221812 - RNA, 16 nt, Human
ccaaguccugaagagg

SEQ ID NO: 2221813 - RNA, 19 nt, Human
ccaaguccugaagaggcgg

SEQ ID NO: 2221814 - RNA, 20 nt, Human
ccaaguccugaagaggcggg

SEQ ID NO: 2221815 - RNA, 12 nt, Human
ccaagcacagca

SEQ ID NO: 2221816 - RNA, 17 nt, Human
ccaagcaaccugggucc

SEQ ID NO: 2221817 - RNA, 20 nt, Human
ccaagcaaaggugaagagac

SEQ ID NO: 2221818 - RNA, 18 nt, Human
ccaagcaaccugggucca

SEQ ID NO: 2221819 - RNA, 23 nt, Human
ccaagcaaccuggguccaaauaa

SEQ ID NO: 2221820 - RNA, 14 nt, Human
ccaagcaaguauua

SEQ ID NO: 2221821 - RNA, 21 nt, Human
ccaagauugcgccauugcacu

SEQ ID NO: 2221822 - RNA, 17 nt, Human
ccaagcaaaaucaugga

SEQ ID NO: 2221823 - RNA, 21 nt, Human
ccaagauucacaccugacucu

SEQ ID NO: 2221824 - RNA, 18 nt, Human
ccaagcacagcagccugg

SEQ ID NO: 2221825 - RNA, 16 nt, Human
ccaagcacaguggugg

SEQ ID NO: 2221826 - RNA, 19 nt, Human
ccaagcacagugguggcag

SEQ ID NO: 2221827 - RNA, 20 nt, Human
ccaagcacagugguggcagg

SEQ ID NO: 2221828 - RNA, 21 nt, Human
ccaagcacagugguggcaggg

SEQ ID NO: 2221829 - RNA, 22 nt, Human
ccaagcacagugguggcagggc

SEQ ID NO: 2221830 - RNA, 23 nt, Human
ccaagcacagugguggcagggcc

SEQ ID NO: 2221831 - RNA, 17 nt, Human
ccaagcacagcagccug

SEQ ID NO: 2221832 - RNA, 15 nt, Human
ccaagcacagcagcc

SEQ ID NO: 2221833 - RNA, 14 nt, Human
ccaagcacagcagc

SEQ ID NO: 2221834 - RNA, 13 nt, Human
ccaagcacagcag

SEQ ID NO: 2221835 - RNA, 14 nt, Human
ccaagcacugugcu

SEQ ID NO: 2221836 - RNA, 21 nt, Human
ccaagcacugugcucagggcu

SEQ ID NO: 2221837 - RNA, 22 nt, Human
ccaagcacugugcucagggcua

SEQ ID NO: 2221838 - RNA, 14 nt, Human
ccaacacucaagaa

SEQ ID NO: 2221839 - RNA, 17 nt, Human
ccaacacgcaccugccu

SEQ ID NO: 2221840 - RNA, 21 nt, Human
ccaacacucaagaagcaggcu

SEQ ID NO: 2221841 - RNA, 21 nt, Human
ccaacacgcaccugccucagg

SEQ ID NO: 2221842 - RNA, 20 nt, Human
ccaacacgcaccugccucag

SEQ ID NO: 2221843 - RNA, 18 nt, Human
ccaacaccacagacacac

SEQ ID NO: 2221844 - RNA, 21 nt, Human
ccaacaccacagacacacaca

SEQ ID NO: 2221845 - RNA, 23 nt, Human
ccaacaccacagacacacacacg

SEQ ID NO: 2221846 - RNA, 13 nt, Human
ccaacaccagccc

SEQ ID NO: 2221847 - RNA, 14 nt, Human
ccaacacugugccc

SEQ ID NO: 2221848 - RNA, 15 nt, Human
ccaacacugugcccu

SEQ ID NO: 2221849 - RNA, 16 nt, Human
ccaacacugugcccug

SEQ ID NO: 2221850 - RNA, 17 nt, Human
ccaacacugugcccugg

SEQ ID NO: 2221851 - RNA, 22 nt, Human
ccaacaauccuagugcuuuccu

SEQ ID NO: 2221852 - RNA, 22 nt, Human
ccaacaaaggguuuuaauguag

SEQ ID NO: 2221853 - RNA, 14 nt, Human
ccaacaaagcuguu

SEQ ID NO: 2221854 - RNA, 21 nt, Human
ccaacaaaggguuuuaaugua

SEQ ID NO: 2221855 - RNA, 23 nt, Human
ccaacaccaagcacagcagccug

SEQ ID NO: 2221856 - RNA, 22 nt, Human
ccaacaccaagcacagcagccu

SEQ ID NO: 2221857 - RNA, 14 nt, Human
ccaacaccacagac

SEQ ID NO: 2221858 - RNA, 15 nt, Human
ccaacaccacagaca

SEQ ID NO: 2221859 - RNA, 16 nt, Human
ccaacaccacagacac

SEQ ID NO: 2221860 - RNA, 17 nt, Human
ccaacaccacagacaca

SEQ ID NO: 2221861 - RNA, 19 nt, Human
ccaacaccaagcacagcag

SEQ ID NO: 2221862 - RNA, 17 nt, Human
ccaacaccaagcacagc

SEQ ID NO: 2221863 - RNA, 16 nt, Human
ccaacaccaagcacag

SEQ ID NO: 2221864 - RNA, 13 nt, Human
ccaacaccaagca

SEQ ID NO: 2221865 - RNA, 17 nt, Human
ccaaauuuucuuuuuau

SEQ ID NO: 2221866 - RNA, 15 nt, Human
ccaaauuugauugau

SEQ ID NO: 2221867 - RNA, 22 nt, Human
ccaaaggugaaggaauauaugg

SEQ ID NO: 2221868 - RNA, 21 nt, Human
ccaaauuuuggccaaaguguu

SEQ ID NO: 2221869 - RNA, 20 nt, Human
ccaaauuugauugauuugaa

SEQ ID NO: 2221870 - RNA, 19 nt, Human
ccaacaaagaacacuaacu

SEQ ID NO: 2221871 - RNA, 12 nt, Human
ccaacaaagcug

SEQ ID NO: 2221872 - RNA, 13 nt, Human
ccaacaaagcugu

SEQ ID NO: 2221873 - RNA, 20 nt, Human
ccaaaguacacuguuucaaa

SEQ ID NO: 2221874 - RNA, 23 nt, Human
ccaaauuucauaccuaucaucuu

SEQ ID NO: 2221875 - RNA, 23 nt, Human
ccaaagggugaagcuauuuaucu

SEQ ID NO: 2221876 - RNA, 15 nt, Human
ccaaaggugaaggaa

SEQ ID NO: 2221877 - RNA, 20 nt, Human
ccaaaggugaaggaauauau

SEQ ID NO: 2221878 - RNA, 21 nt, Human
ccaaagggugaagcuauuuau

SEQ ID NO: 2221879 - RNA, 14 nt, Human
ccaaaggcccccua

SEQ ID NO: 2221880 - RNA, 21 nt, Human
ccaaaggccauggagagcugg

SEQ ID NO: 2221881 - RNA, 12 nt, Human
ccaaaggccccc

SEQ ID NO: 2221882 - RNA, 18 nt, Human
ccaaaguacacuguuuca

SEQ ID NO: 2221883 - RNA, 15 nt, Human
ccaaaguacacuguu

SEQ ID NO: 2221884 - RNA, 23 nt, Human
ccaacaggagcugggauccuaag

SEQ ID NO: 2221885 - RNA, 15 nt, Human
ccaacaggagcuggg

SEQ ID NO: 2221886 - RNA, 15 nt, Human
ccaacaggaggacaa

SEQ ID NO: 2221887 - RNA, 16 nt, Human
ccaacaggaggacaau

SEQ ID NO: 2221888 - RNA, 17 nt, Human
ccaacaggaggacaauu

SEQ ID NO: 2221889 - RNA, 18 nt, Human
ccaacaggaggacaauuc

SEQ ID NO: 2221890 - RNA, 16 nt, Human
ccaacauacucccauc

SEQ ID NO: 2221891 - RNA, 17 nt, Human
ccaacagaugcuuuucu

SEQ ID NO: 2221892 - RNA, 22 nt, Human
ccaacagaugcuuuucugucuc

SEQ ID NO: 2221893 - RNA, 19 nt, Human
ccaacagaagaacuguguu

SEQ ID NO: 2221894 - RNA, 18 nt, Human
ccaacacugugcccuggu

SEQ ID NO: 2221895 - RNA, 19 nt, Human
ccaacacugugcccuggug

SEQ ID NO: 2221896 - RNA, 22 nt, Human
ccaacagcgacauagcccaucc

SEQ ID NO: 2221897 - RNA, 23 nt, Human
ccaacagcgacauagcccauccc

SEQ ID NO: 2221898 - RNA, 17 nt, Human
ccaacauacucccaucu

SEQ ID NO: 2221899 - RNA, 18 nt, Human
ccaacauacucccaucug

SEQ ID NO: 2221900 - RNA, 19 nt, Human
ccaacauacucccaucugu

SEQ ID NO: 2221901 - RNA, 20 nt, Human
ccaacauacucccaucugug

SEQ ID NO: 2221902 - RNA, 13 nt, Human
ccaacaucaacau

SEQ ID NO: 2221903 - RNA, 19 nt, Human
ccaacaggaggacaauuca

SEQ ID NO: 2221904 - RNA, 20 nt, Human
ccaacaggaggacaauucau

SEQ ID NO: 2221905 - RNA, 20 nt, Human
ccaaccaaguggcucccaca

SEQ ID NO: 2221906 - RNA, 20 nt, Human
ccaacauugccuauuucagu

SEQ ID NO: 2221907 - RNA, 14 nt, Human
ccaacagguggcag

SEQ ID NO: 2221908 - RNA, 15 nt, Human
ccaacagguggcagg

SEQ ID NO: 2221909 - RNA, 21 nt, Human
ccaacauacucccaucuguga

SEQ ID NO: 2221910 - RNA, 22 nt, Human
ccaacauacucccaucugugaa

SEQ ID NO: 2221911 - RNA, 20 nt, Human
ccaacccccaccccacacuu

SEQ ID NO: 2221912 - RNA, 19 nt, Human
ccaacccccaccccacacu

SEQ ID NO: 2221913 - RNA, 13 nt, Human
ccaacccccagca

SEQ ID NO: 2221914 - RNA, 14 nt, Human
ccaacccccagcac

SEQ ID NO: 2221915 - RNA, 15 nt, Human
ccaacccccagcacc

SEQ ID NO: 2221916 - RNA, 21 nt, Human
ccaacccccagcacccgggcu

SEQ ID NO: 2221917 - RNA, 18 nt, Human
ccaacccccaccccacac

SEQ ID NO: 2221918 - RNA, 17 nt, Human
ccaacccccaccccaca

SEQ ID NO: 2221919 - RNA, 16 nt, Human
ccaacccccaccccac

SEQ ID NO: 2221920 - RNA, 13 nt, Human
ccaacccccaccc

SEQ ID NO: 2221921 - RNA, 14 nt, Human
ccaacccaucagaa

SEQ ID NO: 2221922 - RNA, 12 nt, Human
ccaacccaucag

SEQ ID NO: 2221923 - RNA, 14 nt, Human
ccaaccccaacucc

SEQ ID NO: 2221924 - RNA, 13 nt, Human
ccaaccccagccg

SEQ ID NO: 2221925 - RNA, 13 nt, Human
ccaacccagccgc

SEQ ID NO: 2221926 - RNA, 16 nt, Human
ccaacccagccgcugc

SEQ ID NO: 2221927 - RNA, 19 nt, Human
ccaacccagccgcugcccg

SEQ ID NO: 2221928 - RNA, 21 nt, Human
ccaacccagccgcugcccggc

SEQ ID NO: 2221929 - RNA, 12 nt, Human
ccaacccagccg

SEQ ID NO: 2221930 - RNA, 18 nt, Human
ccaaaggaggcuggcagg

SEQ ID NO: 2221931 - RNA, 17 nt, Human
ccaaaggaggcuggcag

SEQ ID NO: 2221932 - RNA, 16 nt, Human
ccaaaggaggcuggca

SEQ ID NO: 2221933 - RNA, 15 nt, Human
ccaaaggaggcuggc

SEQ ID NO: 2221934 - RNA, 12 nt, Human
ccaaaggaggcu

SEQ ID NO: 2221935 - RNA, 17 nt, Human
ccaaaggacuccaccca

SEQ ID NO: 2221936 - RNA, 16 nt, Human
ccaaaggcucucuccu

SEQ ID NO: 2221937 - RNA, 16 nt, Human
ccaaaggaugugauau

SEQ ID NO: 2221938 - RNA, 19 nt, Human
ccaaaggaugugauauaua

SEQ ID NO: 2221939 - RNA, 21 nt, Human
ccaaaggacuccacccauccu

SEQ ID NO: 2221940 - RNA, 22 nt, Human
ccaaaggcauuuuauugcuuga

SEQ ID NO: 2221941 - RNA, 19 nt, Human
ccaaaggccauggagagcu

SEQ ID NO: 2221942 - RNA, 20 nt, Human
ccaaaggccauggagagcug

SEQ ID NO: 2221943 - RNA, 21 nt, Human
ccaaagcuguuggucuguccc

SEQ ID NO: 2221944 - RNA, 12 nt, Human
ccaaaggaaaaa

SEQ ID NO: 2221945 - RNA, 17 nt, Human
ccaaaggaaaaagcaca

SEQ ID NO: 2221946 - RNA, 22 nt, Human
ccaaaggaaaaagcacaagaag

SEQ ID NO: 2221947 - RNA, 18 nt, Human
ccaaaggaagucuaggag

SEQ ID NO: 2221948 - RNA, 23 nt, Human
ccaaaggaaaaagcacaagaagc

SEQ ID NO: 2221949 - RNA, 23 nt, Human
ccaaaggaagcacaugccucucu

SEQ ID NO: 2221950 - RNA, 15 nt, Human
ccaaaggaagcacau

SEQ ID NO: 2221951 - RNA, 16 nt, Human
ccaaagcuuuccugcc

SEQ ID NO: 2221952 - RNA, 17 nt, Human
ccaaagcuuuccugccc

SEQ ID NO: 2221953 - RNA, 19 nt, Human
ccaaagcuuuccugcccca

SEQ ID NO: 2221954 - RNA, 20 nt, Human
ccaaagcuuuccugccccag

SEQ ID NO: 2221955 - RNA, 15 nt, Human
ccaaagccagacagc

SEQ ID NO: 2221956 - RNA, 23 nt, Human
ccaaagcuaggguggcccuugca

SEQ ID NO: 2221957 - RNA, 16 nt, Human
ccaaagcuuucaugua

SEQ ID NO: 2221958 - RNA, 13 nt, Human
ccaaagcuuuccu

SEQ ID NO: 2221959 - RNA, 14 nt, Human
ccaaagcuuuccug

SEQ ID NO: 2221960 - RNA, 15 nt, Human
ccaaagcuuuccugc

SEQ ID NO: 2221961 - RNA, 19 nt, Human
ccaaagcuaggguggcccu

SEQ ID NO: 2221962 - RNA, 18 nt, Human
ccaaagcuaggguggccc

SEQ ID NO: 2221963 - RNA, 21 nt, Human
ccaaagcuaggccuggccaga

SEQ ID NO: 2221964 - RNA, 16 nt, Human
ccaaagcuaggccugg

SEQ ID NO: 2221965 - RNA, 17 nt, Human
ccaaagcuaggccuggc

SEQ ID NO: 2221966 - RNA, 23 nt, Human
ccaaagccccuugcucuccccug

SEQ ID NO: 2221967 - RNA, 15 nt, Human
ccaaagccagaacca

SEQ ID NO: 2221968 - RNA, 17 nt, Human
ccaaagcgaauuuuaaa

SEQ ID NO: 2221969 - RNA, 15 nt, Human
ccaaagcuaggccug

SEQ ID NO: 2221970 - RNA, 12 nt, Human
ccaaacugccua

SEQ ID NO: 2221971 - RNA, 13 nt, Human
ccaaacucugcca

SEQ ID NO: 2221972 - RNA, 13 nt, Human
ccaaacagugaca

SEQ ID NO: 2221973 - RNA, 20 nt, Human
ccaaacucaccugccccuca

SEQ ID NO: 2221974 - RNA, 22 nt, Human
ccaaagccaccagacugacaaa

SEQ ID NO: 2221975 - RNA, 13 nt, Human
ccaaagccaccag

SEQ ID NO: 2221976 - RNA, 14 nt, Human
ccaaagccaaugug

SEQ ID NO: 2221977 - RNA, 20 nt, Human
ccaaagccaauaacacacag

SEQ ID NO: 2221978 - RNA, 21 nt, Human
ccaaagccaauaacacacagc

SEQ ID NO: 2221979 - RNA, 22 nt, Human
ccaaagccuccuccagccgcca

SEQ ID NO: 2221980 - RNA, 17 nt, Human
ccaaagccuccuccagc

SEQ ID NO: 2221981 - RNA, 19 nt, Human
ccaaagccaaagcuaggcc

SEQ ID NO: 2221982 - RNA, 23 nt, Human
ccaaagcagugcaugcugucccu

SEQ ID NO: 2221983 - RNA, 19 nt, Human
ccaaagcagugcaugcugu

SEQ ID NO: 2221984 - RNA, 22 nt, Human
ccaaacugacucuuaagaagac

SEQ ID NO: 2221985 - RNA, 15 nt, Human
ccaagagagaaagaa

SEQ ID NO: 2221986 - RNA, 16 nt, Human
ccaagaggcugcagcc

SEQ ID NO: 2221987 - RNA, 21 nt, Human
ccaagaggcuguucccaccag

SEQ ID NO: 2221988 - RNA, 19 nt, Human
ccaagaggguccuuuagua

SEQ ID NO: 2221989 - RNA, 16 nt, Human
ccaagagucugaugau

SEQ ID NO: 2221990 - RNA, 16 nt, Human
ccaagaucgcgccacu

SEQ ID NO: 2221991 - RNA, 14 nt, Human
ccaagagagaaaga

SEQ ID NO: 2221992 - RNA, 13 nt, Human
ccaagagagaaag

SEQ ID NO: 2221993 - RNA, 12 nt, Human
ccaagagagaaa

SEQ ID NO: 2221994 - RNA, 24 nt, Human
ccaagagacuccuugagagaccag

SEQ ID NO: 2221995 - RNA, 20 nt, Human
ccaagagacaugcugacuuu

SEQ ID NO: 2221996 - RNA, 22 nt, Human
ccaagacuugguguccuuuccc

SEQ ID NO: 2221997 - RNA, 15 nt, Human
ccaagaggcugcagc

SEQ ID NO: 2221998 - RNA, 14 nt, Human
ccaagaggcugcag

SEQ ID NO: 2221999 - RNA, 19 nt, Human
ccaagacuugguguccuuu

SEQ ID NO: 2222000 - RNA, 22 nt, Human
ccaagacuuggcaacagaagca

SEQ ID NO: 2222001 - RNA, 18 nt, Human
ccaagacuuggcaacaga

SEQ ID NO: 2222002 - RNA, 20 nt, Human
ccaagacuuggcaacagaag

SEQ ID NO: 2222003 - RNA, 21 nt, Human
ccaagacuugguguccuuucc

SEQ ID NO: 2222004 - RNA, 20 nt, Human
ccaagacuugguguccuuuc

SEQ ID NO: 2222005 - RNA, 12 nt, Human
ccaagaagggcu

SEQ ID NO: 2222006 - RNA, 19 nt, Human
ccaagaauagaugcugacu

SEQ ID NO: 2222007 - RNA, 13 nt, Human
ccaagaagggcua

SEQ ID NO: 2222008 - RNA, 22 nt, Human
ccaagaagggcuagaaccugga

SEQ ID NO: 2222009 - RNA, 13 nt, Human
ccaagaaguugga

SEQ ID NO: 2222010 - RNA, 19 nt, Human
ccaagaagcccaggaaagg

SEQ ID NO: 2222011 - RNA, 20 nt, Human
ccaagaagcccaggaaaggc

SEQ ID NO: 2222012 - RNA, 18 nt, Human
ccaagacagaugccccag

SEQ ID NO: 2222013 - RNA, 13 nt, Human
ccaagaaugcuga

SEQ ID NO: 2222014 - RNA, 14 nt, Human
ccaagaaugcugaa

SEQ ID NO: 2222015 - RNA, 15 nt, Human
ccaagaaugcugaaa

SEQ ID NO: 2222016 - RNA, 21 nt, Human
ccaagacagaugccccagagc

SEQ ID NO: 2222017 - RNA, 19 nt, Human
ccaagacagaugccccaga

SEQ ID NO: 2222018 - RNA, 22 nt, Human
ccaagacagaugccccagagcu

SEQ ID NO: 2222019 - RNA, 20 nt, Human
ccaagaauagaugcugacug

SEQ ID NO: 2222020 - RNA, 17 nt, Human
ccaagaaguuuaaggaa

SEQ ID NO: 2222021 - RNA, 12 nt, Human
ccaagaaucuau

SEQ ID NO: 2222022 - RNA, 12 nt, Human
ccaagaaugcug

SEQ ID NO: 2222023 - RNA, 18 nt, Human
ccaaccccccaccugcca

SEQ ID NO: 2222024 - RNA, 13 nt, Human
ccaaccccccagc

SEQ ID NO: 2222025 - RNA, 14 nt, Human
ccaaccccccagca

SEQ ID NO: 2222026 - RNA, 15 nt, Human
ccaaccccccagcac

SEQ ID NO: 2222027 - RNA, 17 nt, Human
ccaaccccccagcacug

SEQ ID NO: 2222028 - RNA, 18 nt, Human
ccaaccccccagcacuga

SEQ ID NO: 2222029 - RNA, 19 nt, Human
ccaaccccccagcacugag

SEQ ID NO: 2222030 - RNA, 20 nt, Human
ccaaccccccagcacugagg

SEQ ID NO: 2222031 - RNA, 17 nt, Human
ccaacccgaggcccgca

SEQ ID NO: 2222032 - RNA, 15 nt, Human
ccaaccccuguggag

SEQ ID NO: 2222033 - RNA, 15 nt, Human
ccaacccgaggcccg

SEQ ID NO: 2222034 - RNA, 12 nt, Human
ccaaccccugug

SEQ ID NO: 2222035 - RNA, 18 nt, Human
ccaaccccugaggaagau

SEQ ID NO: 2222036 - RNA, 21 nt, Human
ccaaccccccagcacugagga

SEQ ID NO: 2222037 - RNA, 14 nt, Human
ccaacccucagagc

SEQ ID NO: 2222038 - RNA, 15 nt, Human
ccaacccucagagcc

SEQ ID NO: 2222039 - RNA, 15 nt, Human
ccaagaagcccagga

SEQ ID NO: 2222040 - RNA, 12 nt, Human
ccaacccucauc

SEQ ID NO: 2222041 - RNA, 19 nt, Human
cauuguccaauccuauguu

SEQ ID NO: 2222042 - RNA, 21 nt, Human
cauuguccaauccuauguuuu

SEQ ID NO: 2222043 - RNA, 23 nt, Human
cauuguauucagaguugaugguu

SEQ ID NO: 2222044 - RNA, 15 nt, Human
cauuguaugaugugu

SEQ ID NO: 2222045 - RNA, 21 nt, Human
cauuguaucgauguuauguaa

SEQ ID NO: 2222046 - RNA, 17 nt, Human
cauuguaucgauguuau

SEQ ID NO: 2222047 - RNA, 16 nt, Human
cauuguaucgauguua

SEQ ID NO: 2222048 - RNA, 20 nt, Human
cauuguauauauguguguuu

SEQ ID NO: 2222049 - RNA, 22 nt, Human
cauuguauauauguguguuuaa

SEQ ID NO: 2222050 - RNA, 22 nt, Human
cauuguaucgauguuauguaaa

SEQ ID NO: 2222051 - RNA, 16 nt, Human
cauuguaugauguguu

SEQ ID NO: 2222052 - RNA, 17 nt, Human
cauuguaugauguguug

SEQ ID NO: 2222053 - RNA, 18 nt, Human
cauuguaugauguguugu

SEQ ID NO: 2222054 - RNA, 20 nt, Human
cauuguaugauguguuguga

SEQ ID NO: 2222055 - RNA, 22 nt, Human
cauuguaugauguguugugaua

SEQ ID NO: 2222056 - RNA, 22 nt, Human
cauuguauggauaguaaaauuc

SEQ ID NO: 2222057 - RNA, 13 nt, Human
cauugucuucgga

SEQ ID NO: 2222058 - RNA, 23 nt, Human
cauugucuucggaaaccuuggug

SEQ ID NO: 2222059 - RNA, 13 nt, Human
cauugucuuguuc

SEQ ID NO: 2222060 - RNA, 15 nt, Human
cauugucuuguucug

SEQ ID NO: 2222061 - RNA, 17 nt, Human
cauugugaacugacagg

SEQ ID NO: 2222062 - RNA, 18 nt, Human
cauugugaacugacaggc

SEQ ID NO: 2222063 - RNA, 19 nt, Human
cauugucccugaagagaag

SEQ ID NO: 2222064 - RNA, 21 nt, Human
cauugucccucugccccaucc

SEQ ID NO: 2222065 - RNA, 19 nt, Human
cauugucccucugccccau

SEQ ID NO: 2222066 - RNA, 18 nt, Human
cauugucccucugcccca

SEQ ID NO: 2222067 - RNA, 15 nt, Human
cauugucccucugcc

SEQ ID NO: 2222068 - RNA, 14 nt, Human
cauugucccucugc

SEQ ID NO: 2222069 - RNA, 13 nt, Human
cauugucccucug

SEQ ID NO: 2222070 - RNA, 22 nt, Human
cauuguuugcuuauuguuccaa

SEQ ID NO: 2222071 - RNA, 21 nt, Human
cauuguuugcuuauuguucca

SEQ ID NO: 2222072 - RNA, 15 nt, Human
cauuguuuggagaca

SEQ ID NO: 2222073 - RNA, 17 nt, Human
cauuguuuggagacauu

SEQ ID NO: 2222074 - RNA, 20 nt, Human
cauuguuugcuuauuguucc

SEQ ID NO: 2222075 - RNA, 19 nt, Human
cauuguuugcuuauuguuc

SEQ ID NO: 2222076 - RNA, 18 nt, Human
cauuguuugcuuauuguu

SEQ ID NO: 2222077 - RNA, 17 nt, Human
cauuguuugcuuauugu

SEQ ID NO: 2222078 - RNA, 14 nt, Human
cauuguuugcuuau

SEQ ID NO: 2222079 - RNA, 21 nt, Human
cauuguuugaaacaaagaagg

SEQ ID NO: 2222080 - RNA, 22 nt, Human
cauuguuugaaacaaagaaggu

SEQ ID NO: 2222081 - RNA, 14 nt, Human
cauuguuugaaaca

SEQ ID NO: 2222082 - RNA, 18 nt, Human
cauuguuugaaacaaaga

SEQ ID NO: 2222083 - RNA, 19 nt, Human
cauuguuugaaacaaagaa

SEQ ID NO: 2222084 - RNA, 20 nt, Human
cauuguuugaaacaaagaag

SEQ ID NO: 2222085 - RNA, 18 nt, Human
cauuguuggccaaagcca

SEQ ID NO: 2222086 - RNA, 17 nt, Human
cauuguuuauuaacaaa

SEQ ID NO: 2222087 - RNA, 13 nt, Human
cauuguuggcagc

SEQ ID NO: 2222088 - RNA, 18 nt, Human
cauuguugagguggucug

SEQ ID NO: 2222089 - RNA, 18 nt, Human
cauuguuuagaaagaaua

SEQ ID NO: 2222090 - RNA, 21 nt, Human
cauuguggcugucagcaggaa

SEQ ID NO: 2222091 - RNA, 19 nt, Human
cauuguggcugucagcagg

SEQ ID NO: 2222092 - RNA, 13 nt, Human
cauuguggcuccu

SEQ ID NO: 2222093 - RNA, 16 nt, Human
cauuguggcuccuauc

SEQ ID NO: 2222094 - RNA, 18 nt, Human
cauuguucaauuagaaua

SEQ ID NO: 2222095 - RNA, 17 nt, Human
cauugugcuucuuucuu

SEQ ID NO: 2222096 - RNA, 17 nt, Human
cauuguggcacauucuu

SEQ ID NO: 2222097 - RNA, 13 nt, Human
cauugugcuucuu

SEQ ID NO: 2222098 - RNA, 21 nt, Human
cauuguugagguggucugaau

SEQ ID NO: 2222099 - RNA, 16 nt, Human
cauuguugaggugguc

SEQ ID NO: 2222100 - RNA, 20 nt, Human
cauuguugagcuauugcugu

SEQ ID NO: 2222101 - RNA, 13 nt, Human
cauuguugagcua

SEQ ID NO: 2222102 - RNA, 17 nt, Human
cauuguuggccaaagcc

SEQ ID NO: 2222103 - RNA, 16 nt, Human
cauugccaccaggaga

SEQ ID NO: 2222104 - RNA, 15 nt, Human
cauugccaccaggag

SEQ ID NO: 2222105 - RNA, 14 nt, Human
cauugccaccagga

SEQ ID NO: 2222106 - RNA, 13 nt, Human
cauugccaccagg

SEQ ID NO: 2222107 - RNA, 15 nt, Human
cauugccaagggcuu

SEQ ID NO: 2222108 - RNA, 14 nt, Human
cacccaagggccug

SEQ ID NO: 2222109 - RNA, 15 nt, Human
cacccaagggccugg

SEQ ID NO: 2222110 - RNA, 15 nt, Human
cauuguagagcuucu

SEQ ID NO: 2222111 - RNA, 14 nt, Human
cauuguagaaaagc

SEQ ID NO: 2222112 - RNA, 18 nt, Human
cauugccuccuccuuccc

SEQ ID NO: 2222113 - RNA, 12 nt, Human
cauugcccuggu

SEQ ID NO: 2222114 - RNA, 17 nt, Human
cauugcccccagggcac

SEQ ID NO: 2222115 - RNA, 18 nt, Human
cauugcccccagggcacu

SEQ ID NO: 2222116 - RNA, 13 nt, Human
cauugccuauuuc

SEQ ID NO: 2222117 - RNA, 20 nt, Human
cauugccuauuucaguggca

SEQ ID NO: 2222118 - RNA, 15 nt, Human
cauugccauucccug

SEQ ID NO: 2222119 - RNA, 20 nt, Human
cauugccaccaggagaacca

SEQ ID NO: 2222120 - RNA, 17 nt, Human
cauugccaccaggagaa

SEQ ID NO: 2222121 - RNA, 16 nt, Human
cauugccauucccugc

SEQ ID NO: 2222122 - RNA, 17 nt, Human
cauugccauucccugcc

SEQ ID NO: 2222123 - RNA, 18 nt, Human
cauugccauucccugccu

SEQ ID NO: 2222124 - RNA, 19 nt, Human
cauugccauucccugccug

SEQ ID NO: 2222125 - RNA, 20 nt, Human
cauugccauucccugccugg

SEQ ID NO: 2222126 - RNA, 15 nt, Human
cauuguauaaaaaua

SEQ ID NO: 2222127 - RNA, 16 nt, Human
cauuguauaaaaauag

SEQ ID NO: 2222128 - RNA, 22 nt, Human
cauuguauaguuggaaucauau

SEQ ID NO: 2222129 - RNA, 14 nt, Human
cauuguauauaugu

SEQ ID NO: 2222130 - RNA, 15 nt, Human
cauuguauauaugug

SEQ ID NO: 2222131 - RNA, 16 nt, Human
cauuguauauaugugu

SEQ ID NO: 2222132 - RNA, 17 nt, Human
cauuguauauaugugug

SEQ ID NO: 2222133 - RNA, 16 nt, Human
cauuguagagcuucug

SEQ ID NO: 2222134 - RNA, 17 nt, Human
cauuguagagcuucugg

SEQ ID NO: 2222135 - RNA, 19 nt, Human
cauuguagagcuucuggca

SEQ ID NO: 2222136 - RNA, 21 nt, Human
cauuguagagcuucuggcacu

SEQ ID NO: 2222137 - RNA, 23 nt, Human
cauuucuagaacaucccugccag

SEQ ID NO: 2222138 - RNA, 18 nt, Human
cauuucuacugugacuga

SEQ ID NO: 2222139 - RNA, 21 nt, Human
cauuucuacucuuaaguuucu

SEQ ID NO: 2222140 - RNA, 23 nt, Human
cauuucuacucuuaaguuucuca

SEQ ID NO: 2222141 - RNA, 20 nt, Human
cauuucuacucucccauggc

SEQ ID NO: 2222142 - RNA, 21 nt, Human
cauuucuacucucccauggcu

SEQ ID NO: 2222143 - RNA, 22 nt, Human
cauuucuacucucccauggcuu

SEQ ID NO: 2222144 - RNA, 20 nt, Human
cauuucuacucuuaaguuuc

SEQ ID NO: 2222145 - RNA, 13 nt, Human
cauuucuauuuau

SEQ ID NO: 2222146 - RNA, 14 nt, Human
cauuucuauuuauu

SEQ ID NO: 2222147 - RNA, 18 nt, Human
cauuucuauuuauuuacu

SEQ ID NO: 2222148 - RNA, 23 nt, Human
cauuucuaaaggccucuuccuug

SEQ ID NO: 2222149 - RNA, 18 nt, Human
cauuucuaaaggccucuu

SEQ ID NO: 2222150 - RNA, 17 nt, Human
cauuucuaaaggccucu

SEQ ID NO: 2222151 - RNA, 15 nt, Human
cauuucgguggcuag

SEQ ID NO: 2222152 - RNA, 17 nt, Human
cauuucuacucucccau

SEQ ID NO: 2222153 - RNA, 21 nt, Human
cauuucgccccucauuuaucc

SEQ ID NO: 2222154 - RNA, 17 nt, Human
cauuucgccccucauuu

SEQ ID NO: 2222155 - RNA, 21 nt, Human
cauuucgguggcuagucaagc

SEQ ID NO: 2222156 - RNA, 21 nt, Human
cauuuccugcccuuccucagu

SEQ ID NO: 2222157 - RNA, 23 nt, Human
cauuuccugcccuuccucaguuu

SEQ ID NO: 2222158 - RNA, 16 nt, Human
cauuuccuucaaggca

SEQ ID NO: 2222159 - RNA, 12 nt, Human
cauuuccugugu

SEQ ID NO: 2222160 - RNA, 13 nt, Human
cauuuccuguguc

SEQ ID NO: 2222161 - RNA, 18 nt, Human
cauuguuugucugucuuc

SEQ ID NO: 2222162 - RNA, 22 nt, Human
cauuguuugucugucuucauag

SEQ ID NO: 2222163 - RNA, 13 nt, Human
cauuguuuuaaaa

SEQ ID NO: 2222164 - RNA, 12 nt, Human
cauuuaaaagau

SEQ ID NO: 2222165 - RNA, 16 nt, Human
cauuuaaaagauacag

SEQ ID NO: 2222166 - RNA, 15 nt, Human
cauuuaaaagauaca

SEQ ID NO: 2222167 - RNA, 16 nt, Human
cauuguuuuaaaaaga

SEQ ID NO: 2222168 - RNA, 19 nt, Human
cauuuccuauguaacugca

SEQ ID NO: 2222169 - RNA, 17 nt, Human
cauuuccuauguaacug

SEQ ID NO: 2222170 - RNA, 17 nt, Human
cauuguuuuaaaaagaa

SEQ ID NO: 2222171 - RNA, 17 nt, Human
cauuuaggggccacuuu

SEQ ID NO: 2222172 - RNA, 23 nt, Human
cauuuccuaucaccuauuuccau

SEQ ID NO: 2222173 - RNA, 15 nt, Human
cauuuccuaaauaua

SEQ ID NO: 2222174 - RNA, 13 nt, Human
cauuuccugacag

SEQ ID NO: 2222175 - RNA, 20 nt, Human
cauuuccugacagaaggacu

SEQ ID NO: 2222176 - RNA, 19 nt, Human
cauuuccugagaccacaga

SEQ ID NO: 2222177 - RNA, 11 nt, Human
cauuuccugcc

SEQ ID NO: 2222178 - RNA, 12 nt, Human
cauuuccugccc

SEQ ID NO: 2222179 - RNA, 13 nt, Human
cauuuccugcccu

SEQ ID NO: 2222180 - RNA, 17 nt, Human
cauuuccugcccuuccu

SEQ ID NO: 2222181 - RNA, 19 nt, Human
cauuuccugcccuuccuca

SEQ ID NO: 2222182 - RNA, 20 nt, Human
cauuuccugcccuuccucag

SEQ ID NO: 2222183 - RNA, 17 nt, Human
cauuuaggccaugggac

SEQ ID NO: 2222184 - RNA, 22 nt, Human
cauuuagcuaaacggauuccaa

SEQ ID NO: 2222185 - RNA, 21 nt, Human
cauuuagagaggaaaaguaac

SEQ ID NO: 2222186 - RNA, 20 nt, Human
cauuuagagaggaaaaguaa

SEQ ID NO: 2222187 - RNA, 19 nt, Human
cauuuagauugaaaacuuu

SEQ ID NO: 2222188 - RNA, 17 nt, Human
cauuuagccaccaucuu

SEQ ID NO: 2222189 - RNA, 22 nt, Human
cauuuagccaccaucuuugcag

SEQ ID NO: 2222190 - RNA, 20 nt, Human
cauuuagauugaaaacuuuu

SEQ ID NO: 2222191 - RNA, 18 nt, Human
cauuuagccaccaucuuu

SEQ ID NO: 2222192 - RNA, 20 nt, Human
cauuugcuaacuagcuugga

SEQ ID NO: 2222193 - RNA, 21 nt, Human
cauuugcguuccaugaugcug

SEQ ID NO: 2222194 - RNA, 21 nt, Human
cauuugcgaaugguuccauuc

SEQ ID NO: 2222195 - RNA, 19 nt, Human
cauuugccuauucccacac

SEQ ID NO: 2222196 - RNA, 15 nt, Human
cauuugccuauuccc

SEQ ID NO: 2222197 - RNA, 17 nt, Human
cauuugccuauucccac

SEQ ID NO: 2222198 - RNA, 18 nt, Human
cauuugccuauucccaca

SEQ ID NO: 2222199 - RNA, 14 nt, Human
cauuugccuugcug

SEQ ID NO: 2222200 - RNA, 20 nt, Human
cauuugagcagggcucagcg

SEQ ID NO: 2222201 - RNA, 18 nt, Human
cauuugaaagaaaggacu

SEQ ID NO: 2222202 - RNA, 12 nt, Human
cauuugccuauu

SEQ ID NO: 2222203 - RNA, 14 nt, Human
cauuugccuauucc

SEQ ID NO: 2222204 - RNA, 17 nt, Human
cauuugagcagggcuca

SEQ ID NO: 2222205 - RNA, 18 nt, Human
cauuugagcagggcucag

SEQ ID NO: 2222206 - RNA, 22 nt, Human
cauuugcguuccaugaugcugg

SEQ ID NO: 2222207 - RNA, 19 nt, Human
cauuugcucuuucaucucu

SEQ ID NO: 2222208 - RNA, 17 nt, Human
cauuuguuugaacugau

SEQ ID NO: 2222209 - RNA, 22 nt, Human
cauuuguuugaacugauaaaga

SEQ ID NO: 2222210 - RNA, 20 nt, Human
cauuuguuugaacugauaaa

SEQ ID NO: 2222211 - RNA, 13 nt, Human
cauuugcuccuuu

SEQ ID NO: 2222212 - RNA, 14 nt, Human
cauuugcuccuuuc

SEQ ID NO: 2222213 - RNA, 13 nt, Human
cauuugcucaugg

SEQ ID NO: 2222214 - RNA, 18 nt, Human
cauuugcucauggaauug

SEQ ID NO: 2222215 - RNA, 21 nt, Human
cauuugaauaaagccugcuuu

SEQ ID NO: 2222216 - RNA, 19 nt, Human
cauuugaaagaaaggacuc

SEQ ID NO: 2222217 - RNA, 10 nt, Human
cauuugaaug

SEQ ID NO: 2222218 - RNA, 11 nt, Human
cauuugaaugc

SEQ ID NO: 2222219 - RNA, 11 nt, Human
cauuugaaaga

SEQ ID NO: 2222220 - RNA, 14 nt, Human
cauuugaaagaaag

SEQ ID NO: 2222221 - RNA, 15 nt, Human
cauuugaaagaaagg

SEQ ID NO: 2222222 - RNA, 20 nt, Human
cauuugaaaauuuugauguu

SEQ ID NO: 2222223 - RNA, 22 nt, Human
cauuugaaaauuuugauguuuu

SEQ ID NO: 2222224 - RNA, 14 nt, Human
cauuuuauauguca

SEQ ID NO: 2222225 - RNA, 23 nt, Human
cauuuuauaaaucgcuuuugaua

SEQ ID NO: 2222226 - RNA, 15 nt, Human
cauuuuguauaauug

SEQ ID NO: 2222227 - RNA, 14 nt, Human
cauuuuguauaauu

SEQ ID NO: 2222228 - RNA, 22 nt, Human
cauuuuguggucauuaagcauu

SEQ ID NO: 2222229 - RNA, 18 nt, Human
cauuuugugaauggauug

SEQ ID NO: 2222230 - RNA, 21 nt, Human
cauuuugugaauggauuggau

SEQ ID NO: 2222231 - RNA, 13 nt, Human
cauuuugugaaug

SEQ ID NO: 2222232 - RNA, 14 nt, Human
cauuuugugaaugg

SEQ ID NO: 2222233 - RNA, 15 nt, Human
cauuuugugaaugga

SEQ ID NO: 2222234 - RNA, 16 nt, Human
cauuuugugaauggau

SEQ ID NO: 2222235 - RNA, 21 nt, Human
cauuuuguauaauuguaucgu

SEQ ID NO: 2222236 - RNA, 17 nt, Human
cauuuuguauaauugua

SEQ ID NO: 2222237 - RNA, 18 nt, Human
cauuuuguauaauuguau

SEQ ID NO: 2222238 - RNA, 20 nt, Human
cauuuuguauaauuguaucg

SEQ ID NO: 2222239 - RNA, 12 nt, Human
cauuuugugaau

SEQ ID NO: 2222240 - RNA, 20 nt, Human
cauuuuaaaaaaaaaggcau

SEQ ID NO: 2222241 - RNA, 18 nt, Human
cauuuuaaaaaugaaauu

SEQ ID NO: 2222242 - RNA, 21 nt, Human
cauuuuauaaaucgcuuuuga

SEQ ID NO: 2222243 - RNA, 18 nt, Human
cauuuuauaaaucgcuuu

SEQ ID NO: 2222244 - RNA, 17 nt, Human
cauuuuauaaaucgcuu

SEQ ID NO: 2222245 - RNA, 13 nt, Human
cauuuuauaaauc

SEQ ID NO: 2222246 - RNA, 11 nt, Human
cauuuuauaaa

SEQ ID NO: 2222247 - RNA, 15 nt, Human
cauuuuagucacuuu

SEQ ID NO: 2222248 - RNA, 16 nt, Human
cauuuuagucacuuuu

SEQ ID NO: 2222249 - RNA, 17 nt, Human
cauuuuagucacuuuuu

SEQ ID NO: 2222250 - RNA, 14 nt, Human
cauuuuaguucuuu

SEQ ID NO: 2222251 - RNA, 18 nt, Human
cauuuuucagauauaaaa

SEQ ID NO: 2222252 - RNA, 20 nt, Human
cauuuuucagauauaaaaga

SEQ ID NO: 2222253 - RNA, 13 nt, Human
cauuuuuccuaac

SEQ ID NO: 2222254 - RNA, 18 nt, Human
cauuuuuccuaacaggau

SEQ ID NO: 2222255 - RNA, 20 nt, Human
ccaaacaccuuccagcuccu

SEQ ID NO: 2222256 - RNA, 16 nt, Human
ccaaacagccacacug

SEQ ID NO: 2222257 - RNA, 16 nt, Human
cauuuuuccuucccuu

SEQ ID NO: 2222258 - RNA, 18 nt, Human
cauuuuuccuucccuucu

SEQ ID NO: 2222259 - RNA, 22 nt, Human
ccaaacaccuuccagcuccugu

SEQ ID NO: 2222260 - RNA, 21 nt, Human
cauuuuuccuucccuucucca

SEQ ID NO: 2222261 - RNA, 20 nt, Human
ccaaacauccuacaagacac

SEQ ID NO: 2222262 - RNA, 19 nt, Human
ccaaacauccuacaagaca

SEQ ID NO: 2222263 - RNA, 17 nt, Human
ccaaacucaccugcccc

SEQ ID NO: 2222264 - RNA, 12 nt, Human
uuuuuugaaaac

SEQ ID NO: 2222265 - RNA, 11 nt, Human
uuuuuucugau

SEQ ID NO: 2222266 - RNA, 13 nt, Human
uuuuuucuuacug

SEQ ID NO: 2222267 - RNA, 14 nt, Human
gcgagacuccgucu

SEQ ID NO: 2222268 - RNA, 18 nt, Human
gcgagacuccgucucaaa

SEQ ID NO: 2222269 - RNA, 20 nt, Human
gcgagaaccuaaguuucagu

SEQ ID NO: 2222270 - RNA, 17 nt, Human
gcgacuuucugccugga

SEQ ID NO: 2222271 - RNA, 14 nt, Human
gcgacuuucugccu

SEQ ID NO: 2222272 - RNA, 16 nt, Human
gcgacuuucugccugg

SEQ ID NO: 2222273 - RNA, 16 nt, Human
gcgauccaccugucuc

SEQ ID NO: 2222274 - RNA, 17 nt, Human
gcgaguuguggaaagcc

SEQ ID NO: 2222275 - RNA, 21 nt, Human
gcgagugccaggacuccccag

SEQ ID NO: 2222276 - RNA, 22 nt, Human
gcgagugccaggacuccccagg

SEQ ID NO: 2222277 - RNA, 23 nt, Human
gcgaggucaacagagaaggcagg

SEQ ID NO: 2222278 - RNA, 22 nt, Human
gcgaggucaacagagaaggcag

SEQ ID NO: 2222279 - RNA, 22 nt, Human
gcgaguauguguuugugugugu

SEQ ID NO: 2222280 - RNA, 15 nt, Human
gcgagugccaggacu

SEQ ID NO: 2222281 - RNA, 19 nt, Human
gcgaggucaacagagaagg

SEQ ID NO: 2222282 - RNA, 18 nt, Human
gcgaggucaacagagaag

SEQ ID NO: 2222283 - RNA, 17 nt, Human
gcgaggucaacagagaa

SEQ ID NO: 2222284 - RNA, 16 nt, Human
gcgaggucaacagaga

SEQ ID NO: 2222285 - RNA, 20 nt, Human
gcgagugugugcaugugugu

SEQ ID NO: 2222286 - RNA, 17 nt, Human
gcgauucuccugccuca

SEQ ID NO: 2222287 - RNA, 13 nt, Human
gcgauucuucugc

SEQ ID NO: 2222288 - RNA, 14 nt, Human
gcgaggggagggug

SEQ ID NO: 2222289 - RNA, 14 nt, Human
gcgaggcagaggac

SEQ ID NO: 2222290 - RNA, 16 nt, Human
gcgagcauccuggcca

SEQ ID NO: 2222291 - RNA, 12 nt, Human
gcgaggcagagg

SEQ ID NO: 2222292 - RNA, 13 nt, Human
gcgaggcagagga

SEQ ID NO: 2222293 - RNA, 16 nt, Human
gcgaggcagaggacag

SEQ ID NO: 2222294 - RNA, 16 nt, Human
gcgagagucugucuca

SEQ ID NO: 2222295 - RNA, 23 nt, Human
gcgagauggggugggguggagaa

SEQ ID NO: 2222296 - RNA, 15 nt, Human
gcgagagucccugca

SEQ ID NO: 2222297 - RNA, 15 nt, Human
gcgagaggcagagaa

SEQ ID NO: 2222298 - RNA, 16 nt, Human
gcgagaggcagagaaa

SEQ ID NO: 2222299 - RNA, 16 nt, Human
gcgagaggaggggccc

SEQ ID NO: 2222300 - RNA, 20 nt, Human
gcgauucuggauaaagccac

SEQ ID NO: 2222301 - RNA, 19 nt, Human
gcgauucuggauaaagcca

SEQ ID NO: 2222302 - RNA, 14 nt, Human
gcgauucuucugcu

SEQ ID NO: 2222303 - RNA, 14 nt, Human
gcggagcuggcccc

SEQ ID NO: 2222304 - RNA, 17 nt, Human
gcggagcuggccccgcc

SEQ ID NO: 2222305 - RNA, 16 nt, Human
gcggagguugcaggga

SEQ ID NO: 2222306 - RNA, 15 nt, Human
gcggagguugcaggg

SEQ ID NO: 2222307 - RNA, 16 nt, Human
gcggagcuugcaguga

SEQ ID NO: 2222308 - RNA, 21 nt, Human
gcggagguguggagccgaggc

SEQ ID NO: 2222309 - RNA, 22 nt, Human
gcggagaguacagugagccaag

SEQ ID NO: 2222310 - RNA, 16 nt, Human
gcggagaguacaguga

SEQ ID NO: 2222311 - RNA, 20 nt, Human
gcggagaguacagugagcca

SEQ ID NO: 2222312 - RNA, 12 nt, Human
gcggagcuggcc

SEQ ID NO: 2222313 - RNA, 22 nt, Human
gcggagagaggccuugucccag

SEQ ID NO: 2222314 - RNA, 15 nt, Human
gcggagaguacagug

SEQ ID NO: 2222315 - RNA, 20 nt, Human
gcgugaucaaagccacacuc

SEQ ID NO: 2222316 - RNA, 14 nt, Human
gcgugcacacacca

SEQ ID NO: 2222317 - RNA, 18 nt, Human
gcgugcacacaccagagc

SEQ ID NO: 2222318 - RNA, 23 nt, Human
gcgugaucucggcucacugcaac

SEQ ID NO: 2222319 - RNA, 16 nt, Human
gcguggagggcguggg

SEQ ID NO: 2222320 - RNA, 16 nt, Human
gcguggucacugcugu

SEQ ID NO: 2222321 - RNA, 17 nt, Human
gcguggggacagggcuc

SEQ ID NO: 2222322 - RNA, 13 nt, Human
gcguggggagggc

SEQ ID NO: 2222323 - RNA, 20 nt, Human
gcgugguggacaugcacagc

SEQ ID NO: 2222324 - RNA, 18 nt, Human
gcguggucacugcuguca

SEQ ID NO: 2222325 - RNA, 17 nt, Human
gcguggucacugcuguc

SEQ ID NO: 2222326 - RNA, 15 nt, Human
gcggccgcauucccu

SEQ ID NO: 2222327 - RNA, 16 nt, Human
gcggccccucccgccc

SEQ ID NO: 2222328 - RNA, 13 nt, Human
gcggccccucccg

SEQ ID NO: 2222329 - RNA, 14 nt, Human
gcggccccucccac

SEQ ID NO: 2222330 - RNA, 15 nt, Human
gcggccccucccaca

SEQ ID NO: 2222331 - RNA, 18 nt, Human
gcggccgcauucccugag

SEQ ID NO: 2222332 - RNA, 17 nt, Human
gcggccgcauucccuga

SEQ ID NO: 2222333 - RNA, 16 nt, Human
gcggccgcauucccug

SEQ ID NO: 2222334 - RNA, 19 nt, Human
gcggccgcauucccugagu

SEQ ID NO: 2222335 - RNA, 13 nt, Human
gcggccggccagc

SEQ ID NO: 2222336 - RNA, 14 nt, Human
gcggagugaagagg

SEQ ID NO: 2222337 - RNA, 18 nt, Human
gcggagugaagaggggca

SEQ ID NO: 2222338 - RNA, 20 nt, Human
gcggagugaagaggggcagc

SEQ ID NO: 2222339 - RNA, 21 nt, Human
gcggagugaagaggggcagcc

SEQ ID NO: 2222340 - RNA, 22 nt, Human
gcggagugaagaggggcagccc

SEQ ID NO: 2222341 - RNA, 20 nt, Human
gcggaucucuggagugagcu

SEQ ID NO: 2222342 - RNA, 22 nt, Human
gcggcccaagcccgacuugcug

SEQ ID NO: 2222343 - RNA, 23 nt, Human
gcggcccaagcccgacuugcugu

SEQ ID NO: 2222344 - RNA, 13 nt, Human
gcggcccagcccg

SEQ ID NO: 2222345 - RNA, 15 nt, Human
gcggcccagcccggc

SEQ ID NO: 2222346 - RNA, 16 nt, Human
gcggcccagcccggcu

SEQ ID NO: 2222347 - RNA, 18 nt, Human
gcggcccagcccggcucc

SEQ ID NO: 2222348 - RNA, 21 nt, Human
gcggcccagcccggcucccac

SEQ ID NO: 2222349 - RNA, 11 nt, Human
gcuagaaauga

SEQ ID NO: 2222350 - RNA, 18 nt, Human
gcuagaaauaugauuuua

SEQ ID NO: 2222351 - RNA, 18 nt, Human
gcuacuugggccauagcu

SEQ ID NO: 2222352 - RNA, 21 nt, Human
gcuacuuuauuuauacacugu

SEQ ID NO: 2222353 - RNA, 16 nt, Human
gcuacuuugccuuuug

SEQ ID NO: 2222354 - RNA, 13 nt, Human
gcuacuugggagg

SEQ ID NO: 2222355 - RNA, 19 nt, Human
gcuacuuccuccuccccac

SEQ ID NO: 2222356 - RNA, 18 nt, Human
gcuacuuccuccucccca

SEQ ID NO: 2222357 - RNA, 23 nt, Human
gcuacuuaauuccuuucucaucc

SEQ ID NO: 2222358 - RNA, 20 nt, Human
gcuacuucccucacccacuu

SEQ ID NO: 2222359 - RNA, 17 nt, Human
gcuacuugggaggcuga

SEQ ID NO: 2222360 - RNA, 19 nt, Human
gcuagaaccuggagggcug

SEQ ID NO: 2222361 - RNA, 20 nt, Human
gcuagaaccuguagagcuag

SEQ ID NO: 2222362 - RNA, 18 nt, Human
gcuagaaccaagaagggc

SEQ ID NO: 2222363 - RNA, 19 nt, Human
gcuagaaccaagaagggcu

SEQ ID NO: 2222364 - RNA, 20 nt, Human
gcuagaaccaagaagggcua

SEQ ID NO: 2222365 - RNA, 18 nt, Human
gcuagaaccuagaagggc

SEQ ID NO: 2222366 - RNA, 19 nt, Human
gcuagaaccuagaagggcu

SEQ ID NO: 2222367 - RNA, 20 nt, Human
gcuagaaccuagaagggcua

SEQ ID NO: 2222368 - RNA, 18 nt, Human
gcuagaaccuggaagggc

SEQ ID NO: 2222369 - RNA, 19 nt, Human
gcuagaaccuggaagggcu

SEQ ID NO: 2222370 - RNA, 20 nt, Human
gcuagaaccuggaagggcua

SEQ ID NO: 2222371 - RNA, 15 nt, Human
gcuagaaccuggaga

SEQ ID NO: 2222372 - RNA, 19 nt, Human
gcuagaaccuggagagcua

SEQ ID NO: 2222373 - RNA, 20 nt, Human
gcuagaaccuggagagcuag

SEQ ID NO: 2222374 - RNA, 15 nt, Human
gcuagaaccuggagg

SEQ ID NO: 2222375 - RNA, 19 nt, Human
gcuacuguccuacccaccc

SEQ ID NO: 2222376 - RNA, 20 nt, Human
gcuacuguccuacccacccu

SEQ ID NO: 2222377 - RNA, 21 nt, Human
gcuacugugugugugaaugaa

SEQ ID NO: 2222378 - RNA, 19 nt, Human
gcuacugugugugugaaug

SEQ ID NO: 2222379 - RNA, 17 nt, Human
gcuacuuaauuccuuuc

SEQ ID NO: 2222380 - RNA, 21 nt, Human
gcuacuuaauuccuuucucau

SEQ ID NO: 2222381 - RNA, 18 nt, Human
gcuacugugugugugaau

SEQ ID NO: 2222382 - RNA, 15 nt, Human
gcuacugugugugug

SEQ ID NO: 2222383 - RNA, 12 nt, Human
gcuacugucuca

SEQ ID NO: 2222384 - RNA, 16 nt, Human
gcuacugucucacuga

SEQ ID NO: 2222385 - RNA, 21 nt, Human
gcuacugucucacugaaacau

SEQ ID NO: 2222386 - RNA, 18 nt, Human
gcuacuguaaggcaauca

SEQ ID NO: 2222387 - RNA, 19 nt, Human
gcuacuguaaggcaaucau

SEQ ID NO: 2222388 - RNA, 22 nt, Human
gcuacuguaauuuuauaugaag

SEQ ID NO: 2222389 - RNA, 18 nt, Human
gcuacuguaauuuuauau

SEQ ID NO: 2222390 - RNA, 15 nt, Human
gcuacugucagcucc

SEQ ID NO: 2222391 - RNA, 20 nt, Human
gcuacaaauacucuuaggaa

SEQ ID NO: 2222392 - RNA, 17 nt, Human
gcuacaaagaagacaug

SEQ ID NO: 2222393 - RNA, 18 nt, Human
gcuacaaagaagacaugu

SEQ ID NO: 2222394 - RNA, 19 nt, Human
gcuacaaagaagacauguu

SEQ ID NO: 2222395 - RNA, 20 nt, Human
gcuacaaagaagacauguuu

SEQ ID NO: 2222396 - RNA, 14 nt, Human
gcuacaaagaagac

SEQ ID NO: 2222397 - RNA, 15 nt, Human
gcuacaaagaagaca

SEQ ID NO: 2222398 - RNA, 16 nt, Human
gcuacaaagaagacau

SEQ ID NO: 2222399 - RNA, 23 nt, Human
gcuacuggcaaaaggaucuuugu

SEQ ID NO: 2222400 - RNA, 22 nt, Human
gcuacaaagaagacauguuuua

SEQ ID NO: 2222401 - RNA, 15 nt, Human
gcuacaacuucagca

SEQ ID NO: 2222402 - RNA, 17 nt, Human
gcuacaacuucagcagu

SEQ ID NO: 2222403 - RNA, 15 nt, Human
gcuacaauuuucucc

SEQ ID NO: 2222404 - RNA, 20 nt, Human
gcuacaauuuucucccagga

SEQ ID NO: 2222405 - RNA, 21 nt, Human
gcuacaauuuucucccaggaa

SEQ ID NO: 2222406 - RNA, 22 nt, Human
gcuacaauuuucucccaggaag

SEQ ID NO: 2222407 - RNA, 17 nt, Human
gcuaauuuuuguaauuu

SEQ ID NO: 2222408 - RNA, 16 nt, Human
gcuaauuuuuguaauu

SEQ ID NO: 2222409 - RNA, 15 nt, Human
gcuaauuuuuguaau

SEQ ID NO: 2222410 - RNA, 17 nt, Human
gcuacaaaaacacagca

SEQ ID NO: 2222411 - RNA, 19 nt, Human
gcuacaaaaacacagcaag

SEQ ID NO: 2222412 - RNA, 18 nt, Human
gcuacaaaaacacagcaa

SEQ ID NO: 2222413 - RNA, 14 nt, Human
gcguuguaaaauau

SEQ ID NO: 2222414 - RNA, 15 nt, Human
gcguuguaaaauaua

SEQ ID NO: 2222415 - RNA, 21 nt, Human
gcgugguggaagaggggacag

SEQ ID NO: 2222416 - RNA, 15 nt, Human
gcguugcaugucgug

SEQ ID NO: 2222417 - RNA, 19 nt, Human
gcguuguaaaauauagcug

SEQ ID NO: 2222418 - RNA, 20 nt, Human
gcguuguaaaauauagcugu

SEQ ID NO: 2222419 - RNA, 19 nt, Human
gcguuuaagacuguaauga

SEQ ID NO: 2222420 - RNA, 17 nt, Human
gcguuucuaugacacau

SEQ ID NO: 2222421 - RNA, 16 nt, Human
gcuaauuuuucauuuu

SEQ ID NO: 2222422 - RNA, 18 nt, Human
gcuaauuuugaaaaacug

SEQ ID NO: 2222423 - RNA, 12 nt, Human
gcuaauuugcau

SEQ ID NO: 2222424 - RNA, 20 nt, Human
gcuaauuuauccugaaauuu

SEQ ID NO: 2222425 - RNA, 15 nt, Human
gcuaauuugcauuaa

SEQ ID NO: 2222426 - RNA, 13 nt, Human
gcuaauuugcauu

SEQ ID NO: 2222427 - RNA, 18 nt, Human
gccucauguggcuggaag

SEQ ID NO: 2222428 - RNA, 21 nt, Human
gccucauuacuuuaccacccc

SEQ ID NO: 2222429 - RNA, 19 nt, Human
gccucauguggcuggaaga

SEQ ID NO: 2222430 - RNA, 17 nt, Human
gccuccaaaugccaacu

SEQ ID NO: 2222431 - RNA, 21 nt, Human
gccucauuuagagaggaaaag

SEQ ID NO: 2222432 - RNA, 22 nt, Human
gccuccaaaugccaacuugucc

SEQ ID NO: 2222433 - RNA, 17 nt, Human
gccuccaagcuccaucu

SEQ ID NO: 2222434 - RNA, 18 nt, Human
gccuccagcugccccggg

SEQ ID NO: 2222435 - RNA, 19 nt, Human
gccuccaggaaccacacca

SEQ ID NO: 2222436 - RNA, 12 nt, Human
gccuccaggcca

SEQ ID NO: 2222437 - RNA, 12 nt, Human
gccuccagccuc

SEQ ID NO: 2222438 - RNA, 14 nt, Human
gccuccagccucug

SEQ ID NO: 2222439 - RNA, 15 nt, Human
gccuccagccucugu

SEQ ID NO: 2222440 - RNA, 12 nt, Human
gccuccagggcu

SEQ ID NO: 2222441 - RNA, 22 nt, Human
gccuccaggccacauggggcug

SEQ ID NO: 2222442 - RNA, 13 nt, Human
gccuccagggcug

SEQ ID NO: 2222443 - RNA, 14 nt, Human
gccuccagggcugg

SEQ ID NO: 2222444 - RNA, 11 nt, Human
gccuccagccu

SEQ ID NO: 2222445 - RNA, 19 nt, Human
gccuccagaacucacuggg

SEQ ID NO: 2222446 - RNA, 23 nt, Human
gccuccaaggaggggcuguaaaa

SEQ ID NO: 2222447 - RNA, 22 nt, Human
gccuccaaggaggggcuguaaa

SEQ ID NO: 2222448 - RNA, 20 nt, Human
gccuccuuccuugcuguccu

SEQ ID NO: 2222449 - RNA, 21 nt, Human
gccuccaggccacauggggcu

SEQ ID NO: 2222450 - RNA, 11 nt, Human
gccuccaucuc

SEQ ID NO: 2222451 - RNA, 19 nt, Human
gccuccuuugugaggaagc

SEQ ID NO: 2222452 - RNA, 20 nt, Human
gccuccuuugugaggaagcc

SEQ ID NO: 2222453 - RNA, 21 nt, Human
gccuccuuugugaggaagccg

SEQ ID NO: 2222454 - RNA, 20 nt, Human
gccuccauccugaggcucca

SEQ ID NO: 2222455 - RNA, 16 nt, Human
gccuccauccugaggc

SEQ ID NO: 2222456 - RNA, 16 nt, Human
gccuccagggcuggac

SEQ ID NO: 2222457 - RNA, 17 nt, Human
gccuccagggcuggacu

SEQ ID NO: 2222458 - RNA, 18 nt, Human
gccuccagggcuggacug

SEQ ID NO: 2222459 - RNA, 19 nt, Human
gccuccagggcuggacuga

SEQ ID NO: 2222460 - RNA, 20 nt, Human
gccuccagggcuggacugag

SEQ ID NO: 2222461 - RNA, 23 nt, Human
gccucgcccaccgcaugcccccu

SEQ ID NO: 2222462 - RNA, 14 nt, Human
gccucgcccaccgc

SEQ ID NO: 2222463 - RNA, 15 nt, Human
gccucgcccaccgca

SEQ ID NO: 2222464 - RNA, 16 nt, Human
gccucgcccaccgcau

SEQ ID NO: 2222465 - RNA, 20 nt, Human
gccucgcccaccgcaugccc

SEQ ID NO: 2222466 - RNA, 13 nt, Human
gccucgccuggcc

SEQ ID NO: 2222467 - RNA, 14 nt, Human
gccucgccuggccu

SEQ ID NO: 2222468 - RNA, 15 nt, Human
gccucgccuggccug

SEQ ID NO: 2222469 - RNA, 13 nt, Human
gccucggacuuag

SEQ ID NO: 2222470 - RNA, 14 nt, Human
gccugccccucucc

SEQ ID NO: 2222471 - RNA, 17 nt, Human
gccugccccucucccgc

SEQ ID NO: 2222472 - RNA, 21 nt, Human
gccugcccguaaacacgccug

SEQ ID NO: 2222473 - RNA, 16 nt, Human
gccugcccguaaacac

SEQ ID NO: 2222474 - RNA, 20 nt, Human
gccugcccucauggccccuc

SEQ ID NO: 2222475 - RNA, 18 nt, Human
gccugcccgucucucucc

SEQ ID NO: 2222476 - RNA, 20 nt, Human
gccugcccgucucucuccca

SEQ ID NO: 2222477 - RNA, 21 nt, Human
gccugcccucauggccccucu

SEQ ID NO: 2222478 - RNA, 22 nt, Human
gccugcccucauggccccucug

SEQ ID NO: 2222479 - RNA, 14 nt, Human
gccugcccucaggg

SEQ ID NO: 2222480 - RNA, 15 nt, Human
gccugcccuccccag

SEQ ID NO: 2222481 - RNA, 17 nt, Human
gccugcccuccccagag

SEQ ID NO: 2222482 - RNA, 18 nt, Human
gccugcccuccccagagc

SEQ ID NO: 2222483 - RNA, 17 nt, Human
gccugcuaauuccccag

SEQ ID NO: 2222484 - RNA, 23 nt, Human
gccugcuaauuccccagauugca

SEQ ID NO: 2222485 - RNA, 16 nt, Human
gccugcuccagaccug

SEQ ID NO: 2222486 - RNA, 15 nt, Human
gccugcuccagaccu

SEQ ID NO: 2222487 - RNA, 14 nt, Human
gccugcuccagacc

SEQ ID NO: 2222488 - RNA, 13 nt, Human
gccugcuccagac

SEQ ID NO: 2222489 - RNA, 12 nt, Human
gccugcuccaga

SEQ ID NO: 2222490 - RNA, 23 nt, Human
gccugcgcccaccccgcucugca

SEQ ID NO: 2222491 - RNA, 20 nt, Human
gccugcguucuugugacaga

SEQ ID NO: 2222492 - RNA, 20 nt, Human
gccugcguuuuggaagcucu

SEQ ID NO: 2222493 - RNA, 17 nt, Human
gccugcggccugcugga

SEQ ID NO: 2222494 - RNA, 20 nt, Human
gccugcgcccaccccgcucu

SEQ ID NO: 2222495 - RNA, 22 nt, Human
gccugcgcccaccccgcucugc

SEQ ID NO: 2222496 - RNA, 14 nt, Human
gccugcccuugucu

SEQ ID NO: 2222497 - RNA, 21 nt, Human
gccugcccuugucugagaugc

SEQ ID NO: 2222498 - RNA, 13 nt, Human
gccugcccuuguc

SEQ ID NO: 2222499 - RNA, 22 nt, Human
gccugcccuccccagagcacug

SEQ ID NO: 2222500 - RNA, 19 nt, Human
gccugcccuccccagagca

SEQ ID NO: 2222501 - RNA, 21 nt, Human
gccugcccuccccagagcacu

SEQ ID NO: 2222502 - RNA, 13 nt, Human
gccugcuccagcu

SEQ ID NO: 2222503 - RNA, 21 nt, Human
gccugcuccagaccugauccu

SEQ ID NO: 2222504 - RNA, 17 nt, Human
gccugcuccagaccuga

SEQ ID NO: 2222505 - RNA, 20 nt, Human
gcccaggagagccagcccuc

SEQ ID NO: 2222506 - RNA, 19 nt, Human
gcccaggagagccagcccu

SEQ ID NO: 2222507 - RNA, 23 nt, Human
gccauguuaauguaaucugaugg

SEQ ID NO: 2222508 - RNA, 18 nt, Human
gccauguuccaauaaaca

SEQ ID NO: 2222509 - RNA, 21 nt, Human
gcccaggagagccagcccucc

SEQ ID NO: 2222510 - RNA, 14 nt, Human
gccaugugccaggu

SEQ ID NO: 2222511 - RNA, 22 nt, Human
gccaugugcuaguaauuggaaa

SEQ ID NO: 2222512 - RNA, 19 nt, Human
gccaucaaaaugcuuuuua

SEQ ID NO: 2222513 - RNA, 17 nt, Human
gccaucaacaagaguug

SEQ ID NO: 2222514 - RNA, 18 nt, Human
gccaucaaaaugcuuuuu

SEQ ID NO: 2222515 - RNA, 16 nt, Human
gccaucaaaaugcuuu

SEQ ID NO: 2222516 - RNA, 15 nt, Human
gccaucaaaaugcuu

SEQ ID NO: 2222517 - RNA, 14 nt, Human
gccaucaaaaugcu

SEQ ID NO: 2222518 - RNA, 13 nt, Human
gcccaggcagguc

SEQ ID NO: 2222519 - RNA, 12 nt, Human
gcccaggcaggu

SEQ ID NO: 2222520 - RNA, 22 nt, Human
gcccaggaguuugaggcugcag

SEQ ID NO: 2222521 - RNA, 14 nt, Human
gcccaggcaggucu

SEQ ID NO: 2222522 - RNA, 16 nt, Human
gcccaggcaggucuug

SEQ ID NO: 2222523 - RNA, 15 nt, Human
gcccaggccccugcc

SEQ ID NO: 2222524 - RNA, 13 nt, Human
gcccaggccccug

SEQ ID NO: 2222525 - RNA, 17 nt, Human
gcccaggccccugccac

SEQ ID NO: 2222526 - RNA, 15 nt, Human
gcccauucucucucc

SEQ ID NO: 2222527 - RNA, 14 nt, Human
gcccauucucucuc

SEQ ID NO: 2222528 - RNA, 21 nt, Human
gcccauucucucuccugucca

SEQ ID NO: 2222529 - RNA, 19 nt, Human
gcccauucucucuccuguc

SEQ ID NO: 2222530 - RNA, 17 nt, Human
gcccauucucucuccug

SEQ ID NO: 2222531 - RNA, 22 nt, Human
gccccaacuccuggaagcugug

SEQ ID NO: 2222532 - RNA, 20 nt, Human
gcccauuucaauucucaaaa

SEQ ID NO: 2222533 - RNA, 20 nt, Human
gcccauucucucuccugucc

SEQ ID NO: 2222534 - RNA, 19 nt, Human
gcccauuucaauucucaaa

SEQ ID NO: 2222535 - RNA, 18 nt, Human
gcccauuucaauucucaa

SEQ ID NO: 2222536 - RNA, 13 nt, Human
gccccaaguccug

SEQ ID NO: 2222537 - RNA, 15 nt, Human
gccccaaguccugaa

SEQ ID NO: 2222538 - RNA, 16 nt, Human
gccccaaguccugaag

SEQ ID NO: 2222539 - RNA, 19 nt, Human
gccccaaguccugaagagg

SEQ ID NO: 2222540 - RNA, 20 nt, Human
gccccaaguccugaagaggc

SEQ ID NO: 2222541 - RNA, 21 nt, Human
gccccaacucuccccugaccu

SEQ ID NO: 2222542 - RNA, 16 nt, Human
gcccauuccucaccuu

SEQ ID NO: 2222543 - RNA, 16 nt, Human
gcccauucauuccauu

SEQ ID NO: 2222544 - RNA, 23 nt, Human
gcccauucauuccauucuggaag

SEQ ID NO: 2222545 - RNA, 19 nt, Human
gcccauucauuccauucug

SEQ ID NO: 2222546 - RNA, 11 nt, Human
gcccccgcccc

SEQ ID NO: 2222547 - RNA, 22 nt, Human
gcccccgagcugggggccauga

SEQ ID NO: 2222548 - RNA, 14 nt, Human
gcccccgagcuggg

SEQ ID NO: 2222549 - RNA, 13 nt, Human
gcccccgagcugg

SEQ ID NO: 2222550 - RNA, 16 nt, Human
gccccccuccuugcuc

SEQ ID NO: 2222551 - RNA, 20 nt, Human
gccccccuccuugcucugca

SEQ ID NO: 2222552 - RNA, 12 nt, Human
gccccacccugg

SEQ ID NO: 2222553 - RNA, 17 nt, Human
gccccaccccagguccu

SEQ ID NO: 2222554 - RNA, 20 nt, Human
gccccacacggaggcaucug

SEQ ID NO: 2222555 - RNA, 16 nt, Human
gccccacacuggggug

SEQ ID NO: 2222556 - RNA, 19 nt, Human
gccccacacuggggugccg

SEQ ID NO: 2222557 - RNA, 11 nt, Human
gccccacagcc

SEQ ID NO: 2222558 - RNA, 22 nt, Human
gccccacacuggggugccgccu

SEQ ID NO: 2222559 - RNA, 23 nt, Human
gccccacacuggggugccgccug

SEQ ID NO: 2222560 - RNA, 19 nt, Human
gccccaaucccuuuauuac

SEQ ID NO: 2222561 - RNA, 21 nt, Human
gccccaaguccugaagaggcg

SEQ ID NO: 2222562 - RNA, 18 nt, Human
gccccaaucccuuuauua

SEQ ID NO: 2222563 - RNA, 16 nt, Human
gcccccgccccgcccc

SEQ ID NO: 2222564 - RNA, 14 nt, Human
gcccccggcccccu

SEQ ID NO: 2222565 - RNA, 13 nt, Human
gcccccggcggcg

SEQ ID NO: 2222566 - RNA, 15 nt, Human
gcccccggcggcgcc

SEQ ID NO: 2222567 - RNA, 13 nt, Human
gcccccgccccgc

SEQ ID NO: 2222568 - RNA, 16 nt, Human
gcccccgcccccggcg

SEQ ID NO: 2222569 - RNA, 20 nt, Human
gcccccgcuguaaugaaaca

SEQ ID NO: 2222570 - RNA, 18 nt, Human
gcccccgggccgacggag

SEQ ID NO: 2222571 - RNA, 16 nt, Human
gcccccuccgcccugc

SEQ ID NO: 2222572 - RNA, 15 nt, Human
gccccugccucucug

SEQ ID NO: 2222573 - RNA, 16 nt, Human
gccccugccucucugc

SEQ ID NO: 2222574 - RNA, 21 nt, Human
gccccugcugguucaggguug

SEQ ID NO: 2222575 - RNA, 14 nt, Human
gccccugcuucucc

SEQ ID NO: 2222576 - RNA, 15 nt, Human
gccccugcuucucca

SEQ ID NO: 2222577 - RNA, 22 nt, Human
gccccugcugguucaggguugg

SEQ ID NO: 2222578 - RNA, 17 nt, Human
gccccugccucucugca

SEQ ID NO: 2222579 - RNA, 18 nt, Human
gccccugccucucugcag

SEQ ID NO: 2222580 - RNA, 12 nt, Human
gcccucaucccg

SEQ ID NO: 2222581 - RNA, 16 nt, Human
gcccucauggccccuc

SEQ ID NO: 2222582 - RNA, 23 nt, Human
gcccucaggucagggugaggaug

SEQ ID NO: 2222583 - RNA, 22 nt, Human
gcccucaggucagggugaggau

SEQ ID NO: 2222584 - RNA, 19 nt, Human
gcccucagaacccuuggcu

SEQ ID NO: 2222585 - RNA, 19 nt, Human
gcccucaggggacuugaau

SEQ ID NO: 2222586 - RNA, 17 nt, Human
gcccuaggcuccgucag

SEQ ID NO: 2222587 - RNA, 21 nt, Human
gcccuagagccugccuggagc

SEQ ID NO: 2222588 - RNA, 13 nt, Human
gcccuauggaugu

SEQ ID NO: 2222589 - RNA, 14 nt, Human
gcccuauggaugug

SEQ ID NO: 2222590 - RNA, 11 nt, Human
gcccuaucugu

SEQ ID NO: 2222591 - RNA, 16 nt, Human
gcccucacccuggggc

SEQ ID NO: 2222592 - RNA, 17 nt, Human
gcccucacccuggggcu

SEQ ID NO: 2222593 - RNA, 14 nt, Human
gcccucagaacccu

SEQ ID NO: 2222594 - RNA, 15 nt, Human
gcccuauuuuugcaa

SEQ ID NO: 2222595 - RNA, 17 nt, Human
gcccuauuuuugcaaug

SEQ ID NO: 2222596 - RNA, 23 nt, Human
gcccucagaacccuuggcuugcc

SEQ ID NO: 2222597 - RNA, 18 nt, Human
gcccucagaacccuuggc

SEQ ID NO: 2222598 - RNA, 17 nt, Human
gcccucagaacccuugg

SEQ ID NO: 2222599 - RNA, 12 nt, Human
gcccuaggcucc

SEQ ID NO: 2222600 - RNA, 13 nt, Human
gcccuagcuccac

SEQ ID NO: 2222601 - RNA, 19 nt, Human
gcccuagagccugccugga

SEQ ID NO: 2222602 - RNA, 20 nt, Human
gcccuagagccugccuggag

SEQ ID NO: 2222603 - RNA, 23 nt, Human
gcccuagagccugccuggagcgu

SEQ ID NO: 2222604 - RNA, 21 nt, Human
gcccuagagcacacuguagca

SEQ ID NO: 2222605 - RNA, 13 nt, Human
gcccuagagccug

SEQ ID NO: 2222606 - RNA, 14 nt, Human
gcccuagagccugc

SEQ ID NO: 2222607 - RNA, 15 nt, Human
gcccuagagccugcc

SEQ ID NO: 2222608 - RNA, 16 nt, Human
gcccuagagccugccu

SEQ ID NO: 2222609 - RNA, 17 nt, Human
gcccuagagccugccug

SEQ ID NO: 2222610 - RNA, 18 nt, Human
gcccuagagccugccugg

SEQ ID NO: 2222611 - RNA, 15 nt, Human
gccccuggaugcagc

SEQ ID NO: 2222612 - RNA, 19 nt, Human
gccccuggacaagcagagg

SEQ ID NO: 2222613 - RNA, 16 nt, Human
gccccugcuucuccag

SEQ ID NO: 2222614 - RNA, 18 nt, Human
gccccugcuucuccagcc

SEQ ID NO: 2222615 - RNA, 19 nt, Human
gccccugcuucuccagccu

SEQ ID NO: 2222616 - RNA, 20 nt, Human
gccccugcuucuccagccug

SEQ ID NO: 2222617 - RNA, 20 nt, Human
gccagugugaucccaagugc

SEQ ID NO: 2222618 - RNA, 22 nt, Human
gccagugucugucccggggucc

SEQ ID NO: 2222619 - RNA, 17 nt, Human
gccagugugaucccaag

SEQ ID NO: 2222620 - RNA, 15 nt, Human
gccagugucuguccc

SEQ ID NO: 2222621 - RNA, 16 nt, Human
gccagugucugucccg

SEQ ID NO: 2222622 - RNA, 21 nt, Human
gccagugucugucccgggguc

SEQ ID NO: 2222623 - RNA, 13 nt, Human
gccaguugguccc

SEQ ID NO: 2222624 - RNA, 22 nt, Human
gccaguuauggcuauaggugcu

SEQ ID NO: 2222625 - RNA, 13 nt, Human
gccagugugacaa

SEQ ID NO: 2222626 - RNA, 13 nt, Human
gccagugucuguc

SEQ ID NO: 2222627 - RNA, 23 nt, Human
gccagugccuuaccuccugccca

SEQ ID NO: 2222628 - RNA, 22 nt, Human
gccagugccuuaccuccugccc

SEQ ID NO: 2222629 - RNA, 20 nt, Human
gccagugccuuaccuccugc

SEQ ID NO: 2222630 - RNA, 21 nt, Human
gccagugccuuaccuccugcc

SEQ ID NO: 2222631 - RNA, 23 nt, Human
gccaguggcuggaucugugaggg

SEQ ID NO: 2222632 - RNA, 14 nt, Human
gccaguggcuggau

SEQ ID NO: 2222633 - RNA, 18 nt, Human
gccaguugaauuuaugga

SEQ ID NO: 2222634 - RNA, 15 nt, Human
gccaguucaguaccu

SEQ ID NO: 2222635 - RNA, 20 nt, Human
gccaguucaguaccuggagg

SEQ ID NO: 2222636 - RNA, 21 nt, Human
gccaguucaguaccuggagga

SEQ ID NO: 2222637 - RNA, 22 nt, Human
gccaguucaguaccuggaggag

SEQ ID NO: 2222638 - RNA, 20 nt, Human
gccaguuuuguuuccuuuca

SEQ ID NO: 2222639 - RNA, 22 nt, Human
gccauaaaacagguaauauaaa

SEQ ID NO: 2222640 - RNA, 13 nt, Human
gccauaaaacauu

SEQ ID NO: 2222641 - RNA, 14 nt, Human
gccauaaaacauua

SEQ ID NO: 2222642 - RNA, 20 nt, Human
gccauaaaacauuaagaaaa

SEQ ID NO: 2222643 - RNA, 21 nt, Human
gccauaaaacauuaagaaaau

SEQ ID NO: 2222644 - RNA, 22 nt, Human
gccaguuggucccccuuccaug

SEQ ID NO: 2222645 - RNA, 23 nt, Human
gccaguuggucccccuuccaugg

SEQ ID NO: 2222646 - RNA, 16 nt, Human
gccaguuggucccccu

SEQ ID NO: 2222647 - RNA, 18 nt, Human
gccaguuggucccccuuc

SEQ ID NO: 2222648 - RNA, 20 nt, Human
gccaguuggucccccuucca

SEQ ID NO: 2222649 - RNA, 21 nt, Human
gccaguuggucccccuuccau

SEQ ID NO: 2222650 - RNA, 18 nt, Human
gccauagcuccugcucca

SEQ ID NO: 2222651 - RNA, 23 nt, Human
gccauagcuccugcuccacagcc

SEQ ID NO: 2222652 - RNA, 16 nt, Human
gccauagaguuuaaca

SEQ ID NO: 2222653 - RNA, 12 nt, Human
gccauagcuccu

SEQ ID NO: 2222654 - RNA, 15 nt, Human
gccauagcuccugcu

SEQ ID NO: 2222655 - RNA, 16 nt, Human
gccauacuuugucuga

SEQ ID NO: 2222656 - RNA, 23 nt, Human
gccauacuggccucgccuggccu

SEQ ID NO: 2222657 - RNA, 20 nt, Human
gccauacuuaucucucugug

SEQ ID NO: 2222658 - RNA, 21 nt, Human
gccauacuuaucucucugugc

SEQ ID NO: 2222659 - RNA, 22 nt, Human
gccauacuuaucucucugugcu

SEQ ID NO: 2222660 - RNA, 22 nt, Human
gccauaaaacauuaagaaaauc

SEQ ID NO: 2222661 - RNA, 13 nt, Human
gccauacuggccu

SEQ ID NO: 2222662 - RNA, 14 nt, Human
gccauacuggccuc

SEQ ID NO: 2222663 - RNA, 15 nt, Human
gccauacuggccucg

SEQ ID NO: 2222664 - RNA, 18 nt, Human
gccauacuuaucucucug

SEQ ID NO: 2222665 - RNA, 21 nt, Human
gccauacuggccucgccuggc

SEQ ID NO: 2222666 - RNA, 22 nt, Human
gccauacuggccucgccuggcc

SEQ ID NO: 2222667 - RNA, 17 nt, Human
gccauacuggccucgcc

SEQ ID NO: 2222668 - RNA, 18 nt, Human
gccauacuggccucgccu

SEQ ID NO: 2222669 - RNA, 19 nt, Human
gccauacuggccucgccug

SEQ ID NO: 2222670 - RNA, 20 nt, Human
gccauacuggccucgccugg

SEQ ID NO: 2222671 - RNA, 16 nt, Human
gccauaugaaaaggcu

SEQ ID NO: 2222672 - RNA, 16 nt, Human
gccauagucacauggc

SEQ ID NO: 2222673 - RNA, 16 nt, Human
gccauauaaguuugaa

SEQ ID NO: 2222674 - RNA, 17 nt, Human
gccauauaaguuugaag

SEQ ID NO: 2222675 - RNA, 18 nt, Human
gccauauaaguuugaagg

SEQ ID NO: 2222676 - RNA, 19 nt, Human
gccauauaaguuugaagga

SEQ ID NO: 2222677 - RNA, 22 nt, Human
gccauauaaguuugaaggaaac

SEQ ID NO: 2222678 - RNA, 19 nt, Human
gccauauacucuucaagga

SEQ ID NO: 2222679 - RNA, 23 nt, Human
gccauauaaguuugaaggaaaca

SEQ ID NO: 2222680 - RNA, 17 nt, Human
gccauauuuucaccauu

SEQ ID NO: 2222681 - RNA, 12 nt, Human
gccaggccagcu

SEQ ID NO: 2222682 - RNA, 14 nt, Human
gccaggccagccuc

SEQ ID NO: 2222683 - RNA, 15 nt, Human
gccaggccagccucc

SEQ ID NO: 2222684 - RNA, 12 nt, Human
gccaggccagcc

SEQ ID NO: 2222685 - RNA, 13 nt, Human
gccaggccagccu

SEQ ID NO: 2222686 - RNA, 22 nt, Human
gccaggccagagggagugacag

SEQ ID NO: 2222687 - RNA, 15 nt, Human
gccaggccagaggga

SEQ ID NO: 2222688 - RNA, 21 nt, Human
gccaggccacaagacccuugu

SEQ ID NO: 2222689 - RNA, 23 nt, Human
gccaggcagaucugugccccaug

SEQ ID NO: 2222690 - RNA, 21 nt, Human
gccaggcagaucugugcccca

SEQ ID NO: 2222691 - RNA, 15 nt, Human
gccaggcagaucugu

SEQ ID NO: 2222692 - RNA, 14 nt, Human
gccaggcagaucug

SEQ ID NO: 2222693 - RNA, 18 nt, Human
gccaggcaggugccugga

SEQ ID NO: 2222694 - RNA, 19 nt, Human
gccaggcagguagccaggg

SEQ ID NO: 2222695 - RNA, 14 nt, Human
gccaggcaggggug

SEQ ID NO: 2222696 - RNA, 15 nt, Human
gccaggcaggggugg

SEQ ID NO: 2222697 - RNA, 16 nt, Human
gccaggcagggguggg

SEQ ID NO: 2222698 - RNA, 17 nt, Human
gccaggcaggggugggg

SEQ ID NO: 2222699 - RNA, 13 nt, Human
gccaggccacaag

SEQ ID NO: 2222700 - RNA, 18 nt, Human
gccaggccacaagacccu

SEQ ID NO: 2222701 - RNA, 13 nt, Human
gccaggccccagg

SEQ ID NO: 2222702 - RNA, 13 nt, Human
gccaggccagcug

SEQ ID NO: 2222703 - RNA, 14 nt, Human
gccaggccccaggc

SEQ ID NO: 2222704 - RNA, 18 nt, Human
gccaggcccccaagccug

SEQ ID NO: 2222705 - RNA, 19 nt, Human
gccaggccagccuccgaga

SEQ ID NO: 2222706 - RNA, 18 nt, Human
gccaggcccggggcuggc

SEQ ID NO: 2222707 - RNA, 17 nt, Human
gccaggcccggggcugg

SEQ ID NO: 2222708 - RNA, 16 nt, Human
gccaggcccggggcug

SEQ ID NO: 2222709 - RNA, 19 nt, Human
gccaggcccccaagccugc

SEQ ID NO: 2222710 - RNA, 23 nt, Human
gccaggcccccaagccugcaguc

SEQ ID NO: 2222711 - RNA, 13 nt, Human
gccaggcccucug

SEQ ID NO: 2222712 - RNA, 14 nt, Human
gccaggcccucugc

SEQ ID NO: 2222713 - RNA, 15 nt, Human
gccagccccacccag

SEQ ID NO: 2222714 - RNA, 14 nt, Human
gccagccccaccca

SEQ ID NO: 2222715 - RNA, 13 nt, Human
gccagccccaccc

SEQ ID NO: 2222716 - RNA, 18 nt, Human
gccagccccacagcccac

SEQ ID NO: 2222717 - RNA, 19 nt, Human
gccagccccacagcccacg

SEQ ID NO: 2222718 - RNA, 17 nt, Human
gccagccccacccagga

SEQ ID NO: 2222719 - RNA, 22 nt, Human
gccaggauggaacacggccaca

SEQ ID NO: 2222720 - RNA, 14 nt, Human
gccaggauggaaug

SEQ ID NO: 2222721 - RNA, 19 nt, Human
gccaggcacccccuggaga

SEQ ID NO: 2222722 - RNA, 20 nt, Human
gccaggcacccccuggagag

SEQ ID NO: 2222723 - RNA, 21 nt, Human
gccaggcacccccuggagaga

SEQ ID NO: 2222724 - RNA, 23 nt, Human
gccaggcacacacugugcuuucu

SEQ ID NO: 2222725 - RNA, 15 nt, Human
gccaggcacacacug

SEQ ID NO: 2222726 - RNA, 17 nt, Human
gccaggcacacacugug

SEQ ID NO: 2222727 - RNA, 22 nt, Human
gccaggcacacacugugcuuuc

SEQ ID NO: 2222728 - RNA, 19 nt, Human
gccagccagcagccagcuc

SEQ ID NO: 2222729 - RNA, 16 nt, Human
gccagccagcagccag

SEQ ID NO: 2222730 - RNA, 11 nt, Human
gccagccaggc

SEQ ID NO: 2222731 - RNA, 13 nt, Human
gccagccaggcgg

SEQ ID NO: 2222732 - RNA, 18 nt, Human
gccagccaggcgggcuca

SEQ ID NO: 2222733 - RNA, 19 nt, Human
gccagccagugaccugagg

SEQ ID NO: 2222734 - RNA, 21 nt, Human
gccagccaggcgggcucaagg

SEQ ID NO: 2222735 - RNA, 22 nt, Human
gccagccagugaccugaggaag

SEQ ID NO: 2222736 - RNA, 13 nt, Human
gccagccaugucu

SEQ ID NO: 2222737 - RNA, 13 nt, Human
gccagcccagccc

SEQ ID NO: 2222738 - RNA, 14 nt, Human
gccagcccagccca

SEQ ID NO: 2222739 - RNA, 14 nt, Human
gccagccccacagc

SEQ ID NO: 2222740 - RNA, 15 nt, Human
gccagccccacagcc

SEQ ID NO: 2222741 - RNA, 16 nt, Human
gccagccccacagccc

SEQ ID NO: 2222742 - RNA, 17 nt, Human
gccagccccacagccca

SEQ ID NO: 2222743 - RNA, 22 nt, Human
gcuggagcccagggagcggaaa

SEQ ID NO: 2222744 - RNA, 16 nt, Human
gcuggagcccagggag

SEQ ID NO: 2222745 - RNA, 16 nt, Human
gcuggagccacuaacu

SEQ ID NO: 2222746 - RNA, 19 nt, Human
gcuggagccacuaacuaga

SEQ ID NO: 2222747 - RNA, 15 nt, Human
gcuggagccacuaac

SEQ ID NO: 2222748 - RNA, 10 nt, Human
gcuggagccu

SEQ ID NO: 2222749 - RNA, 21 nt, Human
gcuggagccuagaacaggccu

SEQ ID NO: 2222750 - RNA, 11 nt, Human
gcuggagccug

SEQ ID NO: 2222751 - RNA, 17 nt, Human
gcuggagccuggugccc

SEQ ID NO: 2222752 - RNA, 13 nt, Human
gcuggagccugug

SEQ ID NO: 2222753 - RNA, 14 nt, Human
gcuggagccugugu

SEQ ID NO: 2222754 - RNA, 21 nt, Human
gcuggagccuguguaacagcu

SEQ ID NO: 2222755 - RNA, 13 nt, Human
gcuggagagguua

SEQ ID NO: 2222756 - RNA, 12 nt, Human
gcuggagagguu

SEQ ID NO: 2222757 - RNA, 15 nt, Human
gcuggagauguuuua

SEQ ID NO: 2222758 - RNA, 20 nt, Human
gcugcuccccucccuccucu

SEQ ID NO: 2222759 - RNA, 12 nt, Human
gcugcuccccuc

SEQ ID NO: 2222760 - RNA, 19 nt, Human
gcugcuccccagcagcgga

SEQ ID NO: 2222761 - RNA, 16 nt, Human
gcugcuccccagcagc

SEQ ID NO: 2222762 - RNA, 15 nt, Human
gcugcuccuagaggg

SEQ ID NO: 2222763 - RNA, 17 nt, Human
gcugccccuggcagccc

SEQ ID NO: 2222764 - RNA, 17 nt, Human
gcugccauccagguuca

SEQ ID NO: 2222765 - RNA, 13 nt, Human
gcugccccuggca

SEQ ID NO: 2222766 - RNA, 15 nt, Human
gcugccccuggcagc

SEQ ID NO: 2222767 - RNA, 16 nt, Human
gcugccccuggcagcc

SEQ ID NO: 2222768 - RNA, 18 nt, Human
gcugcugaccuccacagc

SEQ ID NO: 2222769 - RNA, 16 nt, Human
gcugcuccuagaggga

SEQ ID NO: 2222770 - RNA, 18 nt, Human
gcugcuccuagagggagg

SEQ ID NO: 2222771 - RNA, 12 nt, Human
gcugcugacagu

SEQ ID NO: 2222772 - RNA, 16 nt, Human
gcugcugacugauguu

SEQ ID NO: 2222773 - RNA, 19 nt, Human
gcugcugaccuccacagcu

SEQ ID NO: 2222774 - RNA, 15 nt, Human
gcugcugucccuccc

SEQ ID NO: 2222775 - RNA, 16 nt, Human
gcugcugucccucccc

SEQ ID NO: 2222776 - RNA, 18 nt, Human
gcugcugucccucccccu

SEQ ID NO: 2222777 - RNA, 22 nt, Human
gcugcugucccucccccuuguc

SEQ ID NO: 2222778 - RNA, 23 nt, Human
gcugcugucccucccccuugucc

SEQ ID NO: 2222779 - RNA, 22 nt, Human
gcugagucaugaucucccugcc

SEQ ID NO: 2222780 - RNA, 21 nt, Human
gcugagucaugaucucccugc

SEQ ID NO: 2222781 - RNA, 17 nt, Human
gcugaguaggaggccuc

SEQ ID NO: 2222782 - RNA, 21 nt, Human
gcugaguauguuaagcucuuu

SEQ ID NO: 2222783 - RNA, 23 nt, Human
gcugagucaugaucucccugccg

SEQ ID NO: 2222784 - RNA, 21 nt, Human
gcugaggugucuuaagccuuu

SEQ ID NO: 2222785 - RNA, 13 nt, Human
gcugagguuccuc

SEQ ID NO: 2222786 - RNA, 16 nt, Human
gcugagguuccucugc

SEQ ID NO: 2222787 - RNA, 17 nt, Human
gcugagguuccucugcc

SEQ ID NO: 2222788 - RNA, 13 nt, Human
gcugaggcuggca

SEQ ID NO: 2222789 - RNA, 16 nt, Human
gcugaggcgggagaau

SEQ ID NO: 2222790 - RNA, 23 nt, Human
gcugaggcucugacccagugaga

SEQ ID NO: 2222791 - RNA, 18 nt, Human
gcugagguuccucugccu

SEQ ID NO: 2222792 - RNA, 19 nt, Human
gcugagguuccucugccug

SEQ ID NO: 2222793 - RNA, 20 nt, Human
gcugagguuccucugccugc

SEQ ID NO: 2222794 - RNA, 21 nt, Human
gcugagguuccucugccugcc

SEQ ID NO: 2222795 - RNA, 22 nt, Human
gcugagguuccucugccugccc

SEQ ID NO: 2222796 - RNA, 23 nt, Human
gcugagguuccucugccugcccc

SEQ ID NO: 2222797 - RNA, 21 nt, Human
gcugagguugcgccacuacac

SEQ ID NO: 2222798 - RNA, 15 nt, Human
gcugaggugggagga

SEQ ID NO: 2222799 - RNA, 17 nt, Human
gcugaggccugggccgc

SEQ ID NO: 2222800 - RNA, 20 nt, Human
gcugaggccugggccgcugc

SEQ ID NO: 2222801 - RNA, 23 nt, Human
gcugaggccugggccgcugccac

SEQ ID NO: 2222802 - RNA, 21 nt, Human
gcugaggccuuaucauucauu

SEQ ID NO: 2222803 - RNA, 15 nt, Human
gcugaggcgggagaa

SEQ ID NO: 2222804 - RNA, 23 nt, Human
gcugcaccaacccagccgcugcc

SEQ ID NO: 2222805 - RNA, 15 nt, Human
gcugcacccucaggc

SEQ ID NO: 2222806 - RNA, 13 nt, Human
gcugcacccucag

SEQ ID NO: 2222807 - RNA, 18 nt, Human
gcugcagagacagagagg

SEQ ID NO: 2222808 - RNA, 17 nt, Human
gcugcagaaggccaaga

SEQ ID NO: 2222809 - RNA, 19 nt, Human
gcugcagaaggccaagaau

SEQ ID NO: 2222810 - RNA, 20 nt, Human
gcugcagagcagugggccug

SEQ ID NO: 2222811 - RNA, 13 nt, Human
gcugcagagccac

SEQ ID NO: 2222812 - RNA, 19 nt, Human
gcugcagagccacccugug

SEQ ID NO: 2222813 - RNA, 21 nt, Human
gcugcagagcagugggccugg

SEQ ID NO: 2222814 - RNA, 16 nt, Human
gcugcacccucaggca

SEQ ID NO: 2222815 - RNA, 22 nt, Human
gcugcacucugugcccaugggc

SEQ ID NO: 2222816 - RNA, 20 nt, Human
gcugcacugaugcugccccu

SEQ ID NO: 2222817 - RNA, 23 nt, Human
gcugcacucugugcccaugggca

SEQ ID NO: 2222818 - RNA, 16 nt, Human
gcugcagaaggccaag

SEQ ID NO: 2222819 - RNA, 12 nt, Human
gcugcaggggcu

SEQ ID NO: 2222820 - RNA, 11 nt, Human
gcugcaggggc

SEQ ID NO: 2222821 - RNA, 13 nt, Human
gcugcaggggcuc

SEQ ID NO: 2222822 - RNA, 15 nt, Human
gcugcaggggcucug

SEQ ID NO: 2222823 - RNA, 16 nt, Human
gcugcaggggcucugg

SEQ ID NO: 2222824 - RNA, 17 nt, Human
gcugcaggggcucugga

SEQ ID NO: 2222825 - RNA, 20 nt, Human
gcugcaggggcucuggagag

SEQ ID NO: 2222826 - RNA, 12 nt, Human
gcugccauccag

SEQ ID NO: 2222827 - RNA, 13 nt, Human
gcugccauccagg

SEQ ID NO: 2222828 - RNA, 17 nt, Human
gcugcaggacuugagaa

SEQ ID NO: 2222829 - RNA, 21 nt, Human
gcugcagaggggcaggcccug

SEQ ID NO: 2222830 - RNA, 20 nt, Human
gcugcagaggggcaggcccu

SEQ ID NO: 2222831 - RNA, 15 nt, Human
gcugcagcucaccca

SEQ ID NO: 2222832 - RNA, 21 nt, Human
gcugcagccugcgccaccgcc

SEQ ID NO: 2222833 - RNA, 16 nt, Human
gcugcagccugcgcca

SEQ ID NO: 2222834 - RNA, 15 nt, Human
gcugcagaggggcag

SEQ ID NO: 2222835 - RNA, 19 nt, Human
gcugcagaggggcaggccc

SEQ ID NO: 2222836 - RNA, 15 nt, Human
gcugcagaggccaga

SEQ ID NO: 2222837 - RNA, 18 nt, Human
gcugcagaggccagaggc

SEQ ID NO: 2222838 - RNA, 22 nt, Human
gcugcagaggccagaggccccc

SEQ ID NO: 2222839 - RNA, 12 nt, Human
gcugcagagggg

SEQ ID NO: 2222840 - RNA, 13 nt, Human
gcugcagaggggc

SEQ ID NO: 2222841 - RNA, 20 nt, Human
gcucucaggccagcugcuug

SEQ ID NO: 2222842 - RNA, 19 nt, Human
gcucucaggccagcugcuu

SEQ ID NO: 2222843 - RNA, 17 nt, Human
gcucucaggccagcugc

SEQ ID NO: 2222844 - RNA, 18 nt, Human
gcucucaggccagcugcu

SEQ ID NO: 2222845 - RNA, 21 nt, Human
gcucuacuggucuuguggaau

SEQ ID NO: 2222846 - RNA, 19 nt, Human
gcucuacccagggccugca

SEQ ID NO: 2222847 - RNA, 18 nt, Human
gcucuacccagggccugc

SEQ ID NO: 2222848 - RNA, 19 nt, Human
gcucuagacaacccugcaa

SEQ ID NO: 2222849 - RNA, 18 nt, Human
gcucuagacaacccugca

SEQ ID NO: 2222850 - RNA, 16 nt, Human
gcucuagacaacccug

SEQ ID NO: 2222851 - RNA, 19 nt, Human
gcucuacugaggugcuaug

SEQ ID NO: 2222852 - RNA, 15 nt, Human
gcucuacccagggcc

SEQ ID NO: 2222853 - RNA, 14 nt, Human
gcucuacccagggc

SEQ ID NO: 2222854 - RNA, 19 nt, Human
gcucuacaucuucugccuu

SEQ ID NO: 2222855 - RNA, 20 nt, Human
gcucuacaucuucugccuua

SEQ ID NO: 2222856 - RNA, 16 nt, Human
gcuccucuccccagca

SEQ ID NO: 2222857 - RNA, 19 nt, Human
gcuccucuccccagcaagu

SEQ ID NO: 2222858 - RNA, 23 nt, Human
gcuccucuccccagcccagagac

SEQ ID NO: 2222859 - RNA, 18 nt, Human
gcucuacaucuucugccu

SEQ ID NO: 2222860 - RNA, 22 nt, Human
gcuccucuccccagcccagaga

SEQ ID NO: 2222861 - RNA, 21 nt, Human
gcuccucuccccagcccagag

SEQ ID NO: 2222862 - RNA, 20 nt, Human
gcuccucuccccagcccaga

SEQ ID NO: 2222863 - RNA, 19 nt, Human
gcuccucuccccagcccag

SEQ ID NO: 2222864 - RNA, 18 nt, Human
gcuccucuccccagccca

SEQ ID NO: 2222865 - RNA, 16 nt, Human
gcuccucuccccagcc

SEQ ID NO: 2222866 - RNA, 14 nt, Human
gcucuagccugggc

SEQ ID NO: 2222867 - RNA, 14 nt, Human
gcucuagguggggc

SEQ ID NO: 2222868 - RNA, 14 nt, Human
gcucuagugggaag

SEQ ID NO: 2222869 - RNA, 21 nt, Human
gcucuagccugggcaacaaca

SEQ ID NO: 2222870 - RNA, 23 nt, Human
gcucuagauugagagaagagaca

SEQ ID NO: 2222871 - RNA, 16 nt, Human
gcucuauguuuacaaa

SEQ ID NO: 2222872 - RNA, 15 nt, Human
gcucuauguuuacaa

SEQ ID NO: 2222873 - RNA, 18 nt, Human
gcucuaugggcagaucua

SEQ ID NO: 2222874 - RNA, 21 nt, Human
gcucuaugggcagaucuaccc

SEQ ID NO: 2222875 - RNA, 15 nt, Human
gcucuagugccuucu

SEQ ID NO: 2222876 - RNA, 12 nt, Human
gcucuagugccu

SEQ ID NO: 2222877 - RNA, 19 nt, Human
gcucuaucuugcucuguaa

SEQ ID NO: 2222878 - RNA, 21 nt, Human
gcucuaucuugcucuguaauc

SEQ ID NO: 2222879 - RNA, 22 nt, Human
gcucuaucuugcucuguaaucu

SEQ ID NO: 2222880 - RNA, 18 nt, Human
gcucucaaguuaucaggg

SEQ ID NO: 2222881 - RNA, 19 nt, Human
gcucucaacccaggagcau

SEQ ID NO: 2222882 - RNA, 17 nt, Human
gcucuauuguagcauuu

SEQ ID NO: 2222883 - RNA, 12 nt, Human
gcucucagaagg

SEQ ID NO: 2222884 - RNA, 16 nt, Human
gcucucagcucagcgc

SEQ ID NO: 2222885 - RNA, 18 nt, Human
gcucucagcucagcgcca

SEQ ID NO: 2222886 - RNA, 17 nt, Human
gcucucagccaacgagu

SEQ ID NO: 2222887 - RNA, 11 nt, Human
gcucucagcca

SEQ ID NO: 2222888 - RNA, 10 nt, Human
gcucucagcc

SEQ ID NO: 2222889 - RNA, 13 nt, Human
gcucucagaagcc

SEQ ID NO: 2222890 - RNA, 11 nt, Human
gcucucagaag

SEQ ID NO: 2222891 - RNA, 13 nt, Human
gcucccagugucu

SEQ ID NO: 2222892 - RNA, 18 nt, Human
gcucccagugucuuccug

SEQ ID NO: 2222893 - RNA, 19 nt, Human
gcucccagugucuuccugu

SEQ ID NO: 2222894 - RNA, 20 nt, Human
gcucccagugucuuccugug

SEQ ID NO: 2222895 - RNA, 11 nt, Human
gcucccaggcc

SEQ ID NO: 2222896 - RNA, 12 nt, Human
gcucccaggccg

SEQ ID NO: 2222897 - RNA, 22 nt, Human
gcucccaggccgagaagccagu

SEQ ID NO: 2222898 - RNA, 23 nt, Human
gcucccaggccgagaagccagug

SEQ ID NO: 2222899 - RNA, 17 nt, Human
gcuccagcucaccagcc

SEQ ID NO: 2222900 - RNA, 23 nt, Human
gcucccaggcauuccccaggagg

SEQ ID NO: 2222901 - RNA, 13 nt, Human
gcuccagcucacc

SEQ ID NO: 2222902 - RNA, 14 nt, Human
gcuccagcucacca

SEQ ID NO: 2222903 - RNA, 23 nt, Human
gcuccagccaaccccuguggagc

SEQ ID NO: 2222904 - RNA, 22 nt, Human
gcuccagccaaccccuguggag

SEQ ID NO: 2222905 - RNA, 18 nt, Human
gcuccagccaaccccugu

SEQ ID NO: 2222906 - RNA, 17 nt, Human
gcuccagccaaccccug

SEQ ID NO: 2222907 - RNA, 16 nt, Human
gcuccagccaaccccu

SEQ ID NO: 2222908 - RNA, 14 nt, Human
gcuccagccaaccc

SEQ ID NO: 2222909 - RNA, 19 nt, Human
gcuccagcaccauccgcca

SEQ ID NO: 2222910 - RNA, 15 nt, Human
gcuccagccuggcuc

SEQ ID NO: 2222911 - RNA, 19 nt, Human
gcuccucccggugcccaag

SEQ ID NO: 2222912 - RNA, 15 nt, Human
gcucccauuucuacu

SEQ ID NO: 2222913 - RNA, 21 nt, Human
gcucccauucacucuuccaga

SEQ ID NO: 2222914 - RNA, 17 nt, Human
gcuccucccucugaggc

SEQ ID NO: 2222915 - RNA, 16 nt, Human
gcuccucccggugccc

SEQ ID NO: 2222916 - RNA, 20 nt, Human
gcucccauucacucuuccag

SEQ ID NO: 2222917 - RNA, 22 nt, Human
gcucccagugucuuccuguggg

SEQ ID NO: 2222918 - RNA, 23 nt, Human
gcucccagugucuuccugugggg

SEQ ID NO: 2222919 - RNA, 19 nt, Human
gcuccucccucugaggcug

SEQ ID NO: 2222920 - RNA, 20 nt, Human
gcuccucccucugaggcugu

SEQ ID NO: 2222921 - RNA, 21 nt, Human
gcuccucccucugaggcugua

SEQ ID NO: 2222922 - RNA, 22 nt, Human
gcuccucccucugaggcuguag

SEQ ID NO: 2222923 - RNA, 13 nt, Human
gcuccucccuggc

SEQ ID NO: 2222924 - RNA, 14 nt, Human
gcuccucccuggcu

SEQ ID NO: 2222925 - RNA, 15 nt, Human
gcuccucccuggcug

SEQ ID NO: 2222926 - RNA, 16 nt, Human
gcuccucccuggcugc

SEQ ID NO: 2222927 - RNA, 17 nt, Human
gcuccucccuggcugcc

SEQ ID NO: 2222928 - RNA, 18 nt, Human
gcuccucccuggcugccc

SEQ ID NO: 2222929 - RNA, 19 nt, Human
gcuccucccuggcugcccu

SEQ ID NO: 2222930 - RNA, 20 nt, Human
gcuccucccuggcugcccug

SEQ ID NO: 2222931 - RNA, 21 nt, Human
gcuccucccuggcugcccugg

SEQ ID NO: 2222932 - RNA, 22 nt, Human
gcuccucccuggcugcccuggc

SEQ ID NO: 2222933 - RNA, 23 nt, Human
gcuccucccuggcugcccuggcc

SEQ ID NO: 2222934 - RNA, 15 nt, Human
gcuccucuccccagc

SEQ ID NO: 2222935 - RNA, 12 nt, Human
gcuccucucagu

SEQ ID NO: 2222936 - RNA, 12 nt, Human
gcuccucuccag

SEQ ID NO: 2222937 - RNA, 13 nt, Human
gcuccucuccagg

SEQ ID NO: 2222938 - RNA, 14 nt, Human
gcuccucuccaggc

SEQ ID NO: 2222939 - RNA, 15 nt, Human
gcuccucuccaggca

SEQ ID NO: 2222940 - RNA, 16 nt, Human
gcuccucuccaggcac

SEQ ID NO: 2222941 - RNA, 17 nt, Human
gcuccucuccaggcacc

SEQ ID NO: 2222942 - RNA, 22 nt, Human
gcuccucuccaggcacccuucu

SEQ ID NO: 2222943 - RNA, 15 nt, Human
gcuccuccucccugc

SEQ ID NO: 2222944 - RNA, 14 nt, Human
gcuccuccucccug

SEQ ID NO: 2222945 - RNA, 14 nt, Human
gcuccuccgugcuu

SEQ ID NO: 2222946 - RNA, 20 nt, Human
gcuccuccgugcuuccucag

SEQ ID NO: 2222947 - RNA, 18 nt, Human
gcuccuccucccugcauc

SEQ ID NO: 2222948 - RNA, 16 nt, Human
gcuccuccucccugca

SEQ ID NO: 2222949 - RNA, 20 nt, Human
gcuccuccucccugcaucug

SEQ ID NO: 2222950 - RNA, 15 nt, Human
gcuccucgagggcag

SEQ ID NO: 2222951 - RNA, 17 nt, Human
gcuccucgagggcaggg

SEQ ID NO: 2222952 - RNA, 18 nt, Human
gcuccucgagggcaggga

SEQ ID NO: 2222953 - RNA, 20 nt, Human
gcuccucgagggcagggacu

SEQ ID NO: 2222954 - RNA, 9 nt, Human
gcuccagac

SEQ ID NO: 2222955 - RNA, 20 nt, Human
gcuccacuuggucugugaga

SEQ ID NO: 2222956 - RNA, 23 nt, Human
gcuccagacccccagcaacccuc

SEQ ID NO: 2222957 - RNA, 17 nt, Human
gcuccagacccccagca

SEQ ID NO: 2222958 - RNA, 12 nt, Human
gcuccagaccug

SEQ ID NO: 2222959 - RNA, 20 nt, Human
gcuccagaccugauccugga

SEQ ID NO: 2222960 - RNA, 13 nt, Human
gcuccagaccuga

SEQ ID NO: 2222961 - RNA, 22 nt, Human
gcuccagaccugauccuggagg

SEQ ID NO: 2222962 - RNA, 21 nt, Human
gcuccagaccugauccuggag

SEQ ID NO: 2222963 - RNA, 23 nt, Human
gcuccagaccugauccuggaggc

SEQ ID NO: 2222964 - RNA, 12 nt, Human
gcuccagagggc

SEQ ID NO: 2222965 - RNA, 22 nt, Human
gcuccagaugcagggcagucau

SEQ ID NO: 2222966 - RNA, 22 nt, Human
gcuccagacguaggggaggggu

SEQ ID NO: 2222967 - RNA, 21 nt, Human
gcuccagaugcagggcaguca

SEQ ID NO: 2222968 - RNA, 19 nt, Human
gcuccagaugcagggcagu

SEQ ID NO: 2222969 - RNA, 18 nt, Human
gcuccagaugcagggcag

SEQ ID NO: 2222970 - RNA, 17 nt, Human
gcuccagaugcagggca

SEQ ID NO: 2222971 - RNA, 21 nt, Human
gcuccagagggcacucugcuu

SEQ ID NO: 2222972 - RNA, 20 nt, Human
gcuccagagggcacucugcu

SEQ ID NO: 2222973 - RNA, 14 nt, Human
gcuccagaccccca

SEQ ID NO: 2222974 - RNA, 15 nt, Human
gcuccagacccccag

SEQ ID NO: 2222975 - RNA, 20 nt, Human
gcuccagaaaugucuaaaug

SEQ ID NO: 2222976 - RNA, 23 nt, Human
gcuccagacacauguccaagaag

SEQ ID NO: 2222977 - RNA, 18 nt, Human
gcuccagacacaugucca

SEQ ID NO: 2222978 - RNA, 21 nt, Human
gcuccagacacauguccaaga

SEQ ID NO: 2222979 - RNA, 19 nt, Human
gcugaaaaaucacauccug

SEQ ID NO: 2222980 - RNA, 11 nt, Human
gcugaaaauau

SEQ ID NO: 2222981 - RNA, 20 nt, Human
gcugaaaaaucacauccugg

SEQ ID NO: 2222982 - RNA, 16 nt, Human
gcucuguguugccaug

SEQ ID NO: 2222983 - RNA, 23 nt, Human
gcucugugggcugcacucugugc

SEQ ID NO: 2222984 - RNA, 24 nt, Human
gcucugugggcugcacucugugcc

SEQ ID NO: 2222985 - RNA, 14 nt, Human
gcucugugcaguca

SEQ ID NO: 2222986 - RNA, 19 nt, Human
gcucugugcagucacugga

SEQ ID NO: 2222987 - RNA, 21 nt, Human
gcucugugcagucacuggagg

SEQ ID NO: 2222988 - RNA, 14 nt, Human
gcucugugcugacc

SEQ ID NO: 2222989 - RNA, 15 nt, Human
gcucugugcugaccc

SEQ ID NO: 2222990 - RNA, 16 nt, Human
gcucugugcugacccu

SEQ ID NO: 2222991 - RNA, 18 nt, Human
gcucugugcugacccucc

SEQ ID NO: 2222992 - RNA, 22 nt, Human
gcucugugcugacccuccuguu

SEQ ID NO: 2222993 - RNA, 19 nt, Human
gcucugugcugacccuccu

SEQ ID NO: 2222994 - RNA, 21 nt, Human
gcucugugcugacccuccugu

SEQ ID NO: 2222995 - RNA, 12 nt, Human
gcucugugggcu

SEQ ID NO: 2222996 - RNA, 14 nt, Human
gcucugugggcugc

SEQ ID NO: 2222997 - RNA, 17 nt, Human
gcugaaacaggagagaa

SEQ ID NO: 2222998 - RNA, 16 nt, Human
gcugaaacaggagaga

SEQ ID NO: 2222999 - RNA, 23 nt, Human
gcugaaagaacauggacuuguau

SEQ ID NO: 2223000 - RNA, 16 nt, Human
gcugaaacagaauacu

SEQ ID NO: 2223001 - RNA, 20 nt, Human
gcugaaaaccuaaguccuuu

SEQ ID NO: 2223002 - RNA, 16 nt, Human
gcugaaacaacaaaua

SEQ ID NO: 2223003 - RNA, 13 nt, Human
gcugaaagccauu

SEQ ID NO: 2223004 - RNA, 18 nt, Human
gcugaaacaggagagaaa

SEQ ID NO: 2223005 - RNA, 23 nt, Human
gcugaacacuccaauuaaggauu

SEQ ID NO: 2223006 - RNA, 13 nt, Human
gcugaacagugga

SEQ ID NO: 2223007 - RNA, 22 nt, Human
gcugaacaguggaggaagaggg

SEQ ID NO: 2223008 - RNA, 17 nt, Human
gcugaacauugcauaua

SEQ ID NO: 2223009 - RNA, 15 nt, Human
gcugaacauugcaua

SEQ ID NO: 2223010 - RNA, 18 nt, Human
gcucuggugacaccagcc

SEQ ID NO: 2223011 - RNA, 15 nt, Human
gcucuggagagaaac

SEQ ID NO: 2223012 - RNA, 20 nt, Human
gcucuggugacaccagccuu

SEQ ID NO: 2223013 - RNA, 19 nt, Human
gcucuggugacaccagccu

SEQ ID NO: 2223014 - RNA, 18 nt, Human
gcucuguaaucucguuuc

SEQ ID NO: 2223015 - RNA, 19 nt, Human
gcucuguaaucucguuuca

SEQ ID NO: 2223016 - RNA, 23 nt, Human
gcucuguaaucucguuucaaaaa

SEQ ID NO: 2223017 - RNA, 17 nt, Human
gcucuggagcccacugu

SEQ ID NO: 2223018 - RNA, 19 nt, Human
gcucuggagacagccccag

SEQ ID NO: 2223019 - RNA, 20 nt, Human
gcucuggagacagccccaga

SEQ ID NO: 2223020 - RNA, 13 nt, Human
gcucuggagagaa

SEQ ID NO: 2223021 - RNA, 14 nt, Human
gcucuggagagaaa

SEQ ID NO: 2223022 - RNA, 14 nt, Human
gcucugugcaggga

SEQ ID NO: 2223023 - RNA, 17 nt, Human
gcucugugcccacccuc

SEQ ID NO: 2223024 - RNA, 23 nt, Human
gcucugucgcccaggcuggagug

SEQ ID NO: 2223025 - RNA, 16 nt, Human
gcucugucacccaggc

SEQ ID NO: 2223026 - RNA, 23 nt, Human
gcucuguaucaggacccagagga

SEQ ID NO: 2223027 - RNA, 22 nt, Human
gcucuguaucaggacccagagg

SEQ ID NO: 2223028 - RNA, 19 nt, Human
gcucuguaucaggacccag

SEQ ID NO: 2223029 - RNA, 18 nt, Human
gcucuguaucaggaccca

SEQ ID NO: 2223030 - RNA, 23 nt, Human
gcugacaaccaccgcuccccagc

SEQ ID NO: 2223031 - RNA, 22 nt, Human
gcugacaaccaccgcuccccag

SEQ ID NO: 2223032 - RNA, 21 nt, Human
gcugacaaccaccgcucccca

SEQ ID NO: 2223033 - RNA, 17 nt, Human
gcugacacaaaccugcc

SEQ ID NO: 2223034 - RNA, 18 nt, Human
gcugacacaaaccugccu

SEQ ID NO: 2223035 - RNA, 19 nt, Human
gcugacacaaaccugccug

SEQ ID NO: 2223036 - RNA, 20 nt, Human
gcugacacaaaccugccugg

SEQ ID NO: 2223037 - RNA, 19 nt, Human
gcugacaaccaccgcuccc

SEQ ID NO: 2223038 - RNA, 21 nt, Human
gcugaauuuucacaugaacau

SEQ ID NO: 2223039 - RNA, 18 nt, Human
gcugaauaaaugucuuuu

SEQ ID NO: 2223040 - RNA, 14 nt, Human
gcugaauuuucaca

SEQ ID NO: 2223041 - RNA, 12 nt, Human
gcugaauuuuca

SEQ ID NO: 2223042 - RNA, 17 nt, Human
gcugaauacagaggcaa

SEQ ID NO: 2223043 - RNA, 13 nt, Human
gcugaauaaaugu

SEQ ID NO: 2223044 - RNA, 14 nt, Human
gcugaauaaauguc

SEQ ID NO: 2223045 - RNA, 16 nt, Human
gcugaauaaaugucuu

SEQ ID NO: 2223046 - RNA, 17 nt, Human
gcugaauaaaugucuuu

SEQ ID NO: 2223047 - RNA, 17 nt, Human
gcugaacggggagaaaa

SEQ ID NO: 2223048 - RNA, 16 nt, Human
gcugaacggggagaaa

SEQ ID NO: 2223049 - RNA, 20 nt, Human
gcugaacccugugcuggugu

SEQ ID NO: 2223050 - RNA, 21 nt, Human
gcugaacccugugcugguguc

SEQ ID NO: 2223051 - RNA, 22 nt, Human
gcugaacccauuuugagugacu

SEQ ID NO: 2223052 - RNA, 13 nt, Human
gcugaacccugug

SEQ ID NO: 2223053 - RNA, 16 nt, Human
gcugaacccugugcug

SEQ ID NO: 2223054 - RNA, 17 nt, Human
gcugaacccugugcugg

SEQ ID NO: 2223055 - RNA, 18 nt, Human
gcugaagaugaaucaaug

SEQ ID NO: 2223056 - RNA, 15 nt, Human
gcugaacucaugaga

SEQ ID NO: 2223057 - RNA, 20 nt, Human
gcugaacuuguuuucuggga

SEQ ID NO: 2223058 - RNA, 23 nt, Human
gcugaaggcucgagcaugccugg

SEQ ID NO: 2223059 - RNA, 20 nt, Human
gcugaagugcauccaaaggu

SEQ ID NO: 2223060 - RNA, 12 nt, Human
gcugaauaaaug

SEQ ID NO: 2223061 - RNA, 13 nt, Human
gcugaagauggca

SEQ ID NO: 2223062 - RNA, 20 nt, Human
gcugaagggaccuugaaggg

SEQ ID NO: 2223063 - RNA, 15 nt, Human
gcugaagguugaaga

SEQ ID NO: 2223064 - RNA, 16 nt, Human
gcugaagguugaagag

SEQ ID NO: 2223065 - RNA, 14 nt, Human
gcugagcccuggca

SEQ ID NO: 2223066 - RNA, 13 nt, Human
gcugagcccuggc

SEQ ID NO: 2223067 - RNA, 19 nt, Human
gcugacacguccaccccag

SEQ ID NO: 2223068 - RNA, 21 nt, Human
gcugacacaaaccugccuggg

SEQ ID NO: 2223069 - RNA, 13 nt, Human
gcugacagacaca

SEQ ID NO: 2223070 - RNA, 16 nt, Human
gcugagcccuggcagg

SEQ ID NO: 2223071 - RNA, 15 nt, Human
gcugagcccuggcag

SEQ ID NO: 2223072 - RNA, 12 nt, Human
gcugagccucag

SEQ ID NO: 2223073 - RNA, 16 nt, Human
gcugagccucagucuc

SEQ ID NO: 2223074 - RNA, 14 nt, Human
gcugagccucucac

SEQ ID NO: 2223075 - RNA, 14 nt, Human
gcugagccuggcug

SEQ ID NO: 2223076 - RNA, 15 nt, Human
gcugagccuggcugg

SEQ ID NO: 2223077 - RNA, 14 nt, Human
gcugaggccucuca

SEQ ID NO: 2223078 - RNA, 20 nt, Human
gcugagccucugcuccccag

SEQ ID NO: 2223079 - RNA, 19 nt, Human
gcugagccucugcucccca

SEQ ID NO: 2223080 - RNA, 13 nt, Human
gcugagccucugc

SEQ ID NO: 2223081 - RNA, 12 nt, Human
gcugaggccugg

SEQ ID NO: 2223082 - RNA, 13 nt, Human
gcugaggccugga

SEQ ID NO: 2223083 - RNA, 14 nt, Human
gcugaggccuggac

SEQ ID NO: 2223084 - RNA, 21 nt, Human
gcugaggccuggacuuuccug

SEQ ID NO: 2223085 - RNA, 13 nt, Human
gcugaggccuggg

SEQ ID NO: 2223086 - RNA, 14 nt, Human
gcugaggccugggc

SEQ ID NO: 2223087 - RNA, 15 nt, Human
gcugaggccugggcc

SEQ ID NO: 2223088 - RNA, 16 nt, Human
gcugaggccugggccg

SEQ ID NO: 2223089 - RNA, 15 nt, Human
gcucugaaagccagc

SEQ ID NO: 2223090 - RNA, 16 nt, Human
gcucugaaaccagugu

SEQ ID NO: 2223091 - RNA, 19 nt, Human
gcucucuggccuuuuccua

SEQ ID NO: 2223092 - RNA, 19 nt, Human
gcucucugugggcuggcag

SEQ ID NO: 2223093 - RNA, 20 nt, Human
gcucugaucauccacugugc

SEQ ID NO: 2223094 - RNA, 22 nt, Human
gcucugaagucacaucacagga

SEQ ID NO: 2223095 - RNA, 17 nt, Human
gcucugaaagccagcug

SEQ ID NO: 2223096 - RNA, 23 nt, Human
gcucugaagucacaucacaggac

SEQ ID NO: 2223097 - RNA, 21 nt, Human
gcucugaauuaguccuugcuu

SEQ ID NO: 2223098 - RNA, 20 nt, Human
gcucucugugggcuggcagu

SEQ ID NO: 2223099 - RNA, 14 nt, Human
gcucuggagacagc

SEQ ID NO: 2223100 - RNA, 18 nt, Human
gcucuggagacagcccca

SEQ ID NO: 2223101 - RNA, 21 nt, Human
gcucugcccauccugccccug

SEQ ID NO: 2223102 - RNA, 15 nt, Human
gcucuggagcccacu

SEQ ID NO: 2223103 - RNA, 16 nt, Human
gcucuggagcccacug

SEQ ID NO: 2223104 - RNA, 21 nt, Human
gcucugaucauccacugugcc

SEQ ID NO: 2223105 - RNA, 22 nt, Human
gcucugaucauccacugugcca

SEQ ID NO: 2223106 - RNA, 16 nt, Human
gcucugacagaaagca

SEQ ID NO: 2223107 - RNA, 23 nt, Human
gcucugccacccuaccuguucag

SEQ ID NO: 2223108 - RNA, 18 nt, Human
gcucugccacccuaccug

SEQ ID NO: 2223109 - RNA, 22 nt, Human
gcucugccacccuaccuguuca

SEQ ID NO: 2223110 - RNA, 15 nt, Human
gcucugcccauccug

SEQ ID NO: 2223111 - RNA, 14 nt, Human
ggaagaauuuuaaa

SEQ ID NO: 2223112 - RNA, 19 nt, Human
ggaagaauuuuaaaaauga

SEQ ID NO: 2223113 - RNA, 15 nt, Human
ggaagaccccaccca

SEQ ID NO: 2223114 - RNA, 19 nt, Human
ggaagaccccacccaagcu

SEQ ID NO: 2223115 - RNA, 23 nt, Human
ggaagaccccacccaagcuuggc

SEQ ID NO: 2223116 - RNA, 18 nt, Human
ggaagaagggagaagaaa

SEQ ID NO: 2223117 - RNA, 17 nt, Human
ggaagacuucaucccuc

SEQ ID NO: 2223118 - RNA, 20 nt, Human
ggaagacuucaucccucugg

SEQ ID NO: 2223119 - RNA, 16 nt, Human
ggaagacgaggcccuc

SEQ ID NO: 2223120 - RNA, 16 nt, Human
ggaagacgccugagcu

SEQ ID NO: 2223121 - RNA, 15 nt, Human
ggaagacgccugagc

SEQ ID NO: 2223122 - RNA, 14 nt, Human
ggaagaccuggcaa

SEQ ID NO: 2223123 - RNA, 15 nt, Human
ggaagacgaggcccu

SEQ ID NO: 2223124 - RNA, 17 nt, Human
ggaacugaacauuccag

SEQ ID NO: 2223125 - RNA, 19 nt, Human
ggaacacuccuucacagau

SEQ ID NO: 2223126 - RNA, 15 nt, Human
ggaacacuccuucac

SEQ ID NO: 2223127 - RNA, 15 nt, Human
ggaacugcaugcugc

SEQ ID NO: 2223128 - RNA, 21 nt, Human
ggaacugcagaccuguccucc

SEQ ID NO: 2223129 - RNA, 15 nt, Human
ggaacugcagaccug

SEQ ID NO: 2223130 - RNA, 17 nt, Human
ggaacugcagaccuguc

SEQ ID NO: 2223131 - RNA, 16 nt, Human
ggaacugcaugcugcu

SEQ ID NO: 2223132 - RNA, 20 nt, Human
ggaacucuggcuuccaggua

SEQ ID NO: 2223133 - RNA, 19 nt, Human
ggaacucuggcuuccaggu

SEQ ID NO: 2223134 - RNA, 13 nt, Human
ggaacugcagacc

SEQ ID NO: 2223135 - RNA, 14 nt, Human
ggaacugcagaccu

SEQ ID NO: 2223136 - RNA, 17 nt, Human
ggaacaccauaggucac

SEQ ID NO: 2223137 - RNA, 14 nt, Human
ggaacacggccaca

SEQ ID NO: 2223138 - RNA, 13 nt, Human
ggaacaccuccuc

SEQ ID NO: 2223139 - RNA, 13 nt, Human
ggaacaaucuaaa

SEQ ID NO: 2223140 - RNA, 14 nt, Human
ggaacacacuugga

SEQ ID NO: 2223141 - RNA, 23 nt, Human
ggaacaaggcaaggcugucaauu

SEQ ID NO: 2223142 - RNA, 16 nt, Human
ggaagaacauagaacu

SEQ ID NO: 2223143 - RNA, 14 nt, Human
ggaagaacauagaa

SEQ ID NO: 2223144 - RNA, 13 nt, Human
ggaagaacauaga

SEQ ID NO: 2223145 - RNA, 23 nt, Human
ggaagaaauuccuguagcaucuu

SEQ ID NO: 2223146 - RNA, 11 nt, Human
ggaagaacacc

SEQ ID NO: 2223147 - RNA, 18 nt, Human
ggaagaaauuccuguagc

SEQ ID NO: 2223148 - RNA, 19 nt, Human
ggaagaaauuccuguagca

SEQ ID NO: 2223149 - RNA, 14 nt, Human
ggaagaaaagagcu

SEQ ID NO: 2223150 - RNA, 16 nt, Human
ggaagaaagagaagga

SEQ ID NO: 2223151 - RNA, 19 nt, Human
ggaagaaagagaaggagcc

SEQ ID NO: 2223152 - RNA, 16 nt, Human
ggaagaaauuccugua

SEQ ID NO: 2223153 - RNA, 15 nt, Human
ggaacugcugggcuu

SEQ ID NO: 2223154 - RNA, 23 nt, Human
ggaacuuggggaguuaagaccug

SEQ ID NO: 2223155 - RNA, 14 nt, Human
ggaacugcugggcu

SEQ ID NO: 2223156 - RNA, 16 nt, Human
ggaagacaaugugaaa

SEQ ID NO: 2223157 - RNA, 14 nt, Human
ggaagacaauguga

SEQ ID NO: 2223158 - RNA, 21 nt, Human
ggaagaacggggcucuucuca

SEQ ID NO: 2223159 - RNA, 15 nt, Human
ggaagaagagggaga

SEQ ID NO: 2223160 - RNA, 16 nt, Human
ggaagaagagggagag

SEQ ID NO: 2223161 - RNA, 18 nt, Human
ggaagaagcuuaggcagg

SEQ ID NO: 2223162 - RNA, 19 nt, Human
ggaagaagcuuaggcaggg

SEQ ID NO: 2223163 - RNA, 13 nt, Human
ggaagaagggaga

SEQ ID NO: 2223164 - RNA, 14 nt, Human
ggaagaagggagaa

SEQ ID NO: 2223165 - RNA, 15 nt, Human
ggaagaagggagaag

SEQ ID NO: 2223166 - RNA, 16 nt, Human
ggaagaagggagaaga

SEQ ID NO: 2223167 - RNA, 17 nt, Human
ggaaaugucaacaagua

SEQ ID NO: 2223168 - RNA, 19 nt, Human
ggaaaugguaugagcugag

SEQ ID NO: 2223169 - RNA, 22 nt, Human
ggaaauggaaccccaccacugu

SEQ ID NO: 2223170 - RNA, 15 nt, Human
ggaaauggaauacug

SEQ ID NO: 2223171 - RNA, 19 nt, Human
ggaaauuaagaagaaacua

SEQ ID NO: 2223172 - RNA, 19 nt, Human
ggaaauucccuucaucugg

SEQ ID NO: 2223173 - RNA, 14 nt, Human
ggaaauuaagaaga

SEQ ID NO: 2223174 - RNA, 13 nt, Human
ggaaauggugccu

SEQ ID NO: 2223175 - RNA, 20 nt, Human
ggaaauucccuucaucugga

SEQ ID NO: 2223176 - RNA, 23 nt, Human
ggaaauugagauuagagggaggu

SEQ ID NO: 2223177 - RNA, 22 nt, Human
ggaaauucccuucaucuggaac

SEQ ID NO: 2223178 - RNA, 18 nt, Human
ggaacaaggagucagaca

SEQ ID NO: 2223179 - RNA, 15 nt, Human
ggaacaaggcaaggc

SEQ ID NO: 2223180 - RNA, 17 nt, Human
ggaacaaggcaaggcug

SEQ ID NO: 2223181 - RNA, 21 nt, Human
ggaacaaggcaaggcugucaa

SEQ ID NO: 2223182 - RNA, 16 nt, Human
ggaaaugaaugugugu

SEQ ID NO: 2223183 - RNA, 15 nt, Human
ggaaaugaaagaaag

SEQ ID NO: 2223184 - RNA, 18 nt, Human
ggaaaugaucaguuuuuu

SEQ ID NO: 2223185 - RNA, 15 nt, Human
ggaaaugcugggcug

SEQ ID NO: 2223186 - RNA, 14 nt, Human
ggaaaugggcagag

SEQ ID NO: 2223187 - RNA, 15 nt, Human
ggaaaccuuggugua

SEQ ID NO: 2223188 - RNA, 16 nt, Human
ggaaaugggcagagca

SEQ ID NO: 2223189 - RNA, 17 nt, Human
ggaaaugggcagagcag

SEQ ID NO: 2223190 - RNA, 18 nt, Human
ggaaaugggcagagcaga

SEQ ID NO: 2223191 - RNA, 22 nt, Human
ggaaaugggcagagcagagacc

SEQ ID NO: 2223192 - RNA, 15 nt, Human
gcuuugaucccugac

SEQ ID NO: 2223193 - RNA, 14 nt, Human
gcuuugaucccuga

SEQ ID NO: 2223194 - RNA, 14 nt, Human
gcuuugaucccuuc

SEQ ID NO: 2223195 - RNA, 17 nt, Human
gcuuugaucccuucuua

SEQ ID NO: 2223196 - RNA, 22 nt, Human
gcuuuuccuuuguuuuuaugaa

SEQ ID NO: 2223197 - RNA, 13 nt, Human
gcuuuucuccucu

SEQ ID NO: 2223198 - RNA, 16 nt, Human
gcuuuucuccucuuuc

SEQ ID NO: 2223199 - RNA, 17 nt, Human
gcuuuucuccucuuucc

SEQ ID NO: 2223200 - RNA, 23 nt, Human
gcuuuuccuuggggcaggcagug

SEQ ID NO: 2223201 - RNA, 22 nt, Human
gcuuuuccuuggggcaggcagu

SEQ ID NO: 2223202 - RNA, 14 nt, Human
gcuuuucucagcug

SEQ ID NO: 2223203 - RNA, 21 nt, Human
gcuuuuccuuggggcaggcag

SEQ ID NO: 2223204 - RNA, 20 nt, Human
gcuuuuccuuggggcaggca

SEQ ID NO: 2223205 - RNA, 14 nt, Human
gcuuuuccuugggg

SEQ ID NO: 2223206 - RNA, 15 nt, Human
gcuuuuggucugugu

SEQ ID NO: 2223207 - RNA, 18 nt, Human
gcuuuugucuaugggacu

SEQ ID NO: 2223208 - RNA, 14 nt, Human
gcuuuucugcccug

SEQ ID NO: 2223209 - RNA, 15 nt, Human
gcuuuucugcccugg

SEQ ID NO: 2223210 - RNA, 16 nt, Human
gcuuuucugcccuggc

SEQ ID NO: 2223211 - RNA, 22 nt, Human
ggaaacagacucgauucauauu

SEQ ID NO: 2223212 - RNA, 12 nt, Human
ggaaaccugccc

SEQ ID NO: 2223213 - RNA, 19 nt, Human
ggaaaccugcccugccuga

SEQ ID NO: 2223214 - RNA, 22 nt, Human
ggaaaccugcccugccugaggg

SEQ ID NO: 2223215 - RNA, 13 nt, Human
ggaaaccugcccu

SEQ ID NO: 2223216 - RNA, 14 nt, Human
ggaaaccugcccug

SEQ ID NO: 2223217 - RNA, 17 nt, Human
ggaaaccugcccugccu

SEQ ID NO: 2223218 - RNA, 18 nt, Human
ggaaaccugcccugccug

SEQ ID NO: 2223219 - RNA, 13 nt, Human
ggaaacagacucg

SEQ ID NO: 2223220 - RNA, 16 nt, Human
ggaaacccagcucugg

SEQ ID NO: 2223221 - RNA, 13 nt, Human
ggaaacaacagcu

SEQ ID NO: 2223222 - RNA, 22 nt, Human
ggaaacaaagcuuagcaggaga

SEQ ID NO: 2223223 - RNA, 23 nt, Human
ggaaacaaagcuuagcaggagag

SEQ ID NO: 2223224 - RNA, 16 nt, Human
ggaaacaacagcuuua

SEQ ID NO: 2223225 - RNA, 12 nt, Human
ggaaacaauaua

SEQ ID NO: 2223226 - RNA, 14 nt, Human
ggaaacaaagcuua

SEQ ID NO: 2223227 - RNA, 17 nt, Human
gcuuuuuuguuuuggcu

SEQ ID NO: 2223228 - RNA, 16 nt, Human
gcuuuuugucuuuucu

SEQ ID NO: 2223229 - RNA, 20 nt, Human
gcuuuuugagguggcacuuu

SEQ ID NO: 2223230 - RNA, 18 nt, Human
ggaaaauuuuaaaaauac

SEQ ID NO: 2223231 - RNA, 15 nt, Human
gcuuuuuuaucaugu

SEQ ID NO: 2223232 - RNA, 11 nt, Human
gcuuuuucuga

SEQ ID NO: 2223233 - RNA, 12 nt, Human
gcuuuuucugac

SEQ ID NO: 2223234 - RNA, 14 nt, Human
gcuuuuucugacuc

SEQ ID NO: 2223235 - RNA, 18 nt, Human
gcuuuuucugacuccagu

SEQ ID NO: 2223236 - RNA, 21 nt, Human
gcuuuuugagguggcacuuuu

SEQ ID NO: 2223237 - RNA, 18 nt, Human
gcuuuuuuaucaugugaa

SEQ ID NO: 2223238 - RNA, 20 nt, Human
gcuuuuuuaucaugugaaau

SEQ ID NO: 2223239 - RNA, 12 nt, Human
gcuuuugugcau

SEQ ID NO: 2223240 - RNA, 13 nt, Human
gcuuuuuaauugu

SEQ ID NO: 2223241 - RNA, 15 nt, Human
gcuuuuuauuucugc

SEQ ID NO: 2223242 - RNA, 19 nt, Human
gcuuuuuauuccuccugcu

SEQ ID NO: 2223243 - RNA, 20 nt, Human
gcuuuuuaauuguuguuucu

SEQ ID NO: 2223244 - RNA, 21 nt, Human
gcuuuuuaauuguuguuucuu

SEQ ID NO: 2223245 - RNA, 22 nt, Human
gcuuuuuaauuguuguuucuuu

SEQ ID NO: 2223246 - RNA, 21 nt, Human
gcuuuuuauuucugcauaugu

SEQ ID NO: 2223247 - RNA, 17 nt, Human
gcuuuuuauuucugcau

SEQ ID NO: 2223248 - RNA, 13 nt, Human
gcuuuuuccagag

SEQ ID NO: 2223249 - RNA, 22 nt, Human
gcuuccagugaggcucugcccu

SEQ ID NO: 2223250 - RNA, 13 nt, Human
gcuuucugcucag

SEQ ID NO: 2223251 - RNA, 13 nt, Human
gcuuucuggagag

SEQ ID NO: 2223252 - RNA, 11 nt, Human
gcuuucugucu

SEQ ID NO: 2223253 - RNA, 21 nt, Human
gcuuucugcucagcuucuccu

SEQ ID NO: 2223254 - RNA, 22 nt, Human
gcuuucuggaaaagaggaguuu

SEQ ID NO: 2223255 - RNA, 19 nt, Human
gcuuucugcucagcuucuc

SEQ ID NO: 2223256 - RNA, 18 nt, Human
gcuuucugcucagcuucu

SEQ ID NO: 2223257 - RNA, 15 nt, Human
gcuuucuguugucau

SEQ ID NO: 2223258 - RNA, 22 nt, Human
gcuuugagguggaagagggcug

SEQ ID NO: 2223259 - RNA, 19 nt, Human
gcuuugagguggaagaggg

SEQ ID NO: 2223260 - RNA, 15 nt, Human
gcuuucuauuguaca

SEQ ID NO: 2223261 - RNA, 17 nt, Human
gcuuucuauuguacaga

SEQ ID NO: 2223262 - RNA, 19 nt, Human
gcuuuccucaucaggccau

SEQ ID NO: 2223263 - RNA, 16 nt, Human
gcuuucccuuaucaaa

SEQ ID NO: 2223264 - RNA, 15 nt, Human
gcuuucccugccucu

SEQ ID NO: 2223265 - RNA, 15 nt, Human
gcuuuccccuguggg

SEQ ID NO: 2223266 - RNA, 16 nt, Human
gcuuuccccugugggg

SEQ ID NO: 2223267 - RNA, 17 nt, Human
gcuuuccccugugggga

SEQ ID NO: 2223268 - RNA, 22 nt, Human
gcuuuccccuguggggaucuca

SEQ ID NO: 2223269 - RNA, 16 nt, Human
gcuuuccucuuccuga

SEQ ID NO: 2223270 - RNA, 18 nt, Human
gcuuguaaauagcucagg

SEQ ID NO: 2223271 - RNA, 19 nt, Human
gcuuguaaauagcucaggu

SEQ ID NO: 2223272 - RNA, 21 nt, Human
gcuuuccccaugucucgacuc

SEQ ID NO: 2223273 - RNA, 14 nt, Human
gcuugaccugaggc

SEQ ID NO: 2223274 - RNA, 22 nt, Human
gcuuuccccaugucucgacuca

SEQ ID NO: 2223275 - RNA, 12 nt, Human
gcuuuccccugu

SEQ ID NO: 2223276 - RNA, 14 nt, Human
gcuuuccccugugg

SEQ ID NO: 2223277 - RNA, 17 nt, Human
gcuuguaaauagcucag

SEQ ID NO: 2223278 - RNA, 22 nt, Human
gcuugaccuuuaagagaaauga

SEQ ID NO: 2223279 - RNA, 23 nt, Human
gcuugaccgugaggccagagaca

SEQ ID NO: 2223280 - RNA, 18 nt, Human
gcuugaccuuuaagagaa

SEQ ID NO: 2223281 - RNA, 19 nt, Human
gcuucuuaauauaacugcc

SEQ ID NO: 2223282 - RNA, 19 nt, Human
gcuuccuggcaauagucaa

SEQ ID NO: 2223283 - RNA, 20 nt, Human
gcuuccugcguccuccucac

SEQ ID NO: 2223284 - RNA, 23 nt, Human
gcuuccagugaggcucugcccuu

SEQ ID NO: 2223285 - RNA, 12 nt, Human
gcuuccauucca

SEQ ID NO: 2223286 - RNA, 19 nt, Human
gcuuccaugauucuauuua

SEQ ID NO: 2223287 - RNA, 17 nt, Human
gcuuccauuugugugug

SEQ ID NO: 2223288 - RNA, 17 nt, Human
gcuuccaugagaacagc

SEQ ID NO: 2223289 - RNA, 14 nt, Human
gcuuccaugauucu

SEQ ID NO: 2223290 - RNA, 18 nt, Human
gcuuccaugauucuauuu

SEQ ID NO: 2223291 - RNA, 15 nt, Human
gcuuccaugauucua

SEQ ID NO: 2223292 - RNA, 21 nt, Human
gcuucuuaauauaacugccuu

SEQ ID NO: 2223293 - RNA, 22 nt, Human
gcuucuuaauauaacugccuua

SEQ ID NO: 2223294 - RNA, 19 nt, Human
gcuucuuaaucuuuucaca

SEQ ID NO: 2223295 - RNA, 21 nt, Human
gcuucuuaaucuuuucacaaa

SEQ ID NO: 2223296 - RNA, 12 nt, Human
gcuucuucagag

SEQ ID NO: 2223297 - RNA, 13 nt, Human
gcuugaaagaaaa

SEQ ID NO: 2223298 - RNA, 22 nt, Human
gcuucuuaaucuuuucacaaau

SEQ ID NO: 2223299 - RNA, 23 nt, Human
gcuucuuaaucuuuucacaaaua

SEQ ID NO: 2223300 - RNA, 15 nt, Human
gcuucuucagagacu

SEQ ID NO: 2223301 - RNA, 20 nt, Human
gcuugaaagaaaauaugcau

SEQ ID NO: 2223302 - RNA, 21 nt, Human
gcuugaagaucguuaguaucu

SEQ ID NO: 2223303 - RNA, 13 nt, Human
gcuugaacccagg

SEQ ID NO: 2223304 - RNA, 22 nt, Human
gcuugaagaucguuaguaucua

SEQ ID NO: 2223305 - RNA, 11 nt, Human
gcuugaagcca

SEQ ID NO: 2223306 - RNA, 12 nt, Human
gcuugaagccaa

SEQ ID NO: 2223307 - RNA, 14 nt, Human
gcuugaagccaaag

SEQ ID NO: 2223308 - RNA, 15 nt, Human
gcuugaagccaaaga

SEQ ID NO: 2223309 - RNA, 16 nt, Human
gcuugaagccaaagaa

SEQ ID NO: 2223310 - RNA, 14 nt, Human
gcuugaagccaagu

SEQ ID NO: 2223311 - RNA, 18 nt, Human
gcuugaagccaaagaaaa

SEQ ID NO: 2223312 - RNA, 20 nt, Human
gcuugaagccaaagaaaaau

SEQ ID NO: 2223313 - RNA, 15 nt, Human
gcuugacaacaucug

SEQ ID NO: 2223314 - RNA, 20 nt, Human
gcuugaccgugaggccagag

SEQ ID NO: 2223315 - RNA, 18 nt, Human
gcuucaaccuugagacag

SEQ ID NO: 2223316 - RNA, 17 nt, Human
gcuuauuuuuaaaauuu

SEQ ID NO: 2223317 - RNA, 22 nt, Human
gcuuauuuuuaaaauuuuaaua

SEQ ID NO: 2223318 - RNA, 12 nt, Human
gcuuauuuuaaa

SEQ ID NO: 2223319 - RNA, 16 nt, Human
gcuucaaauuguaagc

SEQ ID NO: 2223320 - RNA, 14 nt, Human
gcuucaaggauccu

SEQ ID NO: 2223321 - RNA, 16 nt, Human
gcuucaaaauagagaa

SEQ ID NO: 2223322 - RNA, 23 nt, Human
gcuucagggcgcacagcaugaga

SEQ ID NO: 2223323 - RNA, 14 nt, Human
gcuucaguggcagc

SEQ ID NO: 2223324 - RNA, 17 nt, Human
gcuucagguuaucgaaa

SEQ ID NO: 2223325 - RNA, 12 nt, Human
gcuucagguuau

SEQ ID NO: 2223326 - RNA, 19 nt, Human
gcuucagguuaucgaaaua

SEQ ID NO: 2223327 - RNA, 20 nt, Human
gcuucagguuaucgaaauaa

SEQ ID NO: 2223328 - RNA, 21 nt, Human
gcuucagguuaucgaaauaac

SEQ ID NO: 2223329 - RNA, 22 nt, Human
gcuucagguuaucgaaauaaca

SEQ ID NO: 2223330 - RNA, 15 nt, Human
gcuucaguggcagcu

SEQ ID NO: 2223331 - RNA, 14 nt, Human
gcuucaguggagaa

SEQ ID NO: 2223332 - RNA, 23 nt, Human
gcuucagguuaucgaaauaacaa

SEQ ID NO: 2223333 - RNA, 12 nt, Human
gcuuaaugaaaa

SEQ ID NO: 2223334 - RNA, 18 nt, Human
gcuuaaugacacuagcua

SEQ ID NO: 2223335 - RNA, 15 nt, Human
gcuuaaaaaucauug

SEQ ID NO: 2223336 - RNA, 18 nt, Human
gcuguuuuguucuguggu

SEQ ID NO: 2223337 - RNA, 17 nt, Human
gcuguuuucccugaccu

SEQ ID NO: 2223338 - RNA, 21 nt, Human
gcuguuuuaguuaaauuucug

SEQ ID NO: 2223339 - RNA, 21 nt, Human
gcuguuuguuugacaaagaaa

SEQ ID NO: 2223340 - RNA, 15 nt, Human
gcuguuuuccucccu

SEQ ID NO: 2223341 - RNA, 18 nt, Human
gcuguuuuccucccuucu

SEQ ID NO: 2223342 - RNA, 16 nt, Human
gcuguuuuccucccuu

SEQ ID NO: 2223343 - RNA, 22 nt, Human
gcuguuuuccucccuucugcua

SEQ ID NO: 2223344 - RNA, 13 nt, Human
gcuguuuugugga

SEQ ID NO: 2223345 - RNA, 21 nt, Human
gcuguuuuccucccuucugcu

SEQ ID NO: 2223346 - RNA, 20 nt, Human
gcuguuuuccucccuucugc

SEQ ID NO: 2223347 - RNA, 19 nt, Human
gcuguuuuguggauuuuug

SEQ ID NO: 2223348 - RNA, 13 nt, Human
gcuuacaagccag

SEQ ID NO: 2223349 - RNA, 19 nt, Human
gcuuacaagccagcuggag

SEQ ID NO: 2223350 - RNA, 12 nt, Human
gcuuaauguuua

SEQ ID NO: 2223351 - RNA, 14 nt, Human
gcuuaaugcuucuu

SEQ ID NO: 2223352 - RNA, 16 nt, Human
gcuuaaugcuucuuuc

SEQ ID NO: 2223353 - RNA, 14 nt, Human
gcuuaauguuuauu

SEQ ID NO: 2223354 - RNA, 17 nt, Human
gcuuaauguuuauuccu

SEQ ID NO: 2223355 - RNA, 23 nt, Human
gcuuaauguuuauuccugauaau

SEQ ID NO: 2223356 - RNA, 13 nt, Human
gcuguuggcuggg

SEQ ID NO: 2223357 - RNA, 13 nt, Human
gcuguugcugaau

SEQ ID NO: 2223358 - RNA, 13 nt, Human
gcuguuggcacuc

SEQ ID NO: 2223359 - RNA, 16 nt, Human
gcuguugcugaauagg

SEQ ID NO: 2223360 - RNA, 19 nt, Human
gcuguugcugaauaggcga

SEQ ID NO: 2223361 - RNA, 14 nt, Human
gcuguuggcugggg

SEQ ID NO: 2223362 - RNA, 16 nt, Human
gcuguuggcacucaca

SEQ ID NO: 2223363 - RNA, 22 nt, Human
gcuguuggcacucacagaccug

SEQ ID NO: 2223364 - RNA, 23 nt, Human
gcuguuggcacucacagaccugg

SEQ ID NO: 2223365 - RNA, 16 nt, Human
gcuguuggcagugagu

SEQ ID NO: 2223366 - RNA, 12 nt, Human
gcuguuugucau

SEQ ID NO: 2223367 - RNA, 20 nt, Human
gcuguuuguuugacaaagaa

SEQ ID NO: 2223368 - RNA, 22 nt, Human
gcuguuggcagugagugagccu

SEQ ID NO: 2223369 - RNA, 23 nt, Human
gcuguuggccucugcaaaggaaa

SEQ ID NO: 2223370 - RNA, 12 nt, Human
gcugugccucug

SEQ ID NO: 2223371 - RNA, 14 nt, Human
gcuguugcugaaua

SEQ ID NO: 2223372 - RNA, 15 nt, Human
gcuguugcugaauag

SEQ ID NO: 2223373 - RNA, 17 nt, Human
gcugugccucccaaaau

SEQ ID NO: 2223374 - RNA, 19 nt, Human
gcugugccacccugggcuc

SEQ ID NO: 2223375 - RNA, 21 nt, Human
gcugugccacccugggcucug

SEQ ID NO: 2223376 - RNA, 22 nt, Human
gcugugccacccugggcucugu

SEQ ID NO: 2223377 - RNA, 16 nt, Human
gcugugcccucuugau

SEQ ID NO: 2223378 - RNA, 12 nt, Human
gcugugccaccc

SEQ ID NO: 2223379 - RNA, 16 nt, Human
gcugugcagccugucc

SEQ ID NO: 2223380 - RNA, 13 nt, Human
gcugugccacccu

SEQ ID NO: 2223381 - RNA, 14 nt, Human
gcugugccacccug

SEQ ID NO: 2223382 - RNA, 15 nt, Human
gcugugccacccugg

SEQ ID NO: 2223383 - RNA, 17 nt, Human
gcugugccacccugggc

SEQ ID NO: 2223384 - RNA, 18 nt, Human
gcugugccacccugggcu

SEQ ID NO: 2223385 - RNA, 13 nt, Human
gcuggaucuguga

SEQ ID NO: 2223386 - RNA, 23 nt, Human
gcuggaucacagcugcuuucugu

SEQ ID NO: 2223387 - RNA, 14 nt, Human
gcuggauaaaauga

SEQ ID NO: 2223388 - RNA, 19 nt, Human
gcuggaucacagcugcuuu

SEQ ID NO: 2223389 - RNA, 15 nt, Human
gcuggauaaaaugag

SEQ ID NO: 2223390 - RNA, 16 nt, Human
gcuggaguuucaugua

SEQ ID NO: 2223391 - RNA, 20 nt, Human
gcuggaguucagugguguga

SEQ ID NO: 2223392 - RNA, 20 nt, Human
gcuggagugcagugguguga

SEQ ID NO: 2223393 - RNA, 22 nt, Human
gcuggagccuguguaacagcuc

SEQ ID NO: 2223394 - RNA, 23 nt, Human
gcuggagccuguguaacagcucc

SEQ ID NO: 2223395 - RNA, 23 nt, Human
gcugguucaggguuggccccugc

SEQ ID NO: 2223396 - RNA, 24 nt, Human
gcugguugucauuuuugcaguaga

SEQ ID NO: 2223397 - RNA, 18 nt, Human
gcugguuggagagcuaga

SEQ ID NO: 2223398 - RNA, 15 nt, Human
gcugguuuccucauu

SEQ ID NO: 2223399 - RNA, 15 nt, Human
gcugguugcugugug

SEQ ID NO: 2223400 - RNA, 16 nt, Human
gcugguugcugugugg

SEQ ID NO: 2223401 - RNA, 16 nt, Human
gcugguuggagagcua

SEQ ID NO: 2223402 - RNA, 17 nt, Human
gcugguuggagagcuag

SEQ ID NO: 2223403 - RNA, 12 nt, Human
gcugguucugua

SEQ ID NO: 2223404 - RNA, 13 nt, Human
gcugguugcugug

SEQ ID NO: 2223405 - RNA, 14 nt, Human
gcugguugcugugu

SEQ ID NO: 2223406 - RNA, 20 nt, Human
gcugguucggauuuggggug

SEQ ID NO: 2223407 - RNA, 21 nt, Human
gcugguucggauuuggggugg

SEQ ID NO: 2223408 - RNA, 13 nt, Human
gcuguauuuuaaa

SEQ ID NO: 2223409 - RNA, 13 nt, Human
gcuguauucuucu

SEQ ID NO: 2223410 - RNA, 17 nt, Human
gcuguauugaaucaugu

SEQ ID NO: 2223411 - RNA, 18 nt, Human
gcuguauugaaucaugua

SEQ ID NO: 2223412 - RNA, 19 nt, Human
gcuguauuagucacagaga

SEQ ID NO: 2223413 - RNA, 12 nt, Human
gcuguauuuuaa

SEQ ID NO: 2223414 - RNA, 23 nt, Human
gcugguuuuccuaaaugcaguga

SEQ ID NO: 2223415 - RNA, 14 nt, Human
gcugguuuuccuaa

SEQ ID NO: 2223416 - RNA, 12 nt, Human
gcugguuuuccu

SEQ ID NO: 2223417 - RNA, 20 nt, Human
gcugguuuuguaagaugcug

SEQ ID NO: 2223418 - RNA, 21 nt, Human
gcugguuuuguaagaugcugg

SEQ ID NO: 2223419 - RNA, 22 nt, Human
gcuguacaucuauuuuggauug

SEQ ID NO: 2223420 - RNA, 20 nt, Human
gcuguacaucuauuuuggau

SEQ ID NO: 2223421 - RNA, 16 nt, Human
gcuguacaucuauuuu

SEQ ID NO: 2223422 - RNA, 12 nt, Human
gcuguacaucua

SEQ ID NO: 2223423 - RNA, 13 nt, Human
gcuguagaaggag

SEQ ID NO: 2223424 - RNA, 20 nt, Human
gcuguaggacucgcagucag

SEQ ID NO: 2223425 - RNA, 20 nt, Human
gcuguagacauuugcuauga

SEQ ID NO: 2223426 - RNA, 23 nt, Human
gcuguacaucuauuuuggauugu

SEQ ID NO: 2223427 - RNA, 20 nt, Human
gcuguacuucgucuucuaau

SEQ ID NO: 2223428 - RNA, 17 nt, Human
ggcucacugcagccuca

SEQ ID NO: 2223429 - RNA, 19 nt, Human
ggcucacugcauccuccgc

SEQ ID NO: 2223430 - RNA, 16 nt, Human
ggcucacugcauccuc

SEQ ID NO: 2223431 - RNA, 16 nt, Human
ggcgugguggcgggca

SEQ ID NO: 2223432 - RNA, 18 nt, Human
ggcguggucacugcuguc

SEQ ID NO: 2223433 - RNA, 19 nt, Human
ggcguggucacugcuguca

SEQ ID NO: 2223434 - RNA, 17 nt, Human
ggcguggucaagcacuc

SEQ ID NO: 2223435 - RNA, 15 nt, Human
ggcguggucacugcu

SEQ ID NO: 2223436 - RNA, 17 nt, Human
ggcguggucacugcugu

SEQ ID NO: 2223437 - RNA, 16 nt, Human
ggcucacugcagccuc

SEQ ID NO: 2223438 - RNA, 15 nt, Human
ggcgucugucuucaa

SEQ ID NO: 2223439 - RNA, 21 nt, Human
ggcguccgcgcgccagcacag

SEQ ID NO: 2223440 - RNA, 16 nt, Human
ggcgucuguauauuuu

SEQ ID NO: 2223441 - RNA, 19 nt, Human
ggcgucagccuccagccuc

SEQ ID NO: 2223442 - RNA, 20 nt, Human
ggcgucagccuccagccucu

SEQ ID NO: 2223443 - RNA, 22 nt, Human
ggcgucagccuccagccucugu

SEQ ID NO: 2223444 - RNA, 14 nt, Human
ggcgugcaguggug

SEQ ID NO: 2223445 - RNA, 12 nt, Human
ggcguggagcug

SEQ ID NO: 2223446 - RNA, 20 nt, Human
ggcguggagagcccggcgcc

SEQ ID NO: 2223447 - RNA, 16 nt, Human
ggcgucuguucccccu

SEQ ID NO: 2223448 - RNA, 15 nt, Human
ggcguggagcugccu

SEQ ID NO: 2223449 - RNA, 19 nt, Human
ggcgugcaguggugcgauc

SEQ ID NO: 2223450 - RNA, 12 nt, Human
ggcucagccugg

SEQ ID NO: 2223451 - RNA, 10 nt, Human
ggcucagccu

SEQ ID NO: 2223452 - RNA, 15 nt, Human
ggcucagccagcacu

SEQ ID NO: 2223453 - RNA, 19 nt, Human
ggcucagcaaaagaugcuu

SEQ ID NO: 2223454 - RNA, 13 nt, Human
ggcucacugccag

SEQ ID NO: 2223455 - RNA, 14 nt, Human
ggcucacugccagg

SEQ ID NO: 2223456 - RNA, 23 nt, Human
ggcucagcaaaagaugcuucuca

SEQ ID NO: 2223457 - RNA, 21 nt, Human
ggcucagcggggacagcuccu

SEQ ID NO: 2223458 - RNA, 22 nt, Human
ggcucagcggggacagcuccuu

SEQ ID NO: 2223459 - RNA, 23 nt, Human
ggcucagcggggacagcuccuuc

SEQ ID NO: 2223460 - RNA, 11 nt, Human
ggcucagccug

SEQ ID NO: 2223461 - RNA, 17 nt, Human
ggccucauuacuuuacc

SEQ ID NO: 2223462 - RNA, 20 nt, Human
ggccuccagaacucacuggg

SEQ ID NO: 2223463 - RNA, 15 nt, Human
ggccuccagaacuca

SEQ ID NO: 2223464 - RNA, 13 nt, Human
ggccuccauccug

SEQ ID NO: 2223465 - RNA, 19 nt, Human
ggccucauguggcuggaag

SEQ ID NO: 2223466 - RNA, 20 nt, Human
ggccucauguggcuggaaga

SEQ ID NO: 2223467 - RNA, 15 nt, Human
ggccucauguggcug

SEQ ID NO: 2223468 - RNA, 17 nt, Human
ggccggccaggugggcg

SEQ ID NO: 2223469 - RNA, 16 nt, Human
ggccucauguggcugg

SEQ ID NO: 2223470 - RNA, 17 nt, Human
ggccucauguggcugga

SEQ ID NO: 2223471 - RNA, 19 nt, Human
ggccgcuguucacccacag

SEQ ID NO: 2223472 - RNA, 16 nt, Human
ggccgcuguucaccca

SEQ ID NO: 2223473 - RNA, 23 nt, Human
ggccgcugccacccaccucccug

SEQ ID NO: 2223474 - RNA, 22 nt, Human
ggccgcugccacccaccucccu

SEQ ID NO: 2223475 - RNA, 15 nt, Human
ggccggccagccccu

SEQ ID NO: 2223476 - RNA, 20 nt, Human
ggccggagucagugccaggu

SEQ ID NO: 2223477 - RNA, 14 nt, Human
ggccggccaggugg

SEQ ID NO: 2223478 - RNA, 15 nt, Human
ggccggccagguggg

SEQ ID NO: 2223479 - RNA, 16 nt, Human
ggccggccaggugggc

SEQ ID NO: 2223480 - RNA, 12 nt, Human
ggccugagcugg

SEQ ID NO: 2223481 - RNA, 13 nt, Human
ggccugaggauga

SEQ ID NO: 2223482 - RNA, 18 nt, Human
ggccugaggaugagcugg

SEQ ID NO: 2223483 - RNA, 19 nt, Human
ggccugaggaugagcugga

SEQ ID NO: 2223484 - RNA, 22 nt, Human
ggccugaggaugagcuggaagg

SEQ ID NO: 2223485 - RNA, 18 nt, Human
ggccugaggucucgcuga

SEQ ID NO: 2223486 - RNA, 21 nt, Human
ggccugaggucucgcugaugc

SEQ ID NO: 2223487 - RNA, 15 nt, Human
ggccugagcugggau

SEQ ID NO: 2223488 - RNA, 21 nt, Human
ggcggugggcacccacccugg

SEQ ID NO: 2223489 - RNA, 22 nt, Human
ggcggugggcacccacccuggg

SEQ ID NO: 2223490 - RNA, 19 nt, Human
ggcgaccccgucacagccu

SEQ ID NO: 2223491 - RNA, 20 nt, Human
ggcgaccccgucacagccuc

SEQ ID NO: 2223492 - RNA, 13 nt, Human
ggcgucagccucc

SEQ ID NO: 2223493 - RNA, 14 nt, Human
ggcgucagccucca

SEQ ID NO: 2223494 - RNA, 16 nt, Human
ggcgucagccuccagc

SEQ ID NO: 2223495 - RNA, 17 nt, Human
ggcgucagccuccagcc

SEQ ID NO: 2223496 - RNA, 18 nt, Human
ggcgucagccuccagccu

SEQ ID NO: 2223497 - RNA, 12 nt, Human
ggccuuuuccua

SEQ ID NO: 2223498 - RNA, 14 nt, Human
ggccuuuggcuuca

SEQ ID NO: 2223499 - RNA, 18 nt, Human
ggcgacaguuuuccuucu

SEQ ID NO: 2223500 - RNA, 16 nt, Human
ggcgaagcccaggccc

SEQ ID NO: 2223501 - RNA, 23 nt, Human
ggcgacagagcgagagucugucu

SEQ ID NO: 2223502 - RNA, 20 nt, Human
ggcgacagagcgagacuccg

SEQ ID NO: 2223503 - RNA, 15 nt, Human
ggcgaaucauuuguu

SEQ ID NO: 2223504 - RNA, 14 nt, Human
ggccuuuaaaauuu

SEQ ID NO: 2223505 - RNA, 22 nt, Human
ggccuuuaaaauuuuuuuagaa

SEQ ID NO: 2223506 - RNA, 12 nt, Human
ggccuuguccca

SEQ ID NO: 2223507 - RNA, 13 nt, Human
ggccuuuggcuuc

SEQ ID NO: 2223508 - RNA, 23 nt, Human
ggccuuugagcccacaaagccuu

SEQ ID NO: 2223509 - RNA, 16 nt, Human
ggccuuucugugugug

SEQ ID NO: 2223510 - RNA, 19 nt, Human
ggccuuugagcccacaaag

SEQ ID NO: 2223511 - RNA, 16 nt, Human
ggccuugcccagagau

SEQ ID NO: 2223512 - RNA, 15 nt, Human
ggccuugcccagaga

SEQ ID NO: 2223513 - RNA, 22 nt, Human
ggccuugcgguauccgccccca

SEQ ID NO: 2223514 - RNA, 14 nt, Human
ggccuugcccagag

SEQ ID NO: 2223515 - RNA, 13 nt, Human
ggccuugcccaga

SEQ ID NO: 2223516 - RNA, 16 nt, Human
ggccuugaguccccca

SEQ ID NO: 2223517 - RNA, 15 nt, Human
ggccuucucugaagg

SEQ ID NO: 2223518 - RNA, 16 nt, Human
ggccuucucugaagga

SEQ ID NO: 2223519 - RNA, 23 nt, Human
ggccugcugggcucuccaccuca

SEQ ID NO: 2223520 - RNA, 22 nt, Human
ggccugcugggcucuccaccuc

SEQ ID NO: 2223521 - RNA, 10 nt, Human
ggccugcugu

SEQ ID NO: 2223522 - RNA, 19 nt, Human
ggccugcugugauuccacu

SEQ ID NO: 2223523 - RNA, 16 nt, Human
ggccuggaagacagag

SEQ ID NO: 2223524 - RNA, 17 nt, Human
ggccugcuuccugucuu

SEQ ID NO: 2223525 - RNA, 13 nt, Human
ggccuggaccugc

SEQ ID NO: 2223526 - RNA, 18 nt, Human
ggccuggacuuuccugca

SEQ ID NO: 2223527 - RNA, 21 nt, Human
ggccuggacuuuccugcaacu

SEQ ID NO: 2223528 - RNA, 15 nt, Human
ggccuggaccugccu

SEQ ID NO: 2223529 - RNA, 16 nt, Human
ggccuggaccugccuc

SEQ ID NO: 2223530 - RNA, 21 nt, Human
ggccuggaccugccuccugcc

SEQ ID NO: 2223531 - RNA, 22 nt, Human
ggccuggaccugccuccugccu

SEQ ID NO: 2223532 - RNA, 21 nt, Human
ggccugcugggcucuccaccu

SEQ ID NO: 2223533 - RNA, 18 nt, Human
ggccugaugacagagcga

SEQ ID NO: 2223534 - RNA, 20 nt, Human
ggccugcugggcucuccacc

SEQ ID NO: 2223535 - RNA, 14 nt, Human
ggccugaugacaga

SEQ ID NO: 2223536 - RNA, 20 nt, Human
ggccugaucagaccacggcu

SEQ ID NO: 2223537 - RNA, 21 nt, Human
ggccugaggucuggcugcuug

SEQ ID NO: 2223538 - RNA, 22 nt, Human
ggccugaggucucgcugaugcu

SEQ ID NO: 2223539 - RNA, 19 nt, Human
ggccugaggucuggcugcu

SEQ ID NO: 2223540 - RNA, 18 nt, Human
ggccugaucagaccacgg

SEQ ID NO: 2223541 - RNA, 15 nt, Human
ggccugaucagacca

SEQ ID NO: 2223542 - RNA, 18 nt, Human
ggccuggccaggagcucu

SEQ ID NO: 2223543 - RNA, 17 nt, Human
ggccuggccaggagcuc

SEQ ID NO: 2223544 - RNA, 16 nt, Human
ggccuggccaggagcu

SEQ ID NO: 2223545 - RNA, 15 nt, Human
ggccuggccaggagc

SEQ ID NO: 2223546 - RNA, 14 nt, Human
ggccuggccaggag

SEQ ID NO: 2223547 - RNA, 18 nt, Human
ggccuggagauccuccug

SEQ ID NO: 2223548 - RNA, 19 nt, Human
ggccuggagauccuccugc

SEQ ID NO: 2223549 - RNA, 21 nt, Human
ggccuggccagaugcaccagc

SEQ ID NO: 2223550 - RNA, 11 nt, Human
ggccuggagau

SEQ ID NO: 2223551 - RNA, 14 nt, Human
ggccuggagauccu

SEQ ID NO: 2223552 - RNA, 15 nt, Human
ggccuggagauccuc

SEQ ID NO: 2223553 - RNA, 17 nt, Human
ggccuggagauccuccu

SEQ ID NO: 2223554 - RNA, 23 nt, Human
ggccuggccaggagcucuucagg

SEQ ID NO: 2223555 - RNA, 13 nt, Human
ggccuggccaggc

SEQ ID NO: 2223556 - RNA, 14 nt, Human
ggccuggccaggca

SEQ ID NO: 2223557 - RNA, 22 nt, Human
ggccuggccagggccuggaaga

SEQ ID NO: 2223558 - RNA, 17 nt, Human
ggccuggccagggccug

SEQ ID NO: 2223559 - RNA, 18 nt, Human
ggccuggccagggccugg

SEQ ID NO: 2223560 - RNA, 20 nt, Human
ggccuguggaucaaauccag

SEQ ID NO: 2223561 - RNA, 23 nt, Human
ggccuggcccacagcaggugcug

SEQ ID NO: 2223562 - RNA, 18 nt, Human
ggccuguggccugugucc

SEQ ID NO: 2223563 - RNA, 20 nt, Human
ggccuguggccuguguccca

SEQ ID NO: 2223564 - RNA, 17 nt, Human
ggccugugggagccugc

SEQ ID NO: 2223565 - RNA, 20 nt, Human
ggccugugggagccugcaaa

SEQ ID NO: 2223566 - RNA, 21 nt, Human
ggccugugucuaguuguuuga

SEQ ID NO: 2223567 - RNA, 20 nt, Human
ggccugugucccaugaccca

SEQ ID NO: 2223568 - RNA, 22 nt, Human
ggccugugugugaaaggaagcu

SEQ ID NO: 2223569 - RNA, 21 nt, Human
ggccugugucccaugacccac

SEQ ID NO: 2223570 - RNA, 22 nt, Human
ggccugugucccaugacccacc

SEQ ID NO: 2223571 - RNA, 12 nt, Human
ggccuucucuga

SEQ ID NO: 2223572 - RNA, 23 nt, Human
ggccuucggccuccauccugagg

SEQ ID NO: 2223573 - RNA, 12 nt, Human
ggccaaaccucu

SEQ ID NO: 2223574 - RNA, 17 nt, Human
ggccaaacucaccugcc

SEQ ID NO: 2223575 - RNA, 23 nt, Human
ggccagagagccuggugcugcug

SEQ ID NO: 2223576 - RNA, 16 nt, Human
ggccaaaccucuguuc

SEQ ID NO: 2223577 - RNA, 15 nt, Human
ggccaaaccucuguu

SEQ ID NO: 2223578 - RNA, 21 nt, Human
ggccaaacucaccugccccuc

SEQ ID NO: 2223579 - RNA, 13 nt, Human
ggccagagccagg

SEQ ID NO: 2223580 - RNA, 12 nt, Human
ggccagagccag

SEQ ID NO: 2223581 - RNA, 11 nt, Human
ggccagagcca

SEQ ID NO: 2223582 - RNA, 22 nt, Human
ggccagagagccuggugcugcu

SEQ ID NO: 2223583 - RNA, 22 nt, Human
ggccagagcuacccgcagaguu

SEQ ID NO: 2223584 - RNA, 14 nt, Human
ggccagagccaggg

SEQ ID NO: 2223585 - RNA, 22 nt, Human
ggccagaggaacuguccagaga

SEQ ID NO: 2223586 - RNA, 21 nt, Human
ggccagagcugggaggcaugg

SEQ ID NO: 2223587 - RNA, 21 nt, Human
ggccagaggaacuguccagag

SEQ ID NO: 2223588 - RNA, 14 nt, Human
ggccagagcuggga

SEQ ID NO: 2223589 - RNA, 16 nt, Human
ggccagagcugggagg

SEQ ID NO: 2223590 - RNA, 17 nt, Human
ggccagagcugggaggc

SEQ ID NO: 2223591 - RNA, 13 nt, Human
ggccagcagcuug

SEQ ID NO: 2223592 - RNA, 12 nt, Human
ggccagcagcuu

SEQ ID NO: 2223593 - RNA, 11 nt, Human
ggccagccagg

SEQ ID NO: 2223594 - RNA, 12 nt, Human
ggccagccaggc

SEQ ID NO: 2223595 - RNA, 16 nt, Human
ggccagaggcccccag

SEQ ID NO: 2223596 - RNA, 18 nt, Human
ggccagaggcccccagcc

SEQ ID NO: 2223597 - RNA, 16 nt, Human
ggccaggcuggucuca

SEQ ID NO: 2223598 - RNA, 18 nt, Human
ggccaggcuggucucaaa

SEQ ID NO: 2223599 - RNA, 18 nt, Human
ggccagggagaagcuccu

SEQ ID NO: 2223600 - RNA, 17 nt, Human
ggccagggagaagcucc

SEQ ID NO: 2223601 - RNA, 16 nt, Human
ggccagggagaagcuc

SEQ ID NO: 2223602 - RNA, 15 nt, Human
ggccagggagaagcu

SEQ ID NO: 2223603 - RNA, 15 nt, Human
ggccagccccggccc

SEQ ID NO: 2223604 - RNA, 12 nt, Human
ggccaggcuggu

SEQ ID NO: 2223605 - RNA, 15 nt, Human
ggccagccccaccca

SEQ ID NO: 2223606 - RNA, 14 nt, Human
ggccagccccaccc

SEQ ID NO: 2223607 - RNA, 13 nt, Human
ggccagccccacc

SEQ ID NO: 2223608 - RNA, 18 nt, Human
ggccagccccacagccca

SEQ ID NO: 2223609 - RNA, 19 nt, Human
ggccagccccacagcccac

SEQ ID NO: 2223610 - RNA, 15 nt, Human
ggccagccaugucug

SEQ ID NO: 2223611 - RNA, 13 nt, Human
ggccagccccaca

SEQ ID NO: 2223612 - RNA, 14 nt, Human
ggccagccccacag

SEQ ID NO: 2223613 - RNA, 15 nt, Human
ggccagccccacagc

SEQ ID NO: 2223614 - RNA, 14 nt, Human
ggccagccaugucu

SEQ ID NO: 2223615 - RNA, 16 nt, Human
ggccagccaggcgggc

SEQ ID NO: 2223616 - RNA, 13 nt, Human
ggccagccaggcg

SEQ ID NO: 2223617 - RNA, 14 nt, Human
ggccagccaggcgg

SEQ ID NO: 2223618 - RNA, 21 nt, Human
ggccagccccacccaggaggg

SEQ ID NO: 2223619 - RNA, 23 nt, Human
ggccagccccacagcccacgucc

SEQ ID NO: 2223620 - RNA, 11 nt, Human
ggccagccccg

SEQ ID NO: 2223621 - RNA, 20 nt, Human
ggccagccccacccaggagg

SEQ ID NO: 2223622 - RNA, 16 nt, Human
ggccagccccacccag

SEQ ID NO: 2223623 - RNA, 14 nt, Human
ggccaggcuggucu

SEQ ID NO: 2223624 - RNA, 20 nt, Human
ggccauccuucccugucugc

SEQ ID NO: 2223625 - RNA, 23 nt, Human
ggccauccggcccccagagcgcc

SEQ ID NO: 2223626 - RNA, 15 nt, Human
ggccauccuguccca

SEQ ID NO: 2223627 - RNA, 19 nt, Human
ggccaucucuggaugccug

SEQ ID NO: 2223628 - RNA, 18 nt, Human
ggccaucuccacccccag

SEQ ID NO: 2223629 - RNA, 23 nt, Human
ggccaucuccacccccagcugcu

SEQ ID NO: 2223630 - RNA, 22 nt, Human
ggccaucugggcuccuccaggg

SEQ ID NO: 2223631 - RNA, 17 nt, Human
ggccaucuuccaggugg

SEQ ID NO: 2223632 - RNA, 18 nt, Human
ggccaucuuccagguggg

SEQ ID NO: 2223633 - RNA, 19 nt, Human
ggccaucuuccaggugggg

SEQ ID NO: 2223634 - RNA, 16 nt, Human
ggccaugagcuccaga

SEQ ID NO: 2223635 - RNA, 22 nt, Human
ggccaucuuccaggugggguga

SEQ ID NO: 2223636 - RNA, 14 nt, Human
ggccaugccucagc

SEQ ID NO: 2223637 - RNA, 21 nt, Human
ggccaugauucgcccaaagcc

SEQ ID NO: 2223638 - RNA, 22 nt, Human
ggccaugauggcaacagaucug

SEQ ID NO: 2223639 - RNA, 18 nt, Human
ggccaugauggcaacaga

SEQ ID NO: 2223640 - RNA, 22 nt, Human
ggccaugagcuccagaccccca

SEQ ID NO: 2223641 - RNA, 21 nt, Human
ggccaugagcuccagaccccc

SEQ ID NO: 2223642 - RNA, 18 nt, Human
ggccaugagcuccagacc

SEQ ID NO: 2223643 - RNA, 17 nt, Human
ggccaugagcuccagac

SEQ ID NO: 2223644 - RNA, 21 nt, Human
ggccaugaggccucaguggac

SEQ ID NO: 2223645 - RNA, 15 nt, Human
ggccaugauggcaac

SEQ ID NO: 2223646 - RNA, 18 nt, Human
ggccagggcccugcagag

SEQ ID NO: 2223647 - RNA, 12 nt, Human
ggccagggccug

SEQ ID NO: 2223648 - RNA, 17 nt, Human
ggccagggccuggaaga

SEQ ID NO: 2223649 - RNA, 17 nt, Human
ggccagggcccugcaga

SEQ ID NO: 2223650 - RNA, 16 nt, Human
ggccagggcccugcag

SEQ ID NO: 2223651 - RNA, 13 nt, Human
ggccagggcccug

SEQ ID NO: 2223652 - RNA, 23 nt, Human
ggccagggccccucacccugccu

SEQ ID NO: 2223653 - RNA, 13 nt, Human
ggccagggcagag

SEQ ID NO: 2223654 - RNA, 19 nt, Human
ggccagggccuggaagaca

SEQ ID NO: 2223655 - RNA, 23 nt, Human
ggccagggccuggaagacagaga

SEQ ID NO: 2223656 - RNA, 19 nt, Human
ggccagggcuauagcucag

SEQ ID NO: 2223657 - RNA, 20 nt, Human
ggccagggcuauagcucagg

SEQ ID NO: 2223658 - RNA, 14 nt, Human
ggccaucccacaag

SEQ ID NO: 2223659 - RNA, 19 nt, Human
ggccauccggcccccagag

SEQ ID NO: 2223660 - RNA, 22 nt, Human
ggccauccggcccccagagcgc

SEQ ID NO: 2223661 - RNA, 17 nt, Human
ggccauagcuccugcuc

SEQ ID NO: 2223662 - RNA, 22 nt, Human
ggccauacuggccucgccuggc

SEQ ID NO: 2223663 - RNA, 23 nt, Human
ggccauacuggccucgccuggcc

SEQ ID NO: 2223664 - RNA, 22 nt, Human
ggccagugucugucccgggguc

SEQ ID NO: 2223665 - RNA, 23 nt, Human
ggccagugucugucccggggucc

SEQ ID NO: 2223666 - RNA, 16 nt, Human
ggccauacuggccucg

SEQ ID NO: 2223667 - RNA, 16 nt, Human
ggccagugugacaagg

SEQ ID NO: 2223668 - RNA, 19 nt, Human
ggccaguggcuggaucugu

SEQ ID NO: 2223669 - RNA, 13 nt, Human
ggccagugucugu

SEQ ID NO: 2223670 - RNA, 20 nt, Human
ggcauccuuccucacaccag

SEQ ID NO: 2223671 - RNA, 13 nt, Human
ggcauccugugaa

SEQ ID NO: 2223672 - RNA, 21 nt, Human
ggcaucuccugugcaugggug

SEQ ID NO: 2223673 - RNA, 15 nt, Human
ggcaucucuaauugg

SEQ ID NO: 2223674 - RNA, 17 nt, Human
ggcaucuccugugcaug

SEQ ID NO: 2223675 - RNA, 16 nt, Human
ggcaucuccugugcau

SEQ ID NO: 2223676 - RNA, 18 nt, Human
ggcaucucuaauuggaag

SEQ ID NO: 2223677 - RNA, 18 nt, Human
ggcaucccaguggccuca

SEQ ID NO: 2223678 - RNA, 15 nt, Human
ggcaucccaggggac

SEQ ID NO: 2223679 - RNA, 21 nt, Human
ggcaucccaguggccucaacc

SEQ ID NO: 2223680 - RNA, 20 nt, Human
ggcauccucagguggucagg

SEQ ID NO: 2223681 - RNA, 18 nt, Human
ggcaucugccccuccccc

SEQ ID NO: 2223682 - RNA, 16 nt, Human
ggcaucugccccuccc

SEQ ID NO: 2223683 - RNA, 19 nt, Human
ggcaucugccccuccccca

SEQ ID NO: 2223684 - RNA, 22 nt, Human
ggcaucugcacccucgaugaag

SEQ ID NO: 2223685 - RNA, 14 nt, Human
ggcaucugccccuc

SEQ ID NO: 2223686 - RNA, 15 nt, Human
ggcaucugcacccuc

SEQ ID NO: 2223687 - RNA, 19 nt, Human
ggcaucuuugccuugggcu

SEQ ID NO: 2223688 - RNA, 17 nt, Human
ggcaucuuugccuuggg

SEQ ID NO: 2223689 - RNA, 16 nt, Human
ggcaucuuugccuugg

SEQ ID NO: 2223690 - RNA, 21 nt, Human
ggcaucuuugccuugggcugc

SEQ ID NO: 2223691 - RNA, 15 nt, Human
ggcauuuuuauuuua

SEQ ID NO: 2223692 - RNA, 18 nt, Human
ggcauuuuacuguacaga

SEQ ID NO: 2223693 - RNA, 22 nt, Human
ggcauauccaccaccucccuca

SEQ ID NO: 2223694 - RNA, 17 nt, Human
ggcauaggccugggugc

SEQ ID NO: 2223695 - RNA, 16 nt, Human
ggcauaggccugggug

SEQ ID NO: 2223696 - RNA, 15 nt, Human
ggcauaggccugggu

SEQ ID NO: 2223697 - RNA, 14 nt, Human
ggcauaggccuggg

SEQ ID NO: 2223698 - RNA, 21 nt, Human
ggcauagcccagacacagaag

SEQ ID NO: 2223699 - RNA, 17 nt, Human
ggcaucacagggcagag

SEQ ID NO: 2223700 - RNA, 16 nt, Human
ggcaucacagggcaga

SEQ ID NO: 2223701 - RNA, 14 nt, Human
ggcaucacagggca

SEQ ID NO: 2223702 - RNA, 13 nt, Human
ggcaucacagggc

SEQ ID NO: 2223703 - RNA, 18 nt, Human
ggcauccaguaucuugaa

SEQ ID NO: 2223704 - RNA, 21 nt, Human
ggcauagcuccccgcuucugc

SEQ ID NO: 2223705 - RNA, 20 nt, Human
ggcagugguaagcucuggcu

SEQ ID NO: 2223706 - RNA, 19 nt, Human
ggcauagcccagacacaga

SEQ ID NO: 2223707 - RNA, 20 nt, Human
ggcagugggucccacuuccc

SEQ ID NO: 2223708 - RNA, 23 nt, Human
ggcagugggucccacuuccccuc

SEQ ID NO: 2223709 - RNA, 18 nt, Human
ggcagugggagcugccug

SEQ ID NO: 2223710 - RNA, 19 nt, Human
ggcagugggagcugccugu

SEQ ID NO: 2223711 - RNA, 17 nt, Human
ggcagugggagcugccu

SEQ ID NO: 2223712 - RNA, 21 nt, Human
ggcacugggaugagccgcugu

SEQ ID NO: 2223713 - RNA, 19 nt, Human
ggcacugggaugagccgcu

SEQ ID NO: 2223714 - RNA, 20 nt, Human
ggcacugggaugagccgcug

SEQ ID NO: 2223715 - RNA, 24 nt, Human
ggcacugcuuccagugaggcucug

SEQ ID NO: 2223716 - RNA, 20 nt, Human
ggcacuggcauugucccugu

SEQ ID NO: 2223717 - RNA, 21 nt, Human
ggcacuggcauugucccugug

SEQ ID NO: 2223718 - RNA, 16 nt, Human
ggcaccagcagccugg

SEQ ID NO: 2223719 - RNA, 12 nt, Human
ggcaccagaggc

SEQ ID NO: 2223720 - RNA, 19 nt, Human
ggcaccagaggcugcagaa

SEQ ID NO: 2223721 - RNA, 22 nt, Human
ggcaccagaggcugcagaaggc

SEQ ID NO: 2223722 - RNA, 22 nt, Human
ggcacugcuuccagugaggcuc

SEQ ID NO: 2223723 - RNA, 15 nt, Human
ggcaccagcagccug

SEQ ID NO: 2223724 - RNA, 20 nt, Human
ggcaccagacacccaggacu

SEQ ID NO: 2223725 - RNA, 19 nt, Human
ggcaccagacacccaggac

SEQ ID NO: 2223726 - RNA, 18 nt, Human
ggcaccagacacccagga

SEQ ID NO: 2223727 - RNA, 17 nt, Human
ggcaccagacacccagg

SEQ ID NO: 2223728 - RNA, 17 nt, Human
ggcccaguaugagcccu

SEQ ID NO: 2223729 - RNA, 22 nt, Human
ggcccaguaugagcccuagaag

SEQ ID NO: 2223730 - RNA, 14 nt, Human
ggcccaguccuggc

SEQ ID NO: 2223731 - RNA, 22 nt, Human
ggcccagggcccagagcccagc

SEQ ID NO: 2223732 - RNA, 21 nt, Human
ggcccagggcccagagcccag

SEQ ID NO: 2223733 - RNA, 19 nt, Human
ggcccagggcccagagccc

SEQ ID NO: 2223734 - RNA, 13 nt, Human
ggccccacccugg

SEQ ID NO: 2223735 - RNA, 22 nt, Human
ggcccagugucaaguugugcuu

SEQ ID NO: 2223736 - RNA, 23 nt, Human
ggcccagugucaaguugugcuug

SEQ ID NO: 2223737 - RNA, 21 nt, Human
ggcccaguccuggccuggcuu

SEQ ID NO: 2223738 - RNA, 16 nt, Human
ggcccaguccuggccu

SEQ ID NO: 2223739 - RNA, 19 nt, Human
ggcccagugucaaguugug

SEQ ID NO: 2223740 - RNA, 23 nt, Human
ggccccagagacucagagggagg

SEQ ID NO: 2223741 - RNA, 18 nt, Human
ggccccagagacucagag

SEQ ID NO: 2223742 - RNA, 14 nt, Human
ggccccagagacuc

SEQ ID NO: 2223743 - RNA, 13 nt, Human
ggccccagagacu

SEQ ID NO: 2223744 - RNA, 12 nt, Human
ggccccagagac

SEQ ID NO: 2223745 - RNA, 11 nt, Human
ggccccagaga

SEQ ID NO: 2223746 - RNA, 19 nt, Human
ggccccagaaggcagggaa

SEQ ID NO: 2223747 - RNA, 12 nt, Human
ggccccacuggg

SEQ ID NO: 2223748 - RNA, 15 nt, Human
ggccccagcacagcu

SEQ ID NO: 2223749 - RNA, 20 nt, Human
ggccccugcuucuccagccu

SEQ ID NO: 2223750 - RNA, 21 nt, Human
ggccccugcuucuccagccug

SEQ ID NO: 2223751 - RNA, 13 nt, Human
ggccccuggccca

SEQ ID NO: 2223752 - RNA, 14 nt, Human
ggccccuggcccag

SEQ ID NO: 2223753 - RNA, 15 nt, Human
ggccccuggcccagc

SEQ ID NO: 2223754 - RNA, 15 nt, Human
ggccccacccugggc

SEQ ID NO: 2223755 - RNA, 17 nt, Human
ggccccacccugggccc

SEQ ID NO: 2223756 - RNA, 21 nt, Human
ggccccacccugggcccuggg

SEQ ID NO: 2223757 - RNA, 23 nt, Human
ggccccacccugggcccugggcu

SEQ ID NO: 2223758 - RNA, 17 nt, Human
ggcccagcggccccucc

SEQ ID NO: 2223759 - RNA, 18 nt, Human
ggcccagcggccccuccc

SEQ ID NO: 2223760 - RNA, 23 nt, Human
ggcccagcggccccucccacaca

SEQ ID NO: 2223761 - RNA, 12 nt, Human
ggcccagcuccc

SEQ ID NO: 2223762 - RNA, 14 nt, Human
ggcccagcuccccc

SEQ ID NO: 2223763 - RNA, 15 nt, Human
ggcccagcucccccg

SEQ ID NO: 2223764 - RNA, 16 nt, Human
ggcccagcucccccgg

SEQ ID NO: 2223765 - RNA, 14 nt, Human
ggcccagcugggcu

SEQ ID NO: 2223766 - RNA, 15 nt, Human
ggcccagcugggcuc

SEQ ID NO: 2223767 - RNA, 17 nt, Human
ggcccagcugggcucug

SEQ ID NO: 2223768 - RNA, 22 nt, Human
ggcccaggaccaucauccuacu

SEQ ID NO: 2223769 - RNA, 21 nt, Human
ggcccagcugggcucugccac

SEQ ID NO: 2223770 - RNA, 15 nt, Human
ggcccaggaccagcu

SEQ ID NO: 2223771 - RNA, 16 nt, Human
ggcccaggaccagcug

SEQ ID NO: 2223772 - RNA, 17 nt, Human
ggcccaggaccagcugg

SEQ ID NO: 2223773 - RNA, 18 nt, Human
ggcccagggcccagagcc

SEQ ID NO: 2223774 - RNA, 17 nt, Human
ggcccagggcccagagc

SEQ ID NO: 2223775 - RNA, 15 nt, Human
ggcccagggcccaga

SEQ ID NO: 2223776 - RNA, 18 nt, Human
ggcccaggaccagcuggg

SEQ ID NO: 2223777 - RNA, 16 nt, Human
ggcccagggcccagag

SEQ ID NO: 2223778 - RNA, 22 nt, Human
ggccccuucacuucugaccaca

SEQ ID NO: 2223779 - RNA, 20 nt, Human
ggccccuucacuucugacca

SEQ ID NO: 2223780 - RNA, 13 nt, Human
ggccccugugagu

SEQ ID NO: 2223781 - RNA, 21 nt, Human
ggccccuucacuucugaccac

SEQ ID NO: 2223782 - RNA, 20 nt, Human
ggccccuugacucuggggac

SEQ ID NO: 2223783 - RNA, 17 nt, Human
ggccccuggcccagcgg

SEQ ID NO: 2223784 - RNA, 18 nt, Human
ggccccuggcccagcggc

SEQ ID NO: 2223785 - RNA, 20 nt, Human
ggccccuggcccagcggccc

SEQ ID NO: 2223786 - RNA, 20 nt, Human
ggccccugggcuuggccugc

SEQ ID NO: 2223787 - RNA, 21 nt, Human
ggccccugggcuuggccugcu

SEQ ID NO: 2223788 - RNA, 22 nt, Human
ggccccugggcuuggccugcug

SEQ ID NO: 2223789 - RNA, 23 nt, Human
ggccccugggcuuggccugcugu

SEQ ID NO: 2223790 - RNA, 23 nt, Human
ggccccugggucagucugguggg

SEQ ID NO: 2223791 - RNA, 19 nt, Human
ggccccuuuuuacuccccu

SEQ ID NO: 2223792 - RNA, 20 nt, Human
ggccccuuuucacucccucc

SEQ ID NO: 2223793 - RNA, 16 nt, Human
ggccccuuuucacucc

SEQ ID NO: 2223794 - RNA, 18 nt, Human
ggccccuuuucacucccu

SEQ ID NO: 2223795 - RNA, 17 nt, Human
ggcccugugccuuggug

SEQ ID NO: 2223796 - RNA, 20 nt, Human
ggcccuucacugccuuugcu

SEQ ID NO: 2223797 - RNA, 19 nt, Human
ggcccuucccacaggacau

SEQ ID NO: 2223798 - RNA, 13 nt, Human
ggcccuuccucuc

SEQ ID NO: 2223799 - RNA, 15 nt, Human
ggcccuuccucucca

SEQ ID NO: 2223800 - RNA, 14 nt, Human
ggcccuuccuuuuc

SEQ ID NO: 2223801 - RNA, 16 nt, Human
ggcccuucucuccagc

SEQ ID NO: 2223802 - RNA, 17 nt, Human
ggcccuucucuccagcc

SEQ ID NO: 2223803 - RNA, 12 nt, Human
ggccgagaagca

SEQ ID NO: 2223804 - RNA, 15 nt, Human
ggccgagaagcaaga

SEQ ID NO: 2223805 - RNA, 21 nt, Human
ggcccuucacugccuuugcuc

SEQ ID NO: 2223806 - RNA, 14 nt, Human
ggccgacggagccg

SEQ ID NO: 2223807 - RNA, 16 nt, Human
ggccgacggagccggg

SEQ ID NO: 2223808 - RNA, 18 nt, Human
ggccgaggguccuggcuc

SEQ ID NO: 2223809 - RNA, 16 nt, Human
ggccgaggguccuggc

SEQ ID NO: 2223810 - RNA, 16 nt, Human
ggccgaguccaagcug

SEQ ID NO: 2223811 - RNA, 13 nt, Human
ggccgaguccaag

SEQ ID NO: 2223812 - RNA, 17 nt, Human
ggcccuuccucuccacu

SEQ ID NO: 2223813 - RNA, 18 nt, Human
ggcccuucucuccagccc

SEQ ID NO: 2223814 - RNA, 18 nt, Human
ggccgccccagccucuga

SEQ ID NO: 2223815 - RNA, 17 nt, Human
ggccgcauucccugagu

SEQ ID NO: 2223816 - RNA, 16 nt, Human
ggccgcauucccugag

SEQ ID NO: 2223817 - RNA, 15 nt, Human
ggccgcauucccuga

SEQ ID NO: 2223818 - RNA, 20 nt, Human
ggccgcagcucuugcccuuc

SEQ ID NO: 2223819 - RNA, 21 nt, Human
ggccgcagcucuugcccuucc

SEQ ID NO: 2223820 - RNA, 22 nt, Human
ggccgcagcucuugcccuuccc

SEQ ID NO: 2223821 - RNA, 23 nt, Human
ggccgcagcucuugcccuucccu

SEQ ID NO: 2223822 - RNA, 14 nt, Human
ggccgagugagagc

SEQ ID NO: 2223823 - RNA, 19 nt, Human
ggccgaucggggcacugca

SEQ ID NO: 2223824 - RNA, 18 nt, Human
ggccgcagcucuugcccu

SEQ ID NO: 2223825 - RNA, 21 nt, Human
ggccgcugccacccaccuccc

SEQ ID NO: 2223826 - RNA, 19 nt, Human
ggccgcugccacccaccuc

SEQ ID NO: 2223827 - RNA, 15 nt, Human
ggccgcugccaccca

SEQ ID NO: 2223828 - RNA, 13 nt, Human
ggccgcugccacc

SEQ ID NO: 2223829 - RNA, 12 nt, Human
ggccgcugccac

SEQ ID NO: 2223830 - RNA, 17 nt, Human
ggccgcugaguggcagg

SEQ ID NO: 2223831 - RNA, 12 nt, Human
ggccgcccccug

SEQ ID NO: 2223832 - RNA, 13 nt, Human
ggccgcuccaggg

SEQ ID NO: 2223833 - RNA, 16 nt, Human
ggccgcuccaggggug

SEQ ID NO: 2223834 - RNA, 19 nt, Human
ggccgcuccagggguggcu

SEQ ID NO: 2223835 - RNA, 13 nt, Human
ggaugucaccaau

SEQ ID NO: 2223836 - RNA, 16 nt, Human
ggaugucacagggcca

SEQ ID NO: 2223837 - RNA, 15 nt, Human
ggaugucacagggcc

SEQ ID NO: 2223838 - RNA, 17 nt, Human
ggauguccacagaugcc

SEQ ID NO: 2223839 - RNA, 18 nt, Human
ggaugucacucagaugga

SEQ ID NO: 2223840 - RNA, 18 nt, Human
ggauguccacagaugccu

SEQ ID NO: 2223841 - RNA, 23 nt, Human
ggauguauccaugggggcagggc

SEQ ID NO: 2223842 - RNA, 22 nt, Human
ggauguauccaugggggcaggg

SEQ ID NO: 2223843 - RNA, 18 nt, Human
ggauguauaugucaucuc

SEQ ID NO: 2223844 - RNA, 16 nt, Human
ggauguacauuuccaa

SEQ ID NO: 2223845 - RNA, 15 nt, Human
ggauguucugggaca

SEQ ID NO: 2223846 - RNA, 13 nt, Human
ggaugucugggcc

SEQ ID NO: 2223847 - RNA, 14 nt, Human
ggaugucugccaau

SEQ ID NO: 2223848 - RNA, 16 nt, Human
ggauguucugggacac

SEQ ID NO: 2223849 - RNA, 22 nt, Human
ggauguugaaaaaguucugcag

SEQ ID NO: 2223850 - RNA, 13 nt, Human
ggauguucuggga

SEQ ID NO: 2223851 - RNA, 20 nt, Human
ggaugucugccaauuuuugc

SEQ ID NO: 2223852 - RNA, 15 nt, Human
ggcacaggcccccuu

SEQ ID NO: 2223853 - RNA, 14 nt, Human
ggcacaggcccccu

SEQ ID NO: 2223854 - RNA, 16 nt, Human
ggcacagggcaguggg

SEQ ID NO: 2223855 - RNA, 16 nt, Human
ggcaccagacacccag

SEQ ID NO: 2223856 - RNA, 13 nt, Human
ggcaccagacacc

SEQ ID NO: 2223857 - RNA, 16 nt, Human
ggcacagaaaccucua

SEQ ID NO: 2223858 - RNA, 20 nt, Human
ggcacagcaacucuaagacu

SEQ ID NO: 2223859 - RNA, 18 nt, Human
ggcacagcggggccccag

SEQ ID NO: 2223860 - RNA, 13 nt, Human
ggcacagccuucu

SEQ ID NO: 2223861 - RNA, 14 nt, Human
ggcaauuuuguaac

SEQ ID NO: 2223862 - RNA, 22 nt, Human
ggcacaagcaaaagggugucug

SEQ ID NO: 2223863 - RNA, 22 nt, Human
ggcacaauggcuaauucccaga

SEQ ID NO: 2223864 - RNA, 22 nt, Human
ggcacaaucucggcucacugca

SEQ ID NO: 2223865 - RNA, 21 nt, Human
ggcacagaaacacaauauuuu

SEQ ID NO: 2223866 - RNA, 20 nt, Human
ggcacaauggcuaauuccca

SEQ ID NO: 2223867 - RNA, 21 nt, Human
ggcacacaccuguagucccag

SEQ ID NO: 2223868 - RNA, 13 nt, Human
ggcacacaccugu

SEQ ID NO: 2223869 - RNA, 24 nt, Human
ggcacagaaaauggaagacagcuc

SEQ ID NO: 2223870 - RNA, 13 nt, Human
ggauggccagugu

SEQ ID NO: 2223871 - RNA, 21 nt, Human
ggauggaggggugguccugac

SEQ ID NO: 2223872 - RNA, 19 nt, Human
ggauggaggggugguccug

SEQ ID NO: 2223873 - RNA, 14 nt, Human
ggauggaggagaag

SEQ ID NO: 2223874 - RNA, 13 nt, Human
ggauggccccagc

SEQ ID NO: 2223875 - RNA, 14 nt, Human
ggauggccccagca

SEQ ID NO: 2223876 - RNA, 15 nt, Human
ggauggcaccagagg

SEQ ID NO: 2223877 - RNA, 14 nt, Human
ggauggccaguguc

SEQ ID NO: 2223878 - RNA, 15 nt, Human
ggauggccagugucu

SEQ ID NO: 2223879 - RNA, 22 nt, Human
ggauggccagugucugucccgg

SEQ ID NO: 2223880 - RNA, 18 nt, Human
ggauggauuuccagccaa

SEQ ID NO: 2223881 - RNA, 12 nt, Human
ggauggcaagau

SEQ ID NO: 2223882 - RNA, 16 nt, Human
ggaugggcugcagcag

SEQ ID NO: 2223883 - RNA, 14 nt, Human
ggaugggccaccgc

SEQ ID NO: 2223884 - RNA, 21 nt, Human
ggauguacaaggacagccccu

SEQ ID NO: 2223885 - RNA, 16 nt, Human
ggauggggcugcaccg

SEQ ID NO: 2223886 - RNA, 17 nt, Human
ggaugggaaggagggag

SEQ ID NO: 2223887 - RNA, 15 nt, Human
ggaugggagugagac

SEQ ID NO: 2223888 - RNA, 15 nt, Human
ggaugggaaggaggg

SEQ ID NO: 2223889 - RNA, 12 nt, Human
ggaugggaagga

SEQ ID NO: 2223890 - RNA, 15 nt, Human
ggauggcgggugggg

SEQ ID NO: 2223891 - RNA, 16 nt, Human
ggauggcggguggggg

SEQ ID NO: 2223892 - RNA, 18 nt, Human
ggauggcgggugggggug

SEQ ID NO: 2223893 - RNA, 23 nt, Human
ggauggcggguggggguggaaua

SEQ ID NO: 2223894 - RNA, 21 nt, Human
ggauggccuggccagggccug

SEQ ID NO: 2223895 - RNA, 16 nt, Human
ggauggccuggccagg

SEQ ID NO: 2223896 - RNA, 16 nt, Human
ggauggccccagcaca

SEQ ID NO: 2223897 - RNA, 22 nt, Human
ggauggcccuucccacuggagg

SEQ ID NO: 2223898 - RNA, 15 nt, Human
ggaucugagaaucuu

SEQ ID NO: 2223899 - RNA, 14 nt, Human
ggaucugccccucc

SEQ ID NO: 2223900 - RNA, 15 nt, Human
ggaucugccccuccc

SEQ ID NO: 2223901 - RNA, 17 nt, Human
ggaucugccccucccug

SEQ ID NO: 2223902 - RNA, 20 nt, Human
ggaucugccccucccugcuu

SEQ ID NO: 2223903 - RNA, 19 nt, Human
ggaucugggacccuuuccu

SEQ ID NO: 2223904 - RNA, 17 nt, Human
ggaucuggagaaccuca

SEQ ID NO: 2223905 - RNA, 18 nt, Human
ggaucuggggcucuggga

SEQ ID NO: 2223906 - RNA, 21 nt, Human
ggaucugguagggggaaaaug

SEQ ID NO: 2223907 - RNA, 17 nt, Human
ggaucugguccuaccca

SEQ ID NO: 2223908 - RNA, 23 nt, Human
ggaucugggacccuuuccuuccu

SEQ ID NO: 2223909 - RNA, 19 nt, Human
ggaucugucacaccagcca

SEQ ID NO: 2223910 - RNA, 15 nt, Human
ggaucuguccaagga

SEQ ID NO: 2223911 - RNA, 16 nt, Human
ggaucuguccaaggaa

SEQ ID NO: 2223912 - RNA, 23 nt, Human
ggaucuguuguguacguggagag

SEQ ID NO: 2223913 - RNA, 15 nt, Human
ggaucuucaauggcu

SEQ ID NO: 2223914 - RNA, 16 nt, Human
ggaucugugcccagag

SEQ ID NO: 2223915 - RNA, 15 nt, Human
ggaucugugcccaga

SEQ ID NO: 2223916 - RNA, 15 nt, Human
ggauccuccaggugc

SEQ ID NO: 2223917 - RNA, 14 nt, Human
ggauccuccaggug

SEQ ID NO: 2223918 - RNA, 13 nt, Human
ggauccugagcca

SEQ ID NO: 2223919 - RNA, 14 nt, Human
ggauccugagccag

SEQ ID NO: 2223920 - RNA, 20 nt, Human
ggauaaugcuguugccucau

SEQ ID NO: 2223921 - RNA, 21 nt, Human
ggauaagguaccuuucacaua

SEQ ID NO: 2223922 - RNA, 14 nt, Human
ggauaaccuauaug

SEQ ID NO: 2223923 - RNA, 15 nt, Human
ggauaaaaugagguu

SEQ ID NO: 2223924 - RNA, 15 nt, Human
ggauaaagccacuga

SEQ ID NO: 2223925 - RNA, 14 nt, Human
ggauaaaaugaggu

SEQ ID NO: 2223926 - RNA, 20 nt, Human
ggaguuuuuguuuggagagc

SEQ ID NO: 2223927 - RNA, 15 nt, Human
ggauaaaaagauguu

SEQ ID NO: 2223928 - RNA, 18 nt, Human
ggaguuucuuuccugccu

SEQ ID NO: 2223929 - RNA, 20 nt, Human
ggaguuugaggcugcagcga

SEQ ID NO: 2223930 - RNA, 19 nt, Human
ggaguuugaggcugcagcg

SEQ ID NO: 2223931 - RNA, 22 nt, Human
ggaguugucaagucucugcugg

SEQ ID NO: 2223932 - RNA, 21 nt, Human
ggaguuggaagugugugaucu

SEQ ID NO: 2223933 - RNA, 13 nt, Human
ggaguuugaggcu

SEQ ID NO: 2223934 - RNA, 16 nt, Human
ggaguuucuuuccugc

SEQ ID NO: 2223935 - RNA, 19 nt, Human
ggaguggaagaagagggag

SEQ ID NO: 2223936 - RNA, 20 nt, Human
ggaguggaauaguauccucc

SEQ ID NO: 2223937 - RNA, 12 nt, Human
ggagugcagugg

SEQ ID NO: 2223938 - RNA, 14 nt, Human
ggaguggccacaga

SEQ ID NO: 2223939 - RNA, 13 nt, Human
ggaguggagugga

SEQ ID NO: 2223940 - RNA, 22 nt, Human
ggaguggaauaguauccuccag

SEQ ID NO: 2223941 - RNA, 23 nt, Human
ggaguggaauaguauccuccagg

SEQ ID NO: 2223942 - RNA, 16 nt, Human
ggaguucuaugcucuc

SEQ ID NO: 2223943 - RNA, 23 nt, Human
ggaguugaucgccuuucccaggu

SEQ ID NO: 2223944 - RNA, 20 nt, Human
ggaguugaucgccuuuccca

SEQ ID NO: 2223945 - RNA, 22 nt, Human
ggaguugaucuggaacccagac

SEQ ID NO: 2223946 - RNA, 21 nt, Human
ggaguugaucuggaacccaga

SEQ ID NO: 2223947 - RNA, 17 nt, Human
ggaguugaucuggaacc

SEQ ID NO: 2223948 - RNA, 14 nt, Human
ggaguugaucugga

SEQ ID NO: 2223949 - RNA, 21 nt, Human
ggaguucgaggcugcagucag

SEQ ID NO: 2223950 - RNA, 20 nt, Human
ggaguucgaggcugcaguca

SEQ ID NO: 2223951 - RNA, 15 nt, Human
ggaguucgaggcugc

SEQ ID NO: 2223952 - RNA, 20 nt, Human
ggaguucgagaccagccugg

SEQ ID NO: 2223953 - RNA, 15 nt, Human
ggaguucugguuccu

SEQ ID NO: 2223954 - RNA, 15 nt, Human
ggagugcagugagcc

SEQ ID NO: 2223955 - RNA, 14 nt, Human
ggagcaugggccug

SEQ ID NO: 2223956 - RNA, 19 nt, Human
ggagcauuggcugagagac

SEQ ID NO: 2223957 - RNA, 15 nt, Human
ggagcauggcuguga

SEQ ID NO: 2223958 - RNA, 17 nt, Human
ggagcauggcugugagg

SEQ ID NO: 2223959 - RNA, 16 nt, Human
ggagcaugggccuggc

SEQ ID NO: 2223960 - RNA, 21 nt, Human
ggagcaucucuugaggccagg

SEQ ID NO: 2223961 - RNA, 14 nt, Human
ggagcaucugacuc

SEQ ID NO: 2223962 - RNA, 16 nt, Human
ggagcaucugacucac

SEQ ID NO: 2223963 - RNA, 20 nt, Human
ggagcaucucuugaggccag

SEQ ID NO: 2223964 - RNA, 16 nt, Human
ggagcaucucuugagg

SEQ ID NO: 2223965 - RNA, 18 nt, Human
ggagcagugucuuccaua

SEQ ID NO: 2223966 - RNA, 18 nt, Human
ggagcauagaaggcaggu

SEQ ID NO: 2223967 - RNA, 17 nt, Human
ggagcauccaccuccuu

SEQ ID NO: 2223968 - RNA, 18 nt, Human
ggagcauccaccuccuuc

SEQ ID NO: 2223969 - RNA, 19 nt, Human
ggagcauccaccuccuucu

SEQ ID NO: 2223970 - RNA, 22 nt, Human
ggagcauccaccuccuucucug

SEQ ID NO: 2223971 - RNA, 17 nt, Human
ggagcagugucuuccau

SEQ ID NO: 2223972 - RNA, 13 nt, Human
ggagcagugucuu

SEQ ID NO: 2223973 - RNA, 16 nt, Human
ggagcaucagugcccu

SEQ ID NO: 2223974 - RNA, 20 nt, Human
ggagcuggccccgccgccug

SEQ ID NO: 2223975 - RNA, 18 nt, Human
ggagcuggccccgccgcc

SEQ ID NO: 2223976 - RNA, 21 nt, Human
ggagcugccuguucagcucca

SEQ ID NO: 2223977 - RNA, 13 nt, Human
ggagcugcccaga

SEQ ID NO: 2223978 - RNA, 22 nt, Human
ggagccccuggguggguggugg

SEQ ID NO: 2223979 - RNA, 12 nt, Human
ggagcugccugu

SEQ ID NO: 2223980 - RNA, 16 nt, Human
ggagccccgaggccuu

SEQ ID NO: 2223981 - RNA, 20 nt, Human
ggagcccccgccccgcccca

SEQ ID NO: 2223982 - RNA, 13 nt, Human
ggagccccugggu

SEQ ID NO: 2223983 - RNA, 13 nt, Human
ggagcccccgccc

SEQ ID NO: 2223984 - RNA, 14 nt, Human
ggagccccugggug

SEQ ID NO: 2223985 - RNA, 15 nt, Human
ggagccccugggugg

SEQ ID NO: 2223986 - RNA, 16 nt, Human
ggagccccuggguggg

SEQ ID NO: 2223987 - RNA, 21 nt, Human
ggagccccuggguggguggug

SEQ ID NO: 2223988 - RNA, 22 nt, Human
ggagccccgaggccuucucuga

SEQ ID NO: 2223989 - RNA, 18 nt, Human
ggagccacuaacuagagc

SEQ ID NO: 2223990 - RNA, 16 nt, Human
ggagccacuccucuga

SEQ ID NO: 2223991 - RNA, 21 nt, Human
ggagccagcucccucuauuua

SEQ ID NO: 2223992 - RNA, 21 nt, Human
ggagccacuccucugacucag

SEQ ID NO: 2223993 - RNA, 19 nt, Human
ggagccacuccucugacuc

SEQ ID NO: 2223994 - RNA, 15 nt, Human
ggagccaacugcugc

SEQ ID NO: 2223995 - RNA, 16 nt, Human
ggagccaacugcugcu

SEQ ID NO: 2223996 - RNA, 17 nt, Human
ggagccaacugcugcuu

SEQ ID NO: 2223997 - RNA, 20 nt, Human
ggagccaacagaagcuucca

SEQ ID NO: 2223998 - RNA, 15 nt, Human
ggagcauuuggagag

SEQ ID NO: 2223999 - RNA, 19 nt, Human
ggagcauuuggagagaagg

SEQ ID NO: 2224000 - RNA, 23 nt, Human
ggagccaaggguucagagacuca

SEQ ID NO: 2224001 - RNA, 17 nt, Human
ggagccaaguccagauu

SEQ ID NO: 2224002 - RNA, 16 nt, Human
ggagccaauggagacu

SEQ ID NO: 2224003 - RNA, 19 nt, Human
ggagcccaggcgggagcgg

SEQ ID NO: 2224004 - RNA, 22 nt, Human
ggagcccaggcgggagcggugg

SEQ ID NO: 2224005 - RNA, 16 nt, Human
ggagcccagcucugaa

SEQ ID NO: 2224006 - RNA, 19 nt, Human
ggagcccagcccuccccau

SEQ ID NO: 2224007 - RNA, 16 nt, Human
ggagcccagcccuccc

SEQ ID NO: 2224008 - RNA, 12 nt, Human
ggagccagcucu

SEQ ID NO: 2224009 - RNA, 17 nt, Human
ggagcccacuguccugg

SEQ ID NO: 2224010 - RNA, 14 nt, Human
ggagcccacugucc

SEQ ID NO: 2224011 - RNA, 23 nt, Human
ggagcccacuguccugggccugc

SEQ ID NO: 2224012 - RNA, 22 nt, Human
ggagcccacuguccugggccug

SEQ ID NO: 2224013 - RNA, 20 nt, Human
ggagcccacuguccugggcc

SEQ ID NO: 2224014 - RNA, 18 nt, Human
ggagcccacuguccuggg

SEQ ID NO: 2224015 - RNA, 21 nt, Human
ggaggaaggcuuacacccaca

SEQ ID NO: 2224016 - RNA, 13 nt, Human
ggaggaaggagag

SEQ ID NO: 2224017 - RNA, 13 nt, Human
ggaggaaggauug

SEQ ID NO: 2224018 - RNA, 13 nt, Human
ggaggaaggcaag

SEQ ID NO: 2224019 - RNA, 21 nt, Human
ggagcuuagccaaugugggag

SEQ ID NO: 2224020 - RNA, 20 nt, Human
ggagcuucauggcagaaggc

SEQ ID NO: 2224021 - RNA, 11 nt, Human
ggaggaaggau

SEQ ID NO: 2224022 - RNA, 20 nt, Human
ggaggaaggaaacccagcuc

SEQ ID NO: 2224023 - RNA, 23 nt, Human
ggaggaaggaaacccagcucugg

SEQ ID NO: 2224024 - RNA, 18 nt, Human
ggagcugggcagaaggcc

SEQ ID NO: 2224025 - RNA, 19 nt, Human
ggagcugggcagaaggcca

SEQ ID NO: 2224026 - RNA, 17 nt, Human
ggagcuggggaucccuc

SEQ ID NO: 2224027 - RNA, 17 nt, Human
ggagcuggcgucugucu

SEQ ID NO: 2224028 - RNA, 21 nt, Human
ggagcuggccgugggccuggg

SEQ ID NO: 2224029 - RNA, 15 nt, Human
ggagcugggaggaaa

SEQ ID NO: 2224030 - RNA, 14 nt, Human
ggagcugggaggaa

SEQ ID NO: 2224031 - RNA, 21 nt, Human
ggagcugggacacuuaacaga

SEQ ID NO: 2224032 - RNA, 19 nt, Human
ggaggaaggaaacccagcu

SEQ ID NO: 2224033 - RNA, 23 nt, Human
ggagcugguuagaaaugcagaau

SEQ ID NO: 2224034 - RNA, 18 nt, Human
ggagcugguuagaaaugc

SEQ ID NO: 2224035 - RNA, 18 nt, Human
ggagcuguaaaccagaga

SEQ ID NO: 2224036 - RNA, 20 nt, Human
ggaggccaagugcaggcugg

SEQ ID NO: 2224037 - RNA, 12 nt, Human
ggaggccaccuc

SEQ ID NO: 2224038 - RNA, 14 nt, Human
ggaggccaccucuc

SEQ ID NO: 2224039 - RNA, 18 nt, Human
ggaggccaccucuccaag

SEQ ID NO: 2224040 - RNA, 19 nt, Human
ggaggccaccucuccaagg

SEQ ID NO: 2224041 - RNA, 11 nt, Human
ggaggccagcc

SEQ ID NO: 2224042 - RNA, 16 nt, Human
ggaggccagccaguga

SEQ ID NO: 2224043 - RNA, 16 nt, Human
ggaggccccuggccca

SEQ ID NO: 2224044 - RNA, 17 nt, Human
ggaggccccuggcccag

SEQ ID NO: 2224045 - RNA, 17 nt, Human
ggaggccccacugggga

SEQ ID NO: 2224046 - RNA, 13 nt, Human
ggaggccagccag

SEQ ID NO: 2224047 - RNA, 12 nt, Human
ggaggccagcca

SEQ ID NO: 2224048 - RNA, 21 nt, Human
ggaggccaccucuccaagggc

SEQ ID NO: 2224049 - RNA, 12 nt, Human
ggaggccagccu

SEQ ID NO: 2224050 - RNA, 17 nt, Human
ggaggaaugcuccccca

SEQ ID NO: 2224051 - RNA, 13 nt, Human
ggaggacaauuca

SEQ ID NO: 2224052 - RNA, 14 nt, Human
ggaggacaauucau

SEQ ID NO: 2224053 - RNA, 18 nt, Human
ggaggaaugcucccccau

SEQ ID NO: 2224054 - RNA, 16 nt, Human
ggaggaaugcuccccc

SEQ ID NO: 2224055 - RNA, 15 nt, Human
ggaggaaugcucccc

SEQ ID NO: 2224056 - RNA, 23 nt, Human
ggaggaaucgaggaaccagagcc

SEQ ID NO: 2224057 - RNA, 22 nt, Human
ggaggaaucgaggaaccagagc

SEQ ID NO: 2224058 - RNA, 21 nt, Human
ggaggaaucgaggaaccagag

SEQ ID NO: 2224059 - RNA, 20 nt, Human
ggaggaaucgaggaaccaga

SEQ ID NO: 2224060 - RNA, 19 nt, Human
ggaggaaucgaggaaccag

SEQ ID NO: 2224061 - RNA, 14 nt, Human
ggaggaaggcaaga

SEQ ID NO: 2224062 - RNA, 20 nt, Human
ggaggccaaggugggaggau

SEQ ID NO: 2224063 - RNA, 18 nt, Human
ggaggccaagugcaggcu

SEQ ID NO: 2224064 - RNA, 19 nt, Human
ggaggacaauucaugaacu

SEQ ID NO: 2224065 - RNA, 20 nt, Human
ggaggaccagggcagggcca

SEQ ID NO: 2224066 - RNA, 14 nt, Human
ggaggccugggggc

SEQ ID NO: 2224067 - RNA, 18 nt, Human
ggaggccugggggcaggg

SEQ ID NO: 2224068 - RNA, 22 nt, Human
ggaggcgcacuuuccuccuggc

SEQ ID NO: 2224069 - RNA, 16 nt, Human
ggaggggggagguggg

SEQ ID NO: 2224070 - RNA, 18 nt, Human
ggaggccgggugcucagg

SEQ ID NO: 2224071 - RNA, 17 nt, Human
ggaggcccguccggcag

SEQ ID NO: 2224072 - RNA, 18 nt, Human
ggaggccccuggcccagc

SEQ ID NO: 2224073 - RNA, 19 nt, Human
ggaggccccuggcccagcg

SEQ ID NO: 2224074 - RNA, 22 nt, Human
ggaggccccuggcccagcggcc

SEQ ID NO: 2224075 - RNA, 23 nt, Human
ggaggccccuggcccagcggccc

SEQ ID NO: 2224076 - RNA, 17 nt, Human
ggaggggugguccugac

SEQ ID NO: 2224077 - RNA, 17 nt, Human
ggagggguguggcagug

SEQ ID NO: 2224078 - RNA, 15 nt, Human
ggagggguguggcuc

SEQ ID NO: 2224079 - RNA, 14 nt, Human
ggagggguugccac

SEQ ID NO: 2224080 - RNA, 16 nt, Human
ggagggguugccacag

SEQ ID NO: 2224081 - RNA, 18 nt, Human
ggaggggguuugggggcu

SEQ ID NO: 2224082 - RNA, 23 nt, Human
ggaggggguuugcuggggaacug

SEQ ID NO: 2224083 - RNA, 23 nt, Human
ggagggguaacuugcaccucuga

SEQ ID NO: 2224084 - RNA, 12 nt, Human
ggaggcgcgagc

SEQ ID NO: 2224085 - RNA, 22 nt, Human
ggaggggguuugcuggggaacu

SEQ ID NO: 2224086 - RNA, 21 nt, Human
ggagguagcuuugagguggaa

SEQ ID NO: 2224087 - RNA, 17 nt, Human
ggagggguugccacagg

SEQ ID NO: 2224088 - RNA, 18 nt, Human
ggagggguugccacaggc

SEQ ID NO: 2224089 - RNA, 19 nt, Human
ggagggguugccacaggcc

SEQ ID NO: 2224090 - RNA, 21 nt, Human
ggagggguugccacaggccuc

SEQ ID NO: 2224091 - RNA, 22 nt, Human
ggagggguugccacaggccucc

SEQ ID NO: 2224092 - RNA, 23 nt, Human
ggaggguaaaugauguggugccu

SEQ ID NO: 2224093 - RNA, 13 nt, Human
ggaggugccagca

SEQ ID NO: 2224094 - RNA, 13 nt, Human
ggaggugagggau

SEQ ID NO: 2224095 - RNA, 19 nt, Human
ggagguggagguugcagug

SEQ ID NO: 2224096 - RNA, 20 nt, Human
ggagguggaggcugcaguga

SEQ ID NO: 2224097 - RNA, 14 nt, Human
ggaggugccagcaa

SEQ ID NO: 2224098 - RNA, 19 nt, Human
ggaggugccagcaaagccc

SEQ ID NO: 2224099 - RNA, 22 nt, Human
ggaggugcuuaagcagaagcau

SEQ ID NO: 2224100 - RNA, 17 nt, Human
ggagguggaagaaggga

SEQ ID NO: 2224101 - RNA, 20 nt, Human
ggagguggagguugcaguga

SEQ ID NO: 2224102 - RNA, 20 nt, Human
ggagguggaagaagggagaa

SEQ ID NO: 2224103 - RNA, 22 nt, Human
ggagguauucguaaggauggga

SEQ ID NO: 2224104 - RNA, 20 nt, Human
ggagguagagguugugguga

SEQ ID NO: 2224105 - RNA, 19 nt, Human
ggaggucacauucaggaag

SEQ ID NO: 2224106 - RNA, 20 nt, Human
ggaggucacauucaggaaga

SEQ ID NO: 2224107 - RNA, 23 nt, Human
ggaggucacauucaggaagauga

SEQ ID NO: 2224108 - RNA, 13 nt, Human
ggaggucacugga

SEQ ID NO: 2224109 - RNA, 21 nt, Human
ggaggucacuggaaaggggag

SEQ ID NO: 2224110 - RNA, 20 nt, Human
ggaggucaaggcugcaguga

SEQ ID NO: 2224111 - RNA, 22 nt, Human
ggaggucgaccccaaagccccu

SEQ ID NO: 2224112 - RNA, 17 nt, Human
ggaggucacuggaaagg

SEQ ID NO: 2224113 - RNA, 17 nt, Human
ggaggucguguauuugg

SEQ ID NO: 2224114 - RNA, 14 nt, Human
ggaggucgaggcag

SEQ ID NO: 2224115 - RNA, 18 nt, Human
ggaggucgguagguucag

SEQ ID NO: 2224116 - RNA, 14 nt, Human
ggaggugaccccag

SEQ ID NO: 2224117 - RNA, 23 nt, Human
gggcagcgcccuuccucuccacc

SEQ ID NO: 2224118 - RNA, 16 nt, Human
gggcagcgcccuuccu

SEQ ID NO: 2224119 - RNA, 18 nt, Human
gggcagcgcccuuccucu

SEQ ID NO: 2224120 - RNA, 20 nt, Human
gggcagcgcccuuccucucc

SEQ ID NO: 2224121 - RNA, 21 nt, Human
gggcagcgcccuuccucucca

SEQ ID NO: 2224122 - RNA, 12 nt, Human
gggcagcugcca

SEQ ID NO: 2224123 - RNA, 18 nt, Human
gggcagcugccagagaag

SEQ ID NO: 2224124 - RNA, 16 nt, Human
gggcagcugccagaga

SEQ ID NO: 2224125 - RNA, 19 nt, Human
gggcagcccuugcuuguug

SEQ ID NO: 2224126 - RNA, 16 nt, Human
gggcagcgccaggcug

SEQ ID NO: 2224127 - RNA, 15 nt, Human
gggcagcgccaggcu

SEQ ID NO: 2224128 - RNA, 13 nt, Human
gggcagcgccagg

SEQ ID NO: 2224129 - RNA, 14 nt, Human
gggcagagggcaga

SEQ ID NO: 2224130 - RNA, 23 nt, Human
gggcagaggcuggaggcagggcc

SEQ ID NO: 2224131 - RNA, 21 nt, Human
gggcagaggcuggaggcaggg

SEQ ID NO: 2224132 - RNA, 16 nt, Human
gggcagaggcuggagg

SEQ ID NO: 2224133 - RNA, 20 nt, Human
gggcagagggcagaggcugg

SEQ ID NO: 2224134 - RNA, 15 nt, Human
gggcagagggcagag

SEQ ID NO: 2224135 - RNA, 14 nt, Human
gggcagaggcugga

SEQ ID NO: 2224136 - RNA, 15 nt, Human
gggcagaggcuggag

SEQ ID NO: 2224137 - RNA, 22 nt, Human
gggcaacagagcaagauccugu

SEQ ID NO: 2224138 - RNA, 16 nt, Human
gggcagagucacacgg

SEQ ID NO: 2224139 - RNA, 17 nt, Human
gggcagagugagaccca

SEQ ID NO: 2224140 - RNA, 12 nt, Human
gggcagagucac

SEQ ID NO: 2224141 - RNA, 14 nt, Human
gggcagcccuugcu

SEQ ID NO: 2224142 - RNA, 16 nt, Human
gggcagauuuucagca

SEQ ID NO: 2224143 - RNA, 23 nt, Human
aaaagguaaaacuuuuuauauuu

SEQ ID NO: 2224144 - RNA, 14 nt, Human
aaaagguaaaacuu

SEQ ID NO: 2224145 - RNA, 19 nt, Human
aaaagguaugcaaucaaau

SEQ ID NO: 2224146 - RNA, 19 nt, Human
aaaagggcucuuuagccag

SEQ ID NO: 2224147 - RNA, 19 nt, Human
aaaagggucuugggaaaua

SEQ ID NO: 2224148 - RNA, 21 nt, Human
aaaagggucuugggaaauaug

SEQ ID NO: 2224149 - RNA, 23 nt, Human
aaaagggcagggcaucuccugug

SEQ ID NO: 2224150 - RNA, 18 nt, Human
aaaagggauuacccaagc

SEQ ID NO: 2224151 - RNA, 19 nt, Human
aaaagggacugagaaauuu

SEQ ID NO: 2224152 - RNA, 12 nt, Human
gggcagggagcg

SEQ ID NO: 2224153 - RNA, 15 nt, Human
gggcaggccagagcu

SEQ ID NO: 2224154 - RNA, 13 nt, Human
gggcaggcccugc

SEQ ID NO: 2224155 - RNA, 14 nt, Human
gggcaggcccugca

SEQ ID NO: 2224156 - RNA, 17 nt, Human
gggcaggcccugcacug

SEQ ID NO: 2224157 - RNA, 19 nt, Human
gggcaggcccugcacuguc

SEQ ID NO: 2224158 - RNA, 11 nt, Human
gggcaggcagu

SEQ ID NO: 2224159 - RNA, 17 nt, Human
gggcaggcacagcacag

SEQ ID NO: 2224160 - RNA, 15 nt, Human
gggcaggcaugaagu

SEQ ID NO: 2224161 - RNA, 12 nt, Human
gggcaggcacag

SEQ ID NO: 2224162 - RNA, 13 nt, Human
gggcaggcacagc

SEQ ID NO: 2224163 - RNA, 14 nt, Human
gggcaggcacagca

SEQ ID NO: 2224164 - RNA, 15 nt, Human
gggcaggcacagcac

SEQ ID NO: 2224165 - RNA, 20 nt, Human
gggcagggaaggggaggcag

SEQ ID NO: 2224166 - RNA, 21 nt, Human
gggcaggcccugcacuguccu

SEQ ID NO: 2224167 - RNA, 22 nt, Human
gggcaggcccugcacuguccug

SEQ ID NO: 2224168 - RNA, 23 nt, Human
gggcaggcccugcacuguccugc

SEQ ID NO: 2224169 - RNA, 13 nt, Human
gggcaggcugaca

SEQ ID NO: 2224170 - RNA, 15 nt, Human
gggauuacaggugug

SEQ ID NO: 2224171 - RNA, 12 nt, Human
gggauuacaggu

SEQ ID NO: 2224172 - RNA, 20 nt, Human
gggauuacaggcgugagcca

SEQ ID NO: 2224173 - RNA, 15 nt, Human
gggauuacccaagca

SEQ ID NO: 2224174 - RNA, 16 nt, Human
gggauuacccaagcaa

SEQ ID NO: 2224175 - RNA, 21 nt, Human
gggauuacaggcuccugccac

SEQ ID NO: 2224176 - RNA, 16 nt, Human
gggauuacaggcuccu

SEQ ID NO: 2224177 - RNA, 13 nt, Human
gggauuacaggcu

SEQ ID NO: 2224178 - RNA, 14 nt, Human
gggauuacaggcgu

SEQ ID NO: 2224179 - RNA, 17 nt, Human
gggauuguaaaauggug

SEQ ID NO: 2224180 - RNA, 14 nt, Human
gggcaaagccuagu

SEQ ID NO: 2224181 - RNA, 16 nt, Human
gggauugggggcuggu

SEQ ID NO: 2224182 - RNA, 17 nt, Human
gggauugcugccacuuu

SEQ ID NO: 2224183 - RNA, 16 nt, Human
gggauuguaaaauggu

SEQ ID NO: 2224184 - RNA, 15 nt, Human
gggauugcugccacu

SEQ ID NO: 2224185 - RNA, 15 nt, Human
gggauugggccccug

SEQ ID NO: 2224186 - RNA, 16 nt, Human
gggcaacccccagccu

SEQ ID NO: 2224187 - RNA, 18 nt, Human
gggcaacccccagccugc

SEQ ID NO: 2224188 - RNA, 16 nt, Human
gggcagagcagagacc

SEQ ID NO: 2224189 - RNA, 17 nt, Human
gggcagagcagagacca

SEQ ID NO: 2224190 - RNA, 22 nt, Human
gggcagagcagagaccaucccu

SEQ ID NO: 2224191 - RNA, 14 nt, Human
gggcagaggaaagc

SEQ ID NO: 2224192 - RNA, 15 nt, Human
gggagcaggcggugg

SEQ ID NO: 2224193 - RNA, 21 nt, Human
gggagcaggagauugagaagg

SEQ ID NO: 2224194 - RNA, 12 nt, Human
gggagcaggaga

SEQ ID NO: 2224195 - RNA, 13 nt, Human
gggagcaggagau

SEQ ID NO: 2224196 - RNA, 18 nt, Human
gggagcaggagauugaga

SEQ ID NO: 2224197 - RNA, 21 nt, Human
gggagcaggcggugggcaccc

SEQ ID NO: 2224198 - RNA, 19 nt, Human
gggaggccaaggugggagg

SEQ ID NO: 2224199 - RNA, 20 nt, Human
gggaggcggagcuugcagug

SEQ ID NO: 2224200 - RNA, 13 nt, Human
gggaggcucaggu

SEQ ID NO: 2224201 - RNA, 14 nt, Human
gggaggcgcgagcc

SEQ ID NO: 2224202 - RNA, 20 nt, Human
gggaggcggacguuccagcc

SEQ ID NO: 2224203 - RNA, 21 nt, Human
gggaggcggacguuccagccg

SEQ ID NO: 2224204 - RNA, 18 nt, Human
gggaggcggagaguacag

SEQ ID NO: 2224205 - RNA, 18 nt, Human
gggaggccccacugggga

SEQ ID NO: 2224206 - RNA, 17 nt, Human
gggaggccuaggcgggc

SEQ ID NO: 2224207 - RNA, 16 nt, Human
gggaggccccacuggg

SEQ ID NO: 2224208 - RNA, 11 nt, Human
gggaggcccca

SEQ ID NO: 2224209 - RNA, 19 nt, Human
gggagauggaucaaucaaa

SEQ ID NO: 2224210 - RNA, 19 nt, Human
gggagauggaguucuugug

SEQ ID NO: 2224211 - RNA, 16 nt, Human
gggagaggugccagca

SEQ ID NO: 2224212 - RNA, 17 nt, Human
gggagagugcaggccug

SEQ ID NO: 2224213 - RNA, 13 nt, Human
gggagcagagaca

SEQ ID NO: 2224214 - RNA, 16 nt, Human
gggagcagacaggagg

SEQ ID NO: 2224215 - RNA, 14 nt, Human
gggagcacuggagu

SEQ ID NO: 2224216 - RNA, 16 nt, Human
gggagcacuggagugc

SEQ ID NO: 2224217 - RNA, 17 nt, Human
gggagauucaagggacc

SEQ ID NO: 2224218 - RNA, 11 nt, Human
gggagcacugg

SEQ ID NO: 2224219 - RNA, 15 nt, Human
gggagagggucugga

SEQ ID NO: 2224220 - RNA, 14 nt, Human
gggagacacuggcc

SEQ ID NO: 2224221 - RNA, 19 nt, Human
gggagacacuggccccuca

SEQ ID NO: 2224222 - RNA, 12 nt, Human
gggagacagcau

SEQ ID NO: 2224223 - RNA, 15 nt, Human
gggagacaugugaca

SEQ ID NO: 2224224 - RNA, 21 nt, Human
aaaagcacacucauccccuca

SEQ ID NO: 2224225 - RNA, 16 nt, Human
aaaagcaauuccaacc

SEQ ID NO: 2224226 - RNA, 14 nt, Human
aaaagcaagacugu

SEQ ID NO: 2224227 - RNA, 14 nt, Human
aaaagcaaaugaga

SEQ ID NO: 2224228 - RNA, 14 nt, Human
aaaagauguagauu

SEQ ID NO: 2224229 - RNA, 14 nt, Human
aaaagcaaaaucau

SEQ ID NO: 2224230 - RNA, 12 nt, Human
aaaagcaagacu

SEQ ID NO: 2224231 - RNA, 19 nt, Human
aaaagauggggucuguaaa

SEQ ID NO: 2224232 - RNA, 13 nt, Human
aaaagauguagau

SEQ ID NO: 2224233 - RNA, 21 nt, Human
aaaagauggggucuguaaaau

SEQ ID NO: 2224234 - RNA, 15 nt, Human
aaaagaugcaaugua

SEQ ID NO: 2224235 - RNA, 17 nt, Human
aaaagcagcucuccccu

SEQ ID NO: 2224236 - RNA, 15 nt, Human
aaaagcauaaaugca

SEQ ID NO: 2224237 - RNA, 13 nt, Human
aaaagcauaaaug

SEQ ID NO: 2224238 - RNA, 16 nt, Human
aaaagcagcucucccc

SEQ ID NO: 2224239 - RNA, 14 nt, Human
aaaagcagcuacca

SEQ ID NO: 2224240 - RNA, 19 nt, Human
aaaagcagcccuuggccag

SEQ ID NO: 2224241 - RNA, 14 nt, Human
aaaagcacaagaag

SEQ ID NO: 2224242 - RNA, 15 nt, Human
gggagaaucauguga

SEQ ID NO: 2224243 - RNA, 12 nt, Human
gggagaagcucc

SEQ ID NO: 2224244 - RNA, 22 nt, Human
gggagaaugucaguauguggaa

SEQ ID NO: 2224245 - RNA, 19 nt, Human
gggagaaugucaguaugug

SEQ ID NO: 2224246 - RNA, 12 nt, Human
aaaagcauguac

SEQ ID NO: 2224247 - RNA, 13 nt, Human
aaaagcauguaca

SEQ ID NO: 2224248 - RNA, 14 nt, Human
aaaagcauguacag

SEQ ID NO: 2224249 - RNA, 22 nt, Human
gggagaagaaaggugaguuuga

SEQ ID NO: 2224250 - RNA, 20 nt, Human
gggaggcggagaguacagug

SEQ ID NO: 2224251 - RNA, 15 nt, Human
gggaggcucaggucc

SEQ ID NO: 2224252 - RNA, 15 nt, Human
gggauggaggagaag

SEQ ID NO: 2224253 - RNA, 14 nt, Human
gggauggaggagaa

SEQ ID NO: 2224254 - RNA, 18 nt, Human
gggauggacugaugcuuu

SEQ ID NO: 2224255 - RNA, 15 nt, Human
gggauggaaaaggaa

SEQ ID NO: 2224256 - RNA, 16 nt, Human
gggaugcccuggaggu

SEQ ID NO: 2224257 - RNA, 16 nt, Human
gggaugguccuggggc

SEQ ID NO: 2224258 - RNA, 15 nt, Human
gggaugguccugggg

SEQ ID NO: 2224259 - RNA, 16 nt, Human
gggaugggccaccgcc

SEQ ID NO: 2224260 - RNA, 12 nt, Human
gggaugggaggu

SEQ ID NO: 2224261 - RNA, 13 nt, Human
gggaugggccacc

SEQ ID NO: 2224262 - RNA, 14 nt, Human
gggaugggccaccg

SEQ ID NO: 2224263 - RNA, 15 nt, Human
gggaugggccaccgc

SEQ ID NO: 2224264 - RNA, 18 nt, Human
gggauggaggagaagaau

SEQ ID NO: 2224265 - RNA, 16 nt, Human
gggauguucuggcccu

SEQ ID NO: 2224266 - RNA, 13 nt, Human
gggauguucuggc

SEQ ID NO: 2224267 - RNA, 22 nt, Human
gggauguucagcacugucccuu

SEQ ID NO: 2224268 - RNA, 20 nt, Human
gggauuaauaugaaaacuua

SEQ ID NO: 2224269 - RNA, 16 nt, Human
gggauuaaccucugca

SEQ ID NO: 2224270 - RNA, 22 nt, Human
gggaugugaauugccugcagag

SEQ ID NO: 2224271 - RNA, 23 nt, Human
gggauguauccaugggggcaggg

SEQ ID NO: 2224272 - RNA, 20 nt, Human
gggauguggcugcagcagcg

SEQ ID NO: 2224273 - RNA, 14 nt, Human
gggaugugggaggg

SEQ ID NO: 2224274 - RNA, 16 nt, Human
gggaugguguucaaaa

SEQ ID NO: 2224275 - RNA, 17 nt, Human
gggaugguggagggcca

SEQ ID NO: 2224276 - RNA, 12 nt, Human
gggauggugccc

SEQ ID NO: 2224277 - RNA, 14 nt, Human
gggaugucucucau

SEQ ID NO: 2224278 - RNA, 18 nt, Human
gggaugguggagggccac

SEQ ID NO: 2224279 - RNA, 13 nt, Human
gggauggugcccu

SEQ ID NO: 2224280 - RNA, 22 nt, Human
gggauguacaaggcgaucccau

SEQ ID NO: 2224281 - RNA, 19 nt, Human
gggaggucgaggcaggagg

SEQ ID NO: 2224282 - RNA, 18 nt, Human
gggaggucgaggcaggag

SEQ ID NO: 2224283 - RNA, 17 nt, Human
gggaggucgaggcagga

SEQ ID NO: 2224284 - RNA, 18 nt, Human
gggagggcuccagacaca

SEQ ID NO: 2224285 - RNA, 22 nt, Human
gggaggcucuggagcccacugu

SEQ ID NO: 2224286 - RNA, 14 nt, Human
gggagggcuccaga

SEQ ID NO: 2224287 - RNA, 15 nt, Human
gggagggcuccagac

SEQ ID NO: 2224288 - RNA, 17 nt, Human
gggagggcuccagacac

SEQ ID NO: 2224289 - RNA, 14 nt, Human
aaaaaugccuuuga

SEQ ID NO: 2224290 - RNA, 15 nt, Human
aaaaaugccuuugag

SEQ ID NO: 2224291 - RNA, 18 nt, Human
aaaaaugccuuugagaca

SEQ ID NO: 2224292 - RNA, 14 nt, Human
aaaaaugcugaaca

SEQ ID NO: 2224293 - RNA, 24 nt, Human
aaaaaugccuuugagacaguuucu

SEQ ID NO: 2224294 - RNA, 19 nt, Human
aaaaaugccuuugagacag

SEQ ID NO: 2224295 - RNA, 20 nt, Human
aaaaaugccuuugagacagu

SEQ ID NO: 2224296 - RNA, 21 nt, Human
aaaaaugccuuugagacaguu

SEQ ID NO: 2224297 - RNA, 22 nt, Human
aaaaaugccuuugagacaguuu

SEQ ID NO: 2224298 - RNA, 18 nt, Human
aaaaaucuaccuucugua

SEQ ID NO: 2224299 - RNA, 15 nt, Human
aaaaauccucuuccu

SEQ ID NO: 2224300 - RNA, 19 nt, Human
aaaaauccucuuccucuga

SEQ ID NO: 2224301 - RNA, 19 nt, Human
aaaaaucuaccuucuguag

SEQ ID NO: 2224302 - RNA, 22 nt, Human
aaaaaucuaccuucuguaguuu

SEQ ID NO: 2224303 - RNA, 14 nt, Human
aaaaaucucaaauu

SEQ ID NO: 2224304 - RNA, 14 nt, Human
aaaaauggcucaga

SEQ ID NO: 2224305 - RNA, 18 nt, Human
aaaacaggucaauacagu

SEQ ID NO: 2224306 - RNA, 21 nt, Human
aaaacaggucuucaucgaauc

SEQ ID NO: 2224307 - RNA, 18 nt, Human
aaaacagguggagaaauu

SEQ ID NO: 2224308 - RNA, 16 nt, Human
aaaaaugcugaacauu

SEQ ID NO: 2224309 - RNA, 15 nt, Human
aaaaaugcugaacau

SEQ ID NO: 2224310 - RNA, 19 nt, Human
aaaaaugcugaacauugca

SEQ ID NO: 2224311 - RNA, 23 nt, Human
aaaaauggaaacauuuauuccuu

SEQ ID NO: 2224312 - RNA, 22 nt, Human
aaaaauggaacauaaaauacaa

SEQ ID NO: 2224313 - RNA, 20 nt, Human
aaaacaguccuucaaacuuc

SEQ ID NO: 2224314 - RNA, 18 nt, Human
aaaacauaaucuucugcc

SEQ ID NO: 2224315 - RNA, 17 nt, Human
aaaacauaaucuucugc

SEQ ID NO: 2224316 - RNA, 24 nt, Human
aaaacauaaucuucugccuucuca

SEQ ID NO: 2224317 - RNA, 20 nt, Human
aaaacauaaucuucugccuu

SEQ ID NO: 2224318 - RNA, 16 nt, Human
aaaacaugguagaauu

SEQ ID NO: 2224319 - RNA, 14 nt, Human
aaaacaugguagaa

SEQ ID NO: 2224320 - RNA, 16 nt, Human
aaaaaugggacuucuu

SEQ ID NO: 2224321 - RNA, 19 nt, Human
aaaacauguaauauaaaga

SEQ ID NO: 2224322 - RNA, 14 nt, Human
aaaacauuaagaaa

SEQ ID NO: 2224323 - RNA, 15 nt, Human
aaaacaugcuacaca

SEQ ID NO: 2224324 - RNA, 13 nt, Human
aaaacauuguucc

SEQ ID NO: 2224325 - RNA, 12 nt, Human
aaaacauuguuc

SEQ ID NO: 2224326 - RNA, 16 nt, Human
aaaacauuccauccuu

SEQ ID NO: 2224327 - RNA, 19 nt, Human
aaaacauuaagaaaaucau

SEQ ID NO: 2224328 - RNA, 23 nt, Human
aaaacauuaagaaaaucauauug

SEQ ID NO: 2224329 - RNA, 15 nt, Human
aaaacauuaagaaaa

SEQ ID NO: 2224330 - RNA, 16 nt, Human
aaaacauuaagaaaau

SEQ ID NO: 2224331 - RNA, 18 nt, Human
aaaacauuaagaaaauca

SEQ ID NO: 2224332 - RNA, 21 nt, Human
aaaaccaauguucucucuucu

SEQ ID NO: 2224333 - RNA, 12 nt, Human
aaaaccacagca

SEQ ID NO: 2224334 - RNA, 14 nt, Human
aaaaccacagcagu

SEQ ID NO: 2224335 - RNA, 13 nt, Human
aaaaccacagcag

SEQ ID NO: 2224336 - RNA, 15 nt, Human
aaaacccagagagga

SEQ ID NO: 2224337 - RNA, 13 nt, Human
aaaacccagagag

SEQ ID NO: 2224338 - RNA, 15 nt, Human
aaaacccagauaaag

SEQ ID NO: 2224339 - RNA, 22 nt, Human
aaaaccucacccgaggcugccc

SEQ ID NO: 2224340 - RNA, 13 nt, Human
aaaaccugacaaa

SEQ ID NO: 2224341 - RNA, 20 nt, Human
aaaaccuaaguccuuuaugu

SEQ ID NO: 2224342 - RNA, 21 nt, Human
aaaaccuaaguccuuuaugug

SEQ ID NO: 2224343 - RNA, 22 nt, Human
aaaaccccacuacacagucugc

SEQ ID NO: 2224344 - RNA, 15 nt, Human
aaaacccugccccca

SEQ ID NO: 2224345 - RNA, 13 nt, Human
aaaagaugcuucu

SEQ ID NO: 2224346 - RNA, 17 nt, Human
aaaagaugaaaauauuu

SEQ ID NO: 2224347 - RNA, 23 nt, Human
aaaacugcugacuguuuucucuu

SEQ ID NO: 2224348 - RNA, 22 nt, Human
aaaacugcugacuguuuucucu

SEQ ID NO: 2224349 - RNA, 18 nt, Human
aaaacucuacuuaaucca

SEQ ID NO: 2224350 - RNA, 19 nt, Human
aaaacucuacuuaauccaa

SEQ ID NO: 2224351 - RNA, 20 nt, Human
aaaacugcugacuguuuucu

SEQ ID NO: 2224352 - RNA, 13 nt, Human
aaaacucauuuuu

SEQ ID NO: 2224353 - RNA, 22 nt, Human
aaaacucgaggacuguauuugu

SEQ ID NO: 2224354 - RNA, 12 nt, Human
aaaacucuacuu

SEQ ID NO: 2224355 - RNA, 15 nt, Human
aaaacucuacuuaau

SEQ ID NO: 2224356 - RNA, 14 nt, Human
gggaagagggggcg

SEQ ID NO: 2224357 - RNA, 16 nt, Human
gggaagaguguacugg

SEQ ID NO: 2224358 - RNA, 17 nt, Human
gggaagaguguacuggg

SEQ ID NO: 2224359 - RNA, 12 nt, Human
gggaagcccugg

SEQ ID NO: 2224360 - RNA, 22 nt, Human
gggaagcagaauagcaaggugc

SEQ ID NO: 2224361 - RNA, 22 nt, Human
gggaagauaggcucugcacaga

SEQ ID NO: 2224362 - RNA, 17 nt, Human
gggaagagaggaguuca

SEQ ID NO: 2224363 - RNA, 11 nt, Human
gggaagagagg

SEQ ID NO: 2224364 - RNA, 18 nt, Human
gggaagagaggaguucaa

SEQ ID NO: 2224365 - RNA, 21 nt, Human
gggaagagaggaguucaauga

SEQ ID NO: 2224366 - RNA, 22 nt, Human
gggaagagaggaguucaaugau

SEQ ID NO: 2224367 - RNA, 23 nt, Human
gggaagagaggaguucaaugauc

SEQ ID NO: 2224368 - RNA, 24 nt, Human
gggaagagaggaguucaaugaucu

SEQ ID NO: 2224369 - RNA, 14 nt, Human
gggaagagcacagc

SEQ ID NO: 2224370 - RNA, 15 nt, Human
gggaagagcacagcc

SEQ ID NO: 2224371 - RNA, 16 nt, Human
gggaagagcacagccc

SEQ ID NO: 2224372 - RNA, 18 nt, Human
gggaagagcacagcccuc

SEQ ID NO: 2224373 - RNA, 20 nt, Human
gggaagagcacagcccuccc

SEQ ID NO: 2224374 - RNA, 22 nt, Human
gggaagagcacagcccucccgc

SEQ ID NO: 2224375 - RNA, 16 nt, Human
gggacagcuccuucug

SEQ ID NO: 2224376 - RNA, 23 nt, Human
gggacagaggggguggccuccca

SEQ ID NO: 2224377 - RNA, 13 nt, Human
gggacagaggggg

SEQ ID NO: 2224378 - RNA, 22 nt, Human
gggacagaggggguggccuccc

SEQ ID NO: 2224379 - RNA, 23 nt, Human
gggaagcggagguugcagggagc

SEQ ID NO: 2224380 - RNA, 16 nt, Human
gggaagcuacagguua

SEQ ID NO: 2224381 - RNA, 21 nt, Human
gggaagcugaggcgggagaau

SEQ ID NO: 2224382 - RNA, 17 nt, Human
gggaaggaacucuggcu

SEQ ID NO: 2224383 - RNA, 17 nt, Human
gggaaggaggcuggcuu

SEQ ID NO: 2224384 - RNA, 20 nt, Human
gggaagcuucuuaaaugaga

SEQ ID NO: 2224385 - RNA, 20 nt, Human
gggaaggaggguuagggagg

SEQ ID NO: 2224386 - RNA, 17 nt, Human
gggacagaggccugccc

SEQ ID NO: 2224387 - RNA, 16 nt, Human
gggaaggauacaaaag

SEQ ID NO: 2224388 - RNA, 15 nt, Human
gggacagaggccugc

SEQ ID NO: 2224389 - RNA, 13 nt, Human
gggaaggauacaa

SEQ ID NO: 2224390 - RNA, 15 nt, Human
gggacagagucuggg

SEQ ID NO: 2224391 - RNA, 18 nt, Human
gggacagaggccugcccg

SEQ ID NO: 2224392 - RNA, 21 nt, Human
gggacagcuccuucuguccua

SEQ ID NO: 2224393 - RNA, 19 nt, Human
gggacauuugcucauggaa

SEQ ID NO: 2224394 - RNA, 13 nt, Human
gggaccaaggacc

SEQ ID NO: 2224395 - RNA, 12 nt, Human
gggacagggcug

SEQ ID NO: 2224396 - RNA, 16 nt, Human
gggaccaacugggccc

SEQ ID NO: 2224397 - RNA, 14 nt, Human
gggacagggcucgc

SEQ ID NO: 2224398 - RNA, 13 nt, Human
aaaaauauaaaac

SEQ ID NO: 2224399 - RNA, 14 nt, Human
aaaaauauaaaacu

SEQ ID NO: 2224400 - RNA, 14 nt, Human
aaaaauauaacuua

SEQ ID NO: 2224401 - RNA, 12 nt, Human
aaaaauauaaaa

SEQ ID NO: 2224402 - RNA, 20 nt, Human
gggacauuugcucauggaau

SEQ ID NO: 2224403 - RNA, 21 nt, Human
gggacauuugcucauggaauu

SEQ ID NO: 2224404 - RNA, 16 nt, Human
aaaaauccagaaagaa

SEQ ID NO: 2224405 - RNA, 15 nt, Human
aaaaaucacauccug

SEQ ID NO: 2224406 - RNA, 16 nt, Human
aaaaaucauguuugcu

SEQ ID NO: 2224407 - RNA, 17 nt, Human
aaaaaucauaaacugug

SEQ ID NO: 2224408 - RNA, 11 nt, Human
aaaaauauuua

SEQ ID NO: 2224409 - RNA, 13 nt, Human
aaaaauauuccau

SEQ ID NO: 2224410 - RNA, 20 nt, Human
aaaaauauggaacuucuaau

SEQ ID NO: 2224411 - RNA, 16 nt, Human
aaaaauauuauaacuu

SEQ ID NO: 2224412 - RNA, 13 nt, Human
aaaaauauauuua

SEQ ID NO: 2224413 - RNA, 15 nt, Human
aaaaauauauuuaau

SEQ ID NO: 2224414 - RNA, 19 nt, Human
aaaaauauauuuaaugaua

SEQ ID NO: 2224415 - RNA, 23 nt, Human
aaaaauaugaccacacuccagcu

SEQ ID NO: 2224416 - RNA, 21 nt, Human
aaaaauaugaccacacuccag

SEQ ID NO: 2224417 - RNA, 21 nt, Human
aaaaugaguuaccuacauuuu

SEQ ID NO: 2224418 - RNA, 19 nt, Human
aaaaugaggaauguauaug

SEQ ID NO: 2224419 - RNA, 16 nt, Human
aaaaugaggacauguu

SEQ ID NO: 2224420 - RNA, 23 nt, Human
aaaaugaguuuuuauggggcuga

SEQ ID NO: 2224421 - RNA, 18 nt, Human
aaaaugagguucaacugu

SEQ ID NO: 2224422 - RNA, 23 nt, Human
aaaaugagcucgcauuugucaau

SEQ ID NO: 2224423 - RNA, 15 nt, Human
aaaaugaauccuaca

SEQ ID NO: 2224424 - RNA, 16 nt, Human
aaaaugaauccuacac

SEQ ID NO: 2224425 - RNA, 15 nt, Human
aaaaugaggaaugua

SEQ ID NO: 2224426 - RNA, 16 nt, Human
aaaaugaggaauguau

SEQ ID NO: 2224427 - RNA, 18 nt, Human
aaaaugaggaauguauau

SEQ ID NO: 2224428 - RNA, 21 nt, Human
aaaaugagccuggcaagaaug

SEQ ID NO: 2224429 - RNA, 14 nt, Human
aaaaugagccuggc

SEQ ID NO: 2224430 - RNA, 19 nt, Human
aaaaugaaagcaugucuca

SEQ ID NO: 2224431 - RNA, 22 nt, Human
aaaaucuuucuuucuuagaaau

SEQ ID NO: 2224432 - RNA, 23 nt, Human
aaaaucuuucuuucuuagaaauu

SEQ ID NO: 2224433 - RNA, 17 nt, Human
aaaaucuuucuuucuua

SEQ ID NO: 2224434 - RNA, 19 nt, Human
aaaaucuuucuuucuuaga

SEQ ID NO: 2224435 - RNA, 20 nt, Human
aaaaucuuucuuucuuagaa

SEQ ID NO: 2224436 - RNA, 21 nt, Human
aaaaucuuucuuucuuagaaa

SEQ ID NO: 2224437 - RNA, 22 nt, Human
aaaaugaaagcaugucucaaua

SEQ ID NO: 2224438 - RNA, 20 nt, Human
aaaaugaagguuaggauuua

SEQ ID NO: 2224439 - RNA, 16 nt, Human
aaaaucuguggugguc

SEQ ID NO: 2224440 - RNA, 14 nt, Human
aaaaguauuuuccu

SEQ ID NO: 2224441 - RNA, 15 nt, Human
aaaaguauauguuag

SEQ ID NO: 2224442 - RNA, 14 nt, Human
aaaaguauuauuuu

SEQ ID NO: 2224443 - RNA, 20 nt, Human
aaaaguauuauuuuccaaaa

SEQ ID NO: 2224444 - RNA, 22 nt, Human
aaaaguauuauuuuccaaaagu

SEQ ID NO: 2224445 - RNA, 20 nt, Human
aaaaguagguuuacauucau

SEQ ID NO: 2224446 - RNA, 14 nt, Human
aaaaguauauguua

SEQ ID NO: 2224447 - RNA, 13 nt, Human
aaaaguauauguu

SEQ ID NO: 2224448 - RNA, 19 nt, Human
aaaaguauguuagugcaaa

SEQ ID NO: 2224449 - RNA, 17 nt, Human
aaaaucuuggcacagaa

SEQ ID NO: 2224450 - RNA, 18 nt, Human
aaaaucuuggcacagaaa

SEQ ID NO: 2224451 - RNA, 19 nt, Human
aaaaucuguuugaucccug

SEQ ID NO: 2224452 - RNA, 12 nt, Human
aaaaguauuuuc

SEQ ID NO: 2224453 - RNA, 17 nt, Human
gggccaggacaggcccg

SEQ ID NO: 2224454 - RNA, 16 nt, Human
gggccaggacaggccc

SEQ ID NO: 2224455 - RNA, 14 nt, Human
gggccaggacugag

SEQ ID NO: 2224456 - RNA, 17 nt, Human
gggccaggacugagccc

SEQ ID NO: 2224457 - RNA, 13 nt, Human
gggccaggcuggg

SEQ ID NO: 2224458 - RNA, 11 nt, Human
gggccaggagc

SEQ ID NO: 2224459 - RNA, 15 nt, Human
gggccagccccuccc

SEQ ID NO: 2224460 - RNA, 12 nt, Human
gggccagccccu

SEQ ID NO: 2224461 - RNA, 13 nt, Human
gggccagccccuc

SEQ ID NO: 2224462 - RNA, 17 nt, Human
gggccagccccucccac

SEQ ID NO: 2224463 - RNA, 12 nt, Human
gggccagccagg

SEQ ID NO: 2224464 - RNA, 13 nt, Human
gggccagccaggc

SEQ ID NO: 2224465 - RNA, 14 nt, Human
gggccagccaggcg

SEQ ID NO: 2224466 - RNA, 15 nt, Human
gggccagccaggcgg

SEQ ID NO: 2224467 - RNA, 16 nt, Human
gggccagccaggcggg

SEQ ID NO: 2224468 - RNA, 17 nt, Human
gggccagccaggcgggc

SEQ ID NO: 2224469 - RNA, 18 nt, Human
gggccagccaggcgggcu

SEQ ID NO: 2224470 - RNA, 22 nt, Human
gggccagccaggcgggcucaag

SEQ ID NO: 2224471 - RNA, 18 nt, Human
aaaaugcugaacauugca

SEQ ID NO: 2224472 - RNA, 16 nt, Human
aaaaugcugaacauug

SEQ ID NO: 2224473 - RNA, 15 nt, Human
aaaaugcugaacauu

SEQ ID NO: 2224474 - RNA, 20 nt, Human
aaaaugcugaacauugcaua

SEQ ID NO: 2224475 - RNA, 19 nt, Human
gggccagauccagccuggg

SEQ ID NO: 2224476 - RNA, 15 nt, Human
aaaaugccuuugaga

SEQ ID NO: 2224477 - RNA, 17 nt, Human
aaaaugccuuugagaca

SEQ ID NO: 2224478 - RNA, 22 nt, Human
aaaaugccuuugagacaguuuc

SEQ ID NO: 2224479 - RNA, 23 nt, Human
aaaaugccuuugagacaguuucu

SEQ ID NO: 2224480 - RNA, 16 nt, Human
aaaaugccucagugua

SEQ ID NO: 2224481 - RNA, 18 nt, Human
aaaaugccucaguguauu

SEQ ID NO: 2224482 - RNA, 19 nt, Human
aaaaugccucaguguauuu

SEQ ID NO: 2224483 - RNA, 20 nt, Human
aaaaugccucaguguauuug

SEQ ID NO: 2224484 - RNA, 22 nt, Human
aaaaugccucaguguauuugua

SEQ ID NO: 2224485 - RNA, 11 nt, Human
aaaaugccuuu

SEQ ID NO: 2224486 - RNA, 12 nt, Human
aaaaugccuuug

SEQ ID NO: 2224487 - RNA, 14 nt, Human
aaaaugccuuugag

SEQ ID NO: 2224488 - RNA, 16 nt, Human
gggccagggcccugca

SEQ ID NO: 2224489 - RNA, 14 nt, Human
gggccagggcccug

SEQ ID NO: 2224490 - RNA, 13 nt, Human
gggccagggcccu

SEQ ID NO: 2224491 - RNA, 21 nt, Human
gggccaggcugggucgcccug

SEQ ID NO: 2224492 - RNA, 14 nt, Human
gggccaggcugggu

SEQ ID NO: 2224493 - RNA, 15 nt, Human
gggccaggcuggguc

SEQ ID NO: 2224494 - RNA, 21 nt, Human
gggccaguccugccuggccag

SEQ ID NO: 2224495 - RNA, 20 nt, Human
gggccaguccugccuggcca

SEQ ID NO: 2224496 - RNA, 19 nt, Human
gggccaguccugccuggcc

SEQ ID NO: 2224497 - RNA, 18 nt, Human
gggccaguccugccuggc

SEQ ID NO: 2224498 - RNA, 22 nt, Human
gggccaguccugccuggccagg

SEQ ID NO: 2224499 - RNA, 15 nt, Human
gggccagucugggcu

SEQ ID NO: 2224500 - RNA, 16 nt, Human
gggccagucugggcug

SEQ ID NO: 2224501 - RNA, 22 nt, Human
gggccagucuguggaucagaga

SEQ ID NO: 2224502 - RNA, 15 nt, Human
gggccaguccugccu

SEQ ID NO: 2224503 - RNA, 23 nt, Human
gggccaggggucucccuggagug

SEQ ID NO: 2224504 - RNA, 21 nt, Human
gggccagucccugaggcaggu

SEQ ID NO: 2224505 - RNA, 18 nt, Human
gggccagggcccugcaga

SEQ ID NO: 2224506 - RNA, 18 nt, Human
gggccagucccugaggca

SEQ ID NO: 2224507 - RNA, 22 nt, Human
gggccguaccccacccucagca

SEQ ID NO: 2224508 - RNA, 23 nt, Human
gggccuagauccacacacagagg

SEQ ID NO: 2224509 - RNA, 20 nt, Human
gggccuagauccacacacag

SEQ ID NO: 2224510 - RNA, 17 nt, Human
gggccgugcccaggggc

SEQ ID NO: 2224511 - RNA, 17 nt, Human
gggccuacuagagucug

SEQ ID NO: 2224512 - RNA, 13 nt, Human
gggccgugcccag

SEQ ID NO: 2224513 - RNA, 14 nt, Human
gggccgugcccagg

SEQ ID NO: 2224514 - RNA, 22 nt, Human
gggccuagauccacacacagag

SEQ ID NO: 2224515 - RNA, 23 nt, Human
gggccuagcugcuacaaagaaga

SEQ ID NO: 2224516 - RNA, 14 nt, Human
gggccuaucagugu

SEQ ID NO: 2224517 - RNA, 17 nt, Human
gggccuaggccucagcc

SEQ ID NO: 2224518 - RNA, 15 nt, Human
gggccuaucagugug

SEQ ID NO: 2224519 - RNA, 18 nt, Human
gggccuaucagugugccc

SEQ ID NO: 2224520 - RNA, 20 nt, Human
gggccuaucagugugccccc

SEQ ID NO: 2224521 - RNA, 22 nt, Human
gggccuaucagugugcccccca

SEQ ID NO: 2224522 - RNA, 23 nt, Human
gggccuaucagugugccccccau

SEQ ID NO: 2224523 - RNA, 19 nt, Human
gggcccugguccuuccagg

SEQ ID NO: 2224524 - RNA, 17 nt, Human
gggccaugcugaggccu

SEQ ID NO: 2224525 - RNA, 21 nt, Human
gggcccugguguuucuagcac

SEQ ID NO: 2224526 - RNA, 21 nt, Human
gggcccuucacugccuuugcu

SEQ ID NO: 2224527 - RNA, 13 nt, Human
gggccgcaggcgg

SEQ ID NO: 2224528 - RNA, 23 nt, Human
gggccgcaggcgggaaaagcagc

SEQ ID NO: 2224529 - RNA, 17 nt, Human
gggcccuuugagugcag

SEQ ID NO: 2224530 - RNA, 18 nt, Human
gggccgaauccccucccu

SEQ ID NO: 2224531 - RNA, 18 nt, Human
gggccaugagcuccagac

SEQ ID NO: 2224532 - RNA, 22 nt, Human
gggccaugauggcaacagaucu

SEQ ID NO: 2224533 - RNA, 17 nt, Human
gggccauacuggccucg

SEQ ID NO: 2224534 - RNA, 22 nt, Human
gggccauacuggccucgccugg

SEQ ID NO: 2224535 - RNA, 15 nt, Human
gggccauagcuccug

SEQ ID NO: 2224536 - RNA, 17 nt, Human
gggccauccugucccac

SEQ ID NO: 2224537 - RNA, 20 nt, Human
gggccagucugggcugccgg

SEQ ID NO: 2224538 - RNA, 14 nt, Human
gggccauacuggcc

SEQ ID NO: 2224539 - RNA, 15 nt, Human
gggccauacuggccu

SEQ ID NO: 2224540 - RNA, 16 nt, Human
gggccauacuggccuc

SEQ ID NO: 2224541 - RNA, 19 nt, Human
gggccaugagcuccagacc

SEQ ID NO: 2224542 - RNA, 15 nt, Human
gggccaugcugaagg

SEQ ID NO: 2224543 - RNA, 14 nt, Human
gggccaugcugagg

SEQ ID NO: 2224544 - RNA, 15 nt, Human
gggccaugcugaggc

SEQ ID NO: 2224545 - RNA, 23 nt, Human
gggccaugauggcaacagaucug

SEQ ID NO: 2224546 - RNA, 14 nt, Human
gggccaugcugaag

SEQ ID NO: 2224547 - RNA, 14 nt, Human
gggccaguuggucc

SEQ ID NO: 2224548 - RNA, 18 nt, Human
gggccaguuggucccccu

SEQ ID NO: 2224549 - RNA, 22 nt, Human
gggccaguuggucccccuucca

SEQ ID NO: 2224550 - RNA, 23 nt, Human
gggccaguuggucccccuuccau

SEQ ID NO: 2224551 - RNA, 14 nt, Human
gggcggcagagagg

SEQ ID NO: 2224552 - RNA, 17 nt, Human
gggcggcaggggccugg

SEQ ID NO: 2224553 - RNA, 21 nt, Human
gggcggcaggggccuggagau

SEQ ID NO: 2224554 - RNA, 15 nt, Human
gggcgcuggcccagc

SEQ ID NO: 2224555 - RNA, 16 nt, Human
gggcgcuggcccagcc

SEQ ID NO: 2224556 - RNA, 17 nt, Human
gggcgcuggcccagccg

SEQ ID NO: 2224557 - RNA, 18 nt, Human
gggcgcuggcccagccgg

SEQ ID NO: 2224558 - RNA, 19 nt, Human
gggcgcuggcccagccggc

SEQ ID NO: 2224559 - RNA, 23 nt, Human
gggcgcuggcccagccggccucu

SEQ ID NO: 2224560 - RNA, 14 nt, Human
gggcggcacagccu

SEQ ID NO: 2224561 - RNA, 15 nt, Human
gggcgggaggauguu

SEQ ID NO: 2224562 - RNA, 14 nt, Human
gggcggggccuugc

SEQ ID NO: 2224563 - RNA, 20 nt, Human
gggcgggcagcacagcaagg

SEQ ID NO: 2224564 - RNA, 15 nt, Human
gggcgggccccucau

SEQ ID NO: 2224565 - RNA, 15 nt, Human
gggcgggcagcacag

SEQ ID NO: 2224566 - RNA, 13 nt, Human
gggcggcugagag

SEQ ID NO: 2224567 - RNA, 17 nt, Human
gggcgggacccaggcac

SEQ ID NO: 2224568 - RNA, 20 nt, Human
gggcuaagagcuagcgcugc

SEQ ID NO: 2224569 - RNA, 14 nt, Human
gggcguguuguuuu

SEQ ID NO: 2224570 - RNA, 23 nt, Human
gggcuaagagcuagcgcugccgc

SEQ ID NO: 2224571 - RNA, 23 nt, Human
gggcuacaccuuagccugcccuc

SEQ ID NO: 2224572 - RNA, 15 nt, Human
gggcgugguggugag

SEQ ID NO: 2224573 - RNA, 13 nt, Human
gggcuacccugag

SEQ ID NO: 2224574 - RNA, 15 nt, Human
gggcuacaaggaccc

SEQ ID NO: 2224575 - RNA, 19 nt, Human
gggcuacccugagcugagg

SEQ ID NO: 2224576 - RNA, 16 nt, Human
gggcuacccugagcug

SEQ ID NO: 2224577 - RNA, 15 nt, Human
gggccuccugugugu

SEQ ID NO: 2224578 - RNA, 22 nt, Human
gggccucggacuuagcugggag

SEQ ID NO: 2224579 - RNA, 14 nt, Human
gggccuccagaacu

SEQ ID NO: 2224580 - RNA, 21 nt, Human
gggccuccucuguccagggcc

SEQ ID NO: 2224581 - RNA, 19 nt, Human
gggccucaaaggcccgcuc

SEQ ID NO: 2224582 - RNA, 13 nt, Human
gggccuccugugu

SEQ ID NO: 2224583 - RNA, 23 nt, Human
gggccucuugcggucccuucuua

SEQ ID NO: 2224584 - RNA, 21 nt, Human
gggccucuuggaaaaagugau

SEQ ID NO: 2224585 - RNA, 19 nt, Human
gggccucuuaugggcuggg

SEQ ID NO: 2224586 - RNA, 20 nt, Human
gggccucuuaugggcugggu

SEQ ID NO: 2224587 - RNA, 18 nt, Human
gggccugagccuggccag

SEQ ID NO: 2224588 - RNA, 18 nt, Human
gggccugcaggaccugcc

SEQ ID NO: 2224589 - RNA, 23 nt, Human
gggccugaggucuggcugcuugc

SEQ ID NO: 2224590 - RNA, 16 nt, Human
gggccugauggggagg

SEQ ID NO: 2224591 - RNA, 16 nt, Human
gggccugagccuggcc

SEQ ID NO: 2224592 - RNA, 15 nt, Human
gggccugagccuggc

SEQ ID NO: 2224593 - RNA, 17 nt, Human
gggccugagccaagcua

SEQ ID NO: 2224594 - RNA, 21 nt, Human
aaacaaaaauuagguauuuug

SEQ ID NO: 2224595 - RNA, 20 nt, Human
aaacaagaccacguuucuaa

SEQ ID NO: 2224596 - RNA, 19 nt, Human
aaaauuuuuuuucauguuu

SEQ ID NO: 2224597 - RNA, 18 nt, Human
aaaauuuuuuuucauguu

SEQ ID NO: 2224598 - RNA, 17 nt, Human
aaaauuuuuuuucaugu

SEQ ID NO: 2224599 - RNA, 16 nt, Human
aaaauuuuuuuucaug

SEQ ID NO: 2224600 - RNA, 15 nt, Human
aaaauuuuuuuucau

SEQ ID NO: 2224601 - RNA, 16 nt, Human
aaaauuuuuuuagaaa

SEQ ID NO: 2224602 - RNA, 19 nt, Human
aaacaaaaauuaaaauccu

SEQ ID NO: 2224603 - RNA, 16 nt, Human
aaacaaaaagaacaaa

SEQ ID NO: 2224604 - RNA, 17 nt, Human
aaacaaaaagaacaaaa

SEQ ID NO: 2224605 - RNA, 13 nt, Human
aaacaaaaacacu

SEQ ID NO: 2224606 - RNA, 11 nt, Human
aaacaaaaaga

SEQ ID NO: 2224607 - RNA, 12 nt, Human
aaacaaaaagaa

SEQ ID NO: 2224608 - RNA, 20 nt, Human
aaacaagcacuaaacaaaga

SEQ ID NO: 2224609 - RNA, 12 nt, Human
aaacacauuuuu

SEQ ID NO: 2224610 - RNA, 19 nt, Human
aaacaagaugcuggauguc

SEQ ID NO: 2224611 - RNA, 15 nt, Human
aaacaagauuuuaaa

SEQ ID NO: 2224612 - RNA, 22 nt, Human
aaacaagauuuuaaagacaugu

SEQ ID NO: 2224613 - RNA, 16 nt, Human
aaacacauuuuucuua

SEQ ID NO: 2224614 - RNA, 12 nt, Human
aaacagugccug

SEQ ID NO: 2224615 - RNA, 14 nt, Human
aaacagugagccug

SEQ ID NO: 2224616 - RNA, 20 nt, Human
aaacagucucaggaaaucaa

SEQ ID NO: 2224617 - RNA, 17 nt, Human
aaacaccggguuccagc

SEQ ID NO: 2224618 - RNA, 19 nt, Human
aaacaccaacauguuggga

SEQ ID NO: 2224619 - RNA, 15 nt, Human
aaacacccucacacu

SEQ ID NO: 2224620 - RNA, 14 nt, Human
aaacaccuagcuuu

SEQ ID NO: 2224621 - RNA, 18 nt, Human
aaacaccuccucauguac

SEQ ID NO: 2224622 - RNA, 15 nt, Human
aaacaccuagcuuua

SEQ ID NO: 2224623 - RNA, 22 nt, Human
aaacaucaguuacucugaaggg

SEQ ID NO: 2224624 - RNA, 20 nt, Human
aaacaucaguuacucugaag

SEQ ID NO: 2224625 - RNA, 19 nt, Human
aaacaucaguuacucugaa

SEQ ID NO: 2224626 - RNA, 16 nt, Human
aaacaucaguuacucu

SEQ ID NO: 2224627 - RNA, 14 nt, Human
aaacaucacacaca

SEQ ID NO: 2224628 - RNA, 22 nt, Human
aaacaucacacacacagacaga

SEQ ID NO: 2224629 - RNA, 23 nt, Human
aaacaguuaacuuucagaagaga

SEQ ID NO: 2224630 - RNA, 18 nt, Human
aaacaguuaacuuucaga

SEQ ID NO: 2224631 - RNA, 14 nt, Human
aaacaguuaacuuu

SEQ ID NO: 2224632 - RNA, 13 nt, Human
aaacaguguuuug

SEQ ID NO: 2224633 - RNA, 18 nt, Human
aaacagugccugcugaau

SEQ ID NO: 2224634 - RNA, 14 nt, Human
ggggccuggaccug

SEQ ID NO: 2224635 - RNA, 19 nt, Human
ggggccuggagauccuccu

SEQ ID NO: 2224636 - RNA, 19 nt, Human
ggggccagauccagccugg

SEQ ID NO: 2224637 - RNA, 12 nt, Human
ggggccucccug

SEQ ID NO: 2224638 - RNA, 17 nt, Human
ggggccagauccagccu

SEQ ID NO: 2224639 - RNA, 14 nt, Human
ggggccagauccag

SEQ ID NO: 2224640 - RNA, 13 nt, Human
ggggccagaucca

SEQ ID NO: 2224641 - RNA, 13 nt, Human
ggggccagaggcu

SEQ ID NO: 2224642 - RNA, 19 nt, Human
ggggccacuuuugacuagg

SEQ ID NO: 2224643 - RNA, 12 nt, Human
ggggccagaggc

SEQ ID NO: 2224644 - RNA, 12 nt, Human
ggggccagagga

SEQ ID NO: 2224645 - RNA, 23 nt, Human
ggggccagaggaacuguccagag

SEQ ID NO: 2224646 - RNA, 16 nt, Human
ggggccacacagaaac

SEQ ID NO: 2224647 - RNA, 23 nt, Human
ggggcauguauuggccuggaggu

SEQ ID NO: 2224648 - RNA, 18 nt, Human
ggggcauguauuggccug

SEQ ID NO: 2224649 - RNA, 19 nt, Human
ggggcauguauuggccugg

SEQ ID NO: 2224650 - RNA, 16 nt, Human
ggggcaugcuggggca

SEQ ID NO: 2224651 - RNA, 13 nt, Human
ggggacagggaug

SEQ ID NO: 2224652 - RNA, 15 nt, Human
ggggacagggcuggc

SEQ ID NO: 2224653 - RNA, 20 nt, Human
aaacauccuucaagaacucu

SEQ ID NO: 2224654 - RNA, 18 nt, Human
aaacauccuucaagaacu

SEQ ID NO: 2224655 - RNA, 22 nt, Human
aaacauccuacaagacacagug

SEQ ID NO: 2224656 - RNA, 11 nt, Human
aaacaucugga

SEQ ID NO: 2224657 - RNA, 20 nt, Human
aaacaucuauucucuccaaa

SEQ ID NO: 2224658 - RNA, 15 nt, Human
aaacaucuauucucu

SEQ ID NO: 2224659 - RNA, 23 nt, Human
aaacaucaguuacucugaagggc

SEQ ID NO: 2224660 - RNA, 22 nt, Human
aaacauauuuguuaaauauuua

SEQ ID NO: 2224661 - RNA, 18 nt, Human
aaacauccuacaagacac

SEQ ID NO: 2224662 - RNA, 19 nt, Human
aaacauccaauauuuucuu

SEQ ID NO: 2224663 - RNA, 17 nt, Human
aaacauccaauauuuuc

SEQ ID NO: 2224664 - RNA, 12 nt, Human
aaacaugaagug

SEQ ID NO: 2224665 - RNA, 21 nt, Human
aaacaugacccuaaaucuuga

SEQ ID NO: 2224666 - RNA, 19 nt, Human
aaacaugacccuaaaucuu

SEQ ID NO: 2224667 - RNA, 12 nt, Human
ggggacagcucc

SEQ ID NO: 2224668 - RNA, 14 nt, Human
ggggacagcuccuu

SEQ ID NO: 2224669 - RNA, 20 nt, Human
ggggacagcuccuucugucc

SEQ ID NO: 2224670 - RNA, 19 nt, Human
aaaaugugcaaaacagcgu

SEQ ID NO: 2224671 - RNA, 19 nt, Human
aaaaugugcuauacugcau

SEQ ID NO: 2224672 - RNA, 18 nt, Human
aaaaugugauuuuucuga

SEQ ID NO: 2224673 - RNA, 17 nt, Human
aaaaugugcaaaacagc

SEQ ID NO: 2224674 - RNA, 13 nt, Human
aaaaugugauuuu

SEQ ID NO: 2224675 - RNA, 12 nt, Human
aaaaugugauuu

SEQ ID NO: 2224676 - RNA, 16 nt, Human
aaaaugugacccagau

SEQ ID NO: 2224677 - RNA, 15 nt, Human
aaaaugugauaugua

SEQ ID NO: 2224678 - RNA, 12 nt, Human
aaaaugugaagu

SEQ ID NO: 2224679 - RNA, 21 nt, Human
aaaaugucuguagcuccucaa

SEQ ID NO: 2224680 - RNA, 18 nt, Human
aaaaugugaauaaaauua

SEQ ID NO: 2224681 - RNA, 19 nt, Human
aaaaugugacccagauccu

SEQ ID NO: 2224682 - RNA, 18 nt, Human
aaaaugucuguuaacuua

SEQ ID NO: 2224683 - RNA, 18 nt, Human
aaaaugucuuguguuacc

SEQ ID NO: 2224684 - RNA, 21 nt, Human
gggcuggugacccagucagag

SEQ ID NO: 2224685 - RNA, 15 nt, Human
gggcuggugccagcc

SEQ ID NO: 2224686 - RNA, 16 nt, Human
gggcuggugccagccu

SEQ ID NO: 2224687 - RNA, 17 nt, Human
gggcuggugccagccuu

SEQ ID NO: 2224688 - RNA, 14 nt, Human
gggcugguucugua

SEQ ID NO: 2224689 - RNA, 20 nt, Human
gggcuggugccagccuuccu

SEQ ID NO: 2224690 - RNA, 16 nt, Human
gggcuggguuggcgca

SEQ ID NO: 2224691 - RNA, 19 nt, Human
gggcuggguuggcgcaccc

SEQ ID NO: 2224692 - RNA, 21 nt, Human
gggcuggguuggcgcacccuc

SEQ ID NO: 2224693 - RNA, 22 nt, Human
gggcuggguuggcgcacccucc

SEQ ID NO: 2224694 - RNA, 23 nt, Human
gggcuggguuggcgcacccuccc

SEQ ID NO: 2224695 - RNA, 17 nt, Human
gggcugguagcucaggu

SEQ ID NO: 2224696 - RNA, 18 nt, Human
gggcugguagcucaggug

SEQ ID NO: 2224697 - RNA, 22 nt, Human
gggcuggguucuacccaggugc

SEQ ID NO: 2224698 - RNA, 20 nt, Human
aaaauuucacauuaauauuu

SEQ ID NO: 2224699 - RNA, 13 nt, Human
aaaauuucacauu

SEQ ID NO: 2224700 - RNA, 23 nt, Human
aaaauuuccaguaccuuugucac

SEQ ID NO: 2224701 - RNA, 17 nt, Human
aaaauuuccaguaccuu

SEQ ID NO: 2224702 - RNA, 15 nt, Human
aaaauuucuauuaaa

SEQ ID NO: 2224703 - RNA, 17 nt, Human
aaaauguguaauuuugu

SEQ ID NO: 2224704 - RNA, 12 nt, Human
aaaaugugugug

SEQ ID NO: 2224705 - RNA, 16 nt, Human
aaaauguguaauuuug

SEQ ID NO: 2224706 - RNA, 20 nt, Human
aaaauguguaauuuuguucu

SEQ ID NO: 2224707 - RNA, 11 nt, Human
aaaauguguaa

SEQ ID NO: 2224708 - RNA, 20 nt, Human
aaaaugugcuauacugcaua

SEQ ID NO: 2224709 - RNA, 16 nt, Human
aaaauuugcccuccca

SEQ ID NO: 2224710 - RNA, 18 nt, Human
aaaauuuguuauuuugca

SEQ ID NO: 2224711 - RNA, 18 nt, Human
aaaauuugaaauuuagcu

SEQ ID NO: 2224712 - RNA, 19 nt, Human
aaaauuuguuugaaaucuu

SEQ ID NO: 2224713 - RNA, 14 nt, Human
aaaauuuuuuuaga

SEQ ID NO: 2224714 - RNA, 13 nt, Human
aaaauuuguugca

SEQ ID NO: 2224715 - RNA, 14 nt, Human
aaaauuuguugcau

SEQ ID NO: 2224716 - RNA, 22 nt, Human
aaaauuuuuucucuaggaaaua

SEQ ID NO: 2224717 - RNA, 19 nt, Human
gggcuggcggcuacucagc

SEQ ID NO: 2224718 - RNA, 15 nt, Human
gggcuggccuuccug

SEQ ID NO: 2224719 - RNA, 13 nt, Human
gggcuggcucccu

SEQ ID NO: 2224720 - RNA, 15 nt, Human
gggcuggcucccucu

SEQ ID NO: 2224721 - RNA, 12 nt, Human
gggcuggcuuca

SEQ ID NO: 2224722 - RNA, 17 nt, Human
gggcuggcuucaggagg

SEQ ID NO: 2224723 - RNA, 16 nt, Human
gggcugggagcucugc

SEQ ID NO: 2224724 - RNA, 18 nt, Human
gggcugggagcucugcag

SEQ ID NO: 2224725 - RNA, 20 nt, Human
gggcuggguucuacccaggu

SEQ ID NO: 2224726 - RNA, 12 nt, Human
gggcugcccugc

SEQ ID NO: 2224727 - RNA, 22 nt, Human
gggcugcccgcucccagugucu

SEQ ID NO: 2224728 - RNA, 14 nt, Human
gggcugcccgcucc

SEQ ID NO: 2224729 - RNA, 15 nt, Human
gggcugcccgcuccc

SEQ ID NO: 2224730 - RNA, 18 nt, Human
gggcugcccgcucccagu

SEQ ID NO: 2224731 - RNA, 19 nt, Human
gggcugcccgcucccagug

SEQ ID NO: 2224732 - RNA, 13 nt, Human
gggcugcccuggu

SEQ ID NO: 2224733 - RNA, 14 nt, Human
gggcugcccuggug

SEQ ID NO: 2224734 - RNA, 13 nt, Human
gggcugcccugcc

SEQ ID NO: 2224735 - RNA, 19 nt, Human
gggcuggcccagcccugcu

SEQ ID NO: 2224736 - RNA, 17 nt, Human
gggcuggcccagcccug

SEQ ID NO: 2224737 - RNA, 13 nt, Human
gggcuggccuagg

SEQ ID NO: 2224738 - RNA, 15 nt, Human
gggcuggccuaggag

SEQ ID NO: 2224739 - RNA, 19 nt, Human
gggcuggccucuggcucuc

SEQ ID NO: 2224740 - RNA, 15 nt, Human
gggcugcccuggugc

SEQ ID NO: 2224741 - RNA, 18 nt, Human
gggcucagcaaaagaugc

SEQ ID NO: 2224742 - RNA, 22 nt, Human
gggcugcaccggcuggccuggc

SEQ ID NO: 2224743 - RNA, 16 nt, Human
gggcucaagcagucua

SEQ ID NO: 2224744 - RNA, 13 nt, Human
gggcuacaagagg

SEQ ID NO: 2224745 - RNA, 20 nt, Human
gggcuacccugagcugaggc

SEQ ID NO: 2224746 - RNA, 10 nt, Human
gggcucagca

SEQ ID NO: 2224747 - RNA, 18 nt, Human
gggcugccaugugaagag

SEQ ID NO: 2224748 - RNA, 22 nt, Human
gggcugcagcauguugcugagg

SEQ ID NO: 2224749 - RNA, 19 nt, Human
gggcugcacucugugccca

SEQ ID NO: 2224750 - RNA, 20 nt, Human
gggcugcacucugugcccau

SEQ ID NO: 2224751 - RNA, 11 nt, Human
gggcugcagca

SEQ ID NO: 2224752 - RNA, 19 nt, Human
gggcugcagcauguugcug

SEQ ID NO: 2224753 - RNA, 21 nt, Human
gggcugcaugcgggcuuccuc

SEQ ID NO: 2224754 - RNA, 18 nt, Human
gggcugcaugcgggcuuc

SEQ ID NO: 2224755 - RNA, 18 nt, Human
gggcucagagugggguag

SEQ ID NO: 2224756 - RNA, 14 nt, Human
gggcucacacaccu

SEQ ID NO: 2224757 - RNA, 16 nt, Human
gggcugcacucugugc

SEQ ID NO: 2224758 - RNA, 18 nt, Human
gggcugcacucugugccc

SEQ ID NO: 2224759 - RNA, 16 nt, Human
gguccacaacacacag

SEQ ID NO: 2224760 - RNA, 15 nt, Human
gguauggaacucucu

SEQ ID NO: 2224761 - RNA, 15 nt, Human
gguaugagcugaggg

SEQ ID NO: 2224762 - RNA, 16 nt, Human
gguaugagcugagggg

SEQ ID NO: 2224763 - RNA, 14 nt, Human
gguaugagcugagg

SEQ ID NO: 2224764 - RNA, 14 nt, Human
gguaugcaaucaaa

SEQ ID NO: 2224765 - RNA, 22 nt, Human
gguaugaucacggcucacugca

SEQ ID NO: 2224766 - RNA, 21 nt, Human
gguaugaccuucuaggaagcu

SEQ ID NO: 2224767 - RNA, 14 nt, Human
gguagcuuuucccu

SEQ ID NO: 2224768 - RNA, 18 nt, Human
gguagcugccccuggcuc

SEQ ID NO: 2224769 - RNA, 21 nt, Human
gguagcuguaaggcaugaagg

SEQ ID NO: 2224770 - RNA, 17 nt, Human
gguagcuuugaggugga

SEQ ID NO: 2224771 - RNA, 15 nt, Human
gguagcugccccugg

SEQ ID NO: 2224772 - RNA, 17 nt, Human
gguagcucaggugggcg

SEQ ID NO: 2224773 - RNA, 12 nt, Human
gguagcucaggu

SEQ ID NO: 2224774 - RNA, 13 nt, Human
gguagcucaggug

SEQ ID NO: 2224775 - RNA, 19 nt, Human
gguagcugccccuggcucu

SEQ ID NO: 2224776 - RNA, 12 nt, Human
gguagcuguaag

SEQ ID NO: 2224777 - RNA, 20 nt, Human
gguccacaggaagugaagaa

SEQ ID NO: 2224778 - RNA, 17 nt, Human
gguccacaucccgggac

SEQ ID NO: 2224779 - RNA, 17 nt, Human
gguccacccaggagccc

SEQ ID NO: 2224780 - RNA, 12 nt, Human
gguccagggagc

SEQ ID NO: 2224781 - RNA, 16 nt, Human
gguccagggagcaggc

SEQ ID NO: 2224782 - RNA, 21 nt, Human
gguccagggaagcuggccgag

SEQ ID NO: 2224783 - RNA, 11 nt, Human
gguccagggaa

SEQ ID NO: 2224784 - RNA, 12 nt, Human
gguccagggcua

SEQ ID NO: 2224785 - RNA, 16 nt, Human
gguccacccagcaaag

SEQ ID NO: 2224786 - RNA, 15 nt, Human
gguccaggggccccu

SEQ ID NO: 2224787 - RNA, 17 nt, Human
gguccaggggccccucc

SEQ ID NO: 2224788 - RNA, 20 nt, Human
gguccaggggccccuccagc

SEQ ID NO: 2224789 - RNA, 22 nt, Human
gguccaggggccccuccagcuu

SEQ ID NO: 2224790 - RNA, 23 nt, Human
gguccaggggccccuccagcuug

SEQ ID NO: 2224791 - RNA, 12 nt, Human
gguccacccagg

SEQ ID NO: 2224792 - RNA, 13 nt, Human
gguccacccagga

SEQ ID NO: 2224793 - RNA, 15 nt, Human
gguccacccaggagc

SEQ ID NO: 2224794 - RNA, 16 nt, Human
gguccacccaggagcc

SEQ ID NO: 2224795 - RNA, 19 nt, Human
aaacuuuacuaagaugaca

SEQ ID NO: 2224796 - RNA, 21 nt, Human
aaacuuuacuaagaugacauu

SEQ ID NO: 2224797 - RNA, 18 nt, Human
aaagaaguggggacagag

SEQ ID NO: 2224798 - RNA, 15 nt, Human
aaagaauacagaaag

SEQ ID NO: 2224799 - RNA, 15 nt, Human
aaagaaguuugauau

SEQ ID NO: 2224800 - RNA, 17 nt, Human
aaagaauacagaaagau

SEQ ID NO: 2224801 - RNA, 18 nt, Human
aaacuuuacuauggcccu

SEQ ID NO: 2224802 - RNA, 18 nt, Human
aaacuuuacuaagaugac

SEQ ID NO: 2224803 - RNA, 14 nt, Human
gguccaugggcaga

SEQ ID NO: 2224804 - RNA, 12 nt, Human
aaacuuuacuau

SEQ ID NO: 2224805 - RNA, 13 nt, Human
gguccaggguuga

SEQ ID NO: 2224806 - RNA, 21 nt, Human
gguccaggguugaucacacuc

SEQ ID NO: 2224807 - RNA, 13 nt, Human
gguccaugggcag

SEQ ID NO: 2224808 - RNA, 17 nt, Human
gguccauggaaugcuug

SEQ ID NO: 2224809 - RNA, 15 nt, Human
gguccauagagagca

SEQ ID NO: 2224810 - RNA, 22 nt, Human
aaacuuuaccuuuuuuauacau

SEQ ID NO: 2224811 - RNA, 17 nt, Human
aaacuuuaccuuuuuua

SEQ ID NO: 2224812 - RNA, 17 nt, Human
aaagacuaucuaaaugu

SEQ ID NO: 2224813 - RNA, 14 nt, Human
aaagacuauucaaa

SEQ ID NO: 2224814 - RNA, 13 nt, Human
aaagacaccuacu

SEQ ID NO: 2224815 - RNA, 19 nt, Human
aaagacaccuacugagugg

SEQ ID NO: 2224816 - RNA, 20 nt, Human
aaagacaauucuuuauacaa

SEQ ID NO: 2224817 - RNA, 17 nt, Human
aaagacaauucuuuaua

SEQ ID NO: 2224818 - RNA, 19 nt, Human
aaagacaauucuuuauaca

SEQ ID NO: 2224819 - RNA, 12 nt, Human
aaagacaauucu

SEQ ID NO: 2224820 - RNA, 13 nt, Human
aaagacaauucuu

SEQ ID NO: 2224821 - RNA, 15 nt, Human
aaagacaauucuuua

SEQ ID NO: 2224822 - RNA, 16 nt, Human
aaagacaauucuuuau

SEQ ID NO: 2224823 - RNA, 13 nt, Human
aaagaaugaaaga

SEQ ID NO: 2224824 - RNA, 14 nt, Human
aaagaaugaaagag

SEQ ID NO: 2224825 - RNA, 16 nt, Human
aaagaaugaaagagua

SEQ ID NO: 2224826 - RNA, 22 nt, Human
aaagaaugagaaggagucagaa

SEQ ID NO: 2224827 - RNA, 22 nt, Human
aaagacaaauucuguuucuuga

SEQ ID NO: 2224828 - RNA, 19 nt, Human
aaagacaaauucuguuucu

SEQ ID NO: 2224829 - RNA, 13 nt, Human
aaagacaagacuu

SEQ ID NO: 2224830 - RNA, 17 nt, Human
aaagacaagacuucagu

SEQ ID NO: 2224831 - RNA, 11 nt, Human
aaagacaauuc

SEQ ID NO: 2224832 - RNA, 17 nt, Human
aaagacaaauucuguuu

SEQ ID NO: 2224833 - RNA, 16 nt, Human
aaagacaaauucuguu

SEQ ID NO: 2224834 - RNA, 16 nt, Human
aaagacaaaucaaagc

SEQ ID NO: 2224835 - RNA, 19 nt, Human
aaagacaaaucaaagcaga

SEQ ID NO: 2224836 - RNA, 17 nt, Human
gggugggguagggcuga

SEQ ID NO: 2224837 - RNA, 16 nt, Human
gggugggguagggcug

SEQ ID NO: 2224838 - RNA, 23 nt, Human
ggguggggacguccugccaccug

SEQ ID NO: 2224839 - RNA, 17 nt, Human
ggguggggucaugcccu

SEQ ID NO: 2224840 - RNA, 12 nt, Human
ggguggguauaa

SEQ ID NO: 2224841 - RNA, 12 nt, Human
ggguggugaccu

SEQ ID NO: 2224842 - RNA, 15 nt, Human
ggguggggggggugc

SEQ ID NO: 2224843 - RNA, 14 nt, Human
gggugggccaggcu

SEQ ID NO: 2224844 - RNA, 12 nt, Human
gggugggccucu

SEQ ID NO: 2224845 - RNA, 13 nt, Human
gggugggccucug

SEQ ID NO: 2224846 - RNA, 22 nt, Human
ggguggggaauguuugggcaga

SEQ ID NO: 2224847 - RNA, 18 nt, Human
ggguggggggggugcugg

SEQ ID NO: 2224848 - RNA, 13 nt, Human
gggugguccugac

SEQ ID NO: 2224849 - RNA, 16 nt, Human
ggguggucugcaggca

SEQ ID NO: 2224850 - RNA, 21 nt, Human
ggguggggucaugcccuccuc

SEQ ID NO: 2224851 - RNA, 15 nt, Human
gggugucuugggcag

SEQ ID NO: 2224852 - RNA, 21 nt, Human
gggugucuugggcagagcugg

SEQ ID NO: 2224853 - RNA, 17 nt, Human
ggguguggcgcagcaua

SEQ ID NO: 2224854 - RNA, 17 nt, Human
gggugugcacaucucug

SEQ ID NO: 2224855 - RNA, 21 nt, Human
gggugugcaaugucugaguga

SEQ ID NO: 2224856 - RNA, 23 nt, Human
gggugucuugggcagagcuggcu

SEQ ID NO: 2224857 - RNA, 13 nt, Human
gggugugcuggga

SEQ ID NO: 2224858 - RNA, 12 nt, Human
ggguguggcagu

SEQ ID NO: 2224859 - RNA, 16 nt, Human
ggguguggcccugcca

SEQ ID NO: 2224860 - RNA, 17 nt, Human
gggugggauggaggaga

SEQ ID NO: 2224861 - RNA, 23 nt, Human
ggguggauuuggguuggaaguga

SEQ ID NO: 2224862 - RNA, 19 nt, Human
gggugggccaggcugaugg

SEQ ID NO: 2224863 - RNA, 13 nt, Human
gggugggccaggc

SEQ ID NO: 2224864 - RNA, 15 nt, Human
gggugggcaggaaaa

SEQ ID NO: 2224865 - RNA, 20 nt, Human
ggguggggaccucaggccug

SEQ ID NO: 2224866 - RNA, 19 nt, Human
gggugggagagcccagcca

SEQ ID NO: 2224867 - RNA, 14 nt, Human
gggugggagagccc

SEQ ID NO: 2224868 - RNA, 15 nt, Human
ggggccuggaccugc

SEQ ID NO: 2224869 - RNA, 16 nt, Human
ggggccuggaccugcc

SEQ ID NO: 2224870 - RNA, 22 nt, Human
ggggccuggcgggaugggccac

SEQ ID NO: 2224871 - RNA, 19 nt, Human
gggugggacacccugugau

SEQ ID NO: 2224872 - RNA, 13 nt, Human
ggguggaugccug

SEQ ID NO: 2224873 - RNA, 11 nt, Human
ggggccuggca

SEQ ID NO: 2224874 - RNA, 12 nt, Human
ggggccuggcag

SEQ ID NO: 2224875 - RNA, 15 nt, Human
ggguggcaccagcag

SEQ ID NO: 2224876 - RNA, 17 nt, Human
ggguggaugccuggugg

SEQ ID NO: 2224877 - RNA, 15 nt, Human
gguacauuucccugu

SEQ ID NO: 2224878 - RNA, 18 nt, Human
gguacauuucccugugcu

SEQ ID NO: 2224879 - RNA, 18 nt, Human
gguagcccuggccagagg

SEQ ID NO: 2224880 - RNA, 15 nt, Human
gguagcccuggccag

SEQ ID NO: 2224881 - RNA, 16 nt, Human
gguagcccgccugcca

SEQ ID NO: 2224882 - RNA, 17 nt, Human
gguagcuagaggaacca

SEQ ID NO: 2224883 - RNA, 20 nt, Human
gguagcccuggccagaggcu

SEQ ID NO: 2224884 - RNA, 15 nt, Human
gguagcuagaggaac

SEQ ID NO: 2224885 - RNA, 14 nt, Human
gguaccacugauuu

SEQ ID NO: 2224886 - RNA, 17 nt, Human
gguaccagauaaaauua

SEQ ID NO: 2224887 - RNA, 15 nt, Human
gguaccaaugcugca

SEQ ID NO: 2224888 - RNA, 23 nt, Human
gguacaaccuguucugcuuuccu

SEQ ID NO: 2224889 - RNA, 22 nt, Human
gguaauuguugcuaaucuucuu

SEQ ID NO: 2224890 - RNA, 23 nt, Human
gguaauuauuuugguacuuuuau

SEQ ID NO: 2224891 - RNA, 24 nt, Human
gguacaaccuguucugcuuuccuc

SEQ ID NO: 2224892 - RNA, 17 nt, Human
gguaaucgaccugccuc

SEQ ID NO: 2224893 - RNA, 14 nt, Human
gguaaucgaccugc

SEQ ID NO: 2224894 - RNA, 18 nt, Human
gguaaucgaccugccucg

SEQ ID NO: 2224895 - RNA, 20 nt, Human
gguaaucuugcucugcuuga

SEQ ID NO: 2224896 - RNA, 22 nt, Human
ggguuuggcgggccaaggacug

SEQ ID NO: 2224897 - RNA, 20 nt, Human
ggguuuggcgggccaaggac

SEQ ID NO: 2224898 - RNA, 20 nt, Human
ggguuuggaccccagcuggg

SEQ ID NO: 2224899 - RNA, 21 nt, Human
ggguuuggaccccagcuggga

SEQ ID NO: 2224900 - RNA, 18 nt, Human
ggguuugaggauaggagu

SEQ ID NO: 2224901 - RNA, 18 nt, Human
ggguuuggaccccagcug

SEQ ID NO: 2224902 - RNA, 19 nt, Human
ggguuuggaccccagcugg

SEQ ID NO: 2224903 - RNA, 14 nt, Human
ggguuuuauauuuu

SEQ ID NO: 2224904 - RNA, 20 nt, Human
ggguuuuauuguuuaaaauc

SEQ ID NO: 2224905 - RNA, 21 nt, Human
ggguuuggcugugucuaaacu

SEQ ID NO: 2224906 - RNA, 13 nt, Human
ggguuuuaaugua

SEQ ID NO: 2224907 - RNA, 16 nt, Human
gggugugggaggcccg

SEQ ID NO: 2224908 - RNA, 13 nt, Human
gggugugggaggc

SEQ ID NO: 2224909 - RNA, 17 nt, Human
ggguuucgagaagcugc

SEQ ID NO: 2224910 - RNA, 20 nt, Human
ggguuucgucauguuggcca

SEQ ID NO: 2224911 - RNA, 22 nt, Human
ggguuucugagcugcucugaau

SEQ ID NO: 2224912 - RNA, 17 nt, Human
ggguuucuaaagcugcc

SEQ ID NO: 2224913 - RNA, 13 nt, Human
gguaacaggcaga

SEQ ID NO: 2224914 - RNA, 18 nt, Human
gguaacuagggaagauaa

SEQ ID NO: 2224915 - RNA, 19 nt, Human
gguaauaaguacuguguac

SEQ ID NO: 2224916 - RNA, 15 nt, Human
gguaauaaacuuaga

SEQ ID NO: 2224917 - RNA, 22 nt, Human
gguaacauccuuucuauugaaa

SEQ ID NO: 2224918 - RNA, 21 nt, Human
gguaacaguucauguuugcuu

SEQ ID NO: 2224919 - RNA, 14 nt, Human
gguaacaggcagau

SEQ ID NO: 2224920 - RNA, 20 nt, Human
gguaacaggcagauacagga

SEQ ID NO: 2224921 - RNA, 15 nt, Human
aaagcagcucucccc

SEQ ID NO: 2224922 - RNA, 19 nt, Human
aaagcagcucaaaggcaca

SEQ ID NO: 2224923 - RNA, 18 nt, Human
aaagcagcucaaaggcac

SEQ ID NO: 2224924 - RNA, 15 nt, Human
aaagcagcguuucua

SEQ ID NO: 2224925 - RNA, 17 nt, Human
aaagcaggcagaacuca

SEQ ID NO: 2224926 - RNA, 19 nt, Human
aaagcaggcagaacucauc

SEQ ID NO: 2224927 - RNA, 17 nt, Human
aaagcagggacuugaac

SEQ ID NO: 2224928 - RNA, 18 nt, Human
aaagcagcucuccccuca

SEQ ID NO: 2224929 - RNA, 15 nt, Human
aaagcauaaaugcaa

SEQ ID NO: 2224930 - RNA, 16 nt, Human
aaagcaucacuuggga

SEQ ID NO: 2224931 - RNA, 18 nt, Human
aaagcaucaccucaggcc

SEQ ID NO: 2224932 - RNA, 17 nt, Human
aaagcaucaccucaggc

SEQ ID NO: 2224933 - RNA, 16 nt, Human
aaagcaucaccucagg

SEQ ID NO: 2224934 - RNA, 13 nt, Human
aaagcauccaugu

SEQ ID NO: 2224935 - RNA, 20 nt, Human
aaagcaucauggcuaucugu

SEQ ID NO: 2224936 - RNA, 13 nt, Human
aaagcaugaaugg

SEQ ID NO: 2224937 - RNA, 14 nt, Human
gguggaugccuggu

SEQ ID NO: 2224938 - RNA, 16 nt, Human
ggugcuguggccaggg

SEQ ID NO: 2224939 - RNA, 19 nt, Human
ggugcuguggccaggguga

SEQ ID NO: 2224940 - RNA, 17 nt, Human
ggugcuuacacaucuca

SEQ ID NO: 2224941 - RNA, 22 nt, Human
gguggauggccccagcacagcu

SEQ ID NO: 2224942 - RNA, 14 nt, Human
gguggauggcccca

SEQ ID NO: 2224943 - RNA, 18 nt, Human
ggugcuuaagcagaagca

SEQ ID NO: 2224944 - RNA, 20 nt, Human
ggugcuuaagcagaagcauu

SEQ ID NO: 2224945 - RNA, 21 nt, Human
gguggaugccugguggcagcu

SEQ ID NO: 2224946 - RNA, 22 nt, Human
aaagcagcguuucuaugacaca

SEQ ID NO: 2224947 - RNA, 18 nt, Human
aaagcagcguuucuauga

SEQ ID NO: 2224948 - RNA, 16 nt, Human
aaagcagcguuucuau

SEQ ID NO: 2224949 - RNA, 17 nt, Human
gguggcacaggcccccu

SEQ ID NO: 2224950 - RNA, 18 nt, Human
gguggcacaggcccccuu

SEQ ID NO: 2224951 - RNA, 13 nt, Human
gguggcaagagcc

SEQ ID NO: 2224952 - RNA, 17 nt, Human
gguggcaaggcugugcu

SEQ ID NO: 2224953 - RNA, 20 nt, Human
gguggcaaggcugugcuccc

SEQ ID NO: 2224954 - RNA, 15 nt, Human
ggugcuguccucagg

SEQ ID NO: 2224955 - RNA, 19 nt, Human
ggugcuguccucagguggc

SEQ ID NO: 2224956 - RNA, 20 nt, Human
ggugcuguccucagguggcc

SEQ ID NO: 2224957 - RNA, 23 nt, Human
ggugcuguccucagguggccaug

SEQ ID NO: 2224958 - RNA, 19 nt, Human
ggugcugggccccugccuc

SEQ ID NO: 2224959 - RNA, 21 nt, Human
ggugccagguuuucugggugu

SEQ ID NO: 2224960 - RNA, 23 nt, Human
ggugccagccuuccucugcagcu

SEQ ID NO: 2224961 - RNA, 17 nt, Human
ggugccagguuuucugg

SEQ ID NO: 2224962 - RNA, 20 nt, Human
ggugcugggccccugccucu

SEQ ID NO: 2224963 - RNA, 14 nt, Human
ggugccagcaacug

SEQ ID NO: 2224964 - RNA, 15 nt, Human
ggugccagcaacuga

SEQ ID NO: 2224965 - RNA, 19 nt, Human
ggugccagcaacugaauaa

SEQ ID NO: 2224966 - RNA, 17 nt, Human
ggugccagcaacugaau

SEQ ID NO: 2224967 - RNA, 14 nt, Human
ggugccagccuucc

SEQ ID NO: 2224968 - RNA, 15 nt, Human
ggugccagccuuccu

SEQ ID NO: 2224969 - RNA, 20 nt, Human
ggugccagccuuccucugca

SEQ ID NO: 2224970 - RNA, 22 nt, Human
ggucuucuuacaugcauuugag

SEQ ID NO: 2224971 - RNA, 23 nt, Human
ggugccaaacaaaaagguucuca

SEQ ID NO: 2224972 - RNA, 23 nt, Human
ggugccaauuucaaguuccaagu

SEQ ID NO: 2224973 - RNA, 22 nt, Human
ggugccaacaguguuaggccug

SEQ ID NO: 2224974 - RNA, 22 nt, Human
ggugccaauggaaccuccuuuc

SEQ ID NO: 2224975 - RNA, 18 nt, Human
ggugccacaaauaaaaug

SEQ ID NO: 2224976 - RNA, 12 nt, Human
ggugccagcaaa

SEQ ID NO: 2224977 - RNA, 13 nt, Human
ggugccagcaaag

SEQ ID NO: 2224978 - RNA, 15 nt, Human
ggugccagcaaagcc

SEQ ID NO: 2224979 - RNA, 16 nt, Human
ggugccagcaaagccc

SEQ ID NO: 2224980 - RNA, 17 nt, Human
ggugccagcaaagcccc

SEQ ID NO: 2224981 - RNA, 18 nt, Human
ggugccagcaaagcccca

SEQ ID NO: 2224982 - RNA, 19 nt, Human
ggugccagcaaagccccau

SEQ ID NO: 2224983 - RNA, 19 nt, Human
ggucuucagggggccaggu

SEQ ID NO: 2224984 - RNA, 14 nt, Human
ggucuucagccauc

SEQ ID NO: 2224985 - RNA, 13 nt, Human
ggucuucccaggc

SEQ ID NO: 2224986 - RNA, 17 nt, Human
ggucuucccuaccucag

SEQ ID NO: 2224987 - RNA, 17 nt, Human
ggucuucccaggcuggg

SEQ ID NO: 2224988 - RNA, 20 nt, Human
ggucuucccaggcuggggcu

SEQ ID NO: 2224989 - RNA, 18 nt, Human
ggucuucagccucuuucu

SEQ ID NO: 2224990 - RNA, 17 nt, Human
ggucuguuuuccuuucu

SEQ ID NO: 2224991 - RNA, 21 nt, Human
ggucuguguguguguaugugg

SEQ ID NO: 2224992 - RNA, 20 nt, Human
ggucuguguguguguaugug

SEQ ID NO: 2224993 - RNA, 19 nt, Human
ggucuguuggcaggcuggc

SEQ ID NO: 2224994 - RNA, 20 nt, Human
ggucuguuggcaggcuggcc

SEQ ID NO: 2224995 - RNA, 20 nt, Human
ggucuguuuuccuuucucac

SEQ ID NO: 2224996 - RNA, 22 nt, Human
ggucuucccuaccucaggcagg

SEQ ID NO: 2224997 - RNA, 20 nt, Human
ggucuucccuaccucaggca

SEQ ID NO: 2224998 - RNA, 18 nt, Human
ggugcaaugaccuuucaa

SEQ ID NO: 2224999 - RNA, 19 nt, Human
ggugcaaugaccuuucaau

SEQ ID NO: 2225000 - RNA, 20 nt, Human
ggugcaaugaccuuucaaua

SEQ ID NO: 2225001 - RNA, 22 nt, Human
ggucgcuuacuuugagugaucc

SEQ ID NO: 2225002 - RNA, 15 nt, Human
ggucggaacccaagc

SEQ ID NO: 2225003 - RNA, 13 nt, Human
ggucggaccagcu

SEQ ID NO: 2225004 - RNA, 14 nt, Human
ggucggaaaacaug

SEQ ID NO: 2225005 - RNA, 14 nt, Human
ggucggaccagcuu

SEQ ID NO: 2225006 - RNA, 16 nt, Human
ggucggaggcuuggga

SEQ ID NO: 2225007 - RNA, 20 nt, Human
ggucgguagguucagccaag

SEQ ID NO: 2225008 - RNA, 19 nt, Human
ggucugugucucuuuucuc

SEQ ID NO: 2225009 - RNA, 18 nt, Human
ggucugugucucuuuucu

SEQ ID NO: 2225010 - RNA, 13 nt, Human
ggucugugucucu

SEQ ID NO: 2225011 - RNA, 22 nt, Human
ggucugugccaaagaagaaucc

SEQ ID NO: 2225012 - RNA, 23 nt, Human
ggucuauguaaaugcaucugucc

SEQ ID NO: 2225013 - RNA, 17 nt, Human
ggucuguguguguguau

SEQ ID NO: 2225014 - RNA, 11 nt, Human
ggucugugugu

SEQ ID NO: 2225015 - RNA, 18 nt, Human
ggucuaaagugagcucua

SEQ ID NO: 2225016 - RNA, 14 nt, Human
ggucuagggagaga

SEQ ID NO: 2225017 - RNA, 17 nt, Human
ggucuacacugugcuga

SEQ ID NO: 2225018 - RNA, 22 nt, Human
gguccuggggcucugugcaggg

SEQ ID NO: 2225019 - RNA, 15 nt, Human
gguccuggggcucug

SEQ ID NO: 2225020 - RNA, 12 nt, Human
gguccuggggcu

SEQ ID NO: 2225021 - RNA, 14 nt, Human
gguccuggggccuc

SEQ ID NO: 2225022 - RNA, 15 nt, Human
gguccuggcuccuga

SEQ ID NO: 2225023 - RNA, 14 nt, Human
gguccuggcuccug

SEQ ID NO: 2225024 - RNA, 16 nt, Human
gguccuggcuccugag

SEQ ID NO: 2225025 - RNA, 12 nt, Human
gguccuggggcc

SEQ ID NO: 2225026 - RNA, 12 nt, Human
gguccuggcucc

SEQ ID NO: 2225027 - RNA, 16 nt, Human
gguccuggccauccca

SEQ ID NO: 2225028 - RNA, 14 nt, Human
gguccuggccaucc

SEQ ID NO: 2225029 - RNA, 13 nt, Human
gguccuggccauc

SEQ ID NO: 2225030 - RNA, 12 nt, Human
gguccuggccau

SEQ ID NO: 2225031 - RNA, 17 nt, Human
gguccuggagcagacca

SEQ ID NO: 2225032 - RNA, 21 nt, Human
gguccuggagcagaccacccc

SEQ ID NO: 2225033 - RNA, 23 nt, Human
gguccuggggcucugugcaggga

SEQ ID NO: 2225034 - RNA, 21 nt, Human
gguccuggccaucccacaagu

SEQ ID NO: 2225035 - RNA, 20 nt, Human
ggucgcccuggacugugugc

SEQ ID NO: 2225036 - RNA, 13 nt, Human
ggucggaaaacau

SEQ ID NO: 2225037 - RNA, 12 nt, Human
ggucgcuccugc

SEQ ID NO: 2225038 - RNA, 13 nt, Human
ggucgcuccugcc

SEQ ID NO: 2225039 - RNA, 14 nt, Human
ggucgcuccugccc

SEQ ID NO: 2225040 - RNA, 14 nt, Human
aaagauuuuaauca

SEQ ID NO: 2225041 - RNA, 18 nt, Human
aaagauuuuaaucaaguu

SEQ ID NO: 2225042 - RNA, 15 nt, Human
aaagauuuuaaucaa

SEQ ID NO: 2225043 - RNA, 14 nt, Human
aaagauuucuugag

SEQ ID NO: 2225044 - RNA, 14 nt, Human
aaagcaaaacaaaa

SEQ ID NO: 2225045 - RNA, 13 nt, Human
aaagauuuucaga

SEQ ID NO: 2225046 - RNA, 13 nt, Human
aaagcaaaugaga

SEQ ID NO: 2225047 - RNA, 13 nt, Human
aaagcaaaggaga

SEQ ID NO: 2225048 - RNA, 14 nt, Human
aaagacuaauuuaa

SEQ ID NO: 2225049 - RNA, 20 nt, Human
aaagacuaauuuaaaaaaua

SEQ ID NO: 2225050 - RNA, 23 nt, Human
aaagacuaauuuaaaaaauaacu

SEQ ID NO: 2225051 - RNA, 15 nt, Human
aaagacuauucaaac

SEQ ID NO: 2225052 - RNA, 12 nt, Human
aaagauuuauca

SEQ ID NO: 2225053 - RNA, 13 nt, Human
aaagauuuaucaa

SEQ ID NO: 2225054 - RNA, 21 nt, Human
aaagauugcugaaauuuuaua

SEQ ID NO: 2225055 - RNA, 19 nt, Human
aaagauugcugaaauuuua

SEQ ID NO: 2225056 - RNA, 23 nt, Human
aaagauugaaguauuuugcugga

SEQ ID NO: 2225057 - RNA, 16 nt, Human
aaagcaaaugugaccu

SEQ ID NO: 2225058 - RNA, 19 nt, Human
aaagcaacugucuauuucu

SEQ ID NO: 2225059 - RNA, 13 nt, Human
aaagcaaaugucu

SEQ ID NO: 2225060 - RNA, 14 nt, Human
aaagcaagacuguu

SEQ ID NO: 2225061 - RNA, 21 nt, Human
aaagcaacugucuauuucugc

SEQ ID NO: 2225062 - RNA, 21 nt, Human
aaagcaacuguuaugaaauaa

SEQ ID NO: 2225063 - RNA, 21 nt, Human
gguccucagagaauuucuacc

SEQ ID NO: 2225064 - RNA, 14 nt, Human
gguccucagagaau

SEQ ID NO: 2225065 - RNA, 21 nt, Human
gguccucugauacccagagca

SEQ ID NO: 2225066 - RNA, 21 nt, Human
gguccugcugcaguugccagu

SEQ ID NO: 2225067 - RNA, 23 nt, Human
gguccugcugcaguugccaguca

SEQ ID NO: 2225068 - RNA, 23 nt, Human
gguccucugucagucacagccac

SEQ ID NO: 2225069 - RNA, 21 nt, Human
gguccucugucagucacagcc

SEQ ID NO: 2225070 - RNA, 13 nt, Human
gguccucugucag

SEQ ID NO: 2225071 - RNA, 15 nt, Human
gguccucuugccucc

SEQ ID NO: 2225072 - RNA, 13 nt, Human
gguccugagaccu

SEQ ID NO: 2225073 - RNA, 16 nt, Human
gguuugccugagggcg

SEQ ID NO: 2225074 - RNA, 14 nt, Human
gguuugcaaggaag

SEQ ID NO: 2225075 - RNA, 18 nt, Human
gguuugcagaugacaaaa

SEQ ID NO: 2225076 - RNA, 15 nt, Human
gguuuggaaugcuuc

SEQ ID NO: 2225077 - RNA, 12 nt, Human
gguuuggacccc

SEQ ID NO: 2225078 - RNA, 20 nt, Human
gguuuggaccccagcuggga

SEQ ID NO: 2225079 - RNA, 15 nt, Human
gguuugaauauaaac

SEQ ID NO: 2225080 - RNA, 15 nt, Human
gguuugaagccugga

SEQ ID NO: 2225081 - RNA, 17 nt, Human
gguuugaagccuggaac

SEQ ID NO: 2225082 - RNA, 18 nt, Human
gguuugaauauaaacacu

SEQ ID NO: 2225083 - RNA, 22 nt, Human
gguuugacuccgcuggaggugg

SEQ ID NO: 2225084 - RNA, 15 nt, Human
gguuucuggucucua

SEQ ID NO: 2225085 - RNA, 22 nt, Human
gguuucuucaacaggagaauuu

SEQ ID NO: 2225086 - RNA, 14 nt, Human
gguuuggcgggcca

SEQ ID NO: 2225087 - RNA, 23 nt, Human
gguuuggccaucucuggaugccu

SEQ ID NO: 2225088 - RNA, 19 nt, Human
gguuuggaccccagcuggg

SEQ ID NO: 2225089 - RNA, 19 nt, Human
gguuuggcgggccaaggac

SEQ ID NO: 2225090 - RNA, 17 nt, Human
gguuuggcgggccaagg

SEQ ID NO: 2225091 - RNA, 12 nt, Human
aaaguggugaga

SEQ ID NO: 2225092 - RNA, 16 nt, Human
aaaguggugcucaguu

SEQ ID NO: 2225093 - RNA, 15 nt, Human
gguuuggcugugucu

SEQ ID NO: 2225094 - RNA, 21 nt, Human
gguuuggcugugucuaaacug

SEQ ID NO: 2225095 - RNA, 19 nt, Human
aaaguggugcucaguugua

SEQ ID NO: 2225096 - RNA, 21 nt, Human
aaaguggugcucaguuguaga

SEQ ID NO: 2225097 - RNA, 22 nt, Human
aaaguggugcucaguuguagaa

SEQ ID NO: 2225098 - RNA, 14 nt, Human
aaagugguuguuag

SEQ ID NO: 2225099 - RNA, 11 nt, Human
aaaguguaaag

SEQ ID NO: 2225100 - RNA, 12 nt, Human
aaaguguaaagc

SEQ ID NO: 2225101 - RNA, 13 nt, Human
aaaguguaaagca

SEQ ID NO: 2225102 - RNA, 15 nt, Human
aaaguguaaagcauu

SEQ ID NO: 2225103 - RNA, 16 nt, Human
aaaguguaaagcauuc

SEQ ID NO: 2225104 - RNA, 17 nt, Human
aaaguguaaagcauucc

SEQ ID NO: 2225105 - RNA, 18 nt, Human
aaaguguaaagcauucca

SEQ ID NO: 2225106 - RNA, 22 nt, Human
aaaguguaaagcauuccaacaa

SEQ ID NO: 2225107 - RNA, 22 nt, Human
aaaguucauagggucucuucag

SEQ ID NO: 2225108 - RNA, 21 nt, Human
aaaguucccuacuuccuguga

SEQ ID NO: 2225109 - RNA, 17 nt, Human
aaaguguguuguugcuu

SEQ ID NO: 2225110 - RNA, 14 nt, Human
aaaguguguauuaa

SEQ ID NO: 2225111 - RNA, 15 nt, Human
aaaguguguauuaaa

SEQ ID NO: 2225112 - RNA, 17 nt, Human
aaaguguguauuaaaaa

SEQ ID NO: 2225113 - RNA, 22 nt, Human
aaaguguguauuaaaaaaaaca

SEQ ID NO: 2225114 - RNA, 23 nt, Human
aaaguguguauuaaaaaaaacaa

SEQ ID NO: 2225115 - RNA, 14 nt, Human
aaaguguguuguug

SEQ ID NO: 2225116 - RNA, 20 nt, Human
aaaguguguuguugcuuuag

SEQ ID NO: 2225117 - RNA, 19 nt, Human
aaaguguccauugacaugu

SEQ ID NO: 2225118 - RNA, 21 nt, Human
aaaguguccauugacauguac

SEQ ID NO: 2225119 - RNA, 22 nt, Human
aaaguguccauugacauguaca

SEQ ID NO: 2225120 - RNA, 23 nt, Human
aaaguguccauugacauguacag

SEQ ID NO: 2225121 - RNA, 20 nt, Human
aaaguguaaauccuuuuucu

SEQ ID NO: 2225122 - RNA, 18 nt, Human
aaagugugagcaaacuaa

SEQ ID NO: 2225123 - RNA, 14 nt, Human
aaagugugagcagu

SEQ ID NO: 2225124 - RNA, 19 nt, Human
aaagugugcuuuaugcuga

SEQ ID NO: 2225125 - RNA, 14 nt, Human
aaagugugcuuuau

SEQ ID NO: 2225126 - RNA, 13 nt, Human
aaagugugcuuua

SEQ ID NO: 2225127 - RNA, 22 nt, Human
aaagugugagcagugaguuaca

SEQ ID NO: 2225128 - RNA, 23 nt, Human
aaagugugcuuuaugcugaaaca

SEQ ID NO: 2225129 - RNA, 22 nt, Human
aaagugugcuuuaugcugaaac

SEQ ID NO: 2225130 - RNA, 12 nt, Human
aaaguguguauu

SEQ ID NO: 2225131 - RNA, 13 nt, Human
aaaguguguauua

SEQ ID NO: 2225132 - RNA, 19 nt, Human
aaaguguggucccaacagg

SEQ ID NO: 2225133 - RNA, 23 nt, Human
aaaguucccuacuuccugugacu

SEQ ID NO: 2225134 - RNA, 18 nt, Human
aaaguugcacggcugcug

SEQ ID NO: 2225135 - RNA, 19 nt, Human
aaaguuuacaaguguauau

SEQ ID NO: 2225136 - RNA, 21 nt, Human
aaaguuucucuuuucaaaaca

SEQ ID NO: 2225137 - RNA, 23 nt, Human
aaaguuucucuuuucaaaacauu

SEQ ID NO: 2225138 - RNA, 12 nt, Human
aaaguuucaaug

SEQ ID NO: 2225139 - RNA, 13 nt, Human
aaaguuucaaugu

SEQ ID NO: 2225140 - RNA, 13 nt, Human
aaaguuuccauau

SEQ ID NO: 2225141 - RNA, 14 nt, Human
aaaguuuccauaug

SEQ ID NO: 2225142 - RNA, 15 nt, Human
aaaguuuacaguaaa

SEQ ID NO: 2225143 - RNA, 18 nt, Human
aaaguuuacaguaaauaa

SEQ ID NO: 2225144 - RNA, 21 nt, Human
aaaguuuacaguaaauaaauu

SEQ ID NO: 2225145 - RNA, 22 nt, Human
aaaguuuacaguaaauaaauug

SEQ ID NO: 2225146 - RNA, 15 nt, Human
aaaguuugccagaag

SEQ ID NO: 2225147 - RNA, 13 nt, Human
aaaguuugccaga

SEQ ID NO: 2225148 - RNA, 15 nt, Human
aaaguuugcuuagaa

SEQ ID NO: 2225149 - RNA, 16 nt, Human
aaaguuugcuuagaaa

SEQ ID NO: 2225150 - RNA, 12 nt, Human
aaaguuucucag

SEQ ID NO: 2225151 - RNA, 13 nt, Human
aaaguuucucaga

SEQ ID NO: 2225152 - RNA, 17 nt, Human
aaaguuucucagauccu

SEQ ID NO: 2225153 - RNA, 16 nt, Human
aaaguuuguugaaaca

SEQ ID NO: 2225154 - RNA, 15 nt, Human
aaaguuuucccuuga

SEQ ID NO: 2225155 - RNA, 16 nt, Human
aaaguuuuauuuuucu

SEQ ID NO: 2225156 - RNA, 15 nt, Human
aaaguuuuccugaga

SEQ ID NO: 2225157 - RNA, 12 nt, Human
aaaguuuugaaa

SEQ ID NO: 2225158 - RNA, 13 nt, Human
aaaguuuugaaaa

SEQ ID NO: 2225159 - RNA, 14 nt, Human
aaaguuuugaaaag

SEQ ID NO: 2225160 - RNA, 19 nt, Human
aaaguuuugaaaagcuauu

SEQ ID NO: 2225161 - RNA, 22 nt, Human
aaauaaaaaaaagaaaaaagag

SEQ ID NO: 2225162 - RNA, 20 nt, Human
aaauaaaaaaaagaaaaaag

SEQ ID NO: 2225163 - RNA, 17 nt, Human
aaauaaaaaaaagaaaa

SEQ ID NO: 2225164 - RNA, 15 nt, Human
aaauaaaaaaaagaa

SEQ ID NO: 2225165 - RNA, 13 nt, Human
aaauaaaaaaaag

SEQ ID NO: 2225166 - RNA, 16 nt, Human
aaaguuuugaaaagcu

SEQ ID NO: 2225167 - RNA, 18 nt, Human
aaaguuuugaaaagcuau

SEQ ID NO: 2225168 - RNA, 18 nt, Human
aaauaagggcagagucac

SEQ ID NO: 2225169 - RNA, 13 nt, Human
aaauaaugucucu

SEQ ID NO: 2225170 - RNA, 12 nt, Human
aaauaaugucuc

SEQ ID NO: 2225171 - RNA, 12 nt, Human
aaauaaugugaa

SEQ ID NO: 2225172 - RNA, 20 nt, Human
aaauaagugguuauuucuca

SEQ ID NO: 2225173 - RNA, 13 nt, Human
aaauaaugugaaa

SEQ ID NO: 2225174 - RNA, 15 nt, Human
aaauaauuuuuauau

SEQ ID NO: 2225175 - RNA, 18 nt, Human
aaauaauuuuuauauuug

SEQ ID NO: 2225176 - RNA, 20 nt, Human
aaauaauuuuuauauuugaa

SEQ ID NO: 2225177 - RNA, 15 nt, Human
guaaaauauagcugu

SEQ ID NO: 2225178 - RNA, 16 nt, Human
guaaaauauagcugua

SEQ ID NO: 2225179 - RNA, 15 nt, Human
guaaaauauuuugaa

SEQ ID NO: 2225180 - RNA, 18 nt, Human
guaaaauauagcuguaca

SEQ ID NO: 2225181 - RNA, 20 nt, Human
guaaaauauagcuguacaaa

SEQ ID NO: 2225182 - RNA, 21 nt, Human
guaaaauauagcuguacaaau

SEQ ID NO: 2225183 - RNA, 21 nt, Human
guaaaauauuuugaaucaaua

SEQ ID NO: 2225184 - RNA, 18 nt, Human
guaaaauauuuugaauca

SEQ ID NO: 2225185 - RNA, 19 nt, Human
guaaaauauuuugaaucaa

SEQ ID NO: 2225186 - RNA, 21 nt, Human
guaaaaucuuucuuucuuaga

SEQ ID NO: 2225187 - RNA, 14 nt, Human
guaaaaucuuucuu

SEQ ID NO: 2225188 - RNA, 15 nt, Human
guaaaaucuuucuuu

SEQ ID NO: 2225189 - RNA, 12 nt, Human
guaaaaugugaa

SEQ ID NO: 2225190 - RNA, 19 nt, Human
guaaaaugugaagugaaug

SEQ ID NO: 2225191 - RNA, 20 nt, Human
guaaaaugugaagugaauga

SEQ ID NO: 2225192 - RNA, 22 nt, Human
guaaaaugugaagugaaugaaa

SEQ ID NO: 2225193 - RNA, 16 nt, Human
guaaagcauuccaaca

SEQ ID NO: 2225194 - RNA, 19 nt, Human
guaaauugaaucaguauaa

SEQ ID NO: 2225195 - RNA, 17 nt, Human
guaaauuuaugugaugg

SEQ ID NO: 2225196 - RNA, 16 nt, Human
guaaauuuaugugaug

SEQ ID NO: 2225197 - RNA, 17 nt, Human
guaacaaugaagauaaa

SEQ ID NO: 2225198 - RNA, 16 nt, Human
guaaagacuguagaag

SEQ ID NO: 2225199 - RNA, 15 nt, Human
guaaagacuggcuuu

SEQ ID NO: 2225200 - RNA, 19 nt, Human
guaaagacuggcuuuuauu

SEQ ID NO: 2225201 - RNA, 14 nt, Human
guaaagacuggcuu

SEQ ID NO: 2225202 - RNA, 14 nt, Human
guaaagagaccuac

SEQ ID NO: 2225203 - RNA, 21 nt, Human
guaaagagaccuaccucaggu

SEQ ID NO: 2225204 - RNA, 19 nt, Human
guaaagauauuuuuaucuu

SEQ ID NO: 2225205 - RNA, 22 nt, Human
guaaagagaccuaccucagguu

SEQ ID NO: 2225206 - RNA, 23 nt, Human
guaaagagaccuaccucagguug

SEQ ID NO: 2225207 - RNA, 22 nt, Human
guaaagauauuuuuaucuuuau

SEQ ID NO: 2225208 - RNA, 17 nt, Human
ggugggcacccacccug

SEQ ID NO: 2225209 - RNA, 17 nt, Human
ggugggauggaggagaa

SEQ ID NO: 2225210 - RNA, 16 nt, Human
ggugggauggaggaga

SEQ ID NO: 2225211 - RNA, 19 nt, Human
ggugggauccuccaggugc

SEQ ID NO: 2225212 - RNA, 18 nt, Human
ggugggcacccacccugg

SEQ ID NO: 2225213 - RNA, 14 nt, Human
ggugggcaggaaaa

SEQ ID NO: 2225214 - RNA, 20 nt, Human
ggugggccagccccucccac

SEQ ID NO: 2225215 - RNA, 16 nt, Human
ggugggccagccccuc

SEQ ID NO: 2225216 - RNA, 14 nt, Human
ggugggcagguggu

SEQ ID NO: 2225217 - RNA, 16 nt, Human
ggugggcagguggugg

SEQ ID NO: 2225218 - RNA, 14 nt, Human
ggugggccaggcug

SEQ ID NO: 2225219 - RNA, 12 nt, Human
ggugggccaggc

SEQ ID NO: 2225220 - RNA, 12 nt, Human
ggugggcccagg

SEQ ID NO: 2225221 - RNA, 17 nt, Human
ggugggcccaggaccag

SEQ ID NO: 2225222 - RNA, 18 nt, Human
ggugggcccaggaccagc

SEQ ID NO: 2225223 - RNA, 20 nt, Human
ggugggcccaggaccagcug

SEQ ID NO: 2225224 - RNA, 21 nt, Human
ggugggcccaggaccagcugg

SEQ ID NO: 2225225 - RNA, 22 nt, Human
ggugggcccaggaccagcuggg

SEQ ID NO: 2225226 - RNA, 13 nt, Human
gguggggcagcuu

SEQ ID NO: 2225227 - RNA, 23 nt, Human
ggugggcccaggaccagcugggg

SEQ ID NO: 2225228 - RNA, 16 nt, Human
ggugggccgcaggcgg

SEQ ID NO: 2225229 - RNA, 13 nt, Human
ggugggccucugg

SEQ ID NO: 2225230 - RNA, 14 nt, Human
ggugggccucuggu

SEQ ID NO: 2225231 - RNA, 17 nt, Human
gguggggcagcuugagg

SEQ ID NO: 2225232 - RNA, 11 nt, Human
gguggggaggg

SEQ ID NO: 2225233 - RNA, 12 nt, Human
gguggggagggg

SEQ ID NO: 2225234 - RNA, 13 nt, Human
gguggggaggggc

SEQ ID NO: 2225235 - RNA, 14 nt, Human
gguggggaggggcg

SEQ ID NO: 2225236 - RNA, 20 nt, Human
ggugggaggauugcuugagc

SEQ ID NO: 2225237 - RNA, 23 nt, Human
aaagccuugugucuacagagaac

SEQ ID NO: 2225238 - RNA, 14 nt, Human
aaagcgaauuuuaa

SEQ ID NO: 2225239 - RNA, 14 nt, Human
ggugggauccucca

SEQ ID NO: 2225240 - RNA, 15 nt, Human
ggugggauccuccag

SEQ ID NO: 2225241 - RNA, 11 nt, Human
aaagcauguac

SEQ ID NO: 2225242 - RNA, 14 nt, Human
aaagcaugaauggu

SEQ ID NO: 2225243 - RNA, 17 nt, Human
aaagccuuaucaagugu

SEQ ID NO: 2225244 - RNA, 21 nt, Human
aaagccuugugucuacagaga

SEQ ID NO: 2225245 - RNA, 16 nt, Human
aaagccuguuuaagag

SEQ ID NO: 2225246 - RNA, 18 nt, Human
aaagccuguuuaagagac

SEQ ID NO: 2225247 - RNA, 16 nt, Human
gguggggcgggaaagc

SEQ ID NO: 2225248 - RNA, 12 nt, Human
gguggggcggga

SEQ ID NO: 2225249 - RNA, 23 nt, Human
gguggggguagagcugauccaga

SEQ ID NO: 2225250 - RNA, 17 nt, Human
gguggggggggugcugg

SEQ ID NO: 2225251 - RNA, 15 nt, Human
gguggggucacucug

SEQ ID NO: 2225252 - RNA, 23 nt, Human
gguggggucacucuggcagcuca

SEQ ID NO: 2225253 - RNA, 13 nt, Human
ggugucgggcaug

SEQ ID NO: 2225254 - RNA, 19 nt, Human
gguggggucaugcccuccu

SEQ ID NO: 2225255 - RNA, 15 nt, Human
gguggggucaugccc

SEQ ID NO: 2225256 - RNA, 15 nt, Human
ggugucgcgccuucu

SEQ ID NO: 2225257 - RNA, 17 nt, Human
ggugucgcgccuucucc

SEQ ID NO: 2225258 - RNA, 16 nt, Human
gguggggguggaggcu

SEQ ID NO: 2225259 - RNA, 16 nt, Human
ggugucgggcaugaca

SEQ ID NO: 2225260 - RNA, 21 nt, Human
ggugucgcucugcuggccugg

SEQ ID NO: 2225261 - RNA, 20 nt, Human
ggugucgcgccuucuccccc

SEQ ID NO: 2225262 - RNA, 21 nt, Human
ggugucgcgccuucucccccc

SEQ ID NO: 2225263 - RNA, 20 nt, Human
ggugugaaagucagaugccc

SEQ ID NO: 2225264 - RNA, 16 nt, Human
ggugucugcacccagg

SEQ ID NO: 2225265 - RNA, 15 nt, Human
ggugugaccugaggg

SEQ ID NO: 2225266 - RNA, 16 nt, Human
ggugugacugaauuuc

SEQ ID NO: 2225267 - RNA, 16 nt, Human
ggugugaccacugcag

SEQ ID NO: 2225268 - RNA, 23 nt, Human
ggugucuguguuccaaccacuga

SEQ ID NO: 2225269 - RNA, 20 nt, Human
ggugucuugggcagagcugg

SEQ ID NO: 2225270 - RNA, 19 nt, Human
ggugucuccaaccccccag

SEQ ID NO: 2225271 - RNA, 23 nt, Human
ggugucuccaaccccccagcacu

SEQ ID NO: 2225272 - RNA, 14 nt, Human
ggugugccugcagc

SEQ ID NO: 2225273 - RNA, 13 nt, Human
ggugugccugcag

SEQ ID NO: 2225274 - RNA, 15 nt, Human
ggugugccugcagcc

SEQ ID NO: 2225275 - RNA, 24 nt, Human
ggugugcacguggcauguggccug

SEQ ID NO: 2225276 - RNA, 23 nt, Human
ggugugcacaucucugcuugagu

SEQ ID NO: 2225277 - RNA, 18 nt, Human
ggugugcacaucucugcu

SEQ ID NO: 2225278 - RNA, 16 nt, Human
ggugugcacaucucug

SEQ ID NO: 2225279 - RNA, 15 nt, Human
ggugugcacaucucu

SEQ ID NO: 2225280 - RNA, 17 nt, Human
ggugugcaccaggguug

SEQ ID NO: 2225281 - RNA, 16 nt, Human
ggugugcaccaggguu

SEQ ID NO: 2225282 - RNA, 18 nt, Human
ggugugagucaccaagcc

SEQ ID NO: 2225283 - RNA, 15 nt, Human
ggugugaucgucuga

SEQ ID NO: 2225284 - RNA, 20 nt, Human
ggugugcaaugucugaguga

SEQ ID NO: 2225285 - RNA, 18 nt, Human
ggugugaucgucugacug

SEQ ID NO: 2225286 - RNA, 22 nt, Human
gguuccuauggcuggccacugc

SEQ ID NO: 2225287 - RNA, 12 nt, Human
gguuccucugcc

SEQ ID NO: 2225288 - RNA, 14 nt, Human
gguuccucugccug

SEQ ID NO: 2225289 - RNA, 15 nt, Human
gguuccucugccugc

SEQ ID NO: 2225290 - RNA, 17 nt, Human
gguuccucugccugccc

SEQ ID NO: 2225291 - RNA, 20 nt, Human
gguuccuuccucugagccuu

SEQ ID NO: 2225292 - RNA, 19 nt, Human
gguuccuuccucugagccu

SEQ ID NO: 2225293 - RNA, 23 nt, Human
gguucucacagugggagccaggg

SEQ ID NO: 2225294 - RNA, 18 nt, Human
gguuccucugccugcccc

SEQ ID NO: 2225295 - RNA, 12 nt, Human
gguucucaucuu

SEQ ID NO: 2225296 - RNA, 18 nt, Human
gguucucagguguugcca

SEQ ID NO: 2225297 - RNA, 18 nt, Human
gguucucccccuuucucu

SEQ ID NO: 2225298 - RNA, 19 nt, Human
gguucuccguuagcuccug

SEQ ID NO: 2225299 - RNA, 20 nt, Human
gguucuccguuagcuccugu

SEQ ID NO: 2225300 - RNA, 21 nt, Human
gguucuccguuagcuccugug

SEQ ID NO: 2225301 - RNA, 12 nt, Human
gguucuggggcc

SEQ ID NO: 2225302 - RNA, 18 nt, Human
gguucuggugugaacuaa

SEQ ID NO: 2225303 - RNA, 19 nt, Human
gguucugccugccagcugc

SEQ ID NO: 2225304 - RNA, 12 nt, Human
gguucuggcugc

SEQ ID NO: 2225305 - RNA, 17 nt, Human
gguucuccucuccccuc

SEQ ID NO: 2225306 - RNA, 21 nt, Human
gguucugaugaugugccuggg

SEQ ID NO: 2225307 - RNA, 20 nt, Human
gguucugccugccagcugca

SEQ ID NO: 2225308 - RNA, 17 nt, Human
gguucuggggccccuuu

SEQ ID NO: 2225309 - RNA, 17 nt, Human
gguuuaggcugguggcc

SEQ ID NO: 2225310 - RNA, 22 nt, Human
gguuuaggcugguggcccagga

SEQ ID NO: 2225311 - RNA, 20 nt, Human
gguuuaggcugguggcccag

SEQ ID NO: 2225312 - RNA, 16 nt, Human
gguuuagaaagcuugc

SEQ ID NO: 2225313 - RNA, 13 nt, Human
gguuucugaaaau

SEQ ID NO: 2225314 - RNA, 14 nt, Human
gguuucugagcugc

SEQ ID NO: 2225315 - RNA, 17 nt, Human
gguuucugaguuccugc

SEQ ID NO: 2225316 - RNA, 21 nt, Human
gguuucucgcauaggaccuuu

SEQ ID NO: 2225317 - RNA, 14 nt, Human
gguuucagaaaugu

SEQ ID NO: 2225318 - RNA, 19 nt, Human
gguuucaccauguuggcca

SEQ ID NO: 2225319 - RNA, 19 nt, Human
gguuucaccauguugccca

SEQ ID NO: 2225320 - RNA, 13 nt, Human
gguuucagaaaug

SEQ ID NO: 2225321 - RNA, 12 nt, Human
gguuucagaaau

SEQ ID NO: 2225322 - RNA, 21 nt, Human
ggugugcggccuuuggcuuca

SEQ ID NO: 2225323 - RNA, 13 nt, Human
ggugugcucugau

SEQ ID NO: 2225324 - RNA, 12 nt, Human
gguguggaagag

SEQ ID NO: 2225325 - RNA, 12 nt, Human
ggugugcuggga

SEQ ID NO: 2225326 - RNA, 19 nt, Human
ggugugcugggagcuccac

SEQ ID NO: 2225327 - RNA, 22 nt, Human
gguucaggguuggccccugccc

SEQ ID NO: 2225328 - RNA, 21 nt, Human
gguucauaggucacuggcucu

SEQ ID NO: 2225329 - RNA, 22 nt, Human
ggugugcugggagcuccacucu

SEQ ID NO: 2225330 - RNA, 18 nt, Human
gguucaggguuggccccu

SEQ ID NO: 2225331 - RNA, 21 nt, Human
gguucaggguuggccccugcc

SEQ ID NO: 2225332 - RNA, 21 nt, Human
gguucccccagcccuguggaa

SEQ ID NO: 2225333 - RNA, 17 nt, Human
gguucccguuucuccac

SEQ ID NO: 2225334 - RNA, 15 nt, Human
gguuccccuguucac

SEQ ID NO: 2225335 - RNA, 24 nt, Human
gguuccagcaauucuccugccuca

SEQ ID NO: 2225336 - RNA, 16 nt, Human
gguucccccagcccug

SEQ ID NO: 2225337 - RNA, 19 nt, Human
gguucauuauuggaauuaa

SEQ ID NO: 2225338 - RNA, 18 nt, Human
gguucauuauuggaauua

SEQ ID NO: 2225339 - RNA, 17 nt, Human
gguucauuauuggaauu

SEQ ID NO: 2225340 - RNA, 16 nt, Human
gguucauuauuggaau

SEQ ID NO: 2225341 - RNA, 15 nt, Human
gguucaucugagcaa

SEQ ID NO: 2225342 - RNA, 23 nt, Human
gguucauuucaaauacaucuuug

SEQ ID NO: 2225343 - RNA, 23 nt, Human
gguuccagcaauucuccugccuc

SEQ ID NO: 2225344 - RNA, 22 nt, Human
gguucccuuuccuuccaucccu

SEQ ID NO: 2225345 - RNA, 17 nt, Human
gguucccuuuccuucca

SEQ ID NO: 2225346 - RNA, 13 nt, Human
gguucccucugag

SEQ ID NO: 2225347 - RNA, 16 nt, Human
gguucccucugagaau

SEQ ID NO: 2225348 - RNA, 21 nt, Human
gguucccuuugacgccauccc

SEQ ID NO: 2225349 - RNA, 18 nt, Human
gguuccuauggcuggcca

SEQ ID NO: 2225350 - RNA, 16 nt, Human
gguuccuccccuccuc

SEQ ID NO: 2225351 - RNA, 22 nt, Human
gguucccuuugacgccauccca

SEQ ID NO: 2225352 - RNA, 17 nt, Human
gacauucaccugcccca

SEQ ID NO: 2225353 - RNA, 16 nt, Human
gacauucaccugcccc

SEQ ID NO: 2225354 - RNA, 15 nt, Human
gacauucaccugccc

SEQ ID NO: 2225355 - RNA, 23 nt, Human
gacauuaacaguuuuccaugaaa

SEQ ID NO: 2225356 - RNA, 22 nt, Human
gacauuaacaguuuuccaugaa

SEQ ID NO: 2225357 - RNA, 19 nt, Human
gacauuaacaguuuuccau

SEQ ID NO: 2225358 - RNA, 18 nt, Human
gacauuaacaguuuucca

SEQ ID NO: 2225359 - RNA, 14 nt, Human
gacauucaccugcc

SEQ ID NO: 2225360 - RNA, 23 nt, Human
gacagacaacacugggaaacaga

SEQ ID NO: 2225361 - RNA, 22 nt, Human
gacacuguuuacaagaaaaaau

SEQ ID NO: 2225362 - RNA, 19 nt, Human
gacacuguuuacaagaaaa

SEQ ID NO: 2225363 - RNA, 20 nt, Human
gacacuuaauacuaccuuga

SEQ ID NO: 2225364 - RNA, 13 nt, Human
gacagaagcaggc

SEQ ID NO: 2225365 - RNA, 15 nt, Human
gacagaagcaggcug

SEQ ID NO: 2225366 - RNA, 16 nt, Human
gacagaagcaggcugg

SEQ ID NO: 2225367 - RNA, 17 nt, Human
gacagaagcaggcugga

SEQ ID NO: 2225368 - RNA, 12 nt, Human
gacagacacagg

SEQ ID NO: 2225369 - RNA, 21 nt, Human
gacagcccgggcucugccucc

SEQ ID NO: 2225370 - RNA, 22 nt, Human
gacagcccgggcucugccuccc

SEQ ID NO: 2225371 - RNA, 23 nt, Human
gacagcccgggcucugccuccca

SEQ ID NO: 2225372 - RNA, 23 nt, Human
gacacugaaauauacacacagca

SEQ ID NO: 2225373 - RNA, 17 nt, Human
gacacucugcucugccc

SEQ ID NO: 2225374 - RNA, 15 nt, Human
gacacucugcucugc

SEQ ID NO: 2225375 - RNA, 16 nt, Human
gacacucugcucugcc

SEQ ID NO: 2225376 - RNA, 15 nt, Human
gacacucuggcuggu

SEQ ID NO: 2225377 - RNA, 13 nt, Human
gacacugaugggc

SEQ ID NO: 2225378 - RNA, 13 nt, Human
gacacucugcucu

SEQ ID NO: 2225379 - RNA, 15 nt, Human
gacacugaugggcaa

SEQ ID NO: 2225380 - RNA, 12 nt, Human
gacacuguacaa

SEQ ID NO: 2225381 - RNA, 13 nt, Human
gacacuguacaag

SEQ ID NO: 2225382 - RNA, 16 nt, Human
gacacugccacacagg

SEQ ID NO: 2225383 - RNA, 16 nt, Human
gacacuuaaaaauggu

SEQ ID NO: 2225384 - RNA, 20 nt, Human
gacacugugcccagcccgga

SEQ ID NO: 2225385 - RNA, 16 nt, Human
gacacugugcccagcc

SEQ ID NO: 2225386 - RNA, 23 nt, Human
gacacugugcccagcccggaccu

SEQ ID NO: 2225387 - RNA, 16 nt, Human
gacagucaaggagugg

SEQ ID NO: 2225388 - RNA, 17 nt, Human
gacagucaaggaguggc

SEQ ID NO: 2225389 - RNA, 19 nt, Human
gacagucaaggaguggcuu

SEQ ID NO: 2225390 - RNA, 22 nt, Human
gacagucaaggaguggcuuacu

SEQ ID NO: 2225391 - RNA, 15 nt, Human
gacaguauuuguggg

SEQ ID NO: 2225392 - RNA, 14 nt, Human
gacaguccugggag

SEQ ID NO: 2225393 - RNA, 13 nt, Human
gacaguccuggga

SEQ ID NO: 2225394 - RNA, 14 nt, Human
gacagucaccccag

SEQ ID NO: 2225395 - RNA, 16 nt, Human
gacagucaccccagga

SEQ ID NO: 2225396 - RNA, 17 nt, Human
gacaguccucuccaccu

SEQ ID NO: 2225397 - RNA, 17 nt, Human
gacagucaccucaugga

SEQ ID NO: 2225398 - RNA, 18 nt, Human
gacaguccugggagaacc

SEQ ID NO: 2225399 - RNA, 15 nt, Human
gacaguccugggaga

SEQ ID NO: 2225400 - RNA, 23 nt, Human
gacaguccugggagaaccucagg

SEQ ID NO: 2225401 - RNA, 13 nt, Human
gacagucuugugc

SEQ ID NO: 2225402 - RNA, 24 nt, Human
gacaguccucuccaccuaguggcu

SEQ ID NO: 2225403 - RNA, 13 nt, Human
gacagucucacuu

SEQ ID NO: 2225404 - RNA, 17 nt, Human
gacauuaacaguuuucc

SEQ ID NO: 2225405 - RNA, 14 nt, Human
gacauuaacaguuu

SEQ ID NO: 2225406 - RNA, 12 nt, Human
gacauuaacagu

SEQ ID NO: 2225407 - RNA, 23 nt, Human
gacauuaaaucuaugaaguauau

SEQ ID NO: 2225408 - RNA, 15 nt, Human
gacagucuugugcuu

SEQ ID NO: 2225409 - RNA, 23 nt, Human
gacagucuuuggguaccuauuuu

SEQ ID NO: 2225410 - RNA, 14 nt, Human
gacagugaaagaaa

SEQ ID NO: 2225411 - RNA, 16 nt, Human
gacaggugugccgaca

SEQ ID NO: 2225412 - RNA, 17 nt, Human
gacaggucccucaccca

SEQ ID NO: 2225413 - RNA, 18 nt, Human
gacagcucccucugccug

SEQ ID NO: 2225414 - RNA, 17 nt, Human
gacagcucccucugccu

SEQ ID NO: 2225415 - RNA, 23 nt, Human
gacaggguuuggcugugucuaaa

SEQ ID NO: 2225416 - RNA, 14 nt, Human
gacagguaaauuaa

SEQ ID NO: 2225417 - RNA, 16 nt, Human
gacagcucccucugcc

SEQ ID NO: 2225418 - RNA, 18 nt, Human
gacagcuccacccuggcc

SEQ ID NO: 2225419 - RNA, 20 nt, Human
gacaggguuuugccauguug

SEQ ID NO: 2225420 - RNA, 22 nt, Human
gacaggguuuugccauguuggc

SEQ ID NO: 2225421 - RNA, 23 nt, Human
gacagccuguggcggugccuggg

SEQ ID NO: 2225422 - RNA, 22 nt, Human
gacagccuguggcggugccugg

SEQ ID NO: 2225423 - RNA, 20 nt, Human
gacagccuguggcggugccu

SEQ ID NO: 2225424 - RNA, 11 nt, Human
gacagccugua

SEQ ID NO: 2225425 - RNA, 12 nt, Human
gacagcuccacc

SEQ ID NO: 2225426 - RNA, 11 nt, Human
gacagcuccuu

SEQ ID NO: 2225427 - RNA, 13 nt, Human
gacagacacacac

SEQ ID NO: 2225428 - RNA, 15 nt, Human
gacagacacacacac

SEQ ID NO: 2225429 - RNA, 13 nt, Human
gacagccuggcac

SEQ ID NO: 2225430 - RNA, 19 nt, Human
gacagccuggcacagggca

SEQ ID NO: 2225431 - RNA, 14 nt, Human
gacacacugaagaa

SEQ ID NO: 2225432 - RNA, 15 nt, Human
gacacacgcacacac

SEQ ID NO: 2225433 - RNA, 16 nt, Human
gacaaacaccucccag

SEQ ID NO: 2225434 - RNA, 13 nt, Human
gacacacugaaga

SEQ ID NO: 2225435 - RNA, 21 nt, Human
gacacacagcucuguccuggg

SEQ ID NO: 2225436 - RNA, 12 nt, Human
gacacacaugaa

SEQ ID NO: 2225437 - RNA, 20 nt, Human
gaauuaucuugguugaaaau

SEQ ID NO: 2225438 - RNA, 20 nt, Human
gaauuugugaagguggaaau

SEQ ID NO: 2225439 - RNA, 22 nt, Human
gaauuaucuauacauaucuuua

SEQ ID NO: 2225440 - RNA, 15 nt, Human
gaauuuuaaaaauga

SEQ ID NO: 2225441 - RNA, 13 nt, Human
gaauuuguuauca

SEQ ID NO: 2225442 - RNA, 14 nt, Human
gaaugaggugggag

SEQ ID NO: 2225443 - RNA, 15 nt, Human
gaaugaggugggagg

SEQ ID NO: 2225444 - RNA, 22 nt, Human
gaaugaggucccaggcagagaa

SEQ ID NO: 2225445 - RNA, 21 nt, Human
gaaugaggucccaggcagaga

SEQ ID NO: 2225446 - RNA, 15 nt, Human
gaaugaggucccagg

SEQ ID NO: 2225447 - RNA, 14 nt, Human
gaaugaggucccag

SEQ ID NO: 2225448 - RNA, 18 nt, Human
gaaugaggcuugcugaga

SEQ ID NO: 2225449 - RNA, 20 nt, Human
gaaugaggaggaaggagaga

SEQ ID NO: 2225450 - RNA, 14 nt, Human
gaaugaggcuugcu

SEQ ID NO: 2225451 - RNA, 15 nt, Human
gaaugaggcuugcug

SEQ ID NO: 2225452 - RNA, 17 nt, Human
gaaugaggcuugcugag

SEQ ID NO: 2225453 - RNA, 14 nt, Human
gaaugaggaggaag

SEQ ID NO: 2225454 - RNA, 13 nt, Human
gaaugaggaggaa

SEQ ID NO: 2225455 - RNA, 23 nt, Human
gaaugaggaauaauaaguuaaac

SEQ ID NO: 2225456 - RNA, 19 nt, Human
gaaugaggucccaggcaga

SEQ ID NO: 2225457 - RNA, 18 nt, Human
gaaugaggucccaggcag

SEQ ID NO: 2225458 - RNA, 17 nt, Human
gaaugaggucccaggca

SEQ ID NO: 2225459 - RNA, 16 nt, Human
gaaugaggucccaggc

SEQ ID NO: 2225460 - RNA, 11 nt, Human
gaauuaguuuu

SEQ ID NO: 2225461 - RNA, 15 nt, Human
gaauuuuaagugcuu

SEQ ID NO: 2225462 - RNA, 23 nt, Human
gaauuuuacuguguuucuuuugg

SEQ ID NO: 2225463 - RNA, 23 nt, Human
gaauuuuaaaagaugcaauguag

SEQ ID NO: 2225464 - RNA, 21 nt, Human
gaauuuuaaaagaugcaaugu

SEQ ID NO: 2225465 - RNA, 15 nt, Human
gaauuuuaaaagaug

SEQ ID NO: 2225466 - RNA, 12 nt, Human
gaauuuuaaaag

SEQ ID NO: 2225467 - RNA, 22 nt, Human
gaauuuucacaugaacauacug

SEQ ID NO: 2225468 - RNA, 21 nt, Human
gaauuuuauuuuuugggaaaa

SEQ ID NO: 2225469 - RNA, 23 nt, Human
gaauuuucagaccccagcggcug

SEQ ID NO: 2225470 - RNA, 14 nt, Human
gaauuuucagaccc

SEQ ID NO: 2225471 - RNA, 13 nt, Human
gaauuuucugugu

SEQ ID NO: 2225472 - RNA, 14 nt, Human
gaauuuucccacug

SEQ ID NO: 2225473 - RNA, 23 nt, Human
gaauuuucuuuguguagcuuugc

SEQ ID NO: 2225474 - RNA, 21 nt, Human
gaauuuucuuuguguagcuuu

SEQ ID NO: 2225475 - RNA, 19 nt, Human
gaauuuuggcugugucucc

SEQ ID NO: 2225476 - RNA, 14 nt, Human
gacacacagcucug

SEQ ID NO: 2225477 - RNA, 21 nt, Human
gacaaaaauucaacucagacu

SEQ ID NO: 2225478 - RNA, 18 nt, Human
gacaaaaaguuuccauau

SEQ ID NO: 2225479 - RNA, 15 nt, Human
gacaaaacuagagac

SEQ ID NO: 2225480 - RNA, 15 nt, Human
gacacacagcucugu

SEQ ID NO: 2225481 - RNA, 17 nt, Human
gacacacagcucugucc

SEQ ID NO: 2225482 - RNA, 18 nt, Human
gacacacagcucuguccu

SEQ ID NO: 2225483 - RNA, 19 nt, Human
gacacacagcucuguccug

SEQ ID NO: 2225484 - RNA, 22 nt, Human
gaauuuuguuuggacuucuuuu

SEQ ID NO: 2225485 - RNA, 15 nt, Human
gaauuuuguugcugu

SEQ ID NO: 2225486 - RNA, 21 nt, Human
gacaaaaaugaacugaaguuu

SEQ ID NO: 2225487 - RNA, 16 nt, Human
gaauuuuucauugaua

SEQ ID NO: 2225488 - RNA, 16 nt, Human
gacaaaaaguuuccau

SEQ ID NO: 2225489 - RNA, 14 nt, Human
gaauuuuuauuauu

SEQ ID NO: 2225490 - RNA, 14 nt, Human
gaauuuuucucuaa

SEQ ID NO: 2225491 - RNA, 22 nt, Human
gaauuuucuuuuuaauaaaaag

SEQ ID NO: 2225492 - RNA, 17 nt, Human
gaauuuucuguguuuug

SEQ ID NO: 2225493 - RNA, 21 nt, Human
gaauuuugugcccccauguaa

SEQ ID NO: 2225494 - RNA, 20 nt, Human
gaauuuugugcccccaugua

SEQ ID NO: 2225495 - RNA, 23 nt, Human
gaauuuuggcugugucucccuuc

SEQ ID NO: 2225496 - RNA, 19 nt, Human
gaagugugggucugugugu

SEQ ID NO: 2225497 - RNA, 18 nt, Human
gaagugugggucugugug

SEQ ID NO: 2225498 - RNA, 17 nt, Human
gaagugugggucugugu

SEQ ID NO: 2225499 - RNA, 23 nt, Human
gaaguguaacagcugaggucucu

SEQ ID NO: 2225500 - RNA, 15 nt, Human
gaaguguaggcagac

SEQ ID NO: 2225501 - RNA, 18 nt, Human
gaaguguaacagcugagg

SEQ ID NO: 2225502 - RNA, 17 nt, Human
gaaguguaacagcugag

SEQ ID NO: 2225503 - RNA, 18 nt, Human
gaaguguaggcagacaca

SEQ ID NO: 2225504 - RNA, 20 nt, Human
gaagugugauugggaauaaa

SEQ ID NO: 2225505 - RNA, 23 nt, Human
gaagugugauugggaauaaauau

SEQ ID NO: 2225506 - RNA, 11 nt, Human
gaagugugauu

SEQ ID NO: 2225507 - RNA, 16 nt, Human
gaaguguaggcagaca

SEQ ID NO: 2225508 - RNA, 17 nt, Human
gaaguguaggcagacac

SEQ ID NO: 2225509 - RNA, 14 nt, Human
gaaugagaguguga

SEQ ID NO: 2225510 - RNA, 20 nt, Human
gaaugagccuacgcugaaga

SEQ ID NO: 2225511 - RNA, 22 nt, Human
gaaugagccuacgcugaagaug

SEQ ID NO: 2225512 - RNA, 13 nt, Human
gaaugagccucgg

SEQ ID NO: 2225513 - RNA, 11 nt, Human
gaaugagccuc

SEQ ID NO: 2225514 - RNA, 22 nt, Human
gaaugagagacacacugaagaa

SEQ ID NO: 2225515 - RNA, 23 nt, Human
gaaugagagacacacugaagaag

SEQ ID NO: 2225516 - RNA, 18 nt, Human
gaaugaccuuguugcaug

SEQ ID NO: 2225517 - RNA, 20 nt, Human
gaaugagagacacacugaag

SEQ ID NO: 2225518 - RNA, 14 nt, Human
gaaugaauuaaaua

SEQ ID NO: 2225519 - RNA, 13 nt, Human
gaaugacaaagag

SEQ ID NO: 2225520 - RNA, 16 nt, Human
gaaugaauuaaauaaa

SEQ ID NO: 2225521 - RNA, 16 nt, Human
gaaugacaacagaagc

SEQ ID NO: 2225522 - RNA, 11 nt, Human
gaaugaauguc

SEQ ID NO: 2225523 - RNA, 14 nt, Human
gaaugaaugucagu

SEQ ID NO: 2225524 - RNA, 18 nt, Human
gaaugaaugucaguguga

SEQ ID NO: 2225525 - RNA, 22 nt, Human
gaaugaaugucagugugacuga

SEQ ID NO: 2225526 - RNA, 17 nt, Human
gaagggauggauuccaa

SEQ ID NO: 2225527 - RNA, 14 nt, Human
gaagggaggugggg

SEQ ID NO: 2225528 - RNA, 22 nt, Human
gaagggcaggaaggagagccug

SEQ ID NO: 2225529 - RNA, 10 nt, Human
gaagggaggu

SEQ ID NO: 2225530 - RNA, 13 nt, Human
gaagggaggcugg

SEQ ID NO: 2225531 - RNA, 16 nt, Human
gaagggagagccagcu

SEQ ID NO: 2225532 - RNA, 21 nt, Human
gaagggacuaggagcacugua

SEQ ID NO: 2225533 - RNA, 12 nt, Human
gaagggagaagg

SEQ ID NO: 2225534 - RNA, 21 nt, Human
gaagggagaaggaucuagaau

SEQ ID NO: 2225535 - RNA, 15 nt, Human
gaagggaccaaggca

SEQ ID NO: 2225536 - RNA, 16 nt, Human
gaagggagaagaaagg

SEQ ID NO: 2225537 - RNA, 18 nt, Human
gaagggaccuugaagggu

SEQ ID NO: 2225538 - RNA, 20 nt, Human
gaagggaccuugaaggguaa

SEQ ID NO: 2225539 - RNA, 20 nt, Human
gaagggaccaaggcaaggca

SEQ ID NO: 2225540 - RNA, 21 nt, Human
gaagggaccaaggcaaggcag

SEQ ID NO: 2225541 - RNA, 22 nt, Human
gaagggaccaaggcaaggcagg

SEQ ID NO: 2225542 - RNA, 17 nt, Human
gaagggaccuugaaggg

SEQ ID NO: 2225543 - RNA, 19 nt, Human
gaaggcucgagcaugccug

SEQ ID NO: 2225544 - RNA, 15 nt, Human
gaaggcuauggggau

SEQ ID NO: 2225545 - RNA, 23 nt, Human
gaagcuguaguagcccuuucugu

SEQ ID NO: 2225546 - RNA, 21 nt, Human
gaagcugucauaaaaagacaa

SEQ ID NO: 2225547 - RNA, 20 nt, Human
gaagcuguguccuugcaccu

SEQ ID NO: 2225548 - RNA, 17 nt, Human
gaagcuguguccuugca

SEQ ID NO: 2225549 - RNA, 12 nt, Human
gaagcugugucc

SEQ ID NO: 2225550 - RNA, 22 nt, Human
gaagcuguguccuugcaccugc

SEQ ID NO: 2225551 - RNA, 16 nt, Human
gaaggcucgagcaugc

SEQ ID NO: 2225552 - RNA, 17 nt, Human
gaaggcucgagcaugcc

SEQ ID NO: 2225553 - RNA, 14 nt, Human
gaagcucccaggaa

SEQ ID NO: 2225554 - RNA, 15 nt, Human
gaagcucccaggaac

SEQ ID NO: 2225555 - RNA, 14 nt, Human
gaagcugccugcuu

SEQ ID NO: 2225556 - RNA, 13 nt, Human
gaagcugccugcu

SEQ ID NO: 2225557 - RNA, 16 nt, Human
gaagcugcccugccca

SEQ ID NO: 2225558 - RNA, 13 nt, Human
gaagcugcuccgu

SEQ ID NO: 2225559 - RNA, 17 nt, Human
gaagcugcucuggaauu

SEQ ID NO: 2225560 - RNA, 18 nt, Human
gaagcugcucuggaauuu

SEQ ID NO: 2225561 - RNA, 23 nt, Human
gaagcuggccgaggguccuggcu

SEQ ID NO: 2225562 - RNA, 17 nt, Human
gaagcuggccgaggguc

SEQ ID NO: 2225563 - RNA, 14 nt, Human
gaagugaacauuuc

SEQ ID NO: 2225564 - RNA, 15 nt, Human
gaagugaaugcuggg

SEQ ID NO: 2225565 - RNA, 16 nt, Human
gaagugaaugcuggga

SEQ ID NO: 2225566 - RNA, 13 nt, Human
gaagggccagagc

SEQ ID NO: 2225567 - RNA, 20 nt, Human
gaagggauuuuagucacacg

SEQ ID NO: 2225568 - RNA, 19 nt, Human
gaagggcauccuucugccu

SEQ ID NO: 2225569 - RNA, 14 nt, Human
gaagucuuuuguuc

SEQ ID NO: 2225570 - RNA, 14 nt, Human
gaagugaaacugcu

SEQ ID NO: 2225571 - RNA, 22 nt, Human
gaagugacagggaagcuacagg

SEQ ID NO: 2225572 - RNA, 20 nt, Human
gaagugacagggaagcuaca

SEQ ID NO: 2225573 - RNA, 21 nt, Human
gaagugacagggaagcuacag

SEQ ID NO: 2225574 - RNA, 13 nt, Human
gaagugacaggga

SEQ ID NO: 2225575 - RNA, 14 nt, Human
gaagugacagggaa

SEQ ID NO: 2225576 - RNA, 15 nt, Human
gaagugacagggaag

SEQ ID NO: 2225577 - RNA, 18 nt, Human
gaagugacagggaagcua

SEQ ID NO: 2225578 - RNA, 24 nt, Human
gaagugacaaggccccagagacuc

SEQ ID NO: 2225579 - RNA, 12 nt, Human
gaagugacaggg

SEQ ID NO: 2225580 - RNA, 23 nt, Human
gaagugacaaggccccagagacu

SEQ ID NO: 2225581 - RNA, 21 nt, Human
gaagugacaaggccccagaga

SEQ ID NO: 2225582 - RNA, 18 nt, Human
gaagugacaaggccccag

SEQ ID NO: 2225583 - RNA, 10 nt, Human
gaagggccag

SEQ ID NO: 2225584 - RNA, 17 nt, Human
gaagugaaugcugggac

SEQ ID NO: 2225585 - RNA, 18 nt, Human
gaagggcaucaugcaucu

SEQ ID NO: 2225586 - RNA, 23 nt, Human
gaagggcaggaaggagagccugc

SEQ ID NO: 2225587 - RNA, 19 nt, Human
gaagggcagggcugaggcc

SEQ ID NO: 2225588 - RNA, 18 nt, Human
gaagucuuuguacagaca

SEQ ID NO: 2225589 - RNA, 19 nt, Human
gaagucuuuguacagacaa

SEQ ID NO: 2225590 - RNA, 20 nt, Human
gaagucuuuguacagacaac

SEQ ID NO: 2225591 - RNA, 18 nt, Human
gaaguggaccaggacagg

SEQ ID NO: 2225592 - RNA, 16 nt, Human
gaaguggaccaggaca

SEQ ID NO: 2225593 - RNA, 21 nt, Human
gaagugcuuaguguacuugga

SEQ ID NO: 2225594 - RNA, 23 nt, Human
gaagugccccugcugccucccca

SEQ ID NO: 2225595 - RNA, 20 nt, Human
gaagugcuggcaaccacuaa

SEQ ID NO: 2225596 - RNA, 21 nt, Human
gaagugggccaggacaggccc

SEQ ID NO: 2225597 - RNA, 19 nt, Human
gaagugggccaggacaggc

SEQ ID NO: 2225598 - RNA, 18 nt, Human
gaagugggccaggacagg

SEQ ID NO: 2225599 - RNA, 16 nt, Human
gaagugggccaggaca

SEQ ID NO: 2225600 - RNA, 22 nt, Human
gaaguggaccaggacaggacca

SEQ ID NO: 2225601 - RNA, 17 nt, Human
gaaguggacuggccccu

SEQ ID NO: 2225602 - RNA, 18 nt, Human
gaaguggacuggccccug

SEQ ID NO: 2225603 - RNA, 20 nt, Human
gaaguggacuggccccuggg

SEQ ID NO: 2225604 - RNA, 16 nt, Human
gaaguguaacagcuga

SEQ ID NO: 2225605 - RNA, 15 nt, Human
gaaguguaacagcug

SEQ ID NO: 2225606 - RNA, 14 nt, Human
gaaguguaacagcu

SEQ ID NO: 2225607 - RNA, 15 nt, Human
gaaguggggacagag

SEQ ID NO: 2225608 - RNA, 22 nt, Human
gaagugccccugcugccucccc

SEQ ID NO: 2225609 - RNA, 18 nt, Human
gaagugccccugcugccu

SEQ ID NO: 2225610 - RNA, 15 nt, Human
gaagugccccugcug

SEQ ID NO: 2225611 - RNA, 14 nt, Human
gaagugccccugcu

SEQ ID NO: 2225612 - RNA, 13 nt, Human
gaagugccccugc

SEQ ID NO: 2225613 - RNA, 14 nt, Human
gaagugcauccaaa

SEQ ID NO: 2225614 - RNA, 18 nt, Human
gaagugcaaauuugauac

SEQ ID NO: 2225615 - RNA, 14 nt, Human
gaagugaggcauug

SEQ ID NO: 2225616 - RNA, 13 nt, Human
gaagugacuuugg

SEQ ID NO: 2225617 - RNA, 20 nt, Human
gaagugacuuuggcugcaug

SEQ ID NO: 2225618 - RNA, 15 nt, Human
gaagugacuuuggcu

SEQ ID NO: 2225619 - RNA, 21 nt, Human
gaagugacuuuggcugcaugc

SEQ ID NO: 2225620 - RNA, 16 nt, Human
gaagugagcacagccu

SEQ ID NO: 2225621 - RNA, 18 nt, Human
gaagugagcuuugcugcu

SEQ ID NO: 2225622 - RNA, 16 nt, Human
gaagugaggaagccag

SEQ ID NO: 2225623 - RNA, 14 nt, Human
gaagcuacagguua

SEQ ID NO: 2225624 - RNA, 15 nt, Human
gaagcuacagguuac

SEQ ID NO: 2225625 - RNA, 19 nt, Human
gaagcuacagguuacaaca

SEQ ID NO: 2225626 - RNA, 17 nt, Human
gaagcuaauuugcauua

SEQ ID NO: 2225627 - RNA, 16 nt, Human
gaagcuaauuugcauu

SEQ ID NO: 2225628 - RNA, 15 nt, Human
gaagcuaauuugcau

SEQ ID NO: 2225629 - RNA, 14 nt, Human
gaagcuaauuugca

SEQ ID NO: 2225630 - RNA, 21 nt, Human
gaagcucagcccaccccccuc

SEQ ID NO: 2225631 - RNA, 22 nt, Human
gaagcucagcccaccccccuca

SEQ ID NO: 2225632 - RNA, 23 nt, Human
gaagcuacagguuacaacagauu

SEQ ID NO: 2225633 - RNA, 23 nt, Human
gaagcuacugugugugugaauga

SEQ ID NO: 2225634 - RNA, 22 nt, Human
gaagcuacugugugugugaaug

SEQ ID NO: 2225635 - RNA, 20 nt, Human
gaagcuacugugugugugaa

SEQ ID NO: 2225636 - RNA, 15 nt, Human
gaagcuacugugugu

SEQ ID NO: 2225637 - RNA, 21 nt, Human
gaagcuacagguuacaacaga

SEQ ID NO: 2225638 - RNA, 22 nt, Human
gaagcuacagguuacaacagau

SEQ ID NO: 2225639 - RNA, 14 nt, Human
gaagcucagggccu

SEQ ID NO: 2225640 - RNA, 15 nt, Human
gaagcucagggccug

SEQ ID NO: 2225641 - RNA, 23 nt, Human
gaagcucagggccuggcucaggu

SEQ ID NO: 2225642 - RNA, 13 nt, Human
gaagcuccacugu

SEQ ID NO: 2225643 - RNA, 14 nt, Human
gaagcuccacuguc

SEQ ID NO: 2225644 - RNA, 15 nt, Human
gaagcuccacuguca

SEQ ID NO: 2225645 - RNA, 16 nt, Human
gaagcuccacugucac

SEQ ID NO: 2225646 - RNA, 18 nt, Human
gaagcuccacugucaccc

SEQ ID NO: 2225647 - RNA, 19 nt, Human
gaagcuccacugucacccu

SEQ ID NO: 2225648 - RNA, 23 nt, Human
gaagcuccacugucacccuccac

SEQ ID NO: 2225649 - RNA, 20 nt, Human
gaagcucagggccuggcuca

SEQ ID NO: 2225650 - RNA, 21 nt, Human
gaagcucagggccuggcucag

SEQ ID NO: 2225651 - RNA, 16 nt, Human
gaagcucagggccugg

SEQ ID NO: 2225652 - RNA, 17 nt, Human
gaagcucagggccuggc

SEQ ID NO: 2225653 - RNA, 18 nt, Human
gaagcucagggccuggcu

SEQ ID NO: 2225654 - RNA, 19 nt, Human
gaagcucagggccuggcuc

SEQ ID NO: 2225655 - RNA, 13 nt, Human
gaaauccagggug

SEQ ID NO: 2225656 - RNA, 18 nt, Human
gaaauccagggugguggu

SEQ ID NO: 2225657 - RNA, 14 nt, Human
gaaauccauucaca

SEQ ID NO: 2225658 - RNA, 17 nt, Human
gaaauccauccagaggc

SEQ ID NO: 2225659 - RNA, 12 nt, Human
gagaggcagaga

SEQ ID NO: 2225660 - RNA, 22 nt, Human
gagaggcagacuucccugaaug

SEQ ID NO: 2225661 - RNA, 18 nt, Human
gagacuccugcaggcagc

SEQ ID NO: 2225662 - RNA, 17 nt, Human
gagacuccugcaggcag

SEQ ID NO: 2225663 - RNA, 12 nt, Human
gagaggcaggca

SEQ ID NO: 2225664 - RNA, 11 nt, Human
gagaggcaggc

SEQ ID NO: 2225665 - RNA, 16 nt, Human
gagaggcagagaaaga

SEQ ID NO: 2225666 - RNA, 13 nt, Human
gagaggcagagag

SEQ ID NO: 2225667 - RNA, 14 nt, Human
gagaggcagagagc

SEQ ID NO: 2225668 - RNA, 16 nt, Human
gagaggcagagagcgg

SEQ ID NO: 2225669 - RNA, 14 nt, Human
gagaggcauccagu

SEQ ID NO: 2225670 - RNA, 13 nt, Human
gagacucagacag

SEQ ID NO: 2225671 - RNA, 23 nt, Human
gagacucaccucugccucaaugu

SEQ ID NO: 2225672 - RNA, 20 nt, Human
gagacucaccucugccucaa

SEQ ID NO: 2225673 - RNA, 19 nt, Human
gagacucaccucugccuca

SEQ ID NO: 2225674 - RNA, 18 nt, Human
gagacucaccucugccuc

SEQ ID NO: 2225675 - RNA, 17 nt, Human
gagacucaccucugccu

SEQ ID NO: 2225676 - RNA, 21 nt, Human
gagacuagauuuaugaauaca

SEQ ID NO: 2225677 - RNA, 18 nt, Human
gagacuaugcguuuuuau

SEQ ID NO: 2225678 - RNA, 20 nt, Human
gagacuaugcguuuuuauaa

SEQ ID NO: 2225679 - RNA, 16 nt, Human
gagacucaccucugcc

SEQ ID NO: 2225680 - RNA, 15 nt, Human
gagacucaccucugc

SEQ ID NO: 2225681 - RNA, 15 nt, Human
gagacuccugcaggc

SEQ ID NO: 2225682 - RNA, 16 nt, Human
gagacuccugcaggca

SEQ ID NO: 2225683 - RNA, 23 nt, Human
gagauggaucaaucaaacccggc

SEQ ID NO: 2225684 - RNA, 16 nt, Human
gagauggaggaggagg

SEQ ID NO: 2225685 - RNA, 18 nt, Human
gagauggaguucuugugc

SEQ ID NO: 2225686 - RNA, 14 nt, Human
gagauggaggagga

SEQ ID NO: 2225687 - RNA, 13 nt, Human
gagauggaggagg

SEQ ID NO: 2225688 - RNA, 12 nt, Human
gagauggaggag

SEQ ID NO: 2225689 - RNA, 23 nt, Human
gagauggaacccuuuuggccccc

SEQ ID NO: 2225690 - RNA, 20 nt, Human
gagauggaaguugcagugag

SEQ ID NO: 2225691 - RNA, 20 nt, Human
gagaugccuccaccgcugcc

SEQ ID NO: 2225692 - RNA, 15 nt, Human
gagaugccuccaccg

SEQ ID NO: 2225693 - RNA, 14 nt, Human
gagaugccuccacc

SEQ ID NO: 2225694 - RNA, 23 nt, Human
gagaugcauucuugguuggcugg

SEQ ID NO: 2225695 - RNA, 16 nt, Human
gagaugcagagguaaa

SEQ ID NO: 2225696 - RNA, 13 nt, Human
gagaugcagcugg

SEQ ID NO: 2225697 - RNA, 19 nt, Human
gagaugccuccaccgcugc

SEQ ID NO: 2225698 - RNA, 19 nt, Human
gagaugcuggagaagagag

SEQ ID NO: 2225699 - RNA, 20 nt, Human
gagaugcuggagaagagagg

SEQ ID NO: 2225700 - RNA, 21 nt, Human
gagaugcuggagaagagagga

SEQ ID NO: 2225701 - RNA, 21 nt, Human
gagaugaugccaugggcccuc

SEQ ID NO: 2225702 - RNA, 18 nt, Human
gagaugcaccaccaagcc

SEQ ID NO: 2225703 - RNA, 17 nt, Human
gagaugauucagaaggg

SEQ ID NO: 2225704 - RNA, 18 nt, Human
gagaugauucagaagggg

SEQ ID NO: 2225705 - RNA, 21 nt, Human
gagaugcaccaccaagccaag

SEQ ID NO: 2225706 - RNA, 12 nt, Human
gagaugcagagg

SEQ ID NO: 2225707 - RNA, 14 nt, Human
gagaugcagaggua

SEQ ID NO: 2225708 - RNA, 22 nt, Human
gagaggcauccaguaucuugaa

SEQ ID NO: 2225709 - RNA, 19 nt, Human
gagaugaugaaaauauuua

SEQ ID NO: 2225710 - RNA, 15 nt, Human
gagaggcaggcauag

SEQ ID NO: 2225711 - RNA, 21 nt, Human
gagaggcaggcauagaggcuu

SEQ ID NO: 2225712 - RNA, 20 nt, Human
gagaugaugaaaauauuuaa

SEQ ID NO: 2225713 - RNA, 18 nt, Human
gagauuucuuguugcuca

SEQ ID NO: 2225714 - RNA, 23 nt, Human
gagauuucaucugcucuccuucc

SEQ ID NO: 2225715 - RNA, 12 nt, Human
gagauuuuucau

SEQ ID NO: 2225716 - RNA, 12 nt, Human
gagauuuuccuu

SEQ ID NO: 2225717 - RNA, 13 nt, Human
gagauuuacaacu

SEQ ID NO: 2225718 - RNA, 13 nt, Human
gagauugagaagg

SEQ ID NO: 2225719 - RNA, 17 nt, Human
gagauugagaaggagag

SEQ ID NO: 2225720 - RNA, 18 nt, Human
gagauugagaaggagaga

SEQ ID NO: 2225721 - RNA, 20 nt, Human
gagauugagaaggagagaaa

SEQ ID NO: 2225722 - RNA, 23 nt, Human
gagauuuaauuaaucaugaaugu

SEQ ID NO: 2225723 - RNA, 13 nt, Human
gagauuucaucug

SEQ ID NO: 2225724 - RNA, 17 nt, Human
gagauuucaucugcucu

SEQ ID NO: 2225725 - RNA, 15 nt, Human
gagauuucaagagau

SEQ ID NO: 2225726 - RNA, 19 nt, Human
gagauuucaucugcucucc

SEQ ID NO: 2225727 - RNA, 20 nt, Human
gagauuucaucugcucuccu

SEQ ID NO: 2225728 - RNA, 21 nt, Human
gagauuucaucugcucuccuu

SEQ ID NO: 2225729 - RNA, 22 nt, Human
gagauuucaucugcucuccuuc

SEQ ID NO: 2225730 - RNA, 19 nt, Human
gagaugggacugggagggc

SEQ ID NO: 2225731 - RNA, 14 nt, Human
gagaugggagcucc

SEQ ID NO: 2225732 - RNA, 15 nt, Human
gagaugggagcuccu

SEQ ID NO: 2225733 - RNA, 22 nt, Human
gagaugggagcuccucuccugg

SEQ ID NO: 2225734 - RNA, 18 nt, Human
gagaugggcuuguuuucu

SEQ ID NO: 2225735 - RNA, 23 nt, Human
gagaugggagcuccucuccugga

SEQ ID NO: 2225736 - RNA, 17 nt, Human
gagaugggacugggagg

SEQ ID NO: 2225737 - RNA, 21 nt, Human
gagaugggaaugaggugggag

SEQ ID NO: 2225738 - RNA, 20 nt, Human
gagaugggaaugagguggga

SEQ ID NO: 2225739 - RNA, 15 nt, Human
gagauggccugagaa

SEQ ID NO: 2225740 - RNA, 15 nt, Human
gagauggaggaggag

SEQ ID NO: 2225741 - RNA, 14 nt, Human
gagauggggugggg

SEQ ID NO: 2225742 - RNA, 17 nt, Human
gagauguaaaagguauu

SEQ ID NO: 2225743 - RNA, 16 nt, Human
gagauguaaaagguau

SEQ ID NO: 2225744 - RNA, 14 nt, Human
gagauguagccccu

SEQ ID NO: 2225745 - RNA, 18 nt, Human
gagauugcaccacugcac

SEQ ID NO: 2225746 - RNA, 21 nt, Human
gagauugcaccacugcacucc

SEQ ID NO: 2225747 - RNA, 15 nt, Human
gagauguagcaaaac

SEQ ID NO: 2225748 - RNA, 14 nt, Human
gagauguaauuguu

SEQ ID NO: 2225749 - RNA, 16 nt, Human
gagauguaauuguuuu

SEQ ID NO: 2225750 - RNA, 12 nt, Human
gagaugucuucg

SEQ ID NO: 2225751 - RNA, 17 nt, Human
gagauucaguuuucauu

SEQ ID NO: 2225752 - RNA, 22 nt, Human
gagcauguacugagccuuguaa

SEQ ID NO: 2225753 - RNA, 22 nt, Human
gagcauggggauaaaggagaag

SEQ ID NO: 2225754 - RNA, 21 nt, Human
gagcauggggauaaaggagaa

SEQ ID NO: 2225755 - RNA, 15 nt, Human
gagcauggagcuggc

SEQ ID NO: 2225756 - RNA, 17 nt, Human
gagcauggagcuggccg

SEQ ID NO: 2225757 - RNA, 14 nt, Human
gagcauggcuguga

SEQ ID NO: 2225758 - RNA, 16 nt, Human
gagcauggcugugagg

SEQ ID NO: 2225759 - RNA, 19 nt, Human
gagcauggcugugaggaug

SEQ ID NO: 2225760 - RNA, 21 nt, Human
gagcauggcugugaggauggg

SEQ ID NO: 2225761 - RNA, 15 nt, Human
gagcaugggccuggc

SEQ ID NO: 2225762 - RNA, 22 nt, Human
gagcaugccuggauggggcugc

SEQ ID NO: 2225763 - RNA, 14 nt, Human
gagcauggagcugg

SEQ ID NO: 2225764 - RNA, 17 nt, Human
gagcaguuucuguccug

SEQ ID NO: 2225765 - RNA, 19 nt, Human
gagcagugucuuccauaau

SEQ ID NO: 2225766 - RNA, 18 nt, Human
gagcagugucuuccauaa

SEQ ID NO: 2225767 - RNA, 20 nt, Human
gagcaguuucuguccugcug

SEQ ID NO: 2225768 - RNA, 21 nt, Human
gagcaguuucuguccugcugg

SEQ ID NO: 2225769 - RNA, 21 nt, Human
gagcauaauaaauggaugagg

SEQ ID NO: 2225770 - RNA, 21 nt, Human
gagcagggcucagcggggaca

SEQ ID NO: 2225771 - RNA, 17 nt, Human
gagcagugucuuccaua

SEQ ID NO: 2225772 - RNA, 12 nt, Human
gagcaucaggcc

SEQ ID NO: 2225773 - RNA, 16 nt, Human
gagcauagaaggcagg

SEQ ID NO: 2225774 - RNA, 22 nt, Human
gagcaguuucuguccugcuggu

SEQ ID NO: 2225775 - RNA, 14 nt, Human
gagcauagaaggca

SEQ ID NO: 2225776 - RNA, 24 nt, Human
gagccccagggucuucccuaccuc

SEQ ID NO: 2225777 - RNA, 19 nt, Human
gagccccagggucuucccu

SEQ ID NO: 2225778 - RNA, 18 nt, Human
gagccccaucagcuccag

SEQ ID NO: 2225779 - RNA, 14 nt, Human
gagccccagugcca

SEQ ID NO: 2225780 - RNA, 12 nt, Human
gagccccagugc

SEQ ID NO: 2225781 - RNA, 16 nt, Human
gagccccauuccuggg

SEQ ID NO: 2225782 - RNA, 18 nt, Human
gagccccauuccugggaa

SEQ ID NO: 2225783 - RNA, 17 nt, Human
gagccccauuccuggga

SEQ ID NO: 2225784 - RNA, 17 nt, Human
gagccccagugccaagc

SEQ ID NO: 2225785 - RNA, 13 nt, Human
gagcccccccaac

SEQ ID NO: 2225786 - RNA, 14 nt, Human
gagccccagggucu

SEQ ID NO: 2225787 - RNA, 13 nt, Human
gagccccaggguc

SEQ ID NO: 2225788 - RNA, 12 nt, Human
gagccccagggu

SEQ ID NO: 2225789 - RNA, 18 nt, Human
gagccccaggccucugug

SEQ ID NO: 2225790 - RNA, 16 nt, Human
gagccccagcuacccu

SEQ ID NO: 2225791 - RNA, 19 nt, Human
gagccccagcccccuuugg

SEQ ID NO: 2225792 - RNA, 13 nt, Human
gagccccagcuga

SEQ ID NO: 2225793 - RNA, 14 nt, Human
gagccccagcugac

SEQ ID NO: 2225794 - RNA, 13 nt, Human
gagccccaggccu

SEQ ID NO: 2225795 - RNA, 16 nt, Human
gagccccaggccucug

SEQ ID NO: 2225796 - RNA, 17 nt, Human
gagccccaggccucugu

SEQ ID NO: 2225797 - RNA, 12 nt, Human
gagccccagccc

SEQ ID NO: 2225798 - RNA, 13 nt, Human
gagccccagcccc

SEQ ID NO: 2225799 - RNA, 17 nt, Human
gagcaugggccuggcca

SEQ ID NO: 2225800 - RNA, 18 nt, Human
gagcaggcuggcagcucu

SEQ ID NO: 2225801 - RNA, 19 nt, Human
gagcaggcuggcagcucuc

SEQ ID NO: 2225802 - RNA, 20 nt, Human
gagcaggcuggcagcucucc

SEQ ID NO: 2225803 - RNA, 21 nt, Human
gagcaggcuggcagcucucca

SEQ ID NO: 2225804 - RNA, 22 nt, Human
gagcaggcuggcagcucuccag

SEQ ID NO: 2225805 - RNA, 14 nt, Human
gagcagggcucagc

SEQ ID NO: 2225806 - RNA, 20 nt, Human
gagcagggauuaaccucugc

SEQ ID NO: 2225807 - RNA, 21 nt, Human
gagcagggauuaaccucugca

SEQ ID NO: 2225808 - RNA, 22 nt, Human
gagcagggauuaaccucugcac

SEQ ID NO: 2225809 - RNA, 11 nt, Human
gagcuggugca

SEQ ID NO: 2225810 - RNA, 21 nt, Human
gagcugguaguuaguagcaug

SEQ ID NO: 2225811 - RNA, 24 nt, Human
gagcugggggccaugagcuccaga

SEQ ID NO: 2225812 - RNA, 19 nt, Human
gagcugggggccaugagcu

SEQ ID NO: 2225813 - RNA, 16 nt, Human
gagcuggugcauuaca

SEQ ID NO: 2225814 - RNA, 14 nt, Human
gagcuggugcauua

SEQ ID NO: 2225815 - RNA, 17 nt, Human
gagcuggugcauuacag

SEQ ID NO: 2225816 - RNA, 18 nt, Human
gagcugggggccaugagc

SEQ ID NO: 2225817 - RNA, 19 nt, Human
gagcuggggaccugguacc

SEQ ID NO: 2225818 - RNA, 19 nt, Human
gagcuggggaugucucuca

SEQ ID NO: 2225819 - RNA, 18 nt, Human
gagcugggugucaagagg

SEQ ID NO: 2225820 - RNA, 17 nt, Human
gagcugggaggaaaaga

SEQ ID NO: 2225821 - RNA, 16 nt, Human
gagcugggaggaaaag

SEQ ID NO: 2225822 - RNA, 12 nt, Human
gagcugggaggc

SEQ ID NO: 2225823 - RNA, 17 nt, Human
gagcugggaggcauggc

SEQ ID NO: 2225824 - RNA, 16 nt, Human
gagcugggauccuaag

SEQ ID NO: 2225825 - RNA, 18 nt, Human
gagcugggaggcauggcc

SEQ ID NO: 2225826 - RNA, 17 nt, Human
gagcugggcagaaggcc

SEQ ID NO: 2225827 - RNA, 14 nt, Human
gagcugggaggaaa

SEQ ID NO: 2225828 - RNA, 21 nt, Human
gagcugggacacuuaacagau

SEQ ID NO: 2225829 - RNA, 22 nt, Human
gagcuggcucugagcgccucca

SEQ ID NO: 2225830 - RNA, 19 nt, Human
gagcugggcagaaggccaa

SEQ ID NO: 2225831 - RNA, 12 nt, Human
gagcuggggaag

SEQ ID NO: 2225832 - RNA, 13 nt, Human
gagcuggggaccu

SEQ ID NO: 2225833 - RNA, 15 nt, Human
gagcuggggaccugg

SEQ ID NO: 2225834 - RNA, 20 nt, Human
gagccuugguguccaccugg

SEQ ID NO: 2225835 - RNA, 19 nt, Human
gagccuugguguccaccug

SEQ ID NO: 2225836 - RNA, 17 nt, Human
gagccuuuggaugacca

SEQ ID NO: 2225837 - RNA, 22 nt, Human
gagccuugguguccaccuggcc

SEQ ID NO: 2225838 - RNA, 18 nt, Human
gagccuuugguucuggcc

SEQ ID NO: 2225839 - RNA, 13 nt, Human
gagcgaaacuccg

SEQ ID NO: 2225840 - RNA, 23 nt, Human
gagccuuugguucuggccagaau

SEQ ID NO: 2225841 - RNA, 23 nt, Human
gagccuuuucccucuuuggcucc

SEQ ID NO: 2225842 - RNA, 22 nt, Human
gagcccccgccccgccccacau

SEQ ID NO: 2225843 - RNA, 21 nt, Human
gagcccccgccccgccccaca

SEQ ID NO: 2225844 - RNA, 17 nt, Human
gagcccccgccccgccc

SEQ ID NO: 2225845 - RNA, 22 nt, Human
gagcccccccaacacugugccc

SEQ ID NO: 2225846 - RNA, 19 nt, Human
gagccuugaacuuugaccu

SEQ ID NO: 2225847 - RNA, 22 nt, Human
gagccuugaacuuugaccucug

SEQ ID NO: 2225848 - RNA, 14 nt, Human
gagccuuccagggg

SEQ ID NO: 2225849 - RNA, 15 nt, Human
gagccuuccaggggu

SEQ ID NO: 2225850 - RNA, 16 nt, Human
gagccuuccaggggug

SEQ ID NO: 2225851 - RNA, 17 nt, Human
gagccuuccaggggugg

SEQ ID NO: 2225852 - RNA, 20 nt, Human
gagcugccuguucagcucca

SEQ ID NO: 2225853 - RNA, 16 nt, Human
gagcggucucaggcug

SEQ ID NO: 2225854 - RNA, 11 nt, Human
gagcugccuuc

SEQ ID NO: 2225855 - RNA, 13 nt, Human
gagcugccuuccc

SEQ ID NO: 2225856 - RNA, 17 nt, Human
gagcggucucaggcugg

SEQ ID NO: 2225857 - RNA, 23 nt, Human
gagcugccuucccuagcuuuaga

SEQ ID NO: 2225858 - RNA, 14 nt, Human
gagcugccuucccu

SEQ ID NO: 2225859 - RNA, 19 nt, Human
gagcugccuucccuagcuu

SEQ ID NO: 2225860 - RNA, 13 nt, Human
gagcuggcucuga

SEQ ID NO: 2225861 - RNA, 17 nt, Human
gagcuggcucugagcgc

SEQ ID NO: 2225862 - RNA, 21 nt, Human
gagcugccuguucagcuccag

SEQ ID NO: 2225863 - RNA, 22 nt, Human
gagcugccuguucagcuccagc

SEQ ID NO: 2225864 - RNA, 14 nt, Human
gagcggucucaggc

SEQ ID NO: 2225865 - RNA, 14 nt, Human
gagcgggaccugug

SEQ ID NO: 2225866 - RNA, 16 nt, Human
gagcgggaccuguggc

SEQ ID NO: 2225867 - RNA, 17 nt, Human
gagcgggaccuguggcu

SEQ ID NO: 2225868 - RNA, 18 nt, Human
gagcggagaaaggaaggg

SEQ ID NO: 2225869 - RNA, 21 nt, Human
gagcggagaaaggaagggcug

SEQ ID NO: 2225870 - RNA, 20 nt, Human
gacugaaaaccucuccucau

SEQ ID NO: 2225871 - RNA, 18 nt, Human
gacugaaaaccucuccuc

SEQ ID NO: 2225872 - RNA, 17 nt, Human
gacugaaaaccucuccu

SEQ ID NO: 2225873 - RNA, 16 nt, Human
gacugaaaaccucucc

SEQ ID NO: 2225874 - RNA, 17 nt, Human
gacucuuuugccauuaa

SEQ ID NO: 2225875 - RNA, 19 nt, Human
gacucuuuuuagggccagg

SEQ ID NO: 2225876 - RNA, 20 nt, Human
gacucuuuuuagggccaggc

SEQ ID NO: 2225877 - RNA, 22 nt, Human
gacucuuuuuagggccaggcag

SEQ ID NO: 2225878 - RNA, 18 nt, Human
gacucuuuuuguaccugg

SEQ ID NO: 2225879 - RNA, 19 nt, Human
gacucuuugguggcuuugc

SEQ ID NO: 2225880 - RNA, 20 nt, Human
gacucuuugguggcuuugca

SEQ ID NO: 2225881 - RNA, 21 nt, Human
gacucuuugguggcuuugcau

SEQ ID NO: 2225882 - RNA, 18 nt, Human
gacucuuugguggcuuug

SEQ ID NO: 2225883 - RNA, 19 nt, Human
gacucuuguuuucaguuuc

SEQ ID NO: 2225884 - RNA, 22 nt, Human
gacucugucaauuucccugacu

SEQ ID NO: 2225885 - RNA, 17 nt, Human
gacucuuaagaagacug

SEQ ID NO: 2225886 - RNA, 18 nt, Human
gacucuuaagaagacugc

SEQ ID NO: 2225887 - RNA, 16 nt, Human
gacucuuaagaagacu

SEQ ID NO: 2225888 - RNA, 14 nt, Human
gacucucugugacc

SEQ ID NO: 2225889 - RNA, 15 nt, Human
gacucucugugaccu

SEQ ID NO: 2225890 - RNA, 22 nt, Human
gacucaaaacccaucugggcuc

SEQ ID NO: 2225891 - RNA, 23 nt, Human
gacucaaaacccaucugggcucc

SEQ ID NO: 2225892 - RNA, 19 nt, Human
gacucucugugaccugccc

SEQ ID NO: 2225893 - RNA, 14 nt, Human
gacucugaaaucug

SEQ ID NO: 2225894 - RNA, 15 nt, Human
gacucugaaaucuga

SEQ ID NO: 2225895 - RNA, 19 nt, Human
gacucugaggcucuuucug

SEQ ID NO: 2225896 - RNA, 23 nt, Human
gacucugaccucuuggccacaga

SEQ ID NO: 2225897 - RNA, 22 nt, Human
gacucugaggcucuuucugggc

SEQ ID NO: 2225898 - RNA, 12 nt, Human
gacucugcacau

SEQ ID NO: 2225899 - RNA, 18 nt, Human
gacucugaaaucugaaga

SEQ ID NO: 2225900 - RNA, 15 nt, Human
gacucugaagccucu

SEQ ID NO: 2225901 - RNA, 16 nt, Human
gacucugaagccucug

SEQ ID NO: 2225902 - RNA, 17 nt, Human
gacucugaagccucugg

SEQ ID NO: 2225903 - RNA, 18 nt, Human
gacucugaagccucuggg

SEQ ID NO: 2225904 - RNA, 19 nt, Human
gacucugaagccucuggga

SEQ ID NO: 2225905 - RNA, 20 nt, Human
gacucugaaucuuuuucaga

SEQ ID NO: 2225906 - RNA, 21 nt, Human
gacucugaaucuuuuucagaa

SEQ ID NO: 2225907 - RNA, 12 nt, Human
gacucugucuca

SEQ ID NO: 2225908 - RNA, 13 nt, Human
gacucuggccucc

SEQ ID NO: 2225909 - RNA, 16 nt, Human
gacucuggggacuccg

SEQ ID NO: 2225910 - RNA, 17 nt, Human
gacucugaccucuuggc

SEQ ID NO: 2225911 - RNA, 19 nt, Human
gacucugcacaugucuugu

SEQ ID NO: 2225912 - RNA, 14 nt, Human
gacucugcacauga

SEQ ID NO: 2225913 - RNA, 15 nt, Human
gacucugcacauguc

SEQ ID NO: 2225914 - RNA, 16 nt, Human
gacucuggcaaagcuu

SEQ ID NO: 2225915 - RNA, 15 nt, Human
gacucuggccuccac

SEQ ID NO: 2225916 - RNA, 20 nt, Human
gacuagggauucaggcugcu

SEQ ID NO: 2225917 - RNA, 19 nt, Human
gacuagggauucaggcugc

SEQ ID NO: 2225918 - RNA, 18 nt, Human
gacuagggauucaggcug

SEQ ID NO: 2225919 - RNA, 17 nt, Human
gacuagggauucaggcu

SEQ ID NO: 2225920 - RNA, 14 nt, Human
gacuaggagcacug

SEQ ID NO: 2225921 - RNA, 23 nt, Human
gacuagggaaaugaucaguuuuu

SEQ ID NO: 2225922 - RNA, 21 nt, Human
gacuagccccuguggagacug

SEQ ID NO: 2225923 - RNA, 14 nt, Human
gacuauucaguuuu

SEQ ID NO: 2225924 - RNA, 21 nt, Human
gacuaugaaugggcaaaacug

SEQ ID NO: 2225925 - RNA, 13 nt, Human
gacuauuuaugaa

SEQ ID NO: 2225926 - RNA, 16 nt, Human
gacuauuuaacuugag

SEQ ID NO: 2225927 - RNA, 23 nt, Human
gacuagccccuguggagacuggg

SEQ ID NO: 2225928 - RNA, 19 nt, Human
gacuaugaacuucucucag

SEQ ID NO: 2225929 - RNA, 20 nt, Human
gacuaugaacuucucucaga

SEQ ID NO: 2225930 - RNA, 16 nt, Human
gacuaugaaugggcaa

SEQ ID NO: 2225931 - RNA, 22 nt, Human
gacuaucaaacugaagccagaa

SEQ ID NO: 2225932 - RNA, 18 nt, Human
gacuaucaaacugaagcc

SEQ ID NO: 2225933 - RNA, 18 nt, Human
gacuaucugucugguggc

SEQ ID NO: 2225934 - RNA, 13 nt, Human
gacuaucagccca

SEQ ID NO: 2225935 - RNA, 22 nt, Human
gacuaucuaaauguugaaagau

SEQ ID NO: 2225936 - RNA, 21 nt, Human
gacuagggauucaggcugcuu

SEQ ID NO: 2225937 - RNA, 22 nt, Human
gacuauauuugggccugcucca

SEQ ID NO: 2225938 - RNA, 18 nt, Human
gacuaggguccuggggaa

SEQ ID NO: 2225939 - RNA, 16 nt, Human
gacuaggguccugggg

SEQ ID NO: 2225940 - RNA, 15 nt, Human
gacuaggguccuggg

SEQ ID NO: 2225941 - RNA, 17 nt, Human
gagaagugaaugcuggg

SEQ ID NO: 2225942 - RNA, 19 nt, Human
gagaagugaaugcugggac

SEQ ID NO: 2225943 - RNA, 20 nt, Human
gagaagugaaugcugggacu

SEQ ID NO: 2225944 - RNA, 23 nt, Human
gagaagucuuagacuugaaauac

SEQ ID NO: 2225945 - RNA, 24 nt, Human
gagaagugacagggaagcuacagg

SEQ ID NO: 2225946 - RNA, 21 nt, Human
gagaagugacagggaagcuac

SEQ ID NO: 2225947 - RNA, 23 nt, Human
gagaagugacagggaagcuacag

SEQ ID NO: 2225948 - RNA, 15 nt, Human
gagaagugacaggga

SEQ ID NO: 2225949 - RNA, 16 nt, Human
gagaagugacagggaa

SEQ ID NO: 2225950 - RNA, 17 nt, Human
gagaagugacagggaag

SEQ ID NO: 2225951 - RNA, 19 nt, Human
gagaagugacagggaagcu

SEQ ID NO: 2225952 - RNA, 14 nt, Human
gagaaucacuugaa

SEQ ID NO: 2225953 - RNA, 21 nt, Human
gagaaucauacuuagcaaagu

SEQ ID NO: 2225954 - RNA, 13 nt, Human
gagaaucacuuga

SEQ ID NO: 2225955 - RNA, 20 nt, Human
gagaaucagaucauuucaaa

SEQ ID NO: 2225956 - RNA, 15 nt, Human
gagaaucacuugaac

SEQ ID NO: 2225957 - RNA, 14 nt, Human
gagacccccacacc

SEQ ID NO: 2225958 - RNA, 13 nt, Human
gagacccccacac

SEQ ID NO: 2225959 - RNA, 12 nt, Human
gagacccccaca

SEQ ID NO: 2225960 - RNA, 14 nt, Human
gagacccaaggagg

SEQ ID NO: 2225961 - RNA, 18 nt, Human
gagacccagcccucaucc

SEQ ID NO: 2225962 - RNA, 16 nt, Human
gagacuagauugccuu

SEQ ID NO: 2225963 - RNA, 16 nt, Human
gagacuaagcccuguc

SEQ ID NO: 2225964 - RNA, 22 nt, Human
gagacuaagcccugucgagaca

SEQ ID NO: 2225965 - RNA, 18 nt, Human
gagaccugacaagcacug

SEQ ID NO: 2225966 - RNA, 19 nt, Human
gagaccugacaagcacugc

SEQ ID NO: 2225967 - RNA, 14 nt, Human
gagacuaagcccug

SEQ ID NO: 2225968 - RNA, 15 nt, Human
gagacuaagcccugu

SEQ ID NO: 2225969 - RNA, 23 nt, Human
gagacuaaccccaccacacccuc

SEQ ID NO: 2225970 - RNA, 22 nt, Human
gagacguuuuuggaagaguagu

SEQ ID NO: 2225971 - RNA, 13 nt, Human
gagaccugccccu

SEQ ID NO: 2225972 - RNA, 12 nt, Human
gagaccugcccc

SEQ ID NO: 2225973 - RNA, 11 nt, Human
gagaccugccc

SEQ ID NO: 2225974 - RNA, 13 nt, Human
gagaccuccugcc

SEQ ID NO: 2225975 - RNA, 15 nt, Human
gagaccuccugccuc

SEQ ID NO: 2225976 - RNA, 16 nt, Human
gagaccuccugccucc

SEQ ID NO: 2225977 - RNA, 15 nt, Human
gagaccucagccaug

SEQ ID NO: 2225978 - RNA, 11 nt, Human
gagaccucauc

SEQ ID NO: 2225979 - RNA, 12 nt, Human
gagaccucauca

SEQ ID NO: 2225980 - RNA, 18 nt, Human
gagaccucaucaggauga

SEQ ID NO: 2225981 - RNA, 19 nt, Human
gagaccucaucaggaugaa

SEQ ID NO: 2225982 - RNA, 20 nt, Human
gagaccucaucaggaugaac

SEQ ID NO: 2225983 - RNA, 21 nt, Human
gagaccucaucaggaugaacc

SEQ ID NO: 2225984 - RNA, 14 nt, Human
gagaccucagccau

SEQ ID NO: 2225985 - RNA, 13 nt, Human
gagaccucagcca

SEQ ID NO: 2225986 - RNA, 11 nt, Human
gagaccucagc

SEQ ID NO: 2225987 - RNA, 15 nt, Human
gagacccucugccac

SEQ ID NO: 2225988 - RNA, 21 nt, Human
gagacccucugccaccagaga

SEQ ID NO: 2225989 - RNA, 23 nt, Human
gagacccccacaccucaguuccc

SEQ ID NO: 2225990 - RNA, 15 nt, Human
gagacccccacaccu

SEQ ID NO: 2225991 - RNA, 13 nt, Human
gagaccccuggcc

SEQ ID NO: 2225992 - RNA, 14 nt, Human
gagaccccuggccu

SEQ ID NO: 2225993 - RNA, 15 nt, Human
gagaccccuggccuc

SEQ ID NO: 2225994 - RNA, 16 nt, Human
gagaccccuggccucc

SEQ ID NO: 2225995 - RNA, 19 nt, Human
gagacccucguggccuucc

SEQ ID NO: 2225996 - RNA, 17 nt, Human
gagaccccuggccuccg

SEQ ID NO: 2225997 - RNA, 17 nt, Human
gagacccuacaggagag

SEQ ID NO: 2225998 - RNA, 21 nt, Human
gagacccugucucaaaaaaag

SEQ ID NO: 2225999 - RNA, 21 nt, Human
gagaaggaaggagacucaccu

SEQ ID NO: 2226000 - RNA, 14 nt, Human
gagaaggaaggaga

SEQ ID NO: 2226001 - RNA, 22 nt, Human
gagaaggacccggaggggccug

SEQ ID NO: 2226002 - RNA, 12 nt, Human
gagaaggaagcc

SEQ ID NO: 2226003 - RNA, 20 nt, Human
gagaaggacccggaggggcc

SEQ ID NO: 2226004 - RNA, 22 nt, Human
gagaagcuuuugaauaaaaacu

SEQ ID NO: 2226005 - RNA, 21 nt, Human
gagaagcuuuugaauaaaaac

SEQ ID NO: 2226006 - RNA, 15 nt, Human
gagaagcggcuggca

SEQ ID NO: 2226007 - RNA, 13 nt, Human
gagaagcggcugg

SEQ ID NO: 2226008 - RNA, 16 nt, Human
gagaagcggcuggcag

SEQ ID NO: 2226009 - RNA, 17 nt, Human
gagaagcuuugcccucc

SEQ ID NO: 2226010 - RNA, 21 nt, Human
gacuuuucuuuguggcuuccu

SEQ ID NO: 2226011 - RNA, 23 nt, Human
gacuuuucuuucagccaagaauu

SEQ ID NO: 2226012 - RNA, 23 nt, Human
gacuuuuguauagguagauguuc

SEQ ID NO: 2226013 - RNA, 18 nt, Human
gacuuuugaaaagaggug

SEQ ID NO: 2226014 - RNA, 15 nt, Human
gacuuucugccugga

SEQ ID NO: 2226015 - RNA, 23 nt, Human
gacugggucucgcuuuguugccc

SEQ ID NO: 2226016 - RNA, 21 nt, Human
gacucuuuuuguaccugguga

SEQ ID NO: 2226017 - RNA, 16 nt, Human
gacuggguuuaugucc

SEQ ID NO: 2226018 - RNA, 14 nt, Human
gacuggguuucuag

SEQ ID NO: 2226019 - RNA, 21 nt, Human
gacuggguuuggaccccagcu

SEQ ID NO: 2226020 - RNA, 22 nt, Human
gacuggguuuggaccccagcug

SEQ ID NO: 2226021 - RNA, 14 nt, Human
gacuggugagcaga

SEQ ID NO: 2226022 - RNA, 15 nt, Human
gacugguccugugug

SEQ ID NO: 2226023 - RNA, 23 nt, Human
gacuggguuuggaccccagcugg

SEQ ID NO: 2226024 - RNA, 16 nt, Human
gacugguaaguaacug

SEQ ID NO: 2226025 - RNA, 17 nt, Human
gacuggugagcagacug

SEQ ID NO: 2226026 - RNA, 19 nt, Human
gacuggugcuauaggcugg

SEQ ID NO: 2226027 - RNA, 20 nt, Human
gacuggugcuauaggcugga

SEQ ID NO: 2226028 - RNA, 19 nt, Human
gacuuuccacccccucccu

SEQ ID NO: 2226029 - RNA, 18 nt, Human
gacuuuccacccccuccc

SEQ ID NO: 2226030 - RNA, 17 nt, Human
gacuuuccacccccucc

SEQ ID NO: 2226031 - RNA, 16 nt, Human
gacuuuccacccccuc

SEQ ID NO: 2226032 - RNA, 15 nt, Human
gacuuuccacccccu

SEQ ID NO: 2226033 - RNA, 13 nt, Human
gacuuuccacccc

SEQ ID NO: 2226034 - RNA, 22 nt, Human
gacuggugcuauaggcuggaga

SEQ ID NO: 2226035 - RNA, 23 nt, Human
gacuggugcuauaggcuggagaa

SEQ ID NO: 2226036 - RNA, 11 nt, Human
gacuuuccucu

SEQ ID NO: 2226037 - RNA, 23 nt, Human
gacuuucucagccucugaauaug

SEQ ID NO: 2226038 - RNA, 19 nt, Human
gacuuucggaguugggggu

SEQ ID NO: 2226039 - RNA, 12 nt, Human
gacuuucugccu

SEQ ID NO: 2226040 - RNA, 14 nt, Human
gacuuucugccugg

SEQ ID NO: 2226041 - RNA, 16 nt, Human
gacuuuccuaaauguu

SEQ ID NO: 2226042 - RNA, 11 nt, Human
gacuuuccugc

SEQ ID NO: 2226043 - RNA, 12 nt, Human
gacuuuccugca

SEQ ID NO: 2226044 - RNA, 18 nt, Human
gacuuucggaguuggggg

SEQ ID NO: 2226045 - RNA, 13 nt, Human
gauacgacuuuau

SEQ ID NO: 2226046 - RNA, 11 nt, Human
gauacuacagu

SEQ ID NO: 2226047 - RNA, 20 nt, Human
gauacuaaaaguucuucucc

SEQ ID NO: 2226048 - RNA, 16 nt, Human
gauacgcaucagacag

SEQ ID NO: 2226049 - RNA, 22 nt, Human
gauacuaaaaguucuucuccaa

SEQ ID NO: 2226050 - RNA, 16 nt, Human
gauacuacaguuuguu

SEQ ID NO: 2226051 - RNA, 13 nt, Human
gauaccccccucu

SEQ ID NO: 2226052 - RNA, 20 nt, Human
gauacccauagcuuccauga

SEQ ID NO: 2226053 - RNA, 21 nt, Human
gauaccccccucugucuugug

SEQ ID NO: 2226054 - RNA, 13 nt, Human
gauacccauccca

SEQ ID NO: 2226055 - RNA, 14 nt, Human
gauacccaucccau

SEQ ID NO: 2226056 - RNA, 16 nt, Human
gauauuaaaggaguua

SEQ ID NO: 2226057 - RNA, 18 nt, Human
gauauuccaugaauguau

SEQ ID NO: 2226058 - RNA, 16 nt, Human
gauauuccaugaaugu

SEQ ID NO: 2226059 - RNA, 15 nt, Human
gauauuauucuugua

SEQ ID NO: 2226060 - RNA, 20 nt, Human
gauauuccccccacuuaaga

SEQ ID NO: 2226061 - RNA, 21 nt, Human
gauauuccaugaauguaucag

SEQ ID NO: 2226062 - RNA, 19 nt, Human
gauauuccaugaauguauc

SEQ ID NO: 2226063 - RNA, 19 nt, Human
gauauguaaacauaauucu

SEQ ID NO: 2226064 - RNA, 20 nt, Human
gauauguaccuaacgaagua

SEQ ID NO: 2226065 - RNA, 17 nt, Human
gauaugggacauuuuug

SEQ ID NO: 2226066 - RNA, 16 nt, Human
gauaugggacauuuuu

SEQ ID NO: 2226067 - RNA, 21 nt, Human
gauaugguggguggacagggg

SEQ ID NO: 2226068 - RNA, 14 nt, Human
gauaugcuuaguaa

SEQ ID NO: 2226069 - RNA, 16 nt, Human
gauaugcuuaguaaug

SEQ ID NO: 2226070 - RNA, 12 nt, Human
gauauggagccc

SEQ ID NO: 2226071 - RNA, 15 nt, Human
gauauggagcccugu

SEQ ID NO: 2226072 - RNA, 21 nt, Human
gauauggagcccuguaauuuu

SEQ ID NO: 2226073 - RNA, 14 nt, Human
gauauggcagaaga

SEQ ID NO: 2226074 - RNA, 15 nt, Human
gauauggcagaagac

SEQ ID NO: 2226075 - RNA, 17 nt, Human
gauauggcagaagacac

SEQ ID NO: 2226076 - RNA, 14 nt, Human
gauaugcagaagga

SEQ ID NO: 2226077 - RNA, 18 nt, Human
gauaugcaguuuuccuua

SEQ ID NO: 2226078 - RNA, 17 nt, Human
gauacuugaaaauuaac

SEQ ID NO: 2226079 - RNA, 20 nt, Human
gauaugauuuaaaacaugua

SEQ ID NO: 2226080 - RNA, 16 nt, Human
gauacuugaaaauuaa

SEQ ID NO: 2226081 - RNA, 13 nt, Human
gaguccacuuugu

SEQ ID NO: 2226082 - RNA, 14 nt, Human
gaguccaggcccca

SEQ ID NO: 2226083 - RNA, 12 nt, Human
gaguccagggaa

SEQ ID NO: 2226084 - RNA, 13 nt, Human
gaguccaggcccc

SEQ ID NO: 2226085 - RNA, 11 nt, Human
gaguccacucc

SEQ ID NO: 2226086 - RNA, 22 nt, Human
gaguccacuuuguuucgugggg

SEQ ID NO: 2226087 - RNA, 13 nt, Human
gagucaccaagcc

SEQ ID NO: 2226088 - RNA, 14 nt, Human
gagucaccaagccc

SEQ ID NO: 2226089 - RNA, 16 nt, Human
gagucccaccuuggcu

SEQ ID NO: 2226090 - RNA, 20 nt, Human
gagucccaccuuggcugcag

SEQ ID NO: 2226091 - RNA, 13 nt, Human
gagugagggccug

SEQ ID NO: 2226092 - RNA, 14 nt, Human
gagugagggccuga

SEQ ID NO: 2226093 - RNA, 19 nt, Human
gagugagggguaaaagcug

SEQ ID NO: 2226094 - RNA, 18 nt, Human
gagugaggaugucugggc

SEQ ID NO: 2226095 - RNA, 21 nt, Human
gagugagggguaaaagcugau

SEQ ID NO: 2226096 - RNA, 22 nt, Human
gagugaggguuucugagcugcu

SEQ ID NO: 2226097 - RNA, 14 nt, Human
gagugcaguccuga

SEQ ID NO: 2226098 - RNA, 17 nt, Human
gagugcaggccugcuca

SEQ ID NO: 2226099 - RNA, 19 nt, Human
gagugcaggccugcucagg

SEQ ID NO: 2226100 - RNA, 11 nt, Human
gagugcaguga

SEQ ID NO: 2226101 - RNA, 12 nt, Human
gagugcagugag

SEQ ID NO: 2226102 - RNA, 24 nt, Human
gagugagcacuaaggugugcucug

SEQ ID NO: 2226103 - RNA, 21 nt, Human
gagucccaccuuggcugcagg

SEQ ID NO: 2226104 - RNA, 13 nt, Human
gaguccagucucu

SEQ ID NO: 2226105 - RNA, 22 nt, Human
gagugaggaauaguugagcccc

SEQ ID NO: 2226106 - RNA, 13 nt, Human
gagugagccuggc

SEQ ID NO: 2226107 - RNA, 13 nt, Human
gagucccaccuug

SEQ ID NO: 2226108 - RNA, 12 nt, Human
gagugagcuggu

SEQ ID NO: 2226109 - RNA, 20 nt, Human
gaggugggaggaucuuuuga

SEQ ID NO: 2226110 - RNA, 17 nt, Human
gaggugggagcaggaga

SEQ ID NO: 2226111 - RNA, 18 nt, Human
gaggugggagcaggagau

SEQ ID NO: 2226112 - RNA, 23 nt, Human
gaggugcuacugacuuucucagc

SEQ ID NO: 2226113 - RNA, 15 nt, Human
gaggugggagcagga

SEQ ID NO: 2226114 - RNA, 16 nt, Human
gaggugcugggaggga

SEQ ID NO: 2226115 - RNA, 12 nt, Human
gaggugggaucc

SEQ ID NO: 2226116 - RNA, 15 nt, Human
gagucaaugugcagu

SEQ ID NO: 2226117 - RNA, 19 nt, Human
gagucaauccccucauuca

SEQ ID NO: 2226118 - RNA, 20 nt, Human
gagucaauccccucauucag

SEQ ID NO: 2226119 - RNA, 16 nt, Human
gaggugggauaucccu

SEQ ID NO: 2226120 - RNA, 18 nt, Human
gaggugggagguggaaga

SEQ ID NO: 2226121 - RNA, 15 nt, Human
gaggugggaggugga

SEQ ID NO: 2226122 - RNA, 23 nt, Human
gaggugggagcaggagauugaga

SEQ ID NO: 2226123 - RNA, 11 nt, Human
gaggugggagg

SEQ ID NO: 2226124 - RNA, 13 nt, Human
gaggugccugucc

SEQ ID NO: 2226125 - RNA, 15 nt, Human
gaggugccuguccca

SEQ ID NO: 2226126 - RNA, 21 nt, Human
gaggugccugucccaccccca

SEQ ID NO: 2226127 - RNA, 14 nt, Human
gaggugccagcaaa

SEQ ID NO: 2226128 - RNA, 13 nt, Human
gaggugccagcaa

SEQ ID NO: 2226129 - RNA, 15 nt, Human
gaggugccagcaaag

SEQ ID NO: 2226130 - RNA, 16 nt, Human
gaggugccagcaaagc

SEQ ID NO: 2226131 - RNA, 17 nt, Human
gaggugccagcaaagcc

SEQ ID NO: 2226132 - RNA, 19 nt, Human
gaggugccagcaaagcccc

SEQ ID NO: 2226133 - RNA, 20 nt, Human
gaggugccagcaaagcccca

SEQ ID NO: 2226134 - RNA, 17 nt, Human
gaggugccagcaacuga

SEQ ID NO: 2226135 - RNA, 20 nt, Human
gaggugccagcaacugaaua

SEQ ID NO: 2226136 - RNA, 22 nt, Human
gaggugccagcaacugaauaaa

SEQ ID NO: 2226137 - RNA, 23 nt, Human
gaggucugcucggccgucuucac

SEQ ID NO: 2226138 - RNA, 19 nt, Human
gaggucugcucggccgucu

SEQ ID NO: 2226139 - RNA, 17 nt, Human
gaggucuggcugcuugc

SEQ ID NO: 2226140 - RNA, 21 nt, Human
gaggucuguacguuaccucuu

SEQ ID NO: 2226141 - RNA, 14 nt, Human
gaggucugaaaugg

SEQ ID NO: 2226142 - RNA, 18 nt, Human
gaggucucuugagggagc

SEQ ID NO: 2226143 - RNA, 17 nt, Human
gaggucucuugagggag

SEQ ID NO: 2226144 - RNA, 18 nt, Human
gaggugcagagugcccag

SEQ ID NO: 2226145 - RNA, 18 nt, Human
gaggucuuuugacaugug

SEQ ID NO: 2226146 - RNA, 19 nt, Human
gaggugcagagugcccaga

SEQ ID NO: 2226147 - RNA, 21 nt, Human
gaggugcagagugcccagaac

SEQ ID NO: 2226148 - RNA, 13 nt, Human
gaggucugugcug

SEQ ID NO: 2226149 - RNA, 15 nt, Human
gaggucugugcugag

SEQ ID NO: 2226150 - RNA, 16 nt, Human
gaggucugugcugagg

SEQ ID NO: 2226151 - RNA, 19 nt, Human
gaggucugugcugaggccu

SEQ ID NO: 2226152 - RNA, 14 nt, Human
gaggucuguucuuu

SEQ ID NO: 2226153 - RNA, 13 nt, Human
gaggucuguucuu

SEQ ID NO: 2226154 - RNA, 12 nt, Human
gaguuugguccc

SEQ ID NO: 2226155 - RNA, 18 nt, Human
gaguuuguguguugucuu

SEQ ID NO: 2226156 - RNA, 20 nt, Human
gaguuugggguaugggagag

SEQ ID NO: 2226157 - RNA, 18 nt, Human
gaguuugcuauuagagca

SEQ ID NO: 2226158 - RNA, 17 nt, Human
gaguuugucgcucaugu

SEQ ID NO: 2226159 - RNA, 18 nt, Human
gaguuugucgcucaugug

SEQ ID NO: 2226160 - RNA, 22 nt, Human
gaguuugucgcucaugugugca

SEQ ID NO: 2226161 - RNA, 15 nt, Human
gaguuuggucccugg

SEQ ID NO: 2226162 - RNA, 20 nt, Human
gaguuguggaaagccucugc

SEQ ID NO: 2226163 - RNA, 16 nt, Human
gaguuguggaaagccu

SEQ ID NO: 2226164 - RNA, 16 nt, Human
gaguuuagcuggaaaa

SEQ ID NO: 2226165 - RNA, 16 nt, Human
gaguuuccaaaaccag

SEQ ID NO: 2226166 - RNA, 15 nt, Human
gaguuuccucaggcu

SEQ ID NO: 2226167 - RNA, 18 nt, Human
gaguuucauucuccugcc

SEQ ID NO: 2226168 - RNA, 19 nt, Human
gaguuucauucuccugccu

SEQ ID NO: 2226169 - RNA, 20 nt, Human
gaguuucauucuccugccug

SEQ ID NO: 2226170 - RNA, 21 nt, Human
gaguuuagugaucugaacaga

SEQ ID NO: 2226171 - RNA, 18 nt, Human
gaguuucauguacaagau

SEQ ID NO: 2226172 - RNA, 15 nt, Human
gaguuucauguacaa

SEQ ID NO: 2226173 - RNA, 23 nt, Human
gaguuuccucaggcugcuggagg

SEQ ID NO: 2226174 - RNA, 20 nt, Human
gaguuuccucaggcugcugg

SEQ ID NO: 2226175 - RNA, 16 nt, Human
gaguuuccucaggcug

SEQ ID NO: 2226176 - RNA, 21 nt, Human
gaguuuccucaggcugcugga

SEQ ID NO: 2226177 - RNA, 15 nt, Human
gaguuucgagguaga

SEQ ID NO: 2226178 - RNA, 13 nt, Human
gaguuugcccugg

SEQ ID NO: 2226179 - RNA, 22 nt, Human
gaguuugaaggaggugagggau

SEQ ID NO: 2226180 - RNA, 17 nt, Human
gaguuugagcugccuuc

SEQ ID NO: 2226181 - RNA, 14 nt, Human
gagugcgugcucag

SEQ ID NO: 2226182 - RNA, 19 nt, Human
gaguggaauaguauccucc

SEQ ID NO: 2226183 - RNA, 18 nt, Human
gagugccuuacacaaugg

SEQ ID NO: 2226184 - RNA, 22 nt, Human
gagugcaguccugaucagagcc

SEQ ID NO: 2226185 - RNA, 18 nt, Human
gagugcaguccugaucag

SEQ ID NO: 2226186 - RNA, 17 nt, Human
gagugcaguccugauca

SEQ ID NO: 2226187 - RNA, 20 nt, Human
gaguuguuacauuuuuaagu

SEQ ID NO: 2226188 - RNA, 16 nt, Human
gaguuguuacauuuuu

SEQ ID NO: 2226189 - RNA, 19 nt, Human
gaguggacuguucccugag

SEQ ID NO: 2226190 - RNA, 17 nt, Human
gaguggacuggagugga

SEQ ID NO: 2226191 - RNA, 11 nt, Human
gaguugggggu

SEQ ID NO: 2226192 - RNA, 12 nt, Human
gaguuguaaaua

SEQ ID NO: 2226193 - RNA, 14 nt, Human
gaguuguaaauaua

SEQ ID NO: 2226194 - RNA, 15 nt, Human
gaguuguaaauauau

SEQ ID NO: 2226195 - RNA, 19 nt, Human
gaguuguaaauauauaaau

SEQ ID NO: 2226196 - RNA, 20 nt, Human
gaguggaauaguauccucca

SEQ ID NO: 2226197 - RNA, 22 nt, Human
gaguggaauaguauccuccagg

SEQ ID NO: 2226198 - RNA, 23 nt, Human
gaguggaauaguauccuccaggu

SEQ ID NO: 2226199 - RNA, 16 nt, Human
gaucucuugagccugg

SEQ ID NO: 2226200 - RNA, 12 nt, Human
gaucucuugagc

SEQ ID NO: 2226201 - RNA, 17 nt, Human
gaucucuugagccuggg

SEQ ID NO: 2226202 - RNA, 21 nt, Human
gauauuuuuucagaaauaugu

SEQ ID NO: 2226203 - RNA, 16 nt, Human
gauauuuuuucugaau

SEQ ID NO: 2226204 - RNA, 18 nt, Human
gauauuuuuccauuuuuu

SEQ ID NO: 2226205 - RNA, 17 nt, Human
gauauuuuuaucuuuau

SEQ ID NO: 2226206 - RNA, 15 nt, Human
gauauuuuuuucuuu

SEQ ID NO: 2226207 - RNA, 22 nt, Human
gauauugucagaguucugcucu

SEQ ID NO: 2226208 - RNA, 16 nt, Human
gauauuuugcuuugug

SEQ ID NO: 2226209 - RNA, 12 nt, Human
gauccaggacua

SEQ ID NO: 2226210 - RNA, 21 nt, Human
gauccagccuggggucuggag

SEQ ID NO: 2226211 - RNA, 13 nt, Human
gauccagccuggg

SEQ ID NO: 2226212 - RNA, 16 nt, Human
gauccagggacugaag

SEQ ID NO: 2226213 - RNA, 22 nt, Human
gauccagggacagaggccccag

SEQ ID NO: 2226214 - RNA, 18 nt, Human
gauccagggacagaggcc

SEQ ID NO: 2226215 - RNA, 15 nt, Human
gauccagggacagag

SEQ ID NO: 2226216 - RNA, 14 nt, Human
gauccagggacaga

SEQ ID NO: 2226217 - RNA, 13 nt, Human
gauccagggacag

SEQ ID NO: 2226218 - RNA, 12 nt, Human
gauccagggaca

SEQ ID NO: 2226219 - RNA, 19 nt, Human
gauccauguagcaggacug

SEQ ID NO: 2226220 - RNA, 16 nt, Human
gauccauguagcagga

SEQ ID NO: 2226221 - RNA, 22 nt, Human
gauccaugaguuugcccugguu

SEQ ID NO: 2226222 - RNA, 15 nt, Human
gaucucccugccgcc

SEQ ID NO: 2226223 - RNA, 14 nt, Human
gaucucccugccgc

SEQ ID NO: 2226224 - RNA, 13 nt, Human
gaucucccugccg

SEQ ID NO: 2226225 - RNA, 19 nt, Human
gaucuccauggcuuccucc

SEQ ID NO: 2226226 - RNA, 12 nt, Human
gaucucccugcc

SEQ ID NO: 2226227 - RNA, 20 nt, Human
gaucucccugccgccucaau

SEQ ID NO: 2226228 - RNA, 18 nt, Human
gaucucccugccgccuca

SEQ ID NO: 2226229 - RNA, 13 nt, Human
gaucuccugaccu

SEQ ID NO: 2226230 - RNA, 21 nt, Human
gaucucauuggacccuuccau

SEQ ID NO: 2226231 - RNA, 23 nt, Human
gaucucagugguuaagauuccua

SEQ ID NO: 2226232 - RNA, 17 nt, Human
gaucuccauauguuaca

SEQ ID NO: 2226233 - RNA, 20 nt, Human
gaucuccaaggaccagguua

SEQ ID NO: 2226234 - RNA, 16 nt, Human
gaucuccaaggaccag

SEQ ID NO: 2226235 - RNA, 19 nt, Human
gaucuccaaggaccagguu

SEQ ID NO: 2226236 - RNA, 13 nt, Human
gaucuccaaggac

SEQ ID NO: 2226237 - RNA, 13 nt, Human
gaugagaguuuug

SEQ ID NO: 2226238 - RNA, 18 nt, Human
gaugagaguuuuggaugc

SEQ ID NO: 2226239 - RNA, 21 nt, Human
gaugaugaaaugaggucagag

SEQ ID NO: 2226240 - RNA, 18 nt, Human
gaugcuggaugcuccuuc

SEQ ID NO: 2226241 - RNA, 17 nt, Human
gaugcuggaugucugcc

SEQ ID NO: 2226242 - RNA, 20 nt, Human
gaugcuggaugucugccaau

SEQ ID NO: 2226243 - RNA, 22 nt, Human
gaugcuggaugucugccaauuu

SEQ ID NO: 2226244 - RNA, 15 nt, Human
gaugcuggcccaggg

SEQ ID NO: 2226245 - RNA, 14 nt, Human
gaugcuggcccagg

SEQ ID NO: 2226246 - RNA, 13 nt, Human
gaugcuggcccag

SEQ ID NO: 2226247 - RNA, 12 nt, Human
gaugcuggccca

SEQ ID NO: 2226248 - RNA, 20 nt, Human
gaugaucuuugcagacaggc

SEQ ID NO: 2226249 - RNA, 21 nt, Human
gaugaucuuugcagacaggca

SEQ ID NO: 2226250 - RNA, 22 nt, Human
gaugagcauuuagggcaaggag

SEQ ID NO: 2226251 - RNA, 21 nt, Human
gaugagcauuuagggcaagga

SEQ ID NO: 2226252 - RNA, 18 nt, Human
gaugagcauuuagggcaa

SEQ ID NO: 2226253 - RNA, 12 nt, Human
gaugagcauuua

SEQ ID NO: 2226254 - RNA, 15 nt, Human
gaugagcccucagaa

SEQ ID NO: 2226255 - RNA, 21 nt, Human
gaugagaguuuuggaugcagu

SEQ ID NO: 2226256 - RNA, 16 nt, Human
gaugagcaucccagga

SEQ ID NO: 2226257 - RNA, 17 nt, Human
gaugagcaucccaggau

SEQ ID NO: 2226258 - RNA, 15 nt, Human
gaugagcauggagcu

SEQ ID NO: 2226259 - RNA, 16 nt, Human
gaugagcauggagcug

SEQ ID NO: 2226260 - RNA, 17 nt, Human
gaugagcauggagcugg

SEQ ID NO: 2226261 - RNA, 14 nt, Human
gaugaucuuugcag

SEQ ID NO: 2226262 - RNA, 22 nt, Human
gaugagcccucagaacccuugg

SEQ ID NO: 2226263 - RNA, 19 nt, Human
gaugagcccucagaacccu

SEQ ID NO: 2226264 - RNA, 13 nt, Human
gaugagccgcugu

SEQ ID NO: 2226265 - RNA, 23 nt, Human
gaugagccgcugugagccccugg

SEQ ID NO: 2226266 - RNA, 21 nt, Human
gauuauuuucuacacauacau

SEQ ID NO: 2226267 - RNA, 14 nt, Human
gauuauuucacuuu

SEQ ID NO: 2226268 - RNA, 22 nt, Human
gauuauuucacuuuagaugcug

SEQ ID NO: 2226269 - RNA, 21 nt, Human
gauuauuuguuauuuguacag

SEQ ID NO: 2226270 - RNA, 22 nt, Human
gauuauuuguuauuuguacagu

SEQ ID NO: 2226271 - RNA, 16 nt, Human
gauuauuuuuucagac

SEQ ID NO: 2226272 - RNA, 14 nt, Human
gauuauuuuuucag

SEQ ID NO: 2226273 - RNA, 23 nt, Human
gauuauuuguuauuuguacaguu

SEQ ID NO: 2226274 - RNA, 15 nt, Human
gauuauuuuuucaga

SEQ ID NO: 2226275 - RNA, 23 nt, Human
gauuauuaacuaauaugggcauu

SEQ ID NO: 2226276 - RNA, 14 nt, Human
gauuauuaucuaaa

SEQ ID NO: 2226277 - RNA, 17 nt, Human
gauuauuguauuuauuc

SEQ ID NO: 2226278 - RNA, 12 nt, Human
gauuauuuaaua

SEQ ID NO: 2226279 - RNA, 13 nt, Human
gauuauuuaauaa

SEQ ID NO: 2226280 - RNA, 14 nt, Human
gauuauuuaauaac

SEQ ID NO: 2226281 - RNA, 15 nt, Human
gauuauuuaauaaca

SEQ ID NO: 2226282 - RNA, 16 nt, Human
gauuauuuaauaacau

SEQ ID NO: 2226283 - RNA, 17 nt, Human
gauuauuuaauaacauu

SEQ ID NO: 2226284 - RNA, 18 nt, Human
gauuauuuaauaacauua

SEQ ID NO: 2226285 - RNA, 21 nt, Human
gauuauuuaauaacauuaccu

SEQ ID NO: 2226286 - RNA, 22 nt, Human
gauuauuuaauaacauuaccuu

SEQ ID NO: 2226287 - RNA, 23 nt, Human
gauuauuuaauaacauuaccuua

SEQ ID NO: 2226288 - RNA, 23 nt, Human
gauuauuucacuuuagaugcuga

SEQ ID NO: 2226289 - RNA, 15 nt, Human
gauuagaucuuuuaa

SEQ ID NO: 2226290 - RNA, 17 nt, Human
gauuagagggagguguu

SEQ ID NO: 2226291 - RNA, 20 nt, Human
gauuagagggagguguuuaa

SEQ ID NO: 2226292 - RNA, 18 nt, Human
gauuagaggcagaucugg

SEQ ID NO: 2226293 - RNA, 13 nt, Human
gauuagagggagg

SEQ ID NO: 2226294 - RNA, 14 nt, Human
gauuagagggaggu

SEQ ID NO: 2226295 - RNA, 19 nt, Human
gauuagcaaguuacaguga

SEQ ID NO: 2226296 - RNA, 12 nt, Human
gauuagcucugg

SEQ ID NO: 2226297 - RNA, 13 nt, Human
gauuagcucugga

SEQ ID NO: 2226298 - RNA, 17 nt, Human
gauuagggagagaagau

SEQ ID NO: 2226299 - RNA, 17 nt, Human
gauuaugguuuugugau

SEQ ID NO: 2226300 - RNA, 16 nt, Human
gauuaugguuuuguga

SEQ ID NO: 2226301 - RNA, 15 nt, Human
gauuaugguuuugug

SEQ ID NO: 2226302 - RNA, 20 nt, Human
gauuauuagccagguaaugu

SEQ ID NO: 2226303 - RNA, 19 nt, Human
gauuauguagcaaaauaca

SEQ ID NO: 2226304 - RNA, 15 nt, Human
gauuaguaaagaaau

SEQ ID NO: 2226305 - RNA, 16 nt, Human
gauuagcucuggacca

SEQ ID NO: 2226306 - RNA, 14 nt, Human
gauuagcucuggac

SEQ ID NO: 2226307 - RNA, 23 nt, Human
gauuagggcauuugagaaaugca

SEQ ID NO: 2226308 - RNA, 17 nt, Human
gauuauaacuugucuaa

SEQ ID NO: 2226309 - RNA, 13 nt, Human
gauuauacagaau

SEQ ID NO: 2226310 - RNA, 20 nt, Human
gauuacaggugugaaccacc

SEQ ID NO: 2226311 - RNA, 14 nt, Human
gauuacauaaucug

SEQ ID NO: 2226312 - RNA, 20 nt, Human
gauuacaggugugagccacc

SEQ ID NO: 2226313 - RNA, 23 nt, Human
gaugugaagccaauucagacagg

SEQ ID NO: 2226314 - RNA, 16 nt, Human
gaugcugggcuggcuc

SEQ ID NO: 2226315 - RNA, 21 nt, Human
gaugugaauugccugcagaga

SEQ ID NO: 2226316 - RNA, 22 nt, Human
gaugugaauugccugcagagag

SEQ ID NO: 2226317 - RNA, 23 nt, Human
gaugugaauugccugcagagaga

SEQ ID NO: 2226318 - RNA, 14 nt, Human
gaugugaagccaau

SEQ ID NO: 2226319 - RNA, 13 nt, Human
gaugugaagccaa

SEQ ID NO: 2226320 - RNA, 12 nt, Human
gaugugaagcca

SEQ ID NO: 2226321 - RNA, 17 nt, Human
gaugcugggcuggcucc

SEQ ID NO: 2226322 - RNA, 23 nt, Human
gaugcuggcccagggcccagagc

SEQ ID NO: 2226323 - RNA, 22 nt, Human
gaugcuggcccagggcccagag

SEQ ID NO: 2226324 - RNA, 11 nt, Human
gaugcugggau

SEQ ID NO: 2226325 - RNA, 12 nt, Human
gaugcugggcug

SEQ ID NO: 2226326 - RNA, 13 nt, Human
gaugcugggcugg

SEQ ID NO: 2226327 - RNA, 21 nt, Human
gaugcuggcccagggcccaga

SEQ ID NO: 2226328 - RNA, 19 nt, Human
gaugcuggcccagggccca

SEQ ID NO: 2226329 - RNA, 17 nt, Human
gaugcuggcccagggcc

SEQ ID NO: 2226330 - RNA, 16 nt, Human
gaugcuggcccagggc

SEQ ID NO: 2226331 - RNA, 16 nt, Human
gaugugaacacaucag

SEQ ID NO: 2226332 - RNA, 14 nt, Human
gaugugaacacauc

SEQ ID NO: 2226333 - RNA, 23 nt, Human
gauuacucuuugagauagaagaa

SEQ ID NO: 2226334 - RNA, 21 nt, Human
gauuagaaaugaccaauauua

SEQ ID NO: 2226335 - RNA, 17 nt, Human
gauuagaagcugaaaac

SEQ ID NO: 2226336 - RNA, 14 nt, Human
gauuagaaggcaag

SEQ ID NO: 2226337 - RNA, 17 nt, Human
gauuagaaugaaaauug

SEQ ID NO: 2226338 - RNA, 22 nt, Human
gauuagaaugaaaauuguaugu

SEQ ID NO: 2226339 - RNA, 12 nt, Human
gauuacucuuug

SEQ ID NO: 2226340 - RNA, 22 nt, Human
gauuaccuaguagucauuucau

SEQ ID NO: 2226341 - RNA, 17 nt, Human
gauuaccuccugagaaa

SEQ ID NO: 2226342 - RNA, 14 nt, Human
gauuaccuccugag

SEQ ID NO: 2226343 - RNA, 13 nt, Human
gauuaccuccuga

SEQ ID NO: 2226344 - RNA, 18 nt, Human
gauuacugccuauuuuaa

SEQ ID NO: 2226345 - RNA, 14 nt, Human
gauuacaugcaugu

SEQ ID NO: 2226346 - RNA, 15 nt, Human
gauuacauucaguug

SEQ ID NO: 2226347 - RNA, 15 nt, Human
gauuacauaaucugu

SEQ ID NO: 2226348 - RNA, 14 nt, Human
gauuacccaagcaa

SEQ ID NO: 2226349 - RNA, 21 nt, Human
gauuacccaagcaaaaucaug

SEQ ID NO: 2226350 - RNA, 14 nt, Human
gauuaccagggacu

SEQ ID NO: 2226351 - RNA, 12 nt, Human
gauucuccuuca

SEQ ID NO: 2226352 - RNA, 13 nt, Human
gauucuccuucag

SEQ ID NO: 2226353 - RNA, 17 nt, Human
gauucuccuucagcccu

SEQ ID NO: 2226354 - RNA, 11 nt, Human
gauucuccuuc

SEQ ID NO: 2226355 - RNA, 18 nt, Human
gauucuccuucagcccuc

SEQ ID NO: 2226356 - RNA, 16 nt, Human
gcaccuaauccaggca

SEQ ID NO: 2226357 - RNA, 15 nt, Human
gcaccuaauccaggc

SEQ ID NO: 2226358 - RNA, 15 nt, Human
gcaccguucugugca

SEQ ID NO: 2226359 - RNA, 19 nt, Human
gcaccuaaaccaccagugc

SEQ ID NO: 2226360 - RNA, 14 nt, Human
gcaccguucugugc

SEQ ID NO: 2226361 - RNA, 21 nt, Human
gcaccgucauggcuuaauguu

SEQ ID NO: 2226362 - RNA, 21 nt, Human
gcaccuaaaccaccagugccc

SEQ ID NO: 2226363 - RNA, 23 nt, Human
gcaccuaaaccaccagugcccaa

SEQ ID NO: 2226364 - RNA, 12 nt, Human
gcacugacauug

SEQ ID NO: 2226365 - RNA, 18 nt, Human
gcagaaagguucugcccg

SEQ ID NO: 2226366 - RNA, 22 nt, Human
gcacuuucuacaaugugaacuu

SEQ ID NO: 2226367 - RNA, 21 nt, Human
gcagaaagguucugcccggga

SEQ ID NO: 2226368 - RNA, 21 nt, Human
gcacuuucuacaaugugaacu

SEQ ID NO: 2226369 - RNA, 16 nt, Human
gcacuuuccuccuggc

SEQ ID NO: 2226370 - RNA, 17 nt, Human
gcacuuuccuccuggca

SEQ ID NO: 2226371 - RNA, 20 nt, Human
gcacuuuagggcuguaaaau

SEQ ID NO: 2226372 - RNA, 17 nt, Human
gcacugacugggcauag

SEQ ID NO: 2226373 - RNA, 12 nt, Human
gcacuuguauau

SEQ ID NO: 2226374 - RNA, 17 nt, Human
gcacuugugauuauuua

SEQ ID NO: 2226375 - RNA, 16 nt, Human
gcacuuguccagcuga

SEQ ID NO: 2226376 - RNA, 15 nt, Human
gcacuuguauauacg

SEQ ID NO: 2226377 - RNA, 23 nt, Human
gcacuugugauuauuuauuauuu

SEQ ID NO: 2226378 - RNA, 21 nt, Human
gcacuugugauuauuuauuau

SEQ ID NO: 2226379 - RNA, 20 nt, Human
gcacuugugauuauuuauua

SEQ ID NO: 2226380 - RNA, 16 nt, Human
gcacugacugggcaua

SEQ ID NO: 2226381 - RNA, 15 nt, Human
gcagaaaucuagaag

SEQ ID NO: 2226382 - RNA, 14 nt, Human
gcagaaaucuagaa

SEQ ID NO: 2226383 - RNA, 13 nt, Human
gcagaacacuaac

SEQ ID NO: 2226384 - RNA, 14 nt, Human
gcagaacacuaacc

SEQ ID NO: 2226385 - RNA, 15 nt, Human
gcagaacacuaaccu

SEQ ID NO: 2226386 - RNA, 21 nt, Human
gcagaacagccgcuccugucu

SEQ ID NO: 2226387 - RNA, 18 nt, Human
gcagaacagccgcuccug

SEQ ID NO: 2226388 - RNA, 17 nt, Human
gcagaacacuaaccuga

SEQ ID NO: 2226389 - RNA, 13 nt, Human
gcagagagaagcc

SEQ ID NO: 2226390 - RNA, 14 nt, Human
gcagagagaagccu

SEQ ID NO: 2226391 - RNA, 15 nt, Human
gcagagaggccaggu

SEQ ID NO: 2226392 - RNA, 21 nt, Human
gcagagagccauuuugugaau

SEQ ID NO: 2226393 - RNA, 19 nt, Human
gcagagagcggucucaggc

SEQ ID NO: 2226394 - RNA, 16 nt, Human
gcagagagaagccugu

SEQ ID NO: 2226395 - RNA, 15 nt, Human
gcagagagccauuuu

SEQ ID NO: 2226396 - RNA, 19 nt, Human
gcagagagccauuuuguga

SEQ ID NO: 2226397 - RNA, 22 nt, Human
gcagagauuggaaugggcagcu

SEQ ID NO: 2226398 - RNA, 23 nt, Human
gcagagauuggaaugggcagcuc

SEQ ID NO: 2226399 - RNA, 19 nt, Human
gcagagcaccuuagacagu

SEQ ID NO: 2226400 - RNA, 22 nt, Human
gcagagcaccuuagacaguccc

SEQ ID NO: 2226401 - RNA, 23 nt, Human
gcagagcaccuuagacagucccu

SEQ ID NO: 2226402 - RNA, 20 nt, Human
gcagagcaggggcaggguga

SEQ ID NO: 2226403 - RNA, 14 nt, Human
gcagagcaggggca

SEQ ID NO: 2226404 - RNA, 16 nt, Human
gcagagcaagucugca

SEQ ID NO: 2226405 - RNA, 17 nt, Human
gcagagcaagucugcag

SEQ ID NO: 2226406 - RNA, 18 nt, Human
gcagagcaagucugcagg

SEQ ID NO: 2226407 - RNA, 21 nt, Human
gcagagcagugggccuggcca

SEQ ID NO: 2226408 - RNA, 19 nt, Human
gcagagcagagaccauccc

SEQ ID NO: 2226409 - RNA, 20 nt, Human
gcagagcagagaccaucccu

SEQ ID NO: 2226410 - RNA, 24 nt, Human
gcagagcaccuuagacagucccug

SEQ ID NO: 2226411 - RNA, 12 nt, Human
gcagagcagaga

SEQ ID NO: 2226412 - RNA, 14 nt, Human
gcagagcagagacc

SEQ ID NO: 2226413 - RNA, 15 nt, Human
gcagagcagagacca

SEQ ID NO: 2226414 - RNA, 13 nt, Human
gauucugagagcu

SEQ ID NO: 2226415 - RNA, 12 nt, Human
gcaagucugcag

SEQ ID NO: 2226416 - RNA, 19 nt, Human
gcaagucucuuuauauggc

SEQ ID NO: 2226417 - RNA, 17 nt, Human
gcaagucuggaucuggg

SEQ ID NO: 2226418 - RNA, 21 nt, Human
gcaagucugcagcccggcgcc

SEQ ID NO: 2226419 - RNA, 13 nt, Human
gcaagucugcagg

SEQ ID NO: 2226420 - RNA, 20 nt, Human
gcaagucugcaggugcacca

SEQ ID NO: 2226421 - RNA, 13 nt, Human
gcaagugaagaaa

SEQ ID NO: 2226422 - RNA, 18 nt, Human
gcaagugaagguuuacaa

SEQ ID NO: 2226423 - RNA, 21 nt, Human
gcaagugaagguuuacaauuu

SEQ ID NO: 2226424 - RNA, 13 nt, Human
gcaagugagagcu

SEQ ID NO: 2226425 - RNA, 12 nt, Human
gcaauaaaugaa

SEQ ID NO: 2226426 - RNA, 21 nt, Human
gcaauaaaucugacccagugc

SEQ ID NO: 2226427 - RNA, 19 nt, Human
gcaauaaaucugacccagu

SEQ ID NO: 2226428 - RNA, 20 nt, Human
gcaauaaccucaaagugacu

SEQ ID NO: 2226429 - RNA, 20 nt, Human
gcaagugaauuuuucucuaa

SEQ ID NO: 2226430 - RNA, 17 nt, Human
gcaagugagagagaugg

SEQ ID NO: 2226431 - RNA, 22 nt, Human
gcaagugagagagaugggagcu

SEQ ID NO: 2226432 - RNA, 18 nt, Human
gcaauaaaucugacccag

SEQ ID NO: 2226433 - RNA, 16 nt, Human
gcaauaaaucugaccc

SEQ ID NO: 2226434 - RNA, 21 nt, Human
gcaauaaagcagcguuucuau

SEQ ID NO: 2226435 - RNA, 14 nt, Human
gcacaagcugcacc

SEQ ID NO: 2226436 - RNA, 23 nt, Human
gcacaagcuccaagcucccaggc

SEQ ID NO: 2226437 - RNA, 22 nt, Human
gcacaagcuccaagcucccagg

SEQ ID NO: 2226438 - RNA, 14 nt, Human
gcaccguacugugg

SEQ ID NO: 2226439 - RNA, 13 nt, Human
gcaccgccuucuc

SEQ ID NO: 2226440 - RNA, 17 nt, Human
gcaccgucauggcuuaa

SEQ ID NO: 2226441 - RNA, 18 nt, Human
gcaccggcuggccuggcc

SEQ ID NO: 2226442 - RNA, 21 nt, Human
gcaccggcuggccuggccccu

SEQ ID NO: 2226443 - RNA, 23 nt, Human
gcaccggcuggccuggccccuca

SEQ ID NO: 2226444 - RNA, 14 nt, Human
gcaccgccuucucu

SEQ ID NO: 2226445 - RNA, 19 nt, Human
gcaccggcuggccuggccc

SEQ ID NO: 2226446 - RNA, 16 nt, Human
gcacccuucuuuccuc

SEQ ID NO: 2226447 - RNA, 17 nt, Human
gcacccuucuuuccucu

SEQ ID NO: 2226448 - RNA, 17 nt, Human
gcacccuggggccugga

SEQ ID NO: 2226449 - RNA, 20 nt, Human
gcacccuggggccuggaccu

SEQ ID NO: 2226450 - RNA, 21 nt, Human
gcacccuggggccuggaccug

SEQ ID NO: 2226451 - RNA, 18 nt, Human
gcacccuucuuuccucuu

SEQ ID NO: 2226452 - RNA, 19 nt, Human
gcacccuucuuuccucuuc

SEQ ID NO: 2226453 - RNA, 21 nt, Human
gcacccuucuuuccucuuccc

SEQ ID NO: 2226454 - RNA, 16 nt, Human
gcacccuccgccuuca

SEQ ID NO: 2226455 - RNA, 19 nt, Human
gcacccucgaugaagccca

SEQ ID NO: 2226456 - RNA, 15 nt, Human
gcacccucuauccca

SEQ ID NO: 2226457 - RNA, 14 nt, Human
gcacccuggggccu

SEQ ID NO: 2226458 - RNA, 15 nt, Human
gcacccuggggccug

SEQ ID NO: 2226459 - RNA, 22 nt, Human
gcacaugcagauggggcucccg

SEQ ID NO: 2226460 - RNA, 22 nt, Human
gcacaugccucucucaggccaa

SEQ ID NO: 2226461 - RNA, 20 nt, Human
gcacaugccucucucaggcc

SEQ ID NO: 2226462 - RNA, 21 nt, Human
gcacaugccucucucaggcca

SEQ ID NO: 2226463 - RNA, 14 nt, Human
gcacaugccucucu

SEQ ID NO: 2226464 - RNA, 17 nt, Human
gcacaugccucucucag

SEQ ID NO: 2226465 - RNA, 18 nt, Human
gcacaugccucucucagg

SEQ ID NO: 2226466 - RNA, 19 nt, Human
gcacaugccucucucaggc

SEQ ID NO: 2226467 - RNA, 21 nt, Human
gcacaucugcauuuucacccc

SEQ ID NO: 2226468 - RNA, 13 nt, Human
gcacaucugcauu

SEQ ID NO: 2226469 - RNA, 14 nt, Human
gcacauauugagca

SEQ ID NO: 2226470 - RNA, 15 nt, Human
gcacaguuugaacaa

SEQ ID NO: 2226471 - RNA, 15 nt, Human
gcacaucagaaagga

SEQ ID NO: 2226472 - RNA, 21 nt, Human
gcacaucagcacgauuucugu

SEQ ID NO: 2226473 - RNA, 20 nt, Human
gcacaucagcacgauuucug

SEQ ID NO: 2226474 - RNA, 19 nt, Human
gcacaucagcacgauuucu

SEQ ID NO: 2226475 - RNA, 19 nt, Human
gcacaugacaacuuugcca

SEQ ID NO: 2226476 - RNA, 18 nt, Human
gcacaucugugucuuguu

SEQ ID NO: 2226477 - RNA, 16 nt, Human
gcacaucucugcuuga

SEQ ID NO: 2226478 - RNA, 17 nt, Human
gcacaucugugucuugu

SEQ ID NO: 2226479 - RNA, 13 nt, Human
gcacaugacucgg

SEQ ID NO: 2226480 - RNA, 13 nt, Human
gcacaugccucuc

SEQ ID NO: 2226481 - RNA, 19 nt, Human
gcacacacacacacaggag

SEQ ID NO: 2226482 - RNA, 20 nt, Human
gcacacacacacacaggagg

SEQ ID NO: 2226483 - RNA, 17 nt, Human
gcacacacacacacagg

SEQ ID NO: 2226484 - RNA, 16 nt, Human
gcacacacacacacag

SEQ ID NO: 2226485 - RNA, 14 nt, Human
gcacacacacacac

SEQ ID NO: 2226486 - RNA, 12 nt, Human
gcacacacacac

SEQ ID NO: 2226487 - RNA, 12 nt, Human
gcacacacacaa

SEQ ID NO: 2226488 - RNA, 10 nt, Human
gcacacacac

SEQ ID NO: 2226489 - RNA, 16 nt, Human
gcacaauucuguuuua

SEQ ID NO: 2226490 - RNA, 14 nt, Human
gcacaauucuguuu

SEQ ID NO: 2226491 - RNA, 22 nt, Human
gcacaaucucggcucacugcau

SEQ ID NO: 2226492 - RNA, 21 nt, Human
gcaauaagaauuuagggagaa

SEQ ID NO: 2226493 - RNA, 21 nt, Human
gcacaaucucggcucacugca

SEQ ID NO: 2226494 - RNA, 13 nt, Human
gcacauauggacu

SEQ ID NO: 2226495 - RNA, 18 nt, Human
gcacauauggacucugca

SEQ ID NO: 2226496 - RNA, 12 nt, Human
gcacaguuugaa

SEQ ID NO: 2226497 - RNA, 13 nt, Human
gcacaguuugaac

SEQ ID NO: 2226498 - RNA, 14 nt, Human
gcacaguuugaaca

SEQ ID NO: 2226499 - RNA, 18 nt, Human
gcacaguuuucugagaaa

SEQ ID NO: 2226500 - RNA, 17 nt, Human
gcacaguuuucugagaa

SEQ ID NO: 2226501 - RNA, 14 nt, Human
gcacaguuuucuga

SEQ ID NO: 2226502 - RNA, 12 nt, Human
gcagccaggcca

SEQ ID NO: 2226503 - RNA, 23 nt, Human
gcagccagaccuauuccuccugg

SEQ ID NO: 2226504 - RNA, 14 nt, Human
gcagccacuauugu

SEQ ID NO: 2226505 - RNA, 16 nt, Human
gcagagcccaagggaa

SEQ ID NO: 2226506 - RNA, 20 nt, Human
gcagagcgccgugaguucuc

SEQ ID NO: 2226507 - RNA, 22 nt, Human
gcagagcgccgugaguucucag

SEQ ID NO: 2226508 - RNA, 23 nt, Human
gcagagcgccgugaguucucagg

SEQ ID NO: 2226509 - RNA, 16 nt, Human
gcagccacauuccuga

SEQ ID NO: 2226510 - RNA, 14 nt, Human
gcagagcucugccg

SEQ ID NO: 2226511 - RNA, 13 nt, Human
gcagccaccagcg

SEQ ID NO: 2226512 - RNA, 22 nt, Human
gcagcccaugcccaccugccca

SEQ ID NO: 2226513 - RNA, 18 nt, Human
gcagcccaugcccaccug

SEQ ID NO: 2226514 - RNA, 17 nt, Human
gcagcccaugcccaccu

SEQ ID NO: 2226515 - RNA, 15 nt, Human
gcagcccaugcccac

SEQ ID NO: 2226516 - RNA, 13 nt, Human
gcagcccaugccc

SEQ ID NO: 2226517 - RNA, 17 nt, Human
gcagcccaggccggggu

SEQ ID NO: 2226518 - RNA, 20 nt, Human
gcagcccaugcccaccugcc

SEQ ID NO: 2226519 - RNA, 16 nt, Human
gcagccaggccacaag

SEQ ID NO: 2226520 - RNA, 13 nt, Human
gcagccaggccac

SEQ ID NO: 2226521 - RNA, 14 nt, Human
gcagccaggccaca

SEQ ID NO: 2226522 - RNA, 18 nt, Human
gcauaauaagcuaaagag

SEQ ID NO: 2226523 - RNA, 13 nt, Human
gcauaccuuuauu

SEQ ID NO: 2226524 - RNA, 14 nt, Human
gcauacguacacau

SEQ ID NO: 2226525 - RNA, 16 nt, Human
gcauaccuuuauugug

SEQ ID NO: 2226526 - RNA, 20 nt, Human
gcauaccuuuauugugaucu

SEQ ID NO: 2226527 - RNA, 14 nt, Human
gcauaauaagcuaa

SEQ ID NO: 2226528 - RNA, 14 nt, Human
gcaguuuuucugua

SEQ ID NO: 2226529 - RNA, 20 nt, Human
gcauaccacuuuuguucuug

SEQ ID NO: 2226530 - RNA, 17 nt, Human
gcauaccacuuuuguuc

SEQ ID NO: 2226531 - RNA, 14 nt, Human
gcaguuugggaggu

SEQ ID NO: 2226532 - RNA, 17 nt, Human
gcaguuuucaagucaaa

SEQ ID NO: 2226533 - RNA, 22 nt, Human
gcaguuuuucagaguggaaugc

SEQ ID NO: 2226534 - RNA, 22 nt, Human
gcauaacguauaaaagccuguu

SEQ ID NO: 2226535 - RNA, 21 nt, Human
gcaguuugccuggugcagugg

SEQ ID NO: 2226536 - RNA, 20 nt, Human
gcaguuucuguccugcuggu

SEQ ID NO: 2226537 - RNA, 16 nt, Human
gcaguuucuguccugc

SEQ ID NO: 2226538 - RNA, 16 nt, Human
gcaguuuaucauucaa

SEQ ID NO: 2226539 - RNA, 20 nt, Human
gcaguuuaucauucaagugu

SEQ ID NO: 2226540 - RNA, 13 nt, Human
gcagucgugccug

SEQ ID NO: 2226541 - RNA, 20 nt, Human
gcagucgucgcacagucucu

SEQ ID NO: 2226542 - RNA, 22 nt, Human
gcagucgucgcacagucucucu

SEQ ID NO: 2226543 - RNA, 15 nt, Human
gcagucgugccugug

SEQ ID NO: 2226544 - RNA, 15 nt, Human
gcaguuuaucauuca

SEQ ID NO: 2226545 - RNA, 16 nt, Human
gcagucgggggcuggc

SEQ ID NO: 2226546 - RNA, 17 nt, Human
gcagucgggggcuggcc

SEQ ID NO: 2226547 - RNA, 18 nt, Human
gcagucgggggcuggccu

SEQ ID NO: 2226548 - RNA, 20 nt, Human
gcagucgggggcuggccuag

SEQ ID NO: 2226549 - RNA, 21 nt, Human
gcagucgggggcuggccuagg

SEQ ID NO: 2226550 - RNA, 23 nt, Human
gcagucgggggcuggccuaggag

SEQ ID NO: 2226551 - RNA, 15 nt, Human
gcagucgucgcacag

SEQ ID NO: 2226552 - RNA, 18 nt, Human
gcagucgucgcacagucu

SEQ ID NO: 2226553 - RNA, 18 nt, Human
gcaguccugccucagccu

SEQ ID NO: 2226554 - RNA, 17 nt, Human
gcaguccugccucagcc

SEQ ID NO: 2226555 - RNA, 19 nt, Human
gcaguccugaucagagccg

SEQ ID NO: 2226556 - RNA, 20 nt, Human
gcaguccuggaagccagcuu

SEQ ID NO: 2226557 - RNA, 18 nt, Human
gcaguccuggaagccagc

SEQ ID NO: 2226558 - RNA, 23 nt, Human
gcagucaucuugaccaagcagga

SEQ ID NO: 2226559 - RNA, 19 nt, Human
gcagucauuauccagguaa

SEQ ID NO: 2226560 - RNA, 22 nt, Human
gcagucaucuugaccaagcagg

SEQ ID NO: 2226561 - RNA, 15 nt, Human
gcaggcugacaucug

SEQ ID NO: 2226562 - RNA, 21 nt, Human
gcagggaaaauuauuugcaua

SEQ ID NO: 2226563 - RNA, 22 nt, Human
gcagggagccgagaucacgcca

SEQ ID NO: 2226564 - RNA, 22 nt, Human
gcaggcuuuguuuauagcuugc

SEQ ID NO: 2226565 - RNA, 22 nt, Human
gcagggagaggagugacugagc

SEQ ID NO: 2226566 - RNA, 23 nt, Human
gcagggaggaagaagcuuaggca

SEQ ID NO: 2226567 - RNA, 16 nt, Human
gcagggaggaagaagc

SEQ ID NO: 2226568 - RNA, 19 nt, Human
gcagggagcggccggccag

SEQ ID NO: 2226569 - RNA, 21 nt, Human
gcagggagcauggcugugagg

SEQ ID NO: 2226570 - RNA, 13 nt, Human
gcagggaaacagc

SEQ ID NO: 2226571 - RNA, 19 nt, Human
gcagggacuugaacccaua

SEQ ID NO: 2226572 - RNA, 22 nt, Human
gcagguugaggggcuccuggaa

SEQ ID NO: 2226573 - RNA, 21 nt, Human
gcagguugaggggcuccugga

SEQ ID NO: 2226574 - RNA, 20 nt, Human
gcagguugaggggcuccugg

SEQ ID NO: 2226575 - RNA, 19 nt, Human
gcagguugaggggcuccug

SEQ ID NO: 2226576 - RNA, 23 nt, Human
gcagguugggccauacuggccuc

SEQ ID NO: 2226577 - RNA, 16 nt, Human
gcagguugaggggcuc

SEQ ID NO: 2226578 - RNA, 13 nt, Human
gcagggagggccu

SEQ ID NO: 2226579 - RNA, 10 nt, Human
gcagggaggg

SEQ ID NO: 2226580 - RNA, 20 nt, Human
gcaguagagucaucuccauc

SEQ ID NO: 2226581 - RNA, 18 nt, Human
gcaguagagucaucucca

SEQ ID NO: 2226582 - RNA, 21 nt, Human
gcaguagaggcuauggacagg

SEQ ID NO: 2226583 - RNA, 15 nt, Human
gcaguagauuuucuu

SEQ ID NO: 2226584 - RNA, 18 nt, Human
gcaguagauuuucuuuaa

SEQ ID NO: 2226585 - RNA, 20 nt, Human
gcaguagauuuucuuuaaaa

SEQ ID NO: 2226586 - RNA, 15 nt, Human
gcaguaucaugaagc

SEQ ID NO: 2226587 - RNA, 12 nt, Human
gcaguaucauga

SEQ ID NO: 2226588 - RNA, 12 nt, Human
gcaguagucucu

SEQ ID NO: 2226589 - RNA, 17 nt, Human
gcaguagucucugugcu

SEQ ID NO: 2226590 - RNA, 21 nt, Human
gcaguaucaugcccugugcaa

SEQ ID NO: 2226591 - RNA, 13 nt, Human
gcaguauugagca

SEQ ID NO: 2226592 - RNA, 15 nt, Human
gcaguaugaaaauaa

SEQ ID NO: 2226593 - RNA, 13 nt, Human
gcagucacugaau

SEQ ID NO: 2226594 - RNA, 17 nt, Human
gcagucacaucucuucc

SEQ ID NO: 2226595 - RNA, 24 nt, Human
gcagucacguggaggagcagugca

SEQ ID NO: 2226596 - RNA, 14 nt, Human
gcagucacuggagg

SEQ ID NO: 2226597 - RNA, 23 nt, Human
gcagucacuggagguugaagcca

SEQ ID NO: 2226598 - RNA, 19 nt, Human
gcaguagaaauaauaugca

SEQ ID NO: 2226599 - RNA, 20 nt, Human
gcaguagaaauaauaugcau

SEQ ID NO: 2226600 - RNA, 21 nt, Human
gcaguagaaauaauaugcauu

SEQ ID NO: 2226601 - RNA, 22 nt, Human
gcaguagaaggucggaggcuug

SEQ ID NO: 2226602 - RNA, 23 nt, Human
gcagguugggaaugaggcuugcu

SEQ ID NO: 2226603 - RNA, 22 nt, Human
gcagguugggccauacuggccu

SEQ ID NO: 2226604 - RNA, 13 nt, Human
gcaguaauaaaaa

SEQ ID NO: 2226605 - RNA, 15 nt, Human
gcaguaagucuuuuu

SEQ ID NO: 2226606 - RNA, 18 nt, Human
gcaguaagucuuuuuuga

SEQ ID NO: 2226607 - RNA, 16 nt, Human
gcaguaccuauaaagu

SEQ ID NO: 2226608 - RNA, 23 nt, Human
gcaguaccuauaaaguaaagcua

SEQ ID NO: 2226609 - RNA, 15 nt, Human
gcaggcuggcuggcc

SEQ ID NO: 2226610 - RNA, 11 nt, Human
gcaggcugaca

SEQ ID NO: 2226611 - RNA, 21 nt, Human
gcaggcuggcccugcccuggu

SEQ ID NO: 2226612 - RNA, 20 nt, Human
gcaggcuggcccugcccugg

SEQ ID NO: 2226613 - RNA, 19 nt, Human
gcaggcuggcccugcccug

SEQ ID NO: 2226614 - RNA, 17 nt, Human
gcaggcugucuggccag

SEQ ID NO: 2226615 - RNA, 18 nt, Human
gcaggcuggcccugcccu

SEQ ID NO: 2226616 - RNA, 17 nt, Human
gcaggcuggcccugccc

SEQ ID NO: 2226617 - RNA, 16 nt, Human
gcaggcuggcccugcc

SEQ ID NO: 2226618 - RNA, 15 nt, Human
gcaggcuggcccugc

SEQ ID NO: 2226619 - RNA, 14 nt, Human
gcaggcuggcccug

SEQ ID NO: 2226620 - RNA, 18 nt, Human
gcaggcucucaggccagc

SEQ ID NO: 2226621 - RNA, 23 nt, Human
gcaggcucucaggccagcugcuu

SEQ ID NO: 2226622 - RNA, 17 nt, Human
gcagcugcgguccaccc

SEQ ID NO: 2226623 - RNA, 19 nt, Human
gcagcugcgguccacccag

SEQ ID NO: 2226624 - RNA, 20 nt, Human
gcaggcucucaggccagcug

SEQ ID NO: 2226625 - RNA, 22 nt, Human
gcaggcucucaggccagcugcu

SEQ ID NO: 2226626 - RNA, 18 nt, Human
cuugaagccacugaagcu

SEQ ID NO: 2226627 - RNA, 17 nt, Human
cuugaagccacugaagc

SEQ ID NO: 2226628 - RNA, 16 nt, Human
cuugaagccacugaag

SEQ ID NO: 2226629 - RNA, 13 nt, Human
cuugaagccacug

SEQ ID NO: 2226630 - RNA, 20 nt, Human
cuugaagaucguuaguaucu

SEQ ID NO: 2226631 - RNA, 12 nt, Human
cuugaagcagua

SEQ ID NO: 2226632 - RNA, 12 nt, Human
cuugaagccaaa

SEQ ID NO: 2226633 - RNA, 13 nt, Human
cuugaagccaaag

SEQ ID NO: 2226634 - RNA, 14 nt, Human
cuugaagccaaaga

SEQ ID NO: 2226635 - RNA, 15 nt, Human
cuugaagccaaagaa

SEQ ID NO: 2226636 - RNA, 16 nt, Human
cuugaagccaaagaaa

SEQ ID NO: 2226637 - RNA, 19 nt, Human
cuugaagccaaagaaaaau

SEQ ID NO: 2226638 - RNA, 13 nt, Human
cuugaagaucguu

SEQ ID NO: 2226639 - RNA, 20 nt, Human
cuugaauuucuaaaaaacag

SEQ ID NO: 2226640 - RNA, 17 nt, Human
cuugaauuuucccacug

SEQ ID NO: 2226641 - RNA, 18 nt, Human
cuugaauuuucccacugc

SEQ ID NO: 2226642 - RNA, 19 nt, Human
cuugaauuuucccacugca

SEQ ID NO: 2226643 - RNA, 20 nt, Human
cuugaauuuucccacugcac

SEQ ID NO: 2226644 - RNA, 21 nt, Human
cuugaauuuucccacugcacc

SEQ ID NO: 2226645 - RNA, 19 nt, Human
cuugaauuguaaggaauga

SEQ ID NO: 2226646 - RNA, 21 nt, Human
cuugaagccacugaagcuggg

SEQ ID NO: 2226647 - RNA, 19 nt, Human
cuugaagccacugaagcug

SEQ ID NO: 2226648 - RNA, 13 nt, Human
cuugaagccaagu

SEQ ID NO: 2226649 - RNA, 18 nt, Human
cuugaauuguaaggaaug

SEQ ID NO: 2226650 - RNA, 14 nt, Human
cuugacagggcaca

SEQ ID NO: 2226651 - RNA, 15 nt, Human
cuugacagggcacac

SEQ ID NO: 2226652 - RNA, 13 nt, Human
cuugacagggcac

SEQ ID NO: 2226653 - RNA, 19 nt, Human
cuugacaaagucaagccac

SEQ ID NO: 2226654 - RNA, 16 nt, Human
cuugacaaagucaagc

SEQ ID NO: 2226655 - RNA, 16 nt, Human
cuugaguuugucgcuc

SEQ ID NO: 2226656 - RNA, 22 nt, Human
cuugacaaagucaagccacaug

SEQ ID NO: 2226657 - RNA, 22 nt, Human
cuugaauuuucccacugcaccc

SEQ ID NO: 2226658 - RNA, 16 nt, Human
cuugauaaagggccaa

SEQ ID NO: 2226659 - RNA, 16 nt, Human
cuugaguuuuauuuau

SEQ ID NO: 2226660 - RNA, 21 nt, Human
cuugaguuugucgcucaugug

SEQ ID NO: 2226661 - RNA, 16 nt, Human
cuugauaccccccucu

SEQ ID NO: 2226662 - RNA, 17 nt, Human
cuugauaccccccucug

SEQ ID NO: 2226663 - RNA, 18 nt, Human
cuugauaccccccucugu

SEQ ID NO: 2226664 - RNA, 19 nt, Human
cuugauaccccccucuguc

SEQ ID NO: 2226665 - RNA, 20 nt, Human
cuugauaccccccucugucu

SEQ ID NO: 2226666 - RNA, 21 nt, Human
cuugauaccccccucugucuu

SEQ ID NO: 2226667 - RNA, 22 nt, Human
cuugaucuguauauacaauaac

SEQ ID NO: 2226668 - RNA, 20 nt, Human
cuugaucuguauauacaaua

SEQ ID NO: 2226669 - RNA, 15 nt, Human
cuugaucuguauaua

SEQ ID NO: 2226670 - RNA, 22 nt, Human
cuugaucugcucagcccuggag

SEQ ID NO: 2226671 - RNA, 23 nt, Human
cuugaucugcucagcccuggagg

SEQ ID NO: 2226672 - RNA, 12 nt, Human
cuugaugaagaa

SEQ ID NO: 2226673 - RNA, 22 nt, Human
cuugauacuaaaaguucuucuc

SEQ ID NO: 2226674 - RNA, 23 nt, Human
cuugauacuaaaaguucuucucc

SEQ ID NO: 2226675 - RNA, 16 nt, Human
cuugaucugcucagcc

SEQ ID NO: 2226676 - RNA, 17 nt, Human
cuugaucugcucagccc

SEQ ID NO: 2226677 - RNA, 18 nt, Human
cuugaucugcucagcccu

SEQ ID NO: 2226678 - RNA, 19 nt, Human
cuugaucugcucagcccug

SEQ ID NO: 2226679 - RNA, 20 nt, Human
cuugaucugcucagcccugg

SEQ ID NO: 2226680 - RNA, 21 nt, Human
cuugaucugcucagcccugga

SEQ ID NO: 2226681 - RNA, 20 nt, Human
cuuggcgcugccccuggcag

SEQ ID NO: 2226682 - RNA, 19 nt, Human
cuuggcaucacagggcaga

SEQ ID NO: 2226683 - RNA, 18 nt, Human
cuuggcaucacagggcag

SEQ ID NO: 2226684 - RNA, 15 nt, Human
cuuggcagcugaacu

SEQ ID NO: 2226685 - RNA, 12 nt, Human
cuuggcgcugcc

SEQ ID NO: 2226686 - RNA, 14 nt, Human
cuuggcgcugcccc

SEQ ID NO: 2226687 - RNA, 17 nt, Human
cuuggcgcugccccugg

SEQ ID NO: 2226688 - RNA, 19 nt, Human
cuugaugccaguaggcuca

SEQ ID NO: 2226689 - RNA, 21 nt, Human
cuugaugcaugcacuguuccc

SEQ ID NO: 2226690 - RNA, 12 nt, Human
cuugaugccugg

SEQ ID NO: 2226691 - RNA, 21 nt, Human
cuugaugaccaaaguccuuuu

SEQ ID NO: 2226692 - RNA, 18 nt, Human
cuugaugaccaaaguccu

SEQ ID NO: 2226693 - RNA, 13 nt, Human
cuugaugaagaag

SEQ ID NO: 2226694 - RNA, 13 nt, Human
cuugccugcaggc

SEQ ID NO: 2226695 - RNA, 13 nt, Human
cuugaugccuggc

SEQ ID NO: 2226696 - RNA, 12 nt, Human
cuugccugcagg

SEQ ID NO: 2226697 - RNA, 22 nt, Human
cuugaugccaguaggcucaacu

SEQ ID NO: 2226698 - RNA, 20 nt, Human
cuugccuuauuagagugucu

SEQ ID NO: 2226699 - RNA, 18 nt, Human
cuugccuuauuagagugu

SEQ ID NO: 2226700 - RNA, 18 nt, Human
cuuggcagcaccugucuc

SEQ ID NO: 2226701 - RNA, 21 nt, Human
cuuggcaccagacacccagga

SEQ ID NO: 2226702 - RNA, 20 nt, Human
cuuggcaccagacacccagg

SEQ ID NO: 2226703 - RNA, 19 nt, Human
cuuggcagcccaggccggg

SEQ ID NO: 2226704 - RNA, 18 nt, Human
cuuggcagccgagcucgu

SEQ ID NO: 2226705 - RNA, 20 nt, Human
cuuggcagcaccugucuccu

SEQ ID NO: 2226706 - RNA, 19 nt, Human
cuuggcagcaccugucucc

SEQ ID NO: 2226707 - RNA, 19 nt, Human
cuugcgcuuuugcugguca

SEQ ID NO: 2226708 - RNA, 20 nt, Human
cuugcggaaucacucugucc

SEQ ID NO: 2226709 - RNA, 14 nt, Human
cuugcgcauucuca

SEQ ID NO: 2226710 - RNA, 22 nt, Human
cuugcgguauccgcccccaaua

SEQ ID NO: 2226711 - RNA, 19 nt, Human
cuuggcaccagacacccag

SEQ ID NO: 2226712 - RNA, 16 nt, Human
cuuggcaccagacacc

SEQ ID NO: 2226713 - RNA, 23 nt, Human
cuuggcacauuuaagagacaguc

SEQ ID NO: 2226714 - RNA, 20 nt, Human
cuugccuucuucacccagcu

SEQ ID NO: 2226715 - RNA, 12 nt, Human
cuugccuuucuc

SEQ ID NO: 2226716 - RNA, 19 nt, Human
cuugccuucuucacccagc

SEQ ID NO: 2226717 - RNA, 21 nt, Human
cuugccuuauuagagugucuu

SEQ ID NO: 2226718 - RNA, 20 nt, Human
cuucugccacuucccaggua

SEQ ID NO: 2226719 - RNA, 21 nt, Human
cuucuguugcugccucaugcu

SEQ ID NO: 2226720 - RNA, 23 nt, Human
cuucuucagagacuccugcaggc

SEQ ID NO: 2226721 - RNA, 14 nt, Human
cuucuucagagcug

SEQ ID NO: 2226722 - RNA, 18 nt, Human
cuucuucagaucagugcu

SEQ ID NO: 2226723 - RNA, 16 nt, Human
cuucuucagagcugac

SEQ ID NO: 2226724 - RNA, 21 nt, Human
cuucuucagccaccucucuuu

SEQ ID NO: 2226725 - RNA, 17 nt, Human
cuucuucagccaccucu

SEQ ID NO: 2226726 - RNA, 11 nt, Human
cuucugccacu

SEQ ID NO: 2226727 - RNA, 12 nt, Human
cuucugccacuu

SEQ ID NO: 2226728 - RNA, 14 nt, Human
cuucugccacuucc

SEQ ID NO: 2226729 - RNA, 16 nt, Human
cuucugccacuuccca

SEQ ID NO: 2226730 - RNA, 17 nt, Human
cuucugccacuucccag

SEQ ID NO: 2226731 - RNA, 18 nt, Human
cuucugccacuucccagg

SEQ ID NO: 2226732 - RNA, 15 nt, Human
cuucugcacccucca

SEQ ID NO: 2226733 - RNA, 16 nt, Human
cuucugcacccuccac

SEQ ID NO: 2226734 - RNA, 17 nt, Human
cuucugcacccuccacc

SEQ ID NO: 2226735 - RNA, 18 nt, Human
cuucugcacccuccaccc

SEQ ID NO: 2226736 - RNA, 19 nt, Human
cuucugcacccuccacccu

SEQ ID NO: 2226737 - RNA, 20 nt, Human
cuucugcacccuccacccug

SEQ ID NO: 2226738 - RNA, 21 nt, Human
cuucugcacccuccacccugu

SEQ ID NO: 2226739 - RNA, 22 nt, Human
cuucugcacccuccacccuguc

SEQ ID NO: 2226740 - RNA, 20 nt, Human
cuucuguugcugccucaugc

SEQ ID NO: 2226741 - RNA, 19 nt, Human
cuucuguugcugccucaug

SEQ ID NO: 2226742 - RNA, 18 nt, Human
cuucuguugcugccucau

SEQ ID NO: 2226743 - RNA, 17 nt, Human
cuucuguugcugccuca

SEQ ID NO: 2226744 - RNA, 19 nt, Human
cuucugcaauugcuuagga

SEQ ID NO: 2226745 - RNA, 12 nt, Human
cuucugcacccu

SEQ ID NO: 2226746 - RNA, 13 nt, Human
cuucugcacccuc

SEQ ID NO: 2226747 - RNA, 14 nt, Human
cuucugcacccucc

SEQ ID NO: 2226748 - RNA, 20 nt, Human
cuucugaggacauuccaaga

SEQ ID NO: 2226749 - RNA, 15 nt, Human
cuucugaggacauuc

SEQ ID NO: 2226750 - RNA, 23 nt, Human
cuucugacccaugcugcccugug

SEQ ID NO: 2226751 - RNA, 20 nt, Human
cuucugacccaugcugcccu

SEQ ID NO: 2226752 - RNA, 18 nt, Human
cuucucaagugccuuaau

SEQ ID NO: 2226753 - RNA, 14 nt, Human
cuucucaagugccu

SEQ ID NO: 2226754 - RNA, 15 nt, Human
cuucucaagugccuu

SEQ ID NO: 2226755 - RNA, 16 nt, Human
cuucucaagugccuua

SEQ ID NO: 2226756 - RNA, 17 nt, Human
cuucucaagugccuuaa

SEQ ID NO: 2226757 - RNA, 21 nt, Human
cuucugacccaugcugcccug

SEQ ID NO: 2226758 - RNA, 22 nt, Human
cuucugacccaugcugcccugu

SEQ ID NO: 2226759 - RNA, 17 nt, Human
cuucuucggggaacucc

SEQ ID NO: 2226760 - RNA, 14 nt, Human
cuucuucccucccu

SEQ ID NO: 2226761 - RNA, 15 nt, Human
cuucuuccugaagcu

SEQ ID NO: 2226762 - RNA, 20 nt, Human
cuucuucggggaacuccugg

SEQ ID NO: 2226763 - RNA, 18 nt, Human
cuucuuccaucccaggac

SEQ ID NO: 2226764 - RNA, 20 nt, Human
cuucuuccaucccaggacac

SEQ ID NO: 2226765 - RNA, 19 nt, Human
cuucuuccaggugcccagc

SEQ ID NO: 2226766 - RNA, 14 nt, Human
cuucuuccauccca

SEQ ID NO: 2226767 - RNA, 15 nt, Human
cuucuuccaucccag

SEQ ID NO: 2226768 - RNA, 13 nt, Human
cuucuaggaagcu

SEQ ID NO: 2226769 - RNA, 19 nt, Human
cuucuaggguuauugcauu

SEQ ID NO: 2226770 - RNA, 16 nt, Human
cuucuaggacgccacc

SEQ ID NO: 2226771 - RNA, 19 nt, Human
cuucuaggacgccacccag

SEQ ID NO: 2226772 - RNA, 17 nt, Human
cuucuagaaccaggcaa

SEQ ID NO: 2226773 - RNA, 13 nt, Human
cuucuauuuuauu

SEQ ID NO: 2226774 - RNA, 14 nt, Human
cuucuauuuuguaa

SEQ ID NO: 2226775 - RNA, 16 nt, Human
cuucuauuuuguaaac

SEQ ID NO: 2226776 - RNA, 15 nt, Human
cuucuauuuuguaaa

SEQ ID NO: 2226777 - RNA, 15 nt, Human
cuucucaagauacug

SEQ ID NO: 2226778 - RNA, 12 nt, Human
cuucucaagugc

SEQ ID NO: 2226779 - RNA, 22 nt, Human
cuucucaaaccuguuuaaauau

SEQ ID NO: 2226780 - RNA, 16 nt, Human
cuucucaaaccuugau

SEQ ID NO: 2226781 - RNA, 17 nt, Human
cuucuauuuuguaaacu

SEQ ID NO: 2226782 - RNA, 19 nt, Human
cuucucaaaccuguuuaaa

SEQ ID NO: 2226783 - RNA, 21 nt, Human
cuucuacuucugcccuugcca

SEQ ID NO: 2226784 - RNA, 20 nt, Human
cuucuaauauauuuuuauau

SEQ ID NO: 2226785 - RNA, 13 nt, Human
cuucuacuucugc

SEQ ID NO: 2226786 - RNA, 12 nt, Human
cuucuaauauau

SEQ ID NO: 2226787 - RNA, 14 nt, Human
cuucuaauauauuu

SEQ ID NO: 2226788 - RNA, 15 nt, Human
cuucuaauauauuuu

SEQ ID NO: 2226789 - RNA, 18 nt, Human
cuucuaauauauuuuuau

SEQ ID NO: 2226790 - RNA, 13 nt, Human
cuucuagaaccag

SEQ ID NO: 2226791 - RNA, 13 nt, Human
cuucuacuuuuaa

SEQ ID NO: 2226792 - RNA, 21 nt, Human
cuucuacuuuuaaguugcuga

SEQ ID NO: 2226793 - RNA, 17 nt, Human
cuuccugccaccugcug

SEQ ID NO: 2226794 - RNA, 11 nt, Human
cuucuaauaua

SEQ ID NO: 2226795 - RNA, 22 nt, Human
cuuccugcauucacccagacag

SEQ ID NO: 2226796 - RNA, 13 nt, Human
cuuccugccacca

SEQ ID NO: 2226797 - RNA, 21 nt, Human
cuuccugcauucacccagaca

SEQ ID NO: 2226798 - RNA, 20 nt, Human
cuuccugcauucacccagac

SEQ ID NO: 2226799 - RNA, 15 nt, Human
cuuccugccaccagu

SEQ ID NO: 2226800 - RNA, 16 nt, Human
cuuccugccaccaguc

SEQ ID NO: 2226801 - RNA, 18 nt, Human
cuuccugccaccagucac

SEQ ID NO: 2226802 - RNA, 21 nt, Human
cuuccugccaccagucacugu

SEQ ID NO: 2226803 - RNA, 17 nt, Human
cuuccugcauucaccca

SEQ ID NO: 2226804 - RNA, 13 nt, Human
cuuccugcaagga

SEQ ID NO: 2226805 - RNA, 15 nt, Human
cuuccugcaaggacu

SEQ ID NO: 2226806 - RNA, 23 nt, Human
cuucuaaguaaaaccacagcagu

SEQ ID NO: 2226807 - RNA, 22 nt, Human
cuucuaaguaaaaccacagcag

SEQ ID NO: 2226808 - RNA, 21 nt, Human
cuuccuccucccuccugccga

SEQ ID NO: 2226809 - RNA, 12 nt, Human
cuuccuccugga

SEQ ID NO: 2226810 - RNA, 14 nt, Human
cuuccuccugggcc

SEQ ID NO: 2226811 - RNA, 12 nt, Human
cuuccuccuggg

SEQ ID NO: 2226812 - RNA, 13 nt, Human
cuuccuccuggaa

SEQ ID NO: 2226813 - RNA, 14 nt, Human
cuuccuccuggaaa

SEQ ID NO: 2226814 - RNA, 14 nt, Human
cuuccugaguucag

SEQ ID NO: 2226815 - RNA, 22 nt, Human
cuuccuccugggcccucucugc

SEQ ID NO: 2226816 - RNA, 15 nt, Human
cuuccuccugggccc

SEQ ID NO: 2226817 - RNA, 17 nt, Human
cuuccugcaacaccuug

SEQ ID NO: 2226818 - RNA, 17 nt, Human
cuuccuccgaggccagu

SEQ ID NO: 2226819 - RNA, 20 nt, Human
cuuccuccgaggccaguacc

SEQ ID NO: 2226820 - RNA, 21 nt, Human
cuuccuccgaggccaguaccu

SEQ ID NO: 2226821 - RNA, 16 nt, Human
cuuccuccuccccacu

SEQ ID NO: 2226822 - RNA, 17 nt, Human
cuuccuccuccccacuu

SEQ ID NO: 2226823 - RNA, 14 nt, Human
cuuccuccucccuc

SEQ ID NO: 2226824 - RNA, 16 nt, Human
cuuccuccucccuccu

SEQ ID NO: 2226825 - RNA, 18 nt, Human
cuuccuccucccuccugc

SEQ ID NO: 2226826 - RNA, 19 nt, Human
cuuccuccucccuccugcc

SEQ ID NO: 2226827 - RNA, 21 nt, Human
cugugcugaggccuuaucauu

SEQ ID NO: 2226828 - RNA, 12 nt, Human
cugugcugaguc

SEQ ID NO: 2226829 - RNA, 20 nt, Human
cugugcuccgugccuccacc

SEQ ID NO: 2226830 - RNA, 21 nt, Human
cugugcuccgugccuccacca

SEQ ID NO: 2226831 - RNA, 22 nt, Human
cugugcuccgugccuccaccac

SEQ ID NO: 2226832 - RNA, 13 nt, Human
cugugcugacccu

SEQ ID NO: 2226833 - RNA, 14 nt, Human
cugugcugacccuc

SEQ ID NO: 2226834 - RNA, 17 nt, Human
cugugcugacccuccug

SEQ ID NO: 2226835 - RNA, 14 nt, Human
cugugcugagucug

SEQ ID NO: 2226836 - RNA, 19 nt, Human
cugugcugagucugaaggc

SEQ ID NO: 2226837 - RNA, 18 nt, Human
cugugcugacccuccugu

SEQ ID NO: 2226838 - RNA, 12 nt, Human
cugugcugaggc

SEQ ID NO: 2226839 - RNA, 13 nt, Human
cugugcugaggcc

SEQ ID NO: 2226840 - RNA, 16 nt, Human
cugugcugaggccuua

SEQ ID NO: 2226841 - RNA, 22 nt, Human
cuuaugccacgggaaguuuaga

SEQ ID NO: 2226842 - RNA, 21 nt, Human
cuuaugccauguuaauuucau

SEQ ID NO: 2226843 - RNA, 13 nt, Human
cuuauggaacacu

SEQ ID NO: 2226844 - RNA, 16 nt, Human
cuuauggaacacucug

SEQ ID NO: 2226845 - RNA, 19 nt, Human
cuucacggaagagccuugc

SEQ ID NO: 2226846 - RNA, 15 nt, Human
cuucacggaagagcc

SEQ ID NO: 2226847 - RNA, 18 nt, Human
cuucacgaaguguugcau

SEQ ID NO: 2226848 - RNA, 18 nt, Human
cuuauuguaccucucuua

SEQ ID NO: 2226849 - RNA, 22 nt, Human
cuucaccuuuguccccaccgca

SEQ ID NO: 2226850 - RNA, 13 nt, Human
cuuauuguaccuc

SEQ ID NO: 2226851 - RNA, 18 nt, Human
cuuauuggaacucugcuu

SEQ ID NO: 2226852 - RNA, 14 nt, Human
cuuauuguaccucu

SEQ ID NO: 2226853 - RNA, 15 nt, Human
cuuauuguaccucuc

SEQ ID NO: 2226854 - RNA, 18 nt, Human
cuuauuggcagcucuacu

SEQ ID NO: 2226855 - RNA, 17 nt, Human
cuuauuggaacucugcu

SEQ ID NO: 2226856 - RNA, 15 nt, Human
cuuauuggaacucug

SEQ ID NO: 2226857 - RNA, 21 nt, Human
cuucaccuuuguccccaccgc

SEQ ID NO: 2226858 - RNA, 12 nt, Human
cuuauucuguag

SEQ ID NO: 2226859 - RNA, 14 nt, Human
cuuauucuguagau

SEQ ID NO: 2226860 - RNA, 12 nt, Human
cuuauugcaaaa

SEQ ID NO: 2226861 - RNA, 17 nt, Human
cuuauuagggagaaaau

SEQ ID NO: 2226862 - RNA, 21 nt, Human
cuuauuagagugucuuuccac

SEQ ID NO: 2226863 - RNA, 20 nt, Human
cuuauuagagugucuuucca

SEQ ID NO: 2226864 - RNA, 17 nt, Human
cuuauuagagugucuuu

SEQ ID NO: 2226865 - RNA, 21 nt, Human
cuuauucaggaaaagccucug

SEQ ID NO: 2226866 - RNA, 17 nt, Human
cuuauggaacacucuga

SEQ ID NO: 2226867 - RNA, 19 nt, Human
cuuauggaacacucugaga

SEQ ID NO: 2226868 - RNA, 20 nt, Human
cuuauggaacacucugagac

SEQ ID NO: 2226869 - RNA, 21 nt, Human
cuuauggaacacucugagacu

SEQ ID NO: 2226870 - RNA, 18 nt, Human
cuucccacucuagggcag

SEQ ID NO: 2226871 - RNA, 17 nt, Human
cuucccacccaucgcug

SEQ ID NO: 2226872 - RNA, 15 nt, Human
cuucccacucacccc

SEQ ID NO: 2226873 - RNA, 21 nt, Human
cuucccacccaucgcugugug

SEQ ID NO: 2226874 - RNA, 21 nt, Human
cuucccaccucucucacuccu

SEQ ID NO: 2226875 - RNA, 23 nt, Human
cuucccaccucucucacuccuug

SEQ ID NO: 2226876 - RNA, 14 nt, Human
cuuccauagccuaa

SEQ ID NO: 2226877 - RNA, 16 nt, Human
cuuccauacagcucua

SEQ ID NO: 2226878 - RNA, 14 nt, Human
cuuccauaauuaug

SEQ ID NO: 2226879 - RNA, 14 nt, Human
cuuccauacagcuc

SEQ ID NO: 2226880 - RNA, 22 nt, Human
cuuccauagccuaaucccuggg

SEQ ID NO: 2226881 - RNA, 16 nt, Human
cuuccauaugaccuca

SEQ ID NO: 2226882 - RNA, 14 nt, Human
cuuccauaugaccu

SEQ ID NO: 2226883 - RNA, 11 nt, Human
cuucccaccuc

SEQ ID NO: 2226884 - RNA, 11 nt, Human
cuuccauaauu

SEQ ID NO: 2226885 - RNA, 23 nt, Human
cuuccauaauguauaaagaacaa

SEQ ID NO: 2226886 - RNA, 18 nt, Human
cuuccauaaugcuacugu

SEQ ID NO: 2226887 - RNA, 22 nt, Human
cuuccauaaugcuacugucuca

SEQ ID NO: 2226888 - RNA, 11 nt, Human
cuuccauaaug

SEQ ID NO: 2226889 - RNA, 11 nt, Human
cuuccauaauc

SEQ ID NO: 2226890 - RNA, 21 nt, Human
cuuccauaaucuggacuccuc

SEQ ID NO: 2226891 - RNA, 22 nt, Human
cuucaugcaaugacaucuucaa

SEQ ID NO: 2226892 - RNA, 21 nt, Human
cuuccagugaggcucugcccu

SEQ ID NO: 2226893 - RNA, 13 nt, Human
cuucaugcaauga

SEQ ID NO: 2226894 - RNA, 12 nt, Human
cuucaugcaaug

SEQ ID NO: 2226895 - RNA, 12 nt, Human
cuucaugacauu

SEQ ID NO: 2226896 - RNA, 17 nt, Human
cuucaucuucucagcuc

SEQ ID NO: 2226897 - RNA, 15 nt, Human
cuucaucuucucagc

SEQ ID NO: 2226898 - RNA, 16 nt, Human
cuucaucuucucagcu

SEQ ID NO: 2226899 - RNA, 20 nt, Human
cuucaucuucucagcuccca

SEQ ID NO: 2226900 - RNA, 17 nt, Human
cuucaugcaaugacauc

SEQ ID NO: 2226901 - RNA, 18 nt, Human
cuuccaguguccuuagaa

SEQ ID NO: 2226902 - RNA, 15 nt, Human
cuucaugcauggaaa

SEQ ID NO: 2226903 - RNA, 13 nt, Human
cuucaugcaugga

SEQ ID NO: 2226904 - RNA, 19 nt, Human
cuuccaguguccuuagaac

SEQ ID NO: 2226905 - RNA, 23 nt, Human
cuuccagugguuugagacacugg

SEQ ID NO: 2226906 - RNA, 22 nt, Human
cuuccagugaggcucugcccuu

SEQ ID NO: 2226907 - RNA, 23 nt, Human
cuuccagugaggcucugcccuug

SEQ ID NO: 2226908 - RNA, 18 nt, Human
cuucauagcagauuuuaa

SEQ ID NO: 2226909 - RNA, 21 nt, Human
cuucauacuuuuuuucacagu

SEQ ID NO: 2226910 - RNA, 22 nt, Human
cuucauacagggaugguguuca

SEQ ID NO: 2226911 - RNA, 20 nt, Human
cuucauaccuacauguauuu

SEQ ID NO: 2226912 - RNA, 12 nt, Human
cuucauaaucca

SEQ ID NO: 2226913 - RNA, 13 nt, Human
cuucauacaggga

SEQ ID NO: 2226914 - RNA, 12 nt, Human
cuucauacaggg

SEQ ID NO: 2226915 - RNA, 23 nt, Human
cuucaucuggcaacaucuuuauc

SEQ ID NO: 2226916 - RNA, 12 nt, Human
cuucaucuucuc

SEQ ID NO: 2226917 - RNA, 13 nt, Human
cuucaucuggcaa

SEQ ID NO: 2226918 - RNA, 19 nt, Human
cuucaucuggcaacaucuu

SEQ ID NO: 2226919 - RNA, 14 nt, Human
cuucaucuggcaac

SEQ ID NO: 2226920 - RNA, 15 nt, Human
cuucauauugcugag

SEQ ID NO: 2226921 - RNA, 11 nt, Human
cuucaucugga

SEQ ID NO: 2226922 - RNA, 15 nt, Human
cuucaucuggaacca

SEQ ID NO: 2226923 - RNA, 13 nt, Human
cuucaucuggaac

SEQ ID NO: 2226924 - RNA, 12 nt, Human
cuucaucuggaa

SEQ ID NO: 2226925 - RNA, 17 nt, Human
cuucacuguccuccaag

SEQ ID NO: 2226926 - RNA, 17 nt, Human
cuucacuguauaaauag

SEQ ID NO: 2226927 - RNA, 23 nt, Human
cuucacuguauaaauaggagagg

SEQ ID NO: 2226928 - RNA, 20 nt, Human
cuucagagacuccugcaggc

SEQ ID NO: 2226929 - RNA, 18 nt, Human
cuucagagacuccugcag

SEQ ID NO: 2226930 - RNA, 19 nt, Human
cuucagagacuccugcagg

SEQ ID NO: 2226931 - RNA, 14 nt, Human
cuucauaaaugaag

SEQ ID NO: 2226932 - RNA, 15 nt, Human
cuucauaacaauuuu

SEQ ID NO: 2226933 - RNA, 19 nt, Human
cuucauaacaauuuuagga

SEQ ID NO: 2226934 - RNA, 10 nt, Human
cuucauacac

SEQ ID NO: 2226935 - RNA, 9 nt, Human
cuucauaca

SEQ ID NO: 2226936 - RNA, 14 nt, Human
cuucaguuguuuuc

SEQ ID NO: 2226937 - RNA, 17 nt, Human
cuucaguuguuuucccg

SEQ ID NO: 2226938 - RNA, 17 nt, Human
cuucaguuuccuggucu

SEQ ID NO: 2226939 - RNA, 17 nt, Human
cuucacggcaggacaac

SEQ ID NO: 2226940 - RNA, 16 nt, Human
cuucacggcaggacaa

SEQ ID NO: 2226941 - RNA, 20 nt, Human
cuucacuccagccuggguga

SEQ ID NO: 2226942 - RNA, 13 nt, Human
cuucacggcagga

SEQ ID NO: 2226943 - RNA, 19 nt, Human
cuucacgaaguguugcaug

SEQ ID NO: 2226944 - RNA, 20 nt, Human
cuucacgaaguguugcaugg

SEQ ID NO: 2226945 - RNA, 17 nt, Human
cuucacucgcccccggg

SEQ ID NO: 2226946 - RNA, 15 nt, Human
cuucacucucugaag

SEQ ID NO: 2226947 - RNA, 24 nt, Human
cuucacuccggugugccugcagcc

SEQ ID NO: 2226948 - RNA, 23 nt, Human
cuucacuccggugugccugcagc

SEQ ID NO: 2226949 - RNA, 22 nt, Human
cuucacuccggugugccugcag

SEQ ID NO: 2226950 - RNA, 19 nt, Human
cuucacuccggugugccug

SEQ ID NO: 2226951 - RNA, 14 nt, Human
cuucacuccggugu

SEQ ID NO: 2226952 - RNA, 15 nt, Human
cuucacuguaaaaua

SEQ ID NO: 2226953 - RNA, 17 nt, Human
cuucagagacuccugca

SEQ ID NO: 2226954 - RNA, 13 nt, Human
cuucacugccuuu

SEQ ID NO: 2226955 - RNA, 14 nt, Human
cuucacugccuuug

SEQ ID NO: 2226956 - RNA, 15 nt, Human
cuucacugccuuugc

SEQ ID NO: 2226957 - RNA, 17 nt, Human
cuucacugccuuugcuc

SEQ ID NO: 2226958 - RNA, 19 nt, Human
cuucacugccuuugcuccu

SEQ ID NO: 2226959 - RNA, 13 nt, Human
cuucacuguauaa

SEQ ID NO: 2226960 - RNA, 16 nt, Human
cuucacuguauaaaua

SEQ ID NO: 2226961 - RNA, 22 nt, Human
gaaacuuuauucaaguaaaaau

SEQ ID NO: 2226962 - RNA, 17 nt, Human
gaaaggcucugaaagcc

SEQ ID NO: 2226963 - RNA, 15 nt, Human
gaaaggcucugaaag

SEQ ID NO: 2226964 - RNA, 19 nt, Human
gaaaggcucugaaagccag

SEQ ID NO: 2226965 - RNA, 20 nt, Human
gaaaggcuccaggagcagcc

SEQ ID NO: 2226966 - RNA, 22 nt, Human
gaaaggcuccaggagcagccac

SEQ ID NO: 2226967 - RNA, 21 nt, Human
gaaaggcuccaggagcagcca

SEQ ID NO: 2226968 - RNA, 17 nt, Human
gaaagacuauucaaaca

SEQ ID NO: 2226969 - RNA, 20 nt, Human
gaaagacuaucuaaauguug

SEQ ID NO: 2226970 - RNA, 21 nt, Human
gaaagaaaauaccaaggaaca

SEQ ID NO: 2226971 - RNA, 15 nt, Human
gaaagacuauucaaa

SEQ ID NO: 2226972 - RNA, 14 nt, Human
gaaagacuauucaa

SEQ ID NO: 2226973 - RNA, 18 nt, Human
gaaagguuacccuguaac

SEQ ID NO: 2226974 - RNA, 18 nt, Human
gaaaucaaauaugcaaag

SEQ ID NO: 2226975 - RNA, 18 nt, Human
gaaauauuuauuuuaaua

SEQ ID NO: 2226976 - RNA, 22 nt, Human
gaaauauuuauuuuaauaaugu

SEQ ID NO: 2226977 - RNA, 20 nt, Human
gaaaucaguaauauuuauau

SEQ ID NO: 2226978 - RNA, 18 nt, Human
gaaaucaguaauauuuau

SEQ ID NO: 2226979 - RNA, 13 nt, Human
gaaagguucugcc

SEQ ID NO: 2226980 - RNA, 19 nt, Human
gaaaucaccgaaaacgugg

SEQ ID NO: 2226981 - RNA, 20 nt, Human
gaaaucaaauaugcaaagca

SEQ ID NO: 2226982 - RNA, 19 nt, Human
gaaaucaaauaugcaaagc

SEQ ID NO: 2226983 - RNA, 19 nt, Human
gaaagggacuuggaagcuc

SEQ ID NO: 2226984 - RNA, 20 nt, Human
gaaagggacgcuacccggga

SEQ ID NO: 2226985 - RNA, 22 nt, Human
gaaagggagcuaucaggaacag

SEQ ID NO: 2226986 - RNA, 17 nt, Human
gaaaggggggagcuggg

SEQ ID NO: 2226987 - RNA, 22 nt, Human
gaaagggacuuggaagcuccgc

SEQ ID NO: 2226988 - RNA, 16 nt, Human
gaaagggugcugcuuc

SEQ ID NO: 2226989 - RNA, 15 nt, Human
gaaaggggugcuuuu

SEQ ID NO: 2226990 - RNA, 19 nt, Human
gaaagggugcugcuucccu

SEQ ID NO: 2226991 - RNA, 23 nt, Human
gaaaggguguuuuucuguuuuau

SEQ ID NO: 2226992 - RNA, 17 nt, Human
gaaaggggucggcugac

SEQ ID NO: 2226993 - RNA, 23 nt, Human
gaaagggggucccagugggaggg

SEQ ID NO: 2226994 - RNA, 14 nt, Human
gaaaggggugcuuu

SEQ ID NO: 2226995 - RNA, 16 nt, Human
gaaagggggucccagu

SEQ ID NO: 2226996 - RNA, 17 nt, Human
gaaagggggucccagug

SEQ ID NO: 2226997 - RNA, 18 nt, Human
gaaagggggucccagugg

SEQ ID NO: 2226998 - RNA, 22 nt, Human
gaaagggggucccagugggagg

SEQ ID NO: 2226999 - RNA, 22 nt, Human
gaaaggugaguuugagcugccu

SEQ ID NO: 2227000 - RNA, 23 nt, Human
gaaaggugaguuugagcugccuu

SEQ ID NO: 2227001 - RNA, 17 nt, Human
gaaauauuuauuuuaau

SEQ ID NO: 2227002 - RNA, 18 nt, Human
gaaaaugguccaggagaa

SEQ ID NO: 2227003 - RNA, 14 nt, Human
gaaaaugguauuuu

SEQ ID NO: 2227004 - RNA, 12 nt, Human
gaaaauguacug

SEQ ID NO: 2227005 - RNA, 18 nt, Human
gaaaauguaagcuguuua

SEQ ID NO: 2227006 - RNA, 19 nt, Human
gaaaauguacugagauuuu

SEQ ID NO: 2227007 - RNA, 17 nt, Human
gaaaauguaagcuguuu

SEQ ID NO: 2227008 - RNA, 19 nt, Human
gaaaauggacguguuauga

SEQ ID NO: 2227009 - RNA, 23 nt, Human
gaaaauggacguguuaugacucc

SEQ ID NO: 2227010 - RNA, 13 nt, Human
gaaaauucacuau

SEQ ID NO: 2227011 - RNA, 22 nt, Human
gaaaaugucagaaaccaguuau

SEQ ID NO: 2227012 - RNA, 21 nt, Human
gaaaaugucagaaaccaguua

SEQ ID NO: 2227013 - RNA, 18 nt, Human
gaaaauucacuauuggcu

SEQ ID NO: 2227014 - RNA, 15 nt, Human
gaaaauguaugugua

SEQ ID NO: 2227015 - RNA, 21 nt, Human
gaaaauuccuauugauuuucu

SEQ ID NO: 2227016 - RNA, 23 nt, Human
gaaaaugcuguauuagucacaga

SEQ ID NO: 2227017 - RNA, 21 nt, Human
gaaaauggaagacagcucuua

SEQ ID NO: 2227018 - RNA, 18 nt, Human
gaaaagaaaaaugagccu

SEQ ID NO: 2227019 - RNA, 20 nt, Human
gaaaagaaaaaaaaagaaaa

SEQ ID NO: 2227020 - RNA, 19 nt, Human
gaaaagaaaaaaaaagaaa

SEQ ID NO: 2227021 - RNA, 23 nt, Human
gaaaaugcagcagggaugcccug

SEQ ID NO: 2227022 - RNA, 21 nt, Human
gaaaaugcauuguaucgaugu

SEQ ID NO: 2227023 - RNA, 20 nt, Human
gaaaaacuuccaugaggcca

SEQ ID NO: 2227024 - RNA, 23 nt, Human
gaaaaacucugggaaauaagaga

SEQ ID NO: 2227025 - RNA, 14 nt, Human
gaaaaacugauuuu

SEQ ID NO: 2227026 - RNA, 17 nt, Human
gaaaagaaaaaaaaaga

SEQ ID NO: 2227027 - RNA, 12 nt, Human
gaaaagaaaaaa

SEQ ID NO: 2227028 - RNA, 11 nt, Human
gaaaagaaaaa

SEQ ID NO: 2227029 - RNA, 10 nt, Human
gaaaagaaaa

SEQ ID NO: 2227030 - RNA, 9 nt, Human
gaaaagaaa

SEQ ID NO: 2227031 - RNA, 16 nt, Human
gaaaacuuuucucaga

SEQ ID NO: 2227032 - RNA, 17 nt, Human
gaaaacuuuucucagau

SEQ ID NO: 2227033 - RNA, 15 nt, Human
gaaaacuuuucucag

SEQ ID NO: 2227034 - RNA, 16 nt, Human
gaaaauugcugugccu

SEQ ID NO: 2227035 - RNA, 22 nt, Human
gaaaauugcugugccucccaaa

SEQ ID NO: 2227036 - RNA, 15 nt, Human
gaaaauugcugugcc

SEQ ID NO: 2227037 - RNA, 21 nt, Human
gaaaauuuguuauuuugcaac

SEQ ID NO: 2227038 - RNA, 17 nt, Human
gaaaauuuguuauuuug

SEQ ID NO: 2227039 - RNA, 12 nt, Human
cuuuuguaauuu

SEQ ID NO: 2227040 - RNA, 20 nt, Human
cuuuuguaagacaaagguuu

SEQ ID NO: 2227041 - RNA, 13 nt, Human
cuuuuguaagaca

SEQ ID NO: 2227042 - RNA, 10 nt, Human
cuuuuguaag

SEQ ID NO: 2227043 - RNA, 18 nt, Human
cuuuugucuaugggacuc

SEQ ID NO: 2227044 - RNA, 14 nt, Human
cuuuugugaacuuu

SEQ ID NO: 2227045 - RNA, 13 nt, Human
cuuuuggcccccg

SEQ ID NO: 2227046 - RNA, 15 nt, Human
cuuuuggcacugaga

SEQ ID NO: 2227047 - RNA, 14 nt, Human
cuuuuggcuuccau

SEQ ID NO: 2227048 - RNA, 15 nt, Human
cuuuuggcauuuuac

SEQ ID NO: 2227049 - RNA, 13 nt, Human
cuuuuguaaaugu

SEQ ID NO: 2227050 - RNA, 13 nt, Human
cuuuugguuaagu

SEQ ID NO: 2227051 - RNA, 20 nt, Human
cuuuuggcccccgagcuggg

SEQ ID NO: 2227052 - RNA, 15 nt, Human
cuuuuggcuuccaug

SEQ ID NO: 2227053 - RNA, 20 nt, Human
cuuuugguuaagucuguuuu

SEQ ID NO: 2227054 - RNA, 16 nt, Human
cuuuugguuaagucug

SEQ ID NO: 2227055 - RNA, 15 nt, Human
cuuuugcaucauugu

SEQ ID NO: 2227056 - RNA, 13 nt, Human
cuuuugccauuga

SEQ ID NO: 2227057 - RNA, 13 nt, Human
cuuuuggagucag

SEQ ID NO: 2227058 - RNA, 16 nt, Human
cuuuugccguuauuaa

SEQ ID NO: 2227059 - RNA, 21 nt, Human
cuuuugcccuucacaguguuu

SEQ ID NO: 2227060 - RNA, 15 nt, Human
cuuuugcccuuugau

SEQ ID NO: 2227061 - RNA, 20 nt, Human
cuuuugcccuucacaguguu

SEQ ID NO: 2227062 - RNA, 17 nt, Human
cuuuugccauuaaacuu

SEQ ID NO: 2227063 - RNA, 23 nt, Human
cuuuugcccacacuugggagcaa

SEQ ID NO: 2227064 - RNA, 20 nt, Human
cuuuuuuggggauaugcuua

SEQ ID NO: 2227065 - RNA, 13 nt, Human
cuuuuuuguuuug

SEQ ID NO: 2227066 - RNA, 23 nt, Human
cuuuuuuggcugcugaaggcucg

SEQ ID NO: 2227067 - RNA, 13 nt, Human
cuuuugugcauua

SEQ ID NO: 2227068 - RNA, 12 nt, Human
cuuuugugcauu

SEQ ID NO: 2227069 - RNA, 23 nt, Human
cuuuuuuggcuuuagacacuggc

SEQ ID NO: 2227070 - RNA, 19 nt, Human
cuuuuuuuccaucuuuaca

SEQ ID NO: 2227071 - RNA, 18 nt, Human
cuuuuuuuuucucuuucu

SEQ ID NO: 2227072 - RNA, 22 nt, Human
cuuuuuuuuucucuuucucucc

SEQ ID NO: 2227073 - RNA, 16 nt, Human
cuuuuuuuuuccaaaa

SEQ ID NO: 2227074 - RNA, 15 nt, Human
cuuuuuuuuucucuu

SEQ ID NO: 2227075 - RNA, 17 nt, Human
cuuuuuuuuucucuuuc

SEQ ID NO: 2227076 - RNA, 20 nt, Human
cuuuuuuuuuuuugagacag

SEQ ID NO: 2227077 - RNA, 18 nt, Human
gaaaaacguguugccuug

SEQ ID NO: 2227078 - RNA, 18 nt, Human
gaaaaacaucugaaagcc

SEQ ID NO: 2227079 - RNA, 11 nt, Human
gaaaaacaggu

SEQ ID NO: 2227080 - RNA, 14 nt, Human
gaaaaacacaagca

SEQ ID NO: 2227081 - RNA, 19 nt, Human
gaaaaacaaauucaucaaa

SEQ ID NO: 2227082 - RNA, 15 nt, Human
gaaaaacacaagcaa

SEQ ID NO: 2227083 - RNA, 17 nt, Human
gaaaaacacaagcaaaa

SEQ ID NO: 2227084 - RNA, 19 nt, Human
gaaaaaaaucguccaggga

SEQ ID NO: 2227085 - RNA, 18 nt, Human
gaaaaaaaguuugccaga

SEQ ID NO: 2227086 - RNA, 13 nt, Human
gaaaaaaaugacu

SEQ ID NO: 2227087 - RNA, 20 nt, Human
gaaaaaaaguuugccagaag

SEQ ID NO: 2227088 - RNA, 20 nt, Human
gaaaaaaaauguucuuuggg

SEQ ID NO: 2227089 - RNA, 22 nt, Human
cuuuuuuuuuuuuuaaagacag

SEQ ID NO: 2227090 - RNA, 21 nt, Human
cuuuuuuuuuuuugagacaga

SEQ ID NO: 2227091 - RNA, 23 nt, Human
cuuuuuuuuuuuuuaaagacaga

SEQ ID NO: 2227092 - RNA, 21 nt, Human
gaaaaaaaaagucagacugcu

SEQ ID NO: 2227093 - RNA, 22 nt, Human
gaaaaaaaaguuucagagaagu

SEQ ID NO: 2227094 - RNA, 19 nt, Human
gaaaaaaaaguuucagaga

SEQ ID NO: 2227095 - RNA, 15 nt, Human
gaaaaaaaagaaagc

SEQ ID NO: 2227096 - RNA, 20 nt, Human
cuuuccuguagccuucugua

SEQ ID NO: 2227097 - RNA, 11 nt, Human
cuuuccugccu

SEQ ID NO: 2227098 - RNA, 20 nt, Human
cuuuccuggacacucagacc

SEQ ID NO: 2227099 - RNA, 23 nt, Human
cuuuccuggacacucagaccuga

SEQ ID NO: 2227100 - RNA, 13 nt, Human
cuuuccugcccca

SEQ ID NO: 2227101 - RNA, 14 nt, Human
cuuuccugccccag

SEQ ID NO: 2227102 - RNA, 18 nt, Human
cuuuccugccccaggccu

SEQ ID NO: 2227103 - RNA, 19 nt, Human
cuuuccugccccaggccug

SEQ ID NO: 2227104 - RNA, 16 nt, Human
cuuuccuuccuucccu

SEQ ID NO: 2227105 - RNA, 13 nt, Human
cuuuccuucuugc

SEQ ID NO: 2227106 - RNA, 15 nt, Human
cuuuccuuccuuccc

SEQ ID NO: 2227107 - RNA, 11 nt, Human
cuuuccuuccu

SEQ ID NO: 2227108 - RNA, 15 nt, Human
cuuuccuuccauccc

SEQ ID NO: 2227109 - RNA, 22 nt, Human
cuuuccugaggcugggcucccu

SEQ ID NO: 2227110 - RNA, 19 nt, Human
cuuuccugauggcaggaug

SEQ ID NO: 2227111 - RNA, 21 nt, Human
cuuuccugcaacucaaggacu

SEQ ID NO: 2227112 - RNA, 22 nt, Human
cuuuccugaugguacaggaaag

SEQ ID NO: 2227113 - RNA, 10 nt, Human
cuuuccugcc

SEQ ID NO: 2227114 - RNA, 12 nt, Human
cuuuccugcccc

SEQ ID NO: 2227115 - RNA, 17 nt, Human
cuuucacaaaauuuuau

SEQ ID NO: 2227116 - RNA, 14 nt, Human
cuuucacaaccuuc

SEQ ID NO: 2227117 - RNA, 21 nt, Human
cuuucaauuccguagccagcu

SEQ ID NO: 2227118 - RNA, 21 nt, Human
cuuucaaugguuugcaaggaa

SEQ ID NO: 2227119 - RNA, 22 nt, Human
cuuucaaugguuugcaaggaag

SEQ ID NO: 2227120 - RNA, 20 nt, Human
cuuucaaugguuugcaagga

SEQ ID NO: 2227121 - RNA, 23 nt, Human
cuuucaauaggaaaaacugauuu

SEQ ID NO: 2227122 - RNA, 20 nt, Human
cuuucagggaauuucaggaa

SEQ ID NO: 2227123 - RNA, 14 nt, Human
cuuucagcugugaa

SEQ ID NO: 2227124 - RNA, 13 nt, Human
cuuucagcuguga

SEQ ID NO: 2227125 - RNA, 20 nt, Human
cuuucacaaaauuuuauucc

SEQ ID NO: 2227126 - RNA, 23 nt, Human
cuuucagccaagaauucuuaaau

SEQ ID NO: 2227127 - RNA, 20 nt, Human
cuuucagccaagaauucuua

SEQ ID NO: 2227128 - RNA, 21 nt, Human
cuuugaugauuaauucaccuu

SEQ ID NO: 2227129 - RNA, 15 nt, Human
cuuugaucagguggg

SEQ ID NO: 2227130 - RNA, 22 nt, Human
cuuugauauuuucaacgcagcc

SEQ ID NO: 2227131 - RNA, 22 nt, Human
cuuugauaauguuaaauuugua

SEQ ID NO: 2227132 - RNA, 21 nt, Human
cuuugauaauguuaaauuugu

SEQ ID NO: 2227133 - RNA, 20 nt, Human
cuuuccuuuccccagcccag

SEQ ID NO: 2227134 - RNA, 16 nt, Human
cuuucuagccagagga

SEQ ID NO: 2227135 - RNA, 17 nt, Human
cuuucuacccagcgagc

SEQ ID NO: 2227136 - RNA, 17 nt, Human
cuuuccuuggcucccau

SEQ ID NO: 2227137 - RNA, 22 nt, Human
cuuuccuuggcucccauucacu

SEQ ID NO: 2227138 - RNA, 15 nt, Human
cuuuccuugcucaac

SEQ ID NO: 2227139 - RNA, 14 nt, Human
cuuuccuucuugcc

SEQ ID NO: 2227140 - RNA, 16 nt, Human
cuuuccuuggcuccca

SEQ ID NO: 2227141 - RNA, 17 nt, Human
cuuuccuuuccccagcc

SEQ ID NO: 2227142 - RNA, 19 nt, Human
cuuuccuuguuccccauca

SEQ ID NO: 2227143 - RNA, 16 nt, Human
cuuuccuuuccccagc

SEQ ID NO: 2227144 - RNA, 15 nt, Human
cuuucuagccagagg

SEQ ID NO: 2227145 - RNA, 21 nt, Human
cuuuguaagaguguagaagca

SEQ ID NO: 2227146 - RNA, 22 nt, Human
cuuuguaagaguguagaagcau

SEQ ID NO: 2227147 - RNA, 17 nt, Human
cuuuguaagaguguaga

SEQ ID NO: 2227148 - RNA, 18 nt, Human
cuuuguaagaguguagaa

SEQ ID NO: 2227149 - RNA, 19 nt, Human
cuuuguaagaguguagaag

SEQ ID NO: 2227150 - RNA, 20 nt, Human
cuuuguaagaguguagaagc

SEQ ID NO: 2227151 - RNA, 17 nt, Human
cuuugauguuaacacau

SEQ ID NO: 2227152 - RNA, 15 nt, Human
cuuugauguuaacac

SEQ ID NO: 2227153 - RNA, 23 nt, Human
cuuugguuuuuuucuucuguauu

SEQ ID NO: 2227154 - RNA, 15 nt, Human
cuuuguaaauuguca

SEQ ID NO: 2227155 - RNA, 14 nt, Human
cuuugggcugcccu

SEQ ID NO: 2227156 - RNA, 18 nt, Human
cuuugauguuaacacauu

SEQ ID NO: 2227157 - RNA, 18 nt, Human
cuuugaugucauauggaa

SEQ ID NO: 2227158 - RNA, 15 nt, Human
cuuugggcugcccug

SEQ ID NO: 2227159 - RNA, 19 nt, Human
cuuugggcugcccuggugc

SEQ ID NO: 2227160 - RNA, 20 nt, Human
cuuugggcugcccuggugcu

SEQ ID NO: 2227161 - RNA, 21 nt, Human
cuuugggcugcccuggugcug

SEQ ID NO: 2227162 - RNA, 14 nt, Human
cuuuguacuuugug

SEQ ID NO: 2227163 - RNA, 21 nt, Human
cuuuguaaucguuaugugugu

SEQ ID NO: 2227164 - RNA, 23 nt, Human
cuuuguaagaguguagaagcauu

SEQ ID NO: 2227165 - RNA, 19 nt, Human
cuuuguaaucguuaugugu

SEQ ID NO: 2227166 - RNA, 12 nt, Human
cuuuguaccccc

SEQ ID NO: 2227167 - RNA, 14 nt, Human
cuuuguacccccca

SEQ ID NO: 2227168 - RNA, 19 nt, Human
cuuuguaccccccaacccc

SEQ ID NO: 2227169 - RNA, 21 nt, Human
cuuuguaccccccaaccccug

SEQ ID NO: 2227170 - RNA, 12 nt, Human
cuuuguauauua

SEQ ID NO: 2227171 - RNA, 14 nt, Human
cuuuuauaaaccuc

SEQ ID NO: 2227172 - RNA, 16 nt, Human
cuuuuauaaaccucua

SEQ ID NO: 2227173 - RNA, 14 nt, Human
cuuuuauaaacuuu

SEQ ID NO: 2227174 - RNA, 13 nt, Human
cuuuuauaaacuu

SEQ ID NO: 2227175 - RNA, 10 nt, Human
cuuuguauau

SEQ ID NO: 2227176 - RNA, 18 nt, Human
cuuuuaguuguaucucuu

SEQ ID NO: 2227177 - RNA, 15 nt, Human
cuuuguauauuauuu

SEQ ID NO: 2227178 - RNA, 21 nt, Human
cuuuuaguuguaucucuuuug

SEQ ID NO: 2227179 - RNA, 20 nt, Human
cuuuuaguuguaucucuuuu

SEQ ID NO: 2227180 - RNA, 19 nt, Human
cuuuuaguuguaucucuuu

SEQ ID NO: 2227181 - RNA, 22 nt, Human
cuuuuaguuuuaguugcagaaa

SEQ ID NO: 2227182 - RNA, 21 nt, Human
cuuuuaguuuuaguugcagaa

SEQ ID NO: 2227183 - RNA, 17 nt, Human
cuuuuauccacuuaccu

SEQ ID NO: 2227184 - RNA, 19 nt, Human
cuuuuaucacgauauuauu

SEQ ID NO: 2227185 - RNA, 13 nt, Human
cuuuuaucaaaca

SEQ ID NO: 2227186 - RNA, 20 nt, Human
cuuuuauacucuuucuguau

SEQ ID NO: 2227187 - RNA, 19 nt, Human
cuuuuauacucuuucugua

SEQ ID NO: 2227188 - RNA, 17 nt, Human
cuuuuauacucuuucug

SEQ ID NO: 2227189 - RNA, 12 nt, Human
cuuuuauacucu

SEQ ID NO: 2227190 - RNA, 16 nt, Human
cuuuuauagaugguca

SEQ ID NO: 2227191 - RNA, 22 nt, Human
cuuuuauaaaccucuaauuuau

SEQ ID NO: 2227192 - RNA, 12 nt, Human
cuuuuauagcua

SEQ ID NO: 2227193 - RNA, 14 nt, Human
cuuuuauagcuauu

SEQ ID NO: 2227194 - RNA, 17 nt, Human
cuuuuauagcuauuacu

SEQ ID NO: 2227195 - RNA, 18 nt, Human
cuuuuauagcuauuacug

SEQ ID NO: 2227196 - RNA, 19 nt, Human
cuuuuauagcuauuacugu

SEQ ID NO: 2227197 - RNA, 17 nt, Human
cuuuuaugauguauauu

SEQ ID NO: 2227198 - RNA, 18 nt, Human
cuuuuaugauguauauuu

SEQ ID NO: 2227199 - RNA, 23 nt, Human
cuuuuauguaguaauugacaugu

SEQ ID NO: 2227200 - RNA, 22 nt, Human
cuuuuauguaguaauugacaug

SEQ ID NO: 2227201 - RNA, 18 nt, Human
cuuuuauguaguaauuga

SEQ ID NO: 2227202 - RNA, 15 nt, Human
cuuuuauguaguaau

SEQ ID NO: 2227203 - RNA, 14 nt, Human
cuuuuaugugaaac

SEQ ID NO: 2227204 - RNA, 17 nt, Human
cugggcagaaggaagac

SEQ ID NO: 2227205 - RNA, 12 nt, Human
cugggcagcugu

SEQ ID NO: 2227206 - RNA, 17 nt, Human
cuggggaaauaacagcu

SEQ ID NO: 2227207 - RNA, 15 nt, Human
cuggggaaccugacc

SEQ ID NO: 2227208 - RNA, 17 nt, Human
cuggggaaccugacccc

SEQ ID NO: 2227209 - RNA, 16 nt, Human
cuggggaaccugaccc

SEQ ID NO: 2227210 - RNA, 13 nt, Human
cugggcagaaggc

SEQ ID NO: 2227211 - RNA, 16 nt, Human
cugggcagaaggaaga

SEQ ID NO: 2227212 - RNA, 18 nt, Human
cugggcagaaggaagacu

SEQ ID NO: 2227213 - RNA, 14 nt, Human
cugggcagaaggcc

SEQ ID NO: 2227214 - RNA, 16 nt, Human
cugggcagaaggccaa

SEQ ID NO: 2227215 - RNA, 17 nt, Human
cugggcagaaggccaag

SEQ ID NO: 2227216 - RNA, 13 nt, Human
cugggcagaccuu

SEQ ID NO: 2227217 - RNA, 15 nt, Human
cuggggaugugggag

SEQ ID NO: 2227218 - RNA, 16 nt, Human
cuggggaugugggagg

SEQ ID NO: 2227219 - RNA, 16 nt, Human
cuggggauugggcccc

SEQ ID NO: 2227220 - RNA, 22 nt, Human
cuggggauugggccccugccag

SEQ ID NO: 2227221 - RNA, 18 nt, Human
cuggggauugggccccug

SEQ ID NO: 2227222 - RNA, 22 nt, Human
cuggggaaauaacagcuguggc

SEQ ID NO: 2227223 - RNA, 19 nt, Human
cuggggaaauaacagcugu

SEQ ID NO: 2227224 - RNA, 22 nt, Human
cuggggaugucucucaugacca

SEQ ID NO: 2227225 - RNA, 16 nt, Human
cuggggacagcaaggg

SEQ ID NO: 2227226 - RNA, 21 nt, Human
cuggggcaagucccugacucu

SEQ ID NO: 2227227 - RNA, 14 nt, Human
cuggggcaaguccc

SEQ ID NO: 2227228 - RNA, 17 nt, Human
cuggggaugugggaggg

SEQ ID NO: 2227229 - RNA, 22 nt, Human
cuggggaugugggagggagcag

SEQ ID NO: 2227230 - RNA, 18 nt, Human
cuggggccaggcuggguc

SEQ ID NO: 2227231 - RNA, 12 nt, Human
cuggggccccuu

SEQ ID NO: 2227232 - RNA, 16 nt, Human
cuggggcaagucccug

SEQ ID NO: 2227233 - RNA, 17 nt, Human
cuggggccuaucagugu

SEQ ID NO: 2227234 - RNA, 21 nt, Human
cuggggccuaucagugugccc

SEQ ID NO: 2227235 - RNA, 16 nt, Human
cuggggccgaaagaac

SEQ ID NO: 2227236 - RNA, 21 nt, Human
cuggugacugcgaucuucaga

SEQ ID NO: 2227237 - RNA, 22 nt, Human
cuggugacugcgaucuucagag

SEQ ID NO: 2227238 - RNA, 23 nt, Human
cuggugacuuuccucuuuggucu

SEQ ID NO: 2227239 - RNA, 16 nt, Human
cuggugagcagacugg

SEQ ID NO: 2227240 - RNA, 13 nt, Human
cuggugaggccuu

SEQ ID NO: 2227241 - RNA, 15 nt, Human
cuggugaggccuugc

SEQ ID NO: 2227242 - RNA, 16 nt, Human
cuggugaggccuugcu

SEQ ID NO: 2227243 - RNA, 23 nt, Human
cuggugagucuuggcggcagcag

SEQ ID NO: 2227244 - RNA, 17 nt, Human
cuggugaggccuugcuc

SEQ ID NO: 2227245 - RNA, 19 nt, Human
cuggugagucuuggcggca

SEQ ID NO: 2227246 - RNA, 20 nt, Human
cuggugagucuuggcggcag

SEQ ID NO: 2227247 - RNA, 21 nt, Human
cuggugagucuuggcggcagc

SEQ ID NO: 2227248 - RNA, 21 nt, Human
cuggugauggagguuucauac

SEQ ID NO: 2227249 - RNA, 22 nt, Human
cuggguggcaccagcagccugg

SEQ ID NO: 2227250 - RNA, 17 nt, Human
cuggggccuccagaacu

SEQ ID NO: 2227251 - RNA, 15 nt, Human
cuggggccuccagaa

SEQ ID NO: 2227252 - RNA, 12 nt, Human
cuggggccucca

SEQ ID NO: 2227253 - RNA, 11 nt, Human
cuggggccucc

SEQ ID NO: 2227254 - RNA, 20 nt, Human
cuggggccucggagccucau

SEQ ID NO: 2227255 - RNA, 22 nt, Human
cuggggccuaucagugugcccc

SEQ ID NO: 2227256 - RNA, 19 nt, Human
cuggggccucggagccuca

SEQ ID NO: 2227257 - RNA, 14 nt, Human
cuggguggcacugc

SEQ ID NO: 2227258 - RNA, 15 nt, Human
cuggguggcacugcc

SEQ ID NO: 2227259 - RNA, 16 nt, Human
cuggguggcacugcca

SEQ ID NO: 2227260 - RNA, 20 nt, Human
cuggguggcacugccaugca

SEQ ID NO: 2227261 - RNA, 23 nt, Human
cuggguggcaccagcagccugga

SEQ ID NO: 2227262 - RNA, 16 nt, Human
cuggguguggcgcagc

SEQ ID NO: 2227263 - RNA, 21 nt, Human
cuggguggcacugccaugcag

SEQ ID NO: 2227264 - RNA, 12 nt, Human
cuggguggccca

SEQ ID NO: 2227265 - RNA, 13 nt, Human
cuggguggcccau

SEQ ID NO: 2227266 - RNA, 14 nt, Human
cuggguggcccauc

SEQ ID NO: 2227267 - RNA, 15 nt, Human
cuggguggcccaucc

SEQ ID NO: 2227268 - RNA, 16 nt, Human
cuggguggcccauccc

SEQ ID NO: 2227269 - RNA, 20 nt, Human
cuggguggcccauccccccu

SEQ ID NO: 2227270 - RNA, 21 nt, Human
cuggguggcccauccccccuc

SEQ ID NO: 2227271 - RNA, 13 nt, Human
cuggguggccucg

SEQ ID NO: 2227272 - RNA, 16 nt, Human
cuggguggccucggga

SEQ ID NO: 2227273 - RNA, 17 nt, Human
cuggguguggcgcagca

SEQ ID NO: 2227274 - RNA, 14 nt, Human
cuggguucacugca

SEQ ID NO: 2227275 - RNA, 14 nt, Human
cuggguucccuuuc

SEQ ID NO: 2227276 - RNA, 22 nt, Human
cuggguuccagcaauucuccug

SEQ ID NO: 2227277 - RNA, 20 nt, Human
cuggguucccuuuccuucca

SEQ ID NO: 2227278 - RNA, 16 nt, Human
cuggguucccuuuccu

SEQ ID NO: 2227279 - RNA, 21 nt, Human
cuggguucccuuuccuuccau

SEQ ID NO: 2227280 - RNA, 13 nt, Human
cuggguuccugca

SEQ ID NO: 2227281 - RNA, 22 nt, Human
cuggguuccuuccucugagccu

SEQ ID NO: 2227282 - RNA, 18 nt, Human
cuggguuccuuccucuga

SEQ ID NO: 2227283 - RNA, 23 nt, Human
cuggguuccuuccucugagccuu

SEQ ID NO: 2227284 - RNA, 15 nt, Human
cuggugacuuuccuc

SEQ ID NO: 2227285 - RNA, 20 nt, Human
cuggugacuuuccucuuugg

SEQ ID NO: 2227286 - RNA, 21 nt, Human
cuggugacuuuccucuuuggu

SEQ ID NO: 2227287 - RNA, 20 nt, Human
cugggacccuuuccuuccuu

SEQ ID NO: 2227288 - RNA, 19 nt, Human
cugggacccuuuccuuccu

SEQ ID NO: 2227289 - RNA, 15 nt, Human
cugggacccuuuccu

SEQ ID NO: 2227290 - RNA, 23 nt, Human
cugggacccuuuccuuccuuccc

SEQ ID NO: 2227291 - RNA, 15 nt, Human
cugggaccuccccug

SEQ ID NO: 2227292 - RNA, 16 nt, Human
cugggaccuccccuga

SEQ ID NO: 2227293 - RNA, 20 nt, Human
cugggaccuccccugaggcu

SEQ ID NO: 2227294 - RNA, 17 nt, Human
cugggaccugccaggca

SEQ ID NO: 2227295 - RNA, 18 nt, Human
cugggaccugccaggcag

SEQ ID NO: 2227296 - RNA, 19 nt, Human
cugggaccugccaggcagg

SEQ ID NO: 2227297 - RNA, 20 nt, Human
cugggaccugccaggcaggg

SEQ ID NO: 2227298 - RNA, 13 nt, Human
cugggaccuuuag

SEQ ID NO: 2227299 - RNA, 20 nt, Human
cugggaccuuuagugguggc

SEQ ID NO: 2227300 - RNA, 17 nt, Human
cugggacguggcucagc

SEQ ID NO: 2227301 - RNA, 16 nt, Human
cugggacguggcucag

SEQ ID NO: 2227302 - RNA, 15 nt, Human
cugggacguggcuca

SEQ ID NO: 2227303 - RNA, 12 nt, Human
cuggcagcucag

SEQ ID NO: 2227304 - RNA, 17 nt, Human
cuggagacuaaccccac

SEQ ID NO: 2227305 - RNA, 20 nt, Human
cuggagacuccuaggcagga

SEQ ID NO: 2227306 - RNA, 18 nt, Human
cuggagacuccuaggcag

SEQ ID NO: 2227307 - RNA, 19 nt, Human
cuggagacuccuaggcagg

SEQ ID NO: 2227308 - RNA, 13 nt, Human
cuggcagcucaga

SEQ ID NO: 2227309 - RNA, 14 nt, Human
cuggcagcucagag

SEQ ID NO: 2227310 - RNA, 16 nt, Human
cuggacugugugcuca

SEQ ID NO: 2227311 - RNA, 22 nt, Human
cuggagacagccccagagcagg

SEQ ID NO: 2227312 - RNA, 23 nt, Human
cuggagacagccccagagcaggg

SEQ ID NO: 2227313 - RNA, 20 nt, Human
cuggacugucauagaaauua

SEQ ID NO: 2227314 - RNA, 19 nt, Human
cuggacugucauagaaauu

SEQ ID NO: 2227315 - RNA, 19 nt, Human
cuggagaccagggagccuu

SEQ ID NO: 2227316 - RNA, 18 nt, Human
cuggagaccagggagccu

SEQ ID NO: 2227317 - RNA, 17 nt, Human
cuggagaccagggagcc

SEQ ID NO: 2227318 - RNA, 18 nt, Human
cuggagacgggugggcgg

SEQ ID NO: 2227319 - RNA, 21 nt, Human
cuggagacgggugggcggcug

SEQ ID NO: 2227320 - RNA, 18 nt, Human
cuggagaccaugcagagc

SEQ ID NO: 2227321 - RNA, 20 nt, Human
cuggagaccaugcagagcgc

SEQ ID NO: 2227322 - RNA, 21 nt, Human
cuggagaccaugcagagcgcc

SEQ ID NO: 2227323 - RNA, 23 nt, Human
cuggccccgccgccugguacuca

SEQ ID NO: 2227324 - RNA, 20 nt, Human
cuggccccuagaaucagccu

SEQ ID NO: 2227325 - RNA, 18 nt, Human
cuggccccuagaaucagc

SEQ ID NO: 2227326 - RNA, 17 nt, Human
cuggcagggugggaugg

SEQ ID NO: 2227327 - RNA, 13 nt, Human
cuggccccucagg

SEQ ID NO: 2227328 - RNA, 12 nt, Human
cuggccccgccg

SEQ ID NO: 2227329 - RNA, 14 nt, Human
cuggccccgccgcc

SEQ ID NO: 2227330 - RNA, 16 nt, Human
cuggccccgccgccug

SEQ ID NO: 2227331 - RNA, 22 nt, Human
cuggccccgccgccugguacuc

SEQ ID NO: 2227332 - RNA, 18 nt, Human
cuggcagggugggaugga

SEQ ID NO: 2227333 - RNA, 20 nt, Human
cuggcaggaugacccugcga

SEQ ID NO: 2227334 - RNA, 18 nt, Human
cuggcaggaugacccugc

SEQ ID NO: 2227335 - RNA, 21 nt, Human
cuggcagcucuggacagcccc

SEQ ID NO: 2227336 - RNA, 20 nt, Human
cuggcagcucuggacagccc

SEQ ID NO: 2227337 - RNA, 18 nt, Human
cuggcagcucuggacagc

SEQ ID NO: 2227338 - RNA, 17 nt, Human
cuggcagcucuggacag

SEQ ID NO: 2227339 - RNA, 15 nt, Human
cuggcagcucagaga

SEQ ID NO: 2227340 - RNA, 15 nt, Human
cuggagacuuagggc

SEQ ID NO: 2227341 - RNA, 23 nt, Human
cuggcagccucccauccagggcc

SEQ ID NO: 2227342 - RNA, 12 nt, Human
cuggcagcucug

SEQ ID NO: 2227343 - RNA, 18 nt, Human
cuggcagcucuccaguca

SEQ ID NO: 2227344 - RNA, 23 nt, Human
cuggcagcucuccagucaggagg

SEQ ID NO: 2227345 - RNA, 14 nt, Human
cuggcagcucucca

SEQ ID NO: 2227346 - RNA, 15 nt, Human
cuggcagcucuccag

SEQ ID NO: 2227347 - RNA, 16 nt, Human
cuggcagcucuccagu

SEQ ID NO: 2227348 - RNA, 17 nt, Human
cuggcagcucuccaguc

SEQ ID NO: 2227349 - RNA, 13 nt, Human
cuggcucaucucu

SEQ ID NO: 2227350 - RNA, 24 nt, Human
cuggcucauauuccugcagccugg

SEQ ID NO: 2227351 - RNA, 23 nt, Human
cuggcucauauuccugcagccug

SEQ ID NO: 2227352 - RNA, 22 nt, Human
cuggcucauauuccugcagccu

SEQ ID NO: 2227353 - RNA, 21 nt, Human
cuggcucauauuccugcagcc

SEQ ID NO: 2227354 - RNA, 20 nt, Human
cuggcucauauuccugcagc

SEQ ID NO: 2227355 - RNA, 19 nt, Human
cuggcucauauuccugcag

SEQ ID NO: 2227356 - RNA, 22 nt, Human
cuggccccucaccugggcaccu

SEQ ID NO: 2227357 - RNA, 15 nt, Human
cuggccccucaccug

SEQ ID NO: 2227358 - RNA, 13 nt, Human
cuggccccucacc

SEQ ID NO: 2227359 - RNA, 12 nt, Human
cuggccccucac

SEQ ID NO: 2227360 - RNA, 21 nt, Human
cuggcuccagaugcagggcag

SEQ ID NO: 2227361 - RNA, 20 nt, Human
cuggcuccagaugcagggca

SEQ ID NO: 2227362 - RNA, 14 nt, Human
cuggcuccagaugc

SEQ ID NO: 2227363 - RNA, 20 nt, Human
cuggcuccaaacccucgagg

SEQ ID NO: 2227364 - RNA, 19 nt, Human
cuggcuccaaacccucgag

SEQ ID NO: 2227365 - RNA, 17 nt, Human
cuggccccucagggucc

SEQ ID NO: 2227366 - RNA, 18 nt, Human
cuggccccucaggguccc

SEQ ID NO: 2227367 - RNA, 20 nt, Human
cuggccccucagggucccug

SEQ ID NO: 2227368 - RNA, 21 nt, Human
cuggccccucagggucccugg

SEQ ID NO: 2227369 - RNA, 15 nt, Human
cuggcucccacaggc

SEQ ID NO: 2227370 - RNA, 17 nt, Human
cuggcucccacaggcag

SEQ ID NO: 2227371 - RNA, 18 nt, Human
cuggcucccacaggcagc

SEQ ID NO: 2227372 - RNA, 19 nt, Human
cuggcucccacaggcagcu

SEQ ID NO: 2227373 - RNA, 20 nt, Human
cuggcucccacaggcagcuu

SEQ ID NO: 2227374 - RNA, 16 nt, Human
cuggcuccaggccagg

SEQ ID NO: 2227375 - RNA, 20 nt, Human
cuggcuccagcuggccggga

SEQ ID NO: 2227376 - RNA, 18 nt, Human
cuggcuccagcuggccgg

SEQ ID NO: 2227377 - RNA, 14 nt, Human
cuggcuccagcugg

SEQ ID NO: 2227378 - RNA, 13 nt, Human
cuggcuccagcug

SEQ ID NO: 2227379 - RNA, 23 nt, Human
cugggacacuuaacagaugcaau

SEQ ID NO: 2227380 - RNA, 19 nt, Human
cugggacacuuaacagaug

SEQ ID NO: 2227381 - RNA, 14 nt, Human
cugggacccuuucc

SEQ ID NO: 2227382 - RNA, 10 nt, Human
cugggacagg

SEQ ID NO: 2227383 - RNA, 12 nt, Human
cugggacacagu

SEQ ID NO: 2227384 - RNA, 13 nt, Human
cugggacacaguu

SEQ ID NO: 2227385 - RNA, 13 nt, Human
cugucgcccaguc

SEQ ID NO: 2227386 - RNA, 16 nt, Human
cugucgcccaggcugg

SEQ ID NO: 2227387 - RNA, 15 nt, Human
cugucgauguaggca

SEQ ID NO: 2227388 - RNA, 14 nt, Human
cugucgagacacuu

SEQ ID NO: 2227389 - RNA, 18 nt, Human
cugucgagacacuugccu

SEQ ID NO: 2227390 - RNA, 13 nt, Human
cugucgagacacu

SEQ ID NO: 2227391 - RNA, 13 nt, Human
cuguccugcuggu

SEQ ID NO: 2227392 - RNA, 18 nt, Human
cuguccugcuccacagug

SEQ ID NO: 2227393 - RNA, 19 nt, Human
cuguccugcuccacagugu

SEQ ID NO: 2227394 - RNA, 14 nt, Human
cuguccugcuccac

SEQ ID NO: 2227395 - RNA, 15 nt, Human
cuguccugcuccaca

SEQ ID NO: 2227396 - RNA, 16 nt, Human
cuguccugcuccacag

SEQ ID NO: 2227397 - RNA, 17 nt, Human
cuguccugcuccacagu

SEQ ID NO: 2227398 - RNA, 22 nt, Human
cugugaacuuggggaacaaggg

SEQ ID NO: 2227399 - RNA, 14 nt, Human
cugugaaggacccu

SEQ ID NO: 2227400 - RNA, 23 nt, Human
cugugaagcauucgagacagaac

SEQ ID NO: 2227401 - RNA, 21 nt, Human
cugugaagcauucgagacaga

SEQ ID NO: 2227402 - RNA, 15 nt, Human
cugugagacccccac

SEQ ID NO: 2227403 - RNA, 14 nt, Human
cugugaaguaagga

SEQ ID NO: 2227404 - RNA, 16 nt, Human
cugugaaguccuucac

SEQ ID NO: 2227405 - RNA, 18 nt, Human
cugugaaguccuucaccu

SEQ ID NO: 2227406 - RNA, 24 nt, Human
cugugaaguccuucaccucacuga

SEQ ID NO: 2227407 - RNA, 16 nt, Human
cugugaacuuggggaa

SEQ ID NO: 2227408 - RNA, 15 nt, Human
cugugaacuugggga

SEQ ID NO: 2227409 - RNA, 14 nt, Human
cugugaacuugggg

SEQ ID NO: 2227410 - RNA, 15 nt, Human
cugugaagagaacca

SEQ ID NO: 2227411 - RNA, 19 nt, Human
cugugagacccccacaccu

SEQ ID NO: 2227412 - RNA, 18 nt, Human
cugugagacccccacacc

SEQ ID NO: 2227413 - RNA, 17 nt, Human
cugugagacccccacac

SEQ ID NO: 2227414 - RNA, 16 nt, Human
cugugagacccccaca

SEQ ID NO: 2227415 - RNA, 23 nt, Human
cugugagacccccacaccucagu

SEQ ID NO: 2227416 - RNA, 20 nt, Human
cugugagacccccacaccuc

SEQ ID NO: 2227417 - RNA, 18 nt, Human
cugugagacucgagaacu

SEQ ID NO: 2227418 - RNA, 20 nt, Human
cugugagacucgagaacuuu

SEQ ID NO: 2227419 - RNA, 21 nt, Human
cugugagaugcuagaacuccc

SEQ ID NO: 2227420 - RNA, 16 nt, Human
cugugagaugcuagaa

SEQ ID NO: 2227421 - RNA, 14 nt, Human
cugugcucuggaca

SEQ ID NO: 2227422 - RNA, 14 nt, Human
cugugcucccuggu

SEQ ID NO: 2227423 - RNA, 19 nt, Human
cugugcucaggacucagaa

SEQ ID NO: 2227424 - RNA, 18 nt, Human
cugugcucaggacucaga

SEQ ID NO: 2227425 - RNA, 23 nt, Human
cugugcucaggacucagaagccu

SEQ ID NO: 2227426 - RNA, 22 nt, Human
cugugcucccugguucugauga

SEQ ID NO: 2227427 - RNA, 10 nt, Human
cugugcuccg

SEQ ID NO: 2227428 - RNA, 15 nt, Human
cugugcuccgugccu

SEQ ID NO: 2227429 - RNA, 17 nt, Human
cugugcuccgugccucc

SEQ ID NO: 2227430 - RNA, 18 nt, Human
cugugcuccgugccucca

SEQ ID NO: 2227431 - RNA, 19 nt, Human
cugugcuccgugccuccac

SEQ ID NO: 2227432 - RNA, 15 nt, Human
cugguuuggaaugcu

SEQ ID NO: 2227433 - RNA, 21 nt, Human
cugguuugacuccgcuggagg

SEQ ID NO: 2227434 - RNA, 17 nt, Human
cugguuuggggcgaggc

SEQ ID NO: 2227435 - RNA, 22 nt, Human
cugguuuccugcccugggaggc

SEQ ID NO: 2227436 - RNA, 16 nt, Human
cugguuuccugcccug

SEQ ID NO: 2227437 - RNA, 21 nt, Human
cugguuuccugcccugggagg

SEQ ID NO: 2227438 - RNA, 18 nt, Human
cugguuuccugcccuggg

SEQ ID NO: 2227439 - RNA, 16 nt, Human
cugucacugcaggcac

SEQ ID NO: 2227440 - RNA, 16 nt, Human
cugucacccuccaccu

SEQ ID NO: 2227441 - RNA, 13 nt, Human
cugucacugcagg

SEQ ID NO: 2227442 - RNA, 23 nt, Human
cugucacucauugcugagccucu

SEQ ID NO: 2227443 - RNA, 22 nt, Human
cugucacucauugcugagccuc

SEQ ID NO: 2227444 - RNA, 19 nt, Human
cugucacuguuucucugcu

SEQ ID NO: 2227445 - RNA, 14 nt, Human
cugucacuguuucu

SEQ ID NO: 2227446 - RNA, 20 nt, Human
cugucacuguuucucugcug

SEQ ID NO: 2227447 - RNA, 12 nt, Human
cugucacuuugc

SEQ ID NO: 2227448 - RNA, 14 nt, Human
cugucacuuugcuc

SEQ ID NO: 2227449 - RNA, 15 nt, Human
cugucacuuugcucu

SEQ ID NO: 2227450 - RNA, 17 nt, Human
cugucacuuugcucugg

SEQ ID NO: 2227451 - RNA, 19 nt, Human
cugucacuuugcucugggu

SEQ ID NO: 2227452 - RNA, 18 nt, Human
cugucacuuugcucuggg

SEQ ID NO: 2227453 - RNA, 22 nt, Human
cugucagaugggaagacaugaa

SEQ ID NO: 2227454 - RNA, 21 nt, Human
cugucagaugggaagacauga

SEQ ID NO: 2227455 - RNA, 18 nt, Human
cugucagccauuccuguu

SEQ ID NO: 2227456 - RNA, 21 nt, Human
cugucagcuccccucggagaa

SEQ ID NO: 2227457 - RNA, 13 nt, Human
cugucagccgggc

SEQ ID NO: 2227458 - RNA, 16 nt, Human
cugucagccgggcccu

SEQ ID NO: 2227459 - RNA, 17 nt, Human
cugucagccgggcccug

SEQ ID NO: 2227460 - RNA, 18 nt, Human
cugucagccgggcccuga

SEQ ID NO: 2227461 - RNA, 22 nt, Human
cugucagccgggcccugaguaa

SEQ ID NO: 2227462 - RNA, 23 nt, Human
cugucagccgggcccugaguaau

SEQ ID NO: 2227463 - RNA, 18 nt, Human
cuguccugaccugucuca

SEQ ID NO: 2227464 - RNA, 20 nt, Human
cuguccugacuucaggggcu

SEQ ID NO: 2227465 - RNA, 17 nt, Human
cuguccugauggucagc

SEQ ID NO: 2227466 - RNA, 19 nt, Human
cuguccugauggucagcuc

SEQ ID NO: 2227467 - RNA, 17 nt, Human
cugucagcgcagguuua

SEQ ID NO: 2227468 - RNA, 12 nt, Human
cuguccugccua

SEQ ID NO: 2227469 - RNA, 13 nt, Human
cuguccugcucca

SEQ ID NO: 2227470 - RNA, 20 nt, Human
cuguccugauggucagcucc

SEQ ID NO: 2227471 - RNA, 21 nt, Human
cuguccugauggucagcuccc

SEQ ID NO: 2227472 - RNA, 22 nt, Human
cuguccugauggucagcucccu

SEQ ID NO: 2227473 - RNA, 17 nt, Human
cugucauuugagcaggg

SEQ ID NO: 2227474 - RNA, 18 nt, Human
cugucauuugagcagggc

SEQ ID NO: 2227475 - RNA, 16 nt, Human
cugucauuugagcagg

SEQ ID NO: 2227476 - RNA, 23 nt, Human
cugucagcuccccucggagaaga

SEQ ID NO: 2227477 - RNA, 15 nt, Human
cuguaaaaugaaauu

SEQ ID NO: 2227478 - RNA, 23 nt, Human
cuguaaaauauacuuaaauggaa

SEQ ID NO: 2227479 - RNA, 22 nt, Human
cuguaaaaucuuucuuucuuag

SEQ ID NO: 2227480 - RNA, 10 nt, Human
cuguaaaauc

SEQ ID NO: 2227481 - RNA, 11 nt, Human
cuguaaaaucu

SEQ ID NO: 2227482 - RNA, 16 nt, Human
cuguaaaaugaaauua

SEQ ID NO: 2227483 - RNA, 22 nt, Human
cuguaaaaugcaugauuuugua

SEQ ID NO: 2227484 - RNA, 16 nt, Human
cugguuuggggcgagg

SEQ ID NO: 2227485 - RNA, 17 nt, Human
cuguaaaauaaaagguc

SEQ ID NO: 2227486 - RNA, 22 nt, Human
cugguuugacuccgcuggaggu

SEQ ID NO: 2227487 - RNA, 17 nt, Human
cugguuuggaaugcuuc

SEQ ID NO: 2227488 - RNA, 22 nt, Human
cuguacuugcucuugaugccug

SEQ ID NO: 2227489 - RNA, 21 nt, Human
cuguacuugcucuugaugccu

SEQ ID NO: 2227490 - RNA, 22 nt, Human
cuguaaaccccuuuaguggcuu

SEQ ID NO: 2227491 - RNA, 20 nt, Human
cuguaaaccucucgagggca

SEQ ID NO: 2227492 - RNA, 19 nt, Human
cuguaaacucaaaacuuaa

SEQ ID NO: 2227493 - RNA, 23 nt, Human
cuguacuugcucuugaugccugg

SEQ ID NO: 2227494 - RNA, 14 nt, Human
cugucaccaagcuc

SEQ ID NO: 2227495 - RNA, 18 nt, Human
cuguagggcuggaccuau

SEQ ID NO: 2227496 - RNA, 23 nt, Human
cugucaccaagcucacaguuccu

SEQ ID NO: 2227497 - RNA, 21 nt, Human
cuguagggagggcggcagggg

SEQ ID NO: 2227498 - RNA, 14 nt, Human
cuguagggcuggac

SEQ ID NO: 2227499 - RNA, 15 nt, Human
cuguagggcuggacc

SEQ ID NO: 2227500 - RNA, 16 nt, Human
cuguagggcuggaccu

SEQ ID NO: 2227501 - RNA, 17 nt, Human
cuguagggcuggaccua

SEQ ID NO: 2227502 - RNA, 21 nt, Human
cuguagggcuggaccuauguc

SEQ ID NO: 2227503 - RNA, 21 nt, Human
cugucacucauugcugagccu

SEQ ID NO: 2227504 - RNA, 14 nt, Human
cugucacucauugc

SEQ ID NO: 2227505 - RNA, 13 nt, Human
cugucacccaggc

SEQ ID NO: 2227506 - RNA, 20 nt, Human
cugucacccaggcuggagua

SEQ ID NO: 2227507 - RNA, 14 nt, Human
cugucacccuccac

SEQ ID NO: 2227508 - RNA, 18 nt, Human
cugucacccuccaccucu

SEQ ID NO: 2227509 - RNA, 21 nt, Human
cuguaggaagguuaauguuca

SEQ ID NO: 2227510 - RNA, 14 nt, Human
cuguagggaacucu

SEQ ID NO: 2227511 - RNA, 20 nt, Human
cuguagggagggcggcaggg

SEQ ID NO: 2227512 - RNA, 19 nt, Human
cuguaggacucgcagucag

SEQ ID NO: 2227513 - RNA, 11 nt, Human
cugcugacagu

SEQ ID NO: 2227514 - RNA, 23 nt, Human
cugcugaauuuucacaugaacau

SEQ ID NO: 2227515 - RNA, 21 nt, Human
cugcugacagacacaggcccg

SEQ ID NO: 2227516 - RNA, 23 nt, Human
cugcugacagacacaggcccggc

SEQ ID NO: 2227517 - RNA, 15 nt, Human
cugcugacagacaca

SEQ ID NO: 2227518 - RNA, 18 nt, Human
cugcugacagacacaggc

SEQ ID NO: 2227519 - RNA, 19 nt, Human
cugcugacagacacaggcc

SEQ ID NO: 2227520 - RNA, 20 nt, Human
cugcugacagacacaggccc

SEQ ID NO: 2227521 - RNA, 13 nt, Human
cugcuuaacuuca

SEQ ID NO: 2227522 - RNA, 22 nt, Human
cugcuuuuuaaagaaugcucuu

SEQ ID NO: 2227523 - RNA, 17 nt, Human
cugcuuuuuauggccug

SEQ ID NO: 2227524 - RNA, 14 nt, Human
cugcuucagccucc

SEQ ID NO: 2227525 - RNA, 16 nt, Human
cugcuucagccucccg

SEQ ID NO: 2227526 - RNA, 13 nt, Human
cugcuucagccuc

SEQ ID NO: 2227527 - RNA, 17 nt, Human
cugcuuaacuucacaua

SEQ ID NO: 2227528 - RNA, 15 nt, Human
cugcuuaacuucaca

SEQ ID NO: 2227529 - RNA, 13 nt, Human
cuggacugggagg

SEQ ID NO: 2227530 - RNA, 14 nt, Human
cuggacugggaggu

SEQ ID NO: 2227531 - RNA, 16 nt, Human
cuggacugggagguag

SEQ ID NO: 2227532 - RNA, 17 nt, Human
cuggacugggagguaga

SEQ ID NO: 2227533 - RNA, 18 nt, Human
cuggacugucauagaaau

SEQ ID NO: 2227534 - RNA, 13 nt, Human
cuggacugugugc

SEQ ID NO: 2227535 - RNA, 21 nt, Human
cuggacuggcuagaguccuca

SEQ ID NO: 2227536 - RNA, 15 nt, Human
cuggacuggcuagag

SEQ ID NO: 2227537 - RNA, 19 nt, Human
cuggaacugucucucauga

SEQ ID NO: 2227538 - RNA, 17 nt, Human
cuggaacucagugugac

SEQ ID NO: 2227539 - RNA, 21 nt, Human
cuggaacucagugugacuccu

SEQ ID NO: 2227540 - RNA, 18 nt, Human
cuggaacugucucucaug

SEQ ID NO: 2227541 - RNA, 16 nt, Human
cuggaacugucucuca

SEQ ID NO: 2227542 - RNA, 23 nt, Human
cuggaaccucagccuggccagac

SEQ ID NO: 2227543 - RNA, 22 nt, Human
cuggaaccucagccuggccaga

SEQ ID NO: 2227544 - RNA, 20 nt, Human
cuggaaccucagccuggcca

SEQ ID NO: 2227545 - RNA, 18 nt, Human
cuggaaccucagccuggc

SEQ ID NO: 2227546 - RNA, 17 nt, Human
cuggaaccucagccugg

SEQ ID NO: 2227547 - RNA, 16 nt, Human
cuggaaccucagccug

SEQ ID NO: 2227548 - RNA, 15 nt, Human
cuggaaccucagccu

SEQ ID NO: 2227549 - RNA, 12 nt, Human
cuggaaccucag

SEQ ID NO: 2227550 - RNA, 22 nt, Human
cuggaacccagacucagacauu

SEQ ID NO: 2227551 - RNA, 19 nt, Human
cuggaacccagacucagac

SEQ ID NO: 2227552 - RNA, 18 nt, Human
cuggaacccagacucaga

SEQ ID NO: 2227553 - RNA, 16 nt, Human
cuggaacccagacuca

SEQ ID NO: 2227554 - RNA, 14 nt, Human
cuggaacccagacu

SEQ ID NO: 2227555 - RNA, 23 nt, Human
cuggaaauaucaguuacucagcc

SEQ ID NO: 2227556 - RNA, 17 nt, Human
cuggaacacuaaugagg

SEQ ID NO: 2227557 - RNA, 13 nt, Human
cuggaacccagac

SEQ ID NO: 2227558 - RNA, 16 nt, Human
cuggaaccaucagaaa

SEQ ID NO: 2227559 - RNA, 15 nt, Human
cuggaaccaucagaa

SEQ ID NO: 2227560 - RNA, 21 nt, Human
cuggaacagauucacacuguc

SEQ ID NO: 2227561 - RNA, 14 nt, Human
cuggaacagauuca

SEQ ID NO: 2227562 - RNA, 20 nt, Human
cuggaacaucaucaaggcac

SEQ ID NO: 2227563 - RNA, 16 nt, Human
cuggaaauauuaagaa

SEQ ID NO: 2227564 - RNA, 21 nt, Human
cuggaaaucaggguuaguauu

SEQ ID NO: 2227565 - RNA, 18 nt, Human
cugcuuuuuauggccugu

SEQ ID NO: 2227566 - RNA, 14 nt, Human
cugcccugugggcc

SEQ ID NO: 2227567 - RNA, 12 nt, Human
cugccugggcug

SEQ ID NO: 2227568 - RNA, 23 nt, Human
cugccugggaucccucauccuca

SEQ ID NO: 2227569 - RNA, 20 nt, Human
cugccugguauauccaaaag

SEQ ID NO: 2227570 - RNA, 21 nt, Human
cugccugggcuguuggcacuc

SEQ ID NO: 2227571 - RNA, 24 nt, Human
cugccugggcuguuggcacucaca

SEQ ID NO: 2227572 - RNA, 19 nt, Human
cugccuggggcgggccccu

SEQ ID NO: 2227573 - RNA, 22 nt, Human
cugccuggggcgggccccucau

SEQ ID NO: 2227574 - RNA, 15 nt, Human
cugccugggcuguug

SEQ ID NO: 2227575 - RNA, 16 nt, Human
cugccugggcuguugg

SEQ ID NO: 2227576 - RNA, 17 nt, Human
cugccugggcuguuggc

SEQ ID NO: 2227577 - RNA, 18 nt, Human
cugccugggcuguuggca

SEQ ID NO: 2227578 - RNA, 19 nt, Human
cugccugggcuguuggcac

SEQ ID NO: 2227579 - RNA, 20 nt, Human
cugccugggcuguuggcacu

SEQ ID NO: 2227580 - RNA, 12 nt, Human
cugccuguggcg

SEQ ID NO: 2227581 - RNA, 22 nt, Human
cugccuguggcgccgucuccag

SEQ ID NO: 2227582 - RNA, 23 nt, Human
cugccuguggcgccgucuccagg

SEQ ID NO: 2227583 - RNA, 17 nt, Human
cugccuguuauaacucu

SEQ ID NO: 2227584 - RNA, 18 nt, Human
cugccuguuauaacucug

SEQ ID NO: 2227585 - RNA, 20 nt, Human
cugccuguuauaacucugca

SEQ ID NO: 2227586 - RNA, 14 nt, Human
cugccuguucagcu

SEQ ID NO: 2227587 - RNA, 15 nt, Human
cugccuguucagcuc

SEQ ID NO: 2227588 - RNA, 15 nt, Human
cugccucgaacuggc

SEQ ID NO: 2227589 - RNA, 17 nt, Human
cugccucgaacuggcug

SEQ ID NO: 2227590 - RNA, 18 nt, Human
cugccucgaacuggcugc

SEQ ID NO: 2227591 - RNA, 22 nt, Human
cugccugggaucccucauccuc

SEQ ID NO: 2227592 - RNA, 17 nt, Human
cugcuacccagaaauca

SEQ ID NO: 2227593 - RNA, 16 nt, Human
cugcuacacauacagg

SEQ ID NO: 2227594 - RNA, 15 nt, Human
cugcuacagagcaga

SEQ ID NO: 2227595 - RNA, 12 nt, Human
cugcuaccucac

SEQ ID NO: 2227596 - RNA, 19 nt, Human
cugcuacccucccugcugu

SEQ ID NO: 2227597 - RNA, 20 nt, Human
cugcuacccucccugcuguc

SEQ ID NO: 2227598 - RNA, 13 nt, Human
cugcuacccuccc

SEQ ID NO: 2227599 - RNA, 16 nt, Human
cugcuacccucccugc

SEQ ID NO: 2227600 - RNA, 17 nt, Human
cugcuacccucccugcu

SEQ ID NO: 2227601 - RNA, 18 nt, Human
cugcuacccucccugcug

SEQ ID NO: 2227602 - RNA, 14 nt, Human
cugcuaccucacug

SEQ ID NO: 2227603 - RNA, 13 nt, Human
cugcuaccucacu

SEQ ID NO: 2227604 - RNA, 15 nt, Human
cugcuaccucacugg

SEQ ID NO: 2227605 - RNA, 17 nt, Human
cugcuaccucacugggg

SEQ ID NO: 2227606 - RNA, 12 nt, Human
cugcucagcccu

SEQ ID NO: 2227607 - RNA, 13 nt, Human
cugcucagcccug

SEQ ID NO: 2227608 - RNA, 13 nt, Human
cugcucagcagcu

SEQ ID NO: 2227609 - RNA, 13 nt, Human
cugcucagacaga

SEQ ID NO: 2227610 - RNA, 13 nt, Human
cugcucagcuucu

SEQ ID NO: 2227611 - RNA, 21 nt, Human
cugcucagcccuggaggugcc

SEQ ID NO: 2227612 - RNA, 22 nt, Human
cugcucagcucugggccauucu

SEQ ID NO: 2227613 - RNA, 16 nt, Human
cugcucagcucugggc

SEQ ID NO: 2227614 - RNA, 14 nt, Human
cugcucagcucugg

SEQ ID NO: 2227615 - RNA, 13 nt, Human
cugcucagcucug

SEQ ID NO: 2227616 - RNA, 17 nt, Human
cugcucagcccuggagg

SEQ ID NO: 2227617 - RNA, 18 nt, Human
cugcucagcccuggaggu

SEQ ID NO: 2227618 - RNA, 14 nt, Human
cugcucagcccugg

SEQ ID NO: 2227619 - RNA, 15 nt, Human
cugcucagcccugga

SEQ ID NO: 2227620 - RNA, 16 nt, Human
cugcucagcccuggag

SEQ ID NO: 2227621 - RNA, 23 nt, Human
cugcuacaaauacucuuaggaag

SEQ ID NO: 2227622 - RNA, 20 nt, Human
cugcuacaaagaagacaugu

SEQ ID NO: 2227623 - RNA, 22 nt, Human
cugcuacaaagaagacauguuu

SEQ ID NO: 2227624 - RNA, 15 nt, Human
cugcuacaaagaaga

SEQ ID NO: 2227625 - RNA, 17 nt, Human
cugcuacaaagaagaca

SEQ ID NO: 2227626 - RNA, 18 nt, Human
cugcuacaaagaagacau

SEQ ID NO: 2227627 - RNA, 19 nt, Human
cugcuacaaagaagacaug

SEQ ID NO: 2227628 - RNA, 18 nt, Human
cugcuaaucuucagggca

SEQ ID NO: 2227629 - RNA, 14 nt, Human
cugcuaaucuucag

SEQ ID NO: 2227630 - RNA, 12 nt, Human
cugcuacaaaga

SEQ ID NO: 2227631 - RNA, 16 nt, Human
cugcuaauaaaaccca

SEQ ID NO: 2227632 - RNA, 23 nt, Human
cugcuaaguauuucccagcacau

SEQ ID NO: 2227633 - RNA, 19 nt, Human
cugcuaaguauuucccagc

SEQ ID NO: 2227634 - RNA, 21 nt, Human
cugcuaaguauuucccagcac

SEQ ID NO: 2227635 - RNA, 21 nt, Human
cugccuguuauaacucugcac

SEQ ID NO: 2227636 - RNA, 22 nt, Human
cugccuguuauaacucugcacu

SEQ ID NO: 2227637 - RNA, 16 nt, Human
cugcuaauuccccaga

SEQ ID NO: 2227638 - RNA, 16 nt, Human
cugccuguugggccag

SEQ ID NO: 2227639 - RNA, 14 nt, Human
cugccuguugggcc

SEQ ID NO: 2227640 - RNA, 18 nt, Human
cugccuguugggccagga

SEQ ID NO: 2227641 - RNA, 19 nt, Human
cugccuguugggccaggag

SEQ ID NO: 2227642 - RNA, 18 nt, Human
cugaccuuugucaucuuu

SEQ ID NO: 2227643 - RNA, 22 nt, Human
cugaccuugaacuccugggcuc

SEQ ID NO: 2227644 - RNA, 21 nt, Human
cugaccuugaacuccugggcu

SEQ ID NO: 2227645 - RNA, 21 nt, Human
cugagacucagacaggaaagg

SEQ ID NO: 2227646 - RNA, 20 nt, Human
cugagacucagacaggaaag

SEQ ID NO: 2227647 - RNA, 17 nt, Human
cugagacucagacagga

SEQ ID NO: 2227648 - RNA, 14 nt, Human
cugagacucagaca

SEQ ID NO: 2227649 - RNA, 19 nt, Human
cugagacuccggggagcgc

SEQ ID NO: 2227650 - RNA, 17 nt, Human
cugagacucgcgacaau

SEQ ID NO: 2227651 - RNA, 19 nt, Human
cugagacucgcgacaaugc

SEQ ID NO: 2227652 - RNA, 23 nt, Human
cugagacuccggggagcgcccgc

SEQ ID NO: 2227653 - RNA, 20 nt, Human
cugagacucgcgacaaugca

SEQ ID NO: 2227654 - RNA, 14 nt, Human
cugcauuucugagu

SEQ ID NO: 2227655 - RNA, 9 nt, Human
cugcauuuu

SEQ ID NO: 2227656 - RNA, 20 nt, Human
cugcauuuuaauuuuaacca

SEQ ID NO: 2227657 - RNA, 21 nt, Human
cugcauuuuaauuuuaaccaa

SEQ ID NO: 2227658 - RNA, 22 nt, Human
cugcauuuuaauuuuaaccaaa

SEQ ID NO: 2227659 - RNA, 19 nt, Human
cugcauuuuauucuggaug

SEQ ID NO: 2227660 - RNA, 14 nt, Human
cugcauuuugcuau

SEQ ID NO: 2227661 - RNA, 20 nt, Human
cugcauuuuauucuggaugg

SEQ ID NO: 2227662 - RNA, 21 nt, Human
cugcauuuugcuauuguaaau

SEQ ID NO: 2227663 - RNA, 18 nt, Human
cugcauuuucaccccacc

SEQ ID NO: 2227664 - RNA, 17 nt, Human
cugcauuuucaccccac

SEQ ID NO: 2227665 - RNA, 14 nt, Human
cugcauuugugaaa

SEQ ID NO: 2227666 - RNA, 15 nt, Human
cugcauuugugaaau

SEQ ID NO: 2227667 - RNA, 17 nt, Human
cugcauuugugaaauga

SEQ ID NO: 2227668 - RNA, 22 nt, Human
cugcauuugugaaaugauggug

SEQ ID NO: 2227669 - RNA, 18 nt, Human
cugcauuuuuagaccauu

SEQ ID NO: 2227670 - RNA, 16 nt, Human
cugccaaaaugcucua

SEQ ID NO: 2227671 - RNA, 15 nt, Human
cugccaaaaugcucu

SEQ ID NO: 2227672 - RNA, 14 nt, Human
cugccaaaggaugu

SEQ ID NO: 2227673 - RNA, 16 nt, Human
cugccaaaggauguga

SEQ ID NO: 2227674 - RNA, 18 nt, Human
cugccaaaggaugugaua

SEQ ID NO: 2227675 - RNA, 19 nt, Human
cugccaaaggaugugauau

SEQ ID NO: 2227676 - RNA, 22 nt, Human
cugccaaaggaugugauauaua

SEQ ID NO: 2227677 - RNA, 21 nt, Human
cugccaaagggaaauaucauu

SEQ ID NO: 2227678 - RNA, 20 nt, Human
cugccaaauuuuggccaaag

SEQ ID NO: 2227679 - RNA, 22 nt, Human
cugccaaaaugcucuagugccu

SEQ ID NO: 2227680 - RNA, 15 nt, Human
cugccaaccauaccu

SEQ ID NO: 2227681 - RNA, 21 nt, Human
cugccaaccauaccuuccuuc

SEQ ID NO: 2227682 - RNA, 22 nt, Human
cugccaaccauaccuuccuucc

SEQ ID NO: 2227683 - RNA, 23 nt, Human
cugccaaccauaccuuccuuccc

SEQ ID NO: 2227684 - RNA, 21 nt, Human
cugccaacuucuucagagcug

SEQ ID NO: 2227685 - RNA, 15 nt, Human
cugccaaggccagag

SEQ ID NO: 2227686 - RNA, 22 nt, Human
cugccaacuucuucagagcuga

SEQ ID NO: 2227687 - RNA, 22 nt, Human
cugccaaggccagaguggccug

SEQ ID NO: 2227688 - RNA, 21 nt, Human
cugccaaggccagaguggccu

SEQ ID NO: 2227689 - RNA, 18 nt, Human
cugccaaggccagagugg

SEQ ID NO: 2227690 - RNA, 15 nt, Human
cugccaaugggagcu

SEQ ID NO: 2227691 - RNA, 17 nt, Human
cugccaaugggagcuca

SEQ ID NO: 2227692 - RNA, 20 nt, Human
cugcauuaccgcguuguaaa

SEQ ID NO: 2227693 - RNA, 21 nt, Human
cugcauuaccgcguuguaaaa

SEQ ID NO: 2227694 - RNA, 23 nt, Human
cugcauuaccgcguuguaaaaua

SEQ ID NO: 2227695 - RNA, 15 nt, Human
cugcauuagaaauua

SEQ ID NO: 2227696 - RNA, 22 nt, Human
cugcauucacccagacagcucc

SEQ ID NO: 2227697 - RNA, 21 nt, Human
cugcauucacccagacagcuc

SEQ ID NO: 2227698 - RNA, 20 nt, Human
cugcauucacccagacagcu

SEQ ID NO: 2227699 - RNA, 13 nt, Human
cugcauguuacau

SEQ ID NO: 2227700 - RNA, 15 nt, Human
cugcauguuugugau

SEQ ID NO: 2227701 - RNA, 13 nt, Human
cugcauuugugaa

SEQ ID NO: 2227702 - RNA, 18 nt, Human
cugcauuucgguggcuag

SEQ ID NO: 2227703 - RNA, 13 nt, Human
cugcauuucugag

SEQ ID NO: 2227704 - RNA, 17 nt, Human
cugcauuucgguggcua

SEQ ID NO: 2227705 - RNA, 22 nt, Human
cugcauuuaaaagauacaguua

SEQ ID NO: 2227706 - RNA, 20 nt, Human
cugcauuuaaaagauacagu

SEQ ID NO: 2227707 - RNA, 17 nt, Human
cugcauugagaacugca

SEQ ID NO: 2227708 - RNA, 19 nt, Human
cugcauucugccgugugcc

SEQ ID NO: 2227709 - RNA, 20 nt, Human
cugcauucaggaucaaaccc

SEQ ID NO: 2227710 - RNA, 14 nt, Human
cugcauucuuucug

SEQ ID NO: 2227711 - RNA, 15 nt, Human
cugcauucuuucugu

SEQ ID NO: 2227712 - RNA, 16 nt, Human
cugcauucuuucugua

SEQ ID NO: 2227713 - RNA, 20 nt, Human
cugcccuggugcugccacac

SEQ ID NO: 2227714 - RNA, 21 nt, Human
cugcccuggugcugccacacu

SEQ ID NO: 2227715 - RNA, 23 nt, Human
cugcccugguuuccugcccuggg

SEQ ID NO: 2227716 - RNA, 22 nt, Human
cugcccugguuuccugcccugg

SEQ ID NO: 2227717 - RNA, 21 nt, Human
cugcccuguaccccagcacuu

SEQ ID NO: 2227718 - RNA, 13 nt, Human
cugcccuguaccc

SEQ ID NO: 2227719 - RNA, 12 nt, Human
cugcccugugag

SEQ ID NO: 2227720 - RNA, 13 nt, Human
cugcccugugagu

SEQ ID NO: 2227721 - RNA, 15 nt, Human
cugcccugugggccc

SEQ ID NO: 2227722 - RNA, 16 nt, Human
cugcccugugggcccc

SEQ ID NO: 2227723 - RNA, 18 nt, Human
cugcccugugggccccca

SEQ ID NO: 2227724 - RNA, 17 nt, Human
cugcccuggugcugcca

SEQ ID NO: 2227725 - RNA, 16 nt, Human
cugcccuggugcugcc

SEQ ID NO: 2227726 - RNA, 18 nt, Human
cugcccuggugcugccac

SEQ ID NO: 2227727 - RNA, 19 nt, Human
cugcccuggugcugccaca

SEQ ID NO: 2227728 - RNA, 15 nt, Human
cugccccucccugcu

SEQ ID NO: 2227729 - RNA, 22 nt, Human
cugccccucccccaacccccac

SEQ ID NO: 2227730 - RNA, 14 nt, Human
cugccccuccccca

SEQ ID NO: 2227731 - RNA, 13 nt, Human
cugccccuccccc

SEQ ID NO: 2227732 - RNA, 16 nt, Human
cugccccucccagaac

SEQ ID NO: 2227733 - RNA, 15 nt, Human
cugccccucccagaa

SEQ ID NO: 2227734 - RNA, 14 nt, Human
cugccccucccaga

SEQ ID NO: 2227735 - RNA, 13 nt, Human
cugccccucccag

SEQ ID NO: 2227736 - RNA, 11 nt, Human
cugccccuccc

SEQ ID NO: 2227737 - RNA, 19 nt, Human
cugcccccucugcccugcg

SEQ ID NO: 2227738 - RNA, 18 nt, Human
cugcccccucugcccugc

SEQ ID NO: 2227739 - RNA, 17 nt, Human
cugcccccucugcccug

SEQ ID NO: 2227740 - RNA, 16 nt, Human
cugcccccucugcccu

SEQ ID NO: 2227741 - RNA, 14 nt, Human
cugccccucaacuc

SEQ ID NO: 2227742 - RNA, 22 nt, Human
cugccccucaacucuccuccag

SEQ ID NO: 2227743 - RNA, 19 nt, Human
cugccccagggcucccggc

SEQ ID NO: 2227744 - RNA, 13 nt, Human
cugccccaggccu

SEQ ID NO: 2227745 - RNA, 14 nt, Human
cugccccaggccug

SEQ ID NO: 2227746 - RNA, 21 nt, Human
cugccccauccuccagcaggg

SEQ ID NO: 2227747 - RNA, 18 nt, Human
cugccccauccuccagca

SEQ ID NO: 2227748 - RNA, 17 nt, Human
cugccccauccuccagc

SEQ ID NO: 2227749 - RNA, 16 nt, Human
cugccccauccuccag

SEQ ID NO: 2227750 - RNA, 13 nt, Human
cugccccauccuc

SEQ ID NO: 2227751 - RNA, 15 nt, Human
cugccccaggccuga

SEQ ID NO: 2227752 - RNA, 22 nt, Human
cugccccauccuccagcaggga

SEQ ID NO: 2227753 - RNA, 15 nt, Human
cugcccccucugccc

SEQ ID NO: 2227754 - RNA, 14 nt, Human
cugcccccucugcc

SEQ ID NO: 2227755 - RNA, 16 nt, Human
cugccccagcucuggc

SEQ ID NO: 2227756 - RNA, 21 nt, Human
cugccaggcccccaagccugc

SEQ ID NO: 2227757 - RNA, 18 nt, Human
cugccaggcccccaagcc

SEQ ID NO: 2227758 - RNA, 23 nt, Human
cugccaucauguuuacagaggac

SEQ ID NO: 2227759 - RNA, 19 nt, Human
cugccccagcucuggcuuc

SEQ ID NO: 2227760 - RNA, 18 nt, Human
cugccccagcucuggcuu

SEQ ID NO: 2227761 - RNA, 12 nt, Human
cugccccaggcc

SEQ ID NO: 2227762 - RNA, 12 nt, Human
cugccauccagg

SEQ ID NO: 2227763 - RNA, 22 nt, Human
cugccaucauguuuacagagga

SEQ ID NO: 2227764 - RNA, 17 nt, Human
cugccaucauguuuaca

SEQ ID NO: 2227765 - RNA, 22 nt, Human
cugccaggcccccaagccugca

SEQ ID NO: 2227766 - RNA, 13 nt, Human
cugccaggccccc

SEQ ID NO: 2227767 - RNA, 23 nt, Human
cugccaaggccagaguggccugg

SEQ ID NO: 2227768 - RNA, 11 nt, Human
cugccagggac

SEQ ID NO: 2227769 - RNA, 12 nt, Human
cugccagggaca

SEQ ID NO: 2227770 - RNA, 15 nt, Human
cugccagggacagag

SEQ ID NO: 2227771 - RNA, 20 nt, Human
cugccauauucuguuggcca

SEQ ID NO: 2227772 - RNA, 21 nt, Human
cugccauauucuguuggccag

SEQ ID NO: 2227773 - RNA, 22 nt, Human
cugccauauucuguuggccagu

SEQ ID NO: 2227774 - RNA, 23 nt, Human
cugccauauucuguuggccagug

SEQ ID NO: 2227775 - RNA, 13 nt, Human
cugacccuguaua

SEQ ID NO: 2227776 - RNA, 15 nt, Human
cugacccuguauaua

SEQ ID NO: 2227777 - RNA, 18 nt, Human
cugacccuguauauagcc

SEQ ID NO: 2227778 - RNA, 19 nt, Human
cugacccuguauauagccc

SEQ ID NO: 2227779 - RNA, 20 nt, Human
cugacccuguauauagccca

SEQ ID NO: 2227780 - RNA, 21 nt, Human
cugacccuguauauagcccag

SEQ ID NO: 2227781 - RNA, 22 nt, Human
cugacccuguauauagcccagc

SEQ ID NO: 2227782 - RNA, 13 nt, Human
cugacccugugga

SEQ ID NO: 2227783 - RNA, 12 nt, Human
cugacccuguau

SEQ ID NO: 2227784 - RNA, 23 nt, Human
cugacccugcuucaaauauuucc

SEQ ID NO: 2227785 - RNA, 18 nt, Human
cugacccaugcugcccug

SEQ ID NO: 2227786 - RNA, 17 nt, Human
cugacccaugcugcccu

SEQ ID NO: 2227787 - RNA, 19 nt, Human
cugacccaugcugcccugu

SEQ ID NO: 2227788 - RNA, 20 nt, Human
cugacccaugcugcccugug

SEQ ID NO: 2227789 - RNA, 16 nt, Human
cugaccuccacagcuu

SEQ ID NO: 2227790 - RNA, 11 nt, Human
cugaccuccca

SEQ ID NO: 2227791 - RNA, 12 nt, Human
cugaccucccag

SEQ ID NO: 2227792 - RNA, 13 nt, Human
cugaccucccagc

SEQ ID NO: 2227793 - RNA, 14 nt, Human
cugaccucccagcc

SEQ ID NO: 2227794 - RNA, 16 nt, Human
cugaccucccagcccu

SEQ ID NO: 2227795 - RNA, 17 nt, Human
cugaccucccagcccua

SEQ ID NO: 2227796 - RNA, 18 nt, Human
cugaccucccagcccuau

SEQ ID NO: 2227797 - RNA, 22 nt, Human
cugaccucccagcccuauggau

SEQ ID NO: 2227798 - RNA, 23 nt, Human
cugaccucccagcccuauggaug

SEQ ID NO: 2227799 - RNA, 18 nt, Human
cugaccucccucuaauuu

SEQ ID NO: 2227800 - RNA, 20 nt, Human
cugaccucccucuaauuuau

SEQ ID NO: 2227801 - RNA, 20 nt, Human
cugaccgaaacagcgcuggg

SEQ ID NO: 2227802 - RNA, 13 nt, Human
cugaccgugggcg

SEQ ID NO: 2227803 - RNA, 18 nt, Human
cugaccgaaacagcgcug

SEQ ID NO: 2227804 - RNA, 22 nt, Human
cugacccuuacagccucugacu

SEQ ID NO: 2227805 - RNA, 17 nt, Human
cugacccugguucucuc

SEQ ID NO: 2227806 - RNA, 20 nt, Human
cugacccuuacagccucuga

SEQ ID NO: 2227807 - RNA, 23 nt, Human
cugacccuuacagccucugacuu

SEQ ID NO: 2227808 - RNA, 15 nt, Human
cugaccuccacagcu

SEQ ID NO: 2227809 - RNA, 14 nt, Human
cugaccuccacagc

SEQ ID NO: 2227810 - RNA, 13 nt, Human
cugaccuccacag

SEQ ID NO: 2227811 - RNA, 22 nt, Human
cugaccgugggcggggccuugc

SEQ ID NO: 2227812 - RNA, 17 nt, Human
cugaccuaucacuucca

SEQ ID NO: 2227813 - RNA, 21 nt, Human
cugaccucccucuaauuuauc

SEQ ID NO: 2227814 - RNA, 12 nt, Human
cugaccucuggu

SEQ ID NO: 2227815 - RNA, 20 nt, Human
cugaccugugagcccagcug

SEQ ID NO: 2227816 - RNA, 18 nt, Human
cugaccugugagcccagc

SEQ ID NO: 2227817 - RNA, 17 nt, Human
cugaccugugagcccag

SEQ ID NO: 2227818 - RNA, 23 nt, Human
cugaccugucaugccccccucaa

SEQ ID NO: 2227819 - RNA, 20 nt, Human
cugaccuugaacuccugggc

SEQ ID NO: 2227820 - RNA, 22 nt, Human
cugaccuuccucgcagagaggc

SEQ ID NO: 2227821 - RNA, 23 nt, Human
cugaccuuccucgcagagaggcc

SEQ ID NO: 2227822 - RNA, 17 nt, Human
cugaccuuccucgcaga

SEQ ID NO: 2227823 - RNA, 18 nt, Human
cugaccuuccucgcagag

SEQ ID NO: 2227824 - RNA, 20 nt, Human
cugaccuuccucgcagagag

SEQ ID NO: 2227825 - RNA, 21 nt, Human
cugaccuuccucgcagagagg

SEQ ID NO: 2227826 - RNA, 16 nt, Human
cugaccuuccucgcag

SEQ ID NO: 2227827 - RNA, 21 nt, Human
cugaccugugagcccagcugg

SEQ ID NO: 2227828 - RNA, 12 nt, Human
cugaagggaggu

SEQ ID NO: 2227829 - RNA, 11 nt, Human
cugaagggagg

SEQ ID NO: 2227830 - RNA, 19 nt, Human
cugaaggggccaugauggc

SEQ ID NO: 2227831 - RNA, 15 nt, Human
cugaaggggccauga

SEQ ID NO: 2227832 - RNA, 23 nt, Human
cugaaggggccaugauggcaaca

SEQ ID NO: 2227833 - RNA, 20 nt, Human
cugaaggggcgucuguuccc

SEQ ID NO: 2227834 - RNA, 14 nt, Human
cugacagaaggacu

SEQ ID NO: 2227835 - RNA, 15 nt, Human
cugaagguaaaauug

SEQ ID NO: 2227836 - RNA, 17 nt, Human
cugaagggguucucaca

SEQ ID NO: 2227837 - RNA, 21 nt, Human
cugaagggguucucacagugg

SEQ ID NO: 2227838 - RNA, 15 nt, Human
cugacagacacaggc

SEQ ID NO: 2227839 - RNA, 17 nt, Human
cugaagguaaaauugaa

SEQ ID NO: 2227840 - RNA, 12 nt, Human
cugacagacaca

SEQ ID NO: 2227841 - RNA, 14 nt, Human
cugacagacacagg

SEQ ID NO: 2227842 - RNA, 14 nt, Human
cugaaggaaaaaca

SEQ ID NO: 2227843 - RNA, 16 nt, Human
cugaaggaaaaacaca

SEQ ID NO: 2227844 - RNA, 17 nt, Human
cugaaggaaaaacacaa

SEQ ID NO: 2227845 - RNA, 11 nt, Human
cugaaggaaaa

SEQ ID NO: 2227846 - RNA, 22 nt, Human
cugaaggaauaaauugcuccuu

SEQ ID NO: 2227847 - RNA, 18 nt, Human
cugaaggaaaaacacaag

SEQ ID NO: 2227848 - RNA, 21 nt, Human
cugaaggaaaaacacaagcaa

SEQ ID NO: 2227849 - RNA, 22 nt, Human
cugaaggaaaaacacaagcaaa

SEQ ID NO: 2227850 - RNA, 17 nt, Human
cugaaggacacuuccug

SEQ ID NO: 2227851 - RNA, 18 nt, Human
cugaaaauucgaaccagg

SEQ ID NO: 2227852 - RNA, 14 nt, Human
cugaagcugccugc

SEQ ID NO: 2227853 - RNA, 18 nt, Human
cugaagcugccugcuuuu

SEQ ID NO: 2227854 - RNA, 15 nt, Human
cugaagcugccugcu

SEQ ID NO: 2227855 - RNA, 16 nt, Human
cugaagcugccugcuu

SEQ ID NO: 2227856 - RNA, 16 nt, Human
cugaaaauuaacacug

SEQ ID NO: 2227857 - RNA, 17 nt, Human
cugaaaauuaacacugc

SEQ ID NO: 2227858 - RNA, 22 nt, Human
cugaaaauguuuuucugccagg

SEQ ID NO: 2227859 - RNA, 21 nt, Human
cugaaaaugugaauaaaauua

SEQ ID NO: 2227860 - RNA, 13 nt, Human
cugaaaaugugcu

SEQ ID NO: 2227861 - RNA, 12 nt, Human
cugaaaaugugc

SEQ ID NO: 2227862 - RNA, 13 nt, Human
cugaaaaugugaa

SEQ ID NO: 2227863 - RNA, 19 nt, Human
cugaaaagacucaguguuc

SEQ ID NO: 2227864 - RNA, 18 nt, Human
cugaaaagacucaguguu

SEQ ID NO: 2227865 - RNA, 16 nt, Human
cugaaaacggcccucu

SEQ ID NO: 2227866 - RNA, 16 nt, Human
cugaaaauguaugugu

SEQ ID NO: 2227867 - RNA, 19 nt, Human
cugaaggacauugcggaca

SEQ ID NO: 2227868 - RNA, 20 nt, Human
cugaaggacauugcggacag

SEQ ID NO: 2227869 - RNA, 21 nt, Human
cugaaggacauugcggacagc

SEQ ID NO: 2227870 - RNA, 18 nt, Human
cugaaggacacuuccugc

SEQ ID NO: 2227871 - RNA, 19 nt, Human
cugaaggacacuuccugcc

SEQ ID NO: 2227872 - RNA, 20 nt, Human
cugaaggacacuuccugccu

SEQ ID NO: 2227873 - RNA, 21 nt, Human
cugaaggacacuuccugccua

SEQ ID NO: 2227874 - RNA, 13 nt, Human
cugaaggccccgc

SEQ ID NO: 2227875 - RNA, 14 nt, Human
cugaaggccccgcc

SEQ ID NO: 2227876 - RNA, 17 nt, Human
cugaaggccccgcccag

SEQ ID NO: 2227877 - RNA, 20 nt, Human
cugaaaaccucuccucaugu

SEQ ID NO: 2227878 - RNA, 17 nt, Human
cugaaaaccucuccuca

SEQ ID NO: 2227879 - RNA, 15 nt, Human
cugaaaaccucuccu

SEQ ID NO: 2227880 - RNA, 14 nt, Human
cugaaaaccucucc

SEQ ID NO: 2227881 - RNA, 17 nt, Human
cugaaaacggcccucuu

SEQ ID NO: 2227882 - RNA, 17 nt, Human
cugaaaacccagagagg

SEQ ID NO: 2227883 - RNA, 19 nt, Human
cugaaaaccuaaguccuuu

SEQ ID NO: 2227884 - RNA, 15 nt, Human
cugaaaacccagaga

SEQ ID NO: 2227885 - RNA, 14 nt, Human
cugaaaacccagag

SEQ ID NO: 2227886 - RNA, 14 nt, Human
cugaaaacaucugg

SEQ ID NO: 2227887 - RNA, 15 nt, Human
cucuuggagccugca

SEQ ID NO: 2227888 - RNA, 17 nt, Human
cugaaaacacugugcac

SEQ ID NO: 2227889 - RNA, 15 nt, Human
cugaaaaauuccuuu

SEQ ID NO: 2227890 - RNA, 17 nt, Human
cucuugcggucccuucu

SEQ ID NO: 2227891 - RNA, 14 nt, Human
cucuugccuccugg

SEQ ID NO: 2227892 - RNA, 14 nt, Human
cucuugcuaaucag

SEQ ID NO: 2227893 - RNA, 21 nt, Human
cucuugcuaaucagugucuca

SEQ ID NO: 2227894 - RNA, 22 nt, Human
cucuugcuaaucagugucucac

SEQ ID NO: 2227895 - RNA, 12 nt, Human
cucuugcucaaa

SEQ ID NO: 2227896 - RNA, 19 nt, Human
cucuugcucaaaaaucugu

SEQ ID NO: 2227897 - RNA, 20 nt, Human
cucuugcucaaaaaucuguu

SEQ ID NO: 2227898 - RNA, 12 nt, Human
cucuugcucuuu

SEQ ID NO: 2227899 - RNA, 13 nt, Human
cucuugcucuuuc

SEQ ID NO: 2227900 - RNA, 15 nt, Human
cucuugcucuuucua

SEQ ID NO: 2227901 - RNA, 14 nt, Human
cucuugcucuuucu

SEQ ID NO: 2227902 - RNA, 16 nt, Human
cucuuggaaaaaguga

SEQ ID NO: 2227903 - RNA, 17 nt, Human
cucuuggaaaaagugau

SEQ ID NO: 2227904 - RNA, 12 nt, Human
cucuuggaccuc

SEQ ID NO: 2227905 - RNA, 17 nt, Human
cucuuggaccucugcuc

SEQ ID NO: 2227906 - RNA, 18 nt, Human
cucuuggaccucugcucu

SEQ ID NO: 2227907 - RNA, 14 nt, Human
cucuuggagccugc

SEQ ID NO: 2227908 - RNA, 19 nt, Human
cucuuggaccucugcucug

SEQ ID NO: 2227909 - RNA, 20 nt, Human
cucuuggaccucugcucuga

SEQ ID NO: 2227910 - RNA, 16 nt, Human
cucuugccacugccuc

SEQ ID NO: 2227911 - RNA, 21 nt, Human
cucuugccaaccuguaauaaa

SEQ ID NO: 2227912 - RNA, 22 nt, Human
cucuugccaaccuguaauaaau

SEQ ID NO: 2227913 - RNA, 23 nt, Human
cucuugccaaccuguaauaaaua

SEQ ID NO: 2227914 - RNA, 17 nt, Human
cucuugccacugccucu

SEQ ID NO: 2227915 - RNA, 18 nt, Human
cucuugccacugccucuu

SEQ ID NO: 2227916 - RNA, 19 nt, Human
cucuugccacugccucuuc

SEQ ID NO: 2227917 - RNA, 20 nt, Human
cucuugccacugccucuucc

SEQ ID NO: 2227918 - RNA, 18 nt, Human
cucuuagacuucugcuuu

SEQ ID NO: 2227919 - RNA, 21 nt, Human
cucuuagaugcaguucugaag

SEQ ID NO: 2227920 - RNA, 20 nt, Human
cucuuagaugcaguucugaa

SEQ ID NO: 2227921 - RNA, 18 nt, Human
cucugcaccguacugugg

SEQ ID NO: 2227922 - RNA, 16 nt, Human
cucugcacccccauau

SEQ ID NO: 2227923 - RNA, 18 nt, Human
cucugcacaugucuugua

SEQ ID NO: 2227924 - RNA, 16 nt, Human
cucugcacuacugaca

SEQ ID NO: 2227925 - RNA, 18 nt, Human
cucugcacuacugacaug

SEQ ID NO: 2227926 - RNA, 13 nt, Human
cucugcacuacuc

SEQ ID NO: 2227927 - RNA, 15 nt, Human
cucugcacuacuccu

SEQ ID NO: 2227928 - RNA, 20 nt, Human
cucugcacuacuccucugca

SEQ ID NO: 2227929 - RNA, 22 nt, Human
cucugcacuacuccucugcagu

SEQ ID NO: 2227930 - RNA, 20 nt, Human
cucugcacuacugacaugug

SEQ ID NO: 2227931 - RNA, 22 nt, Human
cucugcacuacugacauguggg

SEQ ID NO: 2227932 - RNA, 15 nt, Human
cucugcacaugucuu

SEQ ID NO: 2227933 - RNA, 16 nt, Human
cucugcacaugucuug

SEQ ID NO: 2227934 - RNA, 22 nt, Human
cucugcgugucaccugugcuuc

SEQ ID NO: 2227935 - RNA, 19 nt, Human
cucugcuacguuccuauug

SEQ ID NO: 2227936 - RNA, 14 nt, Human
cucugcuccaccac

SEQ ID NO: 2227937 - RNA, 13 nt, Human
cucugcuccacca

SEQ ID NO: 2227938 - RNA, 12 nt, Human
cucugcuccacc

SEQ ID NO: 2227939 - RNA, 16 nt, Human
cucugcuccaccacau

SEQ ID NO: 2227940 - RNA, 15 nt, Human
cucugcuccaccaca

SEQ ID NO: 2227941 - RNA, 18 nt, Human
cucugcuccaccacaucc

SEQ ID NO: 2227942 - RNA, 19 nt, Human
cucugcuccaccacauccu

SEQ ID NO: 2227943 - RNA, 13 nt, Human
cucugcagccagc

SEQ ID NO: 2227944 - RNA, 23 nt, Human
cucugcacuacuccucugcagug

SEQ ID NO: 2227945 - RNA, 14 nt, Human
cucugcagccagcc

SEQ ID NO: 2227946 - RNA, 23 nt, Human
cucugcagcaauaaagcagcguu

SEQ ID NO: 2227947 - RNA, 19 nt, Human
cucugcagcaauaaagcag

SEQ ID NO: 2227948 - RNA, 18 nt, Human
cucugcagcaauaaagca

SEQ ID NO: 2227949 - RNA, 15 nt, Human
cucugguuaucuaau

SEQ ID NO: 2227950 - RNA, 14 nt, Human
cucugguuccuccc

SEQ ID NO: 2227951 - RNA, 19 nt, Human
cucugguccauagagagca

SEQ ID NO: 2227952 - RNA, 16 nt, Human
cucugguccauagaga

SEQ ID NO: 2227953 - RNA, 18 nt, Human
cucugguccauagagagc

SEQ ID NO: 2227954 - RNA, 17 nt, Human
cucugcugacagacaca

SEQ ID NO: 2227955 - RNA, 18 nt, Human
cucugcugacagacacag

SEQ ID NO: 2227956 - RNA, 19 nt, Human
cucugcugacagacacagg

SEQ ID NO: 2227957 - RNA, 15 nt, Human
cucugguccauagag

SEQ ID NO: 2227958 - RNA, 22 nt, Human
cucugguccggacacuccuaga

SEQ ID NO: 2227959 - RNA, 13 nt, Human
cucugguucuuug

SEQ ID NO: 2227960 - RNA, 16 nt, Human
cucugguuuaauuaca

SEQ ID NO: 2227961 - RNA, 18 nt, Human
cucuguaaucucguuuca

SEQ ID NO: 2227962 - RNA, 21 nt, Human
cucuguaaaugaaaaaaccca

SEQ ID NO: 2227963 - RNA, 22 nt, Human
cucugguuuggggcgaggcaga

SEQ ID NO: 2227964 - RNA, 20 nt, Human
cucugguuuggggcgaggca

SEQ ID NO: 2227965 - RNA, 17 nt, Human
cucuguacagagcccac

SEQ ID NO: 2227966 - RNA, 21 nt, Human
cucuguacagagcccacgccc

SEQ ID NO: 2227967 - RNA, 15 nt, Human
cucugucaaugaaaa

SEQ ID NO: 2227968 - RNA, 16 nt, Human
cucuuagaaaugaagg

SEQ ID NO: 2227969 - RNA, 15 nt, Human
cucuuagaugcaguu

SEQ ID NO: 2227970 - RNA, 21 nt, Human
cucuguaaucucguuucaaaa

SEQ ID NO: 2227971 - RNA, 22 nt, Human
cucuguaucaggacccagagga

SEQ ID NO: 2227972 - RNA, 22 nt, Human
cucuguagggaacucugggguc

SEQ ID NO: 2227973 - RNA, 18 nt, Human
cucuguagggaacucugg

SEQ ID NO: 2227974 - RNA, 16 nt, Human
cucugaagccucuggg

SEQ ID NO: 2227975 - RNA, 14 nt, Human
cucuccuagagaca

SEQ ID NO: 2227976 - RNA, 21 nt, Human
cucuccuagagacagaagcag

SEQ ID NO: 2227977 - RNA, 15 nt, Human
cucuccggucucucu

SEQ ID NO: 2227978 - RNA, 21 nt, Human
cucuccgaccagacaccuuga

SEQ ID NO: 2227979 - RNA, 23 nt, Human
cucuccccagguccagcucugga

SEQ ID NO: 2227980 - RNA, 18 nt, Human
cucuccccagguccagcu

SEQ ID NO: 2227981 - RNA, 20 nt, Human
cucuccccagguccagcucu

SEQ ID NO: 2227982 - RNA, 23 nt, Human
cucucagccaacgaguaauuuau

SEQ ID NO: 2227983 - RNA, 11 nt, Human
cucucagccaa

SEQ ID NO: 2227984 - RNA, 21 nt, Human
cucucagccccugauccugug

SEQ ID NO: 2227985 - RNA, 15 nt, Human
cucuccccagcccag

SEQ ID NO: 2227986 - RNA, 13 nt, Human
cucuccccagccc

SEQ ID NO: 2227987 - RNA, 22 nt, Human
cucucagccccugauccuguga

SEQ ID NO: 2227988 - RNA, 20 nt, Human
cucuccccagcccagagaca

SEQ ID NO: 2227989 - RNA, 15 nt, Human
cucuccccaggucca

SEQ ID NO: 2227990 - RNA, 16 nt, Human
cucuccccagguccag

SEQ ID NO: 2227991 - RNA, 19 nt, Human
cucuccccagcccagagac

SEQ ID NO: 2227992 - RNA, 18 nt, Human
cucuccccagcccagaga

SEQ ID NO: 2227993 - RNA, 17 nt, Human
cucuccccagcccagag

SEQ ID NO: 2227994 - RNA, 16 nt, Human
cucuccccagcccaga

SEQ ID NO: 2227995 - RNA, 20 nt, Human
cucuccucauguucugcuuu

SEQ ID NO: 2227996 - RNA, 14 nt, Human
cucuccucaucucu

SEQ ID NO: 2227997 - RNA, 12 nt, Human
cucuccucaucu

SEQ ID NO: 2227998 - RNA, 23 nt, Human
cucuccucaucucuaacagcuca

SEQ ID NO: 2227999 - RNA, 16 nt, Human
cucuccuccaagacac

SEQ ID NO: 2228000 - RNA, 11 nt, Human
cucucuggccu

SEQ ID NO: 2228001 - RNA, 12 nt, Human
cucucuggccuu

SEQ ID NO: 2228002 - RNA, 20 nt, Human
cucuccuccaagacacugug

SEQ ID NO: 2228003 - RNA, 13 nt, Human
cucucuggccucc

SEQ ID NO: 2228004 - RNA, 14 nt, Human
cucucuggccuccc

SEQ ID NO: 2228005 - RNA, 15 nt, Human
cucucuggccuccca

SEQ ID NO: 2228006 - RNA, 16 nt, Human
cucucuggccucccac

SEQ ID NO: 2228007 - RNA, 17 nt, Human
cucucuggccucccacc

SEQ ID NO: 2228008 - RNA, 23 nt, Human
cucugaagaguggguuucacaag

SEQ ID NO: 2228009 - RNA, 22 nt, Human
cucugaagaguggguuucacaa

SEQ ID NO: 2228010 - RNA, 18 nt, Human
cucugaagaugaucauuu

SEQ ID NO: 2228011 - RNA, 20 nt, Human
cucucuggccucccacccga

SEQ ID NO: 2228012 - RNA, 11 nt, Human
cucugaagcau

SEQ ID NO: 2228013 - RNA, 21 nt, Human
cucugaagaguggguuucaca

SEQ ID NO: 2228014 - RNA, 13 nt, Human
cucugaagagugg

SEQ ID NO: 2228015 - RNA, 18 nt, Human
cucucuggccucccaccc

SEQ ID NO: 2228016 - RNA, 19 nt, Human
cucucuggccucccacccg

SEQ ID NO: 2228017 - RNA, 15 nt, Human
cucugaaggacauug

SEQ ID NO: 2228018 - RNA, 20 nt, Human
cucugaagcauguuucaugu

SEQ ID NO: 2228019 - RNA, 14 nt, Human
cucugaagcauguu

SEQ ID NO: 2228020 - RNA, 17 nt, Human
cucugaagcauguuuca

SEQ ID NO: 2228021 - RNA, 15 nt, Human
cucugaagccucugg

SEQ ID NO: 2228022 - RNA, 17 nt, Human
cucugaagccucuggga

SEQ ID NO: 2228023 - RNA, 15 nt, Human
cucuauguuuacaaa

SEQ ID NO: 2228024 - RNA, 18 nt, Human
cucuauuaagauuuccaa

SEQ ID NO: 2228025 - RNA, 20 nt, Human
cucuauguuuacaaauggac

SEQ ID NO: 2228026 - RNA, 23 nt, Human
cucgggcccaggccaucuuccag

SEQ ID NO: 2228027 - RNA, 13 nt, Human
cucgggcccagcc

SEQ ID NO: 2228028 - RNA, 14 nt, Human
cucgggcccagccc

SEQ ID NO: 2228029 - RNA, 15 nt, Human
cucgggcccagcccc

SEQ ID NO: 2228030 - RNA, 16 nt, Human
cucgggcccagccccc

SEQ ID NO: 2228031 - RNA, 18 nt, Human
cucgggcccagcccccac

SEQ ID NO: 2228032 - RNA, 12 nt, Human
cucgggcccagg

SEQ ID NO: 2228033 - RNA, 14 nt, Human
cucgggcccaggcc

SEQ ID NO: 2228034 - RNA, 16 nt, Human
cucgggcccaggccau

SEQ ID NO: 2228035 - RNA, 12 nt, Human
cucuauuuaaua

SEQ ID NO: 2228036 - RNA, 23 nt, Human
cucuauugauguacagucuguca

SEQ ID NO: 2228037 - RNA, 20 nt, Human
cucuauuguagcauuucuug

SEQ ID NO: 2228038 - RNA, 20 nt, Human
cucuauuaagauuuccaagu

SEQ ID NO: 2228039 - RNA, 14 nt, Human
cucuauuuagcaug

SEQ ID NO: 2228040 - RNA, 17 nt, Human
cucuauuuauguuugca

SEQ ID NO: 2228041 - RNA, 16 nt, Human
cucuauuuauguuugc

SEQ ID NO: 2228042 - RNA, 13 nt, Human
cucuauuuagcau

SEQ ID NO: 2228043 - RNA, 16 nt, Human
cucuauuuaauauuua

SEQ ID NO: 2228044 - RNA, 17 nt, Human
cucuauuuaauauuuau

SEQ ID NO: 2228045 - RNA, 21 nt, Human
cucuauuguagcauuucuuga

SEQ ID NO: 2228046 - RNA, 13 nt, Human
cucuauuuaauau

SEQ ID NO: 2228047 - RNA, 14 nt, Human
cucuauuuaauauu

SEQ ID NO: 2228048 - RNA, 15 nt, Human
cucuauuuaauauuu

SEQ ID NO: 2228049 - RNA, 22 nt, Human
cucucaaaucuuuuagucauua

SEQ ID NO: 2228050 - RNA, 20 nt, Human
cucucaaccaccuuucagau

SEQ ID NO: 2228051 - RNA, 16 nt, Human
cucucagaagguauuc

SEQ ID NO: 2228052 - RNA, 20 nt, Human
cucucagagcuacuugggcc

SEQ ID NO: 2228053 - RNA, 21 nt, Human
cucucagagcuacuugggcca

SEQ ID NO: 2228054 - RNA, 22 nt, Human
cucucagagcuacuugggccau

SEQ ID NO: 2228055 - RNA, 17 nt, Human
cucucagaauucuucag

SEQ ID NO: 2228056 - RNA, 14 nt, Human
cucucagaagggag

SEQ ID NO: 2228057 - RNA, 19 nt, Human
cucucagaagggaggcugg

SEQ ID NO: 2228058 - RNA, 19 nt, Human
cucucagauuguaccauug

SEQ ID NO: 2228059 - RNA, 12 nt, Human
cucucacugucu

SEQ ID NO: 2228060 - RNA, 15 nt, Human
cucucacuccuugaa

SEQ ID NO: 2228061 - RNA, 12 nt, Human
cucucacuccuu

SEQ ID NO: 2228062 - RNA, 14 nt, Human
cucucacuccuuga

SEQ ID NO: 2228063 - RNA, 17 nt, Human
cucucaacccaggagca

SEQ ID NO: 2228064 - RNA, 15 nt, Human
cucucaauaugcuua

SEQ ID NO: 2228065 - RNA, 16 nt, Human
cucucaauaugcuuac

SEQ ID NO: 2228066 - RNA, 22 nt, Human
cuccgucuuagaaguggaccag

SEQ ID NO: 2228067 - RNA, 22 nt, Human
cuccguccaggagccugugccu

SEQ ID NO: 2228068 - RNA, 20 nt, Human
cuccguccaggagccugugc

SEQ ID NO: 2228069 - RNA, 19 nt, Human
cuccguccaggagccuggc

SEQ ID NO: 2228070 - RNA, 22 nt, Human
cuccguccagccgccauugcca

SEQ ID NO: 2228071 - RNA, 18 nt, Human
cuccguccaggagccugg

SEQ ID NO: 2228072 - RNA, 13 nt, Human
cuccguggagcag

SEQ ID NO: 2228073 - RNA, 15 nt, Human
cuccguuagcuccug

SEQ ID NO: 2228074 - RNA, 16 nt, Human
cuccguuagcuccugu

SEQ ID NO: 2228075 - RNA, 13 nt, Human
cuccgugccucca

SEQ ID NO: 2228076 - RNA, 14 nt, Human
cuccgugccuccac

SEQ ID NO: 2228077 - RNA, 15 nt, Human
cuccgugccuccacc

SEQ ID NO: 2228078 - RNA, 16 nt, Human
cuccgugccuccacca

SEQ ID NO: 2228079 - RNA, 21 nt, Human
cuccgugccuccaccaccacu

SEQ ID NO: 2228080 - RNA, 22 nt, Human
cuccgugccuccaccaccacug

SEQ ID NO: 2228081 - RNA, 16 nt, Human
cuccgugcuuccucag

SEQ ID NO: 2228082 - RNA, 19 nt, Human
cuccgugcuuccucaguua

SEQ ID NO: 2228083 - RNA, 19 nt, Human
cucggcuuuucucagcugg

SEQ ID NO: 2228084 - RNA, 12 nt, Human
cucgggaaccuc

SEQ ID NO: 2228085 - RNA, 16 nt, Human
cucgggaaccucacuc

SEQ ID NO: 2228086 - RNA, 15 nt, Human
cucgggacaccugcc

SEQ ID NO: 2228087 - RNA, 20 nt, Human
cucgggacaccugcccugcc

SEQ ID NO: 2228088 - RNA, 15 nt, Human
cucgggaggcugaga

SEQ ID NO: 2228089 - RNA, 20 nt, Human
cucgggauuaguacacacuu

SEQ ID NO: 2228090 - RNA, 21 nt, Human
cucgggaggcugagacaggag

SEQ ID NO: 2228091 - RNA, 19 nt, Human
cucgggaggcugagacagg

SEQ ID NO: 2228092 - RNA, 13 nt, Human
cucgggcccaccu

SEQ ID NO: 2228093 - RNA, 14 nt, Human
cucgggcccaccug

SEQ ID NO: 2228094 - RNA, 16 nt, Human
cucgggcccaccuggc

SEQ ID NO: 2228095 - RNA, 17 nt, Human
cucgggcccaccuggcc

SEQ ID NO: 2228096 - RNA, 18 nt, Human
cucgggcccaccuggcca

SEQ ID NO: 2228097 - RNA, 19 nt, Human
cucgggcccaccuggccac

SEQ ID NO: 2228098 - RNA, 20 nt, Human
cucgggcccaccuggccacc

SEQ ID NO: 2228099 - RNA, 21 nt, Human
cucgggcccaccuggccaccu

SEQ ID NO: 2228100 - RNA, 12 nt, Human
cucgggcccagc

SEQ ID NO: 2228101 - RNA, 15 nt, Human
cuccagggguggcug

SEQ ID NO: 2228102 - RNA, 22 nt, Human
cuccaggggcugcuuccuccug

SEQ ID NO: 2228103 - RNA, 23 nt, Human
cuccaggggcugcuuccuccugg

SEQ ID NO: 2228104 - RNA, 16 nt, Human
cuccagggugugugcu

SEQ ID NO: 2228105 - RNA, 11 nt, Human
cuccaggugca

SEQ ID NO: 2228106 - RNA, 22 nt, Human
cuccagguccucuacuuaauga

SEQ ID NO: 2228107 - RNA, 16 nt, Human
cuccaggucucacggg

SEQ ID NO: 2228108 - RNA, 17 nt, Human
cuccaggucucacgggc

SEQ ID NO: 2228109 - RNA, 18 nt, Human
cuccaggucucacgggca

SEQ ID NO: 2228110 - RNA, 16 nt, Human
cuccaguccaaggaaa

SEQ ID NO: 2228111 - RNA, 15 nt, Human
cuccagucaggaggc

SEQ ID NO: 2228112 - RNA, 16 nt, Human
cuccagucaggaggca

SEQ ID NO: 2228113 - RNA, 15 nt, Human
cuccagaagauagcu

SEQ ID NO: 2228114 - RNA, 14 nt, Human
cuccagaagauagc

SEQ ID NO: 2228115 - RNA, 20 nt, Human
cuccagaaccgcagaagccu

SEQ ID NO: 2228116 - RNA, 19 nt, Human
cuccagaaccgcagaagcc

SEQ ID NO: 2228117 - RNA, 22 nt, Human
cuccagaaaugucuaaaugcug

SEQ ID NO: 2228118 - RNA, 15 nt, Human
cuccagaaacggcca

SEQ ID NO: 2228119 - RNA, 15 nt, Human
cuccacuuuguugga

SEQ ID NO: 2228120 - RNA, 22 nt, Human
cuccacuuucuagccagaggag

SEQ ID NO: 2228121 - RNA, 16 nt, Human
cuccaagaccuucucc

SEQ ID NO: 2228122 - RNA, 13 nt, Human
cuccaaccugcaa

SEQ ID NO: 2228123 - RNA, 17 nt, Human
cuccaagaccuucuccu

SEQ ID NO: 2228124 - RNA, 18 nt, Human
cuccaagaccuucuccuu

SEQ ID NO: 2228125 - RNA, 23 nt, Human
cuccagaagauagcuucacccca

SEQ ID NO: 2228126 - RNA, 15 nt, Human
cuccagaagccucug

SEQ ID NO: 2228127 - RNA, 14 nt, Human
cuccagaagccucu

SEQ ID NO: 2228128 - RNA, 19 nt, Human
cuccagaagccucuggcua

SEQ ID NO: 2228129 - RNA, 18 nt, Human
cuccagaagccucuggcu

SEQ ID NO: 2228130 - RNA, 17 nt, Human
cuccagaagccucuggc

SEQ ID NO: 2228131 - RNA, 16 nt, Human
cuccagaagccucugg

SEQ ID NO: 2228132 - RNA, 15 nt, Human
cuccagaauuuccca

SEQ ID NO: 2228133 - RNA, 18 nt, Human
cuccagaauuucccaaag

SEQ ID NO: 2228134 - RNA, 14 nt, Human
cuccagacccccag

SEQ ID NO: 2228135 - RNA, 22 nt, Human
cuccagacccccaccccuuccc

SEQ ID NO: 2228136 - RNA, 21 nt, Human
cuccagacccccaccccuucc

SEQ ID NO: 2228137 - RNA, 18 nt, Human
cuccagacccccaccccu

SEQ ID NO: 2228138 - RNA, 16 nt, Human
cuccagacccccaccc

SEQ ID NO: 2228139 - RNA, 12 nt, Human
cuccagaccccc

SEQ ID NO: 2228140 - RNA, 17 nt, Human
cuccagacccaccacac

SEQ ID NO: 2228141 - RNA, 21 nt, Human
cuccagaaucuaaagccagug

SEQ ID NO: 2228142 - RNA, 19 nt, Human
cuccagacacauguccaag

SEQ ID NO: 2228143 - RNA, 21 nt, Human
cuccagaagccucuggcuaga

SEQ ID NO: 2228144 - RNA, 20 nt, Human
cuccagaagccucuggcuag

SEQ ID NO: 2228145 - RNA, 17 nt, Human
cuccagacacaugucca

SEQ ID NO: 2228146 - RNA, 16 nt, Human
cuccagacccccagca

SEQ ID NO: 2228147 - RNA, 14 nt, Human
cucccugacccugu

SEQ ID NO: 2228148 - RNA, 16 nt, Human
cucccugacccuguau

SEQ ID NO: 2228149 - RNA, 17 nt, Human
cucccugacccuguaua

SEQ ID NO: 2228150 - RNA, 23 nt, Human
cucccugacccuguauauagccc

SEQ ID NO: 2228151 - RNA, 12 nt, Human
cucccugacccu

SEQ ID NO: 2228152 - RNA, 21 nt, Human
cucccuccucaccucuggacu

SEQ ID NO: 2228153 - RNA, 19 nt, Human
cucccuccucaccucugga

SEQ ID NO: 2228154 - RNA, 18 nt, Human
cucccuccucaccucugg

SEQ ID NO: 2228155 - RNA, 17 nt, Human
cucccuccucaccucug

SEQ ID NO: 2228156 - RNA, 12 nt, Human
cucccuccucug

SEQ ID NO: 2228157 - RNA, 15 nt, Human
cucccuccucugucc

SEQ ID NO: 2228158 - RNA, 20 nt, Human
cucccugcaucugaccagca

SEQ ID NO: 2228159 - RNA, 17 nt, Human
cucccuccugccgacuc

SEQ ID NO: 2228160 - RNA, 16 nt, Human
cuccccucagagugca

SEQ ID NO: 2228161 - RNA, 13 nt, Human
cuccccucagagu

SEQ ID NO: 2228162 - RNA, 20 nt, Human
cuccccucacagccucugac

SEQ ID NO: 2228163 - RNA, 14 nt, Human
cuccccgcuucugc

SEQ ID NO: 2228164 - RNA, 18 nt, Human
cuccccgccuguuccccc

SEQ ID NO: 2228165 - RNA, 17 nt, Human
cuccccgccuguucccc

SEQ ID NO: 2228166 - RNA, 19 nt, Human
cuccccucacagccucuga

SEQ ID NO: 2228167 - RNA, 23 nt, Human
cucccccugggcucugccccagc

SEQ ID NO: 2228168 - RNA, 12 nt, Human
cucccccugucc

SEQ ID NO: 2228169 - RNA, 13 nt, Human
cucccccuguccc

SEQ ID NO: 2228170 - RNA, 19 nt, Human
cucccccuguccccucagc

SEQ ID NO: 2228171 - RNA, 11 nt, Human
cucccccuucu

SEQ ID NO: 2228172 - RNA, 13 nt, Human
cucccccuucucc

SEQ ID NO: 2228173 - RNA, 14 nt, Human
cucccccuucuccc

SEQ ID NO: 2228174 - RNA, 14 nt, Human
cuccccgccuguuc

SEQ ID NO: 2228175 - RNA, 15 nt, Human
cuccccgccuguucc

SEQ ID NO: 2228176 - RNA, 16 nt, Human
cuccccgccuguuccc

SEQ ID NO: 2228177 - RNA, 14 nt, Human
cuccccucccuccu

SEQ ID NO: 2228178 - RNA, 15 nt, Human
cuccccuccccugcu

SEQ ID NO: 2228179 - RNA, 16 nt, Human
cuccccuccccugcug

SEQ ID NO: 2228180 - RNA, 17 nt, Human
cuccccuccccugcugc

SEQ ID NO: 2228181 - RNA, 18 nt, Human
cuccccuccccugcugca

SEQ ID NO: 2228182 - RNA, 15 nt, Human
cucccuccucaccuc

SEQ ID NO: 2228183 - RNA, 14 nt, Human
cucccuccucaccu

SEQ ID NO: 2228184 - RNA, 15 nt, Human
cuccccuccaaccug

SEQ ID NO: 2228185 - RNA, 13 nt, Human
cuccccuccccug

SEQ ID NO: 2228186 - RNA, 14 nt, Human
cuccccuccccugc

SEQ ID NO: 2228187 - RNA, 12 nt, Human
cuccagucugcu

SEQ ID NO: 2228188 - RNA, 21 nt, Human
cuccagugagacagcucugca

SEQ ID NO: 2228189 - RNA, 21 nt, Human
cuccagucugcugcccuccau

SEQ ID NO: 2228190 - RNA, 20 nt, Human
cuccagucugcugcccucca

SEQ ID NO: 2228191 - RNA, 17 nt, Human
cuccagucugcugcccu

SEQ ID NO: 2228192 - RNA, 15 nt, Human
cuccagucugcugcc

SEQ ID NO: 2228193 - RNA, 15 nt, Human
cucccacccgaugcu

SEQ ID NO: 2228194 - RNA, 17 nt, Human
cucccacccgaugcugc

SEQ ID NO: 2228195 - RNA, 17 nt, Human
cucccacccggcugcag

SEQ ID NO: 2228196 - RNA, 19 nt, Human
cucccacccggcugcagag

SEQ ID NO: 2228197 - RNA, 18 nt, Human
cucccacccgaugcugcu

SEQ ID NO: 2228198 - RNA, 20 nt, Human
cucccacccgaugcugcuuu

SEQ ID NO: 2228199 - RNA, 21 nt, Human
cucccacccgaugcugcuuuc

SEQ ID NO: 2228200 - RNA, 23 nt, Human
cucccacccgaugcugcuuuccc

SEQ ID NO: 2228201 - RNA, 12 nt, Human
cucccaccucag

SEQ ID NO: 2228202 - RNA, 18 nt, Human
cucccaccuagcagcacc

SEQ ID NO: 2228203 - RNA, 13 nt, Human
cucccccugggcu

SEQ ID NO: 2228204 - RNA, 12 nt, Human
cucccccugggc

SEQ ID NO: 2228205 - RNA, 11 nt, Human
cucccccuggg

SEQ ID NO: 2228206 - RNA, 19 nt, Human
cucccccugccagugccuu

SEQ ID NO: 2228207 - RNA, 18 nt, Human
cucccccugccagugccu

SEQ ID NO: 2228208 - RNA, 17 nt, Human
cucccccugccagugcc

SEQ ID NO: 2228209 - RNA, 16 nt, Human
cucccccugccagugc

SEQ ID NO: 2228210 - RNA, 13 nt, Human
cucccccugccag

SEQ ID NO: 2228211 - RNA, 13 nt, Human
cucccaccucagc

SEQ ID NO: 2228212 - RNA, 16 nt, Human
cuccgccucugcuggc

SEQ ID NO: 2228213 - RNA, 14 nt, Human
cuccgcuggaggug

SEQ ID NO: 2228214 - RNA, 21 nt, Human
cuccgccuucacuccggugug

SEQ ID NO: 2228215 - RNA, 19 nt, Human
cuccgcuuucuacccagcg

SEQ ID NO: 2228216 - RNA, 19 nt, Human
cuccgccuucacuccggug

SEQ ID NO: 2228217 - RNA, 18 nt, Human
cuccgccuucacuccggu

SEQ ID NO: 2228218 - RNA, 15 nt, Human
cuccgccucugcugg

SEQ ID NO: 2228219 - RNA, 15 nt, Human
cuccgccucccgggu

SEQ ID NO: 2228220 - RNA, 19 nt, Human
cuauccacccagcccauuc

SEQ ID NO: 2228221 - RNA, 16 nt, Human
cuauccacccagccca

SEQ ID NO: 2228222 - RNA, 15 nt, Human
cuauccacccagccc

SEQ ID NO: 2228223 - RNA, 14 nt, Human
cuauccacccagcc

SEQ ID NO: 2228224 - RNA, 13 nt, Human
cuauccacccagc

SEQ ID NO: 2228225 - RNA, 12 nt, Human
cuauccacccag

SEQ ID NO: 2228226 - RNA, 13 nt, Human
cucagccucccaa

SEQ ID NO: 2228227 - RNA, 16 nt, Human
cuaucccggcugcccu

SEQ ID NO: 2228228 - RNA, 15 nt, Human
cuaucccggcugccc

SEQ ID NO: 2228229 - RNA, 22 nt, Human
cucagccucccaaagugcuggg

SEQ ID NO: 2228230 - RNA, 13 nt, Human
cucagccucccga

SEQ ID NO: 2228231 - RNA, 20 nt, Human
cucagccuccggaguagcug

SEQ ID NO: 2228232 - RNA, 20 nt, Human
cucagccucccagagugcug

SEQ ID NO: 2228233 - RNA, 13 nt, Human
cucagccucccag

SEQ ID NO: 2228234 - RNA, 23 nt, Human
cucagccucccgaauagcuggga

SEQ ID NO: 2228235 - RNA, 21 nt, Human
cucagccucccaaagugcugg

SEQ ID NO: 2228236 - RNA, 17 nt, Human
cuauccacccagcccau

SEQ ID NO: 2228237 - RNA, 21 nt, Human
cuaucccaauaggcagacugg

SEQ ID NO: 2228238 - RNA, 17 nt, Human
cuaucccggcugcccuu

SEQ ID NO: 2228239 - RNA, 14 nt, Human
cucagccucccaaa

SEQ ID NO: 2228240 - RNA, 16 nt, Human
cucagccucccaaagu

SEQ ID NO: 2228241 - RNA, 14 nt, Human
cucagccuccugag

SEQ ID NO: 2228242 - RNA, 22 nt, Human
cucagccuccugaguagcugga

SEQ ID NO: 2228243 - RNA, 13 nt, Human
cucagccuccuga

SEQ ID NO: 2228244 - RNA, 12 nt, Human
cucagccuccug

SEQ ID NO: 2228245 - RNA, 14 nt, Human
cucagccugugcug

SEQ ID NO: 2228246 - RNA, 13 nt, Human
cucagccugugcu

SEQ ID NO: 2228247 - RNA, 20 nt, Human
cucagccuggugggccuccu

SEQ ID NO: 2228248 - RNA, 19 nt, Human
cucagccuggugggccucc

SEQ ID NO: 2228249 - RNA, 18 nt, Human
cucagccuggugggccuc

SEQ ID NO: 2228250 - RNA, 16 nt, Human
cucagccuggugggcc

SEQ ID NO: 2228251 - RNA, 12 nt, Human
cucagccuggug

SEQ ID NO: 2228252 - RNA, 17 nt, Human
cucagccuccucaucug

SEQ ID NO: 2228253 - RNA, 18 nt, Human
cucagccuccucaucugg

SEQ ID NO: 2228254 - RNA, 22 nt, Human
cucagccuuccccuugcccagg

SEQ ID NO: 2228255 - RNA, 19 nt, Human
cucagccuucagacagaga

SEQ ID NO: 2228256 - RNA, 16 nt, Human
cucagccuucagacag

SEQ ID NO: 2228257 - RNA, 17 nt, Human
cucagccuucagacaga

SEQ ID NO: 2228258 - RNA, 18 nt, Human
cucagccugugcugcccg

SEQ ID NO: 2228259 - RNA, 16 nt, Human
cucagccugugcugcc

SEQ ID NO: 2228260 - RNA, 15 nt, Human
cucagccuccugugu

SEQ ID NO: 2228261 - RNA, 15 nt, Human
cucagccuucagaca

SEQ ID NO: 2228262 - RNA, 23 nt, Human
cucagccuuccccuugcccaggg

SEQ ID NO: 2228263 - RNA, 15 nt, Human
cucagccuugccaga

SEQ ID NO: 2228264 - RNA, 17 nt, Human
cucagccuugccagaga

SEQ ID NO: 2228265 - RNA, 16 nt, Human
cucagccuugccagag

SEQ ID NO: 2228266 - RNA, 21 nt, Human
cucagccuugccagagaucca

SEQ ID NO: 2228267 - RNA, 20 nt, Human
cucagccuugccagagaucc

SEQ ID NO: 2228268 - RNA, 19 nt, Human
cucagccuugccagagauc

SEQ ID NO: 2228269 - RNA, 18 nt, Human
cucagccuugccagagau

SEQ ID NO: 2228270 - RNA, 23 nt, Human
cucaggccaccugcccccuucuc

SEQ ID NO: 2228271 - RNA, 22 nt, Human
cucaggccaccugcccccuucu

SEQ ID NO: 2228272 - RNA, 19 nt, Human
cucaggccaccugcccccu

SEQ ID NO: 2228273 - RNA, 18 nt, Human
cucaggccaccugccccc

SEQ ID NO: 2228274 - RNA, 13 nt, Human
cucaggccagcug

SEQ ID NO: 2228275 - RNA, 15 nt, Human
cucagccuuggauaa

SEQ ID NO: 2228276 - RNA, 11 nt, Human
cucagccuugg

SEQ ID NO: 2228277 - RNA, 22 nt, Human
cucagccuugccagagauccaa

SEQ ID NO: 2228278 - RNA, 14 nt, Human
cucagcgaaugaau

SEQ ID NO: 2228279 - RNA, 16 nt, Human
cucaggccaccugccc

SEQ ID NO: 2228280 - RNA, 13 nt, Human
cucaggccaccug

SEQ ID NO: 2228281 - RNA, 13 nt, Human
cucagcggggaca

SEQ ID NO: 2228282 - RNA, 14 nt, Human
cucaggccagcugc

SEQ ID NO: 2228283 - RNA, 15 nt, Human
cucaggccagcugcu

SEQ ID NO: 2228284 - RNA, 20 nt, Human
cucaggccagcugcuugggc

SEQ ID NO: 2228285 - RNA, 21 nt, Human
cucaggccagcugcuugggcu

SEQ ID NO: 2228286 - RNA, 22 nt, Human
cucaggccagcugcuugggcuu

SEQ ID NO: 2228287 - RNA, 18 nt, Human
cucaggccaggugcagug

SEQ ID NO: 2228288 - RNA, 15 nt, Human
cucaggccaggugca

SEQ ID NO: 2228289 - RNA, 16 nt, Human
cucaggcccaaagccu

SEQ ID NO: 2228290 - RNA, 13 nt, Human
cucaggccugggg

SEQ ID NO: 2228291 - RNA, 14 nt, Human
cucaggccuggggg

SEQ ID NO: 2228292 - RNA, 20 nt, Human
cucaggccugggggcugggc

SEQ ID NO: 2228293 - RNA, 21 nt, Human
cucaggccugggggcugggca

SEQ ID NO: 2228294 - RNA, 15 nt, Human
cuccaaaugagaucu

SEQ ID NO: 2228295 - RNA, 12 nt, Human
cuccaaaugcug

SEQ ID NO: 2228296 - RNA, 22 nt, Human
cuccaacaccaagcacagcagc

SEQ ID NO: 2228297 - RNA, 18 nt, Human
cuccaacaccaagcacag

SEQ ID NO: 2228298 - RNA, 16 nt, Human
cuccaacaccaagcac

SEQ ID NO: 2228299 - RNA, 15 nt, Human
cuccaacaccaagca

SEQ ID NO: 2228300 - RNA, 20 nt, Human
cucauggagaagcagaaaua

SEQ ID NO: 2228301 - RNA, 21 nt, Human
cucauggagaagcagaaauac

SEQ ID NO: 2228302 - RNA, 16 nt, Human
cuccaaagucucugga

SEQ ID NO: 2228303 - RNA, 14 nt, Human
cuccaaccccccag

SEQ ID NO: 2228304 - RNA, 23 nt, Human
cuccaacaccaagcacagcagcc

SEQ ID NO: 2228305 - RNA, 15 nt, Human
cuccaaccccccagc

SEQ ID NO: 2228306 - RNA, 17 nt, Human
cuccaaccccccagcac

SEQ ID NO: 2228307 - RNA, 18 nt, Human
cuccaaccccccagcacu

SEQ ID NO: 2228308 - RNA, 19 nt, Human
cuccaaccccccagcacug

SEQ ID NO: 2228309 - RNA, 20 nt, Human
cuccaaccccccagcacuga

SEQ ID NO: 2228310 - RNA, 21 nt, Human
cuccaaccccccagcacugag

SEQ ID NO: 2228311 - RNA, 22 nt, Human
cuccaaccccccagcacugagg

SEQ ID NO: 2228312 - RNA, 23 nt, Human
cuccaaccccccagcacugagga

SEQ ID NO: 2228313 - RNA, 14 nt, Human
cucaugcugaaagc

SEQ ID NO: 2228314 - RNA, 12 nt, Human
cucaugcugaaa

SEQ ID NO: 2228315 - RNA, 13 nt, Human
cucaugcugaaag

SEQ ID NO: 2228316 - RNA, 20 nt, Human
cucaugccucagccuccuga

SEQ ID NO: 2228317 - RNA, 18 nt, Human
cucaugccucagccuccu

SEQ ID NO: 2228318 - RNA, 21 nt, Human
cucaugccuguaaucccagca

SEQ ID NO: 2228319 - RNA, 15 nt, Human
cucaugcuaauauaa

SEQ ID NO: 2228320 - RNA, 15 nt, Human
cucaugcugaaagcc

SEQ ID NO: 2228321 - RNA, 19 nt, Human
cucauguucuuaauucuua

SEQ ID NO: 2228322 - RNA, 18 nt, Human
cucauguucuuaauucuu

SEQ ID NO: 2228323 - RNA, 14 nt, Human
cucauguucuuaau

SEQ ID NO: 2228324 - RNA, 12 nt, Human
cucauguucuua

SEQ ID NO: 2228325 - RNA, 22 nt, Human
cucagugucauuuaugaaaaga

SEQ ID NO: 2228326 - RNA, 18 nt, Human
cucagugucauuuaugaa

SEQ ID NO: 2228327 - RNA, 17 nt, Human
cucagugucauuuauga

SEQ ID NO: 2228328 - RNA, 14 nt, Human
cucagugucauuua

SEQ ID NO: 2228329 - RNA, 12 nt, Human
cucaguguauuu

SEQ ID NO: 2228330 - RNA, 16 nt, Human
cucaguguauuuguau

SEQ ID NO: 2228331 - RNA, 17 nt, Human
cucaguguauuuguauu

SEQ ID NO: 2228332 - RNA, 20 nt, Human
cucaguggacuuuccacccc

SEQ ID NO: 2228333 - RNA, 19 nt, Human
cucaguggacuuuccaccc

SEQ ID NO: 2228334 - RNA, 16 nt, Human
cucaguggacuuucca

SEQ ID NO: 2228335 - RNA, 22 nt, Human
cucaguggacuuuccacccccu

SEQ ID NO: 2228336 - RNA, 21 nt, Human
cucaguggcuucaucugucaa

SEQ ID NO: 2228337 - RNA, 18 nt, Human
cucaguggcuucaucugu

SEQ ID NO: 2228338 - RNA, 13 nt, Human
cucagugccacua

SEQ ID NO: 2228339 - RNA, 20 nt, Human
cucagucucugagcagugaa

SEQ ID NO: 2228340 - RNA, 14 nt, Human
cucagucucugagc

SEQ ID NO: 2228341 - RNA, 22 nt, Human
cucaucuuucauuaaaggcuuc

SEQ ID NO: 2228342 - RNA, 17 nt, Human
cucaucuucuucaccau

SEQ ID NO: 2228343 - RNA, 12 nt, Human
cucaucuuucuu

SEQ ID NO: 2228344 - RNA, 13 nt, Human
cucaucuuucuug

SEQ ID NO: 2228345 - RNA, 15 nt, Human
cucaucuuucuugau

SEQ ID NO: 2228346 - RNA, 13 nt, Human
cucaugaaucugc

SEQ ID NO: 2228347 - RNA, 21 nt, Human
cucaugaaccucaagcugcau

SEQ ID NO: 2228348 - RNA, 12 nt, Human
cucaugaaccuc

SEQ ID NO: 2228349 - RNA, 18 nt, Human
cucagucuggcccuuccu

SEQ ID NO: 2228350 - RNA, 17 nt, Human
cucagucuggcccuucc

SEQ ID NO: 2228351 - RNA, 13 nt, Human
cucagucucugag

SEQ ID NO: 2228352 - RNA, 15 nt, Human
cucagucucccuuuc

SEQ ID NO: 2228353 - RNA, 19 nt, Human
cuaaagaguuuauuuuaag

SEQ ID NO: 2228354 - RNA, 18 nt, Human
cuaaagaguuuauuuuaa

SEQ ID NO: 2228355 - RNA, 18 nt, Human
cuaaagaggcugaaagag

SEQ ID NO: 2228356 - RNA, 23 nt, Human
cuaaagagcccuugccuccccau

SEQ ID NO: 2228357 - RNA, 19 nt, Human
cuaaagagcccuugccucc

SEQ ID NO: 2228358 - RNA, 20 nt, Human
cuaaagagcccuugccuccc

SEQ ID NO: 2228359 - RNA, 21 nt, Human
cuaaagagcccuugccucccc

SEQ ID NO: 2228360 - RNA, 22 nt, Human
cuaaagagcccuugccucccca

SEQ ID NO: 2228361 - RNA, 17 nt, Human
cuaaccuggguucccuu

SEQ ID NO: 2228362 - RNA, 12 nt, Human
cuaaccugugac

SEQ ID NO: 2228363 - RNA, 15 nt, Human
cuaacuucaccauau

SEQ ID NO: 2228364 - RNA, 23 nt, Human
cuaagaaaagauacgacuuuauu

SEQ ID NO: 2228365 - RNA, 15 nt, Human
cuaagaaaagauuuu

SEQ ID NO: 2228366 - RNA, 14 nt, Human
cuaagaaaagauuu

SEQ ID NO: 2228367 - RNA, 22 nt, Human
cuaagaaaagauacgacuuuau

SEQ ID NO: 2228368 - RNA, 16 nt, Human
cuaacuuuccuucauu

SEQ ID NO: 2228369 - RNA, 16 nt, Human
cuaacuucaccauauu

SEQ ID NO: 2228370 - RNA, 20 nt, Human
cuaagaaaagauuuuaauca

SEQ ID NO: 2228371 - RNA, 21 nt, Human
cuaagaaaagauuuuaaucaa

SEQ ID NO: 2228372 - RNA, 16 nt, Human
cuaagaaagaggagug

SEQ ID NO: 2228373 - RNA, 19 nt, Human
cuaagaaagaggagugcuu

SEQ ID NO: 2228374 - RNA, 23 nt, Human
cggcuccugugcuuucccugaac

SEQ ID NO: 2228375 - RNA, 18 nt, Human
cggcucuagguggggcgg

SEQ ID NO: 2228376 - RNA, 16 nt, Human
cggcucuuuccuugcu

SEQ ID NO: 2228377 - RNA, 23 nt, Human
cggcucucuauagcaccagggcu

SEQ ID NO: 2228378 - RNA, 18 nt, Human
cggcucuuuccuugcuca

SEQ ID NO: 2228379 - RNA, 11 nt, Human
cggcugaccau

SEQ ID NO: 2228380 - RNA, 14 nt, Human
cggcugaccaugcu

SEQ ID NO: 2228381 - RNA, 15 nt, Human
cggcugaccaugcuc

SEQ ID NO: 2228382 - RNA, 16 nt, Human
cggcugaccaugcuca

SEQ ID NO: 2228383 - RNA, 22 nt, Human
cggcugaccaugcucaucugcu

SEQ ID NO: 2228384 - RNA, 23 nt, Human
cggcugaccaugcucaucugcug

SEQ ID NO: 2228385 - RNA, 11 nt, Human
cggcugagagc

SEQ ID NO: 2228386 - RNA, 14 nt, Human
cggcugagagcccc

SEQ ID NO: 2228387 - RNA, 19 nt, Human
cggcugagagccccagcug

SEQ ID NO: 2228388 - RNA, 20 nt, Human
cggcugagagccccagcuga

SEQ ID NO: 2228389 - RNA, 15 nt, Human
cggcugagagcccca

SEQ ID NO: 2228390 - RNA, 16 nt, Human
cggcugagagccccag

SEQ ID NO: 2228391 - RNA, 17 nt, Human
cggcugagagccccagc

SEQ ID NO: 2228392 - RNA, 18 nt, Human
cggcugagagccccagcu

SEQ ID NO: 2228393 - RNA, 16 nt, Human
cgugacagugccuggg

SEQ ID NO: 2228394 - RNA, 18 nt, Human
cgugacagacuccugagg

SEQ ID NO: 2228395 - RNA, 13 nt, Human
cgugacucaccca

SEQ ID NO: 2228396 - RNA, 20 nt, Human
cgugacgcugaauaaauguc

SEQ ID NO: 2228397 - RNA, 14 nt, Human
cgugacgcugaaua

SEQ ID NO: 2228398 - RNA, 16 nt, Human
cgugacgcugaauaaa

SEQ ID NO: 2228399 - RNA, 19 nt, Human
cgugacgcugaauaaaugu

SEQ ID NO: 2228400 - RNA, 18 nt, Human
cgugacauccccacccuu

SEQ ID NO: 2228401 - RNA, 17 nt, Human
cgugacagugccuggga

SEQ ID NO: 2228402 - RNA, 23 nt, Human
cgugaccaacuagacauucuguc

SEQ ID NO: 2228403 - RNA, 20 nt, Human
cgugaccggacuuuucugca

SEQ ID NO: 2228404 - RNA, 22 nt, Human
cgugggucuucagggggccagg

SEQ ID NO: 2228405 - RNA, 15 nt, Human
cguggucaagcacuc

SEQ ID NO: 2228406 - RNA, 15 nt, Human
cguggucacugcugu

SEQ ID NO: 2228407 - RNA, 16 nt, Human
cguggucacugcuguc

SEQ ID NO: 2228408 - RNA, 17 nt, Human
cguggucacugcuguca

SEQ ID NO: 2228409 - RNA, 21 nt, Human
cgugguccccaacagcgacau

SEQ ID NO: 2228410 - RNA, 18 nt, Human
cgugggucuguuuuccuu

SEQ ID NO: 2228411 - RNA, 19 nt, Human
cgugggucuguuuuccuuu

SEQ ID NO: 2228412 - RNA, 20 nt, Human
cgugggucuguuuuccuuuc

SEQ ID NO: 2228413 - RNA, 23 nt, Human
cguggguguguguagccaagguc

SEQ ID NO: 2228414 - RNA, 20 nt, Human
cguggggcagcacagagagg

SEQ ID NO: 2228415 - RNA, 14 nt, Human
cgugagccaccgcg

SEQ ID NO: 2228416 - RNA, 23 nt, Human
cgugagacgccaccauuccugga

SEQ ID NO: 2228417 - RNA, 15 nt, Human
cguggggugugcugg

SEQ ID NO: 2228418 - RNA, 17 nt, Human
cguggggugugcuggga

SEQ ID NO: 2228419 - RNA, 18 nt, Human
cguggggugugcugggag

SEQ ID NO: 2228420 - RNA, 17 nt, Human
cgugacugccccaacuc

SEQ ID NO: 2228421 - RNA, 16 nt, Human
cgugacugccccaacu

SEQ ID NO: 2228422 - RNA, 13 nt, Human
cgugacugcccca

SEQ ID NO: 2228423 - RNA, 18 nt, Human
cgugacucacccaagcau

SEQ ID NO: 2228424 - RNA, 17 nt, Human
cgugacucacccaagca

SEQ ID NO: 2228425 - RNA, 16 nt, Human
cgugacucacccaagc

SEQ ID NO: 2228426 - RNA, 15 nt, Human
cgugacucacccaag

SEQ ID NO: 2228427 - RNA, 14 nt, Human
cgugacucacccaa

SEQ ID NO: 2228428 - RNA, 23 nt, Human
cgugacugccccaacuccuggaa

SEQ ID NO: 2228429 - RNA, 22 nt, Human
cgugacugccccaacuccugga

SEQ ID NO: 2228430 - RNA, 21 nt, Human
cgugacugccccaacuccugg

SEQ ID NO: 2228431 - RNA, 20 nt, Human
cgugacugccccaacuccug

SEQ ID NO: 2228432 - RNA, 13 nt, Human
cgugagaccugcc

SEQ ID NO: 2228433 - RNA, 23 nt, Human
cgugagagugucuucacggcagg

SEQ ID NO: 2228434 - RNA, 21 nt, Human
cgugagacgccaccauuccug

SEQ ID NO: 2228435 - RNA, 23 nt, Human
cgugagccaccgugccuggccac

SEQ ID NO: 2228436 - RNA, 16 nt, Human
cgugagaccugccccu

SEQ ID NO: 2228437 - RNA, 14 nt, Human
cgugagaccugccc

SEQ ID NO: 2228438 - RNA, 13 nt, Human
cuaaacuuucaca

SEQ ID NO: 2228439 - RNA, 14 nt, Human
cuaaacuuucacac

SEQ ID NO: 2228440 - RNA, 15 nt, Human
cuaaagagcccuugc

SEQ ID NO: 2228441 - RNA, 16 nt, Human
cuaaagagcccuugcc

SEQ ID NO: 2228442 - RNA, 17 nt, Human
cuaaagagcccuugccu

SEQ ID NO: 2228443 - RNA, 18 nt, Human
cuaaagagcccuugccuc

SEQ ID NO: 2228444 - RNA, 18 nt, Human
cgugugcacacacaccac

SEQ ID NO: 2228445 - RNA, 18 nt, Human
cgugugauuuuucuggag

SEQ ID NO: 2228446 - RNA, 23 nt, Human
cuaaacugcccccucugcccugc

SEQ ID NO: 2228447 - RNA, 20 nt, Human
cuaaacuuccccaucuucua

SEQ ID NO: 2228448 - RNA, 16 nt, Human
cuaaacuuccccaucu

SEQ ID NO: 2228449 - RNA, 22 nt, Human
cgugucuguauuuaugugugag

SEQ ID NO: 2228450 - RNA, 21 nt, Human
cgugugagaagugaaugcugg

SEQ ID NO: 2228451 - RNA, 23 nt, Human
cgugugagaagugaaugcuggga

SEQ ID NO: 2228452 - RNA, 22 nt, Human
cuaaacugcccccucugcccug

SEQ ID NO: 2228453 - RNA, 22 nt, Human
cgugugagaagugaaugcuggg

SEQ ID NO: 2228454 - RNA, 11 nt, Human
cgugugauuuu

SEQ ID NO: 2228455 - RNA, 15 nt, Human
cgugugauuuuucug

SEQ ID NO: 2228456 - RNA, 14 nt, Human
cgugucuguauuua

SEQ ID NO: 2228457 - RNA, 21 nt, Human
cguggugaucaauuaaaugua

SEQ ID NO: 2228458 - RNA, 17 nt, Human
cuaauuuuuaagcaaaa

SEQ ID NO: 2228459 - RNA, 17 nt, Human
cuaauuuuuauucauaa

SEQ ID NO: 2228460 - RNA, 20 nt, Human
cuaauuuuuguaauuuuagu

SEQ ID NO: 2228461 - RNA, 14 nt, Human
cuaauuuuuguaau

SEQ ID NO: 2228462 - RNA, 23 nt, Human
cuacaaaaaauuagaaauuggcu

SEQ ID NO: 2228463 - RNA, 21 nt, Human
cuacaaacaaaauuucuauua

SEQ ID NO: 2228464 - RNA, 20 nt, Human
cuaauuuuuguauuuuucgu

SEQ ID NO: 2228465 - RNA, 10 nt, Human
cuacaaauca

SEQ ID NO: 2228466 - RNA, 19 nt, Human
cuacaaagaagacauguuu

SEQ ID NO: 2228467 - RNA, 20 nt, Human
cuacaaagaagacauguuuu

SEQ ID NO: 2228468 - RNA, 14 nt, Human
cuacaaagaagaca

SEQ ID NO: 2228469 - RNA, 15 nt, Human
cuacaaagaagacau

SEQ ID NO: 2228470 - RNA, 16 nt, Human
cuacaaagaagacaug

SEQ ID NO: 2228471 - RNA, 18 nt, Human
cuacaaagaagacauguu

SEQ ID NO: 2228472 - RNA, 14 nt, Human
cuacaacugagucc

SEQ ID NO: 2228473 - RNA, 20 nt, Human
cuacaaccaagcucucugca

SEQ ID NO: 2228474 - RNA, 14 nt, Human
cuacaacuucagca

SEQ ID NO: 2228475 - RNA, 13 nt, Human
cuacaaccaagcu

SEQ ID NO: 2228476 - RNA, 18 nt, Human
cuacaaccaagcucucug

SEQ ID NO: 2228477 - RNA, 16 nt, Human
cuacaacaagaguuua

SEQ ID NO: 2228478 - RNA, 19 nt, Human
cuaauuggccucuuuaaga

SEQ ID NO: 2228479 - RNA, 13 nt, Human
cuaauuguauaac

SEQ ID NO: 2228480 - RNA, 15 nt, Human
cuaauuguauaacag

SEQ ID NO: 2228481 - RNA, 16 nt, Human
cuaauuguauaacagg

SEQ ID NO: 2228482 - RNA, 17 nt, Human
cuaauuguauaacaggu

SEQ ID NO: 2228483 - RNA, 18 nt, Human
cuaauuguauaacagguu

SEQ ID NO: 2228484 - RNA, 14 nt, Human
cuaauuuaaaaaau

SEQ ID NO: 2228485 - RNA, 19 nt, Human
cuaauuguauaacagguua

SEQ ID NO: 2228486 - RNA, 20 nt, Human
cuaauuguauaacagguuau

SEQ ID NO: 2228487 - RNA, 22 nt, Human
cuaauuguauaacagguuauuu

SEQ ID NO: 2228488 - RNA, 12 nt, Human
cuaauuuaaaaa

SEQ ID NO: 2228489 - RNA, 22 nt, Human
cuaauuggcaugaaggugucau

SEQ ID NO: 2228490 - RNA, 21 nt, Human
cuaauuggaagaaauuccugu

SEQ ID NO: 2228491 - RNA, 22 nt, Human
cuaauuggaagaaauuccugua

SEQ ID NO: 2228492 - RNA, 19 nt, Human
cuaauuggaagaaauuccu

SEQ ID NO: 2228493 - RNA, 14 nt, Human
cuaagugauauaaa

SEQ ID NO: 2228494 - RNA, 16 nt, Human
cuaagugauauaaauc

SEQ ID NO: 2228495 - RNA, 14 nt, Human
cuaagugaaaaggu

SEQ ID NO: 2228496 - RNA, 16 nt, Human
cuaagucuuuccauug

SEQ ID NO: 2228497 - RNA, 13 nt, Human
cuaagugauauaa

SEQ ID NO: 2228498 - RNA, 18 nt, Human
cuaagugaggaugaaaaa

SEQ ID NO: 2228499 - RNA, 20 nt, Human
cuaagugauccucccaccuc

SEQ ID NO: 2228500 - RNA, 22 nt, Human
cuaagugauccucccaccucag

SEQ ID NO: 2228501 - RNA, 20 nt, Human
cuacaguguacagucuugua

SEQ ID NO: 2228502 - RNA, 23 nt, Human
cuacaguuaggguugaguuacuu

SEQ ID NO: 2228503 - RNA, 13 nt, Human
cuacaguugaaaa

SEQ ID NO: 2228504 - RNA, 15 nt, Human
cuacaguguacaguc

SEQ ID NO: 2228505 - RNA, 14 nt, Human
cuacaguguacagu

SEQ ID NO: 2228506 - RNA, 16 nt, Human
cuacaacuucagcagu

SEQ ID NO: 2228507 - RNA, 17 nt, Human
cuacaacuucagcagua

SEQ ID NO: 2228508 - RNA, 16 nt, Human
cuacaguguacagucu

SEQ ID NO: 2228509 - RNA, 17 nt, Human
cuacaguguacagucuu

SEQ ID NO: 2228510 - RNA, 15 nt, Human
cuacaguccucccau

SEQ ID NO: 2228511 - RNA, 16 nt, Human
cuacaguccucccauc

SEQ ID NO: 2228512 - RNA, 17 nt, Human
cuacaguccucccaucu

SEQ ID NO: 2228513 - RNA, 18 nt, Human
cuacaguccucccaucuc

SEQ ID NO: 2228514 - RNA, 18 nt, Human
cuacauacaauuccaaac

SEQ ID NO: 2228515 - RNA, 20 nt, Human
cuacauaaacugacuuuauc

SEQ ID NO: 2228516 - RNA, 14 nt, Human
cuacaugaaacaga

SEQ ID NO: 2228517 - RNA, 23 nt, Human
cuacauaaguaauucaagaaaac

SEQ ID NO: 2228518 - RNA, 12 nt, Human
cuacauaaacug

SEQ ID NO: 2228519 - RNA, 15 nt, Human
cuacauaaacugacu

SEQ ID NO: 2228520 - RNA, 22 nt, Human
cuacauaaguaauucaagaaaa

SEQ ID NO: 2228521 - RNA, 17 nt, Human
cuacauaaacugacuuu

SEQ ID NO: 2228522 - RNA, 18 nt, Human
cuacauaaacugacuuua

SEQ ID NO: 2228523 - RNA, 22 nt, Human
cuacauaaacugacuuuauccu

SEQ ID NO: 2228524 - RNA, 17 nt, Human
cuacaugagaacaaaca

SEQ ID NO: 2228525 - RNA, 14 nt, Human
cuacaugagaacaa

SEQ ID NO: 2228526 - RNA, 15 nt, Human
cuacaugagguacug

SEQ ID NO: 2228527 - RNA, 13 nt, Human
cuacaugagaaca

SEQ ID NO: 2228528 - RNA, 18 nt, Human
cuacaugaaacagaaaca

SEQ ID NO: 2228529 - RNA, 16 nt, Human
cuacaugaaacagaaa

SEQ ID NO: 2228530 - RNA, 15 nt, Human
cuacaugaaacagaa

SEQ ID NO: 2228531 - RNA, 23 nt, Human
cuaagugaaauaagccagacauc

SEQ ID NO: 2228532 - RNA, 20 nt, Human
cuaagugaaauaagccagac

SEQ ID NO: 2228533 - RNA, 14 nt, Human
cuaagucuuuccau

SEQ ID NO: 2228534 - RNA, 17 nt, Human
cuauaaaguaaagcuaa

SEQ ID NO: 2228535 - RNA, 23 nt, Human
cuauaaaugguguuuuuuuaaua

SEQ ID NO: 2228536 - RNA, 16 nt, Human
cuauaaaugguguuuu

SEQ ID NO: 2228537 - RNA, 18 nt, Human
cuauaaaugguguuuuuu

SEQ ID NO: 2228538 - RNA, 17 nt, Human
cuauaaauuccucuuug

SEQ ID NO: 2228539 - RNA, 15 nt, Human
cuauaaauuccucuu

SEQ ID NO: 2228540 - RNA, 18 nt, Human
cuauaaccccagcucccu

SEQ ID NO: 2228541 - RNA, 22 nt, Human
cuauaaauuccucuuugcuuug

SEQ ID NO: 2228542 - RNA, 19 nt, Human
cuauaaauuccucuuugcu

SEQ ID NO: 2228543 - RNA, 23 nt, Human
cuauaaauuccucuuugcuuugc

SEQ ID NO: 2228544 - RNA, 22 nt, Human
cuaguucuuuguucauagccca

SEQ ID NO: 2228545 - RNA, 23 nt, Human
cuaguugaucagcuuauugucua

SEQ ID NO: 2228546 - RNA, 22 nt, Human
cuaguuccaccaucaagccacc

SEQ ID NO: 2228547 - RNA, 17 nt, Human
cuaguucuguagaaaug

SEQ ID NO: 2228548 - RNA, 23 nt, Human
cuaguucuguagaaaugguugua

SEQ ID NO: 2228549 - RNA, 16 nt, Human
cuaguucuguagaaau

SEQ ID NO: 2228550 - RNA, 22 nt, Human
cuauaaccccagcucccuagga

SEQ ID NO: 2228551 - RNA, 13 nt, Human
cuagccucuccag

SEQ ID NO: 2228552 - RNA, 21 nt, Human
cuaggcuuaauaccuggguga

SEQ ID NO: 2228553 - RNA, 20 nt, Human
cuaggcuggagcccagggag

SEQ ID NO: 2228554 - RNA, 11 nt, Human
cuaggcugggg

SEQ ID NO: 2228555 - RNA, 17 nt, Human
cuaggcuggagcccagg

SEQ ID NO: 2228556 - RNA, 19 nt, Human
cuagggaaaaaccagcgug

SEQ ID NO: 2228557 - RNA, 20 nt, Human
cuagccgaccucagccuucc

SEQ ID NO: 2228558 - RNA, 19 nt, Human
cuagccgaccucagccuuc

SEQ ID NO: 2228559 - RNA, 18 nt, Human
cuagccgaccucagccuu

SEQ ID NO: 2228560 - RNA, 17 nt, Human
cuagccgaccucagccu

SEQ ID NO: 2228561 - RNA, 16 nt, Human
cuagccgaccucagcc

SEQ ID NO: 2228562 - RNA, 15 nt, Human
cuagccgaccucagc

SEQ ID NO: 2228563 - RNA, 14 nt, Human
cuagccgaccucag

SEQ ID NO: 2228564 - RNA, 13 nt, Human
cuagccgaccuca

SEQ ID NO: 2228565 - RNA, 19 nt, Human
cuagcccucucacauuuau

SEQ ID NO: 2228566 - RNA, 18 nt, Human
cuagcccucucacauuua

SEQ ID NO: 2228567 - RNA, 13 nt, Human
cuagcccucucac

SEQ ID NO: 2228568 - RNA, 16 nt, Human
cuagcccgaauacaaa

SEQ ID NO: 2228569 - RNA, 22 nt, Human
cuagcccauggacuucacauaa

SEQ ID NO: 2228570 - RNA, 14 nt, Human
cuagccccugugga

SEQ ID NO: 2228571 - RNA, 20 nt, Human
cuagccccuguggagacugg

SEQ ID NO: 2228572 - RNA, 21 nt, Human
cuagccccuguggagacuggg

SEQ ID NO: 2228573 - RNA, 16 nt, Human
cuagggauucaggcug

SEQ ID NO: 2228574 - RNA, 15 nt, Human
cuagggauucaggcu

SEQ ID NO: 2228575 - RNA, 19 nt, Human
cuagggauguucuggcccu

SEQ ID NO: 2228576 - RNA, 16 nt, Human
cuagggaguggucuuu

SEQ ID NO: 2228577 - RNA, 23 nt, Human
cuagggaucccucaucugucccu

SEQ ID NO: 2228578 - RNA, 18 nt, Human
cuagggauucaggcugcu

SEQ ID NO: 2228579 - RNA, 17 nt, Human
cuagggauucaggcugc

SEQ ID NO: 2228580 - RNA, 20 nt, Human
cuagggauucaggcugcuug

SEQ ID NO: 2228581 - RNA, 16 nt, Human
cuagggccaagcccag

SEQ ID NO: 2228582 - RNA, 23 nt, Human
cuaggcuucagcauauuuauagc

SEQ ID NO: 2228583 - RNA, 21 nt, Human
cuaggcuucagcauauuuaua

SEQ ID NO: 2228584 - RNA, 13 nt, Human
cuaggcuggggaa

SEQ ID NO: 2228585 - RNA, 22 nt, Human
cuaggcuggggaaguccucugg

SEQ ID NO: 2228586 - RNA, 17 nt, Human
cuagggaucccucaucu

SEQ ID NO: 2228587 - RNA, 13 nt, Human
cuagggaucccuc

SEQ ID NO: 2228588 - RNA, 21 nt, Human
cuagggaaaaaccagcgugug

SEQ ID NO: 2228589 - RNA, 15 nt, Human
cuagggccacugaag

SEQ ID NO: 2228590 - RNA, 19 nt, Human
cuaggggacacuucccucu

SEQ ID NO: 2228591 - RNA, 12 nt, Human
cuaggggagcag

SEQ ID NO: 2228592 - RNA, 17 nt, Human
cuaggggagcagggggc

SEQ ID NO: 2228593 - RNA, 15 nt, Human
cuagggccuggguuu

SEQ ID NO: 2228594 - RNA, 18 nt, Human
cuagggccaagcccagca

SEQ ID NO: 2228595 - RNA, 17 nt, Human
cuagggccaagcccagc

SEQ ID NO: 2228596 - RNA, 18 nt, Human
cuaguuccaccaucaagc

SEQ ID NO: 2228597 - RNA, 20 nt, Human
cuaguuccaccaucaagcca

SEQ ID NO: 2228598 - RNA, 23 nt, Human
cuagaaaugauccccagcuguuu

SEQ ID NO: 2228599 - RNA, 20 nt, Human
cuagaaauugacacaagugg

SEQ ID NO: 2228600 - RNA, 16 nt, Human
cuagaaauugacacaa

SEQ ID NO: 2228601 - RNA, 23 nt, Human
cuagaaauuuuucagaugcuucu

SEQ ID NO: 2228602 - RNA, 13 nt, Human
cuagaaauuuuuc

SEQ ID NO: 2228603 - RNA, 19 nt, Human
cuagaacacaggcaaaauc

SEQ ID NO: 2228604 - RNA, 14 nt, Human
cuagaacacaggca

SEQ ID NO: 2228605 - RNA, 19 nt, Human
cuagaaauuccccacccug

SEQ ID NO: 2228606 - RNA, 18 nt, Human
cuagaacucuccaucuua

SEQ ID NO: 2228607 - RNA, 22 nt, Human
cuagaacacaggcaaaauccuu

SEQ ID NO: 2228608 - RNA, 21 nt, Human
cuagaacacaggcaaaauccu

SEQ ID NO: 2228609 - RNA, 22 nt, Human
cuagcagcagggagggcuucug

SEQ ID NO: 2228610 - RNA, 12 nt, Human
cuagcagcaggg

SEQ ID NO: 2228611 - RNA, 19 nt, Human
cuagaacucccuuucaaca

SEQ ID NO: 2228612 - RNA, 18 nt, Human
cuagaacucccuuucaac

SEQ ID NO: 2228613 - RNA, 17 nt, Human
cuagaacucccuuucaa

SEQ ID NO: 2228614 - RNA, 16 nt, Human
cuagaacucccuuuca

SEQ ID NO: 2228615 - RNA, 23 nt, Human
cuagcagcagggagggcuucugc

SEQ ID NO: 2228616 - RNA, 20 nt, Human
cuagaagaugaauacaaaca

SEQ ID NO: 2228617 - RNA, 22 nt, Human
cuagcagugaugaaaaugaauc

SEQ ID NO: 2228618 - RNA, 16 nt, Human
cuagaacacagaaagc

SEQ ID NO: 2228619 - RNA, 15 nt, Human
cuagaagaugaauac

SEQ ID NO: 2228620 - RNA, 17 nt, Human
cuagcauggcugccaau

SEQ ID NO: 2228621 - RNA, 18 nt, Human
cuagccaccgccuccuac

SEQ ID NO: 2228622 - RNA, 23 nt, Human
cuagccaaaugguuuaacuucug

SEQ ID NO: 2228623 - RNA, 13 nt, Human
cuagccccugugg

SEQ ID NO: 2228624 - RNA, 14 nt, Human
cuagcccauggacu

SEQ ID NO: 2228625 - RNA, 19 nt, Human
cuagcccauggacuucaca

SEQ ID NO: 2228626 - RNA, 19 nt, Human
cuagcccaggagagagaaa

SEQ ID NO: 2228627 - RNA, 20 nt, Human
cuagcccaggagagagaaag

SEQ ID NO: 2228628 - RNA, 22 nt, Human
cuagcccaggagagagaaagcc

SEQ ID NO: 2228629 - RNA, 23 nt, Human
cuagcccaggagagagaaagcca

SEQ ID NO: 2228630 - RNA, 22 nt, Human
cuagccaccaacucuugcaggu

SEQ ID NO: 2228631 - RNA, 15 nt, Human
cuagccaccaacucu

SEQ ID NO: 2228632 - RNA, 21 nt, Human
cuagccaccaacucuugcagg

SEQ ID NO: 2228633 - RNA, 15 nt, Human
cuagcccaggagaga

SEQ ID NO: 2228634 - RNA, 16 nt, Human
cuagcccaggagagag

SEQ ID NO: 2228635 - RNA, 17 nt, Human
cuagcccaggagagaga

SEQ ID NO: 2228636 - RNA, 18 nt, Human
cuagcccaggagagagaa

SEQ ID NO: 2228637 - RNA, 15 nt, Human
cuaccugaggggccu

SEQ ID NO: 2228638 - RNA, 20 nt, Human
cuaccugacacucccuuggg

SEQ ID NO: 2228639 - RNA, 19 nt, Human
cuaccugacacucccuugg

SEQ ID NO: 2228640 - RNA, 11 nt, Human
cuaccugaggg

SEQ ID NO: 2228641 - RNA, 14 nt, Human
cuaccugaggggcc

SEQ ID NO: 2228642 - RNA, 19 nt, Human
cggcggagcuggccccgcc

SEQ ID NO: 2228643 - RNA, 21 nt, Human
cggcggagcuggccccgccgc

SEQ ID NO: 2228644 - RNA, 13 nt, Human
cggcggagcuggc

SEQ ID NO: 2228645 - RNA, 20 nt, Human
cggcgcgguggcucacgccu

SEQ ID NO: 2228646 - RNA, 13 nt, Human
cggcgcgguggcu

SEQ ID NO: 2228647 - RNA, 17 nt, Human
cggcgcccucuguccug

SEQ ID NO: 2228648 - RNA, 18 nt, Human
cggcgcccucuguccuga

SEQ ID NO: 2228649 - RNA, 18 nt, Human
cggcgccccugccaccuc

SEQ ID NO: 2228650 - RNA, 15 nt, Human
cggcgccaccauccu

SEQ ID NO: 2228651 - RNA, 17 nt, Human
cggcgccaccauccugc

SEQ ID NO: 2228652 - RNA, 13 nt, Human
cggcgccaccauc

SEQ ID NO: 2228653 - RNA, 16 nt, Human
cggaguccacucccag

SEQ ID NO: 2228654 - RNA, 20 nt, Human
cggaguccacucccagugcu

SEQ ID NO: 2228655 - RNA, 14 nt, Human
cggagucccaccuu

SEQ ID NO: 2228656 - RNA, 16 nt, Human
cggaggggccuggcag

SEQ ID NO: 2228657 - RNA, 18 nt, Human
cggaggggccuggcagcc

SEQ ID NO: 2228658 - RNA, 21 nt, Human
cggagccucauccgaggcagg

SEQ ID NO: 2228659 - RNA, 20 nt, Human
cggagccucauccgaggcag

SEQ ID NO: 2228660 - RNA, 22 nt, Human
cggagccucauccgaggcaggg

SEQ ID NO: 2228661 - RNA, 20 nt, Human
cggagccgggaaagaagagc

SEQ ID NO: 2228662 - RNA, 18 nt, Human
cggagcuaacacuggccc

SEQ ID NO: 2228663 - RNA, 17 nt, Human
cggagcuaacacuggcc

SEQ ID NO: 2228664 - RNA, 13 nt, Human
cggagguugcagg

SEQ ID NO: 2228665 - RNA, 16 nt, Human
cggagguguggagccg

SEQ ID NO: 2228666 - RNA, 18 nt, Human
cggaguaucugggaacug

SEQ ID NO: 2228667 - RNA, 15 nt, Human
cggagucagugccag

SEQ ID NO: 2228668 - RNA, 19 nt, Human
cggagucagugccaggucc

SEQ ID NO: 2228669 - RNA, 22 nt, Human
cggagguugggugggccggcuu

SEQ ID NO: 2228670 - RNA, 13 nt, Human
cggcuccugugcu

SEQ ID NO: 2228671 - RNA, 14 nt, Human
cggcuccugcugca

SEQ ID NO: 2228672 - RNA, 15 nt, Human
cggcuccugcugcac

SEQ ID NO: 2228673 - RNA, 17 nt, Human
cggcuccugcugcacca

SEQ ID NO: 2228674 - RNA, 23 nt, Human
cggcuccugcugcaccaacccag

SEQ ID NO: 2228675 - RNA, 20 nt, Human
cggcucgagcaguccugccu

SEQ ID NO: 2228676 - RNA, 14 nt, Human
cggcuccugugcuu

SEQ ID NO: 2228677 - RNA, 20 nt, Human
cggcucggaggaagccccca

SEQ ID NO: 2228678 - RNA, 16 nt, Human
cggcucggaggaagcc

SEQ ID NO: 2228679 - RNA, 12 nt, Human
cggcuccugcug

SEQ ID NO: 2228680 - RNA, 19 nt, Human
cggcuccucggacucugcu

SEQ ID NO: 2228681 - RNA, 13 nt, Human
cggcuccugcugc

SEQ ID NO: 2228682 - RNA, 21 nt, Human
cggcucacugcauccuccgcc

SEQ ID NO: 2228683 - RNA, 15 nt, Human
cggcucccuggagcc

SEQ ID NO: 2228684 - RNA, 19 nt, Human
cggcucacugcagccucaa

SEQ ID NO: 2228685 - RNA, 17 nt, Human
cggcucacugcauccuc

SEQ ID NO: 2228686 - RNA, 18 nt, Human
cggcucacugcagccuca

SEQ ID NO: 2228687 - RNA, 20 nt, Human
cggcgcuugccacuagggcu

SEQ ID NO: 2228688 - RNA, 12 nt, Human
cggcggcgccgg

SEQ ID NO: 2228689 - RNA, 11 nt, Human
cggagccacuc

SEQ ID NO: 2228690 - RNA, 17 nt, Human
cggagccacuccucuga

SEQ ID NO: 2228691 - RNA, 13 nt, Human
cggagccacuccu

SEQ ID NO: 2228692 - RNA, 21 nt, Human
cggagccacuccucugacuca

SEQ ID NO: 2228693 - RNA, 18 nt, Human
cggagccacuccucugac

SEQ ID NO: 2228694 - RNA, 12 nt, Human
cggagccccagg

SEQ ID NO: 2228695 - RNA, 14 nt, Human
cggagccccaggcc

SEQ ID NO: 2228696 - RNA, 22 nt, Human
cggagccccaggccucuguguc

SEQ ID NO: 2228697 - RNA, 19 nt, Human
cggagauuggacggccuga

SEQ ID NO: 2228698 - RNA, 16 nt, Human
cggagcaaacucugcu

SEQ ID NO: 2228699 - RNA, 17 nt, Human
cggagcaaacucugcug

SEQ ID NO: 2228700 - RNA, 22 nt, Human
cgccuccccgaaacaggcuacu

SEQ ID NO: 2228701 - RNA, 14 nt, Human
cgccucgcccaccg

SEQ ID NO: 2228702 - RNA, 13 nt, Human
cgccucgcccacc

SEQ ID NO: 2228703 - RNA, 15 nt, Human
cgccucccagccugg

SEQ ID NO: 2228704 - RNA, 22 nt, Human
cgccgugaguucucagggcucc

SEQ ID NO: 2228705 - RNA, 16 nt, Human
cgccuccccugcccca

SEQ ID NO: 2228706 - RNA, 24 nt, Human
cgccuccccacggccgcuccaggg

SEQ ID NO: 2228707 - RNA, 10 nt, Human
cgccuccccg

SEQ ID NO: 2228708 - RNA, 13 nt, Human
cgccucucccguc

SEQ ID NO: 2228709 - RNA, 15 nt, Human
cgccucucccgucag

SEQ ID NO: 2228710 - RNA, 21 nt, Human
cgccucucccgucagggccca

SEQ ID NO: 2228711 - RNA, 15 nt, Human
cgccucgcccaccgc

SEQ ID NO: 2228712 - RNA, 16 nt, Human
cgccucgcccaccgca

SEQ ID NO: 2228713 - RNA, 19 nt, Human
cgccucgcccaccgcaugc

SEQ ID NO: 2228714 - RNA, 22 nt, Human
cgccucgcccaccgcaugcccc

SEQ ID NO: 2228715 - RNA, 22 nt, Human
cgccucugcaagggcagaacac

SEQ ID NO: 2228716 - RNA, 22 nt, Human
cgagugugaagcuuccuuggcu

SEQ ID NO: 2228717 - RNA, 18 nt, Human
cgagugugugcaugugug

SEQ ID NO: 2228718 - RNA, 11 nt, Human
cgagugugugc

SEQ ID NO: 2228719 - RNA, 19 nt, Human
cgagugugugcaugugugu

SEQ ID NO: 2228720 - RNA, 15 nt, Human
cgagugcucauuuca

SEQ ID NO: 2228721 - RNA, 17 nt, Human
cgaguuacagacaaagc

SEQ ID NO: 2228722 - RNA, 18 nt, Human
cgaguuacagacaaagcg

SEQ ID NO: 2228723 - RNA, 13 nt, Human
cgaguagcuggga

SEQ ID NO: 2228724 - RNA, 14 nt, Human
cgaguagcugggac

SEQ ID NO: 2228725 - RNA, 15 nt, Human
cgaguagcugggacu

SEQ ID NO: 2228726 - RNA, 16 nt, Human
cgaguagcugggacua

SEQ ID NO: 2228727 - RNA, 19 nt, Human
cgccgcaaaccacacugga

SEQ ID NO: 2228728 - RNA, 20 nt, Human
cgccgcaaaccacacuggac

SEQ ID NO: 2228729 - RNA, 18 nt, Human
cgccgacuuuguaccccc

SEQ ID NO: 2228730 - RNA, 18 nt, Human
cgccgagucugucucugu

SEQ ID NO: 2228731 - RNA, 19 nt, Human
cgccgagucugucucuguc

SEQ ID NO: 2228732 - RNA, 23 nt, Human
cgccaaggcugggggaagaagcu

SEQ ID NO: 2228733 - RNA, 16 nt, Human
cgccaaggcuggggga

SEQ ID NO: 2228734 - RNA, 13 nt, Human
cgccaaggcuggg

SEQ ID NO: 2228735 - RNA, 12 nt, Human
cgccaaggcugg

SEQ ID NO: 2228736 - RNA, 20 nt, Human
cgcaggcuggcccugcccug

SEQ ID NO: 2228737 - RNA, 19 nt, Human
cgcaggcuggcccugcccu

SEQ ID NO: 2228738 - RNA, 18 nt, Human
cgcaggcuggcccugccc

SEQ ID NO: 2228739 - RNA, 17 nt, Human
cgcaggcuggcccugcc

SEQ ID NO: 2228740 - RNA, 15 nt, Human
cgcaggcuggcccug

SEQ ID NO: 2228741 - RNA, 14 nt, Human
cgcaggcuggcccu

SEQ ID NO: 2228742 - RNA, 14 nt, Human
cgccgccugguacu

SEQ ID NO: 2228743 - RNA, 15 nt, Human
cgccgccugguacuc

SEQ ID NO: 2228744 - RNA, 12 nt, Human
cgccgccucuuu

SEQ ID NO: 2228745 - RNA, 13 nt, Human
cgccgccucgccc

SEQ ID NO: 2228746 - RNA, 16 nt, Human
cgccgccucgcccacc

SEQ ID NO: 2228747 - RNA, 21 nt, Human
cgccgcaaaccacacuggacu

SEQ ID NO: 2228748 - RNA, 22 nt, Human
cgccgcaaaccacacuggacuc

SEQ ID NO: 2228749 - RNA, 23 nt, Human
cgccgcaaaccacacuggacucc

SEQ ID NO: 2228750 - RNA, 22 nt, Human
cgccgccggaguccacucccag

SEQ ID NO: 2228751 - RNA, 20 nt, Human
cgccgccugguacucaagcc

SEQ ID NO: 2228752 - RNA, 18 nt, Human
cgccgccucgcccaccgc

SEQ ID NO: 2228753 - RNA, 17 nt, Human
cgccgcuuuucuccucu

SEQ ID NO: 2228754 - RNA, 18 nt, Human
cgccggaguccacuccca

SEQ ID NO: 2228755 - RNA, 23 nt, Human
cgccggaguccacucccagugcu

SEQ ID NO: 2228756 - RNA, 22 nt, Human
cgccggcaaaacuuuggcacug

SEQ ID NO: 2228757 - RNA, 18 nt, Human
cgccggcgggcgggccgg

SEQ ID NO: 2228758 - RNA, 16 nt, Human
cgccggggacagaggc

SEQ ID NO: 2228759 - RNA, 17 nt, Human
cgccggggacagaggcc

SEQ ID NO: 2228760 - RNA, 19 nt, Human
cgccggggacagaggccug

SEQ ID NO: 2228761 - RNA, 16 nt, Human
cgccucccacuggggu

SEQ ID NO: 2228762 - RNA, 19 nt, Human
cgccucccacuggggucca

SEQ ID NO: 2228763 - RNA, 14 nt, Human
cgccucccagccug

SEQ ID NO: 2228764 - RNA, 11 nt, Human
cgccucccagc

SEQ ID NO: 2228765 - RNA, 15 nt, Human
cgccucccacugggg

SEQ ID NO: 2228766 - RNA, 13 nt, Human
cgccguggcugcg

SEQ ID NO: 2228767 - RNA, 23 nt, Human
cgccgugaguucucagggcuccu

SEQ ID NO: 2228768 - RNA, 14 nt, Human
cgccuacaggagug

SEQ ID NO: 2228769 - RNA, 15 nt, Human
cgccgucuccagggg

SEQ ID NO: 2228770 - RNA, 20 nt, Human
cgccggggacagaggccugc

SEQ ID NO: 2228771 - RNA, 22 nt, Human
cgccggggacagaggccugccc

SEQ ID NO: 2228772 - RNA, 17 nt, Human
cgccgugaguucucagg

SEQ ID NO: 2228773 - RNA, 18 nt, Human
cgccgugaguucucaggg

SEQ ID NO: 2228774 - RNA, 19 nt, Human
cgccgugaguucucagggc

SEQ ID NO: 2228775 - RNA, 21 nt, Human
cgccgugaguucucagggcuc

SEQ ID NO: 2228776 - RNA, 23 nt, Human
cgaccucguccucccccugccag

SEQ ID NO: 2228777 - RNA, 20 nt, Human
cgaccucuccaucuucagcu

SEQ ID NO: 2228778 - RNA, 22 nt, Human
cgaccucguccucccccugcca

SEQ ID NO: 2228779 - RNA, 19 nt, Human
cgaccucguccucccccug

SEQ ID NO: 2228780 - RNA, 16 nt, Human
cgaccucguccucccc

SEQ ID NO: 2228781 - RNA, 14 nt, Human
cgaccucguccucc

SEQ ID NO: 2228782 - RNA, 12 nt, Human
cgaccucggugg

SEQ ID NO: 2228783 - RNA, 15 nt, Human
cgaccucagccuucc

SEQ ID NO: 2228784 - RNA, 14 nt, Human
cgaccucagccuuc

SEQ ID NO: 2228785 - RNA, 13 nt, Human
cgaccucagccuu

SEQ ID NO: 2228786 - RNA, 12 nt, Human
cgaccucagccu

SEQ ID NO: 2228787 - RNA, 15 nt, Human
cgaccagagccccac

SEQ ID NO: 2228788 - RNA, 23 nt, Human
cgaccaccccugccuccacccuc

SEQ ID NO: 2228789 - RNA, 17 nt, Human
cgaccccaucugcccag

SEQ ID NO: 2228790 - RNA, 20 nt, Human
cgaccgaggcuggagcuggc

SEQ ID NO: 2228791 - RNA, 13 nt, Human
cgaccgcccccuc

SEQ ID NO: 2228792 - RNA, 14 nt, Human
cgaccccaucugcc

SEQ ID NO: 2228793 - RNA, 15 nt, Human
cgaccccaucugccc

SEQ ID NO: 2228794 - RNA, 16 nt, Human
cgaccccaucugccca

SEQ ID NO: 2228795 - RNA, 18 nt, Human
cgaccugauuuacaguuu

SEQ ID NO: 2228796 - RNA, 23 nt, Human
cgaccugauuuacaguuucaaaa

SEQ ID NO: 2228797 - RNA, 16 nt, Human
cgaccugccucggccu

SEQ ID NO: 2228798 - RNA, 18 nt, Human
cgaccugguuuuuaaaua

SEQ ID NO: 2228799 - RNA, 14 nt, Human
ccuuuugcaucauu

SEQ ID NO: 2228800 - RNA, 17 nt, Human
ccuuuugcaccugcucu

SEQ ID NO: 2228801 - RNA, 12 nt, Human
ccuuuuggcccc

SEQ ID NO: 2228802 - RNA, 12 nt, Human
ccuuuuggcacu

SEQ ID NO: 2228803 - RNA, 19 nt, Human
ccuuuugcggaugggaggg

SEQ ID NO: 2228804 - RNA, 18 nt, Human
ccuuuugcuugaaaccaa

SEQ ID NO: 2228805 - RNA, 19 nt, Human
ccuuuuguaccauggugug

SEQ ID NO: 2228806 - RNA, 23 nt, Human
ccuuuuggcccccgagcuggggg

SEQ ID NO: 2228807 - RNA, 21 nt, Human
ccuuuuggcccccgagcuggg

SEQ ID NO: 2228808 - RNA, 20 nt, Human
ccuuuuggcccccgagcugg

SEQ ID NO: 2228809 - RNA, 19 nt, Human
ccuuuuggcccccgagcug

SEQ ID NO: 2228810 - RNA, 15 nt, Human
ccuuuugucugccuc

SEQ ID NO: 2228811 - RNA, 13 nt, Human
ccuuuuuccuucc

SEQ ID NO: 2228812 - RNA, 21 nt, Human
ccuuuuuccccaaagucuuaa

SEQ ID NO: 2228813 - RNA, 14 nt, Human
ccuuuuucuccagc

SEQ ID NO: 2228814 - RNA, 13 nt, Human
ccuuuuuccuugu

SEQ ID NO: 2228815 - RNA, 14 nt, Human
ccuuuuuccuuguc

SEQ ID NO: 2228816 - RNA, 16 nt, Human
ccuuuuucuccagcug

SEQ ID NO: 2228817 - RNA, 17 nt, Human
ccuuuuuccuugucccc

SEQ ID NO: 2228818 - RNA, 18 nt, Human
ccuuuuucucccucugga

SEQ ID NO: 2228819 - RNA, 16 nt, Human
ccuuuuucuuuauaaa

SEQ ID NO: 2228820 - RNA, 20 nt, Human
ccuuuuucuuuauaaacuuu

SEQ ID NO: 2228821 - RNA, 21 nt, Human
ccuuuuucucccucuggauca

SEQ ID NO: 2228822 - RNA, 12 nt, Human
ccuuuuuuauac

SEQ ID NO: 2228823 - RNA, 19 nt, Human
cgacauggacccggagcua

SEQ ID NO: 2228824 - RNA, 14 nt, Human
cgaccacagggucu

SEQ ID NO: 2228825 - RNA, 23 nt, Human
cgaccacagggucugcacucuaa

SEQ ID NO: 2228826 - RNA, 15 nt, Human
cgaccaccccugccu

SEQ ID NO: 2228827 - RNA, 16 nt, Human
cgaccaccccugccuc

SEQ ID NO: 2228828 - RNA, 21 nt, Human
cgaccaccccugccuccaccc

SEQ ID NO: 2228829 - RNA, 22 nt, Human
cgacauagcccaucccugccug

SEQ ID NO: 2228830 - RNA, 12 nt, Human
ccuuuuugaagu

SEQ ID NO: 2228831 - RNA, 23 nt, Human
cgaccagacaccuugacagggca

SEQ ID NO: 2228832 - RNA, 12 nt, Human
cgaccaccugcc

SEQ ID NO: 2228833 - RNA, 14 nt, Human
cgaccaccugccca

SEQ ID NO: 2228834 - RNA, 18 nt, Human
ccuuuuuuauacauaaac

SEQ ID NO: 2228835 - RNA, 17 nt, Human
ccuuuuuuauacauaaa

SEQ ID NO: 2228836 - RNA, 16 nt, Human
cgacagugagacucug

SEQ ID NO: 2228837 - RNA, 15 nt, Human
cgacagugagacucu

SEQ ID NO: 2228838 - RNA, 22 nt, Human
ccuuuucuagcccgaauacaaa

SEQ ID NO: 2228839 - RNA, 14 nt, Human
ccuuuucugcauuu

SEQ ID NO: 2228840 - RNA, 22 nt, Human
ccuuuucugcauuuugcuauug

SEQ ID NO: 2228841 - RNA, 23 nt, Human
ccuuuugaacgcccccccccacc

SEQ ID NO: 2228842 - RNA, 23 nt, Human
ccuuuugaaguaguuuguauaac

SEQ ID NO: 2228843 - RNA, 17 nt, Human
ccuuuugcaccccuccc

SEQ ID NO: 2228844 - RNA, 18 nt, Human
ccuuuugcaccccuccca

SEQ ID NO: 2228845 - RNA, 19 nt, Human
ccuuuugcaccccucccau

SEQ ID NO: 2228846 - RNA, 20 nt, Human
ccuuuugcaccccucccauu

SEQ ID NO: 2228847 - RNA, 20 nt, Human
ccuuuugcaccugcucucuu

SEQ ID NO: 2228848 - RNA, 18 nt, Human
ccuuuucuuuucuacccu

SEQ ID NO: 2228849 - RNA, 22 nt, Human
ccuuuucuuuucuacccuagcc

SEQ ID NO: 2228850 - RNA, 21 nt, Human
ccuuuugaaauuaaccucuca

SEQ ID NO: 2228851 - RNA, 23 nt, Human
ccuuuucuuuucuacccuagcca

SEQ ID NO: 2228852 - RNA, 17 nt, Human
ccuuuccccagcccagg

SEQ ID NO: 2228853 - RNA, 18 nt, Human
ccuuuccccagcccaggg

SEQ ID NO: 2228854 - RNA, 13 nt, Human
ccuuuccccagcc

SEQ ID NO: 2228855 - RNA, 14 nt, Human
ccuuuccccagccc

SEQ ID NO: 2228856 - RNA, 15 nt, Human
ccuuuccccagccca

SEQ ID NO: 2228857 - RNA, 16 nt, Human
ccuuuccccagcccag

SEQ ID NO: 2228858 - RNA, 11 nt, Human
ccuuuccauaa

SEQ ID NO: 2228859 - RNA, 19 nt, Human
ccuuucccaggugcuacac

SEQ ID NO: 2228860 - RNA, 12 nt, Human
ccuuuccccagc

SEQ ID NO: 2228861 - RNA, 14 nt, Human
ccuuuagcgcccag

SEQ ID NO: 2228862 - RNA, 20 nt, Human
ccuuuagcgcccaguugggu

SEQ ID NO: 2228863 - RNA, 13 nt, Human
ccuuuagggcagc

SEQ ID NO: 2228864 - RNA, 14 nt, Human
ccuuuagggcagcu

SEQ ID NO: 2228865 - RNA, 15 nt, Human
ccuuuagggcagcuu

SEQ ID NO: 2228866 - RNA, 20 nt, Human
ccuuuagggcagcuugcccc

SEQ ID NO: 2228867 - RNA, 22 nt, Human
ccuuuagggcagcuugccccgg

SEQ ID NO: 2228868 - RNA, 19 nt, Human
ccuuuccaccacagccagc

SEQ ID NO: 2228869 - RNA, 13 nt, Human
ccuuuccagcaug

SEQ ID NO: 2228870 - RNA, 23 nt, Human
ccuuuccaccacagccagcaccu

SEQ ID NO: 2228871 - RNA, 14 nt, Human
ccuugccuccugug

SEQ ID NO: 2228872 - RNA, 18 nt, Human
ccuuggaaaccugcccug

SEQ ID NO: 2228873 - RNA, 19 nt, Human
ccuuggaaaccugcccugc

SEQ ID NO: 2228874 - RNA, 17 nt, Human
ccuuggaaaccugcccu

SEQ ID NO: 2228875 - RNA, 23 nt, Human
ccuuggaaaccugcccugccuga

SEQ ID NO: 2228876 - RNA, 20 nt, Human
ccuuggaaaccugcccugcc

SEQ ID NO: 2228877 - RNA, 22 nt, Human
ccuuggaaaccugcccugccug

SEQ ID NO: 2228878 - RNA, 22 nt, Human
ccuuggaaguugcauggcauca

SEQ ID NO: 2228879 - RNA, 15 nt, Human
ccuuggaaguuucau

SEQ ID NO: 2228880 - RNA, 19 nt, Human
ccuuuagccaaacccuugu

SEQ ID NO: 2228881 - RNA, 16 nt, Human
ccuuggacauccuccu

SEQ ID NO: 2228882 - RNA, 17 nt, Human
ccuuggacauccuccuc

SEQ ID NO: 2228883 - RNA, 15 nt, Human
ccuugccuccugugu

SEQ ID NO: 2228884 - RNA, 22 nt, Human
ccuugcuuggcugcuuggccuu

SEQ ID NO: 2228885 - RNA, 12 nt, Human
ccuugccuccug

SEQ ID NO: 2228886 - RNA, 23 nt, Human
ccuugccuccccauuucccaucu

SEQ ID NO: 2228887 - RNA, 21 nt, Human
ccuugcuuguugggauuccug

SEQ ID NO: 2228888 - RNA, 19 nt, Human
ccuugccucaaugccagua

SEQ ID NO: 2228889 - RNA, 20 nt, Human
ccuugccucaaugccaguaa

SEQ ID NO: 2228890 - RNA, 12 nt, Human
ccuugccucccc

SEQ ID NO: 2228891 - RNA, 14 nt, Human
ccuugccuccccau

SEQ ID NO: 2228892 - RNA, 17 nt, Human
ccuugccuccccauuuc

SEQ ID NO: 2228893 - RNA, 22 nt, Human
ccuugccuccccauuucccauc

SEQ ID NO: 2228894 - RNA, 20 nt, Human
ccuugcccagggcucagccu

SEQ ID NO: 2228895 - RNA, 15 nt, Human
ccuugccucaaugcc

SEQ ID NO: 2228896 - RNA, 16 nt, Human
ccuugccucaaugcca

SEQ ID NO: 2228897 - RNA, 20 nt, Human
ccuugccgucuaccugaggg

SEQ ID NO: 2228898 - RNA, 18 nt, Human
ccuugcccagggcucagc

SEQ ID NO: 2228899 - RNA, 17 nt, Human
ccuugcccagggcucag

SEQ ID NO: 2228900 - RNA, 16 nt, Human
ccuugcccagggcuca

SEQ ID NO: 2228901 - RNA, 15 nt, Human
ccuugcccagggcuc

SEQ ID NO: 2228902 - RNA, 17 nt, Human
ccuugccgucuaccuga

SEQ ID NO: 2228903 - RNA, 13 nt, Human
ccuugcccagggc

SEQ ID NO: 2228904 - RNA, 23 nt, Human
ccuugcccagagaugccuccacc

SEQ ID NO: 2228905 - RNA, 21 nt, Human
ccuugcccagagaugccucca

SEQ ID NO: 2228906 - RNA, 19 nt, Human
ccuugcccagagaugccuc

SEQ ID NO: 2228907 - RNA, 14 nt, Human
ccuugcccagagau

SEQ ID NO: 2228908 - RNA, 13 nt, Human
ccuugcccagaga

SEQ ID NO: 2228909 - RNA, 12 nt, Human
ccuugcccagag

SEQ ID NO: 2228910 - RNA, 11 nt, Human
ccuugcccaga

SEQ ID NO: 2228911 - RNA, 15 nt, Human
ccuugcccaccccac

SEQ ID NO: 2228912 - RNA, 18 nt, Human
ccuucuggccucccacag

SEQ ID NO: 2228913 - RNA, 18 nt, Human
ccuucuggauucuuggcc

SEQ ID NO: 2228914 - RNA, 19 nt, Human
ccuucuggauucuuggccc

SEQ ID NO: 2228915 - RNA, 20 nt, Human
ccuucuggccucccacagac

SEQ ID NO: 2228916 - RNA, 21 nt, Human
ccuucuggauucuuggcccgc

SEQ ID NO: 2228917 - RNA, 12 nt, Human
ccuucugggaaa

SEQ ID NO: 2228918 - RNA, 20 nt, Human
ccuucugggcagaccuugac

SEQ ID NO: 2228919 - RNA, 18 nt, Human
ccuucugggcaucuguuc

SEQ ID NO: 2228920 - RNA, 19 nt, Human
ccuucugggcaucuguucu

SEQ ID NO: 2228921 - RNA, 20 nt, Human
ccuucugggcaucuguucug

SEQ ID NO: 2228922 - RNA, 22 nt, Human
ccuucugggcaucuguucuggu

SEQ ID NO: 2228923 - RNA, 22 nt, Human
ccuucuguaaagguuuuuggaa

SEQ ID NO: 2228924 - RNA, 16 nt, Human
ccuucuguaguuuuau

SEQ ID NO: 2228925 - RNA, 18 nt, Human
ccuucugucccucacagc

SEQ ID NO: 2228926 - RNA, 19 nt, Human
ccuucugucccucacagca

SEQ ID NO: 2228927 - RNA, 17 nt, Human
ccuucuguaguuuuauc

SEQ ID NO: 2228928 - RNA, 17 nt, Human
ccuucuggccucccaca

SEQ ID NO: 2228929 - RNA, 21 nt, Human
ccuucugcuggauaaaaugag

SEQ ID NO: 2228930 - RNA, 17 nt, Human
ccuucuggauucuuggc

SEQ ID NO: 2228931 - RNA, 22 nt, Human
ccuucuggaauaaggagaauga

SEQ ID NO: 2228932 - RNA, 20 nt, Human
ccuucugcuggauaaaauga

SEQ ID NO: 2228933 - RNA, 17 nt, Human
ccuucugcucagcucug

SEQ ID NO: 2228934 - RNA, 13 nt, Human
ccuucugcuacug

SEQ ID NO: 2228935 - RNA, 16 nt, Human
ccuucugccugagcuu

SEQ ID NO: 2228936 - RNA, 12 nt, Human
ccuucugcucag

SEQ ID NO: 2228937 - RNA, 21 nt, Human
ccuucugaggacauuccaaga

SEQ ID NO: 2228938 - RNA, 18 nt, Human
ccuucugaggacauucca

SEQ ID NO: 2228939 - RNA, 23 nt, Human
ccuucugacccaugcugcccugu

SEQ ID NO: 2228940 - RNA, 21 nt, Human
ccuucugacccaugcugcccu

SEQ ID NO: 2228941 - RNA, 22 nt, Human
ccuucugacccaugcugcccug

SEQ ID NO: 2228942 - RNA, 20 nt, Human
ccuucugaaaaaguauccug

SEQ ID NO: 2228943 - RNA, 20 nt, Human
ccuggccugagcugggauga

SEQ ID NO: 2228944 - RNA, 14 nt, Human
ccuggccugagcug

SEQ ID NO: 2228945 - RNA, 15 nt, Human
ccuggccugagcugg

SEQ ID NO: 2228946 - RNA, 12 nt, Human
ccuucugaccca

SEQ ID NO: 2228947 - RNA, 16 nt, Human
ccuucugacccaugcu

SEQ ID NO: 2228948 - RNA, 17 nt, Human
ccuucugacccaugcug

SEQ ID NO: 2228949 - RNA, 20 nt, Human
ccuucugacccaugcugccc

SEQ ID NO: 2228950 - RNA, 18 nt, Human
ccagcuacaccuuucucc

SEQ ID NO: 2228951 - RNA, 19 nt, Human
ccagcuacaccuuucuccu

SEQ ID NO: 2228952 - RNA, 18 nt, Human
ccagccccugccccagcc

SEQ ID NO: 2228953 - RNA, 20 nt, Human
ccagccccugccccagccca

SEQ ID NO: 2228954 - RNA, 22 nt, Human
ccagccccugccccagcccaag

SEQ ID NO: 2228955 - RNA, 20 nt, Human
ccagcuacaccuuucuccuu

SEQ ID NO: 2228956 - RNA, 16 nt, Human
ccagcuacccuuuuuc

SEQ ID NO: 2228957 - RNA, 21 nt, Human
ccagcuacccuuuuucuccag

SEQ ID NO: 2228958 - RNA, 22 nt, Human
ccagcuacccuuuuucuccagc

SEQ ID NO: 2228959 - RNA, 14 nt, Human
ccagcuacucagga

SEQ ID NO: 2228960 - RNA, 13 nt, Human
ccagcuacucagg

SEQ ID NO: 2228961 - RNA, 23 nt, Human
ccagcuacucagaagccugaggc

SEQ ID NO: 2228962 - RNA, 21 nt, Human
ccagcuacucagaagccugag

SEQ ID NO: 2228963 - RNA, 20 nt, Human
ccagcuacucagaagccuga

SEQ ID NO: 2228964 - RNA, 17 nt, Human
ccagcuacucagaagcc

SEQ ID NO: 2228965 - RNA, 16 nt, Human
ccagcuacucagaagc

SEQ ID NO: 2228966 - RNA, 14 nt, Human
ccagcuacucagaa

SEQ ID NO: 2228967 - RNA, 20 nt, Human
ccagcuacucaagaggcuga

SEQ ID NO: 2228968 - RNA, 14 nt, Human
ccagccccucuggu

SEQ ID NO: 2228969 - RNA, 15 nt, Human
ccagccccucugguc

SEQ ID NO: 2228970 - RNA, 17 nt, Human
ccagccccucuggucgc

SEQ ID NO: 2228971 - RNA, 22 nt, Human
ccagccccucuggucgcuccug

SEQ ID NO: 2228972 - RNA, 23 nt, Human
ccagccccucuggucgcuccugc

SEQ ID NO: 2228973 - RNA, 15 nt, Human
ccagccccugcccca

SEQ ID NO: 2228974 - RNA, 11 nt, Human
ccagccccugg

SEQ ID NO: 2228975 - RNA, 12 nt, Human
ccagccccugga

SEQ ID NO: 2228976 - RNA, 15 nt, Human
ccagcucaccagccc

SEQ ID NO: 2228977 - RNA, 16 nt, Human
ccagcucaccagcccc

SEQ ID NO: 2228978 - RNA, 16 nt, Human
ccagcuguucagcugg

SEQ ID NO: 2228979 - RNA, 22 nt, Human
ccagcucaccagccccagugcc

SEQ ID NO: 2228980 - RNA, 20 nt, Human
ccagcuacucaggaggcuga

SEQ ID NO: 2228981 - RNA, 19 nt, Human
ccagcuacucaggaggcug

SEQ ID NO: 2228982 - RNA, 17 nt, Human
ccagcuacucaggaggc

SEQ ID NO: 2228983 - RNA, 15 nt, Human
ccagcuacucaggag

SEQ ID NO: 2228984 - RNA, 22 nt, Human
ccagcuguucugucccuuggag

SEQ ID NO: 2228985 - RNA, 22 nt, Human
ccagcucaauggacuggaaggg

SEQ ID NO: 2228986 - RNA, 17 nt, Human
ccagcuguucagcuggu

SEQ ID NO: 2228987 - RNA, 19 nt, Human
ccagcuuaaaggggcuaga

SEQ ID NO: 2228988 - RNA, 23 nt, Human
ccaggaaacucugcauucuagua

SEQ ID NO: 2228989 - RNA, 14 nt, Human
ccaggaaccuccuc

SEQ ID NO: 2228990 - RNA, 24 nt, Human
ccaggaaccacaccacaucuaagc

SEQ ID NO: 2228991 - RNA, 21 nt, Human
ccagcuuaaaguaaccggaug

SEQ ID NO: 2228992 - RNA, 16 nt, Human
ccaggaaaggcuccag

SEQ ID NO: 2228993 - RNA, 14 nt, Human
ccaggaaaggcucc

SEQ ID NO: 2228994 - RNA, 15 nt, Human
ccaggaaaggcucca

SEQ ID NO: 2228995 - RNA, 12 nt, Human
ccaggaagccag

SEQ ID NO: 2228996 - RNA, 14 nt, Human
ccaggaacugggcc

SEQ ID NO: 2228997 - RNA, 13 nt, Human
ccaggaagccagc

SEQ ID NO: 2228998 - RNA, 21 nt, Human
ccagcagccagcucucagcca

SEQ ID NO: 2228999 - RNA, 12 nt, Human
ccagcagcgccu

SEQ ID NO: 2229000 - RNA, 18 nt, Human
ccagcagcgccuuuccca

SEQ ID NO: 2229001 - RNA, 17 nt, Human
ccagcagcgccuuuccc

SEQ ID NO: 2229002 - RNA, 19 nt, Human
ccagcagcgccuuucccaa

SEQ ID NO: 2229003 - RNA, 24 nt, Human
ccagcagcggaaccgcccaggauc

SEQ ID NO: 2229004 - RNA, 13 nt, Human
ccagcaggcucuc

SEQ ID NO: 2229005 - RNA, 15 nt, Human
ccagcaggcucucag

SEQ ID NO: 2229006 - RNA, 20 nt, Human
ccagcagccagcucucagcc

SEQ ID NO: 2229007 - RNA, 19 nt, Human
ccagcagccagcucucagc

SEQ ID NO: 2229008 - RNA, 18 nt, Human
ccagcagccagcucucag

SEQ ID NO: 2229009 - RNA, 16 nt, Human
ccagcagccagcucuc

SEQ ID NO: 2229010 - RNA, 15 nt, Human
ccagcagccagcucu

SEQ ID NO: 2229011 - RNA, 21 nt, Human
ccagaguggggaugacaugca

SEQ ID NO: 2229012 - RNA, 23 nt, Human
ccagaguggccuggccaggagcu

SEQ ID NO: 2229013 - RNA, 21 nt, Human
ccagagugugggaagggagag

SEQ ID NO: 2229014 - RNA, 18 nt, Human
ccagagugugggaaggga

SEQ ID NO: 2229015 - RNA, 12 nt, Human
ccagagugugaa

SEQ ID NO: 2229016 - RNA, 22 nt, Human
ccagaguggccuggccaggagc

SEQ ID NO: 2229017 - RNA, 21 nt, Human
ccagaguggccuggccaggag

SEQ ID NO: 2229018 - RNA, 19 nt, Human
ccagaguggccuggccagg

SEQ ID NO: 2229019 - RNA, 18 nt, Human
ccagaguggccuggccag

SEQ ID NO: 2229020 - RNA, 17 nt, Human
ccagaguggccuggcca

SEQ ID NO: 2229021 - RNA, 16 nt, Human
ccagaguggccuggcc

SEQ ID NO: 2229022 - RNA, 15 nt, Human
ccagaguggccuggc

SEQ ID NO: 2229023 - RNA, 14 nt, Human
ccagaguggccugg

SEQ ID NO: 2229024 - RNA, 13 nt, Human
ccagaguggccug

SEQ ID NO: 2229025 - RNA, 21 nt, Human
ccagaguccuuuccaaggcuu

SEQ ID NO: 2229026 - RNA, 16 nt, Human
ccagaguccuuuccaa

SEQ ID NO: 2229027 - RNA, 17 nt, Human
ccagaucccagaaggac

SEQ ID NO: 2229028 - RNA, 16 nt, Human
ccagaucccagaagga

SEQ ID NO: 2229029 - RNA, 13 nt, Human
ccagaucccagaa

SEQ ID NO: 2229030 - RNA, 16 nt, Human
ccagauccagccuggg

SEQ ID NO: 2229031 - RNA, 15 nt, Human
ccagauccagccugg

SEQ ID NO: 2229032 - RNA, 14 nt, Human
ccagauccagccug

SEQ ID NO: 2229033 - RNA, 13 nt, Human
ccagauccagccu

SEQ ID NO: 2229034 - RNA, 18 nt, Human
ccagaguuccccaugcag

SEQ ID NO: 2229035 - RNA, 19 nt, Human
ccagaguuccccaugcaga

SEQ ID NO: 2229036 - RNA, 21 nt, Human
ccagaguuccccaugcagaca

SEQ ID NO: 2229037 - RNA, 13 nt, Human
ccagaguuccugc

SEQ ID NO: 2229038 - RNA, 18 nt, Human
ccagaucccagaaggacc

SEQ ID NO: 2229039 - RNA, 17 nt, Human
ccagauccucacaacca

SEQ ID NO: 2229040 - RNA, 14 nt, Human
ccagauccucacaa

SEQ ID NO: 2229041 - RNA, 15 nt, Human
ccagauccucuuggu

SEQ ID NO: 2229042 - RNA, 14 nt, Human
ccagauccucuugg

SEQ ID NO: 2229043 - RNA, 15 nt, Human
ccagauccuggaaau

SEQ ID NO: 2229044 - RNA, 16 nt, Human
ccaccuuggcucaagu

SEQ ID NO: 2229045 - RNA, 17 nt, Human
ccagagggccugcaagg

SEQ ID NO: 2229046 - RNA, 18 nt, Human
ccagagggccugcaaggg

SEQ ID NO: 2229047 - RNA, 19 nt, Human
ccagagggccugcaaggga

SEQ ID NO: 2229048 - RNA, 20 nt, Human
ccagagggccugcaagggag

SEQ ID NO: 2229049 - RNA, 18 nt, Human
ccagaugcaccagcccuu

SEQ ID NO: 2229050 - RNA, 17 nt, Human
ccagaugcaccagcccu

SEQ ID NO: 2229051 - RNA, 15 nt, Human
ccagaugcaccagcc

SEQ ID NO: 2229052 - RNA, 17 nt, Human
ccagggucacugaaggc

SEQ ID NO: 2229053 - RNA, 23 nt, Human
ccaggguagcccgccugccaguc

SEQ ID NO: 2229054 - RNA, 21 nt, Human
ccagggucacugaaggccugg

SEQ ID NO: 2229055 - RNA, 19 nt, Human
ccaggguagcccgccugcc

SEQ ID NO: 2229056 - RNA, 20 nt, Human
ccaggguagcccgccugcca

SEQ ID NO: 2229057 - RNA, 21 nt, Human
ccaggguagcccgccugccag

SEQ ID NO: 2229058 - RNA, 22 nt, Human
ccaggguagcccgccugccagu

SEQ ID NO: 2229059 - RNA, 13 nt, Human
ccagggucccugg

SEQ ID NO: 2229060 - RNA, 18 nt, Human
ccagggucccucugugua

SEQ ID NO: 2229061 - RNA, 16 nt, Human
ccagggucccucugug

SEQ ID NO: 2229062 - RNA, 17 nt, Human
ccagggucccucugugu

SEQ ID NO: 2229063 - RNA, 19 nt, Human
ccaggggaaaaucagccug

SEQ ID NO: 2229064 - RNA, 20 nt, Human
ccaggggaaaaucagccugc

SEQ ID NO: 2229065 - RNA, 13 nt, Human
ccaggggugggac

SEQ ID NO: 2229066 - RNA, 23 nt, Human
ccaggggugggacacccugugau

SEQ ID NO: 2229067 - RNA, 13 nt, Human
ccagggguuucuc

SEQ ID NO: 2229068 - RNA, 14 nt, Human
ccaggguagcccgc

SEQ ID NO: 2229069 - RNA, 16 nt, Human
ccaggguagcccgccu

SEQ ID NO: 2229070 - RNA, 19 nt, Human
ccaggggugggacacccug

SEQ ID NO: 2229071 - RNA, 19 nt, Human
ccaggggugcccccuccuc

SEQ ID NO: 2229072 - RNA, 20 nt, Human
ccaggggugcccccuccucu

SEQ ID NO: 2229073 - RNA, 14 nt, Human
ccaggggugggaca

SEQ ID NO: 2229074 - RNA, 17 nt, Human
ccaggggugggacaccc

SEQ ID NO: 2229075 - RNA, 20 nt, Human
ccaggcuccuuuagcgccca

SEQ ID NO: 2229076 - RNA, 21 nt, Human
ccaggcuccuuuagcgcccag

SEQ ID NO: 2229077 - RNA, 14 nt, Human
ccaggcuccuuccu

SEQ ID NO: 2229078 - RNA, 18 nt, Human
ccaggcagaucugugccc

SEQ ID NO: 2229079 - RNA, 22 nt, Human
ccaggcuccuuccugucuuccu

SEQ ID NO: 2229080 - RNA, 15 nt, Human
ccaggcuccuuccug

SEQ ID NO: 2229081 - RNA, 23 nt, Human
ccaggcuccuuccugucuuccug

SEQ ID NO: 2229082 - RNA, 16 nt, Human
ccaggcuggcgugcag

SEQ ID NO: 2229083 - RNA, 19 nt, Human
ccaggcuggcgugcagugg

SEQ ID NO: 2229084 - RNA, 22 nt, Human
ccagggcuggacugaggccuga

SEQ ID NO: 2229085 - RNA, 17 nt, Human
ccaggcuggcgugcagu

SEQ ID NO: 2229086 - RNA, 18 nt, Human
ccaggcuggcgugcagug

SEQ ID NO: 2229087 - RNA, 17 nt, Human
ccaggcagaucugugcc

SEQ ID NO: 2229088 - RNA, 13 nt, Human
ccaggcagaucug

SEQ ID NO: 2229089 - RNA, 19 nt, Human
ccaggcagauccaggacua

SEQ ID NO: 2229090 - RNA, 18 nt, Human
ccaggcagauccaggacu

SEQ ID NO: 2229091 - RNA, 17 nt, Human
ccaggcagauccaggac

SEQ ID NO: 2229092 - RNA, 16 nt, Human
ccaggcagauccagga

SEQ ID NO: 2229093 - RNA, 15 nt, Human
ccaggcagauccagg

SEQ ID NO: 2229094 - RNA, 13 nt, Human
ccaggcagaucca

SEQ ID NO: 2229095 - RNA, 23 nt, Human
ccaggcacgaacccaccugcuga

SEQ ID NO: 2229096 - RNA, 22 nt, Human
ccaggcacgaacccaccugcug

SEQ ID NO: 2229097 - RNA, 21 nt, Human
ccaggcacgaacccaccugcu

SEQ ID NO: 2229098 - RNA, 16 nt, Human
ccaggcacugcugccc

SEQ ID NO: 2229099 - RNA, 18 nt, Human
ccaggcacugcugcccag

SEQ ID NO: 2229100 - RNA, 16 nt, Human
ccaggcacccccugga

SEQ ID NO: 2229101 - RNA, 17 nt, Human
ccaggcacccccuggag

SEQ ID NO: 2229102 - RNA, 18 nt, Human
ccaggcacccccuggaga

SEQ ID NO: 2229103 - RNA, 19 nt, Human
ccaggcacccccuggagag

SEQ ID NO: 2229104 - RNA, 21 nt, Human
ccaggcacccccuggagagaa

SEQ ID NO: 2229105 - RNA, 20 nt, Human
ccaggcacgaacccaccugc

SEQ ID NO: 2229106 - RNA, 19 nt, Human
ccaggcacgaacccaccug

SEQ ID NO: 2229107 - RNA, 18 nt, Human
ccaggcacgaacccaccu

SEQ ID NO: 2229108 - RNA, 13 nt, Human
ccaggcacccuuc

SEQ ID NO: 2229109 - RNA, 14 nt, Human
ccaggcacccuucu

SEQ ID NO: 2229110 - RNA, 21 nt, Human
ccaggcacccuucuuuccucu

SEQ ID NO: 2229111 - RNA, 22 nt, Human
ccaggcacccuucuuuccucuu

SEQ ID NO: 2229112 - RNA, 22 nt, Human
ccaggcacacacugugcuuucu

SEQ ID NO: 2229113 - RNA, 20 nt, Human
ccauggugaauuaaucacuu

SEQ ID NO: 2229114 - RNA, 22 nt, Human
ccauggugaauuaaucacuuuu

SEQ ID NO: 2229115 - RNA, 20 nt, Human
ccauggucggaaaacaugcu

SEQ ID NO: 2229116 - RNA, 19 nt, Human
ccauggugugaucgucuga

SEQ ID NO: 2229117 - RNA, 18 nt, Human
ccauggugugaucgucug

SEQ ID NO: 2229118 - RNA, 14 nt, Human
ccaugguugagaaa

SEQ ID NO: 2229119 - RNA, 15 nt, Human
ccauguaacagaaag

SEQ ID NO: 2229120 - RNA, 16 nt, Human
ccauguaacagaaagg

SEQ ID NO: 2229121 - RNA, 16 nt, Human
ccaugagcuccagacc

SEQ ID NO: 2229122 - RNA, 15 nt, Human
ccaugagcuccagac

SEQ ID NO: 2229123 - RNA, 13 nt, Human
ccaugagcuccag

SEQ ID NO: 2229124 - RNA, 23 nt, Human
ccaugagcuccagacccccagca

SEQ ID NO: 2229125 - RNA, 19 nt, Human
ccaugagcuccagaccccc

SEQ ID NO: 2229126 - RNA, 18 nt, Human
ccaugagcuccagacccc

SEQ ID NO: 2229127 - RNA, 17 nt, Human
ccaugagcuccagaccc

SEQ ID NO: 2229128 - RNA, 21 nt, Human
ccaugagccucagcauccugg

SEQ ID NO: 2229129 - RNA, 23 nt, Human
ccaugagccucagcauccuggca

SEQ ID NO: 2229130 - RNA, 23 nt, Human
ccaugucaccggauccugggugg

SEQ ID NO: 2229131 - RNA, 22 nt, Human
ccaugucaccggauccugggug

SEQ ID NO: 2229132 - RNA, 13 nt, Human
ccaugucacugug

SEQ ID NO: 2229133 - RNA, 17 nt, Human
ccaugucagcaaaaagc

SEQ ID NO: 2229134 - RNA, 18 nt, Human
ccauguaagguaucaguu

SEQ ID NO: 2229135 - RNA, 23 nt, Human
ccauguauuuaucucuauuuaau

SEQ ID NO: 2229136 - RNA, 16 nt, Human
ccauguauuuaucucu

SEQ ID NO: 2229137 - RNA, 22 nt, Human
ccauguauuuaucucuauuuaa

SEQ ID NO: 2229138 - RNA, 18 nt, Human
ccaugucagcaaaaagca

SEQ ID NO: 2229139 - RNA, 21 nt, Human
ccaguuccuuucaaugguuug

SEQ ID NO: 2229140 - RNA, 22 nt, Human
ccaguuccuuucaaugguuugc

SEQ ID NO: 2229141 - RNA, 23 nt, Human
ccaguuggucccccuuccaugga

SEQ ID NO: 2229142 - RNA, 23 nt, Human
ccaguucaguaccuggaggagga

SEQ ID NO: 2229143 - RNA, 21 nt, Human
ccaguuucagguguuuaguug

SEQ ID NO: 2229144 - RNA, 18 nt, Human
ccaguuuaaccugaugca

SEQ ID NO: 2229145 - RNA, 19 nt, Human
ccaguuuaaucauugccug

SEQ ID NO: 2229146 - RNA, 17 nt, Human
ccaguuuaaccugaugc

SEQ ID NO: 2229147 - RNA, 13 nt, Human
ccaguuugcagaa

SEQ ID NO: 2229148 - RNA, 14 nt, Human
ccaucccagccuug

SEQ ID NO: 2229149 - RNA, 15 nt, Human
ccaucccagccuugg

SEQ ID NO: 2229150 - RNA, 23 nt, Human
ccaucccagccuuggcaucuaga

SEQ ID NO: 2229151 - RNA, 13 nt, Human
ccaucccagcccc

SEQ ID NO: 2229152 - RNA, 15 nt, Human
ccaucccagccccaa

SEQ ID NO: 2229153 - RNA, 14 nt, Human
ccaucccagcccca

SEQ ID NO: 2229154 - RNA, 12 nt, Human
ccaguuucugcc

SEQ ID NO: 2229155 - RNA, 14 nt, Human
ccaguuucugccuc

SEQ ID NO: 2229156 - RNA, 15 nt, Human
ccaguuucugccucu

SEQ ID NO: 2229157 - RNA, 19 nt, Human
ccaugaauguaucaggaaa

SEQ ID NO: 2229158 - RNA, 18 nt, Human
ccaugaauguaucaggaa

SEQ ID NO: 2229159 - RNA, 15 nt, Human
ccaugaaucgcuucu

SEQ ID NO: 2229160 - RNA, 17 nt, Human
ccaugaaucgcuucucu

SEQ ID NO: 2229161 - RNA, 18 nt, Human
ccaugaaucgcuucucuu

SEQ ID NO: 2229162 - RNA, 19 nt, Human
ccaugaaucgcuucucuuu

SEQ ID NO: 2229163 - RNA, 24 nt, Human
ccaucccaggacaccacacccagc

SEQ ID NO: 2229164 - RNA, 16 nt, Human
ccaugaaucaaagaca

SEQ ID NO: 2229165 - RNA, 17 nt, Human
ccaugaaucaaagacau

SEQ ID NO: 2229166 - RNA, 14 nt, Human
ccaucccaggacac

SEQ ID NO: 2229167 - RNA, 21 nt, Human
ccaucccaggacaccacaccc

SEQ ID NO: 2229168 - RNA, 22 nt, Human
ccaucccaggacaccacaccca

SEQ ID NO: 2229169 - RNA, 23 nt, Human
ccaucccaggacaccacacccag

SEQ ID NO: 2229170 - RNA, 14 nt, Human
ccaugaccauacug

SEQ ID NO: 2229171 - RNA, 12 nt, Human
ccaugacccacc

SEQ ID NO: 2229172 - RNA, 15 nt, Human
ccaugacccaccccu

SEQ ID NO: 2229173 - RNA, 16 nt, Human
ccaugacccaccccug

SEQ ID NO: 2229174 - RNA, 17 nt, Human
ccaugacccaccccugu

SEQ ID NO: 2229175 - RNA, 18 nt, Human
ccaugacccaccccugug

SEQ ID NO: 2229176 - RNA, 18 nt, Human
ccaugacccaggcugggc

SEQ ID NO: 2229177 - RNA, 16 nt, Human
ccaugacccaggcugg

SEQ ID NO: 2229178 - RNA, 17 nt, Human
ccaugacccaggcuggg

SEQ ID NO: 2229179 - RNA, 19 nt, Human
ccaugacccaccccugugc

SEQ ID NO: 2229180 - RNA, 20 nt, Human
ccaugacccaccccugugcu

SEQ ID NO: 2229181 - RNA, 14 nt, Human
ccaugacccaggcu

SEQ ID NO: 2229182 - RNA, 15 nt, Human
ccaugacccaggcug

SEQ ID NO: 2229183 - RNA, 14 nt, Human
ccaucccugaaggc

SEQ ID NO: 2229184 - RNA, 15 nt, Human
ccaucccugaaggcc

SEQ ID NO: 2229185 - RNA, 17 nt, Human
ccaucccugaaggcccc

SEQ ID NO: 2229186 - RNA, 20 nt, Human
ccaucccugaaggccccgcc

SEQ ID NO: 2229187 - RNA, 21 nt, Human
ccaguucaggagucccaagga

SEQ ID NO: 2229188 - RNA, 18 nt, Human
ccaguucaggagucccaa

SEQ ID NO: 2229189 - RNA, 14 nt, Human
ccaguucaggaguc

SEQ ID NO: 2229190 - RNA, 13 nt, Human
ccaguucacccug

SEQ ID NO: 2229191 - RNA, 17 nt, Human
ccaguuaugugaaugau

SEQ ID NO: 2229192 - RNA, 19 nt, Human
ccaguucaaucucccgcug

SEQ ID NO: 2229193 - RNA, 20 nt, Human
ccaguuauuuuccgcccuca

SEQ ID NO: 2229194 - RNA, 15 nt, Human
ccaguucagcuuggg

SEQ ID NO: 2229195 - RNA, 17 nt, Human
ccaguuggguggaugcc

SEQ ID NO: 2229196 - RNA, 17 nt, Human
ccaguucauugcacuuu

SEQ ID NO: 2229197 - RNA, 18 nt, Human
ccaguucauugcacuuug

SEQ ID NO: 2229198 - RNA, 17 nt, Human
ccaguucaguaccugga

SEQ ID NO: 2229199 - RNA, 19 nt, Human
ccaguucaguaccuggagg

SEQ ID NO: 2229200 - RNA, 20 nt, Human
ccaguucaguaccuggagga

SEQ ID NO: 2229201 - RNA, 21 nt, Human
ccaguucaguaccuggaggag

SEQ ID NO: 2229202 - RNA, 19 nt, Human
ccaguuggguggaugccug

SEQ ID NO: 2229203 - RNA, 20 nt, Human
ccaguuggguggaugccugg

SEQ ID NO: 2229204 - RNA, 13 nt, Human
cccauauuucauc

SEQ ID NO: 2229205 - RNA, 16 nt, Human
cccauauuucaucgug

SEQ ID NO: 2229206 - RNA, 17 nt, Human
cccauccuacccucggg

SEQ ID NO: 2229207 - RNA, 20 nt, Human
cccauauuuguacaccaaua

SEQ ID NO: 2229208 - RNA, 19 nt, Human
cccauagugaccggcugcu

SEQ ID NO: 2229209 - RNA, 13 nt, Human
cccauagcuucca

SEQ ID NO: 2229210 - RNA, 14 nt, Human
cccauauccugccu

SEQ ID NO: 2229211 - RNA, 16 nt, Human
cccauagcuuccauga

SEQ ID NO: 2229212 - RNA, 19 nt, Human
cccagggccugcaggaccu

SEQ ID NO: 2229213 - RNA, 16 nt, Human
cccagggccugcagga

SEQ ID NO: 2229214 - RNA, 14 nt, Human
cccagggccugcag

SEQ ID NO: 2229215 - RNA, 22 nt, Human
cccagggcccagagcccagcuc

SEQ ID NO: 2229216 - RNA, 13 nt, Human
cccagggccugag

SEQ ID NO: 2229217 - RNA, 19 nt, Human
cccagggccugagccuggc

SEQ ID NO: 2229218 - RNA, 15 nt, Human
cccagggccugagcc

SEQ ID NO: 2229219 - RNA, 22 nt, Human
cccagggccagggcccugcaga

SEQ ID NO: 2229220 - RNA, 13 nt, Human
cccagggcccaga

SEQ ID NO: 2229221 - RNA, 15 nt, Human
cccagggcccagagc

SEQ ID NO: 2229222 - RNA, 14 nt, Human
cccagggcccagag

SEQ ID NO: 2229223 - RNA, 20 nt, Human
cccagggcccagagcccagc

SEQ ID NO: 2229224 - RNA, 19 nt, Human
cccagggcccagagcccag

SEQ ID NO: 2229225 - RNA, 17 nt, Human
cccagggcccagagccc

SEQ ID NO: 2229226 - RNA, 16 nt, Human
cccagggcccagagcc

SEQ ID NO: 2229227 - RNA, 23 nt, Human
cccagcugcaccugccagccugg

SEQ ID NO: 2229228 - RNA, 15 nt, Human
cccagcuugaaaccu

SEQ ID NO: 2229229 - RNA, 19 nt, Human
cccagcuugggcccagcug

SEQ ID NO: 2229230 - RNA, 20 nt, Human
cccagcuugggcccagcugg

SEQ ID NO: 2229231 - RNA, 22 nt, Human
cccagcuugggcccagcugggc

SEQ ID NO: 2229232 - RNA, 23 nt, Human
cccagcuugggcccagcugggcu

SEQ ID NO: 2229233 - RNA, 13 nt, Human
cccagcuuugccc

SEQ ID NO: 2229234 - RNA, 18 nt, Human
cccagcuuugcccaacac

SEQ ID NO: 2229235 - RNA, 16 nt, Human
cccaggaaaggcccag

SEQ ID NO: 2229236 - RNA, 22 nt, Human
cccagcuuugcccaacaccagc

SEQ ID NO: 2229237 - RNA, 13 nt, Human
cccaggcuggcgu

SEQ ID NO: 2229238 - RNA, 20 nt, Human
cccaggcuggagugcaaugg

SEQ ID NO: 2229239 - RNA, 13 nt, Human
cccaggcuggcca

SEQ ID NO: 2229240 - RNA, 15 nt, Human
cccaggcuggccagc

SEQ ID NO: 2229241 - RNA, 19 nt, Human
cccaggcuggagugcagug

SEQ ID NO: 2229242 - RNA, 21 nt, Human
cccagggccagggcccugcag

SEQ ID NO: 2229243 - RNA, 22 nt, Human
cccaggcuggccagccccacag

SEQ ID NO: 2229244 - RNA, 23 nt, Human
cccaggcuggccagccccacagc

SEQ ID NO: 2229245 - RNA, 16 nt, Human
cccaggcuggccagcc

SEQ ID NO: 2229246 - RNA, 17 nt, Human
cccaggcuggccagccc

SEQ ID NO: 2229247 - RNA, 19 nt, Human
cccaggcuggccagcccca

SEQ ID NO: 2229248 - RNA, 20 nt, Human
cccaggcuggccagccccac

SEQ ID NO: 2229249 - RNA, 17 nt, Human
cccaggcuggcgugcag

SEQ ID NO: 2229250 - RNA, 13 nt, Human
cccauccuccccu

SEQ ID NO: 2229251 - RNA, 12 nt, Human
cccauccucccc

SEQ ID NO: 2229252 - RNA, 19 nt, Human
cccauccuccagcuucugg

SEQ ID NO: 2229253 - RNA, 14 nt, Human
cccauccuccagcu

SEQ ID NO: 2229254 - RNA, 15 nt, Human
cccauccuccagcuu

SEQ ID NO: 2229255 - RNA, 16 nt, Human
cccauccuccagcuuc

SEQ ID NO: 2229256 - RNA, 17 nt, Human
cccauccuccagcuucu

SEQ ID NO: 2229257 - RNA, 18 nt, Human
cccauccuccagcaggga

SEQ ID NO: 2229258 - RNA, 16 nt, Human
cccauccuccagcagg

SEQ ID NO: 2229259 - RNA, 15 nt, Human
cccauccuccagcag

SEQ ID NO: 2229260 - RNA, 14 nt, Human
cccauccuccagca

SEQ ID NO: 2229261 - RNA, 22 nt, Human
cccauccuaucagccugucucu

SEQ ID NO: 2229262 - RNA, 18 nt, Human
cccauccuacccucgggc

SEQ ID NO: 2229263 - RNA, 23 nt, Human
cccauccuacccucgggcccacc

SEQ ID NO: 2229264 - RNA, 18 nt, Human
cccauccuccccuucccu

SEQ ID NO: 2229265 - RNA, 16 nt, Human
cccauccuccccuucc

SEQ ID NO: 2229266 - RNA, 15 nt, Human
cccauccuccccuuc

SEQ ID NO: 2229267 - RNA, 14 nt, Human
cccauccuccccuu

SEQ ID NO: 2229268 - RNA, 22 nt, Human
cccauccuccccuucccugcaa

SEQ ID NO: 2229269 - RNA, 13 nt, Human
cccauccucugua

SEQ ID NO: 2229270 - RNA, 19 nt, Human
cccagccaccccgggcucu

SEQ ID NO: 2229271 - RNA, 14 nt, Human
cccagccaccccgg

SEQ ID NO: 2229272 - RNA, 22 nt, Human
cccagccaccccgggcucucug

SEQ ID NO: 2229273 - RNA, 17 nt, Human
cccagccagaguuccug

SEQ ID NO: 2229274 - RNA, 18 nt, Human
cccagccagaguuccugc

SEQ ID NO: 2229275 - RNA, 23 nt, Human
cccagcucugguccauagagagc

SEQ ID NO: 2229276 - RNA, 12 nt, Human
cccagcugcacc

SEQ ID NO: 2229277 - RNA, 22 nt, Human
cccagcugacaguccucuccac

SEQ ID NO: 2229278 - RNA, 15 nt, Human
cccagcugacaugga

SEQ ID NO: 2229279 - RNA, 20 nt, Human
cccagcucuucuccccaggu

SEQ ID NO: 2229280 - RNA, 17 nt, Human
cccagcugacaguccuc

SEQ ID NO: 2229281 - RNA, 19 nt, Human
cccagcugacaguccucuc

SEQ ID NO: 2229282 - RNA, 21 nt, Human
cccagcugacaguccucucca

SEQ ID NO: 2229283 - RNA, 22 nt, Human
cccagccagaguuccugcggag

SEQ ID NO: 2229284 - RNA, 22 nt, Human
cccagccagauggacuccagcc

SEQ ID NO: 2229285 - RNA, 13 nt, Human
cccagcucuggug

SEQ ID NO: 2229286 - RNA, 15 nt, Human
cccagcucuggugag

SEQ ID NO: 2229287 - RNA, 20 nt, Human
cccagcucuggugagucuug

SEQ ID NO: 2229288 - RNA, 22 nt, Human
cccagcucuggugagucuuggc

SEQ ID NO: 2229289 - RNA, 22 nt, Human
cccagcuuaaaggggcuagagu

SEQ ID NO: 2229290 - RNA, 22 nt, Human
cccagcugcaccugccagccug

SEQ ID NO: 2229291 - RNA, 21 nt, Human
cccagcugcaccugccagccu

SEQ ID NO: 2229292 - RNA, 18 nt, Human
cccagcugcaccugccag

SEQ ID NO: 2229293 - RNA, 13 nt, Human
cccagcugcaccu

SEQ ID NO: 2229294 - RNA, 17 nt, Human
cccagcugacauggaaa

SEQ ID NO: 2229295 - RNA, 15 nt, Human
cccacugccugccca

SEQ ID NO: 2229296 - RNA, 14 nt, Human
cccacugccugccc

SEQ ID NO: 2229297 - RNA, 14 nt, Human
cccacugccuuuga

SEQ ID NO: 2229298 - RNA, 17 nt, Human
cccacuguccugggcgc

SEQ ID NO: 2229299 - RNA, 19 nt, Human
cccacugcuuuuggucugu

SEQ ID NO: 2229300 - RNA, 12 nt, Human
cccacugcucug

SEQ ID NO: 2229301 - RNA, 13 nt, Human
cccacugcucugg

SEQ ID NO: 2229302 - RNA, 16 nt, Human
cccacugccugcccac

SEQ ID NO: 2229303 - RNA, 13 nt, Human
cccacugcucccc

SEQ ID NO: 2229304 - RNA, 18 nt, Human
cccacuguccugggcgcc

SEQ ID NO: 2229305 - RNA, 22 nt, Human
cccacuguccugggcgcccugg

SEQ ID NO: 2229306 - RNA, 23 nt, Human
cccacuguccugggcgcccugga

SEQ ID NO: 2229307 - RNA, 14 nt, Human
cccacuuccccucc

SEQ ID NO: 2229308 - RNA, 15 nt, Human
cccacuuccccuccu

SEQ ID NO: 2229309 - RNA, 17 nt, Human
cccacuuccccuccuac

SEQ ID NO: 2229310 - RNA, 19 nt, Human
cccacuuccccuccuaccc

SEQ ID NO: 2229311 - RNA, 23 nt, Human
cccacuuccccuccuaccccucc

SEQ ID NO: 2229312 - RNA, 12 nt, Human
cccacuucccug

SEQ ID NO: 2229313 - RNA, 16 nt, Human
cccacuucccugacac

SEQ ID NO: 2229314 - RNA, 17 nt, Human
cccacuucccugacacu

SEQ ID NO: 2229315 - RNA, 19 nt, Human
cccacuucccugacacugc

SEQ ID NO: 2229316 - RNA, 20 nt, Human
cccacuucccugacacugcg

SEQ ID NO: 2229317 - RNA, 24 nt, Human
cccacuucccugacacugcggggc

SEQ ID NO: 2229318 - RNA, 12 nt, Human
cccacuuccugu

SEQ ID NO: 2229319 - RNA, 13 nt, Human
cccacugccugcc

SEQ ID NO: 2229320 - RNA, 16 nt, Human
cccacugccucagguu

SEQ ID NO: 2229321 - RNA, 18 nt, Human
cccacugccuacugcauc

SEQ ID NO: 2229322 - RNA, 15 nt, Human
cccacugccucaggu

SEQ ID NO: 2229323 - RNA, 16 nt, Human
cccacugcccaccccc

SEQ ID NO: 2229324 - RNA, 17 nt, Human
cccacugcccacccccu

SEQ ID NO: 2229325 - RNA, 19 nt, Human
cccacugcccacccccuca

SEQ ID NO: 2229326 - RNA, 22 nt, Human
cccacugcccacccccucaagc

SEQ ID NO: 2229327 - RNA, 19 nt, Human
cccacugcaggccccgcuu

SEQ ID NO: 2229328 - RNA, 17 nt, Human
cccacugccauaaaaca

SEQ ID NO: 2229329 - RNA, 12 nt, Human
cccacugcccac

SEQ ID NO: 2229330 - RNA, 23 nt, Human
cccacugcaggccccgcuugucc

SEQ ID NO: 2229331 - RNA, 15 nt, Human
cccacugcaggcccc

SEQ ID NO: 2229332 - RNA, 23 nt, Human
cccacugcacccccuccugcugc

SEQ ID NO: 2229333 - RNA, 19 nt, Human
cccacugcacccccuccug

SEQ ID NO: 2229334 - RNA, 20 nt, Human
cccacugcacccccuccugc

SEQ ID NO: 2229335 - RNA, 21 nt, Human
cccacugcacccccuccugcu

SEQ ID NO: 2229336 - RNA, 22 nt, Human
cccacugcacccccuccugcug

SEQ ID NO: 2229337 - RNA, 17 nt, Human
cccacuccccaccuuca

SEQ ID NO: 2229338 - RNA, 18 nt, Human
cccacugcacccccuccu

SEQ ID NO: 2229339 - RNA, 21 nt, Human
cccacguucucacacccaccg

SEQ ID NO: 2229340 - RNA, 18 nt, Human
cccacuagacccacugga

SEQ ID NO: 2229341 - RNA, 17 nt, Human
cccacguucucacaccc

SEQ ID NO: 2229342 - RNA, 20 nt, Human
cccacguucucacacccacc

SEQ ID NO: 2229343 - RNA, 23 nt, Human
cccacucaagccaagcagccaag

SEQ ID NO: 2229344 - RNA, 20 nt, Human
cccacucaagccaagcagcc

SEQ ID NO: 2229345 - RNA, 19 nt, Human
cccacucaagccaagcagc

SEQ ID NO: 2229346 - RNA, 17 nt, Human
cccacucaagccaagca

SEQ ID NO: 2229347 - RNA, 16 nt, Human
cccacucaagccaagc

SEQ ID NO: 2229348 - RNA, 18 nt, Human
cccacucagcuccgugaa

SEQ ID NO: 2229349 - RNA, 14 nt, Human
cccaccccccucau

SEQ ID NO: 2229350 - RNA, 15 nt, Human
cccacccucccugga

SEQ ID NO: 2229351 - RNA, 18 nt, Human
cccacccucccuggagug

SEQ ID NO: 2229352 - RNA, 13 nt, Human
cccaccccccuca

SEQ ID NO: 2229353 - RNA, 15 nt, Human
cccacccccaccccc

SEQ ID NO: 2229354 - RNA, 12 nt, Human
cccacccccuca

SEQ ID NO: 2229355 - RNA, 19 nt, Human
cccacccuccugucuuccc

SEQ ID NO: 2229356 - RNA, 16 nt, Human
cccacccucccuggag

SEQ ID NO: 2229357 - RNA, 13 nt, Human
cccacccuccugu

SEQ ID NO: 2229358 - RNA, 14 nt, Human
cccacccuccuguc

SEQ ID NO: 2229359 - RNA, 15 nt, Human
cccacccuccugucu

SEQ ID NO: 2229360 - RNA, 18 nt, Human
cccacccugaaagcccug

SEQ ID NO: 2229361 - RNA, 12 nt, Human
cccacccccauc

SEQ ID NO: 2229362 - RNA, 13 nt, Human
cccacccccagcu

SEQ ID NO: 2229363 - RNA, 22 nt, Human
cccacccacaauccuauucucg

SEQ ID NO: 2229364 - RNA, 18 nt, Human
cccacccccacccccacc

SEQ ID NO: 2229365 - RNA, 17 nt, Human
cccacccccacccaagg

SEQ ID NO: 2229366 - RNA, 12 nt, Human
cccacccccacc

SEQ ID NO: 2229367 - RNA, 15 nt, Human
cccacccccacccaa

SEQ ID NO: 2229368 - RNA, 20 nt, Human
cccacccaagggccuggccu

SEQ ID NO: 2229369 - RNA, 21 nt, Human
cccacccaagggccuggccug

SEQ ID NO: 2229370 - RNA, 22 nt, Human
cccacccaagggccuggccuga

SEQ ID NO: 2229371 - RNA, 15 nt, Human
cccacuucccugggc

SEQ ID NO: 2229372 - RNA, 21 nt, Human
ccccagagacucagagggagg

SEQ ID NO: 2229373 - RNA, 10 nt, Human
ccccagagac

SEQ ID NO: 2229374 - RNA, 13 nt, Human
ccccagagcacug

SEQ ID NO: 2229375 - RNA, 11 nt, Human
ccccagagcug

SEQ ID NO: 2229376 - RNA, 23 nt, Human
ccccagagcuguuuauggccuca

SEQ ID NO: 2229377 - RNA, 22 nt, Human
ccccagagcuguuuauggccuc

SEQ ID NO: 2229378 - RNA, 21 nt, Human
ccccagagcuguuuauggccu

SEQ ID NO: 2229379 - RNA, 12 nt, Human
ccccagagcugu

SEQ ID NO: 2229380 - RNA, 21 nt, Human
ccccagcaagugagagcuggg

SEQ ID NO: 2229381 - RNA, 19 nt, Human
ccccagcacuaaagcagug

SEQ ID NO: 2229382 - RNA, 11 nt, Human
ccccagcacua

SEQ ID NO: 2229383 - RNA, 12 nt, Human
ccccagcacuga

SEQ ID NO: 2229384 - RNA, 13 nt, Human
ccccagcacugag

SEQ ID NO: 2229385 - RNA, 15 nt, Human
ccccagcacugagga

SEQ ID NO: 2229386 - RNA, 13 nt, Human
ccccauccuggcc

SEQ ID NO: 2229387 - RNA, 14 nt, Human
ccccauccuggccc

SEQ ID NO: 2229388 - RNA, 15 nt, Human
ccccauccuggccca

SEQ ID NO: 2229389 - RNA, 16 nt, Human
ccccauccuggcccau

SEQ ID NO: 2229390 - RNA, 17 nt, Human
ccccauccuggcccauc

SEQ ID NO: 2229391 - RNA, 22 nt, Human
ccccagcaagugagagcugggu

SEQ ID NO: 2229392 - RNA, 18 nt, Human
ccccagaggccucucucu

SEQ ID NO: 2229393 - RNA, 13 nt, Human
ccccagcacccgg

SEQ ID NO: 2229394 - RNA, 15 nt, Human
ccccagcacccgggc

SEQ ID NO: 2229395 - RNA, 19 nt, Human
ccccagcacccgggcucag

SEQ ID NO: 2229396 - RNA, 14 nt, Human
ccccaucucuacua

SEQ ID NO: 2229397 - RNA, 23 nt, Human
ccccaucucaugccccuggcugg

SEQ ID NO: 2229398 - RNA, 21 nt, Human
ccccaucucaugccccuggcu

SEQ ID NO: 2229399 - RNA, 16 nt, Human
ccccaucucucccucc

SEQ ID NO: 2229400 - RNA, 12 nt, Human
ccccaucucucc

SEQ ID NO: 2229401 - RNA, 19 nt, Human
ccccaucucucccuccccu

SEQ ID NO: 2229402 - RNA, 13 nt, Human
ccccaucugccca

SEQ ID NO: 2229403 - RNA, 18 nt, Human
ccccauuuagguuucuga

SEQ ID NO: 2229404 - RNA, 17 nt, Human
ccccauuuauccaccuc

SEQ ID NO: 2229405 - RNA, 21 nt, Human
ccccauuuauccaccuccauc

SEQ ID NO: 2229406 - RNA, 14 nt, Human
ccccaucugcccag

SEQ ID NO: 2229407 - RNA, 17 nt, Human
ccccaucugcccaggac

SEQ ID NO: 2229408 - RNA, 18 nt, Human
ccccaucugcccaggacg

SEQ ID NO: 2229409 - RNA, 13 nt, Human
ccccauuucuauu

SEQ ID NO: 2229410 - RNA, 20 nt, Human
ccccauuucccaucugcacc

SEQ ID NO: 2229411 - RNA, 22 nt, Human
ccccauuucccaucugcacccc

SEQ ID NO: 2229412 - RNA, 16 nt, Human
ccccauuucccaucug

SEQ ID NO: 2229413 - RNA, 17 nt, Human
ccccauuucccaucugc

SEQ ID NO: 2229414 - RNA, 18 nt, Human
ccccauuucccaucugca

SEQ ID NO: 2229415 - RNA, 19 nt, Human
ccccauuucccaucugcac

SEQ ID NO: 2229416 - RNA, 22 nt, Human
cccccaaauggaaaugggcaga

SEQ ID NO: 2229417 - RNA, 17 nt, Human
ccccauuucuauuuauu

SEQ ID NO: 2229418 - RNA, 20 nt, Human
ccccauuucuauuuauuuac

SEQ ID NO: 2229419 - RNA, 16 nt, Human
cccccaacacugugcc

SEQ ID NO: 2229420 - RNA, 15 nt, Human
ccccauuuucugugg

SEQ ID NO: 2229421 - RNA, 23 nt, Human
ccccgacccuugccgucuaccug

SEQ ID NO: 2229422 - RNA, 19 nt, Human
ccccaaacgggcugcccug

SEQ ID NO: 2229423 - RNA, 18 nt, Human
ccccaaacaccuuccagc

SEQ ID NO: 2229424 - RNA, 22 nt, Human
ccccaaacaccuuccagcuccu

SEQ ID NO: 2229425 - RNA, 14 nt, Human
ccccaaagagccug

SEQ ID NO: 2229426 - RNA, 19 nt, Human
ccccaaaccugcaagggcu

SEQ ID NO: 2229427 - RNA, 20 nt, Human
ccccagacuccaccaagccu

SEQ ID NO: 2229428 - RNA, 21 nt, Human
ccccagacuccaccaagccug

SEQ ID NO: 2229429 - RNA, 15 nt, Human
cccauuguggcuccu

SEQ ID NO: 2229430 - RNA, 20 nt, Human
cccauugucccucugcccca

SEQ ID NO: 2229431 - RNA, 19 nt, Human
cccauuguggcuccuaucu

SEQ ID NO: 2229432 - RNA, 21 nt, Human
ccccaaaacucuccucugcug

SEQ ID NO: 2229433 - RNA, 23 nt, Human
ccccaaaacucuccucugcugcu

SEQ ID NO: 2229434 - RNA, 22 nt, Human
ccccaaaacucuccucugcugc

SEQ ID NO: 2229435 - RNA, 23 nt, Human
cccauuguggucacaggaaguag

SEQ ID NO: 2229436 - RNA, 22 nt, Human
cccauuguggucacaggaagua

SEQ ID NO: 2229437 - RNA, 18 nt, Human
cccauugucccucugccc

SEQ ID NO: 2229438 - RNA, 15 nt, Human
cccauugucccucug

SEQ ID NO: 2229439 - RNA, 16 nt, Human
ccccggccaccucugc

SEQ ID NO: 2229440 - RNA, 17 nt, Human
ccccggccaccucugcg

SEQ ID NO: 2229441 - RNA, 12 nt, Human
ccccggccaccu

SEQ ID NO: 2229442 - RNA, 13 nt, Human
ccccggccaccuc

SEQ ID NO: 2229443 - RNA, 14 nt, Human
ccccggccaccucu

SEQ ID NO: 2229444 - RNA, 15 nt, Human
ccccggccaccucug

SEQ ID NO: 2229445 - RNA, 19 nt, Human
ccccgcuuguccagcgccu

SEQ ID NO: 2229446 - RNA, 18 nt, Human
ccccgcuuguccagcgcc

SEQ ID NO: 2229447 - RNA, 17 nt, Human
ccccgcuuguccagcgc

SEQ ID NO: 2229448 - RNA, 15 nt, Human
ccccgcuuguccagc

SEQ ID NO: 2229449 - RNA, 14 nt, Human
ccccgcuucugccu

SEQ ID NO: 2229450 - RNA, 22 nt, Human
ccccgcucugcaugcggcccag

SEQ ID NO: 2229451 - RNA, 14 nt, Human
ccccggcagacgcc

SEQ ID NO: 2229452 - RNA, 14 nt, Human
ccccggaguucagu

SEQ ID NO: 2229453 - RNA, 12 nt, Human
ccccgagcuggg

SEQ ID NO: 2229454 - RNA, 20 nt, Human
cccccaacacugugcccugg

SEQ ID NO: 2229455 - RNA, 21 nt, Human
cccccaacacugugcccuggu

SEQ ID NO: 2229456 - RNA, 13 nt, Human
ccccgagcugggg

SEQ ID NO: 2229457 - RNA, 13 nt, Human
ccccgcucugcau

SEQ ID NO: 2229458 - RNA, 17 nt, Human
ccccgaggacccagacc

SEQ ID NO: 2229459 - RNA, 14 nt, Human
ccccgcucugcaug

SEQ ID NO: 2229460 - RNA, 21 nt, Human
ccccgcucugcaugcggccca

SEQ ID NO: 2229461 - RNA, 23 nt, Human
ccccgcucugcaugcggcccagc

SEQ ID NO: 2229462 - RNA, 23 nt, Human
ccccgaggccuucucugaaggac

SEQ ID NO: 2229463 - RNA, 23 nt, Human
ccccuuuucuuuucuacccuagc

SEQ ID NO: 2229464 - RNA, 19 nt, Human
ccccuuuuuacuccccuug

SEQ ID NO: 2229465 - RNA, 18 nt, Human
ccccuuuuuacuccccuu

SEQ ID NO: 2229466 - RNA, 15 nt, Human
ccccuuuucuuuucu

SEQ ID NO: 2229467 - RNA, 17 nt, Human
ccccuuuucuuuucuac

SEQ ID NO: 2229468 - RNA, 19 nt, Human
ccccuuuucuuuucuaccc

SEQ ID NO: 2229469 - RNA, 20 nt, Human
ccccuuuucuuuucuacccu

SEQ ID NO: 2229470 - RNA, 14 nt, Human
ccccuuuucugcau

SEQ ID NO: 2229471 - RNA, 16 nt, Human
ccccuuuucugcauuu

SEQ ID NO: 2229472 - RNA, 16 nt, Human
ccccuuuucagcuucu

SEQ ID NO: 2229473 - RNA, 17 nt, Human
ccccuuuucagcuucug

SEQ ID NO: 2229474 - RNA, 19 nt, Human
ccccuuuucagcuucugcu

SEQ ID NO: 2229475 - RNA, 22 nt, Human
ccccuuuucagcuucugcuggg

SEQ ID NO: 2229476 - RNA, 20 nt, Human
ccccuuugaugauuaauuca

SEQ ID NO: 2229477 - RNA, 13 nt, Human
ccccuuugggccc

SEQ ID NO: 2229478 - RNA, 16 nt, Human
ccccuuugggcccagg

SEQ ID NO: 2229479 - RNA, 17 nt, Human
ccccuuugggcccaggg

SEQ ID NO: 2229480 - RNA, 18 nt, Human
ccccuuugggcccaggga

SEQ ID NO: 2229481 - RNA, 20 nt, Human
ccccuuugggcccagggaca

SEQ ID NO: 2229482 - RNA, 12 nt, Human
ccccuuugugcu

SEQ ID NO: 2229483 - RNA, 13 nt, Human
ccccuuugugcug

SEQ ID NO: 2229484 - RNA, 15 nt, Human
ccccuuugugcugug

SEQ ID NO: 2229485 - RNA, 16 nt, Human
ccccuuugugcugugg

SEQ ID NO: 2229486 - RNA, 14 nt, Human
cccgaauagcuggg

SEQ ID NO: 2229487 - RNA, 14 nt, Human
cccgaauacaaaca

SEQ ID NO: 2229488 - RNA, 20 nt, Human
cccgaauacaaacaccugga

SEQ ID NO: 2229489 - RNA, 23 nt, Human
cccgaauacaaacaccuggacuu

SEQ ID NO: 2229490 - RNA, 17 nt, Human
cccggcaugggaaagcc

SEQ ID NO: 2229491 - RNA, 12 nt, Human
cccggccaccuc

SEQ ID NO: 2229492 - RNA, 13 nt, Human
cccggccaccucu

SEQ ID NO: 2229493 - RNA, 14 nt, Human
cccggccaccucug

SEQ ID NO: 2229494 - RNA, 15 nt, Human
cccggccaccucugc

SEQ ID NO: 2229495 - RNA, 20 nt, Human
cccggccaccucugcggacc

SEQ ID NO: 2229496 - RNA, 21 nt, Human
cccggccaccucugcggaccc

SEQ ID NO: 2229497 - RNA, 15 nt, Human
ccccuugggcggcug

SEQ ID NO: 2229498 - RNA, 18 nt, Human
ccccucuugccccaaccc

SEQ ID NO: 2229499 - RNA, 15 nt, Human
ccccuuguccuuucc

SEQ ID NO: 2229500 - RNA, 18 nt, Human
ccccuuguccuuucccuu

SEQ ID NO: 2229501 - RNA, 22 nt, Human
ccccuugcucuccccugcccug

SEQ ID NO: 2229502 - RNA, 24 nt, Human
ccccuugcccuugcccugaccucc

SEQ ID NO: 2229503 - RNA, 13 nt, Human
ccccuugggcggc

SEQ ID NO: 2229504 - RNA, 23 nt, Human
ccccuuuccuggacacucagacc

SEQ ID NO: 2229505 - RNA, 10 nt, Human
ccccuuuccu

SEQ ID NO: 2229506 - RNA, 22 nt, Human
ccccuuuccuggacacucagac

SEQ ID NO: 2229507 - RNA, 24 nt, Human
ccccuuucagaugucuucugccug

SEQ ID NO: 2229508 - RNA, 12 nt, Human
ccccucuugccc

SEQ ID NO: 2229509 - RNA, 13 nt, Human
ccccucuugcccc

SEQ ID NO: 2229510 - RNA, 14 nt, Human
ccccucuugcccca

SEQ ID NO: 2229511 - RNA, 15 nt, Human
ccccucuugccccaa

SEQ ID NO: 2229512 - RNA, 12 nt, Human
ccccucugucuu

SEQ ID NO: 2229513 - RNA, 22 nt, Human
ccccucuguccaggcacugaga

SEQ ID NO: 2229514 - RNA, 14 nt, Human
ccccucuguccagg

SEQ ID NO: 2229515 - RNA, 21 nt, Human
ccccuugcccagggcucagcc

SEQ ID NO: 2229516 - RNA, 20 nt, Human
ccccuugcccagggcucagc

SEQ ID NO: 2229517 - RNA, 17 nt, Human
ccccuugcccagggcuc

SEQ ID NO: 2229518 - RNA, 23 nt, Human
ccccuugcccagggcucagccug

SEQ ID NO: 2229519 - RNA, 17 nt, Human
ccccuugcccuugcccu

SEQ ID NO: 2229520 - RNA, 18 nt, Human
ccccuugcccuugcccug

SEQ ID NO: 2229521 - RNA, 19 nt, Human
ccccuugcccuugcccuga

SEQ ID NO: 2229522 - RNA, 21 nt, Human
ccccuugcccuugcccugacc

SEQ ID NO: 2229523 - RNA, 23 nt, Human
ccccuugcccuugcccugaccuc

SEQ ID NO: 2229524 - RNA, 11 nt, Human
cccggcuccag

SEQ ID NO: 2229525 - RNA, 12 nt, Human
cccggcuccagg

SEQ ID NO: 2229526 - RNA, 13 nt, Human
cccggccaccugc

SEQ ID NO: 2229527 - RNA, 14 nt, Human
cccggccaccugcg

SEQ ID NO: 2229528 - RNA, 13 nt, Human
cccggcuccaggc

SEQ ID NO: 2229529 - RNA, 14 nt, Human
cccggcuccaggcu

SEQ ID NO: 2229530 - RNA, 15 nt, Human
cccggcuccaggcuc

SEQ ID NO: 2229531 - RNA, 16 nt, Human
cccggcuccaggcucc

SEQ ID NO: 2229532 - RNA, 22 nt, Human
cccggcucgagcaguccugccu

SEQ ID NO: 2229533 - RNA, 16 nt, Human
cccggcugcagaggcc

SEQ ID NO: 2229534 - RNA, 21 nt, Human
cccggcugcagaggccagagg

SEQ ID NO: 2229535 - RNA, 17 nt, Human
cccggccaccugcggug

SEQ ID NO: 2229536 - RNA, 17 nt, Human
cccggcucccaccgagg

SEQ ID NO: 2229537 - RNA, 23 nt, Human
cccgggacgcagggguugcagug

SEQ ID NO: 2229538 - RNA, 18 nt, Human
cccgggacgcagcaggag

SEQ ID NO: 2229539 - RNA, 22 nt, Human
cccgggaagggggcugggacau

SEQ ID NO: 2229540 - RNA, 23 nt, Human
cccgggaggcagagguugcagug

SEQ ID NO: 2229541 - RNA, 18 nt, Human
cccuauuagagaagagau

SEQ ID NO: 2229542 - RNA, 17 nt, Human
cccuauugguaaagaau

SEQ ID NO: 2229543 - RNA, 19 nt, Human
cccgggagcugcugcccug

SEQ ID NO: 2229544 - RNA, 19 nt, Human
ccccucuggcuccagcugg

SEQ ID NO: 2229545 - RNA, 12 nt, Human
ccccucuggucg

SEQ ID NO: 2229546 - RNA, 12 nt, Human
ccccucugucca

SEQ ID NO: 2229547 - RNA, 23 nt, Human
ccccucuggucgcuccugcccac

SEQ ID NO: 2229548 - RNA, 19 nt, Human
ccccucuggucgcuccugc

SEQ ID NO: 2229549 - RNA, 20 nt, Human
ccccucuggucgcuccugcc

SEQ ID NO: 2229550 - RNA, 21 nt, Human
ccgccaaaagcugcucaggga

SEQ ID NO: 2229551 - RNA, 23 nt, Human
ccgcauucccugagucaccagga

SEQ ID NO: 2229552 - RNA, 15 nt, Human
ccgcauucccugagu

SEQ ID NO: 2229553 - RNA, 23 nt, Human
ccgccaagguagccaucccauga

SEQ ID NO: 2229554 - RNA, 16 nt, Human
ccgccagacuguuaga

SEQ ID NO: 2229555 - RNA, 23 nt, Human
ccgccacauggcuuccuccugcg

SEQ ID NO: 2229556 - RNA, 17 nt, Human
ccgccaccuaucucgug

SEQ ID NO: 2229557 - RNA, 23 nt, Human
ccgccaccuaucucgugggagag

SEQ ID NO: 2229558 - RNA, 16 nt, Human
ccgccacuccugaacc

SEQ ID NO: 2229559 - RNA, 12 nt, Human
ccgccagggccc

SEQ ID NO: 2229560 - RNA, 12 nt, Human
ccgccaggcgag

SEQ ID NO: 2229561 - RNA, 18 nt, Human
ccgccagccuccucugga

SEQ ID NO: 2229562 - RNA, 23 nt, Human
ccgccagccuccucuggacggca

SEQ ID NO: 2229563 - RNA, 16 nt, Human
ccgccagauggggccu

SEQ ID NO: 2229564 - RNA, 19 nt, Human
ccgccagauggggccucug

SEQ ID NO: 2229565 - RNA, 11 nt, Human
ccgccagccuc

SEQ ID NO: 2229566 - RNA, 12 nt, Human
ccgccagccucc

SEQ ID NO: 2229567 - RNA, 13 nt, Human
ccgccagccuccu

SEQ ID NO: 2229568 - RNA, 14 nt, Human
ccgccagccuccuc

SEQ ID NO: 2229569 - RNA, 15 nt, Human
ccgccagccuccucu

SEQ ID NO: 2229570 - RNA, 22 nt, Human
ccgaccucguccucccccugcc

SEQ ID NO: 2229571 - RNA, 19 nt, Human
ccgaccucguccucccccu

SEQ ID NO: 2229572 - RNA, 13 nt, Human
ccgaccucguccu

SEQ ID NO: 2229573 - RNA, 21 nt, Human
ccgaccgaggcuggagcuggc

SEQ ID NO: 2229574 - RNA, 15 nt, Human
ccgaccucagccuuc

SEQ ID NO: 2229575 - RNA, 14 nt, Human
ccgaccucagccuu

SEQ ID NO: 2229576 - RNA, 17 nt, Human
ccgccaaggcuggggga

SEQ ID NO: 2229577 - RNA, 13 nt, Human
ccgaccucagccu

SEQ ID NO: 2229578 - RNA, 12 nt, Human
ccgaccucagcc

SEQ ID NO: 2229579 - RNA, 19 nt, Human
ccgaccgaggcuggagcug

SEQ ID NO: 2229580 - RNA, 16 nt, Human
ccgacccuugccgucu

SEQ ID NO: 2229581 - RNA, 23 nt, Human
ccgaaucucuuuuugcuuucgaa

SEQ ID NO: 2229582 - RNA, 19 nt, Human
ccgaauccccucccuguca

SEQ ID NO: 2229583 - RNA, 13 nt, Human
ccgaaugugcagg

SEQ ID NO: 2229584 - RNA, 21 nt, Human
cccuucuuggugcuuacacau

SEQ ID NO: 2229585 - RNA, 16 nt, Human
ccgaauccccucccug

SEQ ID NO: 2229586 - RNA, 18 nt, Human
ccgaauccccucccuguc

SEQ ID NO: 2229587 - RNA, 13 nt, Human
ccgaccagagccc

SEQ ID NO: 2229588 - RNA, 15 nt, Human
ccgacaaccgaugcu

SEQ ID NO: 2229589 - RNA, 20 nt, Human
ccgaaugugcagguuuguua

SEQ ID NO: 2229590 - RNA, 20 nt, Human
ccgacaaccgaugcuccagc

SEQ ID NO: 2229591 - RNA, 18 nt, Human
ccgacaaccgaugcucca

SEQ ID NO: 2229592 - RNA, 20 nt, Human
ccgaauagcugggacuacag

SEQ ID NO: 2229593 - RNA, 17 nt, Human
cccuucuuuccacagaa

SEQ ID NO: 2229594 - RNA, 23 nt, Human
cccuucugcucagcucugggcca

SEQ ID NO: 2229595 - RNA, 14 nt, Human
cccuucugcucagc

SEQ ID NO: 2229596 - RNA, 13 nt, Human
cccuucugcuacu

SEQ ID NO: 2229597 - RNA, 20 nt, Human
cccuucugggcaucuguucu

SEQ ID NO: 2229598 - RNA, 21 nt, Human
cccuucugggcaucuguucug

SEQ ID NO: 2229599 - RNA, 22 nt, Human
cccuucugggcaucuguucugg

SEQ ID NO: 2229600 - RNA, 17 nt, Human
cccuucugucccucaca

SEQ ID NO: 2229601 - RNA, 16 nt, Human
cccuucugucccucac

SEQ ID NO: 2229602 - RNA, 16 nt, Human
ccgcccccugcccucc

SEQ ID NO: 2229603 - RNA, 17 nt, Human
ccgcccccugcccuccc

SEQ ID NO: 2229604 - RNA, 11 nt, Human
ccgcccccugc

SEQ ID NO: 2229605 - RNA, 14 nt, Human
ccgccccagccucu

SEQ ID NO: 2229606 - RNA, 12 nt, Human
ccgcccccuccu

SEQ ID NO: 2229607 - RNA, 19 nt, Human
ccgcccccaguccccaccc

SEQ ID NO: 2229608 - RNA, 15 nt, Human
ccgccccagccucug

SEQ ID NO: 2229609 - RNA, 13 nt, Human
ccgccccacauuc

SEQ ID NO: 2229610 - RNA, 13 nt, Human
ccgcccccagucc

SEQ ID NO: 2229611 - RNA, 19 nt, Human
ccgccauugccaccaggag

SEQ ID NO: 2229612 - RNA, 16 nt, Human
ccgccauugccaccag

SEQ ID NO: 2229613 - RNA, 15 nt, Human
ccgccauugccacca

SEQ ID NO: 2229614 - RNA, 20 nt, Human
ccgcccaggcuuagucacug

SEQ ID NO: 2229615 - RNA, 20 nt, Human
ccgccauucucaagcccugc

SEQ ID NO: 2229616 - RNA, 21 nt, Human
ccgccagggcccacacccccu

SEQ ID NO: 2229617 - RNA, 15 nt, Human
ccgccauggcuucca

SEQ ID NO: 2229618 - RNA, 14 nt, Human
ccgccauugccacc

SEQ ID NO: 2229619 - RNA, 21 nt, Human
ccgccauucucaagcccugca

SEQ ID NO: 2229620 - RNA, 16 nt, Human
ccgccaugcuccuggc

SEQ ID NO: 2229621 - RNA, 21 nt, Human
cccuucugacccaugcugccc

SEQ ID NO: 2229622 - RNA, 22 nt, Human
cccuucugacccaugcugcccu

SEQ ID NO: 2229623 - RNA, 23 nt, Human
cccuucugacccaugcugcccug

SEQ ID NO: 2229624 - RNA, 18 nt, Human
cccugugcuccgugccuc

SEQ ID NO: 2229625 - RNA, 17 nt, Human
cccuucuaccugccacu

SEQ ID NO: 2229626 - RNA, 16 nt, Human
cccuucuaccugccac

SEQ ID NO: 2229627 - RNA, 17 nt, Human
cccugugcuccgugccu

SEQ ID NO: 2229628 - RNA, 16 nt, Human
cccuucuaccuuccug

SEQ ID NO: 2229629 - RNA, 16 nt, Human
cccuucgcuccugugu

SEQ ID NO: 2229630 - RNA, 18 nt, Human
cccuucgcuccugugucu

SEQ ID NO: 2229631 - RNA, 20 nt, Human
cccugugccuaacaccagcg

SEQ ID NO: 2229632 - RNA, 21 nt, Human
cccugugccuaacaccagcgu

SEQ ID NO: 2229633 - RNA, 22 nt, Human
cccugugccuaacaccagcguu

SEQ ID NO: 2229634 - RNA, 24 nt, Human
cccugugccuuggugugcuguauc

SEQ ID NO: 2229635 - RNA, 20 nt, Human
cccuggcccucaaggccucc

SEQ ID NO: 2229636 - RNA, 21 nt, Human
cccuggccucugugccuucuu

SEQ ID NO: 2229637 - RNA, 22 nt, Human
cccuggccugcugggcucucca

SEQ ID NO: 2229638 - RNA, 21 nt, Human
cccuggccugcugggcucucc

SEQ ID NO: 2229639 - RNA, 14 nt, Human
cccuggccugcugg

SEQ ID NO: 2229640 - RNA, 13 nt, Human
cccuggccugcug

SEQ ID NO: 2229641 - RNA, 19 nt, Human
cccuggccuguucuguuuu

SEQ ID NO: 2229642 - RNA, 15 nt, Human
cccuggccuguucug

SEQ ID NO: 2229643 - RNA, 17 nt, Human
cccuggccuuucauauu

SEQ ID NO: 2229644 - RNA, 14 nt, Human
cccuggccccagga

SEQ ID NO: 2229645 - RNA, 13 nt, Human
cccuggccccagg

SEQ ID NO: 2229646 - RNA, 21 nt, Human
cccuggcccagcggccccucc

SEQ ID NO: 2229647 - RNA, 13 nt, Human
cccuggcccucaa

SEQ ID NO: 2229648 - RNA, 15 nt, Human
cccuggccagaggcu

SEQ ID NO: 2229649 - RNA, 14 nt, Human
cccuggccagaggc

SEQ ID NO: 2229650 - RNA, 13 nt, Human
cccuggccagagg

SEQ ID NO: 2229651 - RNA, 23 nt, Human
cccuggcauuauguccacugugu

SEQ ID NO: 2229652 - RNA, 20 nt, Human
cccuggccaccaccccccac

SEQ ID NO: 2229653 - RNA, 23 nt, Human
cccuggccaccaccccccacucu

SEQ ID NO: 2229654 - RNA, 20 nt, Human
cccuggcaggaugacccugc

SEQ ID NO: 2229655 - RNA, 22 nt, Human
cccuggcaggaugacccugcga

SEQ ID NO: 2229656 - RNA, 14 nt, Human
cccuggcagccccu

SEQ ID NO: 2229657 - RNA, 16 nt, Human
cccuggcagccccugu

SEQ ID NO: 2229658 - RNA, 22 nt, Human
cccuggcugcugcccccacccc

SEQ ID NO: 2229659 - RNA, 19 nt, Human
cccuggcuuguaacuccac

SEQ ID NO: 2229660 - RNA, 23 nt, Human
cccuggcugggacguggcucagc

SEQ ID NO: 2229661 - RNA, 15 nt, Human
cccuggcugcugccc

SEQ ID NO: 2229662 - RNA, 18 nt, Human
cccuggcugcugccccca

SEQ ID NO: 2229663 - RNA, 20 nt, Human
cccuggcugcccuggcccug

SEQ ID NO: 2229664 - RNA, 22 nt, Human
cccuggcugcccuggcccugag

SEQ ID NO: 2229665 - RNA, 13 nt, Human
cccuggcugcugc

SEQ ID NO: 2229666 - RNA, 14 nt, Human
cccuggcugcugcc

SEQ ID NO: 2229667 - RNA, 17 nt, Human
cccuggcucccacaggc

SEQ ID NO: 2229668 - RNA, 19 nt, Human
cccuggcucccacaggccc

SEQ ID NO: 2229669 - RNA, 19 nt, Human
cccuggcugcccuggcccu

SEQ ID NO: 2229670 - RNA, 16 nt, Human
cccuggcuccaggcca

SEQ ID NO: 2229671 - RNA, 13 nt, Human
cccuggcuccagg

SEQ ID NO: 2229672 - RNA, 13 nt, Human
cccuggcuuuuca

SEQ ID NO: 2229673 - RNA, 23 nt, Human
cccuggcuuguaacuccaccaac

SEQ ID NO: 2229674 - RNA, 20 nt, Human
cccuggcuuguaacuccacc

SEQ ID NO: 2229675 - RNA, 13 nt, Human
cccucaccccugc

SEQ ID NO: 2229676 - RNA, 18 nt, Human
cccucacagccucugacc

SEQ ID NO: 2229677 - RNA, 12 nt, Human
cccucaccaaca

SEQ ID NO: 2229678 - RNA, 14 nt, Human
cccucaccaggggc

SEQ ID NO: 2229679 - RNA, 14 nt, Human
cccucacagccucu

SEQ ID NO: 2229680 - RNA, 15 nt, Human
cccucacagccucug

SEQ ID NO: 2229681 - RNA, 16 nt, Human
cccucacagccucuga

SEQ ID NO: 2229682 - RNA, 17 nt, Human
cccucacagccucugac

SEQ ID NO: 2229683 - RNA, 23 nt, Human
cccuauuuaacagggucucuagu

SEQ ID NO: 2229684 - RNA, 21 nt, Human
cccuauuuaacagggucucua

SEQ ID NO: 2229685 - RNA, 20 nt, Human
cccuauuuuuuuucuguuau

SEQ ID NO: 2229686 - RNA, 16 nt, Human
cccuauuuccccaccc

SEQ ID NO: 2229687 - RNA, 24 nt, Human
cccucaaaccuccucuucugacgu

SEQ ID NO: 2229688 - RNA, 20 nt, Human
cccucaaaccuccucuucug

SEQ ID NO: 2229689 - RNA, 21 nt, Human
cccucaaaccuccucuucuga

SEQ ID NO: 2229690 - RNA, 21 nt, Human
cccuauuuuuuuucuguuaua

SEQ ID NO: 2229691 - RNA, 15 nt, Human
cccucaaaccuccuc

SEQ ID NO: 2229692 - RNA, 19 nt, Human
cccucaaaccuccucuucu

SEQ ID NO: 2229693 - RNA, 13 nt, Human
cccugcccugugg

SEQ ID NO: 2229694 - RNA, 12 nt, Human
cccugcccugug

SEQ ID NO: 2229695 - RNA, 11 nt, Human
cccugcccugu

SEQ ID NO: 2229696 - RNA, 13 nt, Human
cccucaccccugg

SEQ ID NO: 2229697 - RNA, 20 nt, Human
cccucaccccugguucucau

SEQ ID NO: 2229698 - RNA, 22 nt, Human
cccucaccccugguucucaucu

SEQ ID NO: 2229699 - RNA, 21 nt, Human
cccucacccacuuuggccucc

SEQ ID NO: 2229700 - RNA, 15 nt, Human
cccucacccugagcc

SEQ ID NO: 2229701 - RNA, 14 nt, Human
cccugcccuguggg

SEQ ID NO: 2229702 - RNA, 15 nt, Human
cccugcccugugggc

SEQ ID NO: 2229703 - RNA, 16 nt, Human
cccugcccugugggcc

SEQ ID NO: 2229704 - RNA, 20 nt, Human
cccugcccugugggccccca

SEQ ID NO: 2229705 - RNA, 21 nt, Human
cccugcccugugggcccccaa

SEQ ID NO: 2229706 - RNA, 13 nt, Human
cccucacccugcc

SEQ ID NO: 2229707 - RNA, 20 nt, Human
cccucacccugagccccuuc

SEQ ID NO: 2229708 - RNA, 22 nt, Human
cccucacccugagccccuuccu

SEQ ID NO: 2229709 - RNA, 16 nt, Human
cccucacccugccuua

SEQ ID NO: 2229710 - RNA, 12 nt, Human
cccuggcagccc

SEQ ID NO: 2229711 - RNA, 13 nt, Human
cccuggcagcccc

SEQ ID NO: 2229712 - RNA, 12 nt, Human
ccgucacagccu

SEQ ID NO: 2229713 - RNA, 22 nt, Human
ccguaguucccugaaaacccag

SEQ ID NO: 2229714 - RNA, 12 nt, Human
ccguauuucaga

SEQ ID NO: 2229715 - RNA, 13 nt, Human
ccgucacagccuc

SEQ ID NO: 2229716 - RNA, 18 nt, Human
ccggcuaauuuuuguaau

SEQ ID NO: 2229717 - RNA, 14 nt, Human
ccguaguucccuga

SEQ ID NO: 2229718 - RNA, 16 nt, Human
ccguaguucccugaaa

SEQ ID NO: 2229719 - RNA, 15 nt, Human
ccguaguucccugaa

SEQ ID NO: 2229720 - RNA, 16 nt, Human
ccgucucaugaggggc

SEQ ID NO: 2229721 - RNA, 20 nt, Human
ccgucuccaggggcugcuuc

SEQ ID NO: 2229722 - RNA, 21 nt, Human
ccgucuccaggggcugcuucc

SEQ ID NO: 2229723 - RNA, 13 nt, Human
ccgucucucuccc

SEQ ID NO: 2229724 - RNA, 14 nt, Human
ccgucucucuccca

SEQ ID NO: 2229725 - RNA, 19 nt, Human
ccgucuaguuaacauuuca

SEQ ID NO: 2229726 - RNA, 21 nt, Human
ccgucucaguguugagccuuu

SEQ ID NO: 2229727 - RNA, 18 nt, Human
ccguccaggagccugugc

SEQ ID NO: 2229728 - RNA, 16 nt, Human
ccguccaggagccugg

SEQ ID NO: 2229729 - RNA, 22 nt, Human
ccguccagccgccauugccacc

SEQ ID NO: 2229730 - RNA, 17 nt, Human
ccgucauguuccucaaa

SEQ ID NO: 2229731 - RNA, 14 nt, Human
ccguccagaccuug

SEQ ID NO: 2229732 - RNA, 16 nt, Human
ccgucauguuccucaa

SEQ ID NO: 2229733 - RNA, 15 nt, Human
ccgucauguuccuca

SEQ ID NO: 2229734 - RNA, 21 nt, Human
ccgucauggcuuaauguuuau

SEQ ID NO: 2229735 - RNA, 20 nt, Human
ccgucaguaucaggccugcc

SEQ ID NO: 2229736 - RNA, 16 nt, Human
ccgucagggcccaagu

SEQ ID NO: 2229737 - RNA, 12 nt, Human
ccgucagggccc

SEQ ID NO: 2229738 - RNA, 14 nt, Human
ccgucagggcccaa

SEQ ID NO: 2229739 - RNA, 17 nt, Human
ccgucagccaaauguaa

SEQ ID NO: 2229740 - RNA, 22 nt, Human
ccggcuaugggggcacugagga

SEQ ID NO: 2229741 - RNA, 23 nt, Human
ccggcuaugggggcacugaggac

SEQ ID NO: 2229742 - RNA, 17 nt, Human
ccggcuaugggggcacu

SEQ ID NO: 2229743 - RNA, 19 nt, Human
ccggcuaauuuuuguauuu

SEQ ID NO: 2229744 - RNA, 16 nt, Human
ccguagguuauuuuca

SEQ ID NO: 2229745 - RNA, 22 nt, Human
ccggcgugguggaagaggggac

SEQ ID NO: 2229746 - RNA, 23 nt, Human
ccgucugggguucagccccuccu

SEQ ID NO: 2229747 - RNA, 22 nt, Human
ccgucugggguucagccccucc

SEQ ID NO: 2229748 - RNA, 18 nt, Human
ccuaagaguugagcucuc

SEQ ID NO: 2229749 - RNA, 16 nt, Human
ccuaagaguguuuaau

SEQ ID NO: 2229750 - RNA, 12 nt, Human
ccuaagaguguu

SEQ ID NO: 2229751 - RNA, 21 nt, Human
ccgucugggguucagccccuc

SEQ ID NO: 2229752 - RNA, 20 nt, Human
ccgucugggguucagccccu

SEQ ID NO: 2229753 - RNA, 19 nt, Human
ccgucugggguucagcccc

SEQ ID NO: 2229754 - RNA, 17 nt, Human
ccgucugggguucagcc

SEQ ID NO: 2229755 - RNA, 18 nt, Human
ccgucucugguuccuccc

SEQ ID NO: 2229756 - RNA, 19 nt, Human
ccgucucucucccauggag

SEQ ID NO: 2229757 - RNA, 22 nt, Human
ccgucucucucccauggagccc

SEQ ID NO: 2229758 - RNA, 21 nt, Human
ccuaagccaagggccucuugc

SEQ ID NO: 2229759 - RNA, 13 nt, Human
ccuaagccaaggg

SEQ ID NO: 2229760 - RNA, 19 nt, Human
ccuaagggcucaccguggc

SEQ ID NO: 2229761 - RNA, 22 nt, Human
ccuaaggcugcaagguuuaggc

SEQ ID NO: 2229762 - RNA, 23 nt, Human
ccuaagggacauguuuugauaaa

SEQ ID NO: 2229763 - RNA, 12 nt, Human
ccuaaggcugca

SEQ ID NO: 2229764 - RNA, 14 nt, Human
ccuaaggacacacu

SEQ ID NO: 2229765 - RNA, 13 nt, Human
ccuaaggacacac

SEQ ID NO: 2229766 - RNA, 22 nt, Human
ccuaaggaaaggaauuggcaug

SEQ ID NO: 2229767 - RNA, 18 nt, Human
ccuaaguccuuuaugugg

SEQ ID NO: 2229768 - RNA, 16 nt, Human
ccuaaguccuuuaugu

SEQ ID NO: 2229769 - RNA, 20 nt, Human
ccuaaguuucaguugauuuu

SEQ ID NO: 2229770 - RNA, 16 nt, Human
ccuaaguggcugcuga

SEQ ID NO: 2229771 - RNA, 15 nt, Human
ccuaaguggcugcug

SEQ ID NO: 2229772 - RNA, 14 nt, Human
ccuaaguggcugcu

SEQ ID NO: 2229773 - RNA, 14 nt, Human
ccuaauaaagcugu

SEQ ID NO: 2229774 - RNA, 17 nt, Human
ccuaaucaggcugaggu

SEQ ID NO: 2229775 - RNA, 13 nt, Human
ccuaauccaggca

SEQ ID NO: 2229776 - RNA, 15 nt, Human
ccuaauccaggcaga

SEQ ID NO: 2229777 - RNA, 14 nt, Human
ccuaauccaggcag

SEQ ID NO: 2229778 - RNA, 23 nt, Human
ccuagagugagggccugaggucu

SEQ ID NO: 2229779 - RNA, 22 nt, Human
ccuagaguagaguggagggagg

SEQ ID NO: 2229780 - RNA, 18 nt, Human
ccuagaguagaguggagg

SEQ ID NO: 2229781 - RNA, 18 nt, Human
ccuagagggaggggccua

SEQ ID NO: 2229782 - RNA, 23 nt, Human
ccuagagguacuuuccacuugau

SEQ ID NO: 2229783 - RNA, 21 nt, Human
ccuaauaaaguucuguacuca

SEQ ID NO: 2229784 - RNA, 16 nt, Human
ccuaauaaaguucugu

SEQ ID NO: 2229785 - RNA, 23 nt, Human
ccuaauaaagcuguguggcaguc

SEQ ID NO: 2229786 - RNA, 20 nt, Human
ccuaggagugccccauucuu

SEQ ID NO: 2229787 - RNA, 20 nt, Human
ccuaggagauaucugaggga

SEQ ID NO: 2229788 - RNA, 22 nt, Human
ccuaggagauaucugagggagg

SEQ ID NO: 2229789 - RNA, 16 nt, Human
ccuaggauugugccug

SEQ ID NO: 2229790 - RNA, 13 nt, Human
ccuaggcaggaca

SEQ ID NO: 2229791 - RNA, 18 nt, Human
ccuaggcaggacaugcug

SEQ ID NO: 2229792 - RNA, 22 nt, Human
ccuaggcaggacaugcugaagc

SEQ ID NO: 2229793 - RNA, 23 nt, Human
ccuaggcaggacaugcugaagcc

SEQ ID NO: 2229794 - RNA, 12 nt, Human
ccuaggagacca

SEQ ID NO: 2229795 - RNA, 17 nt, Human
ccuaggagauaucugag

SEQ ID NO: 2229796 - RNA, 19 nt, Human
ccuaggagauaucugaggg

SEQ ID NO: 2229797 - RNA, 17 nt, Human
ccuagcacacacuuuug

SEQ ID NO: 2229798 - RNA, 20 nt, Human
ccuagauccacacacagagg

SEQ ID NO: 2229799 - RNA, 19 nt, Human
ccuagauccacacacagag

SEQ ID NO: 2229800 - RNA, 17 nt, Human
ccuagauccacacacag

SEQ ID NO: 2229801 - RNA, 23 nt, Human
ccuagauggcagucacugaauuc

SEQ ID NO: 2229802 - RNA, 21 nt, Human
ccucagcccugacccugugga

SEQ ID NO: 2229803 - RNA, 19 nt, Human
ccucaaggccucccacagu

SEQ ID NO: 2229804 - RNA, 17 nt, Human
ccucaaggccucccaca

SEQ ID NO: 2229805 - RNA, 18 nt, Human
ccucaaggccucccacag

SEQ ID NO: 2229806 - RNA, 23 nt, Human
ccucaaggacuugaaagcaucca

SEQ ID NO: 2229807 - RNA, 22 nt, Human
ccucaaggacuugaaagcaucc

SEQ ID NO: 2229808 - RNA, 15 nt, Human
ccucaaggccuccca

SEQ ID NO: 2229809 - RNA, 16 nt, Human
ccucaaggccucccac

SEQ ID NO: 2229810 - RNA, 20 nt, Human
ccucagccuagacccuccuc

SEQ ID NO: 2229811 - RNA, 19 nt, Human
ccucagccuagacccuccu

SEQ ID NO: 2229812 - RNA, 16 nt, Human
ccucagccuagacccu

SEQ ID NO: 2229813 - RNA, 14 nt, Human
ccucagccuagacc

SEQ ID NO: 2229814 - RNA, 11 nt, Human
ccucagccucc

SEQ ID NO: 2229815 - RNA, 22 nt, Human
ccucagccucccaaagugcugg

SEQ ID NO: 2229816 - RNA, 21 nt, Human
ccucaaggacuugaaagcauc

SEQ ID NO: 2229817 - RNA, 20 nt, Human
ccucaaggacuugaaagcau

SEQ ID NO: 2229818 - RNA, 19 nt, Human
ccucaaggacuugaaagca

SEQ ID NO: 2229819 - RNA, 13 nt, Human
ccucaaggacuug

SEQ ID NO: 2229820 - RNA, 12 nt, Human
ccucaaggacuu

SEQ ID NO: 2229821 - RNA, 15 nt, Human
ccucaagcugcaucu

SEQ ID NO: 2229822 - RNA, 17 nt, Human
ccucaagaugaaggcaa

SEQ ID NO: 2229823 - RNA, 16 nt, Human
ccucaagaaauaaaag

SEQ ID NO: 2229824 - RNA, 16 nt, Human
ccucaagccaaucccc

SEQ ID NO: 2229825 - RNA, 18 nt, Human
ccucaagccaauccccuc

SEQ ID NO: 2229826 - RNA, 20 nt, Human
ccucaagccaauccccuccu

SEQ ID NO: 2229827 - RNA, 15 nt, Human
ccucaacucuccucc

SEQ ID NO: 2229828 - RNA, 15 nt, Human
ccucaagagaaggca

SEQ ID NO: 2229829 - RNA, 15 nt, Human
ccuauuuccccaccc

SEQ ID NO: 2229830 - RNA, 18 nt, Human
ccuauuuccauucaacaa

SEQ ID NO: 2229831 - RNA, 15 nt, Human
ccuauuuuaauaaac

SEQ ID NO: 2229832 - RNA, 22 nt, Human
ccuauugugauuugacuguuuu

SEQ ID NO: 2229833 - RNA, 17 nt, Human
ccuauuugccaugggcu

SEQ ID NO: 2229834 - RNA, 13 nt, Human
ccuauuuucauug

SEQ ID NO: 2229835 - RNA, 19 nt, Human
ccuauuuugaaaaauuccu

SEQ ID NO: 2229836 - RNA, 16 nt, Human
ccucaaccuccugggc

SEQ ID NO: 2229837 - RNA, 20 nt, Human
ccuauuuugaaaaauuccua

SEQ ID NO: 2229838 - RNA, 21 nt, Human
ccuauuuugaaaaauuccuau

SEQ ID NO: 2229839 - RNA, 22 nt, Human
ccuauuuugaaaaauuccuauu

SEQ ID NO: 2229840 - RNA, 23 nt, Human
ccuauuuugaaaaauuccuauug

SEQ ID NO: 2229841 - RNA, 14 nt, Human
ccucaaccugugau

SEQ ID NO: 2229842 - RNA, 19 nt, Human
ccucaacguugcuccccau

SEQ ID NO: 2229843 - RNA, 21 nt, Human
ccucaacucaccuaauguuua

SEQ ID NO: 2229844 - RNA, 13 nt, Human
ccucaaccuguga

SEQ ID NO: 2229845 - RNA, 18 nt, Human
ccucaacguauuguuucg

SEQ ID NO: 2229846 - RNA, 20 nt, Human
ccucaaccucuucuggcuca

SEQ ID NO: 2229847 - RNA, 17 nt, Human
ccucaaccucuucuggc

SEQ ID NO: 2229848 - RNA, 12 nt, Human
ccucaaccucuu

SEQ ID NO: 2229849 - RNA, 14 nt, Human
ccucagccuccuga

SEQ ID NO: 2229850 - RNA, 12 nt, Human
ccucagccuccg

SEQ ID NO: 2229851 - RNA, 18 nt, Human
ccucaugugaucacaauu

SEQ ID NO: 2229852 - RNA, 20 nt, Human
ccucauguccacugguucuu

SEQ ID NO: 2229853 - RNA, 13 nt, Human
ccucauguucuua

SEQ ID NO: 2229854 - RNA, 13 nt, Human
ccucauguggcug

SEQ ID NO: 2229855 - RNA, 15 nt, Human
ccucauguggcugga

SEQ ID NO: 2229856 - RNA, 16 nt, Human
ccucauguggcuggaa

SEQ ID NO: 2229857 - RNA, 17 nt, Human
ccucauguggcuggaag

SEQ ID NO: 2229858 - RNA, 23 nt, Human
ccucagccucccaaagugcuggg

SEQ ID NO: 2229859 - RNA, 22 nt, Human
ccucagccucccgaauagcugg

SEQ ID NO: 2229860 - RNA, 13 nt, Human
ccucagccuccug

SEQ ID NO: 2229861 - RNA, 22 nt, Human
ccucagccucccaaguagcugg

SEQ ID NO: 2229862 - RNA, 23 nt, Human
ccucagccgacugcacagcggcc

SEQ ID NO: 2229863 - RNA, 15 nt, Human
ccucauguccacugg

SEQ ID NO: 2229864 - RNA, 22 nt, Human
ccucauuacuuuaccaccccca

SEQ ID NO: 2229865 - RNA, 20 nt, Human
ccuccaaggaggggcuguaa

SEQ ID NO: 2229866 - RNA, 20 nt, Human
ccucaaggccucccacagug

SEQ ID NO: 2229867 - RNA, 21 nt, Human
ccuccaaggaggggcuguaaa

SEQ ID NO: 2229868 - RNA, 22 nt, Human
ccucccaaggggcccaaauucu

SEQ ID NO: 2229869 - RNA, 22 nt, Human
ccuccaaucccaccaacccuca

SEQ ID NO: 2229870 - RNA, 18 nt, Human
ccucauuagcauuuugcu

SEQ ID NO: 2229871 - RNA, 21 nt, Human
ccuccaagcuccaucuccacu

SEQ ID NO: 2229872 - RNA, 22 nt, Human
ccuccaagcuccaucuccacuc

SEQ ID NO: 2229873 - RNA, 19 nt, Human
ccucauguucuuaauucuu

SEQ ID NO: 2229874 - RNA, 17 nt, Human
ccucauuaaugacacuu

SEQ ID NO: 2229875 - RNA, 15 nt, Human
ccucauuaaugacac

SEQ ID NO: 2229876 - RNA, 18 nt, Human
ccucauguggcuggaaga

SEQ ID NO: 2229877 - RNA, 23 nt, Human
ccucauguggcuggaagauccug

SEQ ID NO: 2229878 - RNA, 12 nt, Human
ccucccagccug

SEQ ID NO: 2229879 - RNA, 18 nt, Human
ccucccagcccuauggau

SEQ ID NO: 2229880 - RNA, 19 nt, Human
ccucccagcccuauggaug

SEQ ID NO: 2229881 - RNA, 12 nt, Human
ccucccagcccu

SEQ ID NO: 2229882 - RNA, 13 nt, Human
ccucccagcccua

SEQ ID NO: 2229883 - RNA, 13 nt, Human
ccucccacccacc

SEQ ID NO: 2229884 - RNA, 21 nt, Human
ccucccagaucggaucuguug

SEQ ID NO: 2229885 - RNA, 15 nt, Human
ccucccaccacagca

SEQ ID NO: 2229886 - RNA, 14 nt, Human
ccucccaccacagc

SEQ ID NO: 2229887 - RNA, 12 nt, Human
ccucccaccaca

SEQ ID NO: 2229888 - RNA, 17 nt, Human
ccucccaaguggugccu

SEQ ID NO: 2229889 - RNA, 19 nt, Human
ccucccaauuucagacucc

SEQ ID NO: 2229890 - RNA, 20 nt, Human
ccucccaauuucagacuccc

SEQ ID NO: 2229891 - RNA, 11 nt, Human
ccucccacaca

SEQ ID NO: 2229892 - RNA, 12 nt, Human
ccucccacagug

SEQ ID NO: 2229893 - RNA, 13 nt, Human
ccucccacaguga

SEQ ID NO: 2229894 - RNA, 23 nt, Human
ccucccacagugacucgggcucc

SEQ ID NO: 2229895 - RNA, 14 nt, Human
ccucccaggcgccc

SEQ ID NO: 2229896 - RNA, 20 nt, Human
ccucccaggcgccccuuccc

SEQ ID NO: 2229897 - RNA, 11 nt, Human
ccucccagcug

SEQ ID NO: 2229898 - RNA, 20 nt, Human
ccucccagcccuauggaugu

SEQ ID NO: 2229899 - RNA, 12 nt, Human
ccucccagcuga

SEQ ID NO: 2229900 - RNA, 16 nt, Human
ccucccagcugacagu

SEQ ID NO: 2229901 - RNA, 19 nt, Human
ccucccagcugacaguccu

SEQ ID NO: 2229902 - RNA, 16 nt, Human
ccugcccauuggagag

SEQ ID NO: 2229903 - RNA, 16 nt, Human
ccugcccaugggagcu

SEQ ID NO: 2229904 - RNA, 21 nt, Human
ccugccccaacucuccccuga

SEQ ID NO: 2229905 - RNA, 23 nt, Human
ccugcccaugucgcgcucagcau

SEQ ID NO: 2229906 - RNA, 16 nt, Human
ccugcccaucugggaa

SEQ ID NO: 2229907 - RNA, 22 nt, Human
ccugcccaugucgcgcucagca

SEQ ID NO: 2229908 - RNA, 19 nt, Human
ccugcccagucccccaacc

SEQ ID NO: 2229909 - RNA, 21 nt, Human
ccugcccagucccccaacccc

SEQ ID NO: 2229910 - RNA, 22 nt, Human
ccugcccagucccccaacccca

SEQ ID NO: 2229911 - RNA, 23 nt, Human
ccugcccagucccccaaccccag

SEQ ID NO: 2229912 - RNA, 12 nt, Human
ccugcccagucc

SEQ ID NO: 2229913 - RNA, 15 nt, Human
ccugcccaguccccc

SEQ ID NO: 2229914 - RNA, 16 nt, Human
ccugcccaguccccca

SEQ ID NO: 2229915 - RNA, 20 nt, Human
ccugcugggcucuccaccuc

SEQ ID NO: 2229916 - RNA, 19 nt, Human
ccugcugggcucuccaccu

SEQ ID NO: 2229917 - RNA, 18 nt, Human
ccugcugggcucuccacc

SEQ ID NO: 2229918 - RNA, 17 nt, Human
ccugcugggcucuccac

SEQ ID NO: 2229919 - RNA, 16 nt, Human
ccugcugggcucucca

SEQ ID NO: 2229920 - RNA, 12 nt, Human
ccugcugggcuc

SEQ ID NO: 2229921 - RNA, 17 nt, Human
ccugcuggcucuucugc

SEQ ID NO: 2229922 - RNA, 19 nt, Human
ccugcuggcucuucugccc

SEQ ID NO: 2229923 - RNA, 12 nt, Human
ccugcugggugu

SEQ ID NO: 2229924 - RNA, 21 nt, Human
ccugcuggccccucaccuggg

SEQ ID NO: 2229925 - RNA, 13 nt, Human
ccugcuggccgcc

SEQ ID NO: 2229926 - RNA, 18 nt, Human
ccugcuggccccucaccu

SEQ ID NO: 2229927 - RNA, 17 nt, Human
ccugcuggccccucacc

SEQ ID NO: 2229928 - RNA, 16 nt, Human
ccugcuggccccucac

SEQ ID NO: 2229929 - RNA, 15 nt, Human
ccugcuggccccuca

SEQ ID NO: 2229930 - RNA, 14 nt, Human
ccugcuggccccuc

SEQ ID NO: 2229931 - RNA, 19 nt, Human
ccugcuggccgccucaccc

SEQ ID NO: 2229932 - RNA, 12 nt, Human
ccugcuggcucu

SEQ ID NO: 2229933 - RNA, 13 nt, Human
ccugcuggcucuu

SEQ ID NO: 2229934 - RNA, 14 nt, Human
ccugcuggccgccu

SEQ ID NO: 2229935 - RNA, 15 nt, Human
ccugcuggccgccuc

SEQ ID NO: 2229936 - RNA, 16 nt, Human
ccugcuggccgccuca

SEQ ID NO: 2229937 - RNA, 17 nt, Human
ccugcuggccgccucac

SEQ ID NO: 2229938 - RNA, 15 nt, Human
ccuggaggaggagca

SEQ ID NO: 2229939 - RNA, 20 nt, Human
ccuggaggaggagcaggggc

SEQ ID NO: 2229940 - RNA, 18 nt, Human
ccuggaggacggccggcu

SEQ ID NO: 2229941 - RNA, 17 nt, Human
ccugcuggguaaacugu

SEQ ID NO: 2229942 - RNA, 16 nt, Human
ccuggaggauuucauc

SEQ ID NO: 2229943 - RNA, 14 nt, Human
ccuggaggcacuga

SEQ ID NO: 2229944 - RNA, 12 nt, Human
ccuggaggccca

SEQ ID NO: 2229945 - RNA, 22 nt, Human
ccuggaggcacugaagugcuua

SEQ ID NO: 2229946 - RNA, 16 nt, Human
ccuggaggcccaguuc

SEQ ID NO: 2229947 - RNA, 14 nt, Human
ccuggaggcccagu

SEQ ID NO: 2229948 - RNA, 13 nt, Human
ccuggaggcccag

SEQ ID NO: 2229949 - RNA, 23 nt, Human
ccugcugggcucuccaccucagc

SEQ ID NO: 2229950 - RNA, 15 nt, Human
ccugcuggguaaacu

SEQ ID NO: 2229951 - RNA, 22 nt, Human
ccuggagcguuucuagcaagug

SEQ ID NO: 2229952 - RNA, 24 nt, Human
ccugcugggcucuccaccucagcc

SEQ ID NO: 2229953 - RNA, 22 nt, Human
ccugcugggcucuccaccucag

SEQ ID NO: 2229954 - RNA, 21 nt, Human
ccugcugggcucuccaccuca

SEQ ID NO: 2229955 - RNA, 22 nt, Human
ccuggagccccugggugggugg

SEQ ID NO: 2229956 - RNA, 14 nt, Human
ccugcugggugugg

SEQ ID NO: 2229957 - RNA, 20 nt, Human
ccugcuggguguggcgcagc

SEQ ID NO: 2229958 - RNA, 14 nt, Human
ccugcccaggcccc

SEQ ID NO: 2229959 - RNA, 15 nt, Human
ccugcccaggccccu

SEQ ID NO: 2229960 - RNA, 16 nt, Human
ccugcccaggccccug

SEQ ID NO: 2229961 - RNA, 22 nt, Human
ccuggaucuaccagcauaaaua

SEQ ID NO: 2229962 - RNA, 16 nt, Human
ccuggaucuaccagca

SEQ ID NO: 2229963 - RNA, 13 nt, Human
ccuggaugcagcc

SEQ ID NO: 2229964 - RNA, 21 nt, Human
ccuggauccaucaggccacuu

SEQ ID NO: 2229965 - RNA, 14 nt, Human
ccuggagugcaguu

SEQ ID NO: 2229966 - RNA, 19 nt, Human
ccuggaguguggcugagga

SEQ ID NO: 2229967 - RNA, 20 nt, Human
ccuggaguguggcugaggag

SEQ ID NO: 2229968 - RNA, 21 nt, Human
ccuggaguguggcugaggagg

SEQ ID NO: 2229969 - RNA, 18 nt, Human
ccuggauauuauucuugu

SEQ ID NO: 2229970 - RNA, 22 nt, Human
ccuggauauuauucuuguaguu

SEQ ID NO: 2229971 - RNA, 19 nt, Human
ccuggaucuccccacucua

SEQ ID NO: 2229972 - RNA, 21 nt, Human
ccuggcacacaucaggaguuc

SEQ ID NO: 2229973 - RNA, 19 nt, Human
ccuggaugcagccucacag

SEQ ID NO: 2229974 - RNA, 14 nt, Human
ccuggaugcagccu

SEQ ID NO: 2229975 - RNA, 17 nt, Human
ccuggaugcagccucac

SEQ ID NO: 2229976 - RNA, 15 nt, Human
ccuggaguucugguu

SEQ ID NO: 2229977 - RNA, 23 nt, Human
ccuggagguggcugagccccugu

SEQ ID NO: 2229978 - RNA, 22 nt, Human
ccuggagguggcugagccccug

SEQ ID NO: 2229979 - RNA, 15 nt, Human
ccuggaguauaauau

SEQ ID NO: 2229980 - RNA, 22 nt, Human
ccuggaguguaugacugcacau

SEQ ID NO: 2229981 - RNA, 20 nt, Human
ccuggaggugggguugggau

SEQ ID NO: 2229982 - RNA, 18 nt, Human
ccuggagucaugccaagc

SEQ ID NO: 2229983 - RNA, 16 nt, Human
ccuggaguucugguuc

SEQ ID NO: 2229984 - RNA, 17 nt, Human
ccuggaguucugguucc

SEQ ID NO: 2229985 - RNA, 21 nt, Human
ccuggagggaaugaaccugga

SEQ ID NO: 2229986 - RNA, 18 nt, Human
ccuggaggauugcaggug

SEQ ID NO: 2229987 - RNA, 12 nt, Human
ccuggagggcua

SEQ ID NO: 2229988 - RNA, 19 nt, Human
ccuggagggcuagaaccua

SEQ ID NO: 2229989 - RNA, 20 nt, Human
ccuggagggcuagaaccuag

SEQ ID NO: 2229990 - RNA, 21 nt, Human
ccuggagggcuagaaccuaga

SEQ ID NO: 2229991 - RNA, 21 nt, Human
ccuggagggcuagaaccugga

SEQ ID NO: 2229992 - RNA, 22 nt, Human
ccuggagggcuagaaccuggag

SEQ ID NO: 2229993 - RNA, 23 nt, Human
ccuggagggcuagaaccuggaga

SEQ ID NO: 2229994 - RNA, 18 nt, Human
ccuggagggcuagaacug

SEQ ID NO: 2229995 - RNA, 21 nt, Human
ccuggagguggcugagccccu

SEQ ID NO: 2229996 - RNA, 14 nt, Human
ccuggagguggcug

SEQ ID NO: 2229997 - RNA, 22 nt, Human
ccuggaggugccagcaaagccc

SEQ ID NO: 2229998 - RNA, 23 nt, Human
ccuggaggugccagcaaagcccc

SEQ ID NO: 2229999 - RNA, 16 nt, Human
ccuggaggugccagca

SEQ ID NO: 2230000 - RNA, 18 nt, Human
ccuggaggugccagcaaa

SEQ ID NO: 2230001 - RNA, 19 nt, Human
ccuggaggugccagcaaag

SEQ ID NO: 2230002 - RNA, 21 nt, Human
ccuggaggugccagcaaagcc

SEQ ID NO: 2230003 - RNA, 22 nt, Human
ccuggaggggcuagaaccuaga

SEQ ID NO: 2230004 - RNA, 20 nt, Human
ccuggaggggcuagaaccua

SEQ ID NO: 2230005 - RNA, 21 nt, Human
ccuggaggggcuagaaccuag

SEQ ID NO: 2230006 - RNA, 13 nt, Human
ccuggaggugcca

SEQ ID NO: 2230007 - RNA, 14 nt, Human
ccuggaggugccag

SEQ ID NO: 2230008 - RNA, 18 nt, Human
ccuggcacccggccccug

SEQ ID NO: 2230009 - RNA, 20 nt, Human
ccuggcacagugucugggcu

SEQ ID NO: 2230010 - RNA, 21 nt, Human
ccuggcacagugucugggcug

SEQ ID NO: 2230011 - RNA, 22 nt, Human
ccuggcacagugucugggcuga

SEQ ID NO: 2230012 - RNA, 23 nt, Human
ccuggcacagugucugggcugac

SEQ ID NO: 2230013 - RNA, 16 nt, Human
ccuggcacagggcagu

SEQ ID NO: 2230014 - RNA, 17 nt, Human
ccuggcacagggcagug

SEQ ID NO: 2230015 - RNA, 18 nt, Human
ccuggcacagggcagugg

SEQ ID NO: 2230016 - RNA, 12 nt, Human
ccuggcacagug

SEQ ID NO: 2230017 - RNA, 13 nt, Human
ccuggcacagugu

SEQ ID NO: 2230018 - RNA, 15 nt, Human
ccuggcacagugucu

SEQ ID NO: 2230019 - RNA, 19 nt, Human
ccuggcacagugucugggc

SEQ ID NO: 2230020 - RNA, 15 nt, Human
ccuggcccugaggug

SEQ ID NO: 2230021 - RNA, 16 nt, Human
ccuggcccugaggugu

SEQ ID NO: 2230022 - RNA, 23 nt, Human
ccuggcccucaaggccucccaca

SEQ ID NO: 2230023 - RNA, 12 nt, Human
ccuggcccucug

SEQ ID NO: 2230024 - RNA, 13 nt, Human
ccuggcccucugu

SEQ ID NO: 2230025 - RNA, 15 nt, Human
ccuggcccucugugu

SEQ ID NO: 2230026 - RNA, 12 nt, Human
ccuggccucugc

SEQ ID NO: 2230027 - RNA, 19 nt, Human
ccuggccgaguccaagcug

SEQ ID NO: 2230028 - RNA, 18 nt, Human
ccuggccgaguccaagcu

SEQ ID NO: 2230029 - RNA, 12 nt, Human
ccuggccgcccc

SEQ ID NO: 2230030 - RNA, 14 nt, Human
ccuggccgcccccu

SEQ ID NO: 2230031 - RNA, 16 nt, Human
ccuggccucugcacuc

SEQ ID NO: 2230032 - RNA, 15 nt, Human
ccuggccgcccccug

SEQ ID NO: 2230033 - RNA, 20 nt, Human
ccuggccgcccccugccccc

SEQ ID NO: 2230034 - RNA, 13 nt, Human
ccuggccugagcu

SEQ ID NO: 2230035 - RNA, 14 nt, Human
ccuggccucugcac

SEQ ID NO: 2230036 - RNA, 15 nt, Human
ccuggccucugcacu

SEQ ID NO: 2230037 - RNA, 13 nt, Human
ccuggcccucaag

SEQ ID NO: 2230038 - RNA, 22 nt, Human
ccuggcccucaaggccucccac

SEQ ID NO: 2230039 - RNA, 12 nt, Human
ccucucugcacc

SEQ ID NO: 2230040 - RNA, 20 nt, Human
ccucucugcaggucccuaau

SEQ ID NO: 2230041 - RNA, 15 nt, Human
ccucucugcaggucc

SEQ ID NO: 2230042 - RNA, 22 nt, Human
ccucucucuucugcuccacccu

SEQ ID NO: 2230043 - RNA, 21 nt, Human
ccucucucuucugcuccaccc

SEQ ID NO: 2230044 - RNA, 13 nt, Human
ccucucugcaggu

SEQ ID NO: 2230045 - RNA, 20 nt, Human
ccucucucuucugcuccacc

SEQ ID NO: 2230046 - RNA, 19 nt, Human
ccucucucuucugcuccac

SEQ ID NO: 2230047 - RNA, 18 nt, Human
ccucucucuucugcucca

SEQ ID NO: 2230048 - RNA, 16 nt, Human
ccucucucuucugcuc

SEQ ID NO: 2230049 - RNA, 12 nt, Human
ccucucucuucu

SEQ ID NO: 2230050 - RNA, 15 nt, Human
ccucucucugacucu

SEQ ID NO: 2230051 - RNA, 17 nt, Human
ccucucucugacucuca

SEQ ID NO: 2230052 - RNA, 11 nt, Human
ccucucucuga

SEQ ID NO: 2230053 - RNA, 12 nt, Human
ccucucucugac

SEQ ID NO: 2230054 - RNA, 13 nt, Human
ccucucucugacu

SEQ ID NO: 2230055 - RNA, 14 nt, Human
ccucucucugacuc

SEQ ID NO: 2230056 - RNA, 14 nt, Human
ccucucucaggcca

SEQ ID NO: 2230057 - RNA, 12 nt, Human
ccucucucccag

SEQ ID NO: 2230058 - RNA, 14 nt, Human
ccucucucccaguc

SEQ ID NO: 2230059 - RNA, 15 nt, Human
ccucucucccagucu

SEQ ID NO: 2230060 - RNA, 14 nt, Human
ccucucuccuuugc

SEQ ID NO: 2230061 - RNA, 12 nt, Human
ccucucucuccg

SEQ ID NO: 2230062 - RNA, 13 nt, Human
ccucucucacucc

SEQ ID NO: 2230063 - RNA, 14 nt, Human
ccucucucacuccu

SEQ ID NO: 2230064 - RNA, 15 nt, Human
ccucucucacuccuu

SEQ ID NO: 2230065 - RNA, 17 nt, Human
ccucucucacuccuuga

SEQ ID NO: 2230066 - RNA, 12 nt, Human
ccucucucaggc

SEQ ID NO: 2230067 - RNA, 14 nt, Human
ccucugcugccaug

SEQ ID NO: 2230068 - RNA, 22 nt, Human
ccucugcucugaggcuuccaga

SEQ ID NO: 2230069 - RNA, 18 nt, Human
ccucugcugauccuccca

SEQ ID NO: 2230070 - RNA, 15 nt, Human
ccucugcugauccuc

SEQ ID NO: 2230071 - RNA, 22 nt, Human
ccucugcuccuggagccuuuga

SEQ ID NO: 2230072 - RNA, 14 nt, Human
ccucugcucugagg

SEQ ID NO: 2230073 - RNA, 20 nt, Human
ccucugcucugaggcuucca

SEQ ID NO: 2230074 - RNA, 21 nt, Human
ccucugcucugaggcuuccag

SEQ ID NO: 2230075 - RNA, 13 nt, Human
ccucugcugcugg

SEQ ID NO: 2230076 - RNA, 14 nt, Human
ccucugcugcuggc

SEQ ID NO: 2230077 - RNA, 15 nt, Human
ccucugcugcuggcu

SEQ ID NO: 2230078 - RNA, 16 nt, Human
ccucugcugcuggcug

SEQ ID NO: 2230079 - RNA, 17 nt, Human
ccucugcugcuggcugg

SEQ ID NO: 2230080 - RNA, 18 nt, Human
ccucugcugcuggcuggu

SEQ ID NO: 2230081 - RNA, 18 nt, Human
ccucugccugucccucuc

SEQ ID NO: 2230082 - RNA, 13 nt, Human
ccucugcucccca

SEQ ID NO: 2230083 - RNA, 14 nt, Human
ccucugcuccccag

SEQ ID NO: 2230084 - RNA, 17 nt, Human
ccucugccugucccucu

SEQ ID NO: 2230085 - RNA, 13 nt, Human
ccucugcuccugg

SEQ ID NO: 2230086 - RNA, 18 nt, Human
ccucugcuccuggagccu

SEQ ID NO: 2230087 - RNA, 16 nt, Human
ccucugccugucccuc

SEQ ID NO: 2230088 - RNA, 15 nt, Human
ccucugccugucccu

SEQ ID NO: 2230089 - RNA, 14 nt, Human
ccucugccuguccc

SEQ ID NO: 2230090 - RNA, 21 nt, Human
ccucugccugccccgccccca

SEQ ID NO: 2230091 - RNA, 12 nt, Human
ccucugccuguc

SEQ ID NO: 2230092 - RNA, 17 nt, Human
ccucugccugcauucug

SEQ ID NO: 2230093 - RNA, 12 nt, Human
ccucugccugcc

SEQ ID NO: 2230094 - RNA, 13 nt, Human
ccucugccugccc

SEQ ID NO: 2230095 - RNA, 16 nt, Human
ccucugccugccccgc

SEQ ID NO: 2230096 - RNA, 16 nt, Human
ccucucugcaucugac

SEQ ID NO: 2230097 - RNA, 11 nt, Human
ccucugccugc

SEQ ID NO: 2230098 - RNA, 22 nt, Human
ccucugccugaagucacacagu

SEQ ID NO: 2230099 - RNA, 12 nt, Human
ccucucugcccu

SEQ ID NO: 2230100 - RNA, 23 nt, Human
ccucucugcaggucccuaauaaa

SEQ ID NO: 2230101 - RNA, 21 nt, Human
ccucucugcaggucccuaaua

SEQ ID NO: 2230102 - RNA, 22 nt, Human
ccucucugcaggucccuaauaa

SEQ ID NO: 2230103 - RNA, 15 nt, Human
ccucugcugccaugg

SEQ ID NO: 2230104 - RNA, 14 nt, Human
ccucugcugcuguc

SEQ ID NO: 2230105 - RNA, 19 nt, Human
ccucugcugcugucccucc

SEQ ID NO: 2230106 - RNA, 20 nt, Human
ccucugcugcugucccuccc

SEQ ID NO: 2230107 - RNA, 21 nt, Human
ccucugcuggcacauuucccc

SEQ ID NO: 2230108 - RNA, 15 nt, Human
ccucugcuucucacg

SEQ ID NO: 2230109 - RNA, 23 nt, Human
ccugacuggugcuauaggcugga

SEQ ID NO: 2230110 - RNA, 19 nt, Human
ccugacuucaggggcugcc

SEQ ID NO: 2230111 - RNA, 20 nt, Human
ccugacuucaggggcugccc

SEQ ID NO: 2230112 - RNA, 19 nt, Human
ccugacuuggggagaugga

SEQ ID NO: 2230113 - RNA, 21 nt, Human
ccugacuucaggggcugcccg

SEQ ID NO: 2230114 - RNA, 22 nt, Human
ccugacuucaggggcugcccgc

SEQ ID NO: 2230115 - RNA, 23 nt, Human
ccugacuuggggagauggaguuc

SEQ ID NO: 2230116 - RNA, 23 nt, Human
ccugacuucaggggcugcccgcu

SEQ ID NO: 2230117 - RNA, 13 nt, Human
ccugagaagagag

SEQ ID NO: 2230118 - RNA, 21 nt, Human
ccugacuggugcuauaggcug

SEQ ID NO: 2230119 - RNA, 15 nt, Human
ccugacucugccccc

SEQ ID NO: 2230120 - RNA, 16 nt, Human
ccugacucugcccccu

SEQ ID NO: 2230121 - RNA, 17 nt, Human
ccugacucugcccccug

SEQ ID NO: 2230122 - RNA, 22 nt, Human
ccugacucugcccccugcuggc

SEQ ID NO: 2230123 - RNA, 18 nt, Human
ccugacucucugugaccu

SEQ ID NO: 2230124 - RNA, 21 nt, Human
ccugacucgucugacugugug

SEQ ID NO: 2230125 - RNA, 13 nt, Human
ccugacucugaaa

SEQ ID NO: 2230126 - RNA, 18 nt, Human
ccugacucugaaaucuga

SEQ ID NO: 2230127 - RNA, 12 nt, Human
ccugacucugcc

SEQ ID NO: 2230128 - RNA, 13 nt, Human
ccugacucugccc

SEQ ID NO: 2230129 - RNA, 14 nt, Human
ccugacucugcccc

SEQ ID NO: 2230130 - RNA, 17 nt, Human
ccugacucucugugacc

SEQ ID NO: 2230131 - RNA, 16 nt, Human
ccugacucucugugac

SEQ ID NO: 2230132 - RNA, 15 nt, Human
ccugacucucuguga

SEQ ID NO: 2230133 - RNA, 13 nt, Human
ccugacucucugu

SEQ ID NO: 2230134 - RNA, 13 nt, Human
ccugaccugaggc

SEQ ID NO: 2230135 - RNA, 14 nt, Human
ccugaccugaggcu

SEQ ID NO: 2230136 - RNA, 14 nt, Human
ccugaccucccagc

SEQ ID NO: 2230137 - RNA, 15 nt, Human
ccugaccucccagcc

SEQ ID NO: 2230138 - RNA, 17 nt, Human
ccugaccucccagcccu

SEQ ID NO: 2230139 - RNA, 18 nt, Human
ccugaccucccagcccua

SEQ ID NO: 2230140 - RNA, 14 nt, Human
ccugaccugucuca

SEQ ID NO: 2230141 - RNA, 15 nt, Human
ccugaccugaggcuc

SEQ ID NO: 2230142 - RNA, 14 nt, Human
ccugacucucagca

SEQ ID NO: 2230143 - RNA, 12 nt, Human
ccucuuguaaau

SEQ ID NO: 2230144 - RNA, 13 nt, Human
ccucuuguaaaua

SEQ ID NO: 2230145 - RNA, 14 nt, Human
ccucuuguaaauaa

SEQ ID NO: 2230146 - RNA, 17 nt, Human
ccucuuguaaauaaagc

SEQ ID NO: 2230147 - RNA, 18 nt, Human
ccucuuguaaauaaagcc

SEQ ID NO: 2230148 - RNA, 20 nt, Human
ccucuuguaaauaaagcccu

SEQ ID NO: 2230149 - RNA, 13 nt, Human
ccucuuggguuca

SEQ ID NO: 2230150 - RNA, 21 nt, Human
ccucuuggucuucccaggcug

SEQ ID NO: 2230151 - RNA, 19 nt, Human
ccucuugagcaguggcugg

SEQ ID NO: 2230152 - RNA, 24 nt, Human
ccucuugagcaguggcugguccag

SEQ ID NO: 2230153 - RNA, 17 nt, Human
ccugacccuguauauag

SEQ ID NO: 2230154 - RNA, 12 nt, Human
ccucuuuaagag

SEQ ID NO: 2230155 - RNA, 12 nt, Human
ccucuuuagagu

SEQ ID NO: 2230156 - RNA, 19 nt, Human
ccucuuuagaguuagacug

SEQ ID NO: 2230157 - RNA, 17 nt, Human
ccucuuuagaguuagac

SEQ ID NO: 2230158 - RNA, 19 nt, Human
ccugacccuguauauagcc

SEQ ID NO: 2230159 - RNA, 16 nt, Human
ccugaccgugggcggg

SEQ ID NO: 2230160 - RNA, 13 nt, Human
ccugaccucccag

SEQ ID NO: 2230161 - RNA, 12 nt, Human
ccugaccuccca

SEQ ID NO: 2230162 - RNA, 16 nt, Human
ccugaccucccucuaa

SEQ ID NO: 2230163 - RNA, 14 nt, Human
ccucuugagcagug

SEQ ID NO: 2230164 - RNA, 15 nt, Human
ccucuugagcagugg

SEQ ID NO: 2230165 - RNA, 16 nt, Human
ccucuugagcaguggc

SEQ ID NO: 2230166 - RNA, 17 nt, Human
ccucuugagcaguggcu

SEQ ID NO: 2230167 - RNA, 19 nt, Human
ccucuugagccuugaacuu

SEQ ID NO: 2230168 - RNA, 13 nt, Human
ccucuugagccuu

SEQ ID NO: 2230169 - RNA, 20 nt, Human
ccugaguagcuggauuacag

SEQ ID NO: 2230170 - RNA, 19 nt, Human
ccugcacuugcagacucua

SEQ ID NO: 2230171 - RNA, 15 nt, Human
ccugaguagcuggau

SEQ ID NO: 2230172 - RNA, 19 nt, Human
ccugaguagcuggauuaca

SEQ ID NO: 2230173 - RNA, 22 nt, Human
ccugcacuugcagacucuacag

SEQ ID NO: 2230174 - RNA, 12 nt, Human
ccugcagccugg

SEQ ID NO: 2230175 - RNA, 15 nt, Human
ccugcagacucacug

SEQ ID NO: 2230176 - RNA, 16 nt, Human
ccugcagaauuugggu

SEQ ID NO: 2230177 - RNA, 16 nt, Human
ccugcagccuggaggc

SEQ ID NO: 2230178 - RNA, 15 nt, Human
ccugcagccuggagg

SEQ ID NO: 2230179 - RNA, 13 nt, Human
ccugcagccugga

SEQ ID NO: 2230180 - RNA, 22 nt, Human
ccugagaagugucuaaaaacac

SEQ ID NO: 2230181 - RNA, 15 nt, Human
ccugagacaaaugga

SEQ ID NO: 2230182 - RNA, 12 nt, Human
ccugagaagaga

SEQ ID NO: 2230183 - RNA, 22 nt, Human
ccugagaauaagaaaguuucac

SEQ ID NO: 2230184 - RNA, 19 nt, Human
ccugagacaaauggaggcc

SEQ ID NO: 2230185 - RNA, 20 nt, Human
ccugagacaaauggaggccu

SEQ ID NO: 2230186 - RNA, 21 nt, Human
ccugagacaaauggaggccug

SEQ ID NO: 2230187 - RNA, 12 nt, Human
ccugagaccaca

SEQ ID NO: 2230188 - RNA, 18 nt, Human
ccugagaccacagagaga

SEQ ID NO: 2230189 - RNA, 22 nt, Human
ccugagaccaguugggagcacu

SEQ ID NO: 2230190 - RNA, 21 nt, Human
ccugagaccaguugggagcac

SEQ ID NO: 2230191 - RNA, 15 nt, Human
ccugagaccccuggc

SEQ ID NO: 2230192 - RNA, 16 nt, Human
ccugagaccccuggcc

SEQ ID NO: 2230193 - RNA, 17 nt, Human
ccugagaccccuggccu

SEQ ID NO: 2230194 - RNA, 20 nt, Human
ccugagaccccuggccuccg

SEQ ID NO: 2230195 - RNA, 18 nt, Human
ccugagaccccuggccuc

SEQ ID NO: 2230196 - RNA, 19 nt, Human
ccugagaccccuggccucc

SEQ ID NO: 2230197 - RNA, 20 nt, Human
ccugagagaaacugagguca

SEQ ID NO: 2230198 - RNA, 22 nt, Human
ccugaggugugggggcugcagc

SEQ ID NO: 2230199 - RNA, 23 nt, Human
ccugaggugugggggcugcagca

SEQ ID NO: 2230200 - RNA, 17 nt, Human
ccugagaggcaggcaua

SEQ ID NO: 2230201 - RNA, 18 nt, Human
ccugagaggcaggcauag

SEQ ID NO: 2230202 - RNA, 12 nt, Human
ccugagaggcag

SEQ ID NO: 2230203 - RNA, 13 nt, Human
ccugagaggcagg

SEQ ID NO: 2230204 - RNA, 14 nt, Human
ccugagaggcaggc

SEQ ID NO: 2230205 - RNA, 15 nt, Human
ccugagaggcaggca

SEQ ID NO: 2230206 - RNA, 22 nt, Human
ccugaguaaaaaagcugugugc

SEQ ID NO: 2230207 - RNA, 20 nt, Human
ccugaguaaucgcuuaaaga

SEQ ID NO: 2230208 - RNA, 23 nt, Human
ccugaguaaucgcuuaaagaugu

SEQ ID NO: 2230209 - RNA, 21 nt, Human
ccugaguagaaaggccuuuaa

SEQ ID NO: 2230210 - RNA, 13 nt, Human
ccugaguagcugg

SEQ ID NO: 2230211 - RNA, 14 nt, Human
ccugaguagaaagg

SEQ ID NO: 2230212 - RNA, 20 nt, Human
ccugaguagaaaggccuuua

SEQ ID NO: 2230213 - RNA, 18 nt, Human
ccugcaggaccugccugu

SEQ ID NO: 2230214 - RNA, 17 nt, Human
ccugcaggaccugccug

SEQ ID NO: 2230215 - RNA, 16 nt, Human
ccugcaggaccugccu

SEQ ID NO: 2230216 - RNA, 15 nt, Human
ccugcaggaccugcc

SEQ ID NO: 2230217 - RNA, 16 nt, Human
cagggaggggaagagg

SEQ ID NO: 2230218 - RNA, 12 nt, Human
cagggaggggac

SEQ ID NO: 2230219 - RNA, 22 nt, Human
cagggaggagguggcagcccug

SEQ ID NO: 2230220 - RNA, 21 nt, Human
cagggaggggacuauuuauga

SEQ ID NO: 2230221 - RNA, 16 nt, Human
cagggcucagccuggu

SEQ ID NO: 2230222 - RNA, 15 nt, Human
cagggcucagccugg

SEQ ID NO: 2230223 - RNA, 19 nt, Human
cagggaggggacuauuuau

SEQ ID NO: 2230224 - RNA, 13 nt, Human
cagggaggggacu

SEQ ID NO: 2230225 - RNA, 16 nt, Human
cagggaggucauuuug

SEQ ID NO: 2230226 - RNA, 16 nt, Human
cagggagggcuucugc

SEQ ID NO: 2230227 - RNA, 18 nt, Human
cagggagggccugggccc

SEQ ID NO: 2230228 - RNA, 17 nt, Human
cagggagggccugggcc

SEQ ID NO: 2230229 - RNA, 19 nt, Human
cagggcucagccugguggg

SEQ ID NO: 2230230 - RNA, 16 nt, Human
cagggagguccgggag

SEQ ID NO: 2230231 - RNA, 19 nt, Human
cagggcuggacugaggccu

SEQ ID NO: 2230232 - RNA, 20 nt, Human
cagggcuggacugaggccug

SEQ ID NO: 2230233 - RNA, 21 nt, Human
cagggcuggacugaggccuga

SEQ ID NO: 2230234 - RNA, 20 nt, Human
cagggcucagcggggacagc

SEQ ID NO: 2230235 - RNA, 12 nt, Human
cagggcucagcg

SEQ ID NO: 2230236 - RNA, 15 nt, Human
cagggcucagcgggg

SEQ ID NO: 2230237 - RNA, 14 nt, Human
caggcugggcuuca

SEQ ID NO: 2230238 - RNA, 22 nt, Human
cagggaggacgcucucuggccu

SEQ ID NO: 2230239 - RNA, 21 nt, Human
cagggaggagguggcagcccu

SEQ ID NO: 2230240 - RNA, 20 nt, Human
cagggaggagguggcagccc

SEQ ID NO: 2230241 - RNA, 19 nt, Human
cagggaggagguggcagcc

SEQ ID NO: 2230242 - RNA, 18 nt, Human
cagggaggagguggcagc

SEQ ID NO: 2230243 - RNA, 12 nt, Human
cagggaggagag

SEQ ID NO: 2230244 - RNA, 22 nt, Human
cagggaggagaggggaagggcc

SEQ ID NO: 2230245 - RNA, 23 nt, Human
cagggaggagaggggaagggcca

SEQ ID NO: 2230246 - RNA, 14 nt, Human
caggccugggucug

SEQ ID NO: 2230247 - RNA, 20 nt, Human
caggcugggagagccuucca

SEQ ID NO: 2230248 - RNA, 19 nt, Human
caggcugggagagccuucc

SEQ ID NO: 2230249 - RNA, 16 nt, Human
caggcugggagagccu

SEQ ID NO: 2230250 - RNA, 18 nt, Human
caggcugggagagccuuc

SEQ ID NO: 2230251 - RNA, 17 nt, Human
caggcuggcgugcagug

SEQ ID NO: 2230252 - RNA, 23 nt, Human
caggccugggggcugggcagagg

SEQ ID NO: 2230253 - RNA, 18 nt, Human
caggcuggcgugcagugg

SEQ ID NO: 2230254 - RNA, 19 nt, Human
caggcuggcgugcaguggu

SEQ ID NO: 2230255 - RNA, 20 nt, Human
caggccugggggcugggcag

SEQ ID NO: 2230256 - RNA, 22 nt, Human
caggccugggggcugggcagag

SEQ ID NO: 2230257 - RNA, 17 nt, Human
caggccuggcaaguggg

SEQ ID NO: 2230258 - RNA, 20 nt, Human
caggccuggcaaguggguga

SEQ ID NO: 2230259 - RNA, 12 nt, Human
caggccugggcc

SEQ ID NO: 2230260 - RNA, 17 nt, Human
caggccugggccagagu

SEQ ID NO: 2230261 - RNA, 22 nt, Human
cagggcuggcccagcccugcug

SEQ ID NO: 2230262 - RNA, 22 nt, Human
cagggcuggacugaggccugag

SEQ ID NO: 2230263 - RNA, 23 nt, Human
cagggcuggacugaggccugagc

SEQ ID NO: 2230264 - RNA, 12 nt, Human
cagggcuggccc

SEQ ID NO: 2230265 - RNA, 13 nt, Human
cagggcuggccca

SEQ ID NO: 2230266 - RNA, 14 nt, Human
cagggcuggcccag

SEQ ID NO: 2230267 - RNA, 15 nt, Human
cagggcuggcccagc

SEQ ID NO: 2230268 - RNA, 16 nt, Human
cagggcuggcccagcc

SEQ ID NO: 2230269 - RNA, 17 nt, Human
cagggcuggcccagccc

SEQ ID NO: 2230270 - RNA, 18 nt, Human
cagggcuggcccagcccu

SEQ ID NO: 2230271 - RNA, 19 nt, Human
cagggcuggcccagcccug

SEQ ID NO: 2230272 - RNA, 20 nt, Human
cagggcuggcccagcccugc

SEQ ID NO: 2230273 - RNA, 21 nt, Human
cagggcuggcccagcccugcu

SEQ ID NO: 2230274 - RNA, 23 nt, Human
cagggcuggcccagcccugcugg

SEQ ID NO: 2230275 - RNA, 23 nt, Human
cagguuuuucaauuaaacggauu

SEQ ID NO: 2230276 - RNA, 21 nt, Human
cagguuuuucaauuaaacgga

SEQ ID NO: 2230277 - RNA, 22 nt, Human
cagguuuuucaauuaaacggau

SEQ ID NO: 2230278 - RNA, 23 nt, Human
cagguuuuuggucugacccacug

SEQ ID NO: 2230279 - RNA, 22 nt, Human
cagguugaggggcuccuggaaa

SEQ ID NO: 2230280 - RNA, 21 nt, Human
cagguugaggggcuccuggaa

SEQ ID NO: 2230281 - RNA, 20 nt, Human
cagguugaggggcuccugga

SEQ ID NO: 2230282 - RNA, 17 nt, Human
cagguugcugguugcug

SEQ ID NO: 2230283 - RNA, 18 nt, Human
cagguugcugguugcugu

SEQ ID NO: 2230284 - RNA, 18 nt, Human
cagguuuuucaauuaaac

SEQ ID NO: 2230285 - RNA, 19 nt, Human
cagguuuuucaauuaaacg

SEQ ID NO: 2230286 - RNA, 18 nt, Human
cagguucuucuuccugaa

SEQ ID NO: 2230287 - RNA, 20 nt, Human
caggugcugcuacccucccu

SEQ ID NO: 2230288 - RNA, 24 nt, Human
cagguucuccguuagcuccugugg

SEQ ID NO: 2230289 - RNA, 20 nt, Human
cagguucuucuuccugaagc

SEQ ID NO: 2230290 - RNA, 23 nt, Human
caggugcugacuucaucucccac

SEQ ID NO: 2230291 - RNA, 13 nt, Human
caggugcugcuac

SEQ ID NO: 2230292 - RNA, 21 nt, Human
caggugcugacuucaucuccc

SEQ ID NO: 2230293 - RNA, 20 nt, Human
caggugcugacuucaucucc

SEQ ID NO: 2230294 - RNA, 21 nt, Human
cagguucuccguuagcuccug

SEQ ID NO: 2230295 - RNA, 16 nt, Human
caggugcugcuacccu

SEQ ID NO: 2230296 - RNA, 19 nt, Human
caggugcugcuacccuccc

SEQ ID NO: 2230297 - RNA, 22 nt, Human
cagguucuccguuagcuccugu

SEQ ID NO: 2230298 - RNA, 23 nt, Human
cagguucuccguuagcuccugug

SEQ ID NO: 2230299 - RNA, 21 nt, Human
caggguugggcccagaucugg

SEQ ID NO: 2230300 - RNA, 19 nt, Human
caggguuucaccauguugc

SEQ ID NO: 2230301 - RNA, 17 nt, Human
cagggugggauggagga

SEQ ID NO: 2230302 - RNA, 17 nt, Human
caggguuucgagaagcu

SEQ ID NO: 2230303 - RNA, 19 nt, Human
caggguuucgagaagcugc

SEQ ID NO: 2230304 - RNA, 19 nt, Human
caggugcucaauaaaugau

SEQ ID NO: 2230305 - RNA, 20 nt, Human
caggguuucgagaagcugcu

SEQ ID NO: 2230306 - RNA, 20 nt, Human
caggguuuggcugugucuaa

SEQ ID NO: 2230307 - RNA, 21 nt, Human
caggguuuggcugugucuaaa

SEQ ID NO: 2230308 - RNA, 22 nt, Human
caggguuuggcugugucuaaac

SEQ ID NO: 2230309 - RNA, 13 nt, Human
caggugcugccau

SEQ ID NO: 2230310 - RNA, 14 nt, Human
caggugcugccauc

SEQ ID NO: 2230311 - RNA, 20 nt, Human
caggguugggcccagaucug

SEQ ID NO: 2230312 - RNA, 16 nt, Human
caggguugggcccaga

SEQ ID NO: 2230313 - RNA, 15 nt, Human
caggguugggcccag

SEQ ID NO: 2230314 - RNA, 14 nt, Human
caggguugggccca

SEQ ID NO: 2230315 - RNA, 13 nt, Human
caggguugggccc

SEQ ID NO: 2230316 - RNA, 17 nt, Human
caggguggacuuagaaa

SEQ ID NO: 2230317 - RNA, 18 nt, Human
cagggugggauggaggag

SEQ ID NO: 2230318 - RNA, 17 nt, Human
caggguuggccccugcc

SEQ ID NO: 2230319 - RNA, 21 nt, Human
caggguuggccccugcccggc

SEQ ID NO: 2230320 - RNA, 11 nt, Human
caguaaaauug

SEQ ID NO: 2230321 - RNA, 24 nt, Human
caguaaauaaauuguuugaccaug

SEQ ID NO: 2230322 - RNA, 18 nt, Human
caguaaaauugccauauu

SEQ ID NO: 2230323 - RNA, 19 nt, Human
caguaaauaaauuguuuga

SEQ ID NO: 2230324 - RNA, 15 nt, Human
caguaaaauugccau

SEQ ID NO: 2230325 - RNA, 16 nt, Human
caguaaaauugccaua

SEQ ID NO: 2230326 - RNA, 18 nt, Human
caguaaaugggggugcau

SEQ ID NO: 2230327 - RNA, 20 nt, Human
caguaaaucuuuuacaacug

SEQ ID NO: 2230328 - RNA, 12 nt, Human
caguaaaucuuu

SEQ ID NO: 2230329 - RNA, 21 nt, Human
caguauucuagguagugcccu

SEQ ID NO: 2230330 - RNA, 13 nt, Human
caguauucuuguc

SEQ ID NO: 2230331 - RNA, 15 nt, Human
caguauucuagguag

SEQ ID NO: 2230332 - RNA, 15 nt, Human
caguauugaagcauu

SEQ ID NO: 2230333 - RNA, 14 nt, Human
caguauugaagcau

SEQ ID NO: 2230334 - RNA, 12 nt, Human
caguauugaagc

SEQ ID NO: 2230335 - RNA, 16 nt, Human
caguauucuugucaaa

SEQ ID NO: 2230336 - RNA, 19 nt, Human
caguauucuugucaaaaaa

SEQ ID NO: 2230337 - RNA, 19 nt, Human
caguaaaugggggugcauu

SEQ ID NO: 2230338 - RNA, 15 nt, Human
caguauuugugggga

SEQ ID NO: 2230339 - RNA, 20 nt, Human
caguauugaagcauuuuaua

SEQ ID NO: 2230340 - RNA, 17 nt, Human
caguauugaagcauuuu

SEQ ID NO: 2230341 - RNA, 16 nt, Human
caguauugaagcauuu

SEQ ID NO: 2230342 - RNA, 20 nt, Human
caguauuguuuugguuugcu

SEQ ID NO: 2230343 - RNA, 16 nt, Human
caguauuuucccugcu

SEQ ID NO: 2230344 - RNA, 14 nt, Human
caguauuuuggaga

SEQ ID NO: 2230345 - RNA, 14 nt, Human
cagucaccccggcc

SEQ ID NO: 2230346 - RNA, 16 nt, Human
cagucaccccggccac

SEQ ID NO: 2230347 - RNA, 17 nt, Human
cagucaccccggccacc

SEQ ID NO: 2230348 - RNA, 21 nt, Human
cagggucucuaccauccccug

SEQ ID NO: 2230349 - RNA, 21 nt, Human
cagggucucuagugcugugaa

SEQ ID NO: 2230350 - RNA, 20 nt, Human
cagggucucuagugcuguga

SEQ ID NO: 2230351 - RNA, 19 nt, Human
cagggucucuagugcugug

SEQ ID NO: 2230352 - RNA, 22 nt, Human
cagggucuucccuaccucaggc

SEQ ID NO: 2230353 - RNA, 15 nt, Human
cagggucuuuucauc

SEQ ID NO: 2230354 - RNA, 21 nt, Human
cagggucuucccuaccucagg

SEQ ID NO: 2230355 - RNA, 22 nt, Human
cagggucucuagugcugugaaa

SEQ ID NO: 2230356 - RNA, 17 nt, Human
cagggucuuuucaucug

SEQ ID NO: 2230357 - RNA, 21 nt, Human
cagggucuuuucaucugggaa

SEQ ID NO: 2230358 - RNA, 22 nt, Human
cagggucuuuucaucugggaaa

SEQ ID NO: 2230359 - RNA, 23 nt, Human
cagggucuuuucaucugggaaag

SEQ ID NO: 2230360 - RNA, 14 nt, Human
cagggugagagcug

SEQ ID NO: 2230361 - RNA, 15 nt, Human
cagggugagagcugc

SEQ ID NO: 2230362 - RNA, 21 nt, Human
cagggugagagcugcucugga

SEQ ID NO: 2230363 - RNA, 22 nt, Human
cagggugagagcugcucuggaa

SEQ ID NO: 2230364 - RNA, 14 nt, Human
cagggugaggaugg

SEQ ID NO: 2230365 - RNA, 15 nt, Human
cagggugaugccagg

SEQ ID NO: 2230366 - RNA, 16 nt, Human
cagggugaugccaggu

SEQ ID NO: 2230367 - RNA, 20 nt, Human
cagggugcaguaucaugccc

SEQ ID NO: 2230368 - RNA, 18 nt, Human
cagggugaugccagguuc

SEQ ID NO: 2230369 - RNA, 13 nt, Human
cagggugcugugg

SEQ ID NO: 2230370 - RNA, 22 nt, Human
caggguggacuuagaaagcagg

SEQ ID NO: 2230371 - RNA, 15 nt, Human
caggguuggccccug

SEQ ID NO: 2230372 - RNA, 16 nt, Human
caggguuggccccugc

SEQ ID NO: 2230373 - RNA, 23 nt, Human
cagggucucacucugucgcccag

SEQ ID NO: 2230374 - RNA, 12 nt, Human
caggacaggacc

SEQ ID NO: 2230375 - RNA, 23 nt, Human
caggacaccacacccagccucag

SEQ ID NO: 2230376 - RNA, 13 nt, Human
caggacaggacca

SEQ ID NO: 2230377 - RNA, 12 nt, Human
caggacaggccc

SEQ ID NO: 2230378 - RNA, 13 nt, Human
caggacaggcccg

SEQ ID NO: 2230379 - RNA, 16 nt, Human
caggacagugcuucag

SEQ ID NO: 2230380 - RNA, 23 nt, Human
caggacagcccuucuuuccacag

SEQ ID NO: 2230381 - RNA, 24 nt, Human
caggacagcccuucuuuccacaga

SEQ ID NO: 2230382 - RNA, 21 nt, Human
caggacagugcuucagccuga

SEQ ID NO: 2230383 - RNA, 20 nt, Human
caggacagugcuucagccug

SEQ ID NO: 2230384 - RNA, 22 nt, Human
caggacagugcuucagccugag

SEQ ID NO: 2230385 - RNA, 18 nt, Human
caggacaugcgguagcca

SEQ ID NO: 2230386 - RNA, 14 nt, Human
caggaccagcucag

SEQ ID NO: 2230387 - RNA, 22 nt, Human
caggacaugcgguagccagcac

SEQ ID NO: 2230388 - RNA, 21 nt, Human
caggacaugcgguagccagca

SEQ ID NO: 2230389 - RNA, 20 nt, Human
caggacaugcgguagccagc

SEQ ID NO: 2230390 - RNA, 20 nt, Human
caggaccagcucaggacaga

SEQ ID NO: 2230391 - RNA, 12 nt, Human
caggaccagcug

SEQ ID NO: 2230392 - RNA, 13 nt, Human
caggaccagcugg

SEQ ID NO: 2230393 - RNA, 14 nt, Human
caggaccagcuggg

SEQ ID NO: 2230394 - RNA, 15 nt, Human
caggaccagcugggg

SEQ ID NO: 2230395 - RNA, 16 nt, Human
caggaccagcuggggc

SEQ ID NO: 2230396 - RNA, 19 nt, Human
caggaccagcucaggacag

SEQ ID NO: 2230397 - RNA, 17 nt, Human
caggaccagcucaggac

SEQ ID NO: 2230398 - RNA, 16 nt, Human
caggaccagcucagga

SEQ ID NO: 2230399 - RNA, 15 nt, Human
caggaccagcucagg

SEQ ID NO: 2230400 - RNA, 22 nt, Human
caggaccucagaguccaggccc

SEQ ID NO: 2230401 - RNA, 21 nt, Human
caggaccucagaguccaggcc

SEQ ID NO: 2230402 - RNA, 23 nt, Human
caggaggauugcuugagcccagg

SEQ ID NO: 2230403 - RNA, 15 nt, Human
caggaggcaggaccu

SEQ ID NO: 2230404 - RNA, 18 nt, Human
caggaggcaggaccuucg

SEQ ID NO: 2230405 - RNA, 20 nt, Human
caggaccucagaguccaggc

SEQ ID NO: 2230406 - RNA, 23 nt, Human
caggaccuaggauaucuucucca

SEQ ID NO: 2230407 - RNA, 22 nt, Human
caggaccuaggauaucuucucc

SEQ ID NO: 2230408 - RNA, 21 nt, Human
caggaccuaggauaucuucuc

SEQ ID NO: 2230409 - RNA, 13 nt, Human
caggaccucaggu

SEQ ID NO: 2230410 - RNA, 13 nt, Human
caggaccagggau

SEQ ID NO: 2230411 - RNA, 16 nt, Human
caggacccugaagggg

SEQ ID NO: 2230412 - RNA, 23 nt, Human
caggaccagcuggggcgugggga

SEQ ID NO: 2230413 - RNA, 13 nt, Human
caggaccaggacu

SEQ ID NO: 2230414 - RNA, 14 nt, Human
caggaccaggacua

SEQ ID NO: 2230415 - RNA, 18 nt, Human
caggaccaggcaauguga

SEQ ID NO: 2230416 - RNA, 18 nt, Human
caggacccugaaggggcc

SEQ ID NO: 2230417 - RNA, 17 nt, Human
caggacccugaaggggc

SEQ ID NO: 2230418 - RNA, 15 nt, Human
caggacacggggcag

SEQ ID NO: 2230419 - RNA, 13 nt, Human
caggacagaugcc

SEQ ID NO: 2230420 - RNA, 17 nt, Human
caggacagaugccacac

SEQ ID NO: 2230421 - RNA, 14 nt, Human
caggacagaugcca

SEQ ID NO: 2230422 - RNA, 15 nt, Human
caggccagcugccuc

SEQ ID NO: 2230423 - RNA, 16 nt, Human
caggccagccuccgag

SEQ ID NO: 2230424 - RNA, 19 nt, Human
caggccagccuccgagagg

SEQ ID NO: 2230425 - RNA, 21 nt, Human
caggccagccuccgagaggga

SEQ ID NO: 2230426 - RNA, 23 nt, Human
caggccagccuccgagagggaga

SEQ ID NO: 2230427 - RNA, 13 nt, Human
caggccaggcccu

SEQ ID NO: 2230428 - RNA, 14 nt, Human
caggccaggcccuc

SEQ ID NO: 2230429 - RNA, 15 nt, Human
caggccaggcccucu

SEQ ID NO: 2230430 - RNA, 16 nt, Human
caggccaggcccucug

SEQ ID NO: 2230431 - RNA, 16 nt, Human
caggccacggcagccu

SEQ ID NO: 2230432 - RNA, 11 nt, Human
caggccagccu

SEQ ID NO: 2230433 - RNA, 12 nt, Human
caggccagccuc

SEQ ID NO: 2230434 - RNA, 13 nt, Human
caggccagccucc

SEQ ID NO: 2230435 - RNA, 15 nt, Human
caggccagccuccga

SEQ ID NO: 2230436 - RNA, 21 nt, Human
caggccaccugcccccuucuc

SEQ ID NO: 2230437 - RNA, 19 nt, Human
caggccaccugcccccuuc

SEQ ID NO: 2230438 - RNA, 18 nt, Human
caggccaccugcccccuu

SEQ ID NO: 2230439 - RNA, 17 nt, Human
caggccaccugcccccu

SEQ ID NO: 2230440 - RNA, 23 nt, Human
caggccaccugcccccuucuccc

SEQ ID NO: 2230441 - RNA, 22 nt, Human
caggccaccugcccccuucucc

SEQ ID NO: 2230442 - RNA, 13 nt, Human
caggccagcugcu

SEQ ID NO: 2230443 - RNA, 15 nt, Human
caggccagcugcuug

SEQ ID NO: 2230444 - RNA, 23 nt, Human
caggcacugcugcccagccucca

SEQ ID NO: 2230445 - RNA, 11 nt, Human
caggccaccuc

SEQ ID NO: 2230446 - RNA, 16 nt, Human
caggccaccugccccc

SEQ ID NO: 2230447 - RNA, 15 nt, Human
caggccaccugcccc

SEQ ID NO: 2230448 - RNA, 13 nt, Human
caggccaccugcc

SEQ ID NO: 2230449 - RNA, 18 nt, Human
caggccaccuccagaaac

SEQ ID NO: 2230450 - RNA, 19 nt, Human
caggccaccuccccagcau

SEQ ID NO: 2230451 - RNA, 20 nt, Human
caggccaccuccccagcauu

SEQ ID NO: 2230452 - RNA, 16 nt, Human
caggccaccuccagaa

SEQ ID NO: 2230453 - RNA, 12 nt, Human
caggccaccucc

SEQ ID NO: 2230454 - RNA, 15 nt, Human
caggccaccucccca

SEQ ID NO: 2230455 - RNA, 16 nt, Human
caggccaccuccccag

SEQ ID NO: 2230456 - RNA, 21 nt, Human
caggcaaugcuggcuguuggc

SEQ ID NO: 2230457 - RNA, 16 nt, Human
caggcacugcugccca

SEQ ID NO: 2230458 - RNA, 17 nt, Human
caggcacugcugcccag

SEQ ID NO: 2230459 - RNA, 23 nt, Human
caggcacugagauaccagcgagg

SEQ ID NO: 2230460 - RNA, 19 nt, Human
caggcaaugcuggcuguug

SEQ ID NO: 2230461 - RNA, 20 nt, Human
caggcaaugcuggcuguugg

SEQ ID NO: 2230462 - RNA, 12 nt, Human
caggaggccagc

SEQ ID NO: 2230463 - RNA, 13 nt, Human
caggaggccagcc

SEQ ID NO: 2230464 - RNA, 22 nt, Human
cagcuguuagaguccaacgugg

SEQ ID NO: 2230465 - RNA, 16 nt, Human
cagcuguucagcuggu

SEQ ID NO: 2230466 - RNA, 15 nt, Human
cagcuguucagcugg

SEQ ID NO: 2230467 - RNA, 17 nt, Human
cagcuuaggggcugcug

SEQ ID NO: 2230468 - RNA, 17 nt, Human
cagcuuauucacaagac

SEQ ID NO: 2230469 - RNA, 16 nt, Human
cagcuuauucacaaga

SEQ ID NO: 2230470 - RNA, 17 nt, Human
caggaaaauccucuggc

SEQ ID NO: 2230471 - RNA, 16 nt, Human
caggaaaauccucugg

SEQ ID NO: 2230472 - RNA, 17 nt, Human
caggaaagggaaggccc

SEQ ID NO: 2230473 - RNA, 23 nt, Human
caggaaaggcuccaggagcagcc

SEQ ID NO: 2230474 - RNA, 21 nt, Human
caggaaaggcuccaggagcag

SEQ ID NO: 2230475 - RNA, 22 nt, Human
caggaaaggcuccaggagcagc

SEQ ID NO: 2230476 - RNA, 23 nt, Human
caggaaaauuguuugaacccagg

SEQ ID NO: 2230477 - RNA, 19 nt, Human
caggaaaagcugcugacag

SEQ ID NO: 2230478 - RNA, 20 nt, Human
caggaaaagcugcugacagu

SEQ ID NO: 2230479 - RNA, 23 nt, Human
caggaaauauauaugugugugua

SEQ ID NO: 2230480 - RNA, 22 nt, Human
caggaaaucaaauaugcaaagc

SEQ ID NO: 2230481 - RNA, 21 nt, Human
caggaaaucaaauaugcaaag

SEQ ID NO: 2230482 - RNA, 17 nt, Human
caggaaauauauaugug

SEQ ID NO: 2230483 - RNA, 16 nt, Human
caggaaauauauaugu

SEQ ID NO: 2230484 - RNA, 15 nt, Human
caggaaauauauaug

SEQ ID NO: 2230485 - RNA, 13 nt, Human
caggaaauauaua

SEQ ID NO: 2230486 - RNA, 21 nt, Human
caggaaagggaaggccccaca

SEQ ID NO: 2230487 - RNA, 13 nt, Human
caggaaauaaagu

SEQ ID NO: 2230488 - RNA, 19 nt, Human
caggaaaucaaauaugcaa

SEQ ID NO: 2230489 - RNA, 15 nt, Human
cagccagaguuccug

SEQ ID NO: 2230490 - RNA, 19 nt, Human
cagccagaguuccugcgga

SEQ ID NO: 2230491 - RNA, 20 nt, Human
cagccagaguuccugcggag

SEQ ID NO: 2230492 - RNA, 21 nt, Human
cagccagaguuccugcggagu

SEQ ID NO: 2230493 - RNA, 17 nt, Human
cagccagauccucuugg

SEQ ID NO: 2230494 - RNA, 22 nt, Human
cagccagauggacuccagccug

SEQ ID NO: 2230495 - RNA, 12 nt, Human
cagccagcaccu

SEQ ID NO: 2230496 - RNA, 13 nt, Human
cagccagcaccug

SEQ ID NO: 2230497 - RNA, 13 nt, Human
cagccagcaauga

SEQ ID NO: 2230498 - RNA, 20 nt, Human
cagccagcaaugauguccag

SEQ ID NO: 2230499 - RNA, 22 nt, Human
cagccagcaaugauguccagaa

SEQ ID NO: 2230500 - RNA, 23 nt, Human
cagccagcaaugauguccagaag

SEQ ID NO: 2230501 - RNA, 14 nt, Human
cagccagcagccag

SEQ ID NO: 2230502 - RNA, 15 nt, Human
cagccagcagccagc

SEQ ID NO: 2230503 - RNA, 23 nt, Human
cagcacuggcucucuccaggauc

SEQ ID NO: 2230504 - RNA, 11 nt, Human
cagccagcagc

SEQ ID NO: 2230505 - RNA, 12 nt, Human
cagccagcagcc

SEQ ID NO: 2230506 - RNA, 14 nt, Human
cagccagcaccugg

SEQ ID NO: 2230507 - RNA, 16 nt, Human
cagccagcaccuggca

SEQ ID NO: 2230508 - RNA, 20 nt, Human
cagauuggcucacacugaga

SEQ ID NO: 2230509 - RNA, 18 nt, Human
cagauuggcucacacuga

SEQ ID NO: 2230510 - RNA, 13 nt, Human
cagauuucacucu

SEQ ID NO: 2230511 - RNA, 14 nt, Human
cagauuugagcuca

SEQ ID NO: 2230512 - RNA, 13 nt, Human
cagauuugagcuc

SEQ ID NO: 2230513 - RNA, 20 nt, Human
cagauuugcuaauuuauccu

SEQ ID NO: 2230514 - RNA, 14 nt, Human
cagauuugggcugg

SEQ ID NO: 2230515 - RNA, 15 nt, Human
cagauuugggcugga

SEQ ID NO: 2230516 - RNA, 18 nt, Human
cagauuugggcuggaaca

SEQ ID NO: 2230517 - RNA, 16 nt, Human
cagauuugagcucagc

SEQ ID NO: 2230518 - RNA, 15 nt, Human
cagauuucacucucc

SEQ ID NO: 2230519 - RNA, 16 nt, Human
cagauuucacucuccu

SEQ ID NO: 2230520 - RNA, 18 nt, Human
cagauuucacucuccuug

SEQ ID NO: 2230521 - RNA, 18 nt, Human
cagauuggagaaacccuu

SEQ ID NO: 2230522 - RNA, 17 nt, Human
cagauuggcucacacug

SEQ ID NO: 2230523 - RNA, 21 nt, Human
cagauugcaugugacucugaa

SEQ ID NO: 2230524 - RNA, 23 nt, Human
cagauugcaugugacucugaagc

SEQ ID NO: 2230525 - RNA, 20 nt, Human
cagauugcaugugacucuga

SEQ ID NO: 2230526 - RNA, 18 nt, Human
cagauugcaugugacucu

SEQ ID NO: 2230527 - RNA, 21 nt, Human
cagauugcaacaggcugggcu

SEQ ID NO: 2230528 - RNA, 16 nt, Human
cagauugcaugugacu

SEQ ID NO: 2230529 - RNA, 15 nt, Human
cagauugcaugugac

SEQ ID NO: 2230530 - RNA, 13 nt, Human
cagauugcaugug

SEQ ID NO: 2230531 - RNA, 12 nt, Human
cagauugcaugu

SEQ ID NO: 2230532 - RNA, 21 nt, Human
cagcaccacccuagucccuuc

SEQ ID NO: 2230533 - RNA, 17 nt, Human
cagcacucacacaggac

SEQ ID NO: 2230534 - RNA, 22 nt, Human
cagcacucacacaggacccccu

SEQ ID NO: 2230535 - RNA, 11 nt, Human
cagcacugagg

SEQ ID NO: 2230536 - RNA, 12 nt, Human
cagcacugagga

SEQ ID NO: 2230537 - RNA, 13 nt, Human
cagcacugaggaa

SEQ ID NO: 2230538 - RNA, 15 nt, Human
cagcacugaggaaga

SEQ ID NO: 2230539 - RNA, 17 nt, Human
cagcacugaggaagaac

SEQ ID NO: 2230540 - RNA, 14 nt, Human
cagcacugauuuca

SEQ ID NO: 2230541 - RNA, 13 nt, Human
cagcacugcccaa

SEQ ID NO: 2230542 - RNA, 19 nt, Human
cagcacugcuugaggaaaa

SEQ ID NO: 2230543 - RNA, 12 nt, Human
cagcacuggcuc

SEQ ID NO: 2230544 - RNA, 18 nt, Human
cagcacugcuugaggaaa

SEQ ID NO: 2230545 - RNA, 16 nt, Human
cagcacugcuugagga

SEQ ID NO: 2230546 - RNA, 13 nt, Human
cagcaccacccua

SEQ ID NO: 2230547 - RNA, 22 nt, Human
cagcacagcuugaccugaggcu

SEQ ID NO: 2230548 - RNA, 18 nt, Human
cagcacagggauccgacu

SEQ ID NO: 2230549 - RNA, 13 nt, Human
cagcacagcuuga

SEQ ID NO: 2230550 - RNA, 15 nt, Human
cagcacagcuugacc

SEQ ID NO: 2230551 - RNA, 16 nt, Human
cagcacagcuugaccu

SEQ ID NO: 2230552 - RNA, 17 nt, Human
cagcacagcuugaccug

SEQ ID NO: 2230553 - RNA, 20 nt, Human
cagcacagcuugaccugagg

SEQ ID NO: 2230554 - RNA, 21 nt, Human
cagcacagcuugaccugaggc

SEQ ID NO: 2230555 - RNA, 19 nt, Human
cagcauagcaagacacauc

SEQ ID NO: 2230556 - RNA, 21 nt, Human
cagcacuggcucucuccagga

SEQ ID NO: 2230557 - RNA, 20 nt, Human
cagcauaugggggccuggau

SEQ ID NO: 2230558 - RNA, 18 nt, Human
cagcauauucaggaagcu

SEQ ID NO: 2230559 - RNA, 16 nt, Human
cagcauauucaggaag

SEQ ID NO: 2230560 - RNA, 17 nt, Human
cagcauauucaggaagc

SEQ ID NO: 2230561 - RNA, 14 nt, Human
cagcacuggcucuc

SEQ ID NO: 2230562 - RNA, 16 nt, Human
cagcacuggcucucuc

SEQ ID NO: 2230563 - RNA, 17 nt, Human
cagcacuggcucucucc

SEQ ID NO: 2230564 - RNA, 18 nt, Human
cagcacuggcucucucca

SEQ ID NO: 2230565 - RNA, 19 nt, Human
cagcacuggcucucuccag

SEQ ID NO: 2230566 - RNA, 20 nt, Human
cagcacuggcucucuccagg

SEQ ID NO: 2230567 - RNA, 23 nt, Human
cagcaguuccggauuggcuugug

SEQ ID NO: 2230568 - RNA, 21 nt, Human
cagcccccacagugcugucug

SEQ ID NO: 2230569 - RNA, 21 nt, Human
cagcccccacugccuuugacc

SEQ ID NO: 2230570 - RNA, 13 nt, Human
cagcccccacagu

SEQ ID NO: 2230571 - RNA, 17 nt, Human
cagcccccacagugcug

SEQ ID NO: 2230572 - RNA, 19 nt, Human
cagcccccacagugcuguc

SEQ ID NO: 2230573 - RNA, 20 nt, Human
cagcccccacagugcugucu

SEQ ID NO: 2230574 - RNA, 23 nt, Human
cagccccauucugccugcccagg

SEQ ID NO: 2230575 - RNA, 24 nt, Human
cagccccauucugccugcccaggc

SEQ ID NO: 2230576 - RNA, 19 nt, Human
cagccccauucugccugcc

SEQ ID NO: 2230577 - RNA, 20 nt, Human
cagccccauucugccugccc

SEQ ID NO: 2230578 - RNA, 22 nt, Human
cagccccauucugccugcccag

SEQ ID NO: 2230579 - RNA, 18 nt, Human
cagccccgcgccuccuuc

SEQ ID NO: 2230580 - RNA, 16 nt, Human
cagccccgcgccuccu

SEQ ID NO: 2230581 - RNA, 19 nt, Human
cagcccccuuugggcccag

SEQ ID NO: 2230582 - RNA, 20 nt, Human
cagcccccuuugggcccagg

SEQ ID NO: 2230583 - RNA, 21 nt, Human
cagcccccuuugggcccaggg

SEQ ID NO: 2230584 - RNA, 18 nt, Human
cagccccgccuccaggcc

SEQ ID NO: 2230585 - RNA, 15 nt, Human
cagcccccuuugggc

SEQ ID NO: 2230586 - RNA, 22 nt, Human
cagcccccuuugggcccaggga

SEQ ID NO: 2230587 - RNA, 19 nt, Human
cagccccgugggguuccuc

SEQ ID NO: 2230588 - RNA, 15 nt, Human
cagccccggcccugg

SEQ ID NO: 2230589 - RNA, 16 nt, Human
cagccccggcccuggg

SEQ ID NO: 2230590 - RNA, 17 nt, Human
cagccccggcccugggc

SEQ ID NO: 2230591 - RNA, 19 nt, Human
cagccccggcccugggcuc

SEQ ID NO: 2230592 - RNA, 12 nt, Human
cagccccuagcc

SEQ ID NO: 2230593 - RNA, 13 nt, Human
cagccccuagccc

SEQ ID NO: 2230594 - RNA, 15 nt, Human
cagccccuagcccag

SEQ ID NO: 2230595 - RNA, 16 nt, Human
cagccccuagcccagg

SEQ ID NO: 2230596 - RNA, 17 nt, Human
cagccccuagcccagga

SEQ ID NO: 2230597 - RNA, 22 nt, Human
cagccccuagcccaggagagag

SEQ ID NO: 2230598 - RNA, 23 nt, Human
cagccccuagcccaggagagaga

SEQ ID NO: 2230599 - RNA, 24 nt, Human
cagccccuagcccaggagagagaa

SEQ ID NO: 2230600 - RNA, 12 nt, Human
cagcccugucag

SEQ ID NO: 2230601 - RNA, 18 nt, Human
cagcccuggucucagcag

SEQ ID NO: 2230602 - RNA, 19 nt, Human
cagcccuggucucagcagc

SEQ ID NO: 2230603 - RNA, 12 nt, Human
cagcccuggucu

SEQ ID NO: 2230604 - RNA, 13 nt, Human
cagcccuggucuc

SEQ ID NO: 2230605 - RNA, 15 nt, Human
cagcccuggucucag

SEQ ID NO: 2230606 - RNA, 16 nt, Human
cagcccuggucucagc

SEQ ID NO: 2230607 - RNA, 20 nt, Human
cagccccugauccugugaag

SEQ ID NO: 2230608 - RNA, 21 nt, Human
cagccccugauccugugaagu

SEQ ID NO: 2230609 - RNA, 11 nt, Human
cagccccugcc

SEQ ID NO: 2230610 - RNA, 15 nt, Human
cagccccugccccag

SEQ ID NO: 2230611 - RNA, 17 nt, Human
cagccccugccccagcc

SEQ ID NO: 2230612 - RNA, 19 nt, Human
cagccccugccccagccca

SEQ ID NO: 2230613 - RNA, 22 nt, Human
cagccccugccccagcccaagu

SEQ ID NO: 2230614 - RNA, 22 nt, Human
cagccccucuugccccccaccc

SEQ ID NO: 2230615 - RNA, 21 nt, Human
cagccccucuugccccccacc

SEQ ID NO: 2230616 - RNA, 17 nt, Human
cagccccucuugccccc

SEQ ID NO: 2230617 - RNA, 15 nt, Human
cagccccucuugccc

SEQ ID NO: 2230618 - RNA, 23 nt, Human
cagccccucuugccccccacccc

SEQ ID NO: 2230619 - RNA, 13 nt, Human
cagccccugcaca

SEQ ID NO: 2230620 - RNA, 14 nt, Human
cagccccugauccu

SEQ ID NO: 2230621 - RNA, 19 nt, Human
cagccccugauccugugaa

SEQ ID NO: 2230622 - RNA, 11 nt, Human
cagccccucuu

SEQ ID NO: 2230623 - RNA, 23 nt, Human
cagccccuccucugccaccuccc

SEQ ID NO: 2230624 - RNA, 22 nt, Human
cagccccucuggucgcuccugc

SEQ ID NO: 2230625 - RNA, 18 nt, Human
cagccccucuggucgcuc

SEQ ID NO: 2230626 - RNA, 21 nt, Human
cagccccucuggucgcuccug

SEQ ID NO: 2230627 - RNA, 22 nt, Human
cagccccuccucugccaccucc

SEQ ID NO: 2230628 - RNA, 21 nt, Human
cagccccuccucugccaccuc

SEQ ID NO: 2230629 - RNA, 13 nt, Human
cagccccucuggu

SEQ ID NO: 2230630 - RNA, 14 nt, Human
cagccccucugguc

SEQ ID NO: 2230631 - RNA, 16 nt, Human
cagccccucuggucgc

SEQ ID NO: 2230632 - RNA, 20 nt, Human
cagccccuccucugccaccu

SEQ ID NO: 2230633 - RNA, 19 nt, Human
cagccccuccucugccacc

SEQ ID NO: 2230634 - RNA, 17 nt, Human
cagccccuccucugcca

SEQ ID NO: 2230635 - RNA, 16 nt, Human
cagccccuccucugcc

SEQ ID NO: 2230636 - RNA, 15 nt, Human
cagccccuccucugc

SEQ ID NO: 2230637 - RNA, 14 nt, Human
cagccccuccucug

SEQ ID NO: 2230638 - RNA, 13 nt, Human
cagccccuccucu

SEQ ID NO: 2230639 - RNA, 12 nt, Human
cagccccuccuc

SEQ ID NO: 2230640 - RNA, 21 nt, Human
cagccccucccaccacagcag

SEQ ID NO: 2230641 - RNA, 15 nt, Human
cagccccucccacca

SEQ ID NO: 2230642 - RNA, 14 nt, Human
cagccccucccacc

SEQ ID NO: 2230643 - RNA, 13 nt, Human
cagccccucccac

SEQ ID NO: 2230644 - RNA, 22 nt, Human
cagccccucccaccacagcagg

SEQ ID NO: 2230645 - RNA, 14 nt, Human
cagcguuucuauga

SEQ ID NO: 2230646 - RNA, 16 nt, Human
cagcguuucuaugaca

SEQ ID NO: 2230647 - RNA, 19 nt, Human
cagcguuucuaugacacau

SEQ ID NO: 2230648 - RNA, 13 nt, Human
cagcguugcaugu

SEQ ID NO: 2230649 - RNA, 14 nt, Human
cagcguugcauguc

SEQ ID NO: 2230650 - RNA, 17 nt, Human
cagcguugcaugucgug

SEQ ID NO: 2230651 - RNA, 16 nt, Human
cagcgggaauggcagc

SEQ ID NO: 2230652 - RNA, 18 nt, Human
cagcggcuggacuuggag

SEQ ID NO: 2230653 - RNA, 16 nt, Human
cagcggcuggacuugg

SEQ ID NO: 2230654 - RNA, 17 nt, Human
cagcggcuggaauuggg

SEQ ID NO: 2230655 - RNA, 19 nt, Human
cagcgugcuuuaaaaaaua

SEQ ID NO: 2230656 - RNA, 14 nt, Human
cagcggggacagcu

SEQ ID NO: 2230657 - RNA, 23 nt, Human
cagcgggaauggcagcugccacg

SEQ ID NO: 2230658 - RNA, 22 nt, Human
cagcgggaauggcagcugccac

SEQ ID NO: 2230659 - RNA, 15 nt, Human
cagccugccuggcag

SEQ ID NO: 2230660 - RNA, 19 nt, Human
cagccugccuggcaggcug

SEQ ID NO: 2230661 - RNA, 17 nt, Human
cagccugcccucuucau

SEQ ID NO: 2230662 - RNA, 17 nt, Human
cagcggccccuugacuc

SEQ ID NO: 2230663 - RNA, 20 nt, Human
cagcggccccugcauccccu

SEQ ID NO: 2230664 - RNA, 17 nt, Human
cagccugccacucaggc

SEQ ID NO: 2230665 - RNA, 16 nt, Human
cagccugccacucagg

SEQ ID NO: 2230666 - RNA, 12 nt, Human
cagccugccacu

SEQ ID NO: 2230667 - RNA, 11 nt, Human
cagccugccac

SEQ ID NO: 2230668 - RNA, 23 nt, Human
cagccucucuugguuuccuuccu

SEQ ID NO: 2230669 - RNA, 10 nt, Human
cagccugagu

SEQ ID NO: 2230670 - RNA, 19 nt, Human
cagccugaggcugagacug

SEQ ID NO: 2230671 - RNA, 18 nt, Human
cagccugaggcugagacu

SEQ ID NO: 2230672 - RNA, 15 nt, Human
cagccugaggcugag

SEQ ID NO: 2230673 - RNA, 12 nt, Human
cagccugaggcu

SEQ ID NO: 2230674 - RNA, 22 nt, Human
cagccucucucccagucuaccc

SEQ ID NO: 2230675 - RNA, 23 nt, Human
cagccucucucccagucuaccca

SEQ ID NO: 2230676 - RNA, 22 nt, Human
cagccucucuugguuuccuucc

SEQ ID NO: 2230677 - RNA, 18 nt, Human
cagccugcagacucacug

SEQ ID NO: 2230678 - RNA, 20 nt, Human
cagccugagucuccugugcc

SEQ ID NO: 2230679 - RNA, 14 nt, Human
cagccugagucucc

SEQ ID NO: 2230680 - RNA, 15 nt, Human
cagccugagucuccu

SEQ ID NO: 2230681 - RNA, 16 nt, Human
cagccugagucuccug

SEQ ID NO: 2230682 - RNA, 17 nt, Human
cagccugagucuccugu

SEQ ID NO: 2230683 - RNA, 18 nt, Human
cagccugagucuccugug

SEQ ID NO: 2230684 - RNA, 19 nt, Human
cagccugagucuccugugc

SEQ ID NO: 2230685 - RNA, 22 nt, Human
cagccugagucuccugugccca

SEQ ID NO: 2230686 - RNA, 23 nt, Human
cagccugagcgacagugagacuc

SEQ ID NO: 2230687 - RNA, 12 nt, Human
cagccucucucc

SEQ ID NO: 2230688 - RNA, 17 nt, Human
cagccucuccccugauu

SEQ ID NO: 2230689 - RNA, 19 nt, Human
cagccucuccccugauuac

SEQ ID NO: 2230690 - RNA, 15 nt, Human
cagccucucucccag

SEQ ID NO: 2230691 - RNA, 16 nt, Human
cagccucucucccagu

SEQ ID NO: 2230692 - RNA, 18 nt, Human
cagccucucucccagucu

SEQ ID NO: 2230693 - RNA, 16 nt, Human
cagccucuccccaggu

SEQ ID NO: 2230694 - RNA, 19 nt, Human
cagccucuccccaggucca

SEQ ID NO: 2230695 - RNA, 20 nt, Human
cagccucuccccagguccag

SEQ ID NO: 2230696 - RNA, 23 nt, Human
cagccucuccccagguccagcuc

SEQ ID NO: 2230697 - RNA, 21 nt, Human
cagcccugucagugcagcccg

SEQ ID NO: 2230698 - RNA, 20 nt, Human
cagcccugucagugcagccc

SEQ ID NO: 2230699 - RNA, 18 nt, Human
cagcccugucagugcagc

SEQ ID NO: 2230700 - RNA, 16 nt, Human
cagcccugucagugca

SEQ ID NO: 2230701 - RNA, 13 nt, Human
cagcccuuagcag

SEQ ID NO: 2230702 - RNA, 11 nt, Human
cagcccugugg

SEQ ID NO: 2230703 - RNA, 21 nt, Human
cagcccugucugaaggacacu

SEQ ID NO: 2230704 - RNA, 23 nt, Human
cagccgccaugcuccuggcccac

SEQ ID NO: 2230705 - RNA, 12 nt, Human
cagccgcuccug

SEQ ID NO: 2230706 - RNA, 14 nt, Human
cagccucuccccag

SEQ ID NO: 2230707 - RNA, 19 nt, Human
cagccgccauugccaccag

SEQ ID NO: 2230708 - RNA, 18 nt, Human
cagccgccauugccacca

SEQ ID NO: 2230709 - RNA, 17 nt, Human
cagccgccauugccacc

SEQ ID NO: 2230710 - RNA, 22 nt, Human
cagccgccauugccaccaggag

SEQ ID NO: 2230711 - RNA, 21 nt, Human
cagccgccauugccaccagga

SEQ ID NO: 2230712 - RNA, 23 nt, Human
cagccgccauugccaccaggaga

SEQ ID NO: 2230713 - RNA, 20 nt, Human
cagagcuacccgcagaguuc

SEQ ID NO: 2230714 - RNA, 16 nt, Human
cagagcugcgggcugg

SEQ ID NO: 2230715 - RNA, 9 nt, Human
cagagcugg

SEQ ID NO: 2230716 - RNA, 16 nt, Human
cagagcuacuugggcc

SEQ ID NO: 2230717 - RNA, 17 nt, Human
cagagcuacacagggga

SEQ ID NO: 2230718 - RNA, 22 nt, Human
cagagcuacacaggggaaaaga

SEQ ID NO: 2230719 - RNA, 20 nt, Human
cagagcgagagucugucuca

SEQ ID NO: 2230720 - RNA, 16 nt, Human
cagagccuuuggauga

SEQ ID NO: 2230721 - RNA, 18 nt, Human
cagagccuuuggaugacc

SEQ ID NO: 2230722 - RNA, 19 nt, Human
cagagccuuuggaugacca

SEQ ID NO: 2230723 - RNA, 20 nt, Human
cagagccuuuggaugaccag

SEQ ID NO: 2230724 - RNA, 23 nt, Human
cagagccuucugaggacauucca

SEQ ID NO: 2230725 - RNA, 15 nt, Human
cagagcgccccuccc

SEQ ID NO: 2230726 - RNA, 19 nt, Human
cagagcgccccucccuagu

SEQ ID NO: 2230727 - RNA, 19 nt, Human
cagagcgccgugaguucuc

SEQ ID NO: 2230728 - RNA, 20 nt, Human
cagagcgccgugaguucuca

SEQ ID NO: 2230729 - RNA, 21 nt, Human
cagagcgccgugaguucucag

SEQ ID NO: 2230730 - RNA, 22 nt, Human
cagagcgccgugaguucucagg

SEQ ID NO: 2230731 - RNA, 18 nt, Human
cagagaggacgugggcgg

SEQ ID NO: 2230732 - RNA, 21 nt, Human
cagagaggacgugggcggcag

SEQ ID NO: 2230733 - RNA, 18 nt, Human
cagagaggacuguaggga

SEQ ID NO: 2230734 - RNA, 20 nt, Human
cagagaggacuguagggagg

SEQ ID NO: 2230735 - RNA, 20 nt, Human
cagagaggagucagagagaa

SEQ ID NO: 2230736 - RNA, 17 nt, Human
cagagaggagucagaga

SEQ ID NO: 2230737 - RNA, 22 nt, Human
cagagaggagaaacacaucuuc

SEQ ID NO: 2230738 - RNA, 21 nt, Human
cagagaggagaaacacaucuu

SEQ ID NO: 2230739 - RNA, 18 nt, Human
cagagaggagaaacacau

SEQ ID NO: 2230740 - RNA, 17 nt, Human
cagagaggagaaacaca

SEQ ID NO: 2230741 - RNA, 16 nt, Human
cagagaggagaaacac

SEQ ID NO: 2230742 - RNA, 13 nt, Human
cagagaggagaaa

SEQ ID NO: 2230743 - RNA, 20 nt, Human
cagagaggccuuuuggaaug

SEQ ID NO: 2230744 - RNA, 16 nt, Human
cagagaggccaggugc

SEQ ID NO: 2230745 - RNA, 18 nt, Human
cagagaggccaggugcag

SEQ ID NO: 2230746 - RNA, 16 nt, Human
cagagagggugggagu

SEQ ID NO: 2230747 - RNA, 14 nt, Human
cagagccugcaguu

SEQ ID NO: 2230748 - RNA, 20 nt, Human
cagagagggugggagugggc

SEQ ID NO: 2230749 - RNA, 22 nt, Human
cagagagggugggagugggccc

SEQ ID NO: 2230750 - RNA, 16 nt, Human
cagagaggacgugggc

SEQ ID NO: 2230751 - RNA, 17 nt, Human
cagagaggacgugggcg

SEQ ID NO: 2230752 - RNA, 15 nt, Human
cagagaggaaucaga

SEQ ID NO: 2230753 - RNA, 13 nt, Human
cagagaggaauca

SEQ ID NO: 2230754 - RNA, 13 nt, Human
cagagagcuggua

SEQ ID NO: 2230755 - RNA, 19 nt, Human
cagagagcugguaguuagu

SEQ ID NO: 2230756 - RNA, 12 nt, Human
cagagagcuggu

SEQ ID NO: 2230757 - RNA, 22 nt, Human
cagagagcggucucaggcuggu

SEQ ID NO: 2230758 - RNA, 20 nt, Human
cagagagccuggugcugcug

SEQ ID NO: 2230759 - RNA, 18 nt, Human
cagagagcggucucaggc

SEQ ID NO: 2230760 - RNA, 21 nt, Human
cagagagcggucucaggcugg

SEQ ID NO: 2230761 - RNA, 19 nt, Human
cagagagccuggugcugcu

SEQ ID NO: 2230762 - RNA, 21 nt, Human
cagagagccauuuugugaaug

SEQ ID NO: 2230763 - RNA, 23 nt, Human
cagagagccauuuugugaaugga

SEQ ID NO: 2230764 - RNA, 15 nt, Human
cagagagccauuuug

SEQ ID NO: 2230765 - RNA, 18 nt, Human
cagagagccauuuuguga

SEQ ID NO: 2230766 - RNA, 19 nt, Human
cagagagccauuuugugaa

SEQ ID NO: 2230767 - RNA, 20 nt, Human
cagagagccauuuugugaau

SEQ ID NO: 2230768 - RNA, 12 nt, Human
cagagagagugu

SEQ ID NO: 2230769 - RNA, 20 nt, Human
cagagagcaacucugagauc

SEQ ID NO: 2230770 - RNA, 22 nt, Human
cagagagaggggagaagccugg

SEQ ID NO: 2230771 - RNA, 24 nt, Human
cagagagagaagugccccugcugc

SEQ ID NO: 2230772 - RNA, 21 nt, Human
cagagacuccugcaggcagcc

SEQ ID NO: 2230773 - RNA, 22 nt, Human
cagagacuccugcaggcagcca

SEQ ID NO: 2230774 - RNA, 20 nt, Human
cagagacuccugcaggcagc

SEQ ID NO: 2230775 - RNA, 21 nt, Human
cagauacuggaaguuuugcau

SEQ ID NO: 2230776 - RNA, 18 nt, Human
cagauacuggaaguuuug

SEQ ID NO: 2230777 - RNA, 16 nt, Human
cagaucauugugaaau

SEQ ID NO: 2230778 - RNA, 17 nt, Human
cagauacaugguuguga

SEQ ID NO: 2230779 - RNA, 14 nt, Human
cagauaccagcccc

SEQ ID NO: 2230780 - RNA, 17 nt, Human
cagauacauaugagugu

SEQ ID NO: 2230781 - RNA, 16 nt, Human
cagauaccagccccug

SEQ ID NO: 2230782 - RNA, 15 nt, Human
cagauaccucacccu

SEQ ID NO: 2230783 - RNA, 22 nt, Human
cagauacuggaaguuuugcauu

SEQ ID NO: 2230784 - RNA, 18 nt, Human
cagauccagccugggguc

SEQ ID NO: 2230785 - RNA, 17 nt, Human
cagauccagccuggggu

SEQ ID NO: 2230786 - RNA, 15 nt, Human
cagauccagccuggg

SEQ ID NO: 2230787 - RNA, 14 nt, Human
cagauccagccugg

SEQ ID NO: 2230788 - RNA, 13 nt, Human
cagauccagccug

SEQ ID NO: 2230789 - RNA, 19 nt, Human
cagaucauuucaaaacuca

SEQ ID NO: 2230790 - RNA, 12 nt, Human
cagauccagccu

SEQ ID NO: 2230791 - RNA, 23 nt, Human
cagaucauuaucagccugugcca

SEQ ID NO: 2230792 - RNA, 22 nt, Human
cagaucauugugaaauuauuca

SEQ ID NO: 2230793 - RNA, 13 nt, Human
cagagcugggagg

SEQ ID NO: 2230794 - RNA, 14 nt, Human
cagagcugggaggc

SEQ ID NO: 2230795 - RNA, 15 nt, Human
cagagcugggaggca

SEQ ID NO: 2230796 - RNA, 23 nt, Human
cagagcugggaggcauggcccug

SEQ ID NO: 2230797 - RNA, 15 nt, Human
cagaggucucugccg

SEQ ID NO: 2230798 - RNA, 20 nt, Human
cagagcugggaggcauggcc

SEQ ID NO: 2230799 - RNA, 19 nt, Human
cagaggucucugccggcuc

SEQ ID NO: 2230800 - RNA, 20 nt, Human
cagaggucucugccggcucu

SEQ ID NO: 2230801 - RNA, 23 nt, Human
cagaggucucugccggcucuuuc

SEQ ID NO: 2230802 - RNA, 14 nt, Human
cagaggucugugcu

SEQ ID NO: 2230803 - RNA, 15 nt, Human
cagaggucugugcug

SEQ ID NO: 2230804 - RNA, 10 nt, Human
cagagcuggg

SEQ ID NO: 2230805 - RNA, 18 nt, Human
cagagcuggcucugagcg

SEQ ID NO: 2230806 - RNA, 13 nt, Human
cagagcuggcucu

SEQ ID NO: 2230807 - RNA, 17 nt, Human
cagagcuggcucugagc

SEQ ID NO: 2230808 - RNA, 12 nt, Human
cagaggugggca

SEQ ID NO: 2230809 - RNA, 19 nt, Human
cagagguggccagagcugg

SEQ ID NO: 2230810 - RNA, 21 nt, Human
cagagguggccagagcuggga

SEQ ID NO: 2230811 - RNA, 16 nt, Human
cagaggucugugcuga

SEQ ID NO: 2230812 - RNA, 14 nt, Human
cagagguggccaga

SEQ ID NO: 2230813 - RNA, 17 nt, Human
cagagguggccagagcu

SEQ ID NO: 2230814 - RNA, 13 nt, Human
cagaggugggcag

SEQ ID NO: 2230815 - RNA, 14 nt, Human
cagaggugggcagg

SEQ ID NO: 2230816 - RNA, 15 nt, Human
cagaggugggcaggu

SEQ ID NO: 2230817 - RNA, 16 nt, Human
cagaggugggcaggug

SEQ ID NO: 2230818 - RNA, 17 nt, Human
cagaggugggcaggugg

SEQ ID NO: 2230819 - RNA, 20 nt, Human
cagaggugggcagguggugg

SEQ ID NO: 2230820 - RNA, 22 nt, Human
cagaggugggcaggugguggca

SEQ ID NO: 2230821 - RNA, 23 nt, Human
cagaggugggcaggugguggcac

SEQ ID NO: 2230822 - RNA, 23 nt, Human
cagauacaggaaaagcugcugac

SEQ ID NO: 2230823 - RNA, 18 nt, Human
cagagguuaucuguccca

SEQ ID NO: 2230824 - RNA, 19 nt, Human
cagagguuaucugucccag

SEQ ID NO: 2230825 - RNA, 21 nt, Human
cagagguuaucugucccaggu

SEQ ID NO: 2230826 - RNA, 12 nt, Human
cauacacacaca

SEQ ID NO: 2230827 - RNA, 13 nt, Human
cauacaaggccca

SEQ ID NO: 2230828 - RNA, 15 nt, Human
cauacaauuccaaac

SEQ ID NO: 2230829 - RNA, 14 nt, Human
cauaauuuucuuca

SEQ ID NO: 2230830 - RNA, 20 nt, Human
cauaauuuucuucaugcaau

SEQ ID NO: 2230831 - RNA, 21 nt, Human
cauaaugcgugcauaccacuu

SEQ ID NO: 2230832 - RNA, 23 nt, Human
cauagaugucccuuucuuggcca

SEQ ID NO: 2230833 - RNA, 20 nt, Human
cauacacacacacacacagc

SEQ ID NO: 2230834 - RNA, 19 nt, Human
cauacacacacacacacag

SEQ ID NO: 2230835 - RNA, 16 nt, Human
cauacacacacacaca

SEQ ID NO: 2230836 - RNA, 15 nt, Human
cauacacacacacac

SEQ ID NO: 2230837 - RNA, 14 nt, Human
cauacacacacaca

SEQ ID NO: 2230838 - RNA, 18 nt, Human
cauagauucccugagcag

SEQ ID NO: 2230839 - RNA, 17 nt, Human
cauagauucccugagca

SEQ ID NO: 2230840 - RNA, 18 nt, Human
cauagauugagaaguuuu

SEQ ID NO: 2230841 - RNA, 20 nt, Human
cauagcagcuuauucacaag

SEQ ID NO: 2230842 - RNA, 11 nt, Human
cauagcauuaa

SEQ ID NO: 2230843 - RNA, 18 nt, Human
cauagcaugacauuucuu

SEQ ID NO: 2230844 - RNA, 17 nt, Human
cauagcaugacauuucu

SEQ ID NO: 2230845 - RNA, 15 nt, Human
cauagcaugacauuu

SEQ ID NO: 2230846 - RNA, 15 nt, Human
cauagaugcagguga

SEQ ID NO: 2230847 - RNA, 21 nt, Human
cauagcauagcuagagauugg

SEQ ID NO: 2230848 - RNA, 23 nt, Human
cauagcauuaacuaaucuauugg

SEQ ID NO: 2230849 - RNA, 16 nt, Human
cauagcauuaacuaau

SEQ ID NO: 2230850 - RNA, 15 nt, Human
cauagcauuaacuaa

SEQ ID NO: 2230851 - RNA, 15 nt, Human
cauagccaccccaga

SEQ ID NO: 2230852 - RNA, 19 nt, Human
cauagccuaaucccugggc

SEQ ID NO: 2230853 - RNA, 12 nt, Human
cauagccuauau

SEQ ID NO: 2230854 - RNA, 13 nt, Human
cauagccuauauu

SEQ ID NO: 2230855 - RNA, 15 nt, Human
cauagccuauauuua

SEQ ID NO: 2230856 - RNA, 18 nt, Human
cauagccuaaucccuggg

SEQ ID NO: 2230857 - RNA, 23 nt, Human
cauagcccaucccugccugguca

SEQ ID NO: 2230858 - RNA, 17 nt, Human
cauagcccaucccugcc

SEQ ID NO: 2230859 - RNA, 18 nt, Human
cauagcccaucccugccu

SEQ ID NO: 2230860 - RNA, 19 nt, Human
cauagcccucacccugggg

SEQ ID NO: 2230861 - RNA, 15 nt, Human
cauagcccucacccu

SEQ ID NO: 2230862 - RNA, 12 nt, Human
cauagcccucac

SEQ ID NO: 2230863 - RNA, 15 nt, Human
cauagcccaguagac

SEQ ID NO: 2230864 - RNA, 13 nt, Human
cauagcccauccc

SEQ ID NO: 2230865 - RNA, 16 nt, Human
cauagcccaucccugc

SEQ ID NO: 2230866 - RNA, 15 nt, Human
cauagccaggaaacu

SEQ ID NO: 2230867 - RNA, 11 nt, Human
cauagcccagu

SEQ ID NO: 2230868 - RNA, 16 nt, Human
cauagcccagacacag

SEQ ID NO: 2230869 - RNA, 18 nt, Human
cauagcccagacacagaa

SEQ ID NO: 2230870 - RNA, 15 nt, Human
cauagggucucuuca

SEQ ID NO: 2230871 - RNA, 14 nt, Human
cauaggccugggug

SEQ ID NO: 2230872 - RNA, 13 nt, Human
cauaggcccagug

SEQ ID NO: 2230873 - RNA, 17 nt, Human
cauaggaggcuucuguu

SEQ ID NO: 2230874 - RNA, 23 nt, Human
cauaggacucaaaguuucagaga

SEQ ID NO: 2230875 - RNA, 16 nt, Human
cauaggaccuuuccac

SEQ ID NO: 2230876 - RNA, 18 nt, Human
cauaggaccuuuccacca

SEQ ID NO: 2230877 - RNA, 22 nt, Human
cauagcuaagaaauaaaacugu

SEQ ID NO: 2230878 - RNA, 21 nt, Human
cauagcuaagaaauaaaacug

SEQ ID NO: 2230879 - RNA, 16 nt, Human
cauagcuaucaagugu

SEQ ID NO: 2230880 - RNA, 20 nt, Human
cauagcuaucaagugugcuu

SEQ ID NO: 2230881 - RNA, 12 nt, Human
cauaggaaaagu

SEQ ID NO: 2230882 - RNA, 24 nt, Human
cauaggaagggaccaaggcaaggc

SEQ ID NO: 2230883 - RNA, 18 nt, Human
cauaggaaaaguacauuu

SEQ ID NO: 2230884 - RNA, 19 nt, Human
cauaggaaaaguacauuua

SEQ ID NO: 2230885 - RNA, 22 nt, Human
cauaggaaaaguacauuuaaua

SEQ ID NO: 2230886 - RNA, 23 nt, Human
cauaggaaaaguacauuuaauac

SEQ ID NO: 2230887 - RNA, 17 nt, Human
cauagggucucuucagg

SEQ ID NO: 2230888 - RNA, 19 nt, Human
cauaggccugggugcuggc

SEQ ID NO: 2230889 - RNA, 18 nt, Human
cauaggccugggugcugg

SEQ ID NO: 2230890 - RNA, 17 nt, Human
cauaggccugggugcug

SEQ ID NO: 2230891 - RNA, 15 nt, Human
cauaggccugggugc

SEQ ID NO: 2230892 - RNA, 17 nt, Human
cauauuaccacagacau

SEQ ID NO: 2230893 - RNA, 21 nt, Human
cauauuaccacagacauacua

SEQ ID NO: 2230894 - RNA, 20 nt, Human
cauauuaccacagacauacu

SEQ ID NO: 2230895 - RNA, 20 nt, Human
caguuuaaccugaugcaguc

SEQ ID NO: 2230896 - RNA, 18 nt, Human
caguuuaaaaaaauuggu

SEQ ID NO: 2230897 - RNA, 16 nt, Human
caguuuaaaaaaauug

SEQ ID NO: 2230898 - RNA, 13 nt, Human
caguuguuuuccc

SEQ ID NO: 2230899 - RNA, 14 nt, Human
caguuguuuucccg

SEQ ID NO: 2230900 - RNA, 13 nt, Human
caguuguuugaug

SEQ ID NO: 2230901 - RNA, 20 nt, Human
caguuguuggccuccggccu

SEQ ID NO: 2230902 - RNA, 15 nt, Human
caguuguuggccucc

SEQ ID NO: 2230903 - RNA, 14 nt, Human
caguuguuggccuc

SEQ ID NO: 2230904 - RNA, 23 nt, Human
cauaaucuggacuccucugucca

SEQ ID NO: 2230905 - RNA, 15 nt, Human
cauaaucuucugccu

SEQ ID NO: 2230906 - RNA, 13 nt, Human
cauaaucuucugc

SEQ ID NO: 2230907 - RNA, 22 nt, Human
cauaaucuucugccuucucaug

SEQ ID NO: 2230908 - RNA, 21 nt, Human
cauaaucuucugccuucucau

SEQ ID NO: 2230909 - RNA, 18 nt, Human
cauaaucuguacaaugaa

SEQ ID NO: 2230910 - RNA, 17 nt, Human
cauaaugcgugcauacc

SEQ ID NO: 2230911 - RNA, 14 nt, Human
cauaaugcgugcau

SEQ ID NO: 2230912 - RNA, 21 nt, Human
cauaaucuggacuccucuguc

SEQ ID NO: 2230913 - RNA, 22 nt, Human
cauaaucuggacuccucugucc

SEQ ID NO: 2230914 - RNA, 20 nt, Human
cauaaucuggacuccucugu

SEQ ID NO: 2230915 - RNA, 21 nt, Human
caguuugugugucuuaauuau

SEQ ID NO: 2230916 - RNA, 23 nt, Human
caguuugugugucuuaauuauua

SEQ ID NO: 2230917 - RNA, 13 nt, Human
caguuugucagac

SEQ ID NO: 2230918 - RNA, 14 nt, Human
caguuuguauauac

SEQ ID NO: 2230919 - RNA, 16 nt, Human
caguuugucacaugaa

SEQ ID NO: 2230920 - RNA, 15 nt, Human
caguuugugugucuu

SEQ ID NO: 2230921 - RNA, 16 nt, Human
caguuugugugucuua

SEQ ID NO: 2230922 - RNA, 19 nt, Human
cauaaucuggacuccucug

SEQ ID NO: 2230923 - RNA, 21 nt, Human
caguuuguacagacguaugcu

SEQ ID NO: 2230924 - RNA, 13 nt, Human
caguuuguauaua

SEQ ID NO: 2230925 - RNA, 17 nt, Human
caguuuggcaaacucuc

SEQ ID NO: 2230926 - RNA, 12 nt, Human
caguuugcuuug

SEQ ID NO: 2230927 - RNA, 12 nt, Human
caguuugcugua

SEQ ID NO: 2230928 - RNA, 19 nt, Human
caguuugcuguacuagaga

SEQ ID NO: 2230929 - RNA, 14 nt, Human
caguuugcuuugua

SEQ ID NO: 2230930 - RNA, 21 nt, Human
caguuugcuuuguaugcacuu

SEQ ID NO: 2230931 - RNA, 23 nt, Human
caguuugcagaaaagcaccugcc

SEQ ID NO: 2230932 - RNA, 22 nt, Human
caguuugcagaaaagcaccugc

SEQ ID NO: 2230933 - RNA, 21 nt, Human
caguuugcagaaaagcaccug

SEQ ID NO: 2230934 - RNA, 13 nt, Human
caguuuaucauuc

SEQ ID NO: 2230935 - RNA, 16 nt, Human
caguuuaauccuucua

SEQ ID NO: 2230936 - RNA, 21 nt, Human
caguuuaauccuucuaguuuc

SEQ ID NO: 2230937 - RNA, 18 nt, Human
cagucaccccggccaccu

SEQ ID NO: 2230938 - RNA, 17 nt, Human
caguauuuuggagaaau

SEQ ID NO: 2230939 - RNA, 18 nt, Human
caguauuuuggagaaauu

SEQ ID NO: 2230940 - RNA, 12 nt, Human
cauccuucugcc

SEQ ID NO: 2230941 - RNA, 15 nt, Human
cauccuucugccuuu

SEQ ID NO: 2230942 - RNA, 14 nt, Human
cauccuugagucaa

SEQ ID NO: 2230943 - RNA, 17 nt, Human
cauccuuuucugcagag

SEQ ID NO: 2230944 - RNA, 16 nt, Human
cauccuuugcacuguc

SEQ ID NO: 2230945 - RNA, 14 nt, Human
cauccuuuccagca

SEQ ID NO: 2230946 - RNA, 16 nt, Human
cauccuuucugccucu

SEQ ID NO: 2230947 - RNA, 18 nt, Human
cauccuuucugccucuca

SEQ ID NO: 2230948 - RNA, 19 nt, Human
cauccuuucugccucucaa

SEQ ID NO: 2230949 - RNA, 19 nt, Human
cauccuuuucugcagaggg

SEQ ID NO: 2230950 - RNA, 21 nt, Human
caucgaaucuacuaauuccac

SEQ ID NO: 2230951 - RNA, 12 nt, Human
caucgcaaugua

SEQ ID NO: 2230952 - RNA, 17 nt, Human
caucugucccugccuca

SEQ ID NO: 2230953 - RNA, 18 nt, Human
cauccccauccuccagcu

SEQ ID NO: 2230954 - RNA, 20 nt, Human
caucugucccuccgggaccu

SEQ ID NO: 2230955 - RNA, 12 nt, Human
caucuguccuca

SEQ ID NO: 2230956 - RNA, 18 nt, Human
caucugucccuccgggac

SEQ ID NO: 2230957 - RNA, 17 nt, Human
caucugucccuccggga

SEQ ID NO: 2230958 - RNA, 16 nt, Human
caucugucccuccggg

SEQ ID NO: 2230959 - RNA, 13 nt, Human
caucgaaugugua

SEQ ID NO: 2230960 - RNA, 15 nt, Human
caucgaauguguaca

SEQ ID NO: 2230961 - RNA, 18 nt, Human
caucugugaaaggaaaga

SEQ ID NO: 2230962 - RNA, 19 nt, Human
caucugugaaaggaaagag

SEQ ID NO: 2230963 - RNA, 19 nt, Human
caucuuaguauuugcauau

SEQ ID NO: 2230964 - RNA, 23 nt, Human
caucuuagagcaaagagccagca

SEQ ID NO: 2230965 - RNA, 22 nt, Human
caucuuacuguaccuguuccuu

SEQ ID NO: 2230966 - RNA, 15 nt, Human
caucuuacugaaggu

SEQ ID NO: 2230967 - RNA, 14 nt, Human
caucuuacugaagg

SEQ ID NO: 2230968 - RNA, 22 nt, Human
caucuuagguuggcaaaaaggc

SEQ ID NO: 2230969 - RNA, 21 nt, Human
caucuuagguuggcaaaaagg

SEQ ID NO: 2230970 - RNA, 13 nt, Human
caucuuacugaag

SEQ ID NO: 2230971 - RNA, 15 nt, Human
caucuuaagagaugc

SEQ ID NO: 2230972 - RNA, 13 nt, Human
caucugugaauaa

SEQ ID NO: 2230973 - RNA, 11 nt, Human
caucugugaau

SEQ ID NO: 2230974 - RNA, 17 nt, Human
caucagagcaaauuugg

SEQ ID NO: 2230975 - RNA, 16 nt, Human
caucagagcaaauuug

SEQ ID NO: 2230976 - RNA, 19 nt, Human
caucagcuguaagaagaga

SEQ ID NO: 2230977 - RNA, 17 nt, Human
caucagcuguaagaaga

SEQ ID NO: 2230978 - RNA, 20 nt, Human
caucagcuugcccuguuaaa

SEQ ID NO: 2230979 - RNA, 23 nt, Human
caucagcuuaggggcugcugacc

SEQ ID NO: 2230980 - RNA, 23 nt, Human
caucagcuguaagaagagacugg

SEQ ID NO: 2230981 - RNA, 13 nt, Human
caucaggacucuu

SEQ ID NO: 2230982 - RNA, 15 nt, Human
caucaggacucuugu

SEQ ID NO: 2230983 - RNA, 19 nt, Human
caucaggagaaaaagccuc

SEQ ID NO: 2230984 - RNA, 22 nt, Human
caucaggagaaaaagccuccag

SEQ ID NO: 2230985 - RNA, 13 nt, Human
caucaggaugaac

SEQ ID NO: 2230986 - RNA, 13 nt, Human
caucaggccaggc

SEQ ID NO: 2230987 - RNA, 15 nt, Human
caucagcugcugaaa

SEQ ID NO: 2230988 - RNA, 18 nt, Human
caucagcugcugaaacaa

SEQ ID NO: 2230989 - RNA, 17 nt, Human
caucagcugcugaaaca

SEQ ID NO: 2230990 - RNA, 15 nt, Human
caucagaaggagaag

SEQ ID NO: 2230991 - RNA, 23 nt, Human
caucagaaggagaaggaaggaga

SEQ ID NO: 2230992 - RNA, 14 nt, Human
caucagacagaugg

SEQ ID NO: 2230993 - RNA, 18 nt, Human
caucagcacgauuucugu

SEQ ID NO: 2230994 - RNA, 17 nt, Human
caucagcacgauuucug

SEQ ID NO: 2230995 - RNA, 23 nt, Human
cauccuggcacccggccccugcu

SEQ ID NO: 2230996 - RNA, 14 nt, Human
cauccccacucacg

SEQ ID NO: 2230997 - RNA, 15 nt, Human
cauccccauccucca

SEQ ID NO: 2230998 - RNA, 16 nt, Human
cauccccauccuccag

SEQ ID NO: 2230999 - RNA, 17 nt, Human
cauccccauccuccagc

SEQ ID NO: 2231000 - RNA, 12 nt, Human
cauccuggccca

SEQ ID NO: 2231001 - RNA, 11 nt, Human
cauccuggccc

SEQ ID NO: 2231002 - RNA, 13 nt, Human
cauccuggcccau

SEQ ID NO: 2231003 - RNA, 14 nt, Human
cauccuggcccauc

SEQ ID NO: 2231004 - RNA, 18 nt, Human
cauccuggccuggcacau

SEQ ID NO: 2231005 - RNA, 21 nt, Human
cauccuggccuggcacaucag

SEQ ID NO: 2231006 - RNA, 15 nt, Human
cauccugucccacca

SEQ ID NO: 2231007 - RNA, 18 nt, Human
cauccugucccaccaugc

SEQ ID NO: 2231008 - RNA, 20 nt, Human
cauccugucccaccaugcag

SEQ ID NO: 2231009 - RNA, 12 nt, Human
cauccugugaag

SEQ ID NO: 2231010 - RNA, 15 nt, Human
cauccuggcccauca

SEQ ID NO: 2231011 - RNA, 16 nt, Human
cauccuggcccaucag

SEQ ID NO: 2231012 - RNA, 19 nt, Human
cauccuggcccaucagugu

SEQ ID NO: 2231013 - RNA, 14 nt, Human
cauccuggccuggc

SEQ ID NO: 2231014 - RNA, 23 nt, Human
cauccuggccuggcacaucagaa

SEQ ID NO: 2231015 - RNA, 17 nt, Human
caucaggaugaacccag

SEQ ID NO: 2231016 - RNA, 19 nt, Human
caucaggaugaacccagga

SEQ ID NO: 2231017 - RNA, 17 nt, Human
caucccaugaacacacu

SEQ ID NO: 2231018 - RNA, 18 nt, Human
caucccaugauguagugc

SEQ ID NO: 2231019 - RNA, 12 nt, Human
caucccauugcc

SEQ ID NO: 2231020 - RNA, 19 nt, Human
caucccauguaacagaaag

SEQ ID NO: 2231021 - RNA, 15 nt, Human
caucccauguauuua

SEQ ID NO: 2231022 - RNA, 16 nt, Human
caucccauguaacaga

SEQ ID NO: 2231023 - RNA, 20 nt, Human
caucccaugauguagugccu

SEQ ID NO: 2231024 - RNA, 17 nt, Human
caucccauguaacagaa

SEQ ID NO: 2231025 - RNA, 21 nt, Human
cauccccaggggucccagcca

SEQ ID NO: 2231026 - RNA, 18 nt, Human
cauccccaggggucccag

SEQ ID NO: 2231027 - RNA, 12 nt, Human
cauccccagggg

SEQ ID NO: 2231028 - RNA, 11 nt, Human
cauccccaggg

SEQ ID NO: 2231029 - RNA, 17 nt, Human
caucccauugcccuggu

SEQ ID NO: 2231030 - RNA, 15 nt, Human
caucccauugcccug

SEQ ID NO: 2231031 - RNA, 13 nt, Human
caucccauugccc

SEQ ID NO: 2231032 - RNA, 16 nt, Human
cauccccacccuugga

SEQ ID NO: 2231033 - RNA, 16 nt, Human
caucccauugcccugg

SEQ ID NO: 2231034 - RNA, 17 nt, Human
caucccagccccaauga

SEQ ID NO: 2231035 - RNA, 16 nt, Human
caucccagccccaaug

SEQ ID NO: 2231036 - RNA, 13 nt, Human
caucccagcccca

SEQ ID NO: 2231037 - RNA, 14 nt, Human
caucccagccccaa

SEQ ID NO: 2231038 - RNA, 14 nt, Human
caucaggccaggcc

SEQ ID NO: 2231039 - RNA, 20 nt, Human
caucaggccaggcccucugc

SEQ ID NO: 2231040 - RNA, 21 nt, Human
caucaggccaggcccucugcc

SEQ ID NO: 2231041 - RNA, 22 nt, Human
caucaggccaggcccucugccc

SEQ ID NO: 2231042 - RNA, 23 nt, Human
caucaggccaggcccucugccca

SEQ ID NO: 2231043 - RNA, 13 nt, Human
caugacauuucuu

SEQ ID NO: 2231044 - RNA, 17 nt, Human
caugaccacauagcaug

SEQ ID NO: 2231045 - RNA, 17 nt, Human
caugacauguuauauau

SEQ ID NO: 2231046 - RNA, 19 nt, Human
caugacauguuauauauuu

SEQ ID NO: 2231047 - RNA, 23 nt, Human
caugacauuccuaaacuaucuuu

SEQ ID NO: 2231048 - RNA, 20 nt, Human
caugacaagccccaggcagg

SEQ ID NO: 2231049 - RNA, 12 nt, Human
caugacacagcu

SEQ ID NO: 2231050 - RNA, 22 nt, Human
caugacacagcuuuaucaccag

SEQ ID NO: 2231051 - RNA, 16 nt, Human
caugacauguuauaua

SEQ ID NO: 2231052 - RNA, 23 nt, Human
caugacacagcuuuaucaccaga

SEQ ID NO: 2231053 - RNA, 17 nt, Human
caugacacgaauauugc

SEQ ID NO: 2231054 - RNA, 18 nt, Human
caugacacgaauauugcu

SEQ ID NO: 2231055 - RNA, 12 nt, Human
caugauuagcaa

SEQ ID NO: 2231056 - RNA, 18 nt, Human
caugaccuaguuuuccau

SEQ ID NO: 2231057 - RNA, 19 nt, Human
caugacccaggcugggcaa

SEQ ID NO: 2231058 - RNA, 14 nt, Human
caugauucauuuua

SEQ ID NO: 2231059 - RNA, 13 nt, Human
caugauucauuuu

SEQ ID NO: 2231060 - RNA, 21 nt, Human
caugauucaugccaauuagca

SEQ ID NO: 2231061 - RNA, 16 nt, Human
caugauucaugccaau

SEQ ID NO: 2231062 - RNA, 18 nt, Human
caugaccauacugaggga

SEQ ID NO: 2231063 - RNA, 12 nt, Human
caugacccaccc

SEQ ID NO: 2231064 - RNA, 13 nt, Human
caugacccacccc

SEQ ID NO: 2231065 - RNA, 14 nt, Human
caugacccaccccu

SEQ ID NO: 2231066 - RNA, 15 nt, Human
caugacccaccccug

SEQ ID NO: 2231067 - RNA, 16 nt, Human
caugacccaccccugu

SEQ ID NO: 2231068 - RNA, 17 nt, Human
caugacccaccccugug

SEQ ID NO: 2231069 - RNA, 18 nt, Human
caugacccaccccugugc

SEQ ID NO: 2231070 - RNA, 19 nt, Human
caugacccaccccugugcu

SEQ ID NO: 2231071 - RNA, 13 nt, Human
caugacccaggcu

SEQ ID NO: 2231072 - RNA, 15 nt, Human
caugacccaggcugg

SEQ ID NO: 2231073 - RNA, 16 nt, Human
caugacccaggcuggg

SEQ ID NO: 2231074 - RNA, 17 nt, Human
caugacccaggcugggc

SEQ ID NO: 2231075 - RNA, 18 nt, Human
caugaauguaucaggaaa

SEQ ID NO: 2231076 - RNA, 17 nt, Human
caugaauguaucaggaa

SEQ ID NO: 2231077 - RNA, 13 nt, Human
caugaauguauca

SEQ ID NO: 2231078 - RNA, 18 nt, Human
caugaauucuuaugcuua

SEQ ID NO: 2231079 - RNA, 14 nt, Human
caugaauuugugaa

SEQ ID NO: 2231080 - RNA, 14 nt, Human
caugacacgaauau

SEQ ID NO: 2231081 - RNA, 19 nt, Human
caugacaagccccaggcag

SEQ ID NO: 2231082 - RNA, 20 nt, Human
caugaauucuuaugcuuaua

SEQ ID NO: 2231083 - RNA, 16 nt, Human
caugaauuaguuuuau

SEQ ID NO: 2231084 - RNA, 14 nt, Human
caugcugccuccag

SEQ ID NO: 2231085 - RNA, 19 nt, Human
caugcugcuggacaguauc

SEQ ID NO: 2231086 - RNA, 20 nt, Human
caugcugagucucccaaggc

SEQ ID NO: 2231087 - RNA, 12 nt, Human
caugcugccucc

SEQ ID NO: 2231088 - RNA, 22 nt, Human
cauggccuuugcuugaaagaaa

SEQ ID NO: 2231089 - RNA, 19 nt, Human
cauggccuuugcuugaaag

SEQ ID NO: 2231090 - RNA, 16 nt, Human
caugcugcccugugag

SEQ ID NO: 2231091 - RNA, 18 nt, Human
caugcugcccugugagua

SEQ ID NO: 2231092 - RNA, 21 nt, Human
caugcugagucucccaaggcu

SEQ ID NO: 2231093 - RNA, 21 nt, Human
caugauucgcccaaagccaga

SEQ ID NO: 2231094 - RNA, 14 nt, Human
caugauucuauuua

SEQ ID NO: 2231095 - RNA, 19 nt, Human
caugauuccuuccuguucu

SEQ ID NO: 2231096 - RNA, 16 nt, Human
caugauuccuuccugu

SEQ ID NO: 2231097 - RNA, 14 nt, Human
caugauuccuuccu

SEQ ID NO: 2231098 - RNA, 18 nt, Human
caugauucauuuuaacau

SEQ ID NO: 2231099 - RNA, 18 nt, Human
caugcaaggucauuuuuu

SEQ ID NO: 2231100 - RNA, 17 nt, Human
caugcaaggucauuuuu

SEQ ID NO: 2231101 - RNA, 16 nt, Human
caugcaaugacaucuu

SEQ ID NO: 2231102 - RNA, 15 nt, Human
caugcugaggccugg

SEQ ID NO: 2231103 - RNA, 16 nt, Human
caugcugaggccuggg

SEQ ID NO: 2231104 - RNA, 17 nt, Human
caugcugaggccugggc

SEQ ID NO: 2231105 - RNA, 18 nt, Human
caugcugaggccugggcc

SEQ ID NO: 2231106 - RNA, 19 nt, Human
caugcugaggccugggccg

SEQ ID NO: 2231107 - RNA, 14 nt, Human
caugcugagucucc

SEQ ID NO: 2231108 - RNA, 15 nt, Human
caugcugagucuccc

SEQ ID NO: 2231109 - RNA, 17 nt, Human
caugcugagucucccaa

SEQ ID NO: 2231110 - RNA, 19 nt, Human
caugcugagucucccaagg

SEQ ID NO: 2231111 - RNA, 22 nt, Human
caugcaaggucauuuuuuuuaa

SEQ ID NO: 2231112 - RNA, 23 nt, Human
cauugggaaggggacccccgccc

SEQ ID NO: 2231113 - RNA, 19 nt, Human
cauugggcagcgcccuucc

SEQ ID NO: 2231114 - RNA, 20 nt, Human
cauugggcagcgcccuuccu

SEQ ID NO: 2231115 - RNA, 22 nt, Human
cauugggcagcgcccuuccucu

SEQ ID NO: 2231116 - RNA, 23 nt, Human
cauugggcagcgcccuuccucuc

SEQ ID NO: 2231117 - RNA, 16 nt, Human
cauuuauucugcucac

SEQ ID NO: 2231118 - RNA, 22 nt, Human
cauuggcucuugaacugagcuu

SEQ ID NO: 2231119 - RNA, 14 nt, Human
cauuggcuauuuaa

SEQ ID NO: 2231120 - RNA, 18 nt, Human
cauuggcuauuuaaaacu

SEQ ID NO: 2231121 - RNA, 13 nt, Human
cauuggcuuuauc

SEQ ID NO: 2231122 - RNA, 22 nt, Human
cauuggcuuuauccucuuuaga

SEQ ID NO: 2231123 - RNA, 19 nt, Human
cauuggcuauuuaaaacuu

SEQ ID NO: 2231124 - RNA, 24 nt, Human
cauuggcagcaggugcugcuaccc

SEQ ID NO: 2231125 - RNA, 15 nt, Human
cauuggcugagagac

SEQ ID NO: 2231126 - RNA, 15 nt, Human
cauugcugguucuau

SEQ ID NO: 2231127 - RNA, 21 nt, Human
cauugcugguucuauuuaaug

SEQ ID NO: 2231128 - RNA, 22 nt, Human
cauugcugugaauuagcucacu

SEQ ID NO: 2231129 - RNA, 20 nt, Human
cauuggcaccuaauccaggc

SEQ ID NO: 2231130 - RNA, 21 nt, Human
cauugcuguugucccucugcu

SEQ ID NO: 2231131 - RNA, 17 nt, Human
cauugcuuacacggaug

SEQ ID NO: 2231132 - RNA, 21 nt, Human
cauuggcaccuaauccaggca

SEQ ID NO: 2231133 - RNA, 14 nt, Human
cauuggcagcaggu

SEQ ID NO: 2231134 - RNA, 16 nt, Human
cauuggcagcaggugc

SEQ ID NO: 2231135 - RNA, 17 nt, Human
cauuggcagcaggugcu

SEQ ID NO: 2231136 - RNA, 20 nt, Human
cauuggcagcaggugcugcu

SEQ ID NO: 2231137 - RNA, 21 nt, Human
cauuggcagcaggugcugcua

SEQ ID NO: 2231138 - RNA, 23 nt, Human
cauuggcagcaggugcugcuacc

SEQ ID NO: 2231139 - RNA, 17 nt, Human
cauuuauuuuuuacauu

SEQ ID NO: 2231140 - RNA, 19 nt, Human
cauuuauuuuuuacauuau

SEQ ID NO: 2231141 - RNA, 18 nt, Human
cauuuauuuuucucauga

SEQ ID NO: 2231142 - RNA, 13 nt, Human
cauuuauuuguga

SEQ ID NO: 2231143 - RNA, 13 nt, Human
cauuucaccccuc

SEQ ID NO: 2231144 - RNA, 14 nt, Human
cauuucaccccucc

SEQ ID NO: 2231145 - RNA, 15 nt, Human
cauuucaccccuccc

SEQ ID NO: 2231146 - RNA, 16 nt, Human
cauuucaccccucccu

SEQ ID NO: 2231147 - RNA, 15 nt, Human
cauuucaacuguuug

SEQ ID NO: 2231148 - RNA, 16 nt, Human
cauuucaauucucaaa

SEQ ID NO: 2231149 - RNA, 13 nt, Human
cauuucauuguau

SEQ ID NO: 2231150 - RNA, 16 nt, Human
cauuucauuguaugau

SEQ ID NO: 2231151 - RNA, 18 nt, Human
cauuucauuugugccaga

SEQ ID NO: 2231152 - RNA, 14 nt, Human
cauuucauuuccua

SEQ ID NO: 2231153 - RNA, 18 nt, Human
cauuucauuguaugaugu

SEQ ID NO: 2231154 - RNA, 20 nt, Human
cauuucauuguaugaugugu

SEQ ID NO: 2231155 - RNA, 18 nt, Human
cauuucaaaugugcuguc

SEQ ID NO: 2231156 - RNA, 23 nt, Human
cauuucaccccucccuuucuccc

SEQ ID NO: 2231157 - RNA, 21 nt, Human
cauuucaccccucccuuucuc

SEQ ID NO: 2231158 - RNA, 22 nt, Human
cauuucaccccucccuuucucc

SEQ ID NO: 2231159 - RNA, 17 nt, Human
cauuucaccccucccuu

SEQ ID NO: 2231160 - RNA, 18 nt, Human
cauuucaccccucccuuu

SEQ ID NO: 2231161 - RNA, 19 nt, Human
cauuucaccccucccuuuc

SEQ ID NO: 2231162 - RNA, 20 nt, Human
cauuucaccccucccuuucu

SEQ ID NO: 2231163 - RNA, 17 nt, Human
cauuuccaaauucacaa

SEQ ID NO: 2231164 - RNA, 23 nt, Human
cauuucauuguaugauguguugu

SEQ ID NO: 2231165 - RNA, 17 nt, Human
cauuuccaaaugaauga

SEQ ID NO: 2231166 - RNA, 21 nt, Human
cauuuccaaaugaaugaccuu

SEQ ID NO: 2231167 - RNA, 13 nt, Human
cauuuccaacacc

SEQ ID NO: 2231168 - RNA, 18 nt, Human
cauuuccaacaccacaga

SEQ ID NO: 2231169 - RNA, 19 nt, Human
cauuuccaacaccacagac

SEQ ID NO: 2231170 - RNA, 12 nt, Human
cauuuccaagca

SEQ ID NO: 2231171 - RNA, 23 nt, Human
cauuuggugguuucagaaaugug

SEQ ID NO: 2231172 - RNA, 22 nt, Human
cauuuggugguuucagaaaugu

SEQ ID NO: 2231173 - RNA, 18 nt, Human
cauuuuugaauacaggca

SEQ ID NO: 2231174 - RNA, 20 nt, Human
cauuuuugaauacaggcaua

SEQ ID NO: 2231175 - RNA, 22 nt, Human
cauuuccaacaccacagacaca

SEQ ID NO: 2231176 - RNA, 17 nt, Human
cauuuuugauuuaugca

SEQ ID NO: 2231177 - RNA, 12 nt, Human
cauuuuuguaca

SEQ ID NO: 2231178 - RNA, 13 nt, Human
cauuuuuguacag

SEQ ID NO: 2231179 - RNA, 14 nt, Human
cauuuuuguacagu

SEQ ID NO: 2231180 - RNA, 20 nt, Human
cauuuuuguacaguuugcug

SEQ ID NO: 2231181 - RNA, 21 nt, Human
cauuuuuguacaguuugcugu

SEQ ID NO: 2231182 - RNA, 23 nt, Human
cauuuuucuuagggaaggauaca

SEQ ID NO: 2231183 - RNA, 21 nt, Human
cauuugguucauuaauucuau

SEQ ID NO: 2231184 - RNA, 20 nt, Human
cauuugguucauuaauucua

SEQ ID NO: 2231185 - RNA, 16 nt, Human
cauuugguucauuaau

SEQ ID NO: 2231186 - RNA, 20 nt, Human
cauuuccaacaccacagaca

SEQ ID NO: 2231187 - RNA, 21 nt, Human
cauuuccaacaccacagacac

SEQ ID NO: 2231188 - RNA, 12 nt, Human
ccaaaacaaaca

SEQ ID NO: 2231189 - RNA, 19 nt, Human
ccaaaaagauuuucagaaa

SEQ ID NO: 2231190 - RNA, 15 nt, Human
ccaaaaccacagccc

SEQ ID NO: 2231191 - RNA, 18 nt, Human
ccaaaacaaacaaacaga

SEQ ID NO: 2231192 - RNA, 17 nt, Human
ccaaaacucuccucugc

SEQ ID NO: 2231193 - RNA, 15 nt, Human
ccaaaaagaccagac

SEQ ID NO: 2231194 - RNA, 16 nt, Human
ccaaaaagaccagacu

SEQ ID NO: 2231195 - RNA, 17 nt, Human
ccaaaaagaccagacua

SEQ ID NO: 2231196 - RNA, 22 nt, Human
ccaaaaaauucuacaacacaca

SEQ ID NO: 2231197 - RNA, 20 nt, Human
ccaaaaaauucuacaacaca

SEQ ID NO: 2231198 - RNA, 17 nt, Human
ccaaaaaaugcuugcuu

SEQ ID NO: 2231199 - RNA, 20 nt, Human
cauuuuuguauuuuguuuaa

SEQ ID NO: 2231200 - RNA, 22 nt, Human
cauuuuuguuucuaccucccag

SEQ ID NO: 2231201 - RNA, 23 nt, Human
cauuuuuguuucuaccucccaga

SEQ ID NO: 2231202 - RNA, 13 nt, Human
cauuuuuguauuu

SEQ ID NO: 2231203 - RNA, 22 nt, Human
cauuuuuguacaguuugcugua

SEQ ID NO: 2231204 - RNA, 13 nt, Human
cauugccuuuucu

SEQ ID NO: 2231205 - RNA, 21 nt, Human
cauugccuuaacuggagcccc

SEQ ID NO: 2231206 - RNA, 21 nt, Human
cauugcgcucuagccugggca

SEQ ID NO: 2231207 - RNA, 15 nt, Human
cauugcuaagaugcu

SEQ ID NO: 2231208 - RNA, 23 nt, Human
cauugcguuugaccuuuuaugua

SEQ ID NO: 2231209 - RNA, 15 nt, Human
cauugcugagccucu

SEQ ID NO: 2231210 - RNA, 14 nt, Human
cauugcugagccuc

SEQ ID NO: 2231211 - RNA, 16 nt, Human
cauugcuaagaugcuc

SEQ ID NO: 2231212 - RNA, 16 nt, Human
cauugcugaaaauggu

SEQ ID NO: 2231213 - RNA, 22 nt, Human
cauugcugaaaaugguauuuuc

SEQ ID NO: 2231214 - RNA, 18 nt, Human
cauugcugggcuugucug

SEQ ID NO: 2231215 - RNA, 21 nt, Human
cauugcugagccucugcuccc

SEQ ID NO: 2231216 - RNA, 18 nt, Human
cauugcugagccucugcu

SEQ ID NO: 2231217 - RNA, 17 nt, Human
cauugcugagccucugc

SEQ ID NO: 2231218 - RNA, 16 nt, Human
cauugcugagccucug

SEQ ID NO: 2231219 - RNA, 14 nt, Human
cauugcggacagcc

SEQ ID NO: 2231220 - RNA, 15 nt, Human
cauugcggacagcca

SEQ ID NO: 2231221 - RNA, 17 nt, Human
cauugcggacagccacg

SEQ ID NO: 2231222 - RNA, 21 nt, Human
cauugcggacagccacggcca

SEQ ID NO: 2231223 - RNA, 17 nt, Human
cauugccuuaacuggag

SEQ ID NO: 2231224 - RNA, 15 nt, Human
cauucucccagguac

SEQ ID NO: 2231225 - RNA, 23 nt, Human
cauucucccagguaccagcugcg

SEQ ID NO: 2231226 - RNA, 12 nt, Human
cauucucccagg

SEQ ID NO: 2231227 - RNA, 19 nt, Human
cauucucauggagaaguua

SEQ ID NO: 2231228 - RNA, 16 nt, Human
cauucuccuuguguua

SEQ ID NO: 2231229 - RNA, 22 nt, Human
cauucuccugccuguagcagug

SEQ ID NO: 2231230 - RNA, 23 nt, Human
cauucuccugccuguagcaguga

SEQ ID NO: 2231231 - RNA, 21 nt, Human
cauucucccagguaccagcug

SEQ ID NO: 2231232 - RNA, 11 nt, Human
cauucuccugc

SEQ ID NO: 2231233 - RNA, 13 nt, Human
cauucuccugccu

SEQ ID NO: 2231234 - RNA, 15 nt, Human
cauucuccugccugu

SEQ ID NO: 2231235 - RNA, 15 nt, Human
cauucucauggagaa

SEQ ID NO: 2231236 - RNA, 16 nt, Human
cauucucauggagaag

SEQ ID NO: 2231237 - RNA, 17 nt, Human
cauucucacuccuaccu

SEQ ID NO: 2231238 - RNA, 16 nt, Human
cauucucacuccuacc

SEQ ID NO: 2231239 - RNA, 22 nt, Human
cauuaugaugugggucaaggaa

SEQ ID NO: 2231240 - RNA, 23 nt, Human
cauuaugaugugggucaaggaau

SEQ ID NO: 2231241 - RNA, 19 nt, Human
cauuaggacaaucaguccc

SEQ ID NO: 2231242 - RNA, 22 nt, Human
cauuaggacaaucaguccccuc

SEQ ID NO: 2231243 - RNA, 18 nt, Human
cauuaucuagauacugua

SEQ ID NO: 2231244 - RNA, 14 nt, Human
cauuaugauucuuu

SEQ ID NO: 2231245 - RNA, 17 nt, Human
cauuauguaaaauguuu

SEQ ID NO: 2231246 - RNA, 20 nt, Human
cauuauguaaaauguuuuag

SEQ ID NO: 2231247 - RNA, 17 nt, Human
cauuauguccacugugu

SEQ ID NO: 2231248 - RNA, 19 nt, Human
cauuauguccacuguguau

SEQ ID NO: 2231249 - RNA, 20 nt, Human
cauuauguccacuguguaua

SEQ ID NO: 2231250 - RNA, 21 nt, Human
cauuauguccacuguguauag

SEQ ID NO: 2231251 - RNA, 22 nt, Human
cauuauguccacuguguauaga

SEQ ID NO: 2231252 - RNA, 13 nt, Human
cauuaugauucuu

SEQ ID NO: 2231253 - RNA, 21 nt, Human
cauuaugaugugggucaagga

SEQ ID NO: 2231254 - RNA, 13 nt, Human
cauuaugaugugu

SEQ ID NO: 2231255 - RNA, 17 nt, Human
cauggcugccaauggga

SEQ ID NO: 2231256 - RNA, 22 nt, Human
cauggcugccaaugggagcuca

SEQ ID NO: 2231257 - RNA, 19 nt, Human
cauggcgugucccucucgg

SEQ ID NO: 2231258 - RNA, 14 nt, Human
cauggcgugucccu

SEQ ID NO: 2231259 - RNA, 16 nt, Human
cauggcuaacuggcga

SEQ ID NO: 2231260 - RNA, 14 nt, Human
cauggcuaacuggc

SEQ ID NO: 2231261 - RNA, 13 nt, Human
cauguuccucaaa

SEQ ID NO: 2231262 - RNA, 15 nt, Human
cauguuccacuaacc

SEQ ID NO: 2231263 - RNA, 16 nt, Human
cauguuccacuaaccc

SEQ ID NO: 2231264 - RNA, 21 nt, Human
cauguuccucaaaagcacccu

SEQ ID NO: 2231265 - RNA, 12 nt, Human
cauguuccuuca

SEQ ID NO: 2231266 - RNA, 13 nt, Human
cauguuccuucaa

SEQ ID NO: 2231267 - RNA, 20 nt, Human
cauguucacaccgcugcacu

SEQ ID NO: 2231268 - RNA, 22 nt, Human
cauguucacaccgcugcacuca

SEQ ID NO: 2231269 - RNA, 14 nt, Human
cauguuccaauaaa

SEQ ID NO: 2231270 - RNA, 16 nt, Human
cauguuccaauaaaca

SEQ ID NO: 2231271 - RNA, 17 nt, Human
cauguuccaauaaacag

SEQ ID NO: 2231272 - RNA, 19 nt, Human
cauguuccaauaaacagga

SEQ ID NO: 2231273 - RNA, 15 nt, Human
cauggcuuccuccuc

SEQ ID NO: 2231274 - RNA, 13 nt, Human
cauggcuuccucc

SEQ ID NO: 2231275 - RNA, 14 nt, Human
cauggcuuccuccu

SEQ ID NO: 2231276 - RNA, 18 nt, Human
cauggcuuaaugcuucuu

SEQ ID NO: 2231277 - RNA, 15 nt, Human
cauggcuuaauguuu

SEQ ID NO: 2231278 - RNA, 17 nt, Human
cauggcuuaauguuuau

SEQ ID NO: 2231279 - RNA, 20 nt, Human
cauggcuuaauguuuauucc

SEQ ID NO: 2231280 - RNA, 21 nt, Human
cauggcugggaacugcagacc

SEQ ID NO: 2231281 - RNA, 23 nt, Human
cauggcugggaacugcagaccug

SEQ ID NO: 2231282 - RNA, 24 nt, Human
cauggcugggaacugcagaccugu

SEQ ID NO: 2231283 - RNA, 14 nt, Human
cauggcugugagga

SEQ ID NO: 2231284 - RNA, 17 nt, Human
cauggcuuaaugcuucu

SEQ ID NO: 2231285 - RNA, 15 nt, Human
cauguucucugagga

SEQ ID NO: 2231286 - RNA, 18 nt, Human
cauuagcaguuugcuuug

SEQ ID NO: 2231287 - RNA, 14 nt, Human
cauguuccuucaag

SEQ ID NO: 2231288 - RNA, 16 nt, Human
cauguuccuucaagau

SEQ ID NO: 2231289 - RNA, 20 nt, Human
cauguuccuucaagaucaug

SEQ ID NO: 2231290 - RNA, 23 nt, Human
cauguuccuucaagaucauguac

SEQ ID NO: 2231291 - RNA, 9 nt, Human
cauuagccu

SEQ ID NO: 2231292 - RNA, 14 nt, Human
cauuagccugagua

SEQ ID NO: 2231293 - RNA, 17 nt, Human
cauuagccugaguagaa

SEQ ID NO: 2231294 - RNA, 18 nt, Human
cauuagccugaguagaaa

SEQ ID NO: 2231295 - RNA, 19 nt, Human
cauuagccugaguagaaag

SEQ ID NO: 2231296 - RNA, 23 nt, Human
cauuagccugaguagaaaggccu

SEQ ID NO: 2231297 - RNA, 21 nt, Human
cauuaggaauuaaguuaucuu

SEQ ID NO: 2231298 - RNA, 17 nt, Human
cauuaucuagauacugu

SEQ ID NO: 2231299 - RNA, 16 nt, Human
cauuaucuagauacug

SEQ ID NO: 2231300 - RNA, 12 nt, Human
cauuaucuagau

SEQ ID NO: 2231301 - RNA, 15 nt, Human
cauuaggauggcuag

SEQ ID NO: 2231302 - RNA, 13 nt, Human
ccacccugggacc

SEQ ID NO: 2231303 - RNA, 12 nt, Human
ccacccugggcc

SEQ ID NO: 2231304 - RNA, 12 nt, Human
ccacccugggac

SEQ ID NO: 2231305 - RNA, 10 nt, Human
ccacccuggg

SEQ ID NO: 2231306 - RNA, 11 nt, Human
ccacccuggaa

SEQ ID NO: 2231307 - RNA, 20 nt, Human
ccacccuggccgaguccaag

SEQ ID NO: 2231308 - RNA, 22 nt, Human
ccacccuggccgaguccaagcu

SEQ ID NO: 2231309 - RNA, 21 nt, Human
ccacccuggccgaguccaagc

SEQ ID NO: 2231310 - RNA, 14 nt, Human
ccaccgcagacagg

SEQ ID NO: 2231311 - RNA, 17 nt, Human
ccaccgcagacaggacc

SEQ ID NO: 2231312 - RNA, 20 nt, Human
ccaccaggcugcucagggcu

SEQ ID NO: 2231313 - RNA, 18 nt, Human
ccaccaucaccagacagg

SEQ ID NO: 2231314 - RNA, 20 nt, Human
ccaccaucaagccaccaaca

SEQ ID NO: 2231315 - RNA, 13 nt, Human
ccacccugcucuc

SEQ ID NO: 2231316 - RNA, 21 nt, Human
ccaccaggccaccuccccagc

SEQ ID NO: 2231317 - RNA, 22 nt, Human
ccaccgggcugggagcucugca

SEQ ID NO: 2231318 - RNA, 13 nt, Human
ccacccugggccc

SEQ ID NO: 2231319 - RNA, 18 nt, Human
ccaccgcagacaggacca

SEQ ID NO: 2231320 - RNA, 23 nt, Human
ccaccgggcugggagcucugcag

SEQ ID NO: 2231321 - RNA, 13 nt, Human
ccaccguccgccc

SEQ ID NO: 2231322 - RNA, 14 nt, Human
ccaccguccgcccu

SEQ ID NO: 2231323 - RNA, 15 nt, Human
ccaccguccgcccug

SEQ ID NO: 2231324 - RNA, 16 nt, Human
ccaccguccgcccugc

SEQ ID NO: 2231325 - RNA, 17 nt, Human
ccaccguccgcccugcu

SEQ ID NO: 2231326 - RNA, 23 nt, Human
ccaccuacuuuucuuuccucaga

SEQ ID NO: 2231327 - RNA, 13 nt, Human
ccaccuuggcuca

SEQ ID NO: 2231328 - RNA, 16 nt, Human
ccaccguggaggagga

SEQ ID NO: 2231329 - RNA, 17 nt, Human
ccaccuaaucaggcuga

SEQ ID NO: 2231330 - RNA, 18 nt, Human
ccaccguccgcccugcuc

SEQ ID NO: 2231331 - RNA, 19 nt, Human
ccaccguccgcccugcucc

SEQ ID NO: 2231332 - RNA, 20 nt, Human
ccaccguccgcccugcuccu

SEQ ID NO: 2231333 - RNA, 13 nt, Human
ccaccguggagga

SEQ ID NO: 2231334 - RNA, 14 nt, Human
ccaccuuggcucaa

SEQ ID NO: 2231335 - RNA, 15 nt, Human
ccaccuuggcucaag

SEQ ID NO: 2231336 - RNA, 23 nt, Human
ccaccagacugacaaauguguau

SEQ ID NO: 2231337 - RNA, 23 nt, Human
ccaccacuggccaccaggcuggc

SEQ ID NO: 2231338 - RNA, 17 nt, Human
ccaccagagaccguccu

SEQ ID NO: 2231339 - RNA, 20 nt, Human
ccaccagagaccguccucac

SEQ ID NO: 2231340 - RNA, 21 nt, Human
ccaccagagaccguccucacc

SEQ ID NO: 2231341 - RNA, 22 nt, Human
ccaccagagaccguccucaccc

SEQ ID NO: 2231342 - RNA, 12 nt, Human
ccaccagagcug

SEQ ID NO: 2231343 - RNA, 14 nt, Human
ccaccagccugcac

SEQ ID NO: 2231344 - RNA, 11 nt, Human
ccaccagccug

SEQ ID NO: 2231345 - RNA, 18 nt, Human
ccaccagaagcccagaau

SEQ ID NO: 2231346 - RNA, 16 nt, Human
ccaccagaagcccaga

SEQ ID NO: 2231347 - RNA, 15 nt, Human
ccaccagaagcccag

SEQ ID NO: 2231348 - RNA, 14 nt, Human
ccaccagaagccca

SEQ ID NO: 2231349 - RNA, 14 nt, Human
ccaccaggagaacc

SEQ ID NO: 2231350 - RNA, 13 nt, Human
ccaccaggagaac

SEQ ID NO: 2231351 - RNA, 16 nt, Human
ccaccaggaaccucuu

SEQ ID NO: 2231352 - RNA, 14 nt, Human
ccaccaggaaccuc

SEQ ID NO: 2231353 - RNA, 19 nt, Human
ccaccaggagaaccacuac

SEQ ID NO: 2231354 - RNA, 18 nt, Human
ccaccaggaaccucuuca

SEQ ID NO: 2231355 - RNA, 18 nt, Human
ccaccaggaucccagggg

SEQ ID NO: 2231356 - RNA, 13 nt, Human
ccaccaggccacc

SEQ ID NO: 2231357 - RNA, 19 nt, Human
ccaccaggccaccucccca

SEQ ID NO: 2231358 - RNA, 16 nt, Human
ccaccaucaagccacc

SEQ ID NO: 2231359 - RNA, 17 nt, Human
ccaccaucaagccacca

SEQ ID NO: 2231360 - RNA, 21 nt, Human
ccacacuuguuccagcucuuu

SEQ ID NO: 2231361 - RNA, 20 nt, Human
ccacacuuguuccagcucuu

SEQ ID NO: 2231362 - RNA, 17 nt, Human
ccacagaagccaggagc

SEQ ID NO: 2231363 - RNA, 17 nt, Human
ccacacuugagaggaug

SEQ ID NO: 2231364 - RNA, 13 nt, Human
ccaccagaagccc

SEQ ID NO: 2231365 - RNA, 12 nt, Human
ccaccagaagcc

SEQ ID NO: 2231366 - RNA, 11 nt, Human
ccaccagaagc

SEQ ID NO: 2231367 - RNA, 19 nt, Human
ccacacuugagaggaugaa

SEQ ID NO: 2231368 - RNA, 18 nt, Human
ccacagaagccaggagca

SEQ ID NO: 2231369 - RNA, 19 nt, Human
ccaccacuggccaccaggc

SEQ ID NO: 2231370 - RNA, 20 nt, Human
ccaccacuggccaccaggcu

SEQ ID NO: 2231371 - RNA, 21 nt, Human
ccaccacuggccaccaggcug

SEQ ID NO: 2231372 - RNA, 18 nt, Human
ccacacuuccuguccaga

SEQ ID NO: 2231373 - RNA, 16 nt, Human
ccacacuuccugucca

SEQ ID NO: 2231374 - RNA, 13 nt, Human
ccacacuuccugu

SEQ ID NO: 2231375 - RNA, 12 nt, Human
ccacacuuccug

SEQ ID NO: 2231376 - RNA, 21 nt, Human
ccacacuuccuguccagagag

SEQ ID NO: 2231377 - RNA, 20 nt, Human
ccacacuuccuguccagaga

SEQ ID NO: 2231378 - RNA, 22 nt, Human
ccacacuucaggcucuucuccu

SEQ ID NO: 2231379 - RNA, 13 nt, Human
ccaaugccaaaaa

SEQ ID NO: 2231380 - RNA, 17 nt, Human
ccaaugcaugcagccac

SEQ ID NO: 2231381 - RNA, 21 nt, Human
ccaaugcaugcagccacugug

SEQ ID NO: 2231382 - RNA, 23 nt, Human
ccaaugcaugcagccacugugcu

SEQ ID NO: 2231383 - RNA, 20 nt, Human
ccaauguucucucuucucca

SEQ ID NO: 2231384 - RNA, 15 nt, Human
ccaauuaaccagaaa

SEQ ID NO: 2231385 - RNA, 18 nt, Human
ccaauuaaggauuuuaug

SEQ ID NO: 2231386 - RNA, 13 nt, Human
ccaauuaaggauu

SEQ ID NO: 2231387 - RNA, 23 nt, Human
ccaauuaggaaguguaacagcug

SEQ ID NO: 2231388 - RNA, 17 nt, Human
ccaauuaggaaguguaa

SEQ ID NO: 2231389 - RNA, 22 nt, Human
ccaauuaaggauuuuaugcuuu

SEQ ID NO: 2231390 - RNA, 22 nt, Human
ccaauuauaugagacguuuuug

SEQ ID NO: 2231391 - RNA, 17 nt, Human
ccaagcuuccuuuguuu

SEQ ID NO: 2231392 - RNA, 22 nt, Human
ccaagcugugccacccugggcu

SEQ ID NO: 2231393 - RNA, 18 nt, Human
ccaagcuguuuucuucua

SEQ ID NO: 2231394 - RNA, 17 nt, Human
ccaagcuguuuucuucu

SEQ ID NO: 2231395 - RNA, 14 nt, Human
ccaagcuguuuucu

SEQ ID NO: 2231396 - RNA, 16 nt, Human
ccaagcugugccaccc

SEQ ID NO: 2231397 - RNA, 17 nt, Human
ccaagcugugccacccu

SEQ ID NO: 2231398 - RNA, 18 nt, Human
ccaagcugugccacccug

SEQ ID NO: 2231399 - RNA, 21 nt, Human
ccaagcugugccacccugggc

SEQ ID NO: 2231400 - RNA, 20 nt, Human
ccaagcuggucccacucagu

SEQ ID NO: 2231401 - RNA, 13 nt, Human
ccaagcugugcca

SEQ ID NO: 2231402 - RNA, 22 nt, Human
ccaacuuuguggaugucuuccu

SEQ ID NO: 2231403 - RNA, 14 nt, Human
ccaagcugugccac

SEQ ID NO: 2231404 - RNA, 15 nt, Human
ccaagcugugccacc

SEQ ID NO: 2231405 - RNA, 13 nt, Human
ccaacuuucugua

SEQ ID NO: 2231406 - RNA, 14 nt, Human
ccaacuuucuguaa

SEQ ID NO: 2231407 - RNA, 17 nt, Human
ccaacuuucuguaaacu

SEQ ID NO: 2231408 - RNA, 23 nt, Human
ccaagcuuguccaacccgaggcc

SEQ ID NO: 2231409 - RNA, 17 nt, Human
ccaagcuuggcagccga

SEQ ID NO: 2231410 - RNA, 15 nt, Human
ccaagcuuggcagcc

SEQ ID NO: 2231411 - RNA, 16 nt, Human
ccaagcuuggcagccg

SEQ ID NO: 2231412 - RNA, 23 nt, Human
ccaaugcacuuuguucuggcucu

SEQ ID NO: 2231413 - RNA, 20 nt, Human
ccaaugcacuuuguucuggc

SEQ ID NO: 2231414 - RNA, 22 nt, Human
ccaaugcacuuuguucuggcuc

SEQ ID NO: 2231415 - RNA, 19 nt, Human
ccaaagugguauagaaaug

SEQ ID NO: 2231416 - RNA, 22 nt, Human
ccaaagugcugggauuacaggu

SEQ ID NO: 2231417 - RNA, 15 nt, Human
ccaaauccccuaagc

SEQ ID NO: 2231418 - RNA, 24 nt, Human
ccaaauccgaaccuccucugugaa

SEQ ID NO: 2231419 - RNA, 22 nt, Human
ccaaauccgaaccuccucugug

SEQ ID NO: 2231420 - RNA, 21 nt, Human
ccaaauccgaaccuccucugu

SEQ ID NO: 2231421 - RNA, 17 nt, Human
ccaaauccgaaccuccu

SEQ ID NO: 2231422 - RNA, 23 nt, Human
ccaaauccgaaccuccucuguga

SEQ ID NO: 2231423 - RNA, 13 nt, Human
ccaaauccucucc

SEQ ID NO: 2231424 - RNA, 18 nt, Human
ccaaauccucuccagcua

SEQ ID NO: 2231425 - RNA, 14 nt, Human
ccaaaucuggaagc

SEQ ID NO: 2231426 - RNA, 16 nt, Human
ccaaaugaaugaccuu

SEQ ID NO: 2231427 - RNA, 22 nt, Human
ccaaaugagggucuugguucca

SEQ ID NO: 2231428 - RNA, 18 nt, Human
ccaaauguucaucaauga

SEQ ID NO: 2231429 - RNA, 11 nt, Human
ccaaauuauuu

SEQ ID NO: 2231430 - RNA, 19 nt, Human
ccaaauguuuacagggagc

SEQ ID NO: 2231431 - RNA, 18 nt, Human
ccaaauguuuacagggag

SEQ ID NO: 2231432 - RNA, 23 nt, Human
ccaaauguuuacagggagccucc

SEQ ID NO: 2231433 - RNA, 15 nt, Human
ccaacguggggcagc

SEQ ID NO: 2231434 - RNA, 16 nt, Human
ccaacguggggcagca

SEQ ID NO: 2231435 - RNA, 16 nt, Human
ccaacgucugugccau

SEQ ID NO: 2231436 - RNA, 12 nt, Human
ccaaauuauuug

SEQ ID NO: 2231437 - RNA, 14 nt, Human
ccaaauuauuugug

SEQ ID NO: 2231438 - RNA, 17 nt, Human
ccaaauuauuuguguaa

SEQ ID NO: 2231439 - RNA, 18 nt, Human
ccaaauuauuuguguaau

SEQ ID NO: 2231440 - RNA, 20 nt, Human
ccaacguggggcagcacaga

SEQ ID NO: 2231441 - RNA, 20 nt, Human
ccaacuaaugccuuacucuu

SEQ ID NO: 2231442 - RNA, 19 nt, Human
ccaacuaaugccuuacucu

SEQ ID NO: 2231443 - RNA, 19 nt, Human
ccaacuaacaagaaacuca

SEQ ID NO: 2231444 - RNA, 16 nt, Human
ccaacuacaaccaagc

SEQ ID NO: 2231445 - RNA, 22 nt, Human
ccaacuacaaccaagcucucug

SEQ ID NO: 2231446 - RNA, 23 nt, Human
ccaacuacaaccaagcucucugc

SEQ ID NO: 2231447 - RNA, 13 nt, Human
ccaacuucccagu

SEQ ID NO: 2231448 - RNA, 21 nt, Human
ccaacuucauuugaugcuaaa

SEQ ID NO: 2231449 - RNA, 19 nt, Human
ccaacuucuucagagcuga

SEQ ID NO: 2231450 - RNA, 18 nt, Human
ccaacuucuucagagcug

SEQ ID NO: 2231451 - RNA, 19 nt, Human
ccaacuugagggcccagag

SEQ ID NO: 2231452 - RNA, 16 nt, Human
ccaacuagacauucug

SEQ ID NO: 2231453 - RNA, 17 nt, Human
ccaacuagacauucugu

SEQ ID NO: 2231454 - RNA, 18 nt, Human
ccaacuagacauucuguc

SEQ ID NO: 2231455 - RNA, 23 nt, Human
ccaacuuguauuaaagacagagg

SEQ ID NO: 2231456 - RNA, 17 nt, Human
ccaacuuguaaauacac

SEQ ID NO: 2231457 - RNA, 14 nt, Human
ccaacuuggcuuuc

SEQ ID NO: 2231458 - RNA, 11 nt, Human
ccaacuuguaa

SEQ ID NO: 2231459 - RNA, 13 nt, Human
ccaacuuggcuuu

SEQ ID NO: 2231460 - RNA, 20 nt, Human
ccaacuugagggcccagagc

SEQ ID NO: 2231461 - RNA, 21 nt, Human
ccaacuugagggcccagagca

SEQ ID NO: 2231462 - RNA, 22 nt, Human
ccaaagugcugggauuacaggg

SEQ ID NO: 2231463 - RNA, 22 nt, Human
ccaaagugcugggauuacaggc

SEQ ID NO: 2231464 - RNA, 19 nt, Human
ccaaagugcugggauuaca

SEQ ID NO: 2231465 - RNA, 14 nt, Human
ccaaaacuccugcc

SEQ ID NO: 2231466 - RNA, 13 nt, Human
caauuuaaagcaa

SEQ ID NO: 2231467 - RNA, 21 nt, Human
caauuuacaaaguguguauua

SEQ ID NO: 2231468 - RNA, 18 nt, Human
caauuuacaaagugugua

SEQ ID NO: 2231469 - RNA, 20 nt, Human
caauuuacaaaguguguauu

SEQ ID NO: 2231470 - RNA, 13 nt, Human
caauuuacaaagu

SEQ ID NO: 2231471 - RNA, 14 nt, Human
caauuuacaaagug

SEQ ID NO: 2231472 - RNA, 15 nt, Human
caauuuacaaagugu

SEQ ID NO: 2231473 - RNA, 17 nt, Human
caauuuacaaagugugu

SEQ ID NO: 2231474 - RNA, 20 nt, Human
caauucuucccuaucuuugc

SEQ ID NO: 2231475 - RNA, 21 nt, Human
caauucuucccuaucuuugcc

SEQ ID NO: 2231476 - RNA, 22 nt, Human
caauucuucccuaucuuugcca

SEQ ID NO: 2231477 - RNA, 12 nt, Human
caauucuuuaua

SEQ ID NO: 2231478 - RNA, 13 nt, Human
caauucuuuauac

SEQ ID NO: 2231479 - RNA, 23 nt, Human
caauucuuuauacaacagugcua

SEQ ID NO: 2231480 - RNA, 18 nt, Human
caauugaacuuaaauaaa

SEQ ID NO: 2231481 - RNA, 16 nt, Human
caauucuuuauacaac

SEQ ID NO: 2231482 - RNA, 19 nt, Human
caauucuuuauacaacagu

SEQ ID NO: 2231483 - RNA, 11 nt, Human
caauggcagcc

SEQ ID NO: 2231484 - RNA, 12 nt, Human
caauggcagccu

SEQ ID NO: 2231485 - RNA, 15 nt, Human
caauucuugccaaau

SEQ ID NO: 2231486 - RNA, 13 nt, Human
caauggauuugau

SEQ ID NO: 2231487 - RNA, 17 nt, Human
caauggauuugaugcug

SEQ ID NO: 2231488 - RNA, 19 nt, Human
caauggauuugaugcuguu

SEQ ID NO: 2231489 - RNA, 22 nt, Human
caauggauuugaugcuguuuga

SEQ ID NO: 2231490 - RNA, 20 nt, Human
caauggagacugucucaaga

SEQ ID NO: 2231491 - RNA, 16 nt, Human
caaugcuguauuuuaa

SEQ ID NO: 2231492 - RNA, 17 nt, Human
caaugcuguauuuuaaa

SEQ ID NO: 2231493 - RNA, 15 nt, Human
caaugcuguauuuua

SEQ ID NO: 2231494 - RNA, 20 nt, Human
cacaagagcccagcagggcc

SEQ ID NO: 2231495 - RNA, 23 nt, Human
caauuuauuaaaaugauuguaaa

SEQ ID NO: 2231496 - RNA, 14 nt, Human
caauuuauuaaaau

SEQ ID NO: 2231497 - RNA, 22 nt, Human
caauuuauuaaaaugauuguaa

SEQ ID NO: 2231498 - RNA, 14 nt, Human
cacaagagcccagg

SEQ ID NO: 2231499 - RNA, 21 nt, Human
caauuuauauuuaauaaaauu

SEQ ID NO: 2231500 - RNA, 14 nt, Human
caauuuaugaauug

SEQ ID NO: 2231501 - RNA, 18 nt, Human
cacaagacugcacaucaa

SEQ ID NO: 2231502 - RNA, 16 nt, Human
cacaagagcccaggcc

SEQ ID NO: 2231503 - RNA, 13 nt, Human
cacaagcuccaag

SEQ ID NO: 2231504 - RNA, 14 nt, Human
cacaagcuccaagc

SEQ ID NO: 2231505 - RNA, 15 nt, Human
cacaagcuccaagcu

SEQ ID NO: 2231506 - RNA, 23 nt, Human
cacaagcugcacccucaggcagg

SEQ ID NO: 2231507 - RNA, 17 nt, Human
cacaagcugcacccuca

SEQ ID NO: 2231508 - RNA, 17 nt, Human
cacaagcuccaagcucc

SEQ ID NO: 2231509 - RNA, 23 nt, Human
cacaagcuccaagcucccaggca

SEQ ID NO: 2231510 - RNA, 21 nt, Human
cacaagagcccagcagggccu

SEQ ID NO: 2231511 - RNA, 12 nt, Human
cacaagcuggaa

SEQ ID NO: 2231512 - RNA, 17 nt, Human
cacaagagcccaggccu

SEQ ID NO: 2231513 - RNA, 17 nt, Human
cacacagcucuguccug

SEQ ID NO: 2231514 - RNA, 20 nt, Human
cacacagcucuguccuggga

SEQ ID NO: 2231515 - RNA, 15 nt, Human
cacacagcugcagag

SEQ ID NO: 2231516 - RNA, 16 nt, Human
cacacagcucuguccu

SEQ ID NO: 2231517 - RNA, 13 nt, Human
cacacaggcaacu

SEQ ID NO: 2231518 - RNA, 18 nt, Human
cacacaggacccccuucc

SEQ ID NO: 2231519 - RNA, 19 nt, Human
cacacaggacccccuuccc

SEQ ID NO: 2231520 - RNA, 17 nt, Human
cacacaggacccccuuc

SEQ ID NO: 2231521 - RNA, 18 nt, Human
cacacagcugggcugugg

SEQ ID NO: 2231522 - RNA, 19 nt, Human
cacacaggcaacugaggca

SEQ ID NO: 2231523 - RNA, 16 nt, Human
cacacaggcaacugag

SEQ ID NO: 2231524 - RNA, 20 nt, Human
cacacaggcaacugaggcag

SEQ ID NO: 2231525 - RNA, 20 nt, Human
cacacaggacccccuucccc

SEQ ID NO: 2231526 - RNA, 12 nt, Human
cacacagggcag

SEQ ID NO: 2231527 - RNA, 19 nt, Human
cacacaggggccacccggg

SEQ ID NO: 2231528 - RNA, 18 nt, Human
cacacagugagucgagga

SEQ ID NO: 2231529 - RNA, 23 nt, Human
cacacagggucugcaaggucuuu

SEQ ID NO: 2231530 - RNA, 17 nt, Human
cacacaguauuaaguga

SEQ ID NO: 2231531 - RNA, 21 nt, Human
cacacaguauuaagugacagu

SEQ ID NO: 2231532 - RNA, 20 nt, Human
cacacaguauuacuucugcu

SEQ ID NO: 2231533 - RNA, 23 nt, Human
cacacaguauuacuucugcuaca

SEQ ID NO: 2231534 - RNA, 14 nt, Human
cacacauacacaca

SEQ ID NO: 2231535 - RNA, 21 nt, Human
cacacauauaaacaucacaca

SEQ ID NO: 2231536 - RNA, 23 nt, Human
cacacauauaaacaucacacaca

SEQ ID NO: 2231537 - RNA, 15 nt, Human
cacacauacacacac

SEQ ID NO: 2231538 - RNA, 21 nt, Human
cacacagugagucgaggacag

SEQ ID NO: 2231539 - RNA, 23 nt, Human
cacacagugagucgaggacaggg

SEQ ID NO: 2231540 - RNA, 13 nt, Human
cacacaucaggag

SEQ ID NO: 2231541 - RNA, 17 nt, Human
cacacaugaaguccaag

SEQ ID NO: 2231542 - RNA, 20 nt, Human
cacacaugagcaucaggcca

SEQ ID NO: 2231543 - RNA, 22 nt, Human
cacacaugaaguccaagcauuu

SEQ ID NO: 2231544 - RNA, 18 nt, Human
cacagaaacacaauauuu

SEQ ID NO: 2231545 - RNA, 21 nt, Human
cacagaaacacaauauuuugu

SEQ ID NO: 2231546 - RNA, 13 nt, Human
cacagaaacacaa

SEQ ID NO: 2231547 - RNA, 22 nt, Human
cacagaaaauauacuguaaaga

SEQ ID NO: 2231548 - RNA, 18 nt, Human
cacagacauacuaaccag

SEQ ID NO: 2231549 - RNA, 23 nt, Human
cacagaaaauggaagacagcucu

SEQ ID NO: 2231550 - RNA, 19 nt, Human
cacagaaaauucuucucca

SEQ ID NO: 2231551 - RNA, 11 nt, Human
cacagccucug

SEQ ID NO: 2231552 - RNA, 13 nt, Human
cacagacccugcc

SEQ ID NO: 2231553 - RNA, 21 nt, Human
cacagacauacuaaccagcag

SEQ ID NO: 2231554 - RNA, 19 nt, Human
cacagacauacuaaccagc

SEQ ID NO: 2231555 - RNA, 21 nt, Human
cacacaugagcaucaggccag

SEQ ID NO: 2231556 - RNA, 22 nt, Human
cacacaugagcaucaggccagg

SEQ ID NO: 2231557 - RNA, 21 nt, Human
cacagaaaauauacuguaaag

SEQ ID NO: 2231558 - RNA, 19 nt, Human
cacacaugcauacacacac

SEQ ID NO: 2231559 - RNA, 18 nt, Human
cacacaugcauacacaca

SEQ ID NO: 2231560 - RNA, 17 nt, Human
cacacaugcauacacac

SEQ ID NO: 2231561 - RNA, 16 nt, Human
cacacaugcauacaca

SEQ ID NO: 2231562 - RNA, 15 nt, Human
cacacaugcauacac

SEQ ID NO: 2231563 - RNA, 14 nt, Human
cacacaugcauaca

SEQ ID NO: 2231564 - RNA, 18 nt, Human
cacagaaaauggaagaca

SEQ ID NO: 2231565 - RNA, 19 nt, Human
cacagaaaauggaagacag

SEQ ID NO: 2231566 - RNA, 20 nt, Human
cacagaaaauggaagacagc

SEQ ID NO: 2231567 - RNA, 22 nt, Human
cacagaaaauggaagacagcuc

SEQ ID NO: 2231568 - RNA, 17 nt, Human
cacagcgagacuccguc

SEQ ID NO: 2231569 - RNA, 18 nt, Human
cacagccuucuccacugg

SEQ ID NO: 2231570 - RNA, 22 nt, Human
cacagcgcuggccgggaccccg

SEQ ID NO: 2231571 - RNA, 19 nt, Human
cacagcgcuggccgggacc

SEQ ID NO: 2231572 - RNA, 22 nt, Human
cacaggcccuuccucuccacug

SEQ ID NO: 2231573 - RNA, 18 nt, Human
cacaggcccuuuccucag

SEQ ID NO: 2231574 - RNA, 19 nt, Human
cacaggcccuuuccucagg

SEQ ID NO: 2231575 - RNA, 20 nt, Human
cacaggcccuuuccucaggc

SEQ ID NO: 2231576 - RNA, 22 nt, Human
cacaggcccuuuccucaggcaa

SEQ ID NO: 2231577 - RNA, 23 nt, Human
cacaggcccuuuccucaggcaag

SEQ ID NO: 2231578 - RNA, 23 nt, Human
cacaggcccuuccucuccacugc

SEQ ID NO: 2231579 - RNA, 20 nt, Human
cacagcggagguguggagcc

SEQ ID NO: 2231580 - RNA, 20 nt, Human
cacagacauucugccaggcc

SEQ ID NO: 2231581 - RNA, 18 nt, Human
cacagacauucugccagg

SEQ ID NO: 2231582 - RNA, 12 nt, Human
cacagccucuga

SEQ ID NO: 2231583 - RNA, 13 nt, Human
cacagccucugac

SEQ ID NO: 2231584 - RNA, 14 nt, Human
cacagccucugacc

SEQ ID NO: 2231585 - RNA, 15 nt, Human
cacagccucugaccc

SEQ ID NO: 2231586 - RNA, 17 nt, Human
cacagccucugaccccu

SEQ ID NO: 2231587 - RNA, 20 nt, Human
cacagccucugaccccuccu

SEQ ID NO: 2231588 - RNA, 17 nt, Human
cacagccucuuagaugc

SEQ ID NO: 2231589 - RNA, 22 nt, Human
cacagccucugaccccuccuca

SEQ ID NO: 2231590 - RNA, 23 nt, Human
cacagccucugaccccuccucac

SEQ ID NO: 2231591 - RNA, 21 nt, Human
cacagccucuuagaugcaguu

SEQ ID NO: 2231592 - RNA, 18 nt, Human
cacaggugggcuucccag

SEQ ID NO: 2231593 - RNA, 20 nt, Human
cacaggucuuuccuaaggcu

SEQ ID NO: 2231594 - RNA, 18 nt, Human
cacaggucuuuccuaagg

SEQ ID NO: 2231595 - RNA, 15 nt, Human
cacagggucugcucu

SEQ ID NO: 2231596 - RNA, 14 nt, Human
cacagggucugcac

SEQ ID NO: 2231597 - RNA, 13 nt, Human
cacagggcuaaga

SEQ ID NO: 2231598 - RNA, 22 nt, Human
cacaggccugagauuucaucug

SEQ ID NO: 2231599 - RNA, 23 nt, Human
cacaggccugagauuucaucugc

SEQ ID NO: 2231600 - RNA, 19 nt, Human
cacaggggaaaagaggagu

SEQ ID NO: 2231601 - RNA, 17 nt, Human
cacaggggaaaagagga

SEQ ID NO: 2231602 - RNA, 18 nt, Human
cacaggggaaaagaggag

SEQ ID NO: 2231603 - RNA, 13 nt, Human
cacaggccugaga

SEQ ID NO: 2231604 - RNA, 15 nt, Human
cacaggccucccugu

SEQ ID NO: 2231605 - RNA, 16 nt, Human
cacaggccucccuguu

SEQ ID NO: 2231606 - RNA, 11 nt, Human
cacaggccucc

SEQ ID NO: 2231607 - RNA, 12 nt, Human
cacaggccuccc

SEQ ID NO: 2231608 - RNA, 13 nt, Human
cacaggccucccu

SEQ ID NO: 2231609 - RNA, 14 nt, Human
cacaggccucccug

SEQ ID NO: 2231610 - RNA, 14 nt, Human
cacaggccugagau

SEQ ID NO: 2231611 - RNA, 15 nt, Human
cacaggccugagauu

SEQ ID NO: 2231612 - RNA, 19 nt, Human
cacaggccugagauuucau

SEQ ID NO: 2231613 - RNA, 20 nt, Human
cacaggccugagauuucauc

SEQ ID NO: 2231614 - RNA, 20 nt, Human
cacaguauuacuucugcuac

SEQ ID NO: 2231615 - RNA, 21 nt, Human
cacaguauuacuucugcuaca

SEQ ID NO: 2231616 - RNA, 19 nt, Human
cacagguucaugccaccau

SEQ ID NO: 2231617 - RNA, 15 nt, Human
cacagguguuuauac

SEQ ID NO: 2231618 - RNA, 20 nt, Human
cacagguucacgugcagcuc

SEQ ID NO: 2231619 - RNA, 21 nt, Human
caaguccagauuuacacuggg

SEQ ID NO: 2231620 - RNA, 22 nt, Human
caaguccagauuuacacuggga

SEQ ID NO: 2231621 - RNA, 14 nt, Human
caaguccaagcaua

SEQ ID NO: 2231622 - RNA, 17 nt, Human
caagucauuuuaacuuu

SEQ ID NO: 2231623 - RNA, 15 nt, Human
caaguccaaauguuu

SEQ ID NO: 2231624 - RNA, 12 nt, Human
caagucauuuua

SEQ ID NO: 2231625 - RNA, 19 nt, Human
caagucaaccaauguagaa

SEQ ID NO: 2231626 - RNA, 17 nt, Human
caagucaugugcauuuc

SEQ ID NO: 2231627 - RNA, 16 nt, Human
caagucaaauuaauaa

SEQ ID NO: 2231628 - RNA, 15 nt, Human
caagucaaauuaaua

SEQ ID NO: 2231629 - RNA, 14 nt, Human
caagucaaauuaau

SEQ ID NO: 2231630 - RNA, 17 nt, Human
caagucaagugaaaaag

SEQ ID NO: 2231631 - RNA, 13 nt, Human
caagucaagugaa

SEQ ID NO: 2231632 - RNA, 15 nt, Human
caaguaugugagugu

SEQ ID NO: 2231633 - RNA, 19 nt, Human
caaguaugaauaaagacac

SEQ ID NO: 2231634 - RNA, 21 nt, Human
caaguaugaauaaagacaccu

SEQ ID NO: 2231635 - RNA, 16 nt, Human
caaguaugaauaaaga

SEQ ID NO: 2231636 - RNA, 17 nt, Human
caaggccaaaggaagca

SEQ ID NO: 2231637 - RNA, 18 nt, Human
caaggccaaaggaagcac

SEQ ID NO: 2231638 - RNA, 15 nt, Human
caaggccaaaggaag

SEQ ID NO: 2231639 - RNA, 16 nt, Human
caaggccaaaggaagc

SEQ ID NO: 2231640 - RNA, 13 nt, Human
caaggcaggugcc

SEQ ID NO: 2231641 - RNA, 14 nt, Human
caaggcaggugccu

SEQ ID NO: 2231642 - RNA, 15 nt, Human
caaggcaggugccuc

SEQ ID NO: 2231643 - RNA, 16 nt, Human
caaggcaggugccucc

SEQ ID NO: 2231644 - RNA, 17 nt, Human
caaggcaggugccucca

SEQ ID NO: 2231645 - RNA, 18 nt, Human
caaggcaggugccuccag

SEQ ID NO: 2231646 - RNA, 19 nt, Human
caaggcaggugccuccagg

SEQ ID NO: 2231647 - RNA, 20 nt, Human
caaggcaggugccuccaggu

SEQ ID NO: 2231648 - RNA, 22 nt, Human
caaggcaggugccuccaggugu

SEQ ID NO: 2231649 - RNA, 23 nt, Human
caaggcaggugccuccaggugug

SEQ ID NO: 2231650 - RNA, 14 nt, Human
caaggcacugccug

SEQ ID NO: 2231651 - RNA, 15 nt, Human
caaggcacugccuga

SEQ ID NO: 2231652 - RNA, 16 nt, Human
caaggcacugccugau

SEQ ID NO: 2231653 - RNA, 18 nt, Human
caaggcacugccugaugg

SEQ ID NO: 2231654 - RNA, 20 nt, Human
caagcugcacccucaggcag

SEQ ID NO: 2231655 - RNA, 17 nt, Human
caagcucuagugggaag

SEQ ID NO: 2231656 - RNA, 13 nt, Human
caagcucucugca

SEQ ID NO: 2231657 - RNA, 12 nt, Human
caaggcacugcc

SEQ ID NO: 2231658 - RNA, 13 nt, Human
caaggcacugccu

SEQ ID NO: 2231659 - RNA, 18 nt, Human
caagcugcacccucaggc

SEQ ID NO: 2231660 - RNA, 14 nt, Human
caagcugcacccuc

SEQ ID NO: 2231661 - RNA, 13 nt, Human
caagcugcacccu

SEQ ID NO: 2231662 - RNA, 14 nt, Human
caagcucugcuccu

SEQ ID NO: 2231663 - RNA, 17 nt, Human
caagcuccuugggaggc

SEQ ID NO: 2231664 - RNA, 13 nt, Human
caagcuccaagcc

SEQ ID NO: 2231665 - RNA, 14 nt, Human
caagcuccaagccc

SEQ ID NO: 2231666 - RNA, 12 nt, Human
caagcuccaagc

SEQ ID NO: 2231667 - RNA, 13 nt, Human
caagcucugcucc

SEQ ID NO: 2231668 - RNA, 22 nt, Human
caagcuccuugggaggccccac

SEQ ID NO: 2231669 - RNA, 18 nt, Human
caagcucaggaccaggca

SEQ ID NO: 2231670 - RNA, 19 nt, Human
caagcuccaagccccaucu

SEQ ID NO: 2231671 - RNA, 19 nt, Human
caagcucuaucaccaagga

SEQ ID NO: 2231672 - RNA, 16 nt, Human
caagcuagaaccugga

SEQ ID NO: 2231673 - RNA, 17 nt, Human
caagcuagaaccuggag

SEQ ID NO: 2231674 - RNA, 18 nt, Human
caagcuagaaccuggagg

SEQ ID NO: 2231675 - RNA, 17 nt, Human
caagcuagaaggccaca

SEQ ID NO: 2231676 - RNA, 18 nt, Human
caagcuagaaggccacau

SEQ ID NO: 2231677 - RNA, 15 nt, Human
caagcuauccuggcu

SEQ ID NO: 2231678 - RNA, 16 nt, Human
caagcuauccuggcuc

SEQ ID NO: 2231679 - RNA, 22 nt, Human
caagcucacaguuccucgcccu

SEQ ID NO: 2231680 - RNA, 21 nt, Human
caagcucacaguuccucgccc

SEQ ID NO: 2231681 - RNA, 20 nt, Human
caagcucacaguuccucgcc

SEQ ID NO: 2231682 - RNA, 19 nt, Human
caagcucacaguuccucgc

SEQ ID NO: 2231683 - RNA, 16 nt, Human
caagcucacaguuccu

SEQ ID NO: 2231684 - RNA, 12 nt, Human
caagcucacagu

SEQ ID NO: 2231685 - RNA, 16 nt, Human
caagcucaaagcgugg

SEQ ID NO: 2231686 - RNA, 15 nt, Human
caagcucagaaggcu

SEQ ID NO: 2231687 - RNA, 21 nt, Human
caagcucagaggcgcacugug

SEQ ID NO: 2231688 - RNA, 17 nt, Human
caagcucagaaggcucu

SEQ ID NO: 2231689 - RNA, 16 nt, Human
caagcucaggaccagg

SEQ ID NO: 2231690 - RNA, 11 nt, Human
caauaaaguau

SEQ ID NO: 2231691 - RNA, 16 nt, Human
caauaaaguaucuaca

SEQ ID NO: 2231692 - RNA, 12 nt, Human
caauaaaguauc

SEQ ID NO: 2231693 - RNA, 19 nt, Human
caauaaagcauuuauaaau

SEQ ID NO: 2231694 - RNA, 13 nt, Human
caauaaaguauuu

SEQ ID NO: 2231695 - RNA, 18 nt, Human
caagucccugacucucug

SEQ ID NO: 2231696 - RNA, 14 nt, Human
caaguccccaagau

SEQ ID NO: 2231697 - RNA, 21 nt, Human
caagucccugacucucuguga

SEQ ID NO: 2231698 - RNA, 20 nt, Human
caagucccugacucucugug

SEQ ID NO: 2231699 - RNA, 23 nt, Human
caagucccugacucucugugacc

SEQ ID NO: 2231700 - RNA, 19 nt, Human
caauaaagcagcguuucua

SEQ ID NO: 2231701 - RNA, 14 nt, Human
caauaaagcauuua

SEQ ID NO: 2231702 - RNA, 16 nt, Human
caauaaagcauuuaua

SEQ ID NO: 2231703 - RNA, 15 nt, Human
caauaaagcauuuau

SEQ ID NO: 2231704 - RNA, 19 nt, Human
cacugggguccagggagca

SEQ ID NO: 2231705 - RNA, 15 nt, Human
cacugggguccuggg

SEQ ID NO: 2231706 - RNA, 19 nt, Human
cacugggguccuggggccu

SEQ ID NO: 2231707 - RNA, 18 nt, Human
cacugggguccuggggcc

SEQ ID NO: 2231708 - RNA, 23 nt, Human
cacugguggcccgacagccuggc

SEQ ID NO: 2231709 - RNA, 16 nt, Human
cacuggggcuggcaca

SEQ ID NO: 2231710 - RNA, 19 nt, Human
cacuggugugaccugaggg

SEQ ID NO: 2231711 - RNA, 23 nt, Human
cacuggugugagggccccugccu

SEQ ID NO: 2231712 - RNA, 22 nt, Human
cacugguguggauuaaccugcc

SEQ ID NO: 2231713 - RNA, 20 nt, Human
cacuggugugaccugagggc

SEQ ID NO: 2231714 - RNA, 22 nt, Human
cacugguucuucuuggucucag

SEQ ID NO: 2231715 - RNA, 21 nt, Human
cacuuaccuucaauaaaguau

SEQ ID NO: 2231716 - RNA, 19 nt, Human
cacuuaccuucaauaaagu

SEQ ID NO: 2231717 - RNA, 18 nt, Human
cacuuaccuucaauaaag

SEQ ID NO: 2231718 - RNA, 17 nt, Human
cacuuaccuucaauaaa

SEQ ID NO: 2231719 - RNA, 16 nt, Human
cacuuaccuucaauaa

SEQ ID NO: 2231720 - RNA, 15 nt, Human
cacuuaccuucaaua

SEQ ID NO: 2231721 - RNA, 14 nt, Human
cacuuaccuucaau

SEQ ID NO: 2231722 - RNA, 13 nt, Human
cacuuaccuucaa

SEQ ID NO: 2231723 - RNA, 15 nt, Human
cacugguugcacuua

SEQ ID NO: 2231724 - RNA, 18 nt, Human
cacuuaccuagauuuaca

SEQ ID NO: 2231725 - RNA, 20 nt, Human
cacugguugcacuuaugauu

SEQ ID NO: 2231726 - RNA, 18 nt, Human
cacuuacacuuuaugcac

SEQ ID NO: 2231727 - RNA, 16 nt, Human
cacuuacacuuuaugc

SEQ ID NO: 2231728 - RNA, 21 nt, Human
cacuuguauauacgcaucuau

SEQ ID NO: 2231729 - RNA, 13 nt, Human
cacuuguauauac

SEQ ID NO: 2231730 - RNA, 16 nt, Human
cacuuguauauacgca

SEQ ID NO: 2231731 - RNA, 16 nt, Human
cacuugucaauaaaau

SEQ ID NO: 2231732 - RNA, 15 nt, Human
cacuuguccagcuga

SEQ ID NO: 2231733 - RNA, 14 nt, Human
cacuuguccagcug

SEQ ID NO: 2231734 - RNA, 19 nt, Human
cacuuguguuuugcaagcc

SEQ ID NO: 2231735 - RNA, 12 nt, Human
cacuuaugauuu

SEQ ID NO: 2231736 - RNA, 20 nt, Human
cacuuauuccccauucuucc

SEQ ID NO: 2231737 - RNA, 16 nt, Human
cacuuaucccucucca

SEQ ID NO: 2231738 - RNA, 17 nt, Human
cacuuauucucaagaag

SEQ ID NO: 2231739 - RNA, 21 nt, Human
cacuuauuggaacucugcuug

SEQ ID NO: 2231740 - RNA, 24 nt, Human
cacuuagaaauugcauuuccugac

SEQ ID NO: 2231741 - RNA, 23 nt, Human
cacuuaggaacguaaucgugucc

SEQ ID NO: 2231742 - RNA, 15 nt, Human
cacuuagcuaucaga

SEQ ID NO: 2231743 - RNA, 22 nt, Human
cacuuauauguucuaauuaaua

SEQ ID NO: 2231744 - RNA, 15 nt, Human
cacuuaucccucucc

SEQ ID NO: 2231745 - RNA, 17 nt, Human
cacuuguuccagcucuu

SEQ ID NO: 2231746 - RNA, 16 nt, Human
cacuuguuccagcucu

SEQ ID NO: 2231747 - RNA, 18 nt, Human
cacuuguuccagcucuuu

SEQ ID NO: 2231748 - RNA, 15 nt, Human
cacuuguuccagcuc

SEQ ID NO: 2231749 - RNA, 13 nt, Human
cacuuguuccagc

SEQ ID NO: 2231750 - RNA, 22 nt, Human
cacuuguguuuugcaagccaga

SEQ ID NO: 2231751 - RNA, 16 nt, Human
cacugcauaccaaccu

SEQ ID NO: 2231752 - RNA, 16 nt, Human
cacugcaggccccgcu

SEQ ID NO: 2231753 - RNA, 13 nt, Human
cacugcaggggcc

SEQ ID NO: 2231754 - RNA, 13 nt, Human
cacugcaggcccc

SEQ ID NO: 2231755 - RNA, 13 nt, Human
cacugcagccuca

SEQ ID NO: 2231756 - RNA, 16 nt, Human
cacugcauccuccgcc

SEQ ID NO: 2231757 - RNA, 14 nt, Human
cacugcauccuccg

SEQ ID NO: 2231758 - RNA, 16 nt, Human
cacugcauguuuguga

SEQ ID NO: 2231759 - RNA, 11 nt, Human
cacugccacac

SEQ ID NO: 2231760 - RNA, 18 nt, Human
cacugcauccuccgccuc

SEQ ID NO: 2231761 - RNA, 18 nt, Human
cacugcaugagcuuuuau

SEQ ID NO: 2231762 - RNA, 22 nt, Human
cacugcaugagcuuuuauacua

SEQ ID NO: 2231763 - RNA, 19 nt, Human
cacugcauggcucccacag

SEQ ID NO: 2231764 - RNA, 18 nt, Human
cacugggaaacagaggcu

SEQ ID NO: 2231765 - RNA, 13 nt, Human
cacugggaaacag

SEQ ID NO: 2231766 - RNA, 16 nt, Human
cacuggggccuacagc

SEQ ID NO: 2231767 - RNA, 23 nt, Human
cacuggcugccuccacucccacu

SEQ ID NO: 2231768 - RNA, 14 nt, Human
cacuggggccuaca

SEQ ID NO: 2231769 - RNA, 17 nt, Human
cacugggacuugcaaaa

SEQ ID NO: 2231770 - RNA, 21 nt, Human
cacugggggaggggacauuga

SEQ ID NO: 2231771 - RNA, 18 nt, Human
cacugggggaggggacau

SEQ ID NO: 2231772 - RNA, 15 nt, Human
cacugggggagggga

SEQ ID NO: 2231773 - RNA, 14 nt, Human
cacugggggagggg

SEQ ID NO: 2231774 - RNA, 13 nt, Human
cacuggggcuggc

SEQ ID NO: 2231775 - RNA, 22 nt, Human
cacuggcugucaguaugacauu

SEQ ID NO: 2231776 - RNA, 19 nt, Human
cacuggcugccuccacucc

SEQ ID NO: 2231777 - RNA, 20 nt, Human
cacuggcugccuccacuccc

SEQ ID NO: 2231778 - RNA, 21 nt, Human
cacuggcugccuccacuccca

SEQ ID NO: 2231779 - RNA, 22 nt, Human
cacuggcugccuccacucccac

SEQ ID NO: 2231780 - RNA, 18 nt, Human
cacugggagaaaugaaaa

SEQ ID NO: 2231781 - RNA, 12 nt, Human
cacugccaggcc

SEQ ID NO: 2231782 - RNA, 14 nt, Human
cacuggcugccagc

SEQ ID NO: 2231783 - RNA, 15 nt, Human
cacuggcugccagcu

SEQ ID NO: 2231784 - RNA, 18 nt, Human
cacuggcugccagcuauu

SEQ ID NO: 2231785 - RNA, 20 nt, Human
cacuggcugccagcuauuuu

SEQ ID NO: 2231786 - RNA, 13 nt, Human
cacuggcugccuc

SEQ ID NO: 2231787 - RNA, 14 nt, Human
cacuggcugccucc

SEQ ID NO: 2231788 - RNA, 15 nt, Human
cacuggcugccucca

SEQ ID NO: 2231789 - RNA, 16 nt, Human
cacuggcugccuccac

SEQ ID NO: 2231790 - RNA, 17 nt, Human
cacuggcugccuccacu

SEQ ID NO: 2231791 - RNA, 18 nt, Human
cacuggcugccuccacuc

SEQ ID NO: 2231792 - RNA, 19 nt, Human
cacugcacuauagccuagg

SEQ ID NO: 2231793 - RNA, 19 nt, Human
cacugcacuccagccuggg

SEQ ID NO: 2231794 - RNA, 18 nt, Human
cacugcacuccagccugg

SEQ ID NO: 2231795 - RNA, 16 nt, Human
cacugcacuccagccu

SEQ ID NO: 2231796 - RNA, 15 nt, Human
cacugcacuccagcc

SEQ ID NO: 2231797 - RNA, 20 nt, Human
cacugcacuccagccugggc

SEQ ID NO: 2231798 - RNA, 17 nt, Human
cacugcacuccagccug

SEQ ID NO: 2231799 - RNA, 13 nt, Human
cacugcacuccgg

SEQ ID NO: 2231800 - RNA, 20 nt, Human
cacugcacuccagccugggu

SEQ ID NO: 2231801 - RNA, 12 nt, Human
cacugcagccuc

SEQ ID NO: 2231802 - RNA, 21 nt, Human
cacugcagaagacaguauggc

SEQ ID NO: 2231803 - RNA, 15 nt, Human
cacuccaauuaagga

SEQ ID NO: 2231804 - RNA, 13 nt, Human
cacuccaauuaag

SEQ ID NO: 2231805 - RNA, 20 nt, Human
cacuaggggauauaggagag

SEQ ID NO: 2231806 - RNA, 19 nt, Human
cacuccaagauauggacac

SEQ ID NO: 2231807 - RNA, 23 nt, Human
cacucauugcugagccucugcuc

SEQ ID NO: 2231808 - RNA, 21 nt, Human
cacucauugcugagccucugc

SEQ ID NO: 2231809 - RNA, 19 nt, Human
cacucauugcugagccucu

SEQ ID NO: 2231810 - RNA, 16 nt, Human
cacucauugcugagcc

SEQ ID NO: 2231811 - RNA, 21 nt, Human
cacuaggggauauaggagagg

SEQ ID NO: 2231812 - RNA, 16 nt, Human
cacuccagccugggug

SEQ ID NO: 2231813 - RNA, 18 nt, Human
cacuccaauuaaggauuu

SEQ ID NO: 2231814 - RNA, 17 nt, Human
cacuccaauuaaggauu

SEQ ID NO: 2231815 - RNA, 23 nt, Human
cacuccagccugggcgacagagc

SEQ ID NO: 2231816 - RNA, 13 nt, Human
cacuccagcuccu

SEQ ID NO: 2231817 - RNA, 15 nt, Human
cacuccagcugggau

SEQ ID NO: 2231818 - RNA, 13 nt, Human
cacuccccugcac

SEQ ID NO: 2231819 - RNA, 12 nt, Human
cacuccagcugg

SEQ ID NO: 2231820 - RNA, 11 nt, Human
cacuccagcug

SEQ ID NO: 2231821 - RNA, 14 nt, Human
cacuaggcuucugg

SEQ ID NO: 2231822 - RNA, 21 nt, Human
cacuagggcagggacaggaua

SEQ ID NO: 2231823 - RNA, 20 nt, Human
cacuagggcagggacaggau

SEQ ID NO: 2231824 - RNA, 19 nt, Human
cacugacacaaaaaguaga

SEQ ID NO: 2231825 - RNA, 23 nt, Human
cacugaauuaaugacagagccag

SEQ ID NO: 2231826 - RNA, 17 nt, Human
cacugaauuccauuuuu

SEQ ID NO: 2231827 - RNA, 14 nt, Human
cacugacaccuuug

SEQ ID NO: 2231828 - RNA, 16 nt, Human
cacugacaccuuugca

SEQ ID NO: 2231829 - RNA, 17 nt, Human
cacugacaccuuugcag

SEQ ID NO: 2231830 - RNA, 21 nt, Human
cacugacaccuuugcaggcau

SEQ ID NO: 2231831 - RNA, 22 nt, Human
cacugacaccuuugcaggcaug

SEQ ID NO: 2231832 - RNA, 13 nt, Human
cacugacacuggu

SEQ ID NO: 2231833 - RNA, 20 nt, Human
cacugacacugguauuccug

SEQ ID NO: 2231834 - RNA, 13 nt, Human
cacugaauauuua

SEQ ID NO: 2231835 - RNA, 14 nt, Human
cacugaauauuuau

SEQ ID NO: 2231836 - RNA, 21 nt, Human
cacugaaugccucaaugugac

SEQ ID NO: 2231837 - RNA, 15 nt, Human
cacugaauuaaucau

SEQ ID NO: 2231838 - RNA, 23 nt, Human
cacugacacugguauuccugccu

SEQ ID NO: 2231839 - RNA, 17 nt, Human
cacuccccugcacugga

SEQ ID NO: 2231840 - RNA, 14 nt, Human
cacuccccugcacu

SEQ ID NO: 2231841 - RNA, 15 nt, Human
cacuccccugcuggg

SEQ ID NO: 2231842 - RNA, 14 nt, Human
cacuccccugcugg

SEQ ID NO: 2231843 - RNA, 12 nt, Human
cacuccccugcu

SEQ ID NO: 2231844 - RNA, 13 nt, Human
cacuccccugcug

SEQ ID NO: 2231845 - RNA, 22 nt, Human
cacucuuguggauguuuuaauu

SEQ ID NO: 2231846 - RNA, 23 nt, Human
cacucuuggagccugcagagcug

SEQ ID NO: 2231847 - RNA, 22 nt, Human
cacucuuggagccugcagagcu

SEQ ID NO: 2231848 - RNA, 21 nt, Human
cacucuuggagccugcagagc

SEQ ID NO: 2231849 - RNA, 15 nt, Human
cacucuuuguaagag

SEQ ID NO: 2231850 - RNA, 23 nt, Human
cacucuuuugcuuuauuccagaa

SEQ ID NO: 2231851 - RNA, 15 nt, Human
cacucuuuugcuuua

SEQ ID NO: 2231852 - RNA, 12 nt, Human
cacucuuuguaa

SEQ ID NO: 2231853 - RNA, 20 nt, Human
caccuacaguguacagucuu

SEQ ID NO: 2231854 - RNA, 13 nt, Human
caccucagccucc

SEQ ID NO: 2231855 - RNA, 14 nt, Human
caccucagccuccc

SEQ ID NO: 2231856 - RNA, 18 nt, Human
caccucagccuccugugu

SEQ ID NO: 2231857 - RNA, 13 nt, Human
caccuacagugua

SEQ ID NO: 2231858 - RNA, 21 nt, Human
caccuaauguuuaugagccag

SEQ ID NO: 2231859 - RNA, 20 nt, Human
caccuaauguuuaugagcca

SEQ ID NO: 2231860 - RNA, 14 nt, Human
caccuaauguuuau

SEQ ID NO: 2231861 - RNA, 22 nt, Human
cacccugggcucugugggcugc

SEQ ID NO: 2231862 - RNA, 16 nt, Human
caccuacaguguacag

SEQ ID NO: 2231863 - RNA, 17 nt, Human
caccuacaguguacagu

SEQ ID NO: 2231864 - RNA, 22 nt, Human
caccuaauccaggcagauccag

SEQ ID NO: 2231865 - RNA, 21 nt, Human
caccuaauccaggcagaucca

SEQ ID NO: 2231866 - RNA, 20 nt, Human
caccuaauccaggcagaucc

SEQ ID NO: 2231867 - RNA, 19 nt, Human
cacccugggcucugugggc

SEQ ID NO: 2231868 - RNA, 21 nt, Human
cacccugggcucugugggcug

SEQ ID NO: 2231869 - RNA, 17 nt, Human
caccuaauccaggcaga

SEQ ID NO: 2231870 - RNA, 21 nt, Human
cacccugggcucugggagcag

SEQ ID NO: 2231871 - RNA, 15 nt, Human
cacccugggcucugu

SEQ ID NO: 2231872 - RNA, 16 nt, Human
cacccugggcucugug

SEQ ID NO: 2231873 - RNA, 17 nt, Human
cacccugggcucugugg

SEQ ID NO: 2231874 - RNA, 23 nt, Human
caccugccucggccucccaaagu

SEQ ID NO: 2231875 - RNA, 23 nt, Human
caccugccgaccucguccucccc

SEQ ID NO: 2231876 - RNA, 24 nt, Human
caccugccguggacuuggggucag

SEQ ID NO: 2231877 - RNA, 21 nt, Human
caccugccgaccucguccucc

SEQ ID NO: 2231878 - RNA, 23 nt, Human
caccugcccccuucucccacacu

SEQ ID NO: 2231879 - RNA, 13 nt, Human
caccugccgaccu

SEQ ID NO: 2231880 - RNA, 22 nt, Human
caccugcccccuucucccacac

SEQ ID NO: 2231881 - RNA, 21 nt, Human
caccugcccccuucucccaca

SEQ ID NO: 2231882 - RNA, 20 nt, Human
caccugcccccuucucccac

SEQ ID NO: 2231883 - RNA, 19 nt, Human
caccugcccccuucuccca

SEQ ID NO: 2231884 - RNA, 17 nt, Human
caccugcccccuucucc

SEQ ID NO: 2231885 - RNA, 15 nt, Human
caccugcccccuucu

SEQ ID NO: 2231886 - RNA, 23 nt, Human
caccucaggccaggugcaguggc

SEQ ID NO: 2231887 - RNA, 15 nt, Human
caccucagccuugga

SEQ ID NO: 2231888 - RNA, 15 nt, Human
caccucaggccaggu

SEQ ID NO: 2231889 - RNA, 13 nt, Human
caccucagccuug

SEQ ID NO: 2231890 - RNA, 12 nt, Human
caccucagccuu

SEQ ID NO: 2231891 - RNA, 14 nt, Human
caccugccccucaa

SEQ ID NO: 2231892 - RNA, 15 nt, Human
caccugccccucaac

SEQ ID NO: 2231893 - RNA, 16 nt, Human
caccugccccucaacu

SEQ ID NO: 2231894 - RNA, 16 nt, Human
cacccucucccaggac

SEQ ID NO: 2231895 - RNA, 12 nt, Human
cacccucugagc

SEQ ID NO: 2231896 - RNA, 13 nt, Human
cacccucugagcu

SEQ ID NO: 2231897 - RNA, 18 nt, Human
cacccucugagcuuugca

SEQ ID NO: 2231898 - RNA, 15 nt, Human
cacccucucccagga

SEQ ID NO: 2231899 - RNA, 16 nt, Human
cacccucuaucccaau

SEQ ID NO: 2231900 - RNA, 19 nt, Human
cacccuccugucuucccag

SEQ ID NO: 2231901 - RNA, 14 nt, Human
cacccucuauccca

SEQ ID NO: 2231902 - RNA, 22 nt, Human
cacccucugagcuuugcauguu

SEQ ID NO: 2231903 - RNA, 16 nt, Human
cacccucuaaauggga

SEQ ID NO: 2231904 - RNA, 17 nt, Human
cacccuccugucuuccc

SEQ ID NO: 2231905 - RNA, 18 nt, Human
cacccuccugucuuccca

SEQ ID NO: 2231906 - RNA, 16 nt, Human
cacccucccuggagug

SEQ ID NO: 2231907 - RNA, 14 nt, Human
cacccucccuggag

SEQ ID NO: 2231908 - RNA, 15 nt, Human
cacccucccuggagu

SEQ ID NO: 2231909 - RNA, 14 nt, Human
cacccuccugucuu

SEQ ID NO: 2231910 - RNA, 16 nt, Human
cacccuccugucuucc

SEQ ID NO: 2231911 - RNA, 17 nt, Human
cacccugaaagcccuga

SEQ ID NO: 2231912 - RNA, 23 nt, Human
cacccugggcccugggcuggaau

SEQ ID NO: 2231913 - RNA, 18 nt, Human
cacccugaaugguuccau

SEQ ID NO: 2231914 - RNA, 12 nt, Human
cacccugggcuc

SEQ ID NO: 2231915 - RNA, 15 nt, Human
cacccuggggagaaa

SEQ ID NO: 2231916 - RNA, 16 nt, Human
cacccuggggagaaag

SEQ ID NO: 2231917 - RNA, 14 nt, Human
cacccucaggcagg

SEQ ID NO: 2231918 - RNA, 21 nt, Human
cacccucaugcugugugacuc

SEQ ID NO: 2231919 - RNA, 16 nt, Human
cacccucaugcugugu

SEQ ID NO: 2231920 - RNA, 14 nt, Human
cacccucaugcugu

SEQ ID NO: 2231921 - RNA, 13 nt, Human
cacccucaugcug

SEQ ID NO: 2231922 - RNA, 19 nt, Human
cacccucagcaccccuucc

SEQ ID NO: 2231923 - RNA, 20 nt, Human
cacccucagcaccccuucca

SEQ ID NO: 2231924 - RNA, 21 nt, Human
cacccucagcaccccuuccau

SEQ ID NO: 2231925 - RNA, 20 nt, Human
cacccucccccgccacuccu

SEQ ID NO: 2231926 - RNA, 19 nt, Human
cacccucccagaccugccu

SEQ ID NO: 2231927 - RNA, 18 nt, Human
cacccuccacccuguccc

SEQ ID NO: 2231928 - RNA, 14 nt, Human
cacccuccaccucu

SEQ ID NO: 2231929 - RNA, 17 nt, Human
cacccuccaccucuuca

SEQ ID NO: 2231930 - RNA, 17 nt, Human
cacccucauucuacuga

SEQ ID NO: 2231931 - RNA, 22 nt, Human
cacccucagcaccccuuccaug

SEQ ID NO: 2231932 - RNA, 12 nt, Human
cacccuccaccc

SEQ ID NO: 2231933 - RNA, 13 nt, Human
cacccuccacccu

SEQ ID NO: 2231934 - RNA, 14 nt, Human
cacccuccacccug

SEQ ID NO: 2231935 - RNA, 16 nt, Human
cacccuccacccuguc

SEQ ID NO: 2231936 - RNA, 17 nt, Human
cacccuccacccugucc

SEQ ID NO: 2231937 - RNA, 22 nt, Human
cacccucccuccgauccuuccu

SEQ ID NO: 2231938 - RNA, 23 nt, Human
cacccucccuccgauccuuccuc

SEQ ID NO: 2231939 - RNA, 13 nt, Human
cacccucccugga

SEQ ID NO: 2231940 - RNA, 23 nt, Human
cacccuccccucucuugcacccg

SEQ ID NO: 2231941 - RNA, 17 nt, Human
cacccuccccucucuug

SEQ ID NO: 2231942 - RNA, 19 nt, Human
cacccuccccucucuugca

SEQ ID NO: 2231943 - RNA, 22 nt, Human
cacccucccagaccugccucuu

SEQ ID NO: 2231944 - RNA, 11 nt, Human
cacccuccccu

SEQ ID NO: 2231945 - RNA, 12 nt, Human
cacccuccccuc

SEQ ID NO: 2231946 - RNA, 13 nt, Human
cacccuccccucc

SEQ ID NO: 2231947 - RNA, 14 nt, Human
cacccuccccuccc

SEQ ID NO: 2231948 - RNA, 13 nt, Human
cacccuccccucu

SEQ ID NO: 2231949 - RNA, 15 nt, Human
cacccuccccucucu

SEQ ID NO: 2231950 - RNA, 16 nt, Human
cacccuccccucucuu

SEQ ID NO: 2231951 - RNA, 14 nt, Human
caccuuggcugcag

SEQ ID NO: 2231952 - RNA, 14 nt, Human
caccuuggcucaag

SEQ ID NO: 2231953 - RNA, 15 nt, Human
caccuuggcucaagu

SEQ ID NO: 2231954 - RNA, 13 nt, Human
caccuuggcugca

SEQ ID NO: 2231955 - RNA, 17 nt, Human
caccugccuguugggcc

SEQ ID NO: 2231956 - RNA, 20 nt, Human
caccugccucaggacugcga

SEQ ID NO: 2231957 - RNA, 14 nt, Human
caccugccucagga

SEQ ID NO: 2231958 - RNA, 13 nt, Human
caccugccucagg

SEQ ID NO: 2231959 - RNA, 19 nt, Human
caccugccuguugggccag

SEQ ID NO: 2231960 - RNA, 24 nt, Human
caccugccuguugggccaggagcc

SEQ ID NO: 2231961 - RNA, 24 nt, Human
caccccacuuaucccucuccauaa

SEQ ID NO: 2231962 - RNA, 11 nt, Human
caccccagccc

SEQ ID NO: 2231963 - RNA, 22 nt, Human
caccccacugcaauccugucuu

SEQ ID NO: 2231964 - RNA, 19 nt, Human
caccccacuuaucccucuc

SEQ ID NO: 2231965 - RNA, 14 nt, Human
caccccacccuucc

SEQ ID NO: 2231966 - RNA, 15 nt, Human
caccccacccucccu

SEQ ID NO: 2231967 - RNA, 19 nt, Human
caccccacccucccuggag

SEQ ID NO: 2231968 - RNA, 20 nt, Human
caccccacccucccuggagu

SEQ ID NO: 2231969 - RNA, 22 nt, Human
caccccacccccuucagugccc

SEQ ID NO: 2231970 - RNA, 13 nt, Human
caccccacccucc

SEQ ID NO: 2231971 - RNA, 18 nt, Human
auuuguuugugcuucuaa

SEQ ID NO: 2231972 - RNA, 16 nt, Human
auuuguuugugcuucu

SEQ ID NO: 2231973 - RNA, 17 nt, Human
auuuguuugugcuucua

SEQ ID NO: 2231974 - RNA, 15 nt, Human
auuuguuugugcuuc

SEQ ID NO: 2231975 - RNA, 12 nt, Human
auuuguuugcau

SEQ ID NO: 2231976 - RNA, 20 nt, Human
auuuguuugaacugauaaag

SEQ ID NO: 2231977 - RNA, 19 nt, Human
auuuuauagcuacuaauuu

SEQ ID NO: 2231978 - RNA, 16 nt, Human
auuuuaugaaugucuu

SEQ ID NO: 2231979 - RNA, 22 nt, Human
auuuuauagcucaguuuaucca

SEQ ID NO: 2231980 - RNA, 19 nt, Human
auuuuauagcucaguuuau

SEQ ID NO: 2231981 - RNA, 18 nt, Human
auuuuauagcucaguuua

SEQ ID NO: 2231982 - RNA, 14 nt, Human
auuuguuuucaugg

SEQ ID NO: 2231983 - RNA, 21 nt, Human
auuuuaugaaagguuuacauu

SEQ ID NO: 2231984 - RNA, 17 nt, Human
auuuuauagcuacuaau

SEQ ID NO: 2231985 - RNA, 14 nt, Human
auuuguguauuuaa

SEQ ID NO: 2231986 - RNA, 13 nt, Human
auuuguguaauag

SEQ ID NO: 2231987 - RNA, 22 nt, Human
auuuguggggagggauuugggg

SEQ ID NO: 2231988 - RNA, 11 nt, Human
auuuguggaau

SEQ ID NO: 2231989 - RNA, 12 nt, Human
auuuguggaaua

SEQ ID NO: 2231990 - RNA, 22 nt, Human
auuuguguauuuaacagggagg

SEQ ID NO: 2231991 - RNA, 21 nt, Human
auuuguguaauagaaaacuga

SEQ ID NO: 2231992 - RNA, 20 nt, Human
auuuguugaaauuauguaug

SEQ ID NO: 2231993 - RNA, 11 nt, Human
auuuguugcau

SEQ ID NO: 2231994 - RNA, 14 nt, Human
auuuguuggaauga

SEQ ID NO: 2231995 - RNA, 13 nt, Human
auuuguuggaaug

SEQ ID NO: 2231996 - RNA, 15 nt, Human
auuuguuuaaaagga

SEQ ID NO: 2231997 - RNA, 16 nt, Human
auuuguuuaaaaggau

SEQ ID NO: 2231998 - RNA, 12 nt, Human
auuuguuuaaaa

SEQ ID NO: 2231999 - RNA, 15 nt, Human
auuuguuggaaugaa

SEQ ID NO: 2232000 - RNA, 14 nt, Human
auuuguuuaaaagg

SEQ ID NO: 2232001 - RNA, 13 nt, Human
auuuguuuaaaag

SEQ ID NO: 2232002 - RNA, 23 nt, Human
auuuguuugaacugauaaagaug

SEQ ID NO: 2232003 - RNA, 22 nt, Human
auuuguuugaacugauaaagau

SEQ ID NO: 2232004 - RNA, 14 nt, Human
auuugugccagaau

SEQ ID NO: 2232005 - RNA, 21 nt, Human
auuugugaugacaacuggaau

SEQ ID NO: 2232006 - RNA, 18 nt, Human
auuugugauagcacuuuc

SEQ ID NO: 2232007 - RNA, 20 nt, Human
auuugugauacaaugcugug

SEQ ID NO: 2232008 - RNA, 17 nt, Human
auuugugauagcacuuu

SEQ ID NO: 2232009 - RNA, 15 nt, Human
auuugugauagcacu

SEQ ID NO: 2232010 - RNA, 17 nt, Human
auuugugauacaaugcu

SEQ ID NO: 2232011 - RNA, 15 nt, Human
auuugugauacaaug

SEQ ID NO: 2232012 - RNA, 13 nt, Human
auuuggaaaauaa

SEQ ID NO: 2232013 - RNA, 12 nt, Human
auuuggaaaaua

SEQ ID NO: 2232014 - RNA, 18 nt, Human
auuugcugggcaguuuuu

SEQ ID NO: 2232015 - RNA, 23 nt, Human
auuugcugggcuuuuuuuuucuc

SEQ ID NO: 2232016 - RNA, 13 nt, Human
auuugcuggggaa

SEQ ID NO: 2232017 - RNA, 18 nt, Human
auuugcuuuuucaccaga

SEQ ID NO: 2232018 - RNA, 11 nt, Human
auuugcuuuuu

SEQ ID NO: 2232019 - RNA, 13 nt, Human
auuugcuccuuuc

SEQ ID NO: 2232020 - RNA, 14 nt, Human
auuugcucauggaa

SEQ ID NO: 2232021 - RNA, 17 nt, Human
auuugcucauggaauug

SEQ ID NO: 2232022 - RNA, 20 nt, Human
auuuuaugccuuuuauuucu

SEQ ID NO: 2232023 - RNA, 14 nt, Human
auuuuaugcaaaua

SEQ ID NO: 2232024 - RNA, 21 nt, Human
auuuuaugccuuuuauuucuu

SEQ ID NO: 2232025 - RNA, 12 nt, Human
auuuuaugcuuu

SEQ ID NO: 2232026 - RNA, 17 nt, Human
auuuuaugcuuuaaaca

SEQ ID NO: 2232027 - RNA, 16 nt, Human
auuuuaugcaaauauu

SEQ ID NO: 2232028 - RNA, 15 nt, Human
auuugcauauguaug

SEQ ID NO: 2232029 - RNA, 21 nt, Human
auuugcauggcuccagaaaug

SEQ ID NO: 2232030 - RNA, 22 nt, Human
auuugcauggcuccagaaaugu

SEQ ID NO: 2232031 - RNA, 17 nt, Human
auuugcauauguaugac

SEQ ID NO: 2232032 - RNA, 23 nt, Human
auuugcauuaaauucacaaacuu

SEQ ID NO: 2232033 - RNA, 19 nt, Human
auuugcauuaaauucacaa

SEQ ID NO: 2232034 - RNA, 18 nt, Human
auuugcauuaaauucaca

SEQ ID NO: 2232035 - RNA, 21 nt, Human
auuugcagcugagagaaaaua

SEQ ID NO: 2232036 - RNA, 22 nt, Human
auuugcauaacaauuccucuac

SEQ ID NO: 2232037 - RNA, 21 nt, Human
auuugcauaacaauuccucua

SEQ ID NO: 2232038 - RNA, 20 nt, Human
auuugcaagggaaaagucuc

SEQ ID NO: 2232039 - RNA, 15 nt, Human
auuugcaagggaaaa

SEQ ID NO: 2232040 - RNA, 22 nt, Human
auuugcagcugagagaaaauaa

SEQ ID NO: 2232041 - RNA, 18 nt, Human
auuugcaagucauggcug

SEQ ID NO: 2232042 - RNA, 19 nt, Human
auuugcaagucauggcugu

SEQ ID NO: 2232043 - RNA, 23 nt, Human
auuugauucuguguguuuucaua

SEQ ID NO: 2232044 - RNA, 16 nt, Human
auuugauugauuugaa

SEQ ID NO: 2232045 - RNA, 13 nt, Human
auuugauugauuu

SEQ ID NO: 2232046 - RNA, 20 nt, Human
auuugauguuuacaggugga

SEQ ID NO: 2232047 - RNA, 13 nt, Human
auuugauuucuau

SEQ ID NO: 2232048 - RNA, 17 nt, Human
auuugauuucuauucaa

SEQ ID NO: 2232049 - RNA, 15 nt, Human
auuugcgaaugguuc

SEQ ID NO: 2232050 - RNA, 15 nt, Human
auuugccuugcugga

SEQ ID NO: 2232051 - RNA, 21 nt, Human
auuugccuguuucugcuugcu

SEQ ID NO: 2232052 - RNA, 14 nt, Human
auuugcccucccau

SEQ ID NO: 2232053 - RNA, 22 nt, Human
auuugccuauucccacaccucc

SEQ ID NO: 2232054 - RNA, 15 nt, Human
auuugccugugccac

SEQ ID NO: 2232055 - RNA, 20 nt, Human
auuugcuaugagcuggggau

SEQ ID NO: 2232056 - RNA, 16 nt, Human
auuugcuaugagcugg

SEQ ID NO: 2232057 - RNA, 15 nt, Human
auuugccaauaauaa

SEQ ID NO: 2232058 - RNA, 22 nt, Human
auuugcauugaacacaaacugu

SEQ ID NO: 2232059 - RNA, 21 nt, Human
auuugcauugaacacaaacug

SEQ ID NO: 2232060 - RNA, 16 nt, Human
auuugcauugaacaca

SEQ ID NO: 2232061 - RNA, 15 nt, Human
auuugccaugggcuu

SEQ ID NO: 2232062 - RNA, 19 nt, Human
auuugccaugggcuucacu

SEQ ID NO: 2232063 - RNA, 24 nt, Human
auuugccaugggcuucacuguaua

SEQ ID NO: 2232064 - RNA, 15 nt, Human
auuugcccuccuccu

SEQ ID NO: 2232065 - RNA, 16 nt, Human
auuugccaauaauaau

SEQ ID NO: 2232066 - RNA, 18 nt, Human
caaagauguuugucagau

SEQ ID NO: 2232067 - RNA, 16 nt, Human
caaagauguuugucag

SEQ ID NO: 2232068 - RNA, 13 nt, Human
caaagaucaaaau

SEQ ID NO: 2232069 - RNA, 23 nt, Human
caaagauauuuugcuuugugauu

SEQ ID NO: 2232070 - RNA, 22 nt, Human
caaagauauuuugcuuugugau

SEQ ID NO: 2232071 - RNA, 22 nt, Human
caaagauguuugucagauauga

SEQ ID NO: 2232072 - RNA, 17 nt, Human
caaagauucaaaauuga

SEQ ID NO: 2232073 - RNA, 21 nt, Human
caaagauucaaaauugacauu

SEQ ID NO: 2232074 - RNA, 15 nt, Human
caaagcaaggaaacu

SEQ ID NO: 2232075 - RNA, 13 nt, Human
caaagcaaggaaa

SEQ ID NO: 2232076 - RNA, 18 nt, Human
caaagcaaugcauuuugg

SEQ ID NO: 2232077 - RNA, 15 nt, Human
caaagcaaugcauuu

SEQ ID NO: 2232078 - RNA, 14 nt, Human
caaagcaauaauag

SEQ ID NO: 2232079 - RNA, 16 nt, Human
caaagcaauaauagua

SEQ ID NO: 2232080 - RNA, 13 nt, Human
caaagcacagugu

SEQ ID NO: 2232081 - RNA, 14 nt, Human
caaagcacaguguu

SEQ ID NO: 2232082 - RNA, 15 nt, Human
caaagcacaguguua

SEQ ID NO: 2232083 - RNA, 19 nt, Human
caaagcacaguguuaaaug

SEQ ID NO: 2232084 - RNA, 18 nt, Human
caaagcacauugaaagag

SEQ ID NO: 2232085 - RNA, 12 nt, Human
caaagcaccagc

SEQ ID NO: 2232086 - RNA, 20 nt, Human
caaagcacgaaauguuauuu

SEQ ID NO: 2232087 - RNA, 22 nt, Human
caaagcacgaaauguuauuuuu

SEQ ID NO: 2232088 - RNA, 21 nt, Human
caaagcaccagcuucuccagg

SEQ ID NO: 2232089 - RNA, 21 nt, Human
caaagcacuuggacucuugcu

SEQ ID NO: 2232090 - RNA, 15 nt, Human
caaagcagacagcuc

SEQ ID NO: 2232091 - RNA, 13 nt, Human
caaagcagacagc

SEQ ID NO: 2232092 - RNA, 12 nt, Human
caaagcagacag

SEQ ID NO: 2232093 - RNA, 22 nt, Human
caaagcacuuggacucuugcuc

SEQ ID NO: 2232094 - RNA, 23 nt, Human
caaagcacuuggacucuugcucu

SEQ ID NO: 2232095 - RNA, 19 nt, Human
caaagcagacagcuccacc

SEQ ID NO: 2232096 - RNA, 17 nt, Human
caaagcagacagcucca

SEQ ID NO: 2232097 - RNA, 16 nt, Human
caaagcagacagcucc

SEQ ID NO: 2232098 - RNA, 18 nt, Human
caaagcaggggaguaugc

SEQ ID NO: 2232099 - RNA, 21 nt, Human
caaagcaggggaguaugcaaa

SEQ ID NO: 2232100 - RNA, 22 nt, Human
caaagcaggggaguaugcaaaa

SEQ ID NO: 2232101 - RNA, 13 nt, Human
caaagcagccacg

SEQ ID NO: 2232102 - RNA, 12 nt, Human
caaagcagccac

SEQ ID NO: 2232103 - RNA, 17 nt, Human
caaagcacauugaaaga

SEQ ID NO: 2232104 - RNA, 17 nt, Human
caaagcacaguuugaac

SEQ ID NO: 2232105 - RNA, 22 nt, Human
caaagcacaguguuaaaugaaa

SEQ ID NO: 2232106 - RNA, 16 nt, Human
caaagcacaguuugaa

SEQ ID NO: 2232107 - RNA, 18 nt, Human
caaagcaccaaaauaaga

SEQ ID NO: 2232108 - RNA, 17 nt, Human
caaagcaccaaaauaag

SEQ ID NO: 2232109 - RNA, 24 nt, Human
caaagcaccaaaauaagaaaagau

SEQ ID NO: 2232110 - RNA, 22 nt, Human
caaagcaccaaaauaagaaaag

SEQ ID NO: 2232111 - RNA, 21 nt, Human
caaagcaccaaaauaagaaaa

SEQ ID NO: 2232112 - RNA, 19 nt, Human
caaagcaccaaaauaagaa

SEQ ID NO: 2232113 - RNA, 22 nt, Human
caaagcacugacuucuaaguaa

SEQ ID NO: 2232114 - RNA, 20 nt, Human
caaagcacugacuucuaagu

SEQ ID NO: 2232115 - RNA, 14 nt, Human
caaagguauaauuu

SEQ ID NO: 2232116 - RNA, 15 nt, Human
caaagcagggucugg

SEQ ID NO: 2232117 - RNA, 13 nt, Human
caaaggugaagga

SEQ ID NO: 2232118 - RNA, 16 nt, Human
caaaggugaaggaaua

SEQ ID NO: 2232119 - RNA, 18 nt, Human
caaaggugaaggaauaua

SEQ ID NO: 2232120 - RNA, 14 nt, Human
caaagguggcucuc

SEQ ID NO: 2232121 - RNA, 19 nt, Human
caaaggugaaggaauauau

SEQ ID NO: 2232122 - RNA, 13 nt, Human
caaagguggcucu

SEQ ID NO: 2232123 - RNA, 15 nt, Human
caaagcagugcaugc

SEQ ID NO: 2232124 - RNA, 17 nt, Human
caaagcagugcaugcug

SEQ ID NO: 2232125 - RNA, 16 nt, Human
caaaguaaaacuugcu

SEQ ID NO: 2232126 - RNA, 19 nt, Human
caaagguuuuccucuucua

SEQ ID NO: 2232127 - RNA, 11 nt, Human
caaagguuuuc

SEQ ID NO: 2232128 - RNA, 15 nt, Human
caaagguugagaugu

SEQ ID NO: 2232129 - RNA, 18 nt, Human
caaaguaaaacuugcugc

SEQ ID NO: 2232130 - RNA, 22 nt, Human
caaaguacacuguuucaaacuu

SEQ ID NO: 2232131 - RNA, 21 nt, Human
caaaguagaagucuuagaugu

SEQ ID NO: 2232132 - RNA, 14 nt, Human
caaaguagaagucu

SEQ ID NO: 2232133 - RNA, 21 nt, Human
caaagucucuggaauuugaaa

SEQ ID NO: 2232134 - RNA, 22 nt, Human
caaagugccacucauuccugua

SEQ ID NO: 2232135 - RNA, 16 nt, Human
caaagugccacucauu

SEQ ID NO: 2232136 - RNA, 13 nt, Human
caaagucugugug

SEQ ID NO: 2232137 - RNA, 20 nt, Human
caaagucugauuugugauga

SEQ ID NO: 2232138 - RNA, 14 nt, Human
caaagucuguguga

SEQ ID NO: 2232139 - RNA, 20 nt, Human
caaagucuuaaaauaacuua

SEQ ID NO: 2232140 - RNA, 22 nt, Human
caaagucuuaaaauaacuuaua

SEQ ID NO: 2232141 - RNA, 16 nt, Human
caaauccauccagaau

SEQ ID NO: 2232142 - RNA, 22 nt, Human
caaauccgaaccuccucuguga

SEQ ID NO: 2232143 - RNA, 16 nt, Human
caaauccgaaccuccu

SEQ ID NO: 2232144 - RNA, 13 nt, Human
caaauccuaugug

SEQ ID NO: 2232145 - RNA, 21 nt, Human
caaauccgaaccuccucugug

SEQ ID NO: 2232146 - RNA, 18 nt, Human
caaauccuaugugauuuu

SEQ ID NO: 2232147 - RNA, 17 nt, Human
caaauccuaugugauuu

SEQ ID NO: 2232148 - RNA, 16 nt, Human
caaauccuaugugauu

SEQ ID NO: 2232149 - RNA, 15 nt, Human
caaauccuaugugau

SEQ ID NO: 2232150 - RNA, 19 nt, Human
caacacgcaccugccucag

SEQ ID NO: 2232151 - RNA, 14 nt, Human
caacacuaacauga

SEQ ID NO: 2232152 - RNA, 20 nt, Human
caacaccucugcacaagcug

SEQ ID NO: 2232153 - RNA, 16 nt, Human
caacacccaucuguuu

SEQ ID NO: 2232154 - RNA, 17 nt, Human
caacaccagccccugcc

SEQ ID NO: 2232155 - RNA, 18 nt, Human
caacaccagccccugccc

SEQ ID NO: 2232156 - RNA, 22 nt, Human
caacaccagccccugccccagc

SEQ ID NO: 2232157 - RNA, 17 nt, Human
caacacgcaccugccuc

SEQ ID NO: 2232158 - RNA, 15 nt, Human
caacacgcaccugcc

SEQ ID NO: 2232159 - RNA, 23 nt, Human
caacacgagcaggcuacugucag

SEQ ID NO: 2232160 - RNA, 18 nt, Human
caacaauccuagugcuuu

SEQ ID NO: 2232161 - RNA, 17 nt, Human
caacaauccuagugcuu

SEQ ID NO: 2232162 - RNA, 15 nt, Human
caacaauccuagugc

SEQ ID NO: 2232163 - RNA, 13 nt, Human
caacaauaaaaua

SEQ ID NO: 2232164 - RNA, 22 nt, Human
caacaauacaugcugcuaauuc

SEQ ID NO: 2232165 - RNA, 17 nt, Human
caacaaucccaaggccc

SEQ ID NO: 2232166 - RNA, 13 nt, Human
caacaauaacacu

SEQ ID NO: 2232167 - RNA, 12 nt, Human
caacaccacaga

SEQ ID NO: 2232168 - RNA, 13 nt, Human
caacaccacagac

SEQ ID NO: 2232169 - RNA, 14 nt, Human
caacaccacagaca

SEQ ID NO: 2232170 - RNA, 22 nt, Human
caacaccaagcacagcagccug

SEQ ID NO: 2232171 - RNA, 15 nt, Human
caacaccaagcacag

SEQ ID NO: 2232172 - RNA, 15 nt, Human
caacaccacagacac

SEQ ID NO: 2232173 - RNA, 16 nt, Human
caacaccacagacaca

SEQ ID NO: 2232174 - RNA, 17 nt, Human
caacaccacagacacac

SEQ ID NO: 2232175 - RNA, 18 nt, Human
caacaccacagacacaca

SEQ ID NO: 2232176 - RNA, 19 nt, Human
caacaccacagacacacac

SEQ ID NO: 2232177 - RNA, 20 nt, Human
caacaccacagacacacaca

SEQ ID NO: 2232178 - RNA, 13 nt, Human
caacaccagcccc

SEQ ID NO: 2232179 - RNA, 14 nt, Human
caacaccagccccu

SEQ ID NO: 2232180 - RNA, 21 nt, Human
caacaagggagagaccucauc

SEQ ID NO: 2232181 - RNA, 15 nt, Human
caacaagggagagac

SEQ ID NO: 2232182 - RNA, 18 nt, Human
caacaagggagagaccuc

SEQ ID NO: 2232183 - RNA, 13 nt, Human
caacaaguaacuu

SEQ ID NO: 2232184 - RNA, 16 nt, Human
caacaauaaaauagca

SEQ ID NO: 2232185 - RNA, 14 nt, Human
caacaagagcgaaa

SEQ ID NO: 2232186 - RNA, 14 nt, Human
caaauggaaaggag

SEQ ID NO: 2232187 - RNA, 15 nt, Human
caacaagaguuuauu

SEQ ID NO: 2232188 - RNA, 14 nt, Human
caacaagggagaga

SEQ ID NO: 2232189 - RNA, 14 nt, Human
caacaagaguuuau

SEQ ID NO: 2232190 - RNA, 21 nt, Human
caaauggaaaugggcagagca

SEQ ID NO: 2232191 - RNA, 22 nt, Human
caaauggaaaugggcagagcag

SEQ ID NO: 2232192 - RNA, 21 nt, Human
caaauggaaaggagaggaaag

SEQ ID NO: 2232193 - RNA, 15 nt, Human
caaaugcuguauucu

SEQ ID NO: 2232194 - RNA, 17 nt, Human
caaaugcuuggcuucuc

SEQ ID NO: 2232195 - RNA, 18 nt, Human
caaaugcuuggcuucuca

SEQ ID NO: 2232196 - RNA, 13 nt, Human
caaauggaaagga

SEQ ID NO: 2232197 - RNA, 20 nt, Human
caaauggaaaugggcagagc

SEQ ID NO: 2232198 - RNA, 23 nt, Human
caaauccuaugugauuuuaacuc

SEQ ID NO: 2232199 - RNA, 13 nt, Human
caaauccucucca

SEQ ID NO: 2232200 - RNA, 22 nt, Human
caaauccuaugugauuuuaacu

SEQ ID NO: 2232201 - RNA, 21 nt, Human
caaauccuaugugauuuuaac

SEQ ID NO: 2232202 - RNA, 15 nt, Human
caaauccuugaagau

SEQ ID NO: 2232203 - RNA, 14 nt, Human
caaacaguagguug

SEQ ID NO: 2232204 - RNA, 19 nt, Human
caaacaguagguuggcagu

SEQ ID NO: 2232205 - RNA, 21 nt, Human
caaaccaucauugaaaucuuu

SEQ ID NO: 2232206 - RNA, 19 nt, Human
caaaccaucauugaaaucu

SEQ ID NO: 2232207 - RNA, 13 nt, Human
caaacagccacac

SEQ ID NO: 2232208 - RNA, 16 nt, Human
caaaagggugucugag

SEQ ID NO: 2232209 - RNA, 20 nt, Human
caaaagggugucugagcccu

SEQ ID NO: 2232210 - RNA, 24 nt, Human
caaaaggaucuuuguggccaagga

SEQ ID NO: 2232211 - RNA, 22 nt, Human
caaaaggaucuuuguggccaag

SEQ ID NO: 2232212 - RNA, 21 nt, Human
caaaaggaucuuuguggccaa

SEQ ID NO: 2232213 - RNA, 15 nt, Human
caaaaggcagaagca

SEQ ID NO: 2232214 - RNA, 18 nt, Human
caaaagaugcuucucacu

SEQ ID NO: 2232215 - RNA, 20 nt, Human
caaaaggaucuuuguggcca

SEQ ID NO: 2232216 - RNA, 19 nt, Human
caaaaggaucuuuguggcc

SEQ ID NO: 2232217 - RNA, 20 nt, Human
caaaagauugcugaaauuuu

SEQ ID NO: 2232218 - RNA, 19 nt, Human
caaaagauugcugaaauuu

SEQ ID NO: 2232219 - RNA, 16 nt, Human
caaaagauugcugaaa

SEQ ID NO: 2232220 - RNA, 16 nt, Human
caaaagaugcuucuca

SEQ ID NO: 2232221 - RNA, 19 nt, Human
caaaagaugcucuucugug

SEQ ID NO: 2232222 - RNA, 20 nt, Human
caaaagaugcucuucugugg

SEQ ID NO: 2232223 - RNA, 22 nt, Human
caaaaaaaaaaaaaagcaucua

SEQ ID NO: 2232224 - RNA, 20 nt, Human
caaaaaaaaaaaaaaauuag

SEQ ID NO: 2232225 - RNA, 19 nt, Human
auuuuuuuuuuaaauuauu

SEQ ID NO: 2232226 - RNA, 14 nt, Human
auuuuuuuuucuaa

SEQ ID NO: 2232227 - RNA, 15 nt, Human
auuuuuuuuucuaag

SEQ ID NO: 2232228 - RNA, 18 nt, Human
auuuuuuuuucuaagaga

SEQ ID NO: 2232229 - RNA, 19 nt, Human
auuuuuuuuucuaagagaa

SEQ ID NO: 2232230 - RNA, 23 nt, Human
auuuuuuuuuccuucagugccuu

SEQ ID NO: 2232231 - RNA, 20 nt, Human
caaagauauuuugcuuugug

SEQ ID NO: 2232232 - RNA, 18 nt, Human
caaagauauuuugcuuug

SEQ ID NO: 2232233 - RNA, 19 nt, Human
auugauauaaauaaaacau

SEQ ID NO: 2232234 - RNA, 21 nt, Human
auugauauacacggaugacuu

SEQ ID NO: 2232235 - RNA, 18 nt, Human
auugauauaaauaaaaca

SEQ ID NO: 2232236 - RNA, 18 nt, Human
auugauagaguguuauca

SEQ ID NO: 2232237 - RNA, 17 nt, Human
auugauaugcuuauaca

SEQ ID NO: 2232238 - RNA, 15 nt, Human
auugcuacuguccua

SEQ ID NO: 2232239 - RNA, 16 nt, Human
auugauaugaaaaaua

SEQ ID NO: 2232240 - RNA, 15 nt, Human
auugauaugaaaaau

SEQ ID NO: 2232241 - RNA, 14 nt, Human
auugauaugaaaaa

SEQ ID NO: 2232242 - RNA, 17 nt, Human
auugauaugaaaaauau

SEQ ID NO: 2232243 - RNA, 22 nt, Human
auugcuauguuuugacauuuuu

SEQ ID NO: 2232244 - RNA, 20 nt, Human
auugcuacuguccuacccac

SEQ ID NO: 2232245 - RNA, 22 nt, Human
auugcuacuguccuacccaccc

SEQ ID NO: 2232246 - RNA, 16 nt, Human
auugauaauugcauuc

SEQ ID NO: 2232247 - RNA, 19 nt, Human
auugauaacagcacugacu

SEQ ID NO: 2232248 - RNA, 16 nt, Human
auugauaagagggcac

SEQ ID NO: 2232249 - RNA, 16 nt, Human
auugaguuuucagugg

SEQ ID NO: 2232250 - RNA, 15 nt, Human
auugaguuuucagug

SEQ ID NO: 2232251 - RNA, 21 nt, Human
auugauaagaaccuuuugagu

SEQ ID NO: 2232252 - RNA, 15 nt, Human
auugagucaaauggu

SEQ ID NO: 2232253 - RNA, 23 nt, Human
auugagguguauggagagaaaac

SEQ ID NO: 2232254 - RNA, 21 nt, Human
auugaguauccuuucaguguu

SEQ ID NO: 2232255 - RNA, 16 nt, Human
auucuugaaagcugug

SEQ ID NO: 2232256 - RNA, 18 nt, Human
auucuugaaggaaaauga

SEQ ID NO: 2232257 - RNA, 22 nt, Human
auucuucuuccaacguggccca

SEQ ID NO: 2232258 - RNA, 15 nt, Human
auucuugaaggaaaa

SEQ ID NO: 2232259 - RNA, 14 nt, Human
auucuucugcuuca

SEQ ID NO: 2232260 - RNA, 14 nt, Human
auucuucugccuca

SEQ ID NO: 2232261 - RNA, 21 nt, Human
auucuucugaacucaaacuga

SEQ ID NO: 2232262 - RNA, 13 nt, Human
auucuugaguuua

SEQ ID NO: 2232263 - RNA, 11 nt, Human
auucuuuccug

SEQ ID NO: 2232264 - RNA, 14 nt, Human
auucucuuucaaag

SEQ ID NO: 2232265 - RNA, 18 nt, Human
auucauaguaacuucuua

SEQ ID NO: 2232266 - RNA, 17 nt, Human
auucauaguaacuucuu

SEQ ID NO: 2232267 - RNA, 16 nt, Human
auucauaguaacuucu

SEQ ID NO: 2232268 - RNA, 16 nt, Human
auucugaacaauucuc

SEQ ID NO: 2232269 - RNA, 15 nt, Human
auucugaaggagccc

SEQ ID NO: 2232270 - RNA, 17 nt, Human
auucugaagccauuguc

SEQ ID NO: 2232271 - RNA, 16 nt, Human
auucugaaggagcccc

SEQ ID NO: 2232272 - RNA, 11 nt, Human
auucuucugcu

SEQ ID NO: 2232273 - RNA, 12 nt, Human
auucuucugcuu

SEQ ID NO: 2232274 - RNA, 13 nt, Human
auucuucugaacu

SEQ ID NO: 2232275 - RNA, 20 nt, Human
auucugaccacccuucucau

SEQ ID NO: 2232276 - RNA, 10 nt, Human
auucugaaug

SEQ ID NO: 2232277 - RNA, 13 nt, Human
auucugaauguac

SEQ ID NO: 2232278 - RNA, 13 nt, Human
auucuuuccugag

SEQ ID NO: 2232279 - RNA, 21 nt, Human
auucuuucccaauucacaucu

SEQ ID NO: 2232280 - RNA, 12 nt, Human
auugugugaugu

SEQ ID NO: 2232281 - RNA, 13 nt, Human
auugugugauguu

SEQ ID NO: 2232282 - RNA, 16 nt, Human
auuguuagucucuuga

SEQ ID NO: 2232283 - RNA, 14 nt, Human
auuguuccaagaca

SEQ ID NO: 2232284 - RNA, 12 nt, Human
auuguuccaaga

SEQ ID NO: 2232285 - RNA, 20 nt, Human
auuguucauuuugagcugaa

SEQ ID NO: 2232286 - RNA, 18 nt, Human
auuguuccaaaugaaugu

SEQ ID NO: 2232287 - RNA, 12 nt, Human
auuguucauuuu

SEQ ID NO: 2232288 - RNA, 18 nt, Human
auuguucauuuugagcug

SEQ ID NO: 2232289 - RNA, 18 nt, Human
auugugucuuuugcauga

SEQ ID NO: 2232290 - RNA, 13 nt, Human
auugugucuuuug

SEQ ID NO: 2232291 - RNA, 15 nt, Human
auugugucuuuugca

SEQ ID NO: 2232292 - RNA, 16 nt, Human
auugugucuuuugcau

SEQ ID NO: 2232293 - RNA, 17 nt, Human
auugugucuuuugcaug

SEQ ID NO: 2232294 - RNA, 14 nt, Human
auugugucugcagg

SEQ ID NO: 2232295 - RNA, 21 nt, Human
auugugucucuugguccugcu

SEQ ID NO: 2232296 - RNA, 23 nt, Human
auugugucucuugguccugcugc

SEQ ID NO: 2232297 - RNA, 15 nt, Human
auuguaaaauuguau

SEQ ID NO: 2232298 - RNA, 15 nt, Human
auuguaaacaugugu

SEQ ID NO: 2232299 - RNA, 16 nt, Human
auuguaaacauguguu

SEQ ID NO: 2232300 - RNA, 23 nt, Human
auugcuugaaagaaaauaugcau

SEQ ID NO: 2232301 - RNA, 17 nt, Human
auuguaaaauuguauag

SEQ ID NO: 2232302 - RNA, 18 nt, Human
auugcuugagcucaggag

SEQ ID NO: 2232303 - RNA, 14 nt, Human
auuguaaaauggug

SEQ ID NO: 2232304 - RNA, 10 nt, Human
auuguaaaua

SEQ ID NO: 2232305 - RNA, 12 nt, Human
auuguaaucacu

SEQ ID NO: 2232306 - RNA, 14 nt, Human
auuguaaauaguau

SEQ ID NO: 2232307 - RNA, 23 nt, Human
auuguaauaggcguaacuaauuu

SEQ ID NO: 2232308 - RNA, 24 nt, Human
auuguaauguuacugaucaugcau

SEQ ID NO: 2232309 - RNA, 17 nt, Human
auuguaauguuacugau

SEQ ID NO: 2232310 - RNA, 15 nt, Human
auuguaauguuacug

SEQ ID NO: 2232311 - RNA, 13 nt, Human
auuguaauguuac

SEQ ID NO: 2232312 - RNA, 13 nt, Human
auuguaaucacug

SEQ ID NO: 2232313 - RNA, 21 nt, Human
auugcugagagaaauauggaa

SEQ ID NO: 2232314 - RNA, 16 nt, Human
auugcugaaauuuuau

SEQ ID NO: 2232315 - RNA, 13 nt, Human
auugcugaaauuu

SEQ ID NO: 2232316 - RNA, 22 nt, Human
auugcugagccucugcucccca

SEQ ID NO: 2232317 - RNA, 16 nt, Human
auugcugagccucugc

SEQ ID NO: 2232318 - RNA, 14 nt, Human
auugcugagccucu

SEQ ID NO: 2232319 - RNA, 23 nt, Human
auugcugagagaaauauggaacu

SEQ ID NO: 2232320 - RNA, 22 nt, Human
auugcugagagaaauauggaac

SEQ ID NO: 2232321 - RNA, 12 nt, Human
auugcuccuuga

SEQ ID NO: 2232322 - RNA, 12 nt, Human
auugcugaaauu

SEQ ID NO: 2232323 - RNA, 16 nt, Human
auugcugaaaauggua

SEQ ID NO: 2232324 - RNA, 18 nt, Human
auugcugaaaaugguauu

SEQ ID NO: 2232325 - RNA, 15 nt, Human
auugcugauggugca

SEQ ID NO: 2232326 - RNA, 16 nt, Human
auugcugauggugcaa

SEQ ID NO: 2232327 - RNA, 18 nt, Human
auugcugauggugcaaug

SEQ ID NO: 2232328 - RNA, 19 nt, Human
auugcugauggugcaauga

SEQ ID NO: 2232329 - RNA, 14 nt, Human
auugcuugagcuca

SEQ ID NO: 2232330 - RNA, 18 nt, Human
auugcuugagcccaggag

SEQ ID NO: 2232331 - RNA, 17 nt, Human
auugcuugagcccagga

SEQ ID NO: 2232332 - RNA, 16 nt, Human
auugcuugaaagaaaa

SEQ ID NO: 2232333 - RNA, 23 nt, Human
auugcuucuucuccuauguguaa

SEQ ID NO: 2232334 - RNA, 14 nt, Human
auugcugguucuau

SEQ ID NO: 2232335 - RNA, 22 nt, Human
auugcuggcaaagacagaagcc

SEQ ID NO: 2232336 - RNA, 18 nt, Human
auugcuggcuggaaggga

SEQ ID NO: 2232337 - RNA, 23 nt, Human
auugcugucaaguuccuuugggu

SEQ ID NO: 2232338 - RNA, 21 nt, Human
auugcugguucuauuuaaugg

SEQ ID NO: 2232339 - RNA, 22 nt, Human
auugcugguucuauuuaaugga

SEQ ID NO: 2232340 - RNA, 17 nt, Human
auugcuucuucuccuau

SEQ ID NO: 2232341 - RNA, 22 nt, Human
auugcuucuucuccuaugugua

SEQ ID NO: 2232342 - RNA, 20 nt, Human
auugcuggcaaagacagaag

SEQ ID NO: 2232343 - RNA, 19 nt, Human
auugcuggcaaagacagaa

SEQ ID NO: 2232344 - RNA, 15 nt, Human
auugcugcugguaau

SEQ ID NO: 2232345 - RNA, 21 nt, Human
auugcugccccaucagugcuc

SEQ ID NO: 2232346 - RNA, 12 nt, Human
auugcugcuuga

SEQ ID NO: 2232347 - RNA, 23 nt, Human
auugcugauggugcaaugaccuu

SEQ ID NO: 2232348 - RNA, 23 nt, Human
auugcugagccucugcuccccag

SEQ ID NO: 2232349 - RNA, 20 nt, Human
auugcugccccaucagugcu

SEQ ID NO: 2232350 - RNA, 14 nt, Human
auugcugccacuuu

SEQ ID NO: 2232351 - RNA, 21 nt, Human
auugcugccacuuuuuaacua

SEQ ID NO: 2232352 - RNA, 20 nt, Human
auuguuccaagacauuguca

SEQ ID NO: 2232353 - RNA, 18 nt, Human
auuguugacaguucugaa

SEQ ID NO: 2232354 - RNA, 21 nt, Human
auuguuccaagacauugucaa

SEQ ID NO: 2232355 - RNA, 17 nt, Human
auuguugacaguucuga

SEQ ID NO: 2232356 - RNA, 18 nt, Human
auuguuccaagacauugu

SEQ ID NO: 2232357 - RNA, 17 nt, Human
auuguuccaagacauug

SEQ ID NO: 2232358 - RNA, 16 nt, Human
auuguuccaagacauu

SEQ ID NO: 2232359 - RNA, 15 nt, Human
auuguuccaagacau

SEQ ID NO: 2232360 - RNA, 21 nt, Human
auuguugagguggucugaaug

SEQ ID NO: 2232361 - RNA, 20 nt, Human
auuguugagguggucugaau

SEQ ID NO: 2232362 - RNA, 19 nt, Human
auuguugagcuauugcugu

SEQ ID NO: 2232363 - RNA, 16 nt, Human
auuguugagcuauugc

SEQ ID NO: 2232364 - RNA, 21 nt, Human
auuguugacaguucugaagaa

SEQ ID NO: 2232365 - RNA, 22 nt, Human
auuguugacaguucugaagaau

SEQ ID NO: 2232366 - RNA, 23 nt, Human
auuguugagguggucugaauguu

SEQ ID NO: 2232367 - RNA, 22 nt, Human
auuguugagguggucugaaugu

SEQ ID NO: 2232368 - RNA, 12 nt, Human
auuguugcauua

SEQ ID NO: 2232369 - RNA, 20 nt, Human
auuguugguaauuauuuugg

SEQ ID NO: 2232370 - RNA, 21 nt, Human
auuguuguacacagaaauaca

SEQ ID NO: 2232371 - RNA, 18 nt, Human
auuguuggcacauccuau

SEQ ID NO: 2232372 - RNA, 20 nt, Human
auuagcugguuggagagcua

SEQ ID NO: 2232373 - RNA, 16 nt, Human
auuagcugugugaaau

SEQ ID NO: 2232374 - RNA, 20 nt, Human
auuaggaaguguaacagcug

SEQ ID NO: 2232375 - RNA, 15 nt, Human
auuaggaaaauaugg

SEQ ID NO: 2232376 - RNA, 20 nt, Human
auuagcuuuacuguuuguua

SEQ ID NO: 2232377 - RNA, 15 nt, Human
auuagcuuuacuguu

SEQ ID NO: 2232378 - RNA, 21 nt, Human
auuaggaaguguaacagcuga

SEQ ID NO: 2232379 - RNA, 22 nt, Human
auuaggacaaucaguccccucc

SEQ ID NO: 2232380 - RNA, 16 nt, Human
auuaggaauaaauaaa

SEQ ID NO: 2232381 - RNA, 13 nt, Human
auuaggaauaaau

SEQ ID NO: 2232382 - RNA, 22 nt, Human
auuaggaaguguaacagcugag

SEQ ID NO: 2232383 - RNA, 16 nt, Human
auuagggagagaagau

SEQ ID NO: 2232384 - RNA, 22 nt, Human
auuagggguugcuaagaagcga

SEQ ID NO: 2232385 - RNA, 13 nt, Human
auuagguauuuug

SEQ ID NO: 2232386 - RNA, 15 nt, Human
auuagggguugcuaa

SEQ ID NO: 2232387 - RNA, 23 nt, Human
auuagggagaaaauucaauugua

SEQ ID NO: 2232388 - RNA, 20 nt, Human
auuagggagaaaauucaauu

SEQ ID NO: 2232389 - RNA, 18 nt, Human
auuagggagaaaauucaa

SEQ ID NO: 2232390 - RNA, 17 nt, Human
auuagggagaaaauuca

SEQ ID NO: 2232391 - RNA, 18 nt, Human
auuagggcauuugagaaa

SEQ ID NO: 2232392 - RNA, 19 nt, Human
auuagggcauuugagaaau

SEQ ID NO: 2232393 - RNA, 18 nt, Human
auuaggugugacugaauu

SEQ ID NO: 2232394 - RNA, 16 nt, Human
auuaggugugacugaa

SEQ ID NO: 2232395 - RNA, 21 nt, Human
auuaggugugacugaauuucu

SEQ ID NO: 2232396 - RNA, 14 nt, Human
auuaugaauuacau

SEQ ID NO: 2232397 - RNA, 17 nt, Human
auuaugaauuacauuug

SEQ ID NO: 2232398 - RNA, 21 nt, Human
auuaugaugugggucaaggaa

SEQ ID NO: 2232399 - RNA, 20 nt, Human
auuaugagaggcaaugauug

SEQ ID NO: 2232400 - RNA, 16 nt, Human
auuaugaguuugcuua

SEQ ID NO: 2232401 - RNA, 19 nt, Human
auuaugacaguuauacugu

SEQ ID NO: 2232402 - RNA, 17 nt, Human
auuaugacaguuauacu

SEQ ID NO: 2232403 - RNA, 16 nt, Human
auuaugacaguuauac

SEQ ID NO: 2232404 - RNA, 15 nt, Human
auuaugacaguuaua

SEQ ID NO: 2232405 - RNA, 14 nt, Human
auuaugacaguuau

SEQ ID NO: 2232406 - RNA, 12 nt, Human
auuaugacaguu

SEQ ID NO: 2232407 - RNA, 18 nt, Human
auuaugaauuacauuugu

SEQ ID NO: 2232408 - RNA, 16 nt, Human
auuaugcagaauacuu

SEQ ID NO: 2232409 - RNA, 17 nt, Human
auuaugcagaauacuuu

SEQ ID NO: 2232410 - RNA, 23 nt, Human
auuaugcaugaaguaauaugcac

SEQ ID NO: 2232411 - RNA, 14 nt, Human
auucaauuccucug

SEQ ID NO: 2232412 - RNA, 16 nt, Human
auucaauuccucuggg

SEQ ID NO: 2232413 - RNA, 22 nt, Human
auucaauguuuaugcaaggaag

SEQ ID NO: 2232414 - RNA, 23 nt, Human
auucaauguuuaugcaaggaagg

SEQ ID NO: 2232415 - RNA, 22 nt, Human
auucaaucuguaaacuguguau

SEQ ID NO: 2232416 - RNA, 22 nt, Human
auucacaaugaaaugcucuccu

SEQ ID NO: 2232417 - RNA, 14 nt, Human
auucacaauagaaa

SEQ ID NO: 2232418 - RNA, 13 nt, Human
auucacaauagaa

SEQ ID NO: 2232419 - RNA, 18 nt, Human
auucaauuguaaauugaa

SEQ ID NO: 2232420 - RNA, 14 nt, Human
auucaauuguaaau

SEQ ID NO: 2232421 - RNA, 13 nt, Human
auucaauuguaaa

SEQ ID NO: 2232422 - RNA, 11 nt, Human
auucacacugu

SEQ ID NO: 2232423 - RNA, 15 nt, Human
auucacaccugacuc

SEQ ID NO: 2232424 - RNA, 17 nt, Human
auucaauuccucuggga

SEQ ID NO: 2232425 - RNA, 18 nt, Human
auucaauuccucugggaa

SEQ ID NO: 2232426 - RNA, 19 nt, Human
auucacaagacccaaaagg

SEQ ID NO: 2232427 - RNA, 14 nt, Human
auucauaaugacuu

SEQ ID NO: 2232428 - RNA, 15 nt, Human
auucauaaugacuua

SEQ ID NO: 2232429 - RNA, 21 nt, Human
auucauaauuauuauuuggcc

SEQ ID NO: 2232430 - RNA, 19 nt, Human
auucauaaugacuuaagca

SEQ ID NO: 2232431 - RNA, 22 nt, Human
auucauagcagcuuauucacaa

SEQ ID NO: 2232432 - RNA, 19 nt, Human
auucauagcagcuuauuca

SEQ ID NO: 2232433 - RNA, 13 nt, Human
auuagcucuggac

SEQ ID NO: 2232434 - RNA, 19 nt, Human
auuagcucacuuggugaua

SEQ ID NO: 2232435 - RNA, 12 nt, Human
auuagcucugga

SEQ ID NO: 2232436 - RNA, 17 nt, Human
auuagccugaguagaaa

SEQ ID NO: 2232437 - RNA, 18 nt, Human
auuagccgggcauggugg

SEQ ID NO: 2232438 - RNA, 17 nt, Human
auuagccagugaaaaac

SEQ ID NO: 2232439 - RNA, 14 nt, Human
auuagccugaguag

SEQ ID NO: 2232440 - RNA, 16 nt, Human
auuagccugaguagaa

SEQ ID NO: 2232441 - RNA, 14 nt, Human
auuagcauuuaguc

SEQ ID NO: 2232442 - RNA, 13 nt, Human
auuagccaggauc

SEQ ID NO: 2232443 - RNA, 17 nt, Human
auuagccacaaaauugg

SEQ ID NO: 2232444 - RNA, 14 nt, Human
auuagccaggauca

SEQ ID NO: 2232445 - RNA, 15 nt, Human
auuagccaggaucau

SEQ ID NO: 2232446 - RNA, 21 nt, Human
auuagccaggaucauggugua

SEQ ID NO: 2232447 - RNA, 22 nt, Human
auuagccaggaucaugguguaa

SEQ ID NO: 2232448 - RNA, 15 nt, Human
auuagccagguaaug

SEQ ID NO: 2232449 - RNA, 19 nt, Human
auuagcauuugucaacaaa

SEQ ID NO: 2232450 - RNA, 17 nt, Human
auuagcaguuugcuuug

SEQ ID NO: 2232451 - RNA, 22 nt, Human
auuagcaauugacugucacugu

SEQ ID NO: 2232452 - RNA, 23 nt, Human
auuagauuucucauuugccaaua

SEQ ID NO: 2232453 - RNA, 19 nt, Human
auuagauguucucuaucau

SEQ ID NO: 2232454 - RNA, 21 nt, Human
auuagauguucucuaucauuu

SEQ ID NO: 2232455 - RNA, 23 nt, Human
auuagauguucucuaucauuuaa

SEQ ID NO: 2232456 - RNA, 22 nt, Human
auuacagagaggagaaacacau

SEQ ID NO: 2232457 - RNA, 21 nt, Human
auuacagagaggagaaacaca

SEQ ID NO: 2232458 - RNA, 15 nt, Human
auuacagaggaaguu

SEQ ID NO: 2232459 - RNA, 17 nt, Human
auuacagaggaaguuau

SEQ ID NO: 2232460 - RNA, 19 nt, Human
auuacagaugggcaaauua

SEQ ID NO: 2232461 - RNA, 17 nt, Human
auuacaggaaguacugg

SEQ ID NO: 2232462 - RNA, 16 nt, Human
auuacaggugugaacc

SEQ ID NO: 2232463 - RNA, 22 nt, Human
auuacaggcaccugccaccaug

SEQ ID NO: 2232464 - RNA, 20 nt, Human
auuacaggcaccugccacca

SEQ ID NO: 2232465 - RNA, 21 nt, Human
auuacagaugggcaaauuaag

SEQ ID NO: 2232466 - RNA, 15 nt, Human
auuacagcuggagaa

SEQ ID NO: 2232467 - RNA, 19 nt, Human
auuaauucaccuuccagug

SEQ ID NO: 2232468 - RNA, 13 nt, Human
auuaauucuauaa

SEQ ID NO: 2232469 - RNA, 14 nt, Human
auuaauuaaaugca

SEQ ID NO: 2232470 - RNA, 14 nt, Human
auuaauucuauaag

SEQ ID NO: 2232471 - RNA, 14 nt, Human
auuaauugcuuuga

SEQ ID NO: 2232472 - RNA, 13 nt, Human
auuaauugcuuug

SEQ ID NO: 2232473 - RNA, 12 nt, Human
auuaauugcuuu

SEQ ID NO: 2232474 - RNA, 16 nt, Human
auuaauuggcagcaga

SEQ ID NO: 2232475 - RNA, 17 nt, Human
auuaauuggcagcagau

SEQ ID NO: 2232476 - RNA, 22 nt, Human
auuaauuuuuuuauuguuuaaa

SEQ ID NO: 2232477 - RNA, 22 nt, Human
auuacaaaaugacauuuugcca

SEQ ID NO: 2232478 - RNA, 19 nt, Human
auuacagagaggagaaaca

SEQ ID NO: 2232479 - RNA, 18 nt, Human
auuacagagaggagaaac

SEQ ID NO: 2232480 - RNA, 13 nt, Human
auuacaaauugcu

SEQ ID NO: 2232481 - RNA, 14 nt, Human
auuacaaauugcuu

SEQ ID NO: 2232482 - RNA, 15 nt, Human
auuacaaauugcuua

SEQ ID NO: 2232483 - RNA, 22 nt, Human
auuacaaauugcuuacuuugga

SEQ ID NO: 2232484 - RNA, 19 nt, Human
auuaauuggcagcagauuu

SEQ ID NO: 2232485 - RNA, 18 nt, Human
auuaauguuaauucagca

SEQ ID NO: 2232486 - RNA, 12 nt, Human
auuaauguuaau

SEQ ID NO: 2232487 - RNA, 13 nt, Human
auuaauguuaauu

SEQ ID NO: 2232488 - RNA, 18 nt, Human
auguuugccucugccucu

SEQ ID NO: 2232489 - RNA, 23 nt, Human
auguuugggagacugcugaguca

SEQ ID NO: 2232490 - RNA, 22 nt, Human
auguuucuucuagguucuaaaa

SEQ ID NO: 2232491 - RNA, 18 nt, Human
auguuugggcagaaggga

SEQ ID NO: 2232492 - RNA, 13 nt, Human
auguuuguggccu

SEQ ID NO: 2232493 - RNA, 10 nt, Human
auguuugugg

SEQ ID NO: 2232494 - RNA, 23 nt, Human
auguuuguccugaacacuuuugu

SEQ ID NO: 2232495 - RNA, 23 nt, Human
auguuugggcagaagggagaagg

SEQ ID NO: 2232496 - RNA, 14 nt, Human
auguuuguaaaacu

SEQ ID NO: 2232497 - RNA, 17 nt, Human
auguuuguggccucaga

SEQ ID NO: 2232498 - RNA, 16 nt, Human
auguuuguggccucag

SEQ ID NO: 2232499 - RNA, 15 nt, Human
auguuuguggccuca

SEQ ID NO: 2232500 - RNA, 14 nt, Human
auguuuguggccuc

SEQ ID NO: 2232501 - RNA, 18 nt, Human
aucugaugcaagcaagaa

SEQ ID NO: 2232502 - RNA, 18 nt, Human
aucugauggcuucuccag

SEQ ID NO: 2232503 - RNA, 18 nt, Human
aucugauuggacauuuuc

SEQ ID NO: 2232504 - RNA, 19 nt, Human
aucugauuggacauuuucu

SEQ ID NO: 2232505 - RNA, 14 nt, Human
aucugauggcuucu

SEQ ID NO: 2232506 - RNA, 17 nt, Human
aucugauggcuucucca

SEQ ID NO: 2232507 - RNA, 19 nt, Human
aucugauuuguuuuccucu

SEQ ID NO: 2232508 - RNA, 17 nt, Human
aucugauugugauguga

SEQ ID NO: 2232509 - RNA, 21 nt, Human
aucugcacccucgaugaagcc

SEQ ID NO: 2232510 - RNA, 21 nt, Human
aucugcaccccccugggcuga

SEQ ID NO: 2232511 - RNA, 17 nt, Human
aucugcaccccuucucu

SEQ ID NO: 2232512 - RNA, 18 nt, Human
aucugcaccccuucucuc

SEQ ID NO: 2232513 - RNA, 20 nt, Human
aucugcaccccuucucuccu

SEQ ID NO: 2232514 - RNA, 19 nt, Human
aucugcaccccccugggcu

SEQ ID NO: 2232515 - RNA, 18 nt, Human
aucugcaccccccugggc

SEQ ID NO: 2232516 - RNA, 17 nt, Human
aucugcaccccccuggg

SEQ ID NO: 2232517 - RNA, 15 nt, Human
aucugcaccccccug

SEQ ID NO: 2232518 - RNA, 10 nt, Human
aucugcaccc

SEQ ID NO: 2232519 - RNA, 20 nt, Human
aucugcagggggugugucug

SEQ ID NO: 2232520 - RNA, 17 nt, Human
aucugcaggcagacacg

SEQ ID NO: 2232521 - RNA, 19 nt, Human
aucugcaggcagacacgga

SEQ ID NO: 2232522 - RNA, 23 nt, Human
aucugcagaaggaaaaaugugua

SEQ ID NO: 2232523 - RNA, 14 nt, Human
aucugcaggcagac

SEQ ID NO: 2232524 - RNA, 15 nt, Human
aucugcaggcagaca

SEQ ID NO: 2232525 - RNA, 16 nt, Human
aucugcaggcagacac

SEQ ID NO: 2232526 - RNA, 21 nt, Human
aucugcaccccuucucuccuc

SEQ ID NO: 2232527 - RNA, 22 nt, Human
aucugcaccccuucucuccucc

SEQ ID NO: 2232528 - RNA, 23 nt, Human
aucugcaccccuucucuccuccc

SEQ ID NO: 2232529 - RNA, 11 nt, Human
aucugcagaag

SEQ ID NO: 2232530 - RNA, 13 nt, Human
aucugcagaagga

SEQ ID NO: 2232531 - RNA, 14 nt, Human
aucugcagaaggaa

SEQ ID NO: 2232532 - RNA, 20 nt, Human
aucugcagaaggaaaaaugu

SEQ ID NO: 2232533 - RNA, 22 nt, Human
aucugcagaaggaaaaaugugu

SEQ ID NO: 2232534 - RNA, 20 nt, Human
aucugagaggccacagugca

SEQ ID NO: 2232535 - RNA, 21 nt, Human
uugccuccccauuucccaucu

SEQ ID NO: 2232536 - RNA, 17 nt, Human
aucugagcaagagcugg

SEQ ID NO: 2232537 - RNA, 22 nt, Human
aucugagcaagagcuggcaaag

SEQ ID NO: 2232538 - RNA, 17 nt, Human
uugccuccccauuuccc

SEQ ID NO: 2232539 - RNA, 20 nt, Human
uugccuccccauuucccauc

SEQ ID NO: 2232540 - RNA, 21 nt, Human
uugccucagucccccaacaga

SEQ ID NO: 2232541 - RNA, 17 nt, Human
uugccuacuaugccaga

SEQ ID NO: 2232542 - RNA, 24 nt, Human
uugccuauucccacaccuccacag

SEQ ID NO: 2232543 - RNA, 14 nt, Human
aucugagggaggag

SEQ ID NO: 2232544 - RNA, 22 nt, Human
aucugagggaggaggccaccuc

SEQ ID NO: 2232545 - RNA, 23 nt, Human
aucugagggaggaggccaccucu

SEQ ID NO: 2232546 - RNA, 16 nt, Human
aucugagggaggaggc

SEQ ID NO: 2232547 - RNA, 19 nt, Human
aucugagggaggaggccac

SEQ ID NO: 2232548 - RNA, 20 nt, Human
aucugagggaggaggccacc

SEQ ID NO: 2232549 - RNA, 21 nt, Human
aucugagggaggaggccaccu

SEQ ID NO: 2232550 - RNA, 21 nt, Human
uugccgcgucgcccucccagg

SEQ ID NO: 2232551 - RNA, 18 nt, Human
uugccgcgucgcccuccc

SEQ ID NO: 2232552 - RNA, 13 nt, Human
uugccgucuaccu

SEQ ID NO: 2232553 - RNA, 18 nt, Human
uugcccuucacaguguuu

SEQ ID NO: 2232554 - RNA, 17 nt, Human
uugcccuucacaguguu

SEQ ID NO: 2232555 - RNA, 11 nt, Human
uugcccuuccc

SEQ ID NO: 2232556 - RNA, 13 nt, Human
uugcccuucccug

SEQ ID NO: 2232557 - RNA, 16 nt, Human
uugcccuucacagugu

SEQ ID NO: 2232558 - RNA, 14 nt, Human
uugcccuucacagu

SEQ ID NO: 2232559 - RNA, 23 nt, Human
uugcccugguuucacuggcccaa

SEQ ID NO: 2232560 - RNA, 14 nt, Human
uugcccuucccugu

SEQ ID NO: 2232561 - RNA, 17 nt, Human
uugcccuucccuguccc

SEQ ID NO: 2232562 - RNA, 19 nt, Human
uugcccuucccugucccuc

SEQ ID NO: 2232563 - RNA, 14 nt, Human
uugcccuugcccug

SEQ ID NO: 2232564 - RNA, 15 nt, Human
uugcccuugcccuga

SEQ ID NO: 2232565 - RNA, 16 nt, Human
uugcccuugcccugac

SEQ ID NO: 2232566 - RNA, 17 nt, Human
uugcccuugcccugacc

SEQ ID NO: 2232567 - RNA, 18 nt, Human
uugcccuugcccugaccu

SEQ ID NO: 2232568 - RNA, 10 nt, Human
uugcccuggu

SEQ ID NO: 2232569 - RNA, 18 nt, Human
uugcccugaccucccagc

SEQ ID NO: 2232570 - RNA, 21 nt, Human
uugcccugaccucccagcccu

SEQ ID NO: 2232571 - RNA, 11 nt, Human
uugcauucaaa

SEQ ID NO: 2232572 - RNA, 13 nt, Human
uugcccuguuaaa

SEQ ID NO: 2232573 - RNA, 22 nt, Human
uugcauuaaauucacaaacuuu

SEQ ID NO: 2232574 - RNA, 12 nt, Human
uugcauucaaau

SEQ ID NO: 2232575 - RNA, 21 nt, Human
uugcauuaaauucacaaacuu

SEQ ID NO: 2232576 - RNA, 20 nt, Human
uugcauuaaauucacaaacu

SEQ ID NO: 2232577 - RNA, 13 nt, Human
uugcauuaaauuc

SEQ ID NO: 2232578 - RNA, 22 nt, Human
uugccgcgucgcccucccaggc

SEQ ID NO: 2232579 - RNA, 19 nt, Human
uugccuaauaaacauccuu

SEQ ID NO: 2232580 - RNA, 14 nt, Human
uugccguuauuaaa

SEQ ID NO: 2232581 - RNA, 19 nt, Human
uugccgucuaccugagggg

SEQ ID NO: 2232582 - RNA, 15 nt, Human
uugccgucuaccuga

SEQ ID NO: 2232583 - RNA, 18 nt, Human
uugccgucuaccugaggg

SEQ ID NO: 2232584 - RNA, 17 nt, Human
aucugguagauuuuuaa

SEQ ID NO: 2232585 - RNA, 19 nt, Human
aucuggguucacugcaacc

SEQ ID NO: 2232586 - RNA, 17 nt, Human
aucuggguucacugcaa

SEQ ID NO: 2232587 - RNA, 19 nt, Human
aucugcauuuucaccccac

SEQ ID NO: 2232588 - RNA, 13 nt, Human
aucugcagucacu

SEQ ID NO: 2232589 - RNA, 16 nt, Human
aucugcagucacuucg

SEQ ID NO: 2232590 - RNA, 23 nt, Human
aucugcauuuucaccccacccuu

SEQ ID NO: 2232591 - RNA, 22 nt, Human
aucugcauuuucaccccacccu

SEQ ID NO: 2232592 - RNA, 15 nt, Human
aucuguacguaagaa

SEQ ID NO: 2232593 - RNA, 23 nt, Human
aucugugaaaggaaagagggagg

SEQ ID NO: 2232594 - RNA, 17 nt, Human
aucuguacuucuucgau

SEQ ID NO: 2232595 - RNA, 13 nt, Human
aucuguacaauga

SEQ ID NO: 2232596 - RNA, 16 nt, Human
aucuguaccucugccu

SEQ ID NO: 2232597 - RNA, 20 nt, Human
aucugguagggggaaaaugu

SEQ ID NO: 2232598 - RNA, 17 nt, Human
aucuggucccuugcagc

SEQ ID NO: 2232599 - RNA, 18 nt, Human
aucugguccuacccaucc

SEQ ID NO: 2232600 - RNA, 17 nt, Human
aucugguccuacccauc

SEQ ID NO: 2232601 - RNA, 14 nt, Human
aucugguccuaccc

SEQ ID NO: 2232602 - RNA, 21 nt, Human
aucugguccuacccauccccg

SEQ ID NO: 2232603 - RNA, 13 nt, Human
aucuguaaacugu

SEQ ID NO: 2232604 - RNA, 17 nt, Human
aucuguaaacuguguau

SEQ ID NO: 2232605 - RNA, 14 nt, Human
aucuguaaacugug

SEQ ID NO: 2232606 - RNA, 22 nt, Human
aucuguaaacuguguauuccaa

SEQ ID NO: 2232607 - RNA, 15 nt, Human
aucugguuuugcuau

SEQ ID NO: 2232608 - RNA, 15 nt, Human
aucuguacaaugaac

SEQ ID NO: 2232609 - RNA, 21 nt, Human
aucuugauaccaccuauauag

SEQ ID NO: 2232610 - RNA, 23 nt, Human
aucuugaccaagcaggaagcuca

SEQ ID NO: 2232611 - RNA, 16 nt, Human
aucuugaucugcucag

SEQ ID NO: 2232612 - RNA, 15 nt, Human
aucuugcucugcuug

SEQ ID NO: 2232613 - RNA, 22 nt, Human
aucuugaucugcucagcccugg

SEQ ID NO: 2232614 - RNA, 20 nt, Human
aucuugaucugcucagcccu

SEQ ID NO: 2232615 - RNA, 21 nt, Human
aucuugaucugcucagcccug

SEQ ID NO: 2232616 - RNA, 14 nt, Human
aucuugcuucccua

SEQ ID NO: 2232617 - RNA, 15 nt, Human
aucuugcuucccuaa

SEQ ID NO: 2232618 - RNA, 14 nt, Human
aucuugcucuguaa

SEQ ID NO: 2232619 - RNA, 15 nt, Human
aucuugcucuguaau

SEQ ID NO: 2232620 - RNA, 16 nt, Human
aucuugcucuguaauc

SEQ ID NO: 2232621 - RNA, 17 nt, Human
aucuugcucuguaaucu

SEQ ID NO: 2232622 - RNA, 17 nt, Human
aucuugcucugcugaca

SEQ ID NO: 2232623 - RNA, 19 nt, Human
aucuugcucugcugacaga

SEQ ID NO: 2232624 - RNA, 20 nt, Human
aucuuaggggagagcuuucu

SEQ ID NO: 2232625 - RNA, 18 nt, Human
aucuugaauuguaaggaa

SEQ ID NO: 2232626 - RNA, 22 nt, Human
aucuugaccaagcaggaagcuc

SEQ ID NO: 2232627 - RNA, 21 nt, Human
aucuugaccaagcaggaagcu

SEQ ID NO: 2232628 - RNA, 19 nt, Human
aucuugaccaagcaggaag

SEQ ID NO: 2232629 - RNA, 17 nt, Human
aucuugaccaagcagga

SEQ ID NO: 2232630 - RNA, 17 nt, Human
aucuugacauucaaggc

SEQ ID NO: 2232631 - RNA, 17 nt, Human
aucuugacuacagucag

SEQ ID NO: 2232632 - RNA, 22 nt, Human
aucuugagcaaguuccuucugg

SEQ ID NO: 2232633 - RNA, 23 nt, Human
aucuuaauuuugguuguauucuu

SEQ ID NO: 2232634 - RNA, 21 nt, Human
aucuguuuaaaguagauuaga

SEQ ID NO: 2232635 - RNA, 18 nt, Human
aucuuaauuuugguugua

SEQ ID NO: 2232636 - RNA, 19 nt, Human
aucuuaauuuugguuguau

SEQ ID NO: 2232637 - RNA, 22 nt, Human
aucuuaauuuugguuguauucu

SEQ ID NO: 2232638 - RNA, 23 nt, Human
aucuguuguguacguggagaggg

SEQ ID NO: 2232639 - RNA, 18 nt, Human
aucuguugcaaacucagc

SEQ ID NO: 2232640 - RNA, 12 nt, Human
aucuguuuacag

SEQ ID NO: 2232641 - RNA, 15 nt, Human
aucuguuguuuuguu

SEQ ID NO: 2232642 - RNA, 15 nt, Human
aucuuacugaaggua

SEQ ID NO: 2232643 - RNA, 14 nt, Human
aucuuacugaaggu

SEQ ID NO: 2232644 - RNA, 13 nt, Human
aucuuacagcugg

SEQ ID NO: 2232645 - RNA, 21 nt, Human
aucuguguuuuugaaauauua

SEQ ID NO: 2232646 - RNA, 18 nt, Human
aucuguguuuuugaaaua

SEQ ID NO: 2232647 - RNA, 16 nt, Human
aucuguguuuuugaaa

SEQ ID NO: 2232648 - RNA, 21 nt, Human
aucuguuguguacguggagag

SEQ ID NO: 2232649 - RNA, 19 nt, Human
aucuguucuuuaauuuauu

SEQ ID NO: 2232650 - RNA, 13 nt, Human
aucuguugcaaac

SEQ ID NO: 2232651 - RNA, 21 nt, Human
aucugugaaaugcuggcauuu

SEQ ID NO: 2232652 - RNA, 11 nt, Human
aucugugaaua

SEQ ID NO: 2232653 - RNA, 13 nt, Human
aucugugaauaag

SEQ ID NO: 2232654 - RNA, 12 nt, Human
aucugugaauaa

SEQ ID NO: 2232655 - RNA, 15 nt, Human
aucugugucuuguuu

SEQ ID NO: 2232656 - RNA, 14 nt, Human
aucuguagggcugg

SEQ ID NO: 2232657 - RNA, 16 nt, Human
aucugugaauucagau

SEQ ID NO: 2232658 - RNA, 17 nt, Human
aucugugaauucagauu

SEQ ID NO: 2232659 - RNA, 13 nt, Human
aucugugugaaaa

SEQ ID NO: 2232660 - RNA, 15 nt, Human
aucugugugaaaaug

SEQ ID NO: 2232661 - RNA, 17 nt, Human
aucugugugaaaauggg

SEQ ID NO: 2232662 - RNA, 15 nt, Human
uugaugcuggagagg

SEQ ID NO: 2232663 - RNA, 15 nt, Human
uugaugccaggacac

SEQ ID NO: 2232664 - RNA, 17 nt, Human
uugaugcuggagagguu

SEQ ID NO: 2232665 - RNA, 14 nt, Human
uugauggagauauu

SEQ ID NO: 2232666 - RNA, 15 nt, Human
uugaugggauuuggu

SEQ ID NO: 2232667 - RNA, 14 nt, Human
uugauggggaagga

SEQ ID NO: 2232668 - RNA, 13 nt, Human
uugauggguucua

SEQ ID NO: 2232669 - RNA, 21 nt, Human
uugaugguaaccauaauggaa

SEQ ID NO: 2232670 - RNA, 18 nt, Human
uugaugcuggagagguua

SEQ ID NO: 2232671 - RNA, 18 nt, Human
uugauggugguauguuuu

SEQ ID NO: 2232672 - RNA, 19 nt, Human
aucucuuauuuuacaauaa

SEQ ID NO: 2232673 - RNA, 16 nt, Human
aucucuuauuuuacaa

SEQ ID NO: 2232674 - RNA, 22 nt, Human
aucucuuagcuccccuccaacc

SEQ ID NO: 2232675 - RNA, 23 nt, Human
aucucuuagcuccccuccaaccu

SEQ ID NO: 2232676 - RNA, 22 nt, Human
aucucuuccuacccaaccacuc

SEQ ID NO: 2232677 - RNA, 23 nt, Human
uugaugcauuaaaagaaaauaaa

SEQ ID NO: 2232678 - RNA, 19 nt, Human
aucucuucuggguuccuuc

SEQ ID NO: 2232679 - RNA, 12 nt, Human
uugaugccuggc

SEQ ID NO: 2232680 - RNA, 14 nt, Human
uugauucagacagc

SEQ ID NO: 2232681 - RNA, 16 nt, Human
uugaugugugucuagg

SEQ ID NO: 2232682 - RNA, 20 nt, Human
uugauguguuuauuuauaga

SEQ ID NO: 2232683 - RNA, 11 nt, Human
uugauguguuu

SEQ ID NO: 2232684 - RNA, 23 nt, Human
uugauggugaugaaauguaaaua

SEQ ID NO: 2232685 - RNA, 19 nt, Human
uugauggugguauguuuuc

SEQ ID NO: 2232686 - RNA, 20 nt, Human
uugauguacagucugucaug

SEQ ID NO: 2232687 - RNA, 19 nt, Human
uugauguacagucugucau

SEQ ID NO: 2232688 - RNA, 19 nt, Human
uugcacaaaccaauuaaac

SEQ ID NO: 2232689 - RNA, 19 nt, Human
uugcacaauauugaacuuu

SEQ ID NO: 2232690 - RNA, 20 nt, Human
uugcacaauauugaacuuuu

SEQ ID NO: 2232691 - RNA, 21 nt, Human
uugcacaauauugaacuuuuu

SEQ ID NO: 2232692 - RNA, 15 nt, Human
uugauucagacagcu

SEQ ID NO: 2232693 - RNA, 16 nt, Human
uugauucagacagcug

SEQ ID NO: 2232694 - RNA, 13 nt, Human
uugcacacuugug

SEQ ID NO: 2232695 - RNA, 22 nt, Human
uugcacacuccccugcacugga

SEQ ID NO: 2232696 - RNA, 17 nt, Human
uugcacacuccccugca

SEQ ID NO: 2232697 - RNA, 21 nt, Human
uugcacacccacucagcuccg

SEQ ID NO: 2232698 - RNA, 19 nt, Human
uugcacacccacucagcuc

SEQ ID NO: 2232699 - RNA, 13 nt, Human
uugcacaugucuu

SEQ ID NO: 2232700 - RNA, 15 nt, Human
uugcacaugucuuaa

SEQ ID NO: 2232701 - RNA, 16 nt, Human
uugcacaugucuuaau

SEQ ID NO: 2232702 - RNA, 16 nt, Human
uugcacagcuaugaag

SEQ ID NO: 2232703 - RNA, 16 nt, Human
uugcacaguuagcaaa

SEQ ID NO: 2232704 - RNA, 21 nt, Human
uugcaucuggguagcuguaag

SEQ ID NO: 2232705 - RNA, 13 nt, Human
uugcaucuguaua

SEQ ID NO: 2232706 - RNA, 14 nt, Human
uugcaucuguauaa

SEQ ID NO: 2232707 - RNA, 19 nt, Human
uugcaucuguauaaguaag

SEQ ID NO: 2232708 - RNA, 23 nt, Human
uugcaucuguauaaguaagaaaa

SEQ ID NO: 2232709 - RNA, 20 nt, Human
uugcaucuggguagcuguaa

SEQ ID NO: 2232710 - RNA, 19 nt, Human
uugcaucuggguagcugua

SEQ ID NO: 2232711 - RNA, 18 nt, Human
uugcaucuggguagcugu

SEQ ID NO: 2232712 - RNA, 18 nt, Human
uugcauccaacuccagga

SEQ ID NO: 2232713 - RNA, 15 nt, Human
uugcaugugacucug

SEQ ID NO: 2232714 - RNA, 20 nt, Human
uugcaugugaaaaucaaaua

SEQ ID NO: 2232715 - RNA, 14 nt, Human
uugcaugugaaaau

SEQ ID NO: 2232716 - RNA, 17 nt, Human
uugcaugugacucugaa

SEQ ID NO: 2232717 - RNA, 16 nt, Human
uugcaugugacucuga

SEQ ID NO: 2232718 - RNA, 17 nt, Human
uugcauguuccacuaac

SEQ ID NO: 2232719 - RNA, 19 nt, Human
uugcauguuccacuaaccc

SEQ ID NO: 2232720 - RNA, 15 nt, Human
uugcauguggaucaa

SEQ ID NO: 2232721 - RNA, 14 nt, Human
uugcaucugaaaau

SEQ ID NO: 2232722 - RNA, 20 nt, Human
uugcaucucccagauaaugu

SEQ ID NO: 2232723 - RNA, 22 nt, Human
uugcacaugucuuaaugaaguu

SEQ ID NO: 2232724 - RNA, 17 nt, Human
uugcacaugucuuaaug

SEQ ID NO: 2232725 - RNA, 21 nt, Human
uugcacaugucuuaaugaagu

SEQ ID NO: 2232726 - RNA, 16 nt, Human
uugcacauguuuccuc

SEQ ID NO: 2232727 - RNA, 17 nt, Human
aucucagugcuguaaaa

SEQ ID NO: 2232728 - RNA, 23 nt, Human
aucucagugguuaagauuccuaa

SEQ ID NO: 2232729 - RNA, 21 nt, Human
aucucauuuccaagcaaguau

SEQ ID NO: 2232730 - RNA, 17 nt, Human
aucucauagguugccaa

SEQ ID NO: 2232731 - RNA, 23 nt, Human
aucucauagguugccaauaauac

SEQ ID NO: 2232732 - RNA, 15 nt, Human
aucuccacuccagau

SEQ ID NO: 2232733 - RNA, 13 nt, Human
aucuccaaaauaa

SEQ ID NO: 2232734 - RNA, 20 nt, Human
aucuccaggauugaagagca

SEQ ID NO: 2232735 - RNA, 12 nt, Human
aucuccaggauu

SEQ ID NO: 2232736 - RNA, 19 nt, Human
aucuccagggaguccccuc

SEQ ID NO: 2232737 - RNA, 20 nt, Human
aucuccagggaguccccucc

SEQ ID NO: 2232738 - RNA, 21 nt, Human
aucuccagggaguccccuccc

SEQ ID NO: 2232739 - RNA, 15 nt, Human
aucuccaguauucuu

SEQ ID NO: 2232740 - RNA, 19 nt, Human
aucucauagguugccaaua

SEQ ID NO: 2232741 - RNA, 15 nt, Human
aucucaucuaucuca

SEQ ID NO: 2232742 - RNA, 23 nt, Human
aucucauuuccaagcaaguauua

SEQ ID NO: 2232743 - RNA, 16 nt, Human
aucuccccaucauugg

SEQ ID NO: 2232744 - RNA, 20 nt, Human
aucucccaccuagcagcacc

SEQ ID NO: 2232745 - RNA, 19 nt, Human
aucucccagauaaugugaa

SEQ ID NO: 2232746 - RNA, 20 nt, Human
aucucccagauaaugugaaa

SEQ ID NO: 2232747 - RNA, 19 nt, Human
aucucccaccuagcagcac

SEQ ID NO: 2232748 - RNA, 18 nt, Human
aucucccaccuagcagca

SEQ ID NO: 2232749 - RNA, 18 nt, Human
aucuccaguauucuuguc

SEQ ID NO: 2232750 - RNA, 14 nt, Human
aucuccauggcuuc

SEQ ID NO: 2232751 - RNA, 15 nt, Human
aucuccauggcuucc

SEQ ID NO: 2232752 - RNA, 17 nt, Human
aucuccauggcuuccuc

SEQ ID NO: 2232753 - RNA, 18 nt, Human
aucuccauggcuuccucc

SEQ ID NO: 2232754 - RNA, 19 nt, Human
aucuccauggcuuccuccu

SEQ ID NO: 2232755 - RNA, 22 nt, Human
aucuccauggcuuccuccuccc

SEQ ID NO: 2232756 - RNA, 14 nt, Human
aucucccccagccc

SEQ ID NO: 2232757 - RNA, 18 nt, Human
aucucuuagcauuuuaau

SEQ ID NO: 2232758 - RNA, 14 nt, Human
aucuccccacucua

SEQ ID NO: 2232759 - RNA, 13 nt, Human
aucuccccacucu

SEQ ID NO: 2232760 - RNA, 13 nt, Human
aucucuuagcucc

SEQ ID NO: 2232761 - RNA, 16 nt, Human
aucucuuagcuccccu

SEQ ID NO: 2232762 - RNA, 18 nt, Human
aucucuuagcuccccucc

SEQ ID NO: 2232763 - RNA, 19 nt, Human
aucucuuagcuccccucca

SEQ ID NO: 2232764 - RNA, 12 nt, Human
aucucccccagc

SEQ ID NO: 2232765 - RNA, 13 nt, Human
aucucccccagcc

SEQ ID NO: 2232766 - RNA, 13 nt, Human
auccuaugcaaua

SEQ ID NO: 2232767 - RNA, 23 nt, Human
auccuaucagccugucucuucca

SEQ ID NO: 2232768 - RNA, 13 nt, Human
auccuagugcuuu

SEQ ID NO: 2232769 - RNA, 20 nt, Human
auccuaucagccugucucuu

SEQ ID NO: 2232770 - RNA, 19 nt, Human
auccuaucaacaacaaggu

SEQ ID NO: 2232771 - RNA, 15 nt, Human
auccuaguuccacca

SEQ ID NO: 2232772 - RNA, 19 nt, Human
auccuaguuccaccaucaa

SEQ ID NO: 2232773 - RNA, 16 nt, Human
aucucacacaugagca

SEQ ID NO: 2232774 - RNA, 16 nt, Human
aucucaauucuucccu

SEQ ID NO: 2232775 - RNA, 14 nt, Human
aucucaauucuucc

SEQ ID NO: 2232776 - RNA, 15 nt, Human
aucucacacaugagc

SEQ ID NO: 2232777 - RNA, 13 nt, Human
aucucaauauuuc

SEQ ID NO: 2232778 - RNA, 19 nt, Human
aucucacuuuucuccauga

SEQ ID NO: 2232779 - RNA, 15 nt, Human
aucucacuuuucucc

SEQ ID NO: 2232780 - RNA, 18 nt, Human
aucucacuugugccaaca

SEQ ID NO: 2232781 - RNA, 22 nt, Human
aucucacuugugccaacacuca

SEQ ID NO: 2232782 - RNA, 13 nt, Human
aucucacuugugc

SEQ ID NO: 2232783 - RNA, 11 nt, Human
aucucagccca

SEQ ID NO: 2232784 - RNA, 20 nt, Human
aucucagaucaguguaccau

SEQ ID NO: 2232785 - RNA, 20 nt, Human
aucucagaauuccuuuucua

SEQ ID NO: 2232786 - RNA, 17 nt, Human
aucucaggccaccugcc

SEQ ID NO: 2232787 - RNA, 15 nt, Human
aucucaggccaccug

SEQ ID NO: 2232788 - RNA, 14 nt, Human
aucucaggccaccu

SEQ ID NO: 2232789 - RNA, 20 nt, Human
aucucaggccaccugccccc

SEQ ID NO: 2232790 - RNA, 19 nt, Human
aucucaggccaccugcccc

SEQ ID NO: 2232791 - RNA, 23 nt, Human
uuggggggggcccgccuggcaga

SEQ ID NO: 2232792 - RNA, 16 nt, Human
uugggggcugugggga

SEQ ID NO: 2232793 - RNA, 14 nt, Human
uugggggcuggugc

SEQ ID NO: 2232794 - RNA, 16 nt, Human
uugggggcuggugcca

SEQ ID NO: 2232795 - RNA, 22 nt, Human
uuggggggcugaggugggagga

SEQ ID NO: 2232796 - RNA, 14 nt, Human
uugguucccuugug

SEQ ID NO: 2232797 - RNA, 20 nt, Human
uuggggggguggccgcugag

SEQ ID NO: 2232798 - RNA, 13 nt, Human
uuggggggguggc

SEQ ID NO: 2232799 - RNA, 16 nt, Human
uuggggcuugacuuuu

SEQ ID NO: 2232800 - RNA, 21 nt, Human
uuggggcgaggcagaggacag

SEQ ID NO: 2232801 - RNA, 12 nt, Human
uugggggcuggu

SEQ ID NO: 2232802 - RNA, 15 nt, Human
uuggggcuuauuuuu

SEQ ID NO: 2232803 - RNA, 18 nt, Human
uugggggacagggcuggc

SEQ ID NO: 2232804 - RNA, 21 nt, Human
uugggggacagggcuggccca

SEQ ID NO: 2232805 - RNA, 23 nt, Human
uugggggacagggcuggcccagc

SEQ ID NO: 2232806 - RNA, 17 nt, Human
uuggggcgaggcagagg

SEQ ID NO: 2232807 - RNA, 19 nt, Human
uugggccugcuccagaccu

SEQ ID NO: 2232808 - RNA, 12 nt, Human
uugggcccuccu

SEQ ID NO: 2232809 - RNA, 13 nt, Human
uugggcccaggga

SEQ ID NO: 2232810 - RNA, 14 nt, Human
uugggccccagccu

SEQ ID NO: 2232811 - RNA, 18 nt, Human
uugggccccagaggcugg

SEQ ID NO: 2232812 - RNA, 12 nt, Human
uugggcccagcu

SEQ ID NO: 2232813 - RNA, 16 nt, Human
uugggcccagcugggc

SEQ ID NO: 2232814 - RNA, 17 nt, Human
uugggcccagcugggcu

SEQ ID NO: 2232815 - RNA, 18 nt, Human
uugggcccagcugggcuc

SEQ ID NO: 2232816 - RNA, 22 nt, Human
uugggcccagcugggcucugcc

SEQ ID NO: 2232817 - RNA, 11 nt, Human
uugggcccagg

SEQ ID NO: 2232818 - RNA, 14 nt, Human
uuggggauauuuuu

SEQ ID NO: 2232819 - RNA, 17 nt, Human
uugggccugcuccagac

SEQ ID NO: 2232820 - RNA, 16 nt, Human
uugggccugcuccaga

SEQ ID NO: 2232821 - RNA, 13 nt, Human
augaauuaaauuu

SEQ ID NO: 2232822 - RNA, 17 nt, Human
uugggccauacuggccu

SEQ ID NO: 2232823 - RNA, 16 nt, Human
uugggccauacuggcc

SEQ ID NO: 2232824 - RNA, 23 nt, Human
uugggccauacuggccucgccug

SEQ ID NO: 2232825 - RNA, 18 nt, Human
uugggccauacuggccuc

SEQ ID NO: 2232826 - RNA, 19 nt, Human
uugggccauacuggccucg

SEQ ID NO: 2232827 - RNA, 17 nt, Human
uugggccagacaugcca

SEQ ID NO: 2232828 - RNA, 16 nt, Human
augaauuaaauaaacc

SEQ ID NO: 2232829 - RNA, 14 nt, Human
uugggccagacaug

SEQ ID NO: 2232830 - RNA, 21 nt, Human
augaaugugugugguuuuuuu

SEQ ID NO: 2232831 - RNA, 12 nt, Human
augaauguguaa

SEQ ID NO: 2232832 - RNA, 11 nt, Human
augaauguuua

SEQ ID NO: 2232833 - RNA, 22 nt, Human
augaauguuuacacucuuugua

SEQ ID NO: 2232834 - RNA, 14 nt, Human
augaauuaaauaaa

SEQ ID NO: 2232835 - RNA, 14 nt, Human
augaauuaaagugg

SEQ ID NO: 2232836 - RNA, 24 nt, Human
augaaccuucuggccucccacaga

SEQ ID NO: 2232837 - RNA, 21 nt, Human
augaaccuucuggccucccac

SEQ ID NO: 2232838 - RNA, 16 nt, Human
augaacggugagcauu

SEQ ID NO: 2232839 - RNA, 13 nt, Human
augaacuauuccc

SEQ ID NO: 2232840 - RNA, 15 nt, Human
augaacggugagcau

SEQ ID NO: 2232841 - RNA, 14 nt, Human
augaacugaaguuu

SEQ ID NO: 2232842 - RNA, 20 nt, Human
augaacuauuccccagcagg

SEQ ID NO: 2232843 - RNA, 20 nt, Human
augaacucuuagaaaugaag

SEQ ID NO: 2232844 - RNA, 14 nt, Human
augaacucaacuuu

SEQ ID NO: 2232845 - RNA, 16 nt, Human
augaacucuuaaucaa

SEQ ID NO: 2232846 - RNA, 15 nt, Human
augaacugaaguuuc

SEQ ID NO: 2232847 - RNA, 16 nt, Human
augaacugaaguuuca

SEQ ID NO: 2232848 - RNA, 17 nt, Human
augaacugaaguuucac

SEQ ID NO: 2232849 - RNA, 19 nt, Human
augaacugaaguuucacau

SEQ ID NO: 2232850 - RNA, 20 nt, Human
augaacugaaguuucacaug

SEQ ID NO: 2232851 - RNA, 15 nt, Human
augaaagggcccaga

SEQ ID NO: 2232852 - RNA, 18 nt, Human
augaaauauuauguuaaa

SEQ ID NO: 2232853 - RNA, 13 nt, Human
augaaauauuaug

SEQ ID NO: 2232854 - RNA, 17 nt, Human
augaaauauuauguuaa

SEQ ID NO: 2232855 - RNA, 16 nt, Human
augaacuuauucugua

SEQ ID NO: 2232856 - RNA, 22 nt, Human
augaagauauuuuuccauuuuu

SEQ ID NO: 2232857 - RNA, 20 nt, Human
augaagaucauauacgugaa

SEQ ID NO: 2232858 - RNA, 13 nt, Human
augaaugaauggc

SEQ ID NO: 2232859 - RNA, 18 nt, Human
augaagauguagaggaga

SEQ ID NO: 2232860 - RNA, 15 nt, Human
augaaugcacacuag

SEQ ID NO: 2232861 - RNA, 20 nt, Human
augaaugaggucccaggcag

SEQ ID NO: 2232862 - RNA, 19 nt, Human
augaaugaggucccaggca

SEQ ID NO: 2232863 - RNA, 16 nt, Human
augaaugagaaucuac

SEQ ID NO: 2232864 - RNA, 18 nt, Human
augaaugcccccagcugg

SEQ ID NO: 2232865 - RNA, 20 nt, Human
augaaugcccccagcuggcc

SEQ ID NO: 2232866 - RNA, 21 nt, Human
augaaugcccccagcuggccc

SEQ ID NO: 2232867 - RNA, 20 nt, Human
augaaugucagugugacuga

SEQ ID NO: 2232868 - RNA, 20 nt, Human
uuggaugggagugagacaga

SEQ ID NO: 2232869 - RNA, 21 nt, Human
uuggauggaguccagggaaga

SEQ ID NO: 2232870 - RNA, 21 nt, Human
uuggaugggagugagacagaa

SEQ ID NO: 2232871 - RNA, 23 nt, Human
uuggaugcagugcucgcuguugc

SEQ ID NO: 2232872 - RNA, 24 nt, Human
uuggaugcagugcucgcuguugcu

SEQ ID NO: 2232873 - RNA, 13 nt, Human
uuggauuauucau

SEQ ID NO: 2232874 - RNA, 17 nt, Human
uuggauuauucauuuaa

SEQ ID NO: 2232875 - RNA, 18 nt, Human
uuggauuauucauuuaaa

SEQ ID NO: 2232876 - RNA, 22 nt, Human
uuggauaaugcuguugccucau

SEQ ID NO: 2232877 - RNA, 19 nt, Human
uuggaucuucaauggcuuu

SEQ ID NO: 2232878 - RNA, 23 nt, Human
aucuugcuuuuuuucaccaauau

SEQ ID NO: 2232879 - RNA, 22 nt, Human
aucuugcucuguaaucucguuu

SEQ ID NO: 2232880 - RNA, 23 nt, Human
aucuugcuucccuaaucuauggu

SEQ ID NO: 2232881 - RNA, 22 nt, Human
uuggagugaguguggcuccccu

SEQ ID NO: 2232882 - RNA, 22 nt, Human
uuggaguguuccccuuccacug

SEQ ID NO: 2232883 - RNA, 19 nt, Human
uuggaguguuccccuucca

SEQ ID NO: 2232884 - RNA, 14 nt, Human
uuggcgggccaagg

SEQ ID NO: 2232885 - RNA, 17 nt, Human
uuggauuauuuaauaac

SEQ ID NO: 2232886 - RNA, 14 nt, Human
uuggauuauuuaau

SEQ ID NO: 2232887 - RNA, 15 nt, Human
uuggauuauuuaaua

SEQ ID NO: 2232888 - RNA, 18 nt, Human
uuggcuagagguucaaag

SEQ ID NO: 2232889 - RNA, 20 nt, Human
uuggauuauucauuuaaaau

SEQ ID NO: 2232890 - RNA, 23 nt, Human
uuggauuauucauuuaaaaugau

SEQ ID NO: 2232891 - RNA, 23 nt, Human
uuggcgcugccccuggcagcccc

SEQ ID NO: 2232892 - RNA, 20 nt, Human
uuggcuaacuauauuugcuu

SEQ ID NO: 2232893 - RNA, 13 nt, Human
uuggcucuggaga

SEQ ID NO: 2232894 - RNA, 22 nt, Human
uuggcucgaaucucugugccuu

SEQ ID NO: 2232895 - RNA, 23 nt, Human
uuggcugagauaugaacauauug

SEQ ID NO: 2232896 - RNA, 22 nt, Human
uuggcugaaauucuccuggagg

SEQ ID NO: 2232897 - RNA, 20 nt, Human
uuggcugaaauucuccugga

SEQ ID NO: 2232898 - RNA, 21 nt, Human
uuggcugaaauucuccuggag

SEQ ID NO: 2232899 - RNA, 14 nt, Human
uuggcucuggagac

SEQ ID NO: 2232900 - RNA, 17 nt, Human
uuggcucuggagacagc

SEQ ID NO: 2232901 - RNA, 19 nt, Human
uuggcucuggagacagccc

SEQ ID NO: 2232902 - RNA, 19 nt, Human
uuggcugaaauucuccugg

SEQ ID NO: 2232903 - RNA, 20 nt, Human
uuggcucuggagacagcccc

SEQ ID NO: 2232904 - RNA, 22 nt, Human
uuggcucuggagacagccccag

SEQ ID NO: 2232905 - RNA, 14 nt, Human
aucuuuugugagau

SEQ ID NO: 2232906 - RNA, 23 nt, Human
aucuuuugugagauguaauuguu

SEQ ID NO: 2232907 - RNA, 19 nt, Human
aucuuugcagguugcuuug

SEQ ID NO: 2232908 - RNA, 22 nt, Human
aucuuugccuugggcugcuccu

SEQ ID NO: 2232909 - RNA, 23 nt, Human
aucuuuggacagaagcagcucuu

SEQ ID NO: 2232910 - RNA, 13 nt, Human
aucuuuuuauuca

SEQ ID NO: 2232911 - RNA, 13 nt, Human
aucuuuuucuaac

SEQ ID NO: 2232912 - RNA, 18 nt, Human
augaaagcauguggcaug

SEQ ID NO: 2232913 - RNA, 12 nt, Human
augaaagcaugu

SEQ ID NO: 2232914 - RNA, 22 nt, Human
augaaagcuccucgagggcagg

SEQ ID NO: 2232915 - RNA, 23 nt, Human
aucuuuuuuagcauaaaauuuuc

SEQ ID NO: 2232916 - RNA, 19 nt, Human
aucuuuuuuagcauaaaau

SEQ ID NO: 2232917 - RNA, 18 nt, Human
aucuuuuuuagcauaaaa

SEQ ID NO: 2232918 - RNA, 16 nt, Human
aucuuuuuuagcauaa

SEQ ID NO: 2232919 - RNA, 14 nt, Human
aucuuuuucucuaa

SEQ ID NO: 2232920 - RNA, 15 nt, Human
augaaagcagggacu

SEQ ID NO: 2232921 - RNA, 13 nt, Human
aucuuugccuugg

SEQ ID NO: 2232922 - RNA, 15 nt, Human
aucuuugccacccuc

SEQ ID NO: 2232923 - RNA, 16 nt, Human
aucuuugccacccuca

SEQ ID NO: 2232924 - RNA, 20 nt, Human
aucuuugccuugggcugcuc

SEQ ID NO: 2232925 - RNA, 14 nt, Human
aucuuugccuuggg

SEQ ID NO: 2232926 - RNA, 22 nt, Human
aucuuuggacagaagcagcucu

SEQ ID NO: 2232927 - RNA, 18 nt, Human
aucuuugcagacaggcaa

SEQ ID NO: 2232928 - RNA, 23 nt, Human
uuggcucuggagacagccccaga

SEQ ID NO: 2232929 - RNA, 14 nt, Human
aucuuuauuaauca

SEQ ID NO: 2232930 - RNA, 13 nt, Human
aucuuuauuaauc

SEQ ID NO: 2232931 - RNA, 14 nt, Human
aucuuugccacccu

SEQ ID NO: 2232932 - RNA, 13 nt, Human
uuggcugcaggga

SEQ ID NO: 2232933 - RNA, 21 nt, Human
aucuuuacaaaacuacaugag

SEQ ID NO: 2232934 - RNA, 17 nt, Human
aucuuuacaaaacuaca

SEQ ID NO: 2232935 - RNA, 22 nt, Human
aucuuuaauuuuacauuuccua

SEQ ID NO: 2232936 - RNA, 16 nt, Human
aucuuuaauuuuacau

SEQ ID NO: 2232937 - RNA, 21 nt, Human
aucuuuaauuuuacauuuccu

SEQ ID NO: 2232938 - RNA, 18 nt, Human
uugguugucaauauuaaa

SEQ ID NO: 2232939 - RNA, 12 nt, Human
uugguuguauuc

SEQ ID NO: 2232940 - RNA, 15 nt, Human
uugguuggcuggccu

SEQ ID NO: 2232941 - RNA, 13 nt, Human
uugguuguauucu

SEQ ID NO: 2232942 - RNA, 16 nt, Human
uugguuguauucuuug

SEQ ID NO: 2232943 - RNA, 12 nt, Human
uugguugucaau

SEQ ID NO: 2232944 - RNA, 22 nt, Human
uugguugucaauauuaaauaca

SEQ ID NO: 2232945 - RNA, 13 nt, Human
uugguucuggggc

SEQ ID NO: 2232946 - RNA, 14 nt, Human
uugguucuggggcc

SEQ ID NO: 2232947 - RNA, 13 nt, Human
uugguucuguguc

SEQ ID NO: 2232948 - RNA, 15 nt, Human
uugguucuaauagaa

SEQ ID NO: 2232949 - RNA, 19 nt, Human
uugguucuaauagaacuca

SEQ ID NO: 2232950 - RNA, 16 nt, Human
uugguugaauaaacua

SEQ ID NO: 2232951 - RNA, 13 nt, Human
uugguugaauaaa

SEQ ID NO: 2232952 - RNA, 20 nt, Human
uugguugaaaauaaaaagau

SEQ ID NO: 2232953 - RNA, 22 nt, Human
uugguucuugguagagauucau

SEQ ID NO: 2232954 - RNA, 16 nt, Human
uugguugcuuuaauau

SEQ ID NO: 2232955 - RNA, 13 nt, Human
uugguugcuuuaa

SEQ ID NO: 2232956 - RNA, 19 nt, Human
uuguaggggucaaagaaau

SEQ ID NO: 2232957 - RNA, 18 nt, Human
uuguaguaaagaaauuua

SEQ ID NO: 2232958 - RNA, 15 nt, Human
uuguaguagucucau

SEQ ID NO: 2232959 - RNA, 20 nt, Human
uuguaguagucucauuacuu

SEQ ID NO: 2232960 - RNA, 16 nt, Human
uuguauaaaauaauuu

SEQ ID NO: 2232961 - RNA, 15 nt, Human
uuguauaaaauaauu

SEQ ID NO: 2232962 - RNA, 20 nt, Human
uuguaggcgaaucauuuguu

SEQ ID NO: 2232963 - RNA, 16 nt, Human
uuguagggaugccuuu

SEQ ID NO: 2232964 - RNA, 17 nt, Human
uuguaggggucaaagaa

SEQ ID NO: 2232965 - RNA, 20 nt, Human
uuguaggggucaaagaaaug

SEQ ID NO: 2232966 - RNA, 23 nt, Human
uuguacaaaauaaacaaauaaca

SEQ ID NO: 2232967 - RNA, 16 nt, Human
uuguauauugucagau

SEQ ID NO: 2232968 - RNA, 15 nt, Human
uuguauauuguguuu

SEQ ID NO: 2232969 - RNA, 13 nt, Human
uuguauauugugu

SEQ ID NO: 2232970 - RNA, 15 nt, Human
uuguauaguaaagug

SEQ ID NO: 2232971 - RNA, 14 nt, Human
uuguauaguaaagu

SEQ ID NO: 2232972 - RNA, 18 nt, Human
uuguauagguagauguuc

SEQ ID NO: 2232973 - RNA, 14 nt, Human
uuguauaguguaaa

SEQ ID NO: 2232974 - RNA, 15 nt, Human
uuguauaguguaaaa

SEQ ID NO: 2232975 - RNA, 16 nt, Human
uuguauaguguaaaau

SEQ ID NO: 2232976 - RNA, 17 nt, Human
uuguauagagauaugca

SEQ ID NO: 2232977 - RNA, 16 nt, Human
uuguauaauuguaucg

SEQ ID NO: 2232978 - RNA, 17 nt, Human
uuguauaauuguaucgu

SEQ ID NO: 2232979 - RNA, 17 nt, Human
uuguauaaaauaauuuu

SEQ ID NO: 2232980 - RNA, 15 nt, Human
uuguauaauuguauc

SEQ ID NO: 2232981 - RNA, 21 nt, Human
augaauuuggagacucugugg

SEQ ID NO: 2232982 - RNA, 20 nt, Human
augaauuuggagacucugug

SEQ ID NO: 2232983 - RNA, 15 nt, Human
augaauuuggagacu

SEQ ID NO: 2232984 - RNA, 11 nt, Human
augaauuuaaa

SEQ ID NO: 2232985 - RNA, 13 nt, Human
augaauugcauuu

SEQ ID NO: 2232986 - RNA, 18 nt, Human
uuguauauuuguacaaaa

SEQ ID NO: 2232987 - RNA, 13 nt, Human
augaauuuaaaua

SEQ ID NO: 2232988 - RNA, 14 nt, Human
augaauuuaaauau

SEQ ID NO: 2232989 - RNA, 16 nt, Human
augaauuuaaauauaa

SEQ ID NO: 2232990 - RNA, 19 nt, Human
uuguauauugucagauauu

SEQ ID NO: 2232991 - RNA, 13 nt, Human
uuguauauuugua

SEQ ID NO: 2232992 - RNA, 19 nt, Human
uuguauauuguguuugugu

SEQ ID NO: 2232993 - RNA, 14 nt, Human
uuguauauuuguac

SEQ ID NO: 2232994 - RNA, 15 nt, Human
uuguauauuuguaca

SEQ ID NO: 2232995 - RNA, 16 nt, Human
uuguauauuuguacaa

SEQ ID NO: 2232996 - RNA, 17 nt, Human
uuguauauuuguacaaa

SEQ ID NO: 2232997 - RNA, 16 nt, Human
uuguaucacaaaucuu

SEQ ID NO: 2232998 - RNA, 18 nt, Human
augaauuuucaaguaauu

SEQ ID NO: 2232999 - RNA, 22 nt, Human
augaauuuucaaguaauuguga

SEQ ID NO: 2233000 - RNA, 23 nt, Human
augaauuuuguuuggacuucuuu

SEQ ID NO: 2233001 - RNA, 23 nt, Human
augaauuuaaauauaauucugua

SEQ ID NO: 2233002 - RNA, 22 nt, Human
augacacaugcaaggucauuuu

SEQ ID NO: 2233003 - RNA, 14 nt, Human
augacacaugcaag

SEQ ID NO: 2233004 - RNA, 15 nt, Human
augagaagagggccu

SEQ ID NO: 2233005 - RNA, 16 nt, Human
augagaaggaacuucc

SEQ ID NO: 2233006 - RNA, 16 nt, Human
augagaagagggccug

SEQ ID NO: 2233007 - RNA, 18 nt, Human
augagaagagggccugug

SEQ ID NO: 2233008 - RNA, 18 nt, Human
augagaaggaauuugagu

SEQ ID NO: 2233009 - RNA, 21 nt, Human
augagaagagggccuguggga

SEQ ID NO: 2233010 - RNA, 15 nt, Human
augagaaggcagcca

SEQ ID NO: 2233011 - RNA, 22 nt, Human
augagaaguugauauagaacag

SEQ ID NO: 2233012 - RNA, 23 nt, Human
augagaaucuacccccagaucca

SEQ ID NO: 2233013 - RNA, 11 nt, Human
augagaaucua

SEQ ID NO: 2233014 - RNA, 18 nt, Human
augagacaggaccuagga

SEQ ID NO: 2233015 - RNA, 21 nt, Human
augagaauuugagugcucuga

SEQ ID NO: 2233016 - RNA, 21 nt, Human
augagacccauuccuauuucu

SEQ ID NO: 2233017 - RNA, 18 nt, Human
augagaccacuguuauca

SEQ ID NO: 2233018 - RNA, 20 nt, Human
augagacaggaccuaggaua

SEQ ID NO: 2233019 - RNA, 22 nt, Human
augagacauaggccaugaaaaa

SEQ ID NO: 2233020 - RNA, 13 nt, Human
augagagacacac

SEQ ID NO: 2233021 - RNA, 14 nt, Human
augagagacacacu

SEQ ID NO: 2233022 - RNA, 17 nt, Human
augagagacacacugaa

SEQ ID NO: 2233023 - RNA, 19 nt, Human
augagagacacacugaaga

SEQ ID NO: 2233024 - RNA, 14 nt, Human
augagaacucugag

SEQ ID NO: 2233025 - RNA, 23 nt, Human
augagaaaucuaaaaaacgaaaa

SEQ ID NO: 2233026 - RNA, 13 nt, Human
augagaacaaaca

SEQ ID NO: 2233027 - RNA, 21 nt, Human
augagaaagguugaagcacca

SEQ ID NO: 2233028 - RNA, 22 nt, Human
augagaaagguugaagcaccaa

SEQ ID NO: 2233029 - RNA, 15 nt, Human
augagaaaucuaaaa

SEQ ID NO: 2233030 - RNA, 18 nt, Human
augagaaaucuaaaaaac

SEQ ID NO: 2233031 - RNA, 21 nt, Human
augacauuucuuugugcuuug

SEQ ID NO: 2233032 - RNA, 22 nt, Human
augacauuucuuugugcuuugg

SEQ ID NO: 2233033 - RNA, 14 nt, Human
augacauuuugcca

SEQ ID NO: 2233034 - RNA, 18 nt, Human
augacauuuauuuuucau

SEQ ID NO: 2233035 - RNA, 22 nt, Human
augacauuuauaucacauguuu

SEQ ID NO: 2233036 - RNA, 23 nt, Human
augaccaauauuauacuaagaaa

SEQ ID NO: 2233037 - RNA, 17 nt, Human
augacauuuugccaaaa

SEQ ID NO: 2233038 - RNA, 15 nt, Human
augaccaaaguccuu

SEQ ID NO: 2233039 - RNA, 14 nt, Human
augacuuacuguac

SEQ ID NO: 2233040 - RNA, 22 nt, Human
augacuuaagcacacuugacau

SEQ ID NO: 2233041 - RNA, 18 nt, Human
augacauucaugccuggc

SEQ ID NO: 2233042 - RNA, 13 nt, Human
augacauugcuaa

SEQ ID NO: 2233043 - RNA, 14 nt, Human
augacauugcuaag

SEQ ID NO: 2233044 - RNA, 20 nt, Human
augacauugcuaagaugcuc

SEQ ID NO: 2233045 - RNA, 23 nt, Human
augacauugcuaagaugcucuau

SEQ ID NO: 2233046 - RNA, 21 nt, Human
augaauuuuuuucaucuucuc

SEQ ID NO: 2233047 - RNA, 22 nt, Human
augaauuuuuuucaucuucucu

SEQ ID NO: 2233048 - RNA, 17 nt, Human
augacacauuuggcagu

SEQ ID NO: 2233049 - RNA, 18 nt, Human
augacacgaauauugcug

SEQ ID NO: 2233050 - RNA, 14 nt, Human
augagaaaagaggc

SEQ ID NO: 2233051 - RNA, 17 nt, Human
augacuuuuccauguau

SEQ ID NO: 2233052 - RNA, 12 nt, Human
augacuuuggac

SEQ ID NO: 2233053 - RNA, 20 nt, Human
augacuuuuccauguaucua

SEQ ID NO: 2233054 - RNA, 16 nt, Human
augacuuuauugcauc

SEQ ID NO: 2233055 - RNA, 13 nt, Human
augacuuuauugc

SEQ ID NO: 2233056 - RNA, 23 nt, Human
augacuuuauauggaugauucag

SEQ ID NO: 2233057 - RNA, 21 nt, Human
augacuuuauugcaucugggu

SEQ ID NO: 2233058 - RNA, 11 nt, Human
augacuuugga

SEQ ID NO: 2233059 - RNA, 16 nt, Human
augacuucauuaauaa

SEQ ID NO: 2233060 - RNA, 17 nt, Human
augacuuacuguacaug

SEQ ID NO: 2233061 - RNA, 16 nt, Human
augacuuacuguacau

SEQ ID NO: 2233062 - RNA, 17 nt, Human
auggcuaauucccagag

SEQ ID NO: 2233063 - RNA, 18 nt, Human
auggcgcagugccucugg

SEQ ID NO: 2233064 - RNA, 16 nt, Human
auggcuaauucccaga

SEQ ID NO: 2233065 - RNA, 21 nt, Human
auggcuauaaacaauuacaug

SEQ ID NO: 2233066 - RNA, 20 nt, Human
auggcuaguaucaaaagaaa

SEQ ID NO: 2233067 - RNA, 19 nt, Human
auggccuugcagcacucac

SEQ ID NO: 2233068 - RNA, 12 nt, Human
auggccuggcca

SEQ ID NO: 2233069 - RNA, 14 nt, Human
auggcgcagugccu

SEQ ID NO: 2233070 - RNA, 16 nt, Human
auggcgcagugccucu

SEQ ID NO: 2233071 - RNA, 17 nt, Human
auggcgcagugccucug

SEQ ID NO: 2233072 - RNA, 19 nt, Human
auggcgcagugccucuggu

SEQ ID NO: 2233073 - RNA, 15 nt, Human
auggcgggugggggu

SEQ ID NO: 2233074 - RNA, 15 nt, Human
auggccguuggccac

SEQ ID NO: 2233075 - RNA, 18 nt, Human
auggccuaugcacauaug

SEQ ID NO: 2233076 - RNA, 20 nt, Human
auggccuauuauauuaaaau

SEQ ID NO: 2233077 - RNA, 21 nt, Human
auggccuauuauauuaaaaua

SEQ ID NO: 2233078 - RNA, 14 nt, Human
auggccucagcugc

SEQ ID NO: 2233079 - RNA, 13 nt, Human
auggccucagcug

SEQ ID NO: 2233080 - RNA, 21 nt, Human
auggccucaagaucaaugaaa

SEQ ID NO: 2233081 - RNA, 20 nt, Human
auggccugccuugaagccac

SEQ ID NO: 2233082 - RNA, 19 nt, Human
auggccugccuugaagcca

SEQ ID NO: 2233083 - RNA, 16 nt, Human
auggccugggggaugu

SEQ ID NO: 2233084 - RNA, 20 nt, Human
auggccuuugcuugaaagaa

SEQ ID NO: 2233085 - RNA, 13 nt, Human
auggccggccggg

SEQ ID NO: 2233086 - RNA, 18 nt, Human
auggccggagaggaccgg

SEQ ID NO: 2233087 - RNA, 16 nt, Human
auggccagugucuguc

SEQ ID NO: 2233088 - RNA, 21 nt, Human
auggccgggcgcgguggcuca

SEQ ID NO: 2233089 - RNA, 22 nt, Human
auggccagguggccacuccaga

SEQ ID NO: 2233090 - RNA, 15 nt, Human
auggccagugucugu

SEQ ID NO: 2233091 - RNA, 16 nt, Human
auggccagguggccac

SEQ ID NO: 2233092 - RNA, 22 nt, Human
auggccacaguagucuugauga

SEQ ID NO: 2233093 - RNA, 16 nt, Human
auggccaccuuuucag

SEQ ID NO: 2233094 - RNA, 17 nt, Human
auggccaccuuuucagc

SEQ ID NO: 2233095 - RNA, 21 nt, Human
auggcagaaggcaaacccauc

SEQ ID NO: 2233096 - RNA, 19 nt, Human
auggcagaggaauaucaau

SEQ ID NO: 2233097 - RNA, 15 nt, Human
auggcagaguuguaa

SEQ ID NO: 2233098 - RNA, 20 nt, Human
auggcagaaggcaaacccau

SEQ ID NO: 2233099 - RNA, 15 nt, Human
auggcagaaggcaaa

SEQ ID NO: 2233100 - RNA, 17 nt, Human
auggcagaguuguaaau

SEQ ID NO: 2233101 - RNA, 18 nt, Human
auggcagaguuguaaaua

SEQ ID NO: 2233102 - RNA, 20 nt, Human
auggcagaguuguaaauaua

SEQ ID NO: 2233103 - RNA, 21 nt, Human
auggcagaguuguaaauauau

SEQ ID NO: 2233104 - RNA, 19 nt, Human
auggcagaguuuguguguu

SEQ ID NO: 2233105 - RNA, 20 nt, Human
auggcagaguuuguguguug

SEQ ID NO: 2233106 - RNA, 22 nt, Human
auggcagaguuuguguguuguc

SEQ ID NO: 2233107 - RNA, 23 nt, Human
auggcagaguuuguguguugucu

SEQ ID NO: 2233108 - RNA, 23 nt, Human
auggcacagcccaaagaaggaaa

SEQ ID NO: 2233109 - RNA, 23 nt, Human
auggcaauucuuugaccucaacc

SEQ ID NO: 2233110 - RNA, 22 nt, Human
auggcacaaucucggcucacug

SEQ ID NO: 2233111 - RNA, 16 nt, Human
auggcaauuuuguaac

SEQ ID NO: 2233112 - RNA, 15 nt, Human
auggcaauuuuguaa

SEQ ID NO: 2233113 - RNA, 19 nt, Human
auggcaaggacugcaggga

SEQ ID NO: 2233114 - RNA, 23 nt, Human
auggcaagaaagcugguaaacua

SEQ ID NO: 2233115 - RNA, 18 nt, Human
auggcaaggcagcccugu

SEQ ID NO: 2233116 - RNA, 21 nt, Human
auggcaaggcagcccugucug

SEQ ID NO: 2233117 - RNA, 17 nt, Human
auggcaacagaucugga

SEQ ID NO: 2233118 - RNA, 16 nt, Human
auggcaacagaucugg

SEQ ID NO: 2233119 - RNA, 24 nt, Human
auggcaacagaucuggaaccucag

SEQ ID NO: 2233120 - RNA, 19 nt, Human
auggcaccaaagccaccag

SEQ ID NO: 2233121 - RNA, 16 nt, Human
auggcagaagacacca

SEQ ID NO: 2233122 - RNA, 13 nt, Human
auggcagaagaca

SEQ ID NO: 2233123 - RNA, 13 nt, Human
auggcagaaggca

SEQ ID NO: 2233124 - RNA, 22 nt, Human
auggcagaagacaccagagcag

SEQ ID NO: 2233125 - RNA, 24 nt, Human
auggcagaagacaccagagcagau

SEQ ID NO: 2233126 - RNA, 17 nt, Human
auggcagaagacaccag

SEQ ID NO: 2233127 - RNA, 19 nt, Human
auggcagaagacaccagag

SEQ ID NO: 2233128 - RNA, 20 nt, Human
auggcagaagacaccagagc

SEQ ID NO: 2233129 - RNA, 21 nt, Human
auggcagaagacaccagagca

SEQ ID NO: 2233130 - RNA, 23 nt, Human
auggcacaucagcacgauuucug

SEQ ID NO: 2233131 - RNA, 17 nt, Human
auggcacaucagcacga

SEQ ID NO: 2233132 - RNA, 14 nt, Human
auggauuugccugu

SEQ ID NO: 2233133 - RNA, 18 nt, Human
auggauuuucuauuguua

SEQ ID NO: 2233134 - RNA, 21 nt, Human
auggauuugccugugccaccc

SEQ ID NO: 2233135 - RNA, 20 nt, Human
auggauuuucuauuguuacu

SEQ ID NO: 2233136 - RNA, 21 nt, Human
auggauuuucuauuguuacuc

SEQ ID NO: 2233137 - RNA, 14 nt, Human
auggauuugaagca

SEQ ID NO: 2233138 - RNA, 15 nt, Human
auggauuugaagcaa

SEQ ID NO: 2233139 - RNA, 17 nt, Human
auggauuugaugcuguu

SEQ ID NO: 2233140 - RNA, 19 nt, Human
auggauuugaugcuguuug

SEQ ID NO: 2233141 - RNA, 14 nt, Human
auggcaaaaauggc

SEQ ID NO: 2233142 - RNA, 18 nt, Human
auggcaaaggaaggugga

SEQ ID NO: 2233143 - RNA, 15 nt, Human
auggcaacagaucug

SEQ ID NO: 2233144 - RNA, 14 nt, Human
auggcaacagaucu

SEQ ID NO: 2233145 - RNA, 18 nt, Human
auggauuuccagccaaag

SEQ ID NO: 2233146 - RNA, 23 nt, Human
auggacguguuaugacuccagaa

SEQ ID NO: 2233147 - RNA, 19 nt, Human
auggacguguuaugacucc

SEQ ID NO: 2233148 - RNA, 20 nt, Human
auggacguguuaugacucca

SEQ ID NO: 2233149 - RNA, 13 nt, Human
uuucauauuucuu

SEQ ID NO: 2233150 - RNA, 15 nt, Human
uuucauauguugcuc

SEQ ID NO: 2233151 - RNA, 12 nt, Human
uuucauauugug

SEQ ID NO: 2233152 - RNA, 14 nt, Human
uuucauauugugcc

SEQ ID NO: 2233153 - RNA, 15 nt, Human
uuucauauugugcca

SEQ ID NO: 2233154 - RNA, 13 nt, Human
uuucauauuuuag

SEQ ID NO: 2233155 - RNA, 21 nt, Human
uuucauauuuuagcuacuaua

SEQ ID NO: 2233156 - RNA, 17 nt, Human
uuucaucauauuauaca

SEQ ID NO: 2233157 - RNA, 16 nt, Human
uuucaucauauuauac

SEQ ID NO: 2233158 - RNA, 19 nt, Human
uuucaucaaucauuguaca

SEQ ID NO: 2233159 - RNA, 21 nt, Human
uuucaucaaucauuguacagu

SEQ ID NO: 2233160 - RNA, 22 nt, Human
uuucaucugcucuccuuccugg

SEQ ID NO: 2233161 - RNA, 14 nt, Human
uuucaucugggaaa

SEQ ID NO: 2233162 - RNA, 15 nt, Human
uuucaucugggaaag

SEQ ID NO: 2233163 - RNA, 14 nt, Human
uuucagaccccagc

SEQ ID NO: 2233164 - RNA, 10 nt, Human
uuucagaccc

SEQ ID NO: 2233165 - RNA, 11 nt, Human
uuucagacucc

SEQ ID NO: 2233166 - RNA, 22 nt, Human
uuucauauguugcucagucucc

SEQ ID NO: 2233167 - RNA, 23 nt, Human
uuucagaaccucuuccccagaaa

SEQ ID NO: 2233168 - RNA, 20 nt, Human
uuucagaaccucuuccccag

SEQ ID NO: 2233169 - RNA, 19 nt, Human
uuucagaaccucuucccca

SEQ ID NO: 2233170 - RNA, 18 nt, Human
uuucagaaccucuucccc

SEQ ID NO: 2233171 - RNA, 22 nt, Human
uuucagaagugagcuuugcugc

SEQ ID NO: 2233172 - RNA, 20 nt, Human
uuucacugcugcaaggccuu

SEQ ID NO: 2233173 - RNA, 21 nt, Human
uuucagaagugagcuuugcug

SEQ ID NO: 2233174 - RNA, 22 nt, Human
auggaauacaguguuauuuucu

SEQ ID NO: 2233175 - RNA, 17 nt, Human
auggaauacaguguuau

SEQ ID NO: 2233176 - RNA, 20 nt, Human
auggaaucuaccaacuguuu

SEQ ID NO: 2233177 - RNA, 21 nt, Human
auggaaugaugggucaguugu

SEQ ID NO: 2233178 - RNA, 16 nt, Human
auggaaugcuguguua

SEQ ID NO: 2233179 - RNA, 16 nt, Human
auggaauacaguguua

SEQ ID NO: 2233180 - RNA, 15 nt, Human
auggaauacaguguu

SEQ ID NO: 2233181 - RNA, 16 nt, Human
auggaagacacauuga

SEQ ID NO: 2233182 - RNA, 16 nt, Human
auggaauaacucugug

SEQ ID NO: 2233183 - RNA, 16 nt, Human
auggaagacagcucuu

SEQ ID NO: 2233184 - RNA, 20 nt, Human
uuucacugcuggcugccuua

SEQ ID NO: 2233185 - RNA, 22 nt, Human
uuucacugcuggcugccuuaga

SEQ ID NO: 2233186 - RNA, 13 nt, Human
uuucagaaaugug

SEQ ID NO: 2233187 - RNA, 14 nt, Human
uuucacugcuggcu

SEQ ID NO: 2233188 - RNA, 13 nt, Human
uuucacugccaua

SEQ ID NO: 2233189 - RNA, 17 nt, Human
uuucacugcuggcugcc

SEQ ID NO: 2233190 - RNA, 18 nt, Human
uuucacugcuggcugccu

SEQ ID NO: 2233191 - RNA, 19 nt, Human
auggacagaagaaggcagc

SEQ ID NO: 2233192 - RNA, 20 nt, Human
auggacagaagaaggcagca

SEQ ID NO: 2233193 - RNA, 14 nt, Human
auggacaggcuggc

SEQ ID NO: 2233194 - RNA, 19 nt, Human
auggacaggcuggcuccag

SEQ ID NO: 2233195 - RNA, 18 nt, Human
auggacagggcaugccac

SEQ ID NO: 2233196 - RNA, 14 nt, Human
auggacaugaucuu

SEQ ID NO: 2233197 - RNA, 21 nt, Human
auggacggugcuccaggcagg

SEQ ID NO: 2233198 - RNA, 22 nt, Human
auggacggugcuccaggcaggc

SEQ ID NO: 2233199 - RNA, 19 nt, Human
uuuccccccacucucccca

SEQ ID NO: 2233200 - RNA, 17 nt, Human
uuuccccccacucuccc

SEQ ID NO: 2233201 - RNA, 13 nt, Human
uuuccccccacuc

SEQ ID NO: 2233202 - RNA, 12 nt, Human
uuuccccccacu

SEQ ID NO: 2233203 - RNA, 21 nt, Human
uuuccccaggggaaaaugaag

SEQ ID NO: 2233204 - RNA, 23 nt, Human
uuuccccauuuagguuucugagu

SEQ ID NO: 2233205 - RNA, 19 nt, Human
uuuccccaggggaaaauga

SEQ ID NO: 2233206 - RNA, 11 nt, Human
uuuccccagcc

SEQ ID NO: 2233207 - RNA, 13 nt, Human
uuuccccagccca

SEQ ID NO: 2233208 - RNA, 16 nt, Human
uuucccauggggaggg

SEQ ID NO: 2233209 - RNA, 18 nt, Human
uuuccccaacagugugaa

SEQ ID NO: 2233210 - RNA, 19 nt, Human
uuuccccaacagugugaag

SEQ ID NO: 2233211 - RNA, 14 nt, Human
uuuccccaaagucu

SEQ ID NO: 2233212 - RNA, 21 nt, Human
uuuccccaaagucuuaaaaua

SEQ ID NO: 2233213 - RNA, 14 nt, Human
uuuccccaacagug

SEQ ID NO: 2233214 - RNA, 15 nt, Human
uuuccccaacagugu

SEQ ID NO: 2233215 - RNA, 21 nt, Human
uuucaugauuagcaaguuaca

SEQ ID NO: 2233216 - RNA, 19 nt, Human
uuucaucugggaaagacau

SEQ ID NO: 2233217 - RNA, 16 nt, Human
uuucaucugggaaaga

SEQ ID NO: 2233218 - RNA, 18 nt, Human
uuucaucugggaaagaca

SEQ ID NO: 2233219 - RNA, 19 nt, Human
uuucaugcuaucucugugu

SEQ ID NO: 2233220 - RNA, 16 nt, Human
uuucaugcuaucucug

SEQ ID NO: 2233221 - RNA, 16 nt, Human
uuucaugauuuugaaa

SEQ ID NO: 2233222 - RNA, 16 nt, Human
uuucauuaaagcauuu

SEQ ID NO: 2233223 - RNA, 14 nt, Human
uuucauuaaaggcu

SEQ ID NO: 2233224 - RNA, 14 nt, Human
uuucauuaaagcau

SEQ ID NO: 2233225 - RNA, 18 nt, Human
uuucauguuuugugacua

SEQ ID NO: 2233226 - RNA, 13 nt, Human
uuucauuaaagca

SEQ ID NO: 2233227 - RNA, 16 nt, Human
uuucauguuuugugac

SEQ ID NO: 2233228 - RNA, 17 nt, Human
uuucauguuuugugacu

SEQ ID NO: 2233229 - RNA, 16 nt, Human
uuucauuaaaggcuuc

SEQ ID NO: 2233230 - RNA, 23 nt, Human
uuucauuaaaggcuucucucuca

SEQ ID NO: 2233231 - RNA, 16 nt, Human
uuucauguuuuaacaa

SEQ ID NO: 2233232 - RNA, 19 nt, Human
uuucauguuuuaacaaaaa

SEQ ID NO: 2233233 - RNA, 17 nt, Human
uuucauguuuuaacaaa

SEQ ID NO: 2233234 - RNA, 23 nt, Human
uuucauguugcacacccacucag

SEQ ID NO: 2233235 - RNA, 23 nt, Human
uuucaugugcggggaucaucugc

SEQ ID NO: 2233236 - RNA, 18 nt, Human
uuuaggaaaugaaugugu

SEQ ID NO: 2233237 - RNA, 22 nt, Human
uuuagcuggaaaaguauguuag

SEQ ID NO: 2233238 - RNA, 15 nt, Human
uuuaguagagacagg

SEQ ID NO: 2233239 - RNA, 17 nt, Human
uuuaggagauuuuaggu

SEQ ID NO: 2233240 - RNA, 13 nt, Human
uuuaggagauuuu

SEQ ID NO: 2233241 - RNA, 21 nt, Human
uuuaguagauauuaccaguuu

SEQ ID NO: 2233242 - RNA, 23 nt, Human
uuuaguagauauuaccaguuuuc

SEQ ID NO: 2233243 - RNA, 16 nt, Human
uuuaguaucuuuuuau

SEQ ID NO: 2233244 - RNA, 17 nt, Human
uuuauagcuauuacugu

SEQ ID NO: 2233245 - RNA, 18 nt, Human
uuuagucugcaaaaugag

SEQ ID NO: 2233246 - RNA, 20 nt, Human
uuuauagcuauuacugucug

SEQ ID NO: 2233247 - RNA, 15 nt, Human
uuuagucaugugacc

SEQ ID NO: 2233248 - RNA, 12 nt, Human
uuuagucacuuu

SEQ ID NO: 2233249 - RNA, 16 nt, Human
uuuagucugcaaaaug

SEQ ID NO: 2233250 - RNA, 22 nt, Human
uuuagcagcagccuuuaaugca

SEQ ID NO: 2233251 - RNA, 23 nt, Human
uuuagcaauuuaauauuuugcac

SEQ ID NO: 2233252 - RNA, 22 nt, Human
uuuagcaauuuaauauuuugca

SEQ ID NO: 2233253 - RNA, 20 nt, Human
uuuagcuggaaaaguauguu

SEQ ID NO: 2233254 - RNA, 11 nt, Human
uuuagaugcug

SEQ ID NO: 2233255 - RNA, 19 nt, Human
uuuagauugaaaacuuuuc

SEQ ID NO: 2233256 - RNA, 13 nt, Human
uuuagaugcugau

SEQ ID NO: 2233257 - RNA, 22 nt, Human
uuuagauugaaaacuuuucuca

SEQ ID NO: 2233258 - RNA, 15 nt, Human
augccccagagcugu

SEQ ID NO: 2233259 - RNA, 13 nt, Human
augcccccagcug

SEQ ID NO: 2233260 - RNA, 14 nt, Human
augcccccagcugg

SEQ ID NO: 2233261 - RNA, 15 nt, Human
augcccccagcuggc

SEQ ID NO: 2233262 - RNA, 16 nt, Human
augcccccagcuggcc

SEQ ID NO: 2233263 - RNA, 13 nt, Human
augccccccucaa

SEQ ID NO: 2233264 - RNA, 15 nt, Human
augcccccucgugcc

SEQ ID NO: 2233265 - RNA, 21 nt, Human
augccccccucaaaccuccuc

SEQ ID NO: 2233266 - RNA, 22 nt, Human
augccccccucaaaccuccucu

SEQ ID NO: 2233267 - RNA, 18 nt, Human
augcccccucgugccagu

SEQ ID NO: 2233268 - RNA, 17 nt, Human
augcccccucgugccag

SEQ ID NO: 2233269 - RNA, 19 nt, Human
augccccggccaccucugc

SEQ ID NO: 2233270 - RNA, 20 nt, Human
augccccggccaccucugcg

SEQ ID NO: 2233271 - RNA, 13 nt, Human
augcccccuuuca

SEQ ID NO: 2233272 - RNA, 18 nt, Human
augcccccuuucagaugu

SEQ ID NO: 2233273 - RNA, 19 nt, Human
augcccccuuucagauguc

SEQ ID NO: 2233274 - RNA, 21 nt, Human
augcccccuuucagaugucuu

SEQ ID NO: 2233275 - RNA, 15 nt, Human
augccccggccaccu

SEQ ID NO: 2233276 - RNA, 16 nt, Human
augccccggccaccuc

SEQ ID NO: 2233277 - RNA, 17 nt, Human
augccccggccaccucu

SEQ ID NO: 2233278 - RNA, 18 nt, Human
augccccggccaccucug

SEQ ID NO: 2233279 - RNA, 22 nt, Human
uuuaugggucagaguuccgacu

SEQ ID NO: 2233280 - RNA, 14 nt, Human
uuuauauaaaugcu

SEQ ID NO: 2233281 - RNA, 24 nt, Human
uuuauggcuuuugugcauuaucua

SEQ ID NO: 2233282 - RNA, 22 nt, Human
uuuauggggcugaacggggaga

SEQ ID NO: 2233283 - RNA, 21 nt, Human
uuuaugguuucccccuucuac

SEQ ID NO: 2233284 - RNA, 17 nt, Human
uuuauaguuuguacaug

SEQ ID NO: 2233285 - RNA, 19 nt, Human
uuuauaguuuguacaugca

SEQ ID NO: 2233286 - RNA, 20 nt, Human
uuuauggcuuuugugcauua

SEQ ID NO: 2233287 - RNA, 16 nt, Human
uuuauagcucaguuua

SEQ ID NO: 2233288 - RNA, 13 nt, Human
uuuauauaagcuu

SEQ ID NO: 2233289 - RNA, 22 nt, Human
uuuaugugugaggagcugcugg

SEQ ID NO: 2233290 - RNA, 18 nt, Human
uuuaugugugaggagcug

SEQ ID NO: 2233291 - RNA, 12 nt, Human
uuuaugugaugg

SEQ ID NO: 2233292 - RNA, 13 nt, Human
uuuaugugugugu

SEQ ID NO: 2233293 - RNA, 11 nt, Human
uuuaugugugu

SEQ ID NO: 2233294 - RNA, 13 nt, Human
uuuauguuauuua

SEQ ID NO: 2233295 - RNA, 20 nt, Human
uuuauguuaagggaagaauu

SEQ ID NO: 2233296 - RNA, 20 nt, Human
uuuauguuacuacaugcacu

SEQ ID NO: 2233297 - RNA, 16 nt, Human
uuuauuaaaaucuuaa

SEQ ID NO: 2233298 - RNA, 14 nt, Human
uuuauuaaaaugau

SEQ ID NO: 2233299 - RNA, 15 nt, Human
uuuauuaaaaucuua

SEQ ID NO: 2233300 - RNA, 14 nt, Human
uuuauuaaaaucuu

SEQ ID NO: 2233301 - RNA, 13 nt, Human
uuuauuaaaaucu

SEQ ID NO: 2233302 - RNA, 21 nt, Human
uuuauuaaaaugauuguaaaa

SEQ ID NO: 2233303 - RNA, 22 nt, Human
uuuauuaaaaugauuguaaaau

SEQ ID NO: 2233304 - RNA, 23 nt, Human
uuuauuaaaaugauuguaaaaua

SEQ ID NO: 2233305 - RNA, 17 nt, Human
uuuauuaaacagauuuu

SEQ ID NO: 2233306 - RNA, 23 nt, Human
uuuauguuugcacuugugauuau

SEQ ID NO: 2233307 - RNA, 13 nt, Human
augcugguuuuuc

SEQ ID NO: 2233308 - RNA, 22 nt, Human
augcuguaacuuucugaaauaa

SEQ ID NO: 2233309 - RNA, 22 nt, Human
augcugguuuuccuaaaugcag

SEQ ID NO: 2233310 - RNA, 21 nt, Human
augcugguuuuccuaaaugca

SEQ ID NO: 2233311 - RNA, 23 nt, Human
augcuggcccagggcccagagcc

SEQ ID NO: 2233312 - RNA, 22 nt, Human
augcuggcccagggcccagagc

SEQ ID NO: 2233313 - RNA, 21 nt, Human
augcuggcccagggcccagag

SEQ ID NO: 2233314 - RNA, 20 nt, Human
augcuggcccagggcccaga

SEQ ID NO: 2233315 - RNA, 19 nt, Human
augcuggcccagggcccag

SEQ ID NO: 2233316 - RNA, 23 nt, Human
augcuggcauuugcaccuaccuc

SEQ ID NO: 2233317 - RNA, 12 nt, Human
augcuggcccag

SEQ ID NO: 2233318 - RNA, 22 nt, Human
augcuggaugucugccaauuuu

SEQ ID NO: 2233319 - RNA, 18 nt, Human
augcuggcccagggccca

SEQ ID NO: 2233320 - RNA, 16 nt, Human
augcuggcccagggcc

SEQ ID NO: 2233321 - RNA, 15 nt, Human
augcuggcccagggc

SEQ ID NO: 2233322 - RNA, 13 nt, Human
augcuggcccagg

SEQ ID NO: 2233323 - RNA, 22 nt, Human
augcucucugcagccagcccag

SEQ ID NO: 2233324 - RNA, 21 nt, Human
augcucucugcagccagccca

SEQ ID NO: 2233325 - RNA, 19 nt, Human
augcucucugcagccagcc

SEQ ID NO: 2233326 - RNA, 13 nt, Human
augcucucugcag

SEQ ID NO: 2233327 - RNA, 14 nt, Human
augcucuccuuucc

SEQ ID NO: 2233328 - RNA, 19 nt, Human
augcuggaugucugccaau

SEQ ID NO: 2233329 - RNA, 23 nt, Human
augcucucugcagccagcccagc

SEQ ID NO: 2233330 - RNA, 15 nt, Human
augcucugcauguua

SEQ ID NO: 2233331 - RNA, 16 nt, Human
uuuauuacaucuuuca

SEQ ID NO: 2233332 - RNA, 22 nt, Human
uuuauuaaacagauuuuuacaa

SEQ ID NO: 2233333 - RNA, 13 nt, Human
uuuauuaccucug

SEQ ID NO: 2233334 - RNA, 23 nt, Human
uuuauuacccccuccuucagaca

SEQ ID NO: 2233335 - RNA, 17 nt, Human
uuuauuacccccuccuu

SEQ ID NO: 2233336 - RNA, 12 nt, Human
uuuauuaccccc

SEQ ID NO: 2233337 - RNA, 14 nt, Human
uuuauuaccucuga

SEQ ID NO: 2233338 - RNA, 20 nt, Human
uuuauuaccucugauaccuc

SEQ ID NO: 2233339 - RNA, 13 nt, Human
uuuauuacugauu

SEQ ID NO: 2233340 - RNA, 15 nt, Human
augcuagaacucccu

SEQ ID NO: 2233341 - RNA, 19 nt, Human
augcuagaacucccuuuca

SEQ ID NO: 2233342 - RNA, 16 nt, Human
augcuagaacucccuu

SEQ ID NO: 2233343 - RNA, 17 nt, Human
augcucuagugccuucu

SEQ ID NO: 2233344 - RNA, 16 nt, Human
augcucuagugccuuc

SEQ ID NO: 2233345 - RNA, 19 nt, Human
augcucuaucuugcucugu

SEQ ID NO: 2233346 - RNA, 21 nt, Human
augcucuaucuugcucuguaa

SEQ ID NO: 2233347 - RNA, 18 nt, Human
augcuccuuguuccuaga

SEQ ID NO: 2233348 - RNA, 15 nt, Human
augcuccuuguuccu

SEQ ID NO: 2233349 - RNA, 16 nt, Human
augcuccuugggcccu

SEQ ID NO: 2233350 - RNA, 15 nt, Human
augcuccuugggccc

SEQ ID NO: 2233351 - RNA, 22 nt, Human
augcuacuuuauuuauacacug

SEQ ID NO: 2233352 - RNA, 19 nt, Human
auggaacucauuccugccu

SEQ ID NO: 2233353 - RNA, 16 nt, Human
auggaacacucugaga

SEQ ID NO: 2233354 - RNA, 22 nt, Human
auggaacucauuccugccuguc

SEQ ID NO: 2233355 - RNA, 18 nt, Human
auggaacuucuaauauau

SEQ ID NO: 2233356 - RNA, 19 nt, Human
auggaacuucuaauauauu

SEQ ID NO: 2233357 - RNA, 13 nt, Human
auggaagacacau

SEQ ID NO: 2233358 - RNA, 14 nt, Human
auggaagacacauu

SEQ ID NO: 2233359 - RNA, 15 nt, Human
auggaagacagcucu

SEQ ID NO: 2233360 - RNA, 11 nt, Human
auggaacacuc

SEQ ID NO: 2233361 - RNA, 23 nt, Human
augcuucauacagggaugguguu

SEQ ID NO: 2233362 - RNA, 22 nt, Human
augcuguacaucuauuuuggau

SEQ ID NO: 2233363 - RNA, 14 nt, Human
auggaacacucuga

SEQ ID NO: 2233364 - RNA, 15 nt, Human
auggaacacucugag

SEQ ID NO: 2233365 - RNA, 19 nt, Human
augcugucccuuacgugag

SEQ ID NO: 2233366 - RNA, 16 nt, Human
augcuguacaucuauu

SEQ ID NO: 2233367 - RNA, 12 nt, Human
augcuguacauc

SEQ ID NO: 2233368 - RNA, 23 nt, Human
augcugucccuuacgugaguccu

SEQ ID NO: 2233369 - RNA, 22 nt, Human
augcugucuacacuaagagaga

SEQ ID NO: 2233370 - RNA, 10 nt, Human
augcuucaua

SEQ ID NO: 2233371 - RNA, 21 nt, Human
augcuuauuuuaaaauuuuau

SEQ ID NO: 2233372 - RNA, 12 nt, Human
augcuucauaca

SEQ ID NO: 2233373 - RNA, 11 nt, Human
augcuucauac

SEQ ID NO: 2233374 - RNA, 19 nt, Human
augcuucauacagggaugg

SEQ ID NO: 2233375 - RNA, 16 nt, Human
augcuucauacaggga

SEQ ID NO: 2233376 - RNA, 15 nt, Human
augcuucauacaggg

SEQ ID NO: 2233377 - RNA, 13 nt, Human
augcuucauacag

SEQ ID NO: 2233378 - RNA, 15 nt, Human
augcaguauugagca

SEQ ID NO: 2233379 - RNA, 16 nt, Human
augcagugaauuguga

SEQ ID NO: 2233380 - RNA, 18 nt, Human
augcagugccccuagcuu

SEQ ID NO: 2233381 - RNA, 18 nt, Human
augcagugauauggcaga

SEQ ID NO: 2233382 - RNA, 19 nt, Human
augcagugauauggcagaa

SEQ ID NO: 2233383 - RNA, 21 nt, Human
augcagugauauggcagaaga

SEQ ID NO: 2233384 - RNA, 22 nt, Human
augcagugauauggcagaagac

SEQ ID NO: 2233385 - RNA, 13 nt, Human
augcagugcucgc

SEQ ID NO: 2233386 - RNA, 17 nt, Human
augcagugcucgcuguu

SEQ ID NO: 2233387 - RNA, 19 nt, Human
augcagugcucgcuguugc

SEQ ID NO: 2233388 - RNA, 20 nt, Human
augcagugcucgcuguugcu

SEQ ID NO: 2233389 - RNA, 21 nt, Human
augcagugcucgcuguugcug

SEQ ID NO: 2233390 - RNA, 23 nt, Human
augcagugcucgcuguugcugaa

SEQ ID NO: 2233391 - RNA, 24 nt, Human
augcagugcucgcuguugcugaau

SEQ ID NO: 2233392 - RNA, 23 nt, Human
augcagugauauggcagaagaca

SEQ ID NO: 2233393 - RNA, 15 nt, Human
augcaguucugaaga

SEQ ID NO: 2233394 - RNA, 17 nt, Human
augcaguucugaagaag

SEQ ID NO: 2233395 - RNA, 15 nt, Human
augcagggcagucau

SEQ ID NO: 2233396 - RNA, 22 nt, Human
augcagggauugcugccacuuu

SEQ ID NO: 2233397 - RNA, 19 nt, Human
augcagggccucacacggu

SEQ ID NO: 2233398 - RNA, 17 nt, Human
augcagccucacagucc

SEQ ID NO: 2233399 - RNA, 13 nt, Human
augcagggcaguc

SEQ ID NO: 2233400 - RNA, 19 nt, Human
augcagggauugcugccac

SEQ ID NO: 2233401 - RNA, 20 nt, Human
augcagggauugcugccacu

SEQ ID NO: 2233402 - RNA, 14 nt, Human
augcagccucacag

SEQ ID NO: 2233403 - RNA, 15 nt, Human
augcagccucacagu

SEQ ID NO: 2233404 - RNA, 21 nt, Human
augcagccgugaucaagggaa

SEQ ID NO: 2233405 - RNA, 15 nt, Human
uuuaauuuuguauuu

SEQ ID NO: 2233406 - RNA, 16 nt, Human
uuuaauuuuguauuuu

SEQ ID NO: 2233407 - RNA, 13 nt, Human
augcagccucaca

SEQ ID NO: 2233408 - RNA, 21 nt, Human
uuuaauuugauaucacagucu

SEQ ID NO: 2233409 - RNA, 22 nt, Human
uuuaauuuugacacuauaucug

SEQ ID NO: 2233410 - RNA, 11 nt, Human
uuuaauuuugu

SEQ ID NO: 2233411 - RNA, 15 nt, Human
augcaguuuuccuua

SEQ ID NO: 2233412 - RNA, 15 nt, Human
augcauaaagucagu

SEQ ID NO: 2233413 - RNA, 17 nt, Human
augcaguuuuucagagu

SEQ ID NO: 2233414 - RNA, 22 nt, Human
augcaguuuuucagaguggaau

SEQ ID NO: 2233415 - RNA, 18 nt, Human
augcaguucugaagaaga

SEQ ID NO: 2233416 - RNA, 19 nt, Human
augcaguucugaagaagau

SEQ ID NO: 2233417 - RNA, 22 nt, Human
augccaaagcuaggguggcccu

SEQ ID NO: 2233418 - RNA, 21 nt, Human
augcauaaauaugcagugaua

SEQ ID NO: 2233419 - RNA, 14 nt, Human
augcauaaauaugc

SEQ ID NO: 2233420 - RNA, 15 nt, Human
augcauaaauaugca

SEQ ID NO: 2233421 - RNA, 16 nt, Human
augcauaaauaugcag

SEQ ID NO: 2233422 - RNA, 17 nt, Human
augcauaaauaugcagu

SEQ ID NO: 2233423 - RNA, 20 nt, Human
augccaaauuguaguucuug

SEQ ID NO: 2233424 - RNA, 14 nt, Human
augccaacuugucc

SEQ ID NO: 2233425 - RNA, 23 nt, Human
augccaagaaguuuaaggaauau

SEQ ID NO: 2233426 - RNA, 16 nt, Human
augccaagcacugugc

SEQ ID NO: 2233427 - RNA, 17 nt, Human
augccaagcacugugcu

SEQ ID NO: 2233428 - RNA, 21 nt, Human
augccaagcacugugcucagg

SEQ ID NO: 2233429 - RNA, 18 nt, Human
augccaagcacugugcuc

SEQ ID NO: 2233430 - RNA, 19 nt, Human
augccaagcacugugcuca

SEQ ID NO: 2233431 - RNA, 16 nt, Human
augccaaguuguuuga

SEQ ID NO: 2233432 - RNA, 14 nt, Human
augccaaguuguuu

SEQ ID NO: 2233433 - RNA, 19 nt, Human
augcccaccugcccaucac

SEQ ID NO: 2233434 - RNA, 16 nt, Human
augcccaccugcccau

SEQ ID NO: 2233435 - RNA, 15 nt, Human
augcccaccugccca

SEQ ID NO: 2233436 - RNA, 19 nt, Human
augcccacccccugcccug

SEQ ID NO: 2233437 - RNA, 20 nt, Human
augcccacccccugcccugc

SEQ ID NO: 2233438 - RNA, 21 nt, Human
augcccaccugcccaucacag

SEQ ID NO: 2233439 - RNA, 20 nt, Human
augcccaccugcccaucaca

SEQ ID NO: 2233440 - RNA, 23 nt, Human
augcccagagggcccaggcaggc

SEQ ID NO: 2233441 - RNA, 22 nt, Human
augcccagagggcccaggcagg

SEQ ID NO: 2233442 - RNA, 21 nt, Human
augcccagagggcccaggcag

SEQ ID NO: 2233443 - RNA, 20 nt, Human
augcccagagggcccaggca

SEQ ID NO: 2233444 - RNA, 17 nt, Human
augcccaguuucugccu

SEQ ID NO: 2233445 - RNA, 18 nt, Human
augcccaguuucugccuc

SEQ ID NO: 2233446 - RNA, 19 nt, Human
augcccaguuucugccucu

SEQ ID NO: 2233447 - RNA, 17 nt, Human
augccacgggaaguuua

SEQ ID NO: 2233448 - RNA, 20 nt, Human
augccacccuguuuucagcu

SEQ ID NO: 2233449 - RNA, 19 nt, Human
augccacccuguuuucagc

SEQ ID NO: 2233450 - RNA, 23 nt, Human
augccaaguuguuugagaaauua

SEQ ID NO: 2233451 - RNA, 14 nt, Human
augccacugccuuc

SEQ ID NO: 2233452 - RNA, 15 nt, Human
augccacugccuucg

SEQ ID NO: 2233453 - RNA, 12 nt, Human
augcccaccccc

SEQ ID NO: 2233454 - RNA, 15 nt, Human
augcccacccccugc

SEQ ID NO: 2233455 - RNA, 16 nt, Human
augcccacccccugcc

SEQ ID NO: 2233456 - RNA, 17 nt, Human
augcccacccccugccc

SEQ ID NO: 2233457 - RNA, 18 nt, Human
augcccacccccugcccu

SEQ ID NO: 2233458 - RNA, 17 nt, Human
augccacuaaauugaca

SEQ ID NO: 2233459 - RNA, 15 nt, Human
augccacuaaauuga

SEQ ID NO: 2233460 - RNA, 23 nt, Human
uuuaagcauuguuugcuuauugu

SEQ ID NO: 2233461 - RNA, 20 nt, Human
uuuaagcccaucaauuauag

SEQ ID NO: 2233462 - RNA, 19 nt, Human
uuuaagccucauauuuaaa

SEQ ID NO: 2233463 - RNA, 16 nt, Human
uuuaagugcugcauuu

SEQ ID NO: 2233464 - RNA, 15 nt, Human
uuuaagugcugcauu

SEQ ID NO: 2233465 - RNA, 14 nt, Human
uuuaaugagauaau

SEQ ID NO: 2233466 - RNA, 13 nt, Human
uuuaagcuguaaa

SEQ ID NO: 2233467 - RNA, 19 nt, Human
uuuaagugcugcauuuaaa

SEQ ID NO: 2233468 - RNA, 17 nt, Human
uuuaagugcugcauuua

SEQ ID NO: 2233469 - RNA, 14 nt, Human
uuuaauguagccau

SEQ ID NO: 2233470 - RNA, 16 nt, Human
uuuaauucauguuucu

SEQ ID NO: 2233471 - RNA, 14 nt, Human
uuuaauucauguuu

SEQ ID NO: 2233472 - RNA, 23 nt, Human
uuuaauucauguuucuuaaaugg

SEQ ID NO: 2233473 - RNA, 23 nt, Human
uuuaauucaucccaacugucuuu

SEQ ID NO: 2233474 - RNA, 16 nt, Human
uuuaauuccaauauga

SEQ ID NO: 2233475 - RNA, 20 nt, Human
uuuaauggccggcuggaaau

SEQ ID NO: 2233476 - RNA, 23 nt, Human
uuuaaugccgauauacucuagau

SEQ ID NO: 2233477 - RNA, 22 nt, Human
uuuaauggccggcuggaaaugc

SEQ ID NO: 2233478 - RNA, 20 nt, Human
uuuaauggggguagcagcug

SEQ ID NO: 2233479 - RNA, 21 nt, Human
uuuaauggggguagcagcugg

SEQ ID NO: 2233480 - RNA, 22 nt, Human
uuuaauggggguagcagcugga

SEQ ID NO: 2233481 - RNA, 21 nt, Human
uuuaauggacaugagauaaug

SEQ ID NO: 2233482 - RNA, 12 nt, Human
uuuaauuuuaca

SEQ ID NO: 2233483 - RNA, 14 nt, Human
uuuaauugauuauu

SEQ ID NO: 2233484 - RNA, 13 nt, Human
uuuaauucucuug

SEQ ID NO: 2233485 - RNA, 11 nt, Human
uuuaauucucu

SEQ ID NO: 2233486 - RNA, 21 nt, Human
uuuaauuccaauaugaugacu

SEQ ID NO: 2233487 - RNA, 11 nt, Human
uuuaauuccau

SEQ ID NO: 2233488 - RNA, 13 nt, Human
uuuaauuccauga

SEQ ID NO: 2233489 - RNA, 22 nt, Human
uuuaauuccaugaaucgcuucu

SEQ ID NO: 2233490 - RNA, 16 nt, Human
uuguuuucaguguaca

SEQ ID NO: 2233491 - RNA, 13 nt, Human
uuguuuucagugu

SEQ ID NO: 2233492 - RNA, 15 nt, Human
augcacuuuguucug

SEQ ID NO: 2233493 - RNA, 15 nt, Human
uuguuuuacugucuu

SEQ ID NO: 2233494 - RNA, 17 nt, Human
uuguuuucccgccaagc

SEQ ID NO: 2233495 - RNA, 14 nt, Human
uuguuuucauuauc

SEQ ID NO: 2233496 - RNA, 19 nt, Human
uuguuuuaucaugacaugu

SEQ ID NO: 2233497 - RNA, 15 nt, Human
uuuaaaugucuaaug

SEQ ID NO: 2233498 - RNA, 16 nt, Human
uuuaaaugucuaaugu

SEQ ID NO: 2233499 - RNA, 14 nt, Human
uuuaaauguuuuuu

SEQ ID NO: 2233500 - RNA, 12 nt, Human
uuuaagauuuuu

SEQ ID NO: 2233501 - RNA, 14 nt, Human
uuuaagauaauuau

SEQ ID NO: 2233502 - RNA, 14 nt, Human
uuuaagauuuuucu

SEQ ID NO: 2233503 - RNA, 16 nt, Human
uuuaagauuuuucuca

SEQ ID NO: 2233504 - RNA, 18 nt, Human
uuuaagauuuuucucaaa

SEQ ID NO: 2233505 - RNA, 20 nt, Human
uuuaagcacuacauaaacug

SEQ ID NO: 2233506 - RNA, 21 nt, Human
uuuaagcauuguuugcuuauu

SEQ ID NO: 2233507 - RNA, 14 nt, Human
uuuaagcauuguuu

SEQ ID NO: 2233508 - RNA, 13 nt, Human
uuuaagcagcucu

SEQ ID NO: 2233509 - RNA, 20 nt, Human
uuuaagcagcucuugcuaau

SEQ ID NO: 2233510 - RNA, 13 nt, Human
uuuaagcauuguu

SEQ ID NO: 2233511 - RNA, 17 nt, Human
uuuaagauuuuucucaa

SEQ ID NO: 2233512 - RNA, 23 nt, Human
uuuaagcacuacauaaacugacu

SEQ ID NO: 2233513 - RNA, 15 nt, Human
uuuaagauaaauuau

SEQ ID NO: 2233514 - RNA, 15 nt, Human
uuuaagauaauuaua

SEQ ID NO: 2233515 - RNA, 18 nt, Human
uuuaagauaauaauauau

SEQ ID NO: 2233516 - RNA, 23 nt, Human
uuuaagauaauaauauauguuua

SEQ ID NO: 2233517 - RNA, 15 nt, Human
uuuaagauaauaguu

SEQ ID NO: 2233518 - RNA, 20 nt, Human
uuuaagauaauaguuuacau

SEQ ID NO: 2233519 - RNA, 18 nt, Human
uuuaaaugucuaauguau

SEQ ID NO: 2233520 - RNA, 18 nt, Human
uuuaaauguuuuucuaug

SEQ ID NO: 2233521 - RNA, 20 nt, Human
uuuaaauuauaacuuaaaau

SEQ ID NO: 2233522 - RNA, 21 nt, Human
uuuaaauucacaauagaaacu

SEQ ID NO: 2233523 - RNA, 19 nt, Human
uuuaaauucacaauagaaa

SEQ ID NO: 2233524 - RNA, 21 nt, Human
uuguggccugggccuccucac

SEQ ID NO: 2233525 - RNA, 13 nt, Human
uuguggccucaga

SEQ ID NO: 2233526 - RNA, 13 nt, Human
uuguggccuggga

SEQ ID NO: 2233527 - RNA, 20 nt, Human
uuguggccaaggagcugcua

SEQ ID NO: 2233528 - RNA, 14 nt, Human
uuguggcugggggc

SEQ ID NO: 2233529 - RNA, 18 nt, Human
uuguggcuccuaucugug

SEQ ID NO: 2233530 - RNA, 19 nt, Human
uuguggcuccuaucugugu

SEQ ID NO: 2233531 - RNA, 20 nt, Human
uuguggcugucagcaggaag

SEQ ID NO: 2233532 - RNA, 15 nt, Human
uuguggcugucagca

SEQ ID NO: 2233533 - RNA, 13 nt, Human
uugugggugggag

SEQ ID NO: 2233534 - RNA, 17 nt, Human
uuguggggaugaugaaa

SEQ ID NO: 2233535 - RNA, 20 nt, Human
uugugaggcccaugguugag

SEQ ID NO: 2233536 - RNA, 18 nt, Human
uugugagccaccacgucc

SEQ ID NO: 2233537 - RNA, 22 nt, Human
uugugaguuuaguaaggcugug

SEQ ID NO: 2233538 - RNA, 22 nt, Human
uugugaguuuaccuuguauacu

SEQ ID NO: 2233539 - RNA, 18 nt, Human
uugugauacaaugcugug

SEQ ID NO: 2233540 - RNA, 12 nt, Human
uuguggccucag

SEQ ID NO: 2233541 - RNA, 11 nt, Human
uuguggccuca

SEQ ID NO: 2233542 - RNA, 19 nt, Human
uuguggccaaggagcugcu

SEQ ID NO: 2233543 - RNA, 18 nt, Human
uuguggccaaggagcugc

SEQ ID NO: 2233544 - RNA, 22 nt, Human
uugugauaaguucuaguugcuu

SEQ ID NO: 2233545 - RNA, 19 nt, Human
uugugauacaaugcugugc

SEQ ID NO: 2233546 - RNA, 19 nt, Human
uugugacuauauagagaug

SEQ ID NO: 2233547 - RNA, 15 nt, Human
uugugacuauauaga

SEQ ID NO: 2233548 - RNA, 17 nt, Human
uugugaccuuaguguuu

SEQ ID NO: 2233549 - RNA, 19 nt, Human
uugugaccuuaguguuucu

SEQ ID NO: 2233550 - RNA, 20 nt, Human
uugugaccuuaguguuucug

SEQ ID NO: 2233551 - RNA, 14 nt, Human
uugugacuaauugu

SEQ ID NO: 2233552 - RNA, 16 nt, Human
uugugacuaauuguau

SEQ ID NO: 2233553 - RNA, 20 nt, Human
uugugacuaauuguauaaca

SEQ ID NO: 2233554 - RNA, 22 nt, Human
uugugacuaauuguauaacagg

SEQ ID NO: 2233555 - RNA, 23 nt, Human
uugugacuaauuguauaacaggu

SEQ ID NO: 2233556 - RNA, 12 nt, Human
uugugagauggg

SEQ ID NO: 2233557 - RNA, 23 nt, Human
uugugacuguauauaaaggaaaa

SEQ ID NO: 2233558 - RNA, 21 nt, Human
uugugacuauauagagauguu

SEQ ID NO: 2233559 - RNA, 22 nt, Human
uugugacuauauagagauguuu

SEQ ID NO: 2233560 - RNA, 16 nt, Human
uugugacuguauauaa

SEQ ID NO: 2233561 - RNA, 22 nt, Human
uugugacuguauauaaaggaaa

SEQ ID NO: 2233562 - RNA, 21 nt, Human
uugugaggaagccgcuggggc

SEQ ID NO: 2233563 - RNA, 23 nt, Human
augagacuuccaaaccugacaga

SEQ ID NO: 2233564 - RNA, 15 nt, Human
augagacuugcucuc

SEQ ID NO: 2233565 - RNA, 20 nt, Human
uugugaccugaaguucacca

SEQ ID NO: 2233566 - RNA, 16 nt, Human
uugugaccuuaguguu

SEQ ID NO: 2233567 - RNA, 23 nt, Human
augagagacacacugaagaagca

SEQ ID NO: 2233568 - RNA, 20 nt, Human
augagagacacacugaagaa

SEQ ID NO: 2233569 - RNA, 21 nt, Human
augagagacacacugaagaag

SEQ ID NO: 2233570 - RNA, 23 nt, Human
uuguucugugguuuuccccuccc

SEQ ID NO: 2233571 - RNA, 13 nt, Human
uuguguguuucac

SEQ ID NO: 2233572 - RNA, 12 nt, Human
uuguuggccucc

SEQ ID NO: 2233573 - RNA, 18 nt, Human
uuguuggccuccggccuc

SEQ ID NO: 2233574 - RNA, 21 nt, Human
uuguuggccuccggccucccc

SEQ ID NO: 2233575 - RNA, 20 nt, Human
uuguucuggcucuuccaggc

SEQ ID NO: 2233576 - RNA, 22 nt, Human
uuguucuggcucuuccaggcug

SEQ ID NO: 2233577 - RNA, 21 nt, Human
uuguguguuauuuaaaugagu

SEQ ID NO: 2233578 - RNA, 20 nt, Human
uuguguguuauuuaaaugag

SEQ ID NO: 2233579 - RNA, 12 nt, Human
uugugugugugc

SEQ ID NO: 2233580 - RNA, 13 nt, Human
uuguguguugucu

SEQ ID NO: 2233581 - RNA, 17 nt, Human
uuguguguuuauuguca

SEQ ID NO: 2233582 - RNA, 19 nt, Human
uuguucuggcucuuccagg

SEQ ID NO: 2233583 - RNA, 20 nt, Human
uuguguuaaguauguguaaa

SEQ ID NO: 2233584 - RNA, 15 nt, Human
uuguguguugucucu

SEQ ID NO: 2233585 - RNA, 17 nt, Human
uuguguguugucucuug

SEQ ID NO: 2233586 - RNA, 14 nt, Human
uugugguuuauguc

SEQ ID NO: 2233587 - RNA, 13 nt, Human
uugugguuaaucu

SEQ ID NO: 2233588 - RNA, 22 nt, Human
uuguguaacaauuuuaaugcua

SEQ ID NO: 2233589 - RNA, 23 nt, Human
uugugugaaagguacuucaaauc

SEQ ID NO: 2233590 - RNA, 18 nt, Human
uugugucuuuugcaugau

SEQ ID NO: 2233591 - RNA, 16 nt, Human
uuguguguuauuuaaa

SEQ ID NO: 2233592 - RNA, 15 nt, Human
uuguguguuauuuaa

SEQ ID NO: 2233593 - RNA, 13 nt, Human
uugugugauugaa

SEQ ID NO: 2233594 - RNA, 14 nt, Human
uugugugauuuaag

SEQ ID NO: 2233595 - RNA, 14 nt, Human
augcaacaacaugu

SEQ ID NO: 2233596 - RNA, 16 nt, Human
augcaacaacauguau

SEQ ID NO: 2233597 - RNA, 21 nt, Human
augcaacaacauguauaauau

SEQ ID NO: 2233598 - RNA, 19 nt, Human
augcacauauggacucugc

SEQ ID NO: 2233599 - RNA, 19 nt, Human
augcaaauccuaugugauu

SEQ ID NO: 2233600 - RNA, 18 nt, Human
augcaaauccuaugugau

SEQ ID NO: 2233601 - RNA, 11 nt, Human
augcaaauccu

SEQ ID NO: 2233602 - RNA, 18 nt, Human
augcaaaucaauuacugg

SEQ ID NO: 2233603 - RNA, 14 nt, Human
augcaccaccaagc

SEQ ID NO: 2233604 - RNA, 21 nt, Human
augcacauauggacucugcac

SEQ ID NO: 2233605 - RNA, 13 nt, Human
augcaccagcccu

SEQ ID NO: 2233606 - RNA, 22 nt, Human
augcacuuucuauccucuguaa

SEQ ID NO: 2233607 - RNA, 12 nt, Human
augcacuuuguu

SEQ ID NO: 2233608 - RNA, 14 nt, Human
augcaccagcccuu

SEQ ID NO: 2233609 - RNA, 19 nt, Human
augcacuuauaauuuuccu

SEQ ID NO: 2233610 - RNA, 21 nt, Human
augcaccaccaagccaaggga

SEQ ID NO: 2233611 - RNA, 15 nt, Human
augcaccaccaagcc

SEQ ID NO: 2233612 - RNA, 18 nt, Human
augcaccaccaagccaag

SEQ ID NO: 2233613 - RNA, 16 nt, Human
augauuuuauuugaca

SEQ ID NO: 2233614 - RNA, 18 nt, Human
augauuuuauuugacaaa

SEQ ID NO: 2233615 - RNA, 15 nt, Human
augcaaagcacugac

SEQ ID NO: 2233616 - RNA, 11 nt, Human
augauuuuuag

SEQ ID NO: 2233617 - RNA, 23 nt, Human
augauuuuauuugacaaaauuug

SEQ ID NO: 2233618 - RNA, 13 nt, Human
augauuuuuagau

SEQ ID NO: 2233619 - RNA, 13 nt, Human
augcaaaggcugg

SEQ ID NO: 2233620 - RNA, 15 nt, Human
augcaaaggcuggga

SEQ ID NO: 2233621 - RNA, 14 nt, Human
augcaaaggcuggg

SEQ ID NO: 2233622 - RNA, 18 nt, Human
augcaaauauuuuuuugu

SEQ ID NO: 2233623 - RNA, 19 nt, Human
augauuucagcucacugca

SEQ ID NO: 2233624 - RNA, 21 nt, Human
augauuucaugcuaucucugu

SEQ ID NO: 2233625 - RNA, 20 nt, Human
augauuucaugcuaucucug

SEQ ID NO: 2233626 - RNA, 21 nt, Human
augauuuccuugaauguggcu

SEQ ID NO: 2233627 - RNA, 19 nt, Human
augauuaaccacuucagcu

SEQ ID NO: 2233628 - RNA, 23 nt, Human
uuguuggcuuucccuuaucaaac

SEQ ID NO: 2233629 - RNA, 19 nt, Human
uuguugggauuccugaccc

SEQ ID NO: 2233630 - RNA, 22 nt, Human
uuguugggauuccugacccagg

SEQ ID NO: 2233631 - RNA, 20 nt, Human
uuguugggauuccugaccca

SEQ ID NO: 2233632 - RNA, 21 nt, Human
uuguugggauuccugacccag

SEQ ID NO: 2233633 - RNA, 21 nt, Human
augauuaaccacuucagcuga

SEQ ID NO: 2233634 - RNA, 20 nt, Human
augauuaaccacuucagcug

SEQ ID NO: 2233635 - RNA, 22 nt, Human
augauuaugaauuacauuugua

SEQ ID NO: 2233636 - RNA, 23 nt, Human
augauuagcaaguuacagugaug

SEQ ID NO: 2233637 - RNA, 14 nt, Human
augauuagcaaguu

SEQ ID NO: 2233638 - RNA, 15 nt, Human
augauuaguaaagaa

SEQ ID NO: 2233639 - RNA, 14 nt, Human
augauuauuuucaa

SEQ ID NO: 2233640 - RNA, 21 nt, Human
augauucaacagguuuuccug

SEQ ID NO: 2233641 - RNA, 13 nt, Human
augauucauuuua

SEQ ID NO: 2233642 - RNA, 16 nt, Human
augauucaguguuaaa

SEQ ID NO: 2233643 - RNA, 17 nt, Human
augauucagaaauugga

SEQ ID NO: 2233644 - RNA, 14 nt, Human
augauucagaaauu

SEQ ID NO: 2233645 - RNA, 17 nt, Human
augauuucagcucacug

SEQ ID NO: 2233646 - RNA, 13 nt, Human
augauuccuuccu

SEQ ID NO: 2233647 - RNA, 16 nt, Human
augauuccagguggca

SEQ ID NO: 2233648 - RNA, 15 nt, Human
augauuccagguggc

SEQ ID NO: 2233649 - RNA, 12 nt, Human
augauucccagc

SEQ ID NO: 2233650 - RNA, 11 nt, Human
auauuuuaauu

SEQ ID NO: 2233651 - RNA, 22 nt, Human
uucccagcaguggacucaaaac

SEQ ID NO: 2233652 - RNA, 14 nt, Human
uucccagauacuuc

SEQ ID NO: 2233653 - RNA, 14 nt, Human
uucccagcacauga

SEQ ID NO: 2233654 - RNA, 23 nt, Human
uucccagcagggccacucccggc

SEQ ID NO: 2233655 - RNA, 23 nt, Human
uucccagagcaaaauaauuuuaa

SEQ ID NO: 2233656 - RNA, 21 nt, Human
uucccagagugugaaacuucc

SEQ ID NO: 2233657 - RNA, 15 nt, Human
uucccagagacagga

SEQ ID NO: 2233658 - RNA, 23 nt, Human
uucccagaaucaaagcaaugcau

SEQ ID NO: 2233659 - RNA, 13 nt, Human
uucccagaaucaa

SEQ ID NO: 2233660 - RNA, 15 nt, Human
uucccagaaucaaag

SEQ ID NO: 2233661 - RNA, 22 nt, Human
uucccagagacaggaaaauccu

SEQ ID NO: 2233662 - RNA, 19 nt, Human
uucccagagacaggaaaau

SEQ ID NO: 2233663 - RNA, 18 nt, Human
uucccagagcaaaauaau

SEQ ID NO: 2233664 - RNA, 13 nt, Human
uucccagaaggca

SEQ ID NO: 2233665 - RNA, 23 nt, Human
uucccagaaggcauaucagucuc

SEQ ID NO: 2233666 - RNA, 12 nt, Human
uucccagaauca

SEQ ID NO: 2233667 - RNA, 11 nt, Human
uucccacugca

SEQ ID NO: 2233668 - RNA, 15 nt, Human
uucccacucaccccg

SEQ ID NO: 2233669 - RNA, 18 nt, Human
uucccacucuagggcagu

SEQ ID NO: 2233670 - RNA, 15 nt, Human
uucccacuguuuaag

SEQ ID NO: 2233671 - RNA, 23 nt, Human
uucccacugcacccccuccugcu

SEQ ID NO: 2233672 - RNA, 24 nt, Human
uucccacugcacccccuccugcug

SEQ ID NO: 2233673 - RNA, 13 nt, Human
uucccacugcacc

SEQ ID NO: 2233674 - RNA, 18 nt, Human
uucccacugcacccccuc

SEQ ID NO: 2233675 - RNA, 19 nt, Human
uucccacugcacccccucc

SEQ ID NO: 2233676 - RNA, 20 nt, Human
uucccacugcacccccuccu

SEQ ID NO: 2233677 - RNA, 17 nt, Human
uuccccucccuggcucc

SEQ ID NO: 2233678 - RNA, 16 nt, Human
uuccccucccuggcuc

SEQ ID NO: 2233679 - RNA, 13 nt, Human
uuccccucccugg

SEQ ID NO: 2233680 - RNA, 21 nt, Human
uuccccuacccccuccucucu

SEQ ID NO: 2233681 - RNA, 22 nt, Human
uuccccuaguaagugccuucca

SEQ ID NO: 2233682 - RNA, 19 nt, Human
uuccccucacuggaugaaa

SEQ ID NO: 2233683 - RNA, 14 nt, Human
uuccccucccuggg

SEQ ID NO: 2233684 - RNA, 13 nt, Human
uuccccuccuacc

SEQ ID NO: 2233685 - RNA, 16 nt, Human
uuccccuccuaccccu

SEQ ID NO: 2233686 - RNA, 17 nt, Human
uuccccuccuaccccuc

SEQ ID NO: 2233687 - RNA, 19 nt, Human
uuccccuccuaccccuccc

SEQ ID NO: 2233688 - RNA, 20 nt, Human
uuccccuccuaccccuccca

SEQ ID NO: 2233689 - RNA, 21 nt, Human
uuccccuccuaccccucccag

SEQ ID NO: 2233690 - RNA, 18 nt, Human
uuccccuccuucucccuu

SEQ ID NO: 2233691 - RNA, 12 nt, Human
uuccccucugcu

SEQ ID NO: 2233692 - RNA, 17 nt, Human
uuccccuccuucucccu

SEQ ID NO: 2233693 - RNA, 15 nt, Human
uuccccuccuccacu

SEQ ID NO: 2233694 - RNA, 14 nt, Human
uuccccucugcugc

SEQ ID NO: 2233695 - RNA, 15 nt, Human
uuccccucugcugcu

SEQ ID NO: 2233696 - RNA, 18 nt, Human
uuccccucugcugcuguc

SEQ ID NO: 2233697 - RNA, 16 nt, Human
uuccccggucccuuga

SEQ ID NO: 2233698 - RNA, 22 nt, Human
uuccccgagggaugaugccaca

SEQ ID NO: 2233699 - RNA, 23 nt, Human
uuccccgagggaugaugccacac

SEQ ID NO: 2233700 - RNA, 19 nt, Human
uuccccuaaccucauuccc

SEQ ID NO: 2233701 - RNA, 17 nt, Human
uuccccggucccuugag

SEQ ID NO: 2233702 - RNA, 19 nt, Human
uucccccuuuucugcauuu

SEQ ID NO: 2233703 - RNA, 16 nt, Human
uuccccgagggaugau

SEQ ID NO: 2233704 - RNA, 22 nt, Human
uucccccuggccaccacccccc

SEQ ID NO: 2233705 - RNA, 17 nt, Human
uucccccuucacaaagc

SEQ ID NO: 2233706 - RNA, 15 nt, Human
uucccccucccaggg

SEQ ID NO: 2233707 - RNA, 19 nt, Human
uucccccuccaaucccacc

SEQ ID NO: 2233708 - RNA, 23 nt, Human
auauuuuacauucuuggaaaguc

SEQ ID NO: 2233709 - RNA, 17 nt, Human
auauuuuaccucuuauu

SEQ ID NO: 2233710 - RNA, 23 nt, Human
auauuuuaccucuuauugcaaaa

SEQ ID NO: 2233711 - RNA, 20 nt, Human
uucccccuggccaccacccc

SEQ ID NO: 2233712 - RNA, 22 nt, Human
uucccccugcuuccaccucacc

SEQ ID NO: 2233713 - RNA, 21 nt, Human
uucccuuuuacauacugcugu

SEQ ID NO: 2233714 - RNA, 19 nt, Human
uucccuuuuacauacugcu

SEQ ID NO: 2233715 - RNA, 18 nt, Human
uucccuuuuacauacugc

SEQ ID NO: 2233716 - RNA, 17 nt, Human
uucccuuuuacauacug

SEQ ID NO: 2233717 - RNA, 18 nt, Human
uucccuuuuuuggcugcu

SEQ ID NO: 2233718 - RNA, 19 nt, Human
uucccuuuuuuggcugcug

SEQ ID NO: 2233719 - RNA, 20 nt, Human
uucccuuuuuuggcugcuga

SEQ ID NO: 2233720 - RNA, 13 nt, Human
uucccuaucuuuu

SEQ ID NO: 2233721 - RNA, 18 nt, Human
uuccuacacccuuggacu

SEQ ID NO: 2233722 - RNA, 18 nt, Human
uuccuacagauagucaaa

SEQ ID NO: 2233723 - RNA, 18 nt, Human
uuccuacagccccuuuuu

SEQ ID NO: 2233724 - RNA, 21 nt, Human
uuccuacacccuuggacuuga

SEQ ID NO: 2233725 - RNA, 17 nt, Human
uuccuacagauagucaa

SEQ ID NO: 2233726 - RNA, 12 nt, Human
uuccuacagccc

SEQ ID NO: 2233727 - RNA, 14 nt, Human
uuccuacagccccu

SEQ ID NO: 2233728 - RNA, 15 nt, Human
uuccuaccucccugc

SEQ ID NO: 2233729 - RNA, 16 nt, Human
uuccuaccucccugca

SEQ ID NO: 2233730 - RNA, 13 nt, Human
uuccuaccucccu

SEQ ID NO: 2233731 - RNA, 23 nt, Human
uuccuacccacaccucugccaga

SEQ ID NO: 2233732 - RNA, 16 nt, Human
uuccuacccaaccacu

SEQ ID NO: 2233733 - RNA, 17 nt, Human
uuccuacccaaccacuc

SEQ ID NO: 2233734 - RNA, 20 nt, Human
uuccuacccacaccucugcc

SEQ ID NO: 2233735 - RNA, 21 nt, Human
uuccuacccacaccucugcca

SEQ ID NO: 2233736 - RNA, 17 nt, Human
uuccccuguucacucua

SEQ ID NO: 2233737 - RNA, 14 nt, Human
uuccccuguucacu

SEQ ID NO: 2233738 - RNA, 22 nt, Human
uuccccuccuaccccucccagc

SEQ ID NO: 2233739 - RNA, 13 nt, Human
uuccccuguccug

SEQ ID NO: 2233740 - RNA, 15 nt, Human
uuccccuguggggau

SEQ ID NO: 2233741 - RNA, 21 nt, Human
uuccccuuccacugagggcag

SEQ ID NO: 2233742 - RNA, 22 nt, Human
uuccccuuccuaauuccacagc

SEQ ID NO: 2233743 - RNA, 15 nt, Human
uuccccuuccacuga

SEQ ID NO: 2233744 - RNA, 14 nt, Human
uuccccuuccacug

SEQ ID NO: 2233745 - RNA, 21 nt, Human
uucccuaggggacacuucccu

SEQ ID NO: 2233746 - RNA, 19 nt, Human
uucccuagucuauucauua

SEQ ID NO: 2233747 - RNA, 16 nt, Human
uucccuaucuuugcca

SEQ ID NO: 2233748 - RNA, 18 nt, Human
uucccuaggggacacuuc

SEQ ID NO: 2233749 - RNA, 19 nt, Human
uucccuaggggacacuucc

SEQ ID NO: 2233750 - RNA, 22 nt, Human
uucccuagaaacuuccaaaucc

SEQ ID NO: 2233751 - RNA, 17 nt, Human
uucccuacuuccuguga

SEQ ID NO: 2233752 - RNA, 14 nt, Human
uucccuacuuccug

SEQ ID NO: 2233753 - RNA, 16 nt, Human
uucccuacuuccugug

SEQ ID NO: 2233754 - RNA, 22 nt, Human
uuccccuugcccagggcucagc

SEQ ID NO: 2233755 - RNA, 23 nt, Human
uuccccuugcccagggcucagcc

SEQ ID NO: 2233756 - RNA, 13 nt, Human
uucccuacuuccu

SEQ ID NO: 2233757 - RNA, 15 nt, Human
auauuuuuaauuaaa

SEQ ID NO: 2233758 - RNA, 13 nt, Human
auauuuuuagaua

SEQ ID NO: 2233759 - RNA, 14 nt, Human
auauuuuuauagac

SEQ ID NO: 2233760 - RNA, 13 nt, Human
auauuuuuauaga

SEQ ID NO: 2233761 - RNA, 20 nt, Human
auauuuuuaagauaauaaua

SEQ ID NO: 2233762 - RNA, 14 nt, Human
auauuuuuaagaua

SEQ ID NO: 2233763 - RNA, 16 nt, Human
auauuuuuaagauaau

SEQ ID NO: 2233764 - RNA, 20 nt, Human
auauuuuuaaaauauuuauu

SEQ ID NO: 2233765 - RNA, 14 nt, Human
auauuuugucuaaa

SEQ ID NO: 2233766 - RNA, 12 nt, Human
auauuuuuaaga

SEQ ID NO: 2233767 - RNA, 19 nt, Human
auauuuucuuccaagcaaa

SEQ ID NO: 2233768 - RNA, 17 nt, Human
auauuuugucuaaaaug

SEQ ID NO: 2233769 - RNA, 19 nt, Human
auauuuuuauagacaaaua

SEQ ID NO: 2233770 - RNA, 16 nt, Human
auauuuuuauauuuag

SEQ ID NO: 2233771 - RNA, 13 nt, Human
aucaaauauuaga

SEQ ID NO: 2233772 - RNA, 14 nt, Human
aucaaauauuagau

SEQ ID NO: 2233773 - RNA, 15 nt, Human
aucaaauauuagaug

SEQ ID NO: 2233774 - RNA, 16 nt, Human
aucaaauauuagaugu

SEQ ID NO: 2233775 - RNA, 18 nt, Human
aucaaauauuagauguga

SEQ ID NO: 2233776 - RNA, 20 nt, Human
aucaaauaugcaaagcacug

SEQ ID NO: 2233777 - RNA, 18 nt, Human
auauuuuuauauuuaguu

SEQ ID NO: 2233778 - RNA, 19 nt, Human
aucaaauauuagaugugau

SEQ ID NO: 2233779 - RNA, 21 nt, Human
aucaaauauuagaugugauuu

SEQ ID NO: 2233780 - RNA, 21 nt, Human
aucaaauggaagacacauuga

SEQ ID NO: 2233781 - RNA, 22 nt, Human
aucaaauggaaaggagaggaaa

SEQ ID NO: 2233782 - RNA, 17 nt, Human
aucaaauggaagacaca

SEQ ID NO: 2233783 - RNA, 12 nt, Human
aucaagucaccg

SEQ ID NO: 2233784 - RNA, 20 nt, Human
aucaaguauuugggaaguga

SEQ ID NO: 2233785 - RNA, 21 nt, Human
aucaaguauuugggaagugaa

SEQ ID NO: 2233786 - RNA, 13 nt, Human
aucaagugucuuc

SEQ ID NO: 2233787 - RNA, 16 nt, Human
aucaagugucuuccau

SEQ ID NO: 2233788 - RNA, 22 nt, Human
aucaaguuauugacaaacucuc

SEQ ID NO: 2233789 - RNA, 15 nt, Human
aucaaguugaauuga

SEQ ID NO: 2233790 - RNA, 15 nt, Human
aucaagugugcuuua

SEQ ID NO: 2233791 - RNA, 16 nt, Human
aucaagugugcuuuag

SEQ ID NO: 2233792 - RNA, 22 nt, Human
aucaaguuggcuucuaaucaaa

SEQ ID NO: 2233793 - RNA, 23 nt, Human
aucaaguuggcuucuaaucaaag

SEQ ID NO: 2233794 - RNA, 19 nt, Human
aucaaccccuucgcuccug

SEQ ID NO: 2233795 - RNA, 20 nt, Human
aucaaccccuucgcuccugu

SEQ ID NO: 2233796 - RNA, 22 nt, Human
aucaaccccuucgcuccugugu

SEQ ID NO: 2233797 - RNA, 16 nt, Human
aucaaguauuugggaa

SEQ ID NO: 2233798 - RNA, 18 nt, Human
auauuuuccaugaaaaug

SEQ ID NO: 2233799 - RNA, 16 nt, Human
auauuuuccaugaaaa

SEQ ID NO: 2233800 - RNA, 23 nt, Human
auauuuucuuccaagcaaaggug

SEQ ID NO: 2233801 - RNA, 13 nt, Human
auauuuucuguuu

SEQ ID NO: 2233802 - RNA, 12 nt, Human
auauuuucuguu

SEQ ID NO: 2233803 - RNA, 23 nt, Human
uuccuuauguauauuuaaaagaa

SEQ ID NO: 2233804 - RNA, 22 nt, Human
uuccuuagguuuuuuuccuucu

SEQ ID NO: 2233805 - RNA, 23 nt, Human
uuccuuagguuuuuuuccuucug

SEQ ID NO: 2233806 - RNA, 23 nt, Human
uuccuuagcuuagaccucagccu

SEQ ID NO: 2233807 - RNA, 22 nt, Human
uuccuuagcuuagaccucagcc

SEQ ID NO: 2233808 - RNA, 20 nt, Human
uuccuuagcuuagaccucag

SEQ ID NO: 2233809 - RNA, 21 nt, Human
uuccuuagcuuagaccucagc

SEQ ID NO: 2233810 - RNA, 17 nt, Human
uuccuucacauccugug

SEQ ID NO: 2233811 - RNA, 20 nt, Human
uuccuucaaagcaaaugucu

SEQ ID NO: 2233812 - RNA, 15 nt, Human
uuccuguccagagag

SEQ ID NO: 2233813 - RNA, 15 nt, Human
uuccuguccagcucc

SEQ ID NO: 2233814 - RNA, 17 nt, Human
uuccuguccagcuccaa

SEQ ID NO: 2233815 - RNA, 16 nt, Human
uuccuguccagcucca

SEQ ID NO: 2233816 - RNA, 22 nt, Human
uuccuguccagcuccaaccugc

SEQ ID NO: 2233817 - RNA, 14 nt, Human
uuccugucccaccu

SEQ ID NO: 2233818 - RNA, 15 nt, Human
uuccugucccaccuc

SEQ ID NO: 2233819 - RNA, 16 nt, Human
uuccuguauguugucc

SEQ ID NO: 2233820 - RNA, 15 nt, Human
uuccuguagcaucuu

SEQ ID NO: 2233821 - RNA, 17 nt, Human
uuccuguagcaucuucu

SEQ ID NO: 2233822 - RNA, 18 nt, Human
uuccuguagcaucuucug

SEQ ID NO: 2233823 - RNA, 22 nt, Human
uuccuguagccuucuguaggaa

SEQ ID NO: 2233824 - RNA, 21 nt, Human
uuccuguaaaaaaaaaaaagu

SEQ ID NO: 2233825 - RNA, 11 nt, Human
uuccuguaaca

SEQ ID NO: 2233826 - RNA, 19 nt, Human
uuccuguaacacaagccac

SEQ ID NO: 2233827 - RNA, 21 nt, Human
uuccuguaacacaagccacag

SEQ ID NO: 2233828 - RNA, 22 nt, Human
uuccuguaacacaagccacaga

SEQ ID NO: 2233829 - RNA, 23 nt, Human
uuccuguaacacaagccacagaa

SEQ ID NO: 2233830 - RNA, 13 nt, Human
uuccucuccacug

SEQ ID NO: 2233831 - RNA, 14 nt, Human
uuccucuccacugc

SEQ ID NO: 2233832 - RNA, 15 nt, Human
uuccucuccacugcc

SEQ ID NO: 2233833 - RNA, 17 nt, Human
uuccucuccacccuccc

SEQ ID NO: 2233834 - RNA, 19 nt, Human
uuccucucacuaaacuuua

SEQ ID NO: 2233835 - RNA, 12 nt, Human
uuccucuccacc

SEQ ID NO: 2233836 - RNA, 12 nt, Human
uuccucuccacu

SEQ ID NO: 2233837 - RNA, 19 nt, Human
uuccuagaaguuacugaau

SEQ ID NO: 2233838 - RNA, 23 nt, Human
uuccucuauugauguacagucug

SEQ ID NO: 2233839 - RNA, 17 nt, Human
uuccucucacuaaacuu

SEQ ID NO: 2233840 - RNA, 18 nt, Human
uuccucucacuaaacuuu

SEQ ID NO: 2233841 - RNA, 22 nt, Human
uucgcgauggacagacucacaa

SEQ ID NO: 2233842 - RNA, 19 nt, Human
uucgcgugcccucgcugcu

SEQ ID NO: 2233843 - RNA, 22 nt, Human
uucgcaucaaaagacaauucuu

SEQ ID NO: 2233844 - RNA, 13 nt, Human
uucgcuccugugu

SEQ ID NO: 2233845 - RNA, 15 nt, Human
uucuaaaguaaaaac

SEQ ID NO: 2233846 - RNA, 13 nt, Human
uucuaaaguaaaa

SEQ ID NO: 2233847 - RNA, 13 nt, Human
uucuaaauagcaa

SEQ ID NO: 2233848 - RNA, 19 nt, Human
uucuaaaucuccaaaauaa

SEQ ID NO: 2233849 - RNA, 14 nt, Human
uucuaacaagucau

SEQ ID NO: 2233850 - RNA, 19 nt, Human
uucuaacaaaaaaauauau

SEQ ID NO: 2233851 - RNA, 20 nt, Human
uucuaacaaaaaaauauauu

SEQ ID NO: 2233852 - RNA, 18 nt, Human
uucuaaggaauaugagcu

SEQ ID NO: 2233853 - RNA, 14 nt, Human
uucuaaggaauaug

SEQ ID NO: 2233854 - RNA, 17 nt, Human
uucuaaguaaaaccaca

SEQ ID NO: 2233855 - RNA, 20 nt, Human
uucuaaguaaaaccacagca

SEQ ID NO: 2233856 - RNA, 19 nt, Human
uucuaaguaaaaccacagc

SEQ ID NO: 2233857 - RNA, 15 nt, Human
uucuaacuccaguga

SEQ ID NO: 2233858 - RNA, 18 nt, Human
uucuaagagaaguuauuu

SEQ ID NO: 2233859 - RNA, 14 nt, Human
uucgagaccagccu

SEQ ID NO: 2233860 - RNA, 18 nt, Human
uucgagaccaaccugacc

SEQ ID NO: 2233861 - RNA, 21 nt, Human
uucgagaagcugcucuggaau

SEQ ID NO: 2233862 - RNA, 17 nt, Human
uucgacuugcauuuuug

SEQ ID NO: 2233863 - RNA, 15 nt, Human
uucgagaagcugcuc

SEQ ID NO: 2233864 - RNA, 20 nt, Human
uucgagaagcugcucuggaa

SEQ ID NO: 2233865 - RNA, 19 nt, Human
uucgagaccagccuggcca

SEQ ID NO: 2233866 - RNA, 17 nt, Human
uucgagaccagccuggc

SEQ ID NO: 2233867 - RNA, 16 nt, Human
uucgagaccagccugg

SEQ ID NO: 2233868 - RNA, 15 nt, Human
uucgagaccagccug

SEQ ID NO: 2233869 - RNA, 17 nt, Human
uucgaccugauuuacag

SEQ ID NO: 2233870 - RNA, 19 nt, Human
uucgacugugaccuguggg

SEQ ID NO: 2233871 - RNA, 18 nt, Human
uucgaccugauuuacagu

SEQ ID NO: 2233872 - RNA, 17 nt, Human
uucgacucagccucagg

SEQ ID NO: 2233873 - RNA, 22 nt, Human
uucgaagcucagcccacccccc

SEQ ID NO: 2233874 - RNA, 17 nt, Human
aucaauaaaaugugauu

SEQ ID NO: 2233875 - RNA, 16 nt, Human
aucaauaaaaugugau

SEQ ID NO: 2233876 - RNA, 15 nt, Human
aucaauaaaauguga

SEQ ID NO: 2233877 - RNA, 16 nt, Human
uucgaagcucagccca

SEQ ID NO: 2233878 - RNA, 14 nt, Human
uucgaagcucagcc

SEQ ID NO: 2233879 - RNA, 22 nt, Human
uucgaaaccugggauucaggaa

SEQ ID NO: 2233880 - RNA, 19 nt, Human
aucaauaaacgauuuaauu

SEQ ID NO: 2233881 - RNA, 14 nt, Human
aucaauaaacgauu

SEQ ID NO: 2233882 - RNA, 15 nt, Human
aucaauaaacgauuu

SEQ ID NO: 2233883 - RNA, 21 nt, Human
uucgaugggcccaauucuuac

SEQ ID NO: 2233884 - RNA, 20 nt, Human
uucgaugggcccaauucuua

SEQ ID NO: 2233885 - RNA, 14 nt, Human
uucgcacagcaguu

SEQ ID NO: 2233886 - RNA, 20 nt, Human
uucgauacaccgggccugga

SEQ ID NO: 2233887 - RNA, 21 nt, Human
uucgcaggauucuuccucccu

SEQ ID NO: 2233888 - RNA, 23 nt, Human
uucgcaccuaccaucagggacag

SEQ ID NO: 2233889 - RNA, 14 nt, Human
uucgccguggcugc

SEQ ID NO: 2233890 - RNA, 19 nt, Human
uucgcccaaagccagacag

SEQ ID NO: 2233891 - RNA, 20 nt, Human
uucgccguggcugcggcacc

SEQ ID NO: 2233892 - RNA, 21 nt, Human
uucgccguggcugcggcaccc

SEQ ID NO: 2233893 - RNA, 23 nt, Human
uucgcauggucacacacugaugc

SEQ ID NO: 2233894 - RNA, 21 nt, Human
uucgcauggucacacacugau

SEQ ID NO: 2233895 - RNA, 20 nt, Human
uucgcauggucacacacuga

SEQ ID NO: 2233896 - RNA, 19 nt, Human
uucgcauggucacacacug

SEQ ID NO: 2233897 - RNA, 18 nt, Human
uucgcauggucacacacu

SEQ ID NO: 2233898 - RNA, 17 nt, Human
uucgcauggucacacac

SEQ ID NO: 2233899 - RNA, 16 nt, Human
uucgcauggucacaca

SEQ ID NO: 2233900 - RNA, 14 nt, Human
uucgcauggucaca

SEQ ID NO: 2233901 - RNA, 14 nt, Human
uucgcaucaaaaga

SEQ ID NO: 2233902 - RNA, 18 nt, Human
uucgcaucaaaagacaau

SEQ ID NO: 2233903 - RNA, 19 nt, Human
uucgcaucaaaagacaauu

SEQ ID NO: 2233904 - RNA, 20 nt, Human
uucgcaucaaaagacaauuc

SEQ ID NO: 2233905 - RNA, 21 nt, Human
uucgcaucaaaagacaauucu

SEQ ID NO: 2233906 - RNA, 21 nt, Human
uucucacugccaugccagcuu

SEQ ID NO: 2233907 - RNA, 22 nt, Human
uucucagaaggcaaaugacuuu

SEQ ID NO: 2233908 - RNA, 13 nt, Human
uucucagaaucua

SEQ ID NO: 2233909 - RNA, 15 nt, Human
uucucagaaucuacc

SEQ ID NO: 2233910 - RNA, 21 nt, Human
uucucagaaggcaaaugacuu

SEQ ID NO: 2233911 - RNA, 19 nt, Human
uucucagaaggcaaaugac

SEQ ID NO: 2233912 - RNA, 18 nt, Human
uucucagaaggcaaauga

SEQ ID NO: 2233913 - RNA, 18 nt, Human
uucucacuguucccucug

SEQ ID NO: 2233914 - RNA, 21 nt, Human
uucuauaaguuuuauguuaaa

SEQ ID NO: 2233915 - RNA, 22 nt, Human
uucuaguggucuuuguaagagu

SEQ ID NO: 2233916 - RNA, 22 nt, Human
uucuauaaguuuuauguuaaau

SEQ ID NO: 2233917 - RNA, 14 nt, Human
uucuauaauuuaaa

SEQ ID NO: 2233918 - RNA, 13 nt, Human
uucuauaauuuaa

SEQ ID NO: 2233919 - RNA, 21 nt, Human
uucuagaauuuaucacacuuc

SEQ ID NO: 2233920 - RNA, 15 nt, Human
uucuagaauuuauca

SEQ ID NO: 2233921 - RNA, 22 nt, Human
uucuagaacaucccugccagcu

SEQ ID NO: 2233922 - RNA, 17 nt, Human
uucuagaaagccuguuc

SEQ ID NO: 2233923 - RNA, 23 nt, Human
uucuagaaagccuguuccccuca

SEQ ID NO: 2233924 - RNA, 21 nt, Human
uucuagaacaucccugccagc

SEQ ID NO: 2233925 - RNA, 15 nt, Human
uucuagacuuucugu

SEQ ID NO: 2233926 - RNA, 12 nt, Human
uucuagagaaga

SEQ ID NO: 2233927 - RNA, 14 nt, Human
uucuagagaagagg

SEQ ID NO: 2233928 - RNA, 21 nt, Human
uucuaaguaaaaccacagcag

SEQ ID NO: 2233929 - RNA, 22 nt, Human
uucuagagaagaggcuggugcu

SEQ ID NO: 2233930 - RNA, 21 nt, Human
uucuagucuccuuugcacuga

SEQ ID NO: 2233931 - RNA, 22 nt, Human
uucuagucuccuuugcacugag

SEQ ID NO: 2233932 - RNA, 12 nt, Human
uucuagugcugc

SEQ ID NO: 2233933 - RNA, 23 nt, Human
uucuagucuccuuugcacugagg

SEQ ID NO: 2233934 - RNA, 14 nt, Human
uucuagucucucug

SEQ ID NO: 2233935 - RNA, 13 nt, Human
uucuagugcugcu

SEQ ID NO: 2233936 - RNA, 14 nt, Human
uucuagugcugcug

SEQ ID NO: 2233937 - RNA, 16 nt, Human
uucuagugcugcugaa

SEQ ID NO: 2233938 - RNA, 18 nt, Human
uucuagugcugcugaaga

SEQ ID NO: 2233939 - RNA, 20 nt, Human
uucuaguggucuuuguaaga

SEQ ID NO: 2233940 - RNA, 21 nt, Human
uucuaguggucuuuguaagag

SEQ ID NO: 2233941 - RNA, 15 nt, Human
uucuaguggucuuug

SEQ ID NO: 2233942 - RNA, 17 nt, Human
uucuaguggucuuugua

SEQ ID NO: 2233943 - RNA, 18 nt, Human
uucuaguggucuuuguaa

SEQ ID NO: 2233944 - RNA, 19 nt, Human
uucuaguggucuuuguaag

SEQ ID NO: 2233945 - RNA, 20 nt, Human
aucacuuucucaguuuucau

SEQ ID NO: 2233946 - RNA, 16 nt, Human
uucucagcucccccug

SEQ ID NO: 2233947 - RNA, 13 nt, Human
aucacuuuucagu

SEQ ID NO: 2233948 - RNA, 14 nt, Human
aucacuuuucagug

SEQ ID NO: 2233949 - RNA, 15 nt, Human
aucacuuuucaguga

SEQ ID NO: 2233950 - RNA, 21 nt, Human
aucacuuucucaguuuucaua

SEQ ID NO: 2233951 - RNA, 18 nt, Human
aucacuuucucaguuuuc

SEQ ID NO: 2233952 - RNA, 14 nt, Human
uucucagcuccccc

SEQ ID NO: 2233953 - RNA, 15 nt, Human
uucucagcucccccu

SEQ ID NO: 2233954 - RNA, 13 nt, Human
aucagaaaaggga

SEQ ID NO: 2233955 - RNA, 15 nt, Human
aucagaaaagggaag

SEQ ID NO: 2233956 - RNA, 14 nt, Human
aucacuuuuuucca

SEQ ID NO: 2233957 - RNA, 20 nt, Human
aucagaaacacccucacacu

SEQ ID NO: 2233958 - RNA, 16 nt, Human
aucagaaacacccuca

SEQ ID NO: 2233959 - RNA, 20 nt, Human
uucucagauauuuauauuuu

SEQ ID NO: 2233960 - RNA, 15 nt, Human
uucucagauccuugu

SEQ ID NO: 2233961 - RNA, 15 nt, Human
uucucagauauuuau

SEQ ID NO: 2233962 - RNA, 14 nt, Human
uucucagauauuua

SEQ ID NO: 2233963 - RNA, 19 nt, Human
uucucagauccuuguuuca

SEQ ID NO: 2233964 - RNA, 21 nt, Human
uucucagauggauugauaauu

SEQ ID NO: 2233965 - RNA, 13 nt, Human
uucucagauauuu

SEQ ID NO: 2233966 - RNA, 19 nt, Human
uucucagaaucuacccaaa

SEQ ID NO: 2233967 - RNA, 23 nt, Human
uucucagaaucuacccaaaggau

SEQ ID NO: 2233968 - RNA, 13 nt, Human
uucucagaaucuc

SEQ ID NO: 2233969 - RNA, 13 nt, Human
uucucagcuccca

SEQ ID NO: 2233970 - RNA, 14 nt, Human
uucucagcucccau

SEQ ID NO: 2233971 - RNA, 18 nt, Human
uucucagcucccauuucu

SEQ ID NO: 2233972 - RNA, 19 nt, Human
uucucagcucccauuucua

SEQ ID NO: 2233973 - RNA, 13 nt, Human
uucucagcucccc

SEQ ID NO: 2233974 - RNA, 12 nt, Human
uucucagcuccc

SEQ ID NO: 2233975 - RNA, 20 nt, Human
aucagacccuaccccaccac

SEQ ID NO: 2233976 - RNA, 19 nt, Human
aucagacccuaccccacca

SEQ ID NO: 2233977 - RNA, 18 nt, Human
aucagacccuaccccacc

SEQ ID NO: 2233978 - RNA, 16 nt, Human
aucagacccuacccca

SEQ ID NO: 2233979 - RNA, 15 nt, Human
aucagacccuacccc

SEQ ID NO: 2233980 - RNA, 14 nt, Human
aucagacccuaccc

SEQ ID NO: 2233981 - RNA, 20 nt, Human
aucagaccauaauguuacau

SEQ ID NO: 2233982 - RNA, 16 nt, Human
aucagaccauaauguu

SEQ ID NO: 2233983 - RNA, 19 nt, Human
aucagacacucuggcuggu

SEQ ID NO: 2233984 - RNA, 18 nt, Human
aucagacuucacacugca

SEQ ID NO: 2233985 - RNA, 22 nt, Human
aucagacuagugacaagcuccu

SEQ ID NO: 2233986 - RNA, 22 nt, Human
aucagaccuuggaucagaugaa

SEQ ID NO: 2233987 - RNA, 19 nt, Human
aucagacuaugaaguuuuu

SEQ ID NO: 2233988 - RNA, 13 nt, Human
aucaggccaggcc

SEQ ID NO: 2233989 - RNA, 19 nt, Human
aucaggaugaacccaggac

SEQ ID NO: 2233990 - RNA, 13 nt, Human
aucaggaugaacc

SEQ ID NO: 2233991 - RNA, 18 nt, Human
aucaggaugaacccagga

SEQ ID NO: 2233992 - RNA, 14 nt, Human
aucaggccaggccc

SEQ ID NO: 2233993 - RNA, 20 nt, Human
aucaggacccagaggaaggg

SEQ ID NO: 2233994 - RNA, 18 nt, Human
aucaggacccagaggaag

SEQ ID NO: 2233995 - RNA, 13 nt, Human
aucaggagaaaaa

SEQ ID NO: 2233996 - RNA, 22 nt, Human
aucaggagaaaaagccuccagu

SEQ ID NO: 2233997 - RNA, 12 nt, Human
aucaggaugaac

SEQ ID NO: 2233998 - RNA, 16 nt, Human
aucaggacccagagga

SEQ ID NO: 2233999 - RNA, 22 nt, Human
aucaggaauauuuuccaaagag

SEQ ID NO: 2234000 - RNA, 19 nt, Human
aucaggaauauuuuccaaa

SEQ ID NO: 2234001 - RNA, 16 nt, Human
uucucuuucucuccuu

SEQ ID NO: 2234002 - RNA, 22 nt, Human
uucucuuuccuuggcucccauu

SEQ ID NO: 2234003 - RNA, 13 nt, Human
uucucuuucucuc

SEQ ID NO: 2234004 - RNA, 14 nt, Human
uucucuuucucucc

SEQ ID NO: 2234005 - RNA, 16 nt, Human
uucucuuuucaaaaca

SEQ ID NO: 2234006 - RNA, 19 nt, Human
uucugacaaaaaguuucca

SEQ ID NO: 2234007 - RNA, 22 nt, Human
uucugacaaaaaguuuccauau

SEQ ID NO: 2234008 - RNA, 13 nt, Human
uucucuuucaaag

SEQ ID NO: 2234009 - RNA, 19 nt, Human
uucucuagcuggugguuuc

SEQ ID NO: 2234010 - RNA, 13 nt, Human
uucucuuuccuug

SEQ ID NO: 2234011 - RNA, 20 nt, Human
uucucuacagacuucuccag

SEQ ID NO: 2234012 - RNA, 19 nt, Human
uucucuacuuugaggaaac

SEQ ID NO: 2234013 - RNA, 20 nt, Human
uucucuacuuugaggaaacc

SEQ ID NO: 2234014 - RNA, 17 nt, Human
uucucuacucuagggaa

SEQ ID NO: 2234015 - RNA, 21 nt, Human
uucucuaaguuccacugagcu

SEQ ID NO: 2234016 - RNA, 23 nt, Human
uucucuaaguuccacugagcucc

SEQ ID NO: 2234017 - RNA, 24 nt, Human
uucucuaagagaacaaugugcuau

SEQ ID NO: 2234018 - RNA, 18 nt, Human
uucucuaaguuccacuga

SEQ ID NO: 2234019 - RNA, 20 nt, Human
uucucuaaguuccacugagc

SEQ ID NO: 2234020 - RNA, 15 nt, Human
uucugcacugagcag

SEQ ID NO: 2234021 - RNA, 17 nt, Human
uucugcacugagcagag

SEQ ID NO: 2234022 - RNA, 20 nt, Human
uucugcacugagcagagucu

SEQ ID NO: 2234023 - RNA, 20 nt, Human
uucugcagcaugaccuguga

SEQ ID NO: 2234024 - RNA, 23 nt, Human
uucugcagaguuuccaaaaccag

SEQ ID NO: 2234025 - RNA, 22 nt, Human
uucugcacccuccacccugucc

SEQ ID NO: 2234026 - RNA, 23 nt, Human
uucugcacccuccacccuguccc

SEQ ID NO: 2234027 - RNA, 13 nt, Human
uucugcacccucc

SEQ ID NO: 2234028 - RNA, 16 nt, Human
uucugcacccuccacc

SEQ ID NO: 2234029 - RNA, 17 nt, Human
uucugcacccuccaccc

SEQ ID NO: 2234030 - RNA, 19 nt, Human
uucugcacccuccacccug

SEQ ID NO: 2234031 - RNA, 23 nt, Human
uucugcagcaugaccugugacca

SEQ ID NO: 2234032 - RNA, 19 nt, Human
uucugcccuggcugcugcc

SEQ ID NO: 2234033 - RNA, 22 nt, Human
uucugcagcaugaccugugacc

SEQ ID NO: 2234034 - RNA, 21 nt, Human
uucugcagcaugaccugugac

SEQ ID NO: 2234035 - RNA, 18 nt, Human
uucugcccuggcugcugc

SEQ ID NO: 2234036 - RNA, 13 nt, Human
uucugccgcagcc

SEQ ID NO: 2234037 - RNA, 13 nt, Human
uucugaccacacu

SEQ ID NO: 2234038 - RNA, 23 nt, Human
uucugacauuaacaguuuuccau

SEQ ID NO: 2234039 - RNA, 22 nt, Human
uucugacauuaacaguuuucca

SEQ ID NO: 2234040 - RNA, 20 nt, Human
uucugacauuaacaguuuuc

SEQ ID NO: 2234041 - RNA, 15 nt, Human
uucugacauuaacag

SEQ ID NO: 2234042 - RNA, 14 nt, Human
uucugacauuaaca

SEQ ID NO: 2234043 - RNA, 23 nt, Human
uucugacaucuuaguauuugcau

SEQ ID NO: 2234044 - RNA, 14 nt, Human
uucugacccaugcu

SEQ ID NO: 2234045 - RNA, 22 nt, Human
uucugaccacacuuccugucca

SEQ ID NO: 2234046 - RNA, 14 nt, Human
uucugaccacacuu

SEQ ID NO: 2234047 - RNA, 17 nt, Human
uucugaccacagcauca

SEQ ID NO: 2234048 - RNA, 20 nt, Human
uucugaccacagcaucauuu

SEQ ID NO: 2234049 - RNA, 22 nt, Human
uucugcaagcacaucugcauuu

SEQ ID NO: 2234050 - RNA, 14 nt, Human
uucugaccauuuca

SEQ ID NO: 2234051 - RNA, 13 nt, Human
uucugcaagccug

SEQ ID NO: 2234052 - RNA, 15 nt, Human
uucugcaagccugcg

SEQ ID NO: 2234053 - RNA, 12 nt, Human
uucugcacccuc

SEQ ID NO: 2234054 - RNA, 15 nt, Human
uucugcacacagcac

SEQ ID NO: 2234055 - RNA, 22 nt, Human
uucuccucuuguaaauaaagcc

SEQ ID NO: 2234056 - RNA, 18 nt, Human
uucuccugacccaguccc

SEQ ID NO: 2234057 - RNA, 17 nt, Human
uucuccucuuguaaaua

SEQ ID NO: 2234058 - RNA, 19 nt, Human
uucuccucuuguaaauaaa

SEQ ID NO: 2234059 - RNA, 13 nt, Human
uucuccucuugua

SEQ ID NO: 2234060 - RNA, 14 nt, Human
uucuccucuuguaa

SEQ ID NO: 2234061 - RNA, 14 nt, Human
uucuccucuccccu

SEQ ID NO: 2234062 - RNA, 20 nt, Human
uucuccucccuuccuuuucc

SEQ ID NO: 2234063 - RNA, 11 nt, Human
uucuccucccc

SEQ ID NO: 2234064 - RNA, 19 nt, Human
uucuccucccuuccuuuuc

SEQ ID NO: 2234065 - RNA, 21 nt, Human
uucucuaacuucaaggcccau

SEQ ID NO: 2234066 - RNA, 19 nt, Human
uucucuaagagaacaaugu

SEQ ID NO: 2234067 - RNA, 14 nt, Human
uucuccugccucag

SEQ ID NO: 2234068 - RNA, 13 nt, Human
uucuccugccuca

SEQ ID NO: 2234069 - RNA, 12 nt, Human
uucuccugccuc

SEQ ID NO: 2234070 - RNA, 19 nt, Human
aucauuuauuuuuuacauu

SEQ ID NO: 2234071 - RNA, 18 nt, Human
aucauugcuuugaagcag

SEQ ID NO: 2234072 - RNA, 21 nt, Human
aucauuuaauaauauacuugu

SEQ ID NO: 2234073 - RNA, 14 nt, Human
aucauuuaauaaua

SEQ ID NO: 2234074 - RNA, 17 nt, Human
aucauuuaauaauauac

SEQ ID NO: 2234075 - RNA, 18 nt, Human
aucauuuaauaauauacu

SEQ ID NO: 2234076 - RNA, 19 nt, Human
aucauuuaauaauauacuu

SEQ ID NO: 2234077 - RNA, 22 nt, Human
aucauuuauuuuuuacauuauu

SEQ ID NO: 2234078 - RNA, 15 nt, Human
aucauuucuauuucu

SEQ ID NO: 2234079 - RNA, 13 nt, Human
uucuccucccagg

SEQ ID NO: 2234080 - RNA, 20 nt, Human
aucauuucugcaucagcugc

SEQ ID NO: 2234081 - RNA, 13 nt, Human
aucauuguacagu

SEQ ID NO: 2234082 - RNA, 23 nt, Human
aucauugcuuugaagcaguugug

SEQ ID NO: 2234083 - RNA, 12 nt, Human
aucauuuaauaa

SEQ ID NO: 2234084 - RNA, 13 nt, Human
aucauuuaauaau

SEQ ID NO: 2234085 - RNA, 22 nt, Human
aucauuggauucugagagcugu

SEQ ID NO: 2234086 - RNA, 21 nt, Human
aucauuggauucugagagcug

SEQ ID NO: 2234087 - RNA, 18 nt, Human
aucauugauugucagcua

SEQ ID NO: 2234088 - RNA, 21 nt, Human
aucauugcacucuagccuggg

SEQ ID NO: 2234089 - RNA, 22 nt, Human
aucauugcacucuagccugggc

SEQ ID NO: 2234090 - RNA, 13 nt, Human
aucauugccuggu

SEQ ID NO: 2234091 - RNA, 21 nt, Human
aucauugaaaucuuuuugcuu

SEQ ID NO: 2234092 - RNA, 21 nt, Human
aucaggccaggcccucugccc

SEQ ID NO: 2234093 - RNA, 22 nt, Human
aucaggccaggcccucugccca

SEQ ID NO: 2234094 - RNA, 23 nt, Human
aucaggccaggcccucugcccac

SEQ ID NO: 2234095 - RNA, 20 nt, Human
aucaggccaggcccucugcc

SEQ ID NO: 2234096 - RNA, 20 nt, Human
uucuggugugaacuaaacuu

SEQ ID NO: 2234097 - RNA, 15 nt, Human
uucugguuccagggu

SEQ ID NO: 2234098 - RNA, 17 nt, Human
uucugguuccagggucc

SEQ ID NO: 2234099 - RNA, 22 nt, Human
uucuggcucucccauuuccuga

SEQ ID NO: 2234100 - RNA, 14 nt, Human
uucuggugugaacu

SEQ ID NO: 2234101 - RNA, 21 nt, Human
uucuggugugaacuaaacuuu

SEQ ID NO: 2234102 - RNA, 10 nt, Human
uucuggcuca

SEQ ID NO: 2234103 - RNA, 20 nt, Human
uucugcccuggcugcugccc

SEQ ID NO: 2234104 - RNA, 16 nt, Human
uucuggcucucccauu

SEQ ID NO: 2234105 - RNA, 17 nt, Human
uucuggcucagggaggu

SEQ ID NO: 2234106 - RNA, 17 nt, Human
uucuggcuccucaaaca

SEQ ID NO: 2234107 - RNA, 20 nt, Human
uucuggcuaugcauuugaaa

SEQ ID NO: 2234108 - RNA, 18 nt, Human
uucuggcuaugcauuuga

SEQ ID NO: 2234109 - RNA, 14 nt, Human
uucugccgcagccc

SEQ ID NO: 2234110 - RNA, 15 nt, Human
uucugccgcagcccu

SEQ ID NO: 2234111 - RNA, 22 nt, Human
uucugguugaugccugugaacu

SEQ ID NO: 2234112 - RNA, 17 nt, Human
uucuguaaaaugucugu

SEQ ID NO: 2234113 - RNA, 13 nt, Human
uucuguagaaaug

SEQ ID NO: 2234114 - RNA, 19 nt, Human
uucuguaaacucaaaacuu

SEQ ID NO: 2234115 - RNA, 20 nt, Human
uucuguaaacucaaaacuua

SEQ ID NO: 2234116 - RNA, 14 nt, Human
uucuguagaaaugg

SEQ ID NO: 2234117 - RNA, 15 nt, Human
uucuguagaaauggu

SEQ ID NO: 2234118 - RNA, 11 nt, Human
uucuguauaaa

SEQ ID NO: 2234119 - RNA, 21 nt, Human
uucuguauaaagccuguauuc

SEQ ID NO: 2234120 - RNA, 13 nt, Human
uucuguagauucu

SEQ ID NO: 2234121 - RNA, 23 nt, Human
uucuguaaacucaaaacuuaaca

SEQ ID NO: 2234122 - RNA, 16 nt, Human
uucuguagguucugug

SEQ ID NO: 2234123 - RNA, 18 nt, Human
uucuguagaaaugguugu

SEQ ID NO: 2234124 - RNA, 20 nt, Human
uucuguagaaaugguuguau

SEQ ID NO: 2234125 - RNA, 21 nt, Human
uucuguagaaaugguuguauu

SEQ ID NO: 2234126 - RNA, 22 nt, Human
uucuguagaaaugguuguauua

SEQ ID NO: 2234127 - RNA, 14 nt, Human
aucauuuuuguauc

SEQ ID NO: 2234128 - RNA, 20 nt, Human
aucauuuuuguacaguuugc

SEQ ID NO: 2234129 - RNA, 22 nt, Human
aucauuuuuguacaguuugcug

SEQ ID NO: 2234130 - RNA, 14 nt, Human
aucauuuuuguaca

SEQ ID NO: 2234131 - RNA, 15 nt, Human
aucauuuuuguacag

SEQ ID NO: 2234132 - RNA, 16 nt, Human
aucauuuuuguacagu

SEQ ID NO: 2234133 - RNA, 22 nt, Human
auccaaugcucaagaaacaacu

SEQ ID NO: 2234134 - RNA, 20 nt, Human
auccaauccucacugggugg

SEQ ID NO: 2234135 - RNA, 20 nt, Human
auccaaucuaaccacaucaa

SEQ ID NO: 2234136 - RNA, 19 nt, Human
auccaauccucacugggug

SEQ ID NO: 2234137 - RNA, 18 nt, Human
auccaauccucacugggu

SEQ ID NO: 2234138 - RNA, 17 nt, Human
auccaauccucacuggg

SEQ ID NO: 2234139 - RNA, 14 nt, Human
auccaauccucacu

SEQ ID NO: 2234140 - RNA, 22 nt, Human
auccaauauuuucuuuaaugcu

SEQ ID NO: 2234141 - RNA, 19 nt, Human
auccaauauuuucuuuaau

SEQ ID NO: 2234142 - RNA, 24 nt, Human
auccaauauuuucuuuaaugcuuu

SEQ ID NO: 2234143 - RNA, 14 nt, Human
auccaaggagaaac

SEQ ID NO: 2234144 - RNA, 13 nt, Human
auccaaggagaaa

SEQ ID NO: 2234145 - RNA, 23 nt, Human
auccaagcuuuuuuaaaguaaaa

SEQ ID NO: 2234146 - RNA, 20 nt, Human
auccaaacuuggauuuuuga

SEQ ID NO: 2234147 - RNA, 22 nt, Human
auccaaggagaaacagagacag

SEQ ID NO: 2234148 - RNA, 19 nt, Human
auccaaggagaaacagaga

SEQ ID NO: 2234149 - RNA, 12 nt, Human
auccaagugaac

SEQ ID NO: 2234150 - RNA, 13 nt, Human
auccaaaagaagc

SEQ ID NO: 2234151 - RNA, 19 nt, Human
auccaaaagaagcccccag

SEQ ID NO: 2234152 - RNA, 18 nt, Human
auccaaaagaagccccca

SEQ ID NO: 2234153 - RNA, 22 nt, Human
auccaaaagaagcccccagcua

SEQ ID NO: 2234154 - RNA, 13 nt, Human
auccaaaagcuuu

SEQ ID NO: 2234155 - RNA, 23 nt, Human
auccauuucaucuauuucugaga

SEQ ID NO: 2234156 - RNA, 22 nt, Human
auccauuucaucuauuucugag

SEQ ID NO: 2234157 - RNA, 21 nt, Human
auccauuucaucuauuucuga

SEQ ID NO: 2234158 - RNA, 20 nt, Human
auccauuucaucuauuucug

SEQ ID NO: 2234159 - RNA, 18 nt, Human
auccauuucaucuauuuc

SEQ ID NO: 2234160 - RNA, 16 nt, Human
auccauucuuucugau

SEQ ID NO: 2234161 - RNA, 15 nt, Human
auccauucuuucuga

SEQ ID NO: 2234162 - RNA, 13 nt, Human
auccauucuuucu

SEQ ID NO: 2234163 - RNA, 13 nt, Human
auccauaaagaag

SEQ ID NO: 2234164 - RNA, 14 nt, Human
auccauaaagaagc

SEQ ID NO: 2234165 - RNA, 16 nt, Human
auccauaaagaagcaa

SEQ ID NO: 2234166 - RNA, 17 nt, Human
auccauaaagaagcaau

SEQ ID NO: 2234167 - RNA, 21 nt, Human
auccauaaagaagcaauaaag

SEQ ID NO: 2234168 - RNA, 14 nt, Human
auccauacauuugu

SEQ ID NO: 2234169 - RNA, 15 nt, Human
aucccaagugccagu

SEQ ID NO: 2234170 - RNA, 14 nt, Human
aucccacacccugg

SEQ ID NO: 2234171 - RNA, 15 nt, Human
aucccaccaacccuc

SEQ ID NO: 2234172 - RNA, 14 nt, Human
aucccacccacaug

SEQ ID NO: 2234173 - RNA, 23 nt, Human
auccauuugcguuccaugaugcu

SEQ ID NO: 2234174 - RNA, 15 nt, Human
uucuuacaaacaugu

SEQ ID NO: 2234175 - RNA, 20 nt, Human
uucuuaauugcacucuaaaa

SEQ ID NO: 2234176 - RNA, 13 nt, Human
uucuuaauucuua

SEQ ID NO: 2234177 - RNA, 17 nt, Human
uucuuaaacaaauguau

SEQ ID NO: 2234178 - RNA, 15 nt, Human
uucuuaaaauauauu

SEQ ID NO: 2234179 - RNA, 13 nt, Human
uucuuaaagaguu

SEQ ID NO: 2234180 - RNA, 17 nt, Human
uucuuaaagucaagauu

SEQ ID NO: 2234181 - RNA, 22 nt, Human
uucuuaaucuuuucacaaauaa

SEQ ID NO: 2234182 - RNA, 23 nt, Human
uucuuaaucuuuucacaaauaaa

SEQ ID NO: 2234183 - RNA, 23 nt, Human
uucuuccucccucccucuuuccc

SEQ ID NO: 2234184 - RNA, 12 nt, Human
uucuuacaagga

SEQ ID NO: 2234185 - RNA, 14 nt, Human
uucuuaauugcacu

SEQ ID NO: 2234186 - RNA, 13 nt, Human
uucuuacagacug

SEQ ID NO: 2234187 - RNA, 13 nt, Human
uucuuacauaauu

SEQ ID NO: 2234188 - RNA, 16 nt, Human
uucuuacauaauuuuu

SEQ ID NO: 2234189 - RNA, 11 nt, Human
uucuuccucug

SEQ ID NO: 2234190 - RNA, 12 nt, Human
uucuuccucugc

SEQ ID NO: 2234191 - RNA, 13 nt, Human
uucuuccucugcu

SEQ ID NO: 2234192 - RNA, 20 nt, Human
uucuguuuuucuaggccugg

SEQ ID NO: 2234193 - RNA, 21 nt, Human
uucuuaaaauauauuucagau

SEQ ID NO: 2234194 - RNA, 21 nt, Human
uucuguuggccagugugacaa

SEQ ID NO: 2234195 - RNA, 16 nt, Human
uucuguuuugccugaa

SEQ ID NO: 2234196 - RNA, 17 nt, Human
uucuguugcugccucau

SEQ ID NO: 2234197 - RNA, 17 nt, Human
uucuguuuugccugaag

SEQ ID NO: 2234198 - RNA, 16 nt, Human
aucccacgcuucucuu

SEQ ID NO: 2234199 - RNA, 17 nt, Human
aucccacgcacuccaug

SEQ ID NO: 2234200 - RNA, 18 nt, Human
aucccacgcacuccauga

SEQ ID NO: 2234201 - RNA, 21 nt, Human
uucuguuuugccugaaguugg

SEQ ID NO: 2234202 - RNA, 16 nt, Human
aucccacgcacuccau

SEQ ID NO: 2234203 - RNA, 18 nt, Human
aucccacgcuucucuuug

SEQ ID NO: 2234204 - RNA, 15 nt, Human
aucccacccacaugu

SEQ ID NO: 2234205 - RNA, 18 nt, Human
aucccacccacaugugac

SEQ ID NO: 2234206 - RNA, 20 nt, Human
aucccacccacaugugacac

SEQ ID NO: 2234207 - RNA, 23 nt, Human
aucccacccacaugugacacaua

SEQ ID NO: 2234208 - RNA, 16 nt, Human
uucuguugcugccuca

SEQ ID NO: 2234209 - RNA, 15 nt, Human
uucuguugcugccuc

SEQ ID NO: 2234210 - RNA, 18 nt, Human
uucuguucuuucuggcua

SEQ ID NO: 2234211 - RNA, 19 nt, Human
uucuuuguguagcuuugcu

SEQ ID NO: 2234212 - RNA, 12 nt, Human
uucuuuguguag

SEQ ID NO: 2234213 - RNA, 16 nt, Human
uucuuuguuacaggca

SEQ ID NO: 2234214 - RNA, 21 nt, Human
uucuuuuaaaggggcagaaaa

SEQ ID NO: 2234215 - RNA, 15 nt, Human
uucuuugaaauuguu

SEQ ID NO: 2234216 - RNA, 20 nt, Human
uucuuucuuagaaauuuauu

SEQ ID NO: 2234217 - RNA, 16 nt, Human
uucuuucuuugggaau

SEQ ID NO: 2234218 - RNA, 16 nt, Human
uucuuuguaaugaaaa

SEQ ID NO: 2234219 - RNA, 13 nt, Human
uucuuucuuccuc

SEQ ID NO: 2234220 - RNA, 15 nt, Human
uucuuucuuccucug

SEQ ID NO: 2234221 - RNA, 13 nt, Human
uucuuucuuagaa

SEQ ID NO: 2234222 - RNA, 19 nt, Human
uucuugguucauaaaugaa

SEQ ID NO: 2234223 - RNA, 14 nt, Human
uucuuucuuagaaa

SEQ ID NO: 2234224 - RNA, 15 nt, Human
uucuuucuuagaaau

SEQ ID NO: 2234225 - RNA, 22 nt, Human
uucuuucuggcuaugcauuuga

SEQ ID NO: 2234226 - RNA, 18 nt, Human
uucuuggggcccuacacc

SEQ ID NO: 2234227 - RNA, 14 nt, Human
uucuugguagagau

SEQ ID NO: 2234228 - RNA, 16 nt, Human
uucuugguagagauuc

SEQ ID NO: 2234229 - RNA, 15 nt, Human
uucuugguagagauu

SEQ ID NO: 2234230 - RNA, 21 nt, Human
uucuuggugcuuacacaucuc

SEQ ID NO: 2234231 - RNA, 17 nt, Human
uucuugguucauaaaug

SEQ ID NO: 2234232 - RNA, 18 nt, Human
uucuugguucauaaauga

SEQ ID NO: 2234233 - RNA, 23 nt, Human
uucuugcugguugucauuuuugc

SEQ ID NO: 2234234 - RNA, 13 nt, Human
uucuugcaaagua

SEQ ID NO: 2234235 - RNA, 14 nt, Human
uucuugggcccucc

SEQ ID NO: 2234236 - RNA, 20 nt, Human
uucuuggggcccuacaccuu

SEQ ID NO: 2234237 - RNA, 14 nt, Human
uucuugcugguugu

SEQ ID NO: 2234238 - RNA, 18 nt, Human
uucuuggagucuuccaaa

SEQ ID NO: 2234239 - RNA, 22 nt, Human
uucuuccuuaauucacucccac

SEQ ID NO: 2234240 - RNA, 21 nt, Human
uucuugaauuuaauaaucugu

SEQ ID NO: 2234241 - RNA, 21 nt, Human
uucuugaucaacaucuuuucu

SEQ ID NO: 2234242 - RNA, 16 nt, Human
uucuugauguugcuua

SEQ ID NO: 2234243 - RNA, 12 nt, Human
uucuugcaaagu

SEQ ID NO: 2234244 - RNA, 17 nt, Human
uugaacccaggaguuca

SEQ ID NO: 2234245 - RNA, 12 nt, Human
uugaacccagga

SEQ ID NO: 2234246 - RNA, 21 nt, Human
auccuaagcuauucaguaaua

SEQ ID NO: 2234247 - RNA, 13 nt, Human
uugaacccaggag

SEQ ID NO: 2234248 - RNA, 18 nt, Human
uugaacacucaugcugaa

SEQ ID NO: 2234249 - RNA, 19 nt, Human
uugaacacucaugcugaaa

SEQ ID NO: 2234250 - RNA, 21 nt, Human
uugaacacaaacuguaaauaa

SEQ ID NO: 2234251 - RNA, 20 nt, Human
uugaacacaaacuguaaaua

SEQ ID NO: 2234252 - RNA, 13 nt, Human
uugaacacugggg

SEQ ID NO: 2234253 - RNA, 20 nt, Human
uugaacacucaugcugaaag

SEQ ID NO: 2234254 - RNA, 16 nt, Human
uugaaccacuucccuc

SEQ ID NO: 2234255 - RNA, 18 nt, Human
uugaacccgggaggcaga

SEQ ID NO: 2234256 - RNA, 21 nt, Human
auccuaggcauuugcugaaua

SEQ ID NO: 2234257 - RNA, 20 nt, Human
auccuagguaggguuuaauc

SEQ ID NO: 2234258 - RNA, 17 nt, Human
auccuagggccuggguu

SEQ ID NO: 2234259 - RNA, 13 nt, Human
auccuagggccug

SEQ ID NO: 2234260 - RNA, 20 nt, Human
auccuaauuucuccucccuu

SEQ ID NO: 2234261 - RNA, 23 nt, Human
auccuaauuucuccucccuuccu

SEQ ID NO: 2234262 - RNA, 13 nt, Human
auccuaguuccac

SEQ ID NO: 2234263 - RNA, 20 nt, Human
auccuagucucuaucauuaa

SEQ ID NO: 2234264 - RNA, 23 nt, Human
auccuagucucuaucauuaaagu

SEQ ID NO: 2234265 - RNA, 12 nt, Human
auccuaaugaau

SEQ ID NO: 2234266 - RNA, 13 nt, Human
auccuaaugaaug

SEQ ID NO: 2234267 - RNA, 19 nt, Human
auccuaaucauccaaugcu

SEQ ID NO: 2234268 - RNA, 21 nt, Human
auccuaaugacuucuaaaaau

SEQ ID NO: 2234269 - RNA, 19 nt, Human
auccuaaugaaugcauaaa

SEQ ID NO: 2234270 - RNA, 15 nt, Human
auccuaauuucuccu

SEQ ID NO: 2234271 - RNA, 16 nt, Human
auccuaauuucuccuc

SEQ ID NO: 2234272 - RNA, 18 nt, Human
auccuaauuucuccuccc

SEQ ID NO: 2234273 - RNA, 19 nt, Human
auccuaauuucuccucccu

SEQ ID NO: 2234274 - RNA, 15 nt, Human
uucuuuuuauugaau

SEQ ID NO: 2234275 - RNA, 15 nt, Human
uucuuuuuauuuucu

SEQ ID NO: 2234276 - RNA, 20 nt, Human
uucuuuuguauguaaaugug

SEQ ID NO: 2234277 - RNA, 13 nt, Human
uucuuuuguaauu

SEQ ID NO: 2234278 - RNA, 14 nt, Human
uucuuuuguaugua

SEQ ID NO: 2234279 - RNA, 18 nt, Human
uucuuuuguauguaaaug

SEQ ID NO: 2234280 - RNA, 23 nt, Human
uucuuuucgccguggcugcggca

SEQ ID NO: 2234281 - RNA, 19 nt, Human
uucuuuucacauucuuaua

SEQ ID NO: 2234282 - RNA, 20 nt, Human
uucuuuucacauucuuauaa

SEQ ID NO: 2234283 - RNA, 19 nt, Human
uucuuuuacucaugaucuu

SEQ ID NO: 2234284 - RNA, 12 nt, Human
uucuuuucacau

SEQ ID NO: 2234285 - RNA, 15 nt, Human
uucuuuucacauucu

SEQ ID NO: 2234286 - RNA, 17 nt, Human
uucuuuucacauucuua

SEQ ID NO: 2234287 - RNA, 12 nt, Human
uucuuuuaucac

SEQ ID NO: 2234288 - RNA, 16 nt, Human
uugaaaguuuacagga

SEQ ID NO: 2234289 - RNA, 16 nt, Human
uucuuuuuauuuucuu

SEQ ID NO: 2234290 - RNA, 18 nt, Human
uucuuuuucuucuucccu

SEQ ID NO: 2234291 - RNA, 15 nt, Human
uugaaauaauaaauc

SEQ ID NO: 2234292 - RNA, 17 nt, Human
uugaaaguuuucagaac

SEQ ID NO: 2234293 - RNA, 20 nt, Human
uugaacaaguuguuucauug

SEQ ID NO: 2234294 - RNA, 14 nt, Human
uugaacacaaacug

SEQ ID NO: 2234295 - RNA, 18 nt, Human
uugaacacaaacuguaaa

SEQ ID NO: 2234296 - RNA, 15 nt, Human
uugaacacaaacugu

SEQ ID NO: 2234297 - RNA, 12 nt, Human
uugaaauuuuaa

SEQ ID NO: 2234298 - RNA, 21 nt, Human
uugaaauuuuuauuaaauuau

SEQ ID NO: 2234299 - RNA, 21 nt, Human
uugaaaugaaaguauaacuga

SEQ ID NO: 2234300 - RNA, 15 nt, Human
uugaaaucuguaucu

SEQ ID NO: 2234301 - RNA, 13 nt, Human
uugaaaucuuuua

SEQ ID NO: 2234302 - RNA, 11 nt, Human
uugaaaucuuu

SEQ ID NO: 2234303 - RNA, 20 nt, Human
uugaaauauaggaacuuaaa

SEQ ID NO: 2234304 - RNA, 19 nt, Human
uugaaauauugacuuuuua

SEQ ID NO: 2234305 - RNA, 14 nt, Human
uucauauugaauau

SEQ ID NO: 2234306 - RNA, 18 nt, Human
uucauauugcugagagaa

SEQ ID NO: 2234307 - RNA, 18 nt, Human
uucauauguugcucaguc

SEQ ID NO: 2234308 - RNA, 14 nt, Human
uucauauguugcuc

SEQ ID NO: 2234309 - RNA, 16 nt, Human
uucauauguugcucag

SEQ ID NO: 2234310 - RNA, 20 nt, Human
uucauauguaccauguacau

SEQ ID NO: 2234311 - RNA, 13 nt, Human
uucauauguugcu

SEQ ID NO: 2234312 - RNA, 13 nt, Human
uucauaugcugua

SEQ ID NO: 2234313 - RNA, 18 nt, Human
uucauacacagccugggc

SEQ ID NO: 2234314 - RNA, 12 nt, Human
uucauacaaggc

SEQ ID NO: 2234315 - RNA, 21 nt, Human
uucauacagggaugguguuca

SEQ ID NO: 2234316 - RNA, 19 nt, Human
uucauaauuauuauuuggc

SEQ ID NO: 2234317 - RNA, 18 nt, Human
uucagugccuuauggaac

SEQ ID NO: 2234318 - RNA, 13 nt, Human
uucagaaauaugu

SEQ ID NO: 2234319 - RNA, 15 nt, Human
uucagaaaugcugcc

SEQ ID NO: 2234320 - RNA, 16 nt, Human
uucagaaaugcugccu

SEQ ID NO: 2234321 - RNA, 17 nt, Human
uucagaaaugcugccug

SEQ ID NO: 2234322 - RNA, 18 nt, Human
uucagaaagugugcuuua

SEQ ID NO: 2234323 - RNA, 16 nt, Human
uucagaaagugugcuu

SEQ ID NO: 2234324 - RNA, 13 nt, Human
uucagaaaugugu

SEQ ID NO: 2234325 - RNA, 11 nt, Human
uucagaaaugu

SEQ ID NO: 2234326 - RNA, 14 nt, Human
uucagugcccacca

SEQ ID NO: 2234327 - RNA, 10 nt, Human
uucagugccc

SEQ ID NO: 2234328 - RNA, 22 nt, Human
uucagaaaugcugccugccugu

SEQ ID NO: 2234329 - RNA, 13 nt, Human
uucagugccaaua

SEQ ID NO: 2234330 - RNA, 18 nt, Human
uucagaaaugcugccugc

SEQ ID NO: 2234331 - RNA, 19 nt, Human
uucagaaaugcugccugcc

SEQ ID NO: 2234332 - RNA, 20 nt, Human
uucagaaaugcugccugccu

SEQ ID NO: 2234333 - RNA, 21 nt, Human
uucagaaaugcugccugccug

SEQ ID NO: 2234334 - RNA, 16 nt, Human
uucagugccaaaaaca

SEQ ID NO: 2234335 - RNA, 12 nt, Human
uucagugccuua

SEQ ID NO: 2234336 - RNA, 13 nt, Human
uucagugccuuau

SEQ ID NO: 2234337 - RNA, 21 nt, Human
uucaucccucuggggcuguuc

SEQ ID NO: 2234338 - RNA, 12 nt, Human
auauauguauuu

SEQ ID NO: 2234339 - RNA, 12 nt, Human
auauaugugaac

SEQ ID NO: 2234340 - RNA, 18 nt, Human
auauaugugaacauuuau

SEQ ID NO: 2234341 - RNA, 12 nt, Human
auauauguguau

SEQ ID NO: 2234342 - RNA, 16 nt, Human
uucaucccaugaugua

SEQ ID NO: 2234343 - RNA, 18 nt, Human
uucaucccaugauguagu

SEQ ID NO: 2234344 - RNA, 19 nt, Human
uucaucccaugauguagug

SEQ ID NO: 2234345 - RNA, 21 nt, Human
uucaucccaugauguagugcc

SEQ ID NO: 2234346 - RNA, 17 nt, Human
uucaucccucuggggcu

SEQ ID NO: 2234347 - RNA, 12 nt, Human
uucauauugugc

SEQ ID NO: 2234348 - RNA, 14 nt, Human
uucauauugugcca

SEQ ID NO: 2234349 - RNA, 16 nt, Human
uucauauugugccaau

SEQ ID NO: 2234350 - RNA, 22 nt, Human
uucauauugugccaauauguau

SEQ ID NO: 2234351 - RNA, 19 nt, Human
uucaucccaacugucuuuu

SEQ ID NO: 2234352 - RNA, 20 nt, Human
uucauauuguggcacaagca

SEQ ID NO: 2234353 - RNA, 23 nt, Human
uucauccacucugccugcuuaca

SEQ ID NO: 2234354 - RNA, 13 nt, Human
auauauuugugua

SEQ ID NO: 2234355 - RNA, 15 nt, Human
auauauuuaaugaua

SEQ ID NO: 2234356 - RNA, 13 nt, Human
auauauuuaauga

SEQ ID NO: 2234357 - RNA, 12 nt, Human
auauauuuuaag

SEQ ID NO: 2234358 - RNA, 13 nt, Human
auauauuuuaaga

SEQ ID NO: 2234359 - RNA, 12 nt, Human
auauauuuaaaa

SEQ ID NO: 2234360 - RNA, 19 nt, Human
auauauugguaacauccuu

SEQ ID NO: 2234361 - RNA, 21 nt, Human
auauauugguaacauccuuuc

SEQ ID NO: 2234362 - RNA, 13 nt, Human
auauauugaauua

SEQ ID NO: 2234363 - RNA, 14 nt, Human
auauauugaauuaa

SEQ ID NO: 2234364 - RNA, 23 nt, Human
auauauguguguuuaaauaaagu

SEQ ID NO: 2234365 - RNA, 12 nt, Human
auauauugcugc

SEQ ID NO: 2234366 - RNA, 16 nt, Human
auauauguguguuuaa

SEQ ID NO: 2234367 - RNA, 18 nt, Human
auauauguguguuuaaau

SEQ ID NO: 2234368 - RNA, 20 nt, Human
auauauguguguuuaaauaa

SEQ ID NO: 2234369 - RNA, 21 nt, Human
auauauguguguuuaaauaaa

SEQ ID NO: 2234370 - RNA, 16 nt, Human
auauauguguguguau

SEQ ID NO: 2234371 - RNA, 19 nt, Human
auauauguguguguauguu

SEQ ID NO: 2234372 - RNA, 14 nt, Human
auauaugugaugau

SEQ ID NO: 2234373 - RNA, 13 nt, Human
auauauguguaug

SEQ ID NO: 2234374 - RNA, 15 nt, Human
auauauguguaugua

SEQ ID NO: 2234375 - RNA, 22 nt, Human
auauauuuguguauuuaacagg

SEQ ID NO: 2234376 - RNA, 17 nt, Human
auauauuuguguauuua

SEQ ID NO: 2234377 - RNA, 21 nt, Human
auauauuuguguauuuaacag

SEQ ID NO: 2234378 - RNA, 14 nt, Human
auauauuuuaagac

SEQ ID NO: 2234379 - RNA, 14 nt, Human
auaucuauauauaa

SEQ ID NO: 2234380 - RNA, 16 nt, Human
auaucuauauauaauu

SEQ ID NO: 2234381 - RNA, 21 nt, Human
auaucuauauauaauucugua

SEQ ID NO: 2234382 - RNA, 17 nt, Human
auaucuauauguacuug

SEQ ID NO: 2234383 - RNA, 17 nt, Human
auaucuauauauaauuc

SEQ ID NO: 2234384 - RNA, 20 nt, Human
auaucuauauauaauucugu

SEQ ID NO: 2234385 - RNA, 23 nt, Human
auaucuauauauaauucuguaca

SEQ ID NO: 2234386 - RNA, 17 nt, Human
auaugaaaaauaugaua

SEQ ID NO: 2234387 - RNA, 14 nt, Human
auaugaaaaauaug

SEQ ID NO: 2234388 - RNA, 13 nt, Human
auaugaaaaauau

SEQ ID NO: 2234389 - RNA, 14 nt, Human
auaucuuuugaccu

SEQ ID NO: 2234390 - RNA, 20 nt, Human
auaugaaaaaaaugcauuuu

SEQ ID NO: 2234391 - RNA, 19 nt, Human
auaugaaaaauaugauauu

SEQ ID NO: 2234392 - RNA, 18 nt, Human
auaugaaaaauaugauau

SEQ ID NO: 2234393 - RNA, 16 nt, Human
auaugaaaauacaacu

SEQ ID NO: 2234394 - RNA, 16 nt, Human
auaucuuuauuaauca

SEQ ID NO: 2234395 - RNA, 13 nt, Human
auaucuuuauuaa

SEQ ID NO: 2234396 - RNA, 20 nt, Human
auaucugaaaauguaugugu

SEQ ID NO: 2234397 - RNA, 17 nt, Human
auaucugaaaauguaug

SEQ ID NO: 2234398 - RNA, 16 nt, Human
auaucugaaaauguau

SEQ ID NO: 2234399 - RNA, 12 nt, Human
auaucucaucuc

SEQ ID NO: 2234400 - RNA, 22 nt, Human
auauggguugcauuuggucaag

SEQ ID NO: 2234401 - RNA, 16 nt, Human
auaugcacacauuuuu

SEQ ID NO: 2234402 - RNA, 15 nt, Human
auaugcacacauuuu

SEQ ID NO: 2234403 - RNA, 14 nt, Human
auaugcacacauuu

SEQ ID NO: 2234404 - RNA, 23 nt, Human
auaugaggaugcagagucagcag

SEQ ID NO: 2234405 - RNA, 23 nt, Human
auaugaaaauacaacuuaaauaa

SEQ ID NO: 2234406 - RNA, 20 nt, Human
auaugagcuuuauguaauaa

SEQ ID NO: 2234407 - RNA, 16 nt, Human
auaugauauguaaaca

SEQ ID NO: 2234408 - RNA, 21 nt, Human
auaugaguuucauagcuaaga

SEQ ID NO: 2234409 - RNA, 14 nt, Human
auaugauauguaaa

SEQ ID NO: 2234410 - RNA, 20 nt, Human
auaugaguguggaagccgga

SEQ ID NO: 2234411 - RNA, 23 nt, Human
auaugaguguggaagccggaggg

SEQ ID NO: 2234412 - RNA, 17 nt, Human
auaugaguuucauagcu

SEQ ID NO: 2234413 - RNA, 19 nt, Human
auaugaguuucauagcuaa

SEQ ID NO: 2234414 - RNA, 16 nt, Human
auaugauauugcauau

SEQ ID NO: 2234415 - RNA, 15 nt, Human
auaugauauugcaua

SEQ ID NO: 2234416 - RNA, 16 nt, Human
auauguaaaauaaaau

SEQ ID NO: 2234417 - RNA, 15 nt, Human
auauguaaaauaaaa

SEQ ID NO: 2234418 - RNA, 14 nt, Human
auauguaaaauaaa

SEQ ID NO: 2234419 - RNA, 13 nt, Human
auauguaaaauaa

SEQ ID NO: 2234420 - RNA, 16 nt, Human
auauguaacaagccac

SEQ ID NO: 2234421 - RNA, 12 nt, Human
auauguaaaaua

SEQ ID NO: 2234422 - RNA, 21 nt, Human
auaugauuaguaaagaaauga

SEQ ID NO: 2234423 - RNA, 17 nt, Human
auauguaacaagccacc

SEQ ID NO: 2234424 - RNA, 20 nt, Human
auauguaaaauaaaauuaug

SEQ ID NO: 2234425 - RNA, 11 nt, Human
auaugugaauc

SEQ ID NO: 2234426 - RNA, 19 nt, Human
auaugugaacauuuaucaa

SEQ ID NO: 2234427 - RNA, 19 nt, Human
auauguaccauguacauga

SEQ ID NO: 2234428 - RNA, 14 nt, Human
auauguaccaugua

SEQ ID NO: 2234429 - RNA, 14 nt, Human
auauguacaugaga

SEQ ID NO: 2234430 - RNA, 12 nt, Human
uuccaagagcug

SEQ ID NO: 2234431 - RNA, 13 nt, Human
uuccaagagcuga

SEQ ID NO: 2234432 - RNA, 22 nt, Human
uuccaagagccugagagugagg

SEQ ID NO: 2234433 - RNA, 14 nt, Human
uuccaagagccuga

SEQ ID NO: 2234434 - RNA, 17 nt, Human
uuccaaggguacuaagg

SEQ ID NO: 2234435 - RNA, 15 nt, Human
uuccaaggguacuaa

SEQ ID NO: 2234436 - RNA, 17 nt, Human
uucauuguauaaaaaua

SEQ ID NO: 2234437 - RNA, 13 nt, Human
uucauuguauaaa

SEQ ID NO: 2234438 - RNA, 16 nt, Human
uucauuguaugaugug

SEQ ID NO: 2234439 - RNA, 13 nt, Human
uucauuuacugug

SEQ ID NO: 2234440 - RNA, 17 nt, Human
uucauuuaaaaugauua

SEQ ID NO: 2234441 - RNA, 14 nt, Human
uucauuguaugaug

SEQ ID NO: 2234442 - RNA, 13 nt, Human
uucauuuaaaaug

SEQ ID NO: 2234443 - RNA, 14 nt, Human
uucauuuaaaauga

SEQ ID NO: 2234444 - RNA, 15 nt, Human
uucauuuaaaaugau

SEQ ID NO: 2234445 - RNA, 16 nt, Human
uucauuuaaaaugauu

SEQ ID NO: 2234446 - RNA, 21 nt, Human
uucauuuagcuaaacggauuc

SEQ ID NO: 2234447 - RNA, 13 nt, Human
uuccaagagccug

SEQ ID NO: 2234448 - RNA, 18 nt, Human
uucauuuaggugaggaag

SEQ ID NO: 2234449 - RNA, 16 nt, Human
uucauuuacuguggcu

SEQ ID NO: 2234450 - RNA, 19 nt, Human
uucauuuacuguggcuucu

SEQ ID NO: 2234451 - RNA, 18 nt, Human
auaugugcuugccucagu

SEQ ID NO: 2234452 - RNA, 19 nt, Human
auaugugcuggaauucuaa

SEQ ID NO: 2234453 - RNA, 9 nt, Human
uucauucag

SEQ ID NO: 2234454 - RNA, 16 nt, Human
auauguggaguucauc

SEQ ID NO: 2234455 - RNA, 18 nt, Human
auaugugcuggaauucua

SEQ ID NO: 2234456 - RNA, 21 nt, Human
auaugugaauccucuucuuua

SEQ ID NO: 2234457 - RNA, 15 nt, Human
auauguggaguucau

SEQ ID NO: 2234458 - RNA, 20 nt, Human
uucauuguaauguuacugau

SEQ ID NO: 2234459 - RNA, 18 nt, Human
uucauuguaauguuacug

SEQ ID NO: 2234460 - RNA, 17 nt, Human
uucauuguaauguuacu

SEQ ID NO: 2234461 - RNA, 13 nt, Human
uucauucuccugc

SEQ ID NO: 2234462 - RNA, 15 nt, Human
uucauucuccugccu

SEQ ID NO: 2234463 - RNA, 18 nt, Human
uucauuccuaacacagca

SEQ ID NO: 2234464 - RNA, 22 nt, Human
uucauucaugucauguguacaa

SEQ ID NO: 2234465 - RNA, 16 nt, Human
uucauuccauucugga

SEQ ID NO: 2234466 - RNA, 18 nt, Human
uuccacacucaccucuaa

SEQ ID NO: 2234467 - RNA, 22 nt, Human
uuccacaccuuuuauugacaca

SEQ ID NO: 2234468 - RNA, 15 nt, Human
uuccacaccuuuuau

SEQ ID NO: 2234469 - RNA, 22 nt, Human
uuccacacccccaccccuugcu

SEQ ID NO: 2234470 - RNA, 19 nt, Human
uuccacaccuggcacugcu

SEQ ID NO: 2234471 - RNA, 19 nt, Human
uuccaccaucaagccacca

SEQ ID NO: 2234472 - RNA, 19 nt, Human
uuccacaccuagcaucuca

SEQ ID NO: 2234473 - RNA, 16 nt, Human
uuccacacccccaccc

SEQ ID NO: 2234474 - RNA, 17 nt, Human
uuccacacccccacccc

SEQ ID NO: 2234475 - RNA, 18 nt, Human
uuccacaccaagcagcaa

SEQ ID NO: 2234476 - RNA, 13 nt, Human
uuccacaccccca

SEQ ID NO: 2234477 - RNA, 15 nt, Human
uuccacacccccacc

SEQ ID NO: 2234478 - RNA, 21 nt, Human
uuccacaagauucccagagac

SEQ ID NO: 2234479 - RNA, 20 nt, Human
uuccacaagauucccagaga

SEQ ID NO: 2234480 - RNA, 19 nt, Human
uuccacaagauucccagag

SEQ ID NO: 2234481 - RNA, 13 nt, Human
uuccaaugucugc

SEQ ID NO: 2234482 - RNA, 16 nt, Human
uuccaaggaguuccau

SEQ ID NO: 2234483 - RNA, 13 nt, Human
uuccaaggcuucu

SEQ ID NO: 2234484 - RNA, 20 nt, Human
uuccaagguggucugcucgg

SEQ ID NO: 2234485 - RNA, 12 nt, Human
uuccaagugugc

SEQ ID NO: 2234486 - RNA, 16 nt, Human
uuccaaguugcuaaua

SEQ ID NO: 2234487 - RNA, 14 nt, Human
uuccaagugugcau

SEQ ID NO: 2234488 - RNA, 20 nt, Human
uuccaagugugcauauugua

SEQ ID NO: 2234489 - RNA, 16 nt, Human
uuccaauaugaugacu

SEQ ID NO: 2234490 - RNA, 22 nt, Human
uuccaagugugcauauuguaca

SEQ ID NO: 2234491 - RNA, 13 nt, Human
uuccaauaaacag

SEQ ID NO: 2234492 - RNA, 13 nt, Human
uuccaauaaacca

SEQ ID NO: 2234493 - RNA, 21 nt, Human
uuccaauaaaccagguuuaga

SEQ ID NO: 2234494 - RNA, 22 nt, Human
uuccacaagagcccaggccucc

SEQ ID NO: 2234495 - RNA, 13 nt, Human
uuccacccuggaa

SEQ ID NO: 2234496 - RNA, 11 nt, Human
uuccacccugg

SEQ ID NO: 2234497 - RNA, 20 nt, Human
uuccacccccucccuggccu

SEQ ID NO: 2234498 - RNA, 18 nt, Human
uuccacccccucccuggc

SEQ ID NO: 2234499 - RNA, 15 nt, Human
uuccacccccucccu

SEQ ID NO: 2234500 - RNA, 14 nt, Human
uuccacccccuccc

SEQ ID NO: 2234501 - RNA, 20 nt, Human
uuccagcucaccccccacac

SEQ ID NO: 2234502 - RNA, 23 nt, Human
uuccagcucaccccccacacuca

SEQ ID NO: 2234503 - RNA, 13 nt, Human
uuccaccucaccc

SEQ ID NO: 2234504 - RNA, 15 nt, Human
uuccaccucacccca

SEQ ID NO: 2234505 - RNA, 12 nt, Human
uuccaccucccu

SEQ ID NO: 2234506 - RNA, 13 nt, Human
uuccaccucccuc

SEQ ID NO: 2234507 - RNA, 13 nt, Human
uuccacccccucc

SEQ ID NO: 2234508 - RNA, 12 nt, Human
uuccacccccuc

SEQ ID NO: 2234509 - RNA, 21 nt, Human
uuccacaccuggcacugcugu

SEQ ID NO: 2234510 - RNA, 21 nt, Human
uuccaggaaacuccacaucug

SEQ ID NO: 2234511 - RNA, 13 nt, Human
uuccagcuccuca

SEQ ID NO: 2234512 - RNA, 22 nt, Human
uuccaggaaacuccacaucugc

SEQ ID NO: 2234513 - RNA, 24 nt, Human
uuccaggaaacuccacaucugccu

SEQ ID NO: 2234514 - RNA, 18 nt, Human
uuccagcuggaugagaau

SEQ ID NO: 2234515 - RNA, 11 nt, Human
uuccagcuccu

SEQ ID NO: 2234516 - RNA, 14 nt, Human
uuccagcuccugua

SEQ ID NO: 2234517 - RNA, 21 nt, Human
uuccaggcuaaacauccaaua

SEQ ID NO: 2234518 - RNA, 23 nt, Human
uuccaggaaacuccacaucugcc

SEQ ID NO: 2234519 - RNA, 17 nt, Human
uuccaggggugggacac

SEQ ID NO: 2234520 - RNA, 21 nt, Human
uuccagugcaacacugaagcu

SEQ ID NO: 2234521 - RNA, 19 nt, Human
uuccagugcaacacugaag

SEQ ID NO: 2234522 - RNA, 15 nt, Human
uuccagugcaacacu

SEQ ID NO: 2234523 - RNA, 23 nt, Human
uuccagugguccauggaaugcuu

SEQ ID NO: 2234524 - RNA, 18 nt, Human
uuccaguguccuuagaac

SEQ ID NO: 2234525 - RNA, 15 nt, Human
uuccauaaacaccca

SEQ ID NO: 2234526 - RNA, 11 nt, Human
uuccaguuccc

SEQ ID NO: 2234527 - RNA, 18 nt, Human
uuccauaaagaagauguu

SEQ ID NO: 2234528 - RNA, 22 nt, Human
uuccauaaagaagauguuuaac

SEQ ID NO: 2234529 - RNA, 19 nt, Human
uuccauaaucuggacuccu

SEQ ID NO: 2234530 - RNA, 22 nt, Human
uuccauaaucuggacuccucug

SEQ ID NO: 2234531 - RNA, 23 nt, Human
uuccauaaucuggacuccucugu

SEQ ID NO: 2234532 - RNA, 16 nt, Human
uuccauaauuaugaca

SEQ ID NO: 2234533 - RNA, 14 nt, Human
uuccauaauuauga

SEQ ID NO: 2234534 - RNA, 13 nt, Human
uuccauaauuaug

SEQ ID NO: 2234535 - RNA, 12 nt, Human
uuccauaauuau

SEQ ID NO: 2234536 - RNA, 19 nt, Human
uuccauaauguauaaagaa

SEQ ID NO: 2234537 - RNA, 16 nt, Human
uuccauaauguauaaa

SEQ ID NO: 2234538 - RNA, 19 nt, Human
uuccauaaggaauguagcu

SEQ ID NO: 2234539 - RNA, 17 nt, Human
uuccauaaggaauguag

SEQ ID NO: 2234540 - RNA, 22 nt, Human
uuccauaauuaugacaguuaua

SEQ ID NO: 2234541 - RNA, 18 nt, Human
uuccauaauuaugacagu

SEQ ID NO: 2234542 - RNA, 15 nt, Human
uuccauacagcucua

SEQ ID NO: 2234543 - RNA, 16 nt, Human
uucccaaaggacucca

SEQ ID NO: 2234544 - RNA, 17 nt, Human
uucccaaaggacuccac

SEQ ID NO: 2234545 - RNA, 19 nt, Human
uucccaaaggacuccaccc

SEQ ID NO: 2234546 - RNA, 20 nt, Human
uucccaaaggacuccaccca

SEQ ID NO: 2234547 - RNA, 23 nt, Human
uucccaaagcagugcaugcuguc

SEQ ID NO: 2234548 - RNA, 18 nt, Human
uuccagguaucuccagga

SEQ ID NO: 2234549 - RNA, 19 nt, Human
uuccagguaucuccaggau

SEQ ID NO: 2234550 - RNA, 15 nt, Human
uuccaggugggguga

SEQ ID NO: 2234551 - RNA, 17 nt, Human
uuccagguaucuccagg

SEQ ID NO: 2234552 - RNA, 20 nt, Human
uuccagggucccucugugua

SEQ ID NO: 2234553 - RNA, 17 nt, Human
uuccagugaggcucugc

SEQ ID NO: 2234554 - RNA, 21 nt, Human
uuccaggggugggacacccug

SEQ ID NO: 2234555 - RNA, 16 nt, Human
uuccagggucccucug

SEQ ID NO: 2234556 - RNA, 18 nt, Human
uuccagggucccucugug

SEQ ID NO: 2234557 - RNA, 19 nt, Human
uuccagggucccucugugu

SEQ ID NO: 2234558 - RNA, 19 nt, Human
uuccagugaggcucugccc

SEQ ID NO: 2234559 - RNA, 20 nt, Human
uuccagugaggcucugcccu

SEQ ID NO: 2234560 - RNA, 21 nt, Human
uuccagugaggcucugcccuu

SEQ ID NO: 2234561 - RNA, 22 nt, Human
uuccagugaggcucugcccuug

SEQ ID NO: 2234562 - RNA, 18 nt, Human
uucccaccaggcugcuca

SEQ ID NO: 2234563 - RNA, 15 nt, Human
uucccaccaaggucu

SEQ ID NO: 2234564 - RNA, 12 nt, Human
uucccaccucuc

SEQ ID NO: 2234565 - RNA, 22 nt, Human
uucccaccucucucacuccuug

SEQ ID NO: 2234566 - RNA, 15 nt, Human
uucccacccaucgcu

SEQ ID NO: 2234567 - RNA, 14 nt, Human
uucccaauuaggaa

SEQ ID NO: 2234568 - RNA, 23 nt, Human
uucccaauagcaacguagcuucu

SEQ ID NO: 2234569 - RNA, 14 nt, Human
uucccaauucacau

SEQ ID NO: 2234570 - RNA, 18 nt, Human
uucccacaggacauuucu

SEQ ID NO: 2234571 - RNA, 21 nt, Human
uucccacaccuccacaguuca

SEQ ID NO: 2234572 - RNA, 13 nt, Human
uucccaauugcuu

SEQ ID NO: 2234573 - RNA, 16 nt, Human
uucccacaccuccaca

SEQ ID NO: 2234574 - RNA, 17 nt, Human
uucccacaccuccacag

SEQ ID NO: 2234575 - RNA, 20 nt, Human
uucccaauagcaacguagcu

SEQ ID NO: 2234576 - RNA, 11 nt, Human
uucccaagcuc

SEQ ID NO: 2234577 - RNA, 18 nt, Human
uucccaagcucugcuccu

SEQ ID NO: 2234578 - RNA, 15 nt, Human
uucccaacucuagcu

SEQ ID NO: 2234579 - RNA, 18 nt, Human
uucccaacucuagcuggg

SEQ ID NO: 2234580 - RNA, 17 nt, Human
uucccaacucuagcugg

SEQ ID NO: 2234581 - RNA, 18 nt, Human
uucccaacuccagaaagu

SEQ ID NO: 2234582 - RNA, 12 nt, Human
uucccaaauuuc

SEQ ID NO: 2234583 - RNA, 13 nt, Human
uucccaagcucug

SEQ ID NO: 2234584 - RNA, 14 nt, Human
uucccaagcucugc

SEQ ID NO: 2234585 - RNA, 15 nt, Human
uucccaagcucugcu

SEQ ID NO: 2234586 - RNA, 16 nt, Human
uucccaagcucugcuc

SEQ ID NO: 2234587 - RNA, 18 nt, Human
auaggaaaaguacauuua

SEQ ID NO: 2234588 - RNA, 17 nt, Human
auagcuuuuauuguaua

SEQ ID NO: 2234589 - RNA, 18 nt, Human
auagcuuuuauuguauaa

SEQ ID NO: 2234590 - RNA, 21 nt, Human
auaggaaaguauuuuuuuaag

SEQ ID NO: 2234591 - RNA, 19 nt, Human
auaggaaaaguacauuuaa

SEQ ID NO: 2234592 - RNA, 21 nt, Human
auaggaacauaugaaaauaca

SEQ ID NO: 2234593 - RNA, 18 nt, Human
auaggaacauaugaaaau

SEQ ID NO: 2234594 - RNA, 16 nt, Human
auaggaacauaugaaa

SEQ ID NO: 2234595 - RNA, 15 nt, Human
auaggaacauaugaa

SEQ ID NO: 2234596 - RNA, 22 nt, Human
auaggaauugacccacaagaaa

SEQ ID NO: 2234597 - RNA, 22 nt, Human
auaggacucaaaguuucagaga

SEQ ID NO: 2234598 - RNA, 23 nt, Human
auaggaccuuuccaccacagcca

SEQ ID NO: 2234599 - RNA, 14 nt, Human
auaggaccuuucca

SEQ ID NO: 2234600 - RNA, 20 nt, Human
auaggaccuuuccaccacag

SEQ ID NO: 2234601 - RNA, 14 nt, Human
auaggagaggauga

SEQ ID NO: 2234602 - RNA, 19 nt, Human
auaggagaggaugagagcc

SEQ ID NO: 2234603 - RNA, 20 nt, Human
auaggagaggaugagagccc

SEQ ID NO: 2234604 - RNA, 21 nt, Human
auaggagaggaugagagccca

SEQ ID NO: 2234605 - RNA, 14 nt, Human
auaggccugggugc

SEQ ID NO: 2234606 - RNA, 15 nt, Human
auaggagccugcugg

SEQ ID NO: 2234607 - RNA, 16 nt, Human
auaggagccugcuggu

SEQ ID NO: 2234608 - RNA, 23 nt, Human
auaggagaggaugagagcccaga

SEQ ID NO: 2234609 - RNA, 24 nt, Human
auaggagaggaugagagcccagag

SEQ ID NO: 2234610 - RNA, 12 nt, Human
auaggagccugc

SEQ ID NO: 2234611 - RNA, 13 nt, Human
auaggagccugcu

SEQ ID NO: 2234612 - RNA, 17 nt, Human
auaggcguaacuaauuu

SEQ ID NO: 2234613 - RNA, 22 nt, Human
uucacauuaauauuugcugaca

SEQ ID NO: 2234614 - RNA, 12 nt, Human
uucacauucuua

SEQ ID NO: 2234615 - RNA, 13 nt, Human
uucacauucuuau

SEQ ID NO: 2234616 - RNA, 16 nt, Human
uucacauucuuauaaa

SEQ ID NO: 2234617 - RNA, 20 nt, Human
uucacauucuuauaaauaug

SEQ ID NO: 2234618 - RNA, 22 nt, Human
auagcuuuucccuuuuuuuaag

SEQ ID NO: 2234619 - RNA, 14 nt, Human
auagcuuuuauugu

SEQ ID NO: 2234620 - RNA, 19 nt, Human
uucacauucuuauaaauau

SEQ ID NO: 2234621 - RNA, 15 nt, Human
auagcuuuuauugua

SEQ ID NO: 2234622 - RNA, 12 nt, Human
auaggaaaaacu

SEQ ID NO: 2234623 - RNA, 14 nt, Human
auaggaaaaacuga

SEQ ID NO: 2234624 - RNA, 16 nt, Human
auaggaaaaacugauu

SEQ ID NO: 2234625 - RNA, 17 nt, Human
auaggaaaaacugauuu

SEQ ID NO: 2234626 - RNA, 21 nt, Human
uucacacacaggcaacugagg

SEQ ID NO: 2234627 - RNA, 20 nt, Human
uucacaaugaaaugcucucc

SEQ ID NO: 2234628 - RNA, 13 nt, Human
uucacaauagaaa

SEQ ID NO: 2234629 - RNA, 16 nt, Human
uucaagucaccuccuu

SEQ ID NO: 2234630 - RNA, 15 nt, Human
uucacacuuccacca

SEQ ID NO: 2234631 - RNA, 12 nt, Human
uucacacuucca

SEQ ID NO: 2234632 - RNA, 21 nt, Human
uucacacugcaagagccuugg

SEQ ID NO: 2234633 - RNA, 13 nt, Human
uucacacugucug

SEQ ID NO: 2234634 - RNA, 14 nt, Human
uucacacucucaca

SEQ ID NO: 2234635 - RNA, 22 nt, Human
uucacacucucacauguuuaga

SEQ ID NO: 2234636 - RNA, 14 nt, Human
uucacaccugacuc

SEQ ID NO: 2234637 - RNA, 19 nt, Human
uucacaccugacucugaaa

SEQ ID NO: 2234638 - RNA, 21 nt, Human
uucacaccugacucugaaauc

SEQ ID NO: 2234639 - RNA, 17 nt, Human
uucaagugaaucuaaaa

SEQ ID NO: 2234640 - RNA, 21 nt, Human
uucaaguauuagggguaauau

SEQ ID NO: 2234641 - RNA, 16 nt, Human
uucaaguaauugugaa

SEQ ID NO: 2234642 - RNA, 15 nt, Human
uucaaguaauucugc

SEQ ID NO: 2234643 - RNA, 18 nt, Human
uucaaguaauucugcugu

SEQ ID NO: 2234644 - RNA, 21 nt, Human
uucaaguacuguaacuguguc

SEQ ID NO: 2234645 - RNA, 17 nt, Human
uucaagugauucucaug

SEQ ID NO: 2234646 - RNA, 23 nt, Human
uucacaagacccaaaaggcagaa

SEQ ID NO: 2234647 - RNA, 13 nt, Human
uucacaguuuuuc

SEQ ID NO: 2234648 - RNA, 19 nt, Human
uucacauccuguguuucua

SEQ ID NO: 2234649 - RNA, 21 nt, Human
uucacaguucuuugggccaga

SEQ ID NO: 2234650 - RNA, 23 nt, Human
uucacaguuggcuggaugaaauu

SEQ ID NO: 2234651 - RNA, 13 nt, Human
uucacaguucucu

SEQ ID NO: 2234652 - RNA, 20 nt, Human
uucacaguucuuugggccag

SEQ ID NO: 2234653 - RNA, 12 nt, Human
uucacagcuccu

SEQ ID NO: 2234654 - RNA, 21 nt, Human
uucacauccuguguuucuagg

SEQ ID NO: 2234655 - RNA, 19 nt, Human
uucacaucuaaccucaucu

SEQ ID NO: 2234656 - RNA, 18 nt, Human
uucacaucuaaccucauc

SEQ ID NO: 2234657 - RNA, 18 nt, Human
uucacaugcaucaaguua

SEQ ID NO: 2234658 - RNA, 14 nt, Human
uucacaugaacaua

SEQ ID NO: 2234659 - RNA, 19 nt, Human
uucacaugagcuauuucca

SEQ ID NO: 2234660 - RNA, 20 nt, Human
uucacaucuaaccucaucuu

SEQ ID NO: 2234661 - RNA, 13 nt, Human
uucacaugaacau

SEQ ID NO: 2234662 - RNA, 19 nt, Human
uucacacuuccaccagccu

SEQ ID NO: 2234663 - RNA, 18 nt, Human
uucacacuuccaccagcc

SEQ ID NO: 2234664 - RNA, 20 nt, Human
uucacacuuccaccagccug

SEQ ID NO: 2234665 - RNA, 21 nt, Human
uucacagagugugcuggagga

SEQ ID NO: 2234666 - RNA, 12 nt, Human
uucacagagugu

SEQ ID NO: 2234667 - RNA, 20 nt, Human
uucacagaugggugcuugga

SEQ ID NO: 2234668 - RNA, 15 nt, Human
uucacaguucucucc

SEQ ID NO: 2234669 - RNA, 20 nt, Human
uucacaguucucuccuucuu

SEQ ID NO: 2234670 - RNA, 17 nt, Human
uucaaaaguugaaauua

SEQ ID NO: 2234671 - RNA, 16 nt, Human
uucaaaaguugaaauu

SEQ ID NO: 2234672 - RNA, 21 nt, Human
uucaaaaguauuuuccuguaa

SEQ ID NO: 2234673 - RNA, 21 nt, Human
uucaaaagaaucagaaacagg

SEQ ID NO: 2234674 - RNA, 20 nt, Human
uucaaaaguauuuuccugua

SEQ ID NO: 2234675 - RNA, 17 nt, Human
uucaaaauaaaaaugag

SEQ ID NO: 2234676 - RNA, 14 nt, Human
uucaaaauaaaaac

SEQ ID NO: 2234677 - RNA, 21 nt, Human
uucaaaauuguuacaaauugu

SEQ ID NO: 2234678 - RNA, 15 nt, Human
uucaaacacaaaugc

SEQ ID NO: 2234679 - RNA, 17 nt, Human
uucaaacacaaaugcag

SEQ ID NO: 2234680 - RNA, 16 nt, Human
uucaaaauuguuacaa

SEQ ID NO: 2234681 - RNA, 14 nt, Human
uucaaacacaaaug

SEQ ID NO: 2234682 - RNA, 23 nt, Human
uucaagaauaaucacgcuuuccu

SEQ ID NO: 2234683 - RNA, 14 nt, Human
uucaaacauauaua

SEQ ID NO: 2234684 - RNA, 18 nt, Human
uucaaacagucucaggaa

SEQ ID NO: 2234685 - RNA, 17 nt, Human
uucaagguggccaaauu

SEQ ID NO: 2234686 - RNA, 22 nt, Human
uucaagguggccaaauuauuug

SEQ ID NO: 2234687 - RNA, 18 nt, Human
uucaagguggccaaauua

SEQ ID NO: 2234688 - RNA, 20 nt, Human
uucaagguggccaaauuauu

SEQ ID NO: 2234689 - RNA, 19 nt, Human
uucaagguaauuucuugug

SEQ ID NO: 2234690 - RNA, 21 nt, Human
uucaagcgauucuucugcuuc

SEQ ID NO: 2234691 - RNA, 20 nt, Human
uucaagcgauucuucugccu

SEQ ID NO: 2234692 - RNA, 17 nt, Human
uucaagcagauuggaga

SEQ ID NO: 2234693 - RNA, 17 nt, Human
uucaagcagucgugccu

SEQ ID NO: 2234694 - RNA, 18 nt, Human
uucaagcagucgugccug

SEQ ID NO: 2234695 - RNA, 22 nt, Human
uucaagcagucgugccuguguc

SEQ ID NO: 2234696 - RNA, 15 nt, Human
uucaagcauuaagaa

SEQ ID NO: 2234697 - RNA, 23 nt, Human
uucaagcagucgugccugugucc

SEQ ID NO: 2234698 - RNA, 18 nt, Human
uucaagaccuucucccca

SEQ ID NO: 2234699 - RNA, 18 nt, Human
uucaagacauuaaaucua

SEQ ID NO: 2234700 - RNA, 18 nt, Human
uucaagagauuuaauuaa

SEQ ID NO: 2234701 - RNA, 18 nt, Human
uuauuuuuagacagaguc

SEQ ID NO: 2234702 - RNA, 20 nt, Human
uuauuuuuauaucagccuga

SEQ ID NO: 2234703 - RNA, 18 nt, Human
uuauuuuuacauucugaa

SEQ ID NO: 2234704 - RNA, 17 nt, Human
uuauuuuuagacagagu

SEQ ID NO: 2234705 - RNA, 19 nt, Human
uuaguuuuuguaauuuauu

SEQ ID NO: 2234706 - RNA, 13 nt, Human
uuauuuuuaaaau

SEQ ID NO: 2234707 - RNA, 18 nt, Human
uuaguuuuuguaauuuau

SEQ ID NO: 2234708 - RNA, 17 nt, Human
uuaguuuuuguaauuua

SEQ ID NO: 2234709 - RNA, 17 nt, Human
uuaguuuuaguugcaga

SEQ ID NO: 2234710 - RNA, 15 nt, Human
uuaguuuuaguugca

SEQ ID NO: 2234711 - RNA, 16 nt, Human
uuaguuuguguguugu

SEQ ID NO: 2234712 - RNA, 16 nt, Human
uuaguuuugaugaguu

SEQ ID NO: 2234713 - RNA, 12 nt, Human
uuaguuuugauu

SEQ ID NO: 2234714 - RNA, 20 nt, Human
uuaguuuuuaaaauaucuuu

SEQ ID NO: 2234715 - RNA, 14 nt, Human
uuauuuuuuucuac

SEQ ID NO: 2234716 - RNA, 17 nt, Human
uucaaaaccuuuugaaa

SEQ ID NO: 2234717 - RNA, 17 nt, Human
uuauuuuuuucugaauu

SEQ ID NO: 2234718 - RNA, 13 nt, Human
uuauuuuuuucug

SEQ ID NO: 2234719 - RNA, 14 nt, Human
uuauuuuuucagac

SEQ ID NO: 2234720 - RNA, 15 nt, Human
uuauuuuuucagacc

SEQ ID NO: 2234721 - RNA, 16 nt, Human
uuauuuuuucagaccg

SEQ ID NO: 2234722 - RNA, 19 nt, Human
uuauuuuuucagaccgaaa

SEQ ID NO: 2234723 - RNA, 13 nt, Human
uuauuuuuuccca

SEQ ID NO: 2234724 - RNA, 20 nt, Human
uuauuuuuucagaccgaaaa

SEQ ID NO: 2234725 - RNA, 20 nt, Human
uuauuuuuuuaagcuguaaa

SEQ ID NO: 2234726 - RNA, 13 nt, Human
uuauuuuuuauug

SEQ ID NO: 2234727 - RNA, 12 nt, Human
uuauuuuuucag

SEQ ID NO: 2234728 - RNA, 13 nt, Human
uuauuuuuucaga

SEQ ID NO: 2234729 - RNA, 14 nt, Human
uuauuuuuuacauu

SEQ ID NO: 2234730 - RNA, 18 nt, Human
uuauuuuuuacauuauua

SEQ ID NO: 2234731 - RNA, 18 nt, Human
uuauuuuuuaaguauuua

SEQ ID NO: 2234732 - RNA, 23 nt, Human
uuauuuuuguuucuuccaaagca

SEQ ID NO: 2234733 - RNA, 14 nt, Human
uuauuuuuuaauua

SEQ ID NO: 2234734 - RNA, 16 nt, Human
uuauuuuuuaauuauu

SEQ ID NO: 2234735 - RNA, 14 nt, Human
uuauuuuucauauu

SEQ ID NO: 2234736 - RNA, 16 nt, Human
uuauuuuucauauugu

SEQ ID NO: 2234737 - RNA, 19 nt, Human
uuauuuuucauauugugcc

SEQ ID NO: 2234738 - RNA, 10 nt, Human
uuauuuuucu

SEQ ID NO: 2234739 - RNA, 23 nt, Human
uuauuuuugacaguguugaaaau

SEQ ID NO: 2234740 - RNA, 14 nt, Human
uuauuuuucuaaaa

SEQ ID NO: 2234741 - RNA, 22 nt, Human
uuauuuuucuaagguucucaua

SEQ ID NO: 2234742 - RNA, 16 nt, Human
auaguggggagacuuc

SEQ ID NO: 2234743 - RNA, 20 nt, Human
auagugggcaccccacugca

SEQ ID NO: 2234744 - RNA, 22 nt, Human
auaguggacauuguuggcagca

SEQ ID NO: 2234745 - RNA, 17 nt, Human
auagugcuuaaaaauca

SEQ ID NO: 2234746 - RNA, 15 nt, Human
auaguggugugauuu

SEQ ID NO: 2234747 - RNA, 17 nt, Human
auaguggcuuaaaacaa

SEQ ID NO: 2234748 - RNA, 20 nt, Human
auagugcucgcuuucuaugu

SEQ ID NO: 2234749 - RNA, 23 nt, Human
auagugcucgcuuucuauguagu

SEQ ID NO: 2234750 - RNA, 23 nt, Human
auaguguguucugauuagaaaug

SEQ ID NO: 2234751 - RNA, 12 nt, Human
auaguguuaauc

SEQ ID NO: 2234752 - RNA, 15 nt, Human
auaguguuaaucaau

SEQ ID NO: 2234753 - RNA, 21 nt, Human
auaguguguucugauuagaaa

SEQ ID NO: 2234754 - RNA, 19 nt, Human
auaguguguucugauuaga

SEQ ID NO: 2234755 - RNA, 17 nt, Human
auaguguguucugauua

SEQ ID NO: 2234756 - RNA, 15 nt, Human
auaguguguucugau

SEQ ID NO: 2234757 - RNA, 22 nt, Human
auaguguucugcaaaaauauuu

SEQ ID NO: 2234758 - RNA, 16 nt, Human
auaguguuaaucaauu

SEQ ID NO: 2234759 - RNA, 18 nt, Human
auaguguuaaucaauuua

SEQ ID NO: 2234760 - RNA, 20 nt, Human
auaguguuaaucaauuuaaa

SEQ ID NO: 2234761 - RNA, 21 nt, Human
auaguguuaaucaauuuaaac

SEQ ID NO: 2234762 - RNA, 13 nt, Human
auaguguaaaaua

SEQ ID NO: 2234763 - RNA, 22 nt, Human
auagugggcccuccgacagccc

SEQ ID NO: 2234764 - RNA, 14 nt, Human
auaguguaaaauaa

SEQ ID NO: 2234765 - RNA, 14 nt, Human
auaguguguucuga

SEQ ID NO: 2234766 - RNA, 13 nt, Human
auaguguguucug

SEQ ID NO: 2234767 - RNA, 12 nt, Human
auaguguguucu

SEQ ID NO: 2234768 - RNA, 23 nt, Human
auaguguggaaauuaagaagaaa

SEQ ID NO: 2234769 - RNA, 22 nt, Human
auaggcucugcacagauggauu

SEQ ID NO: 2234770 - RNA, 19 nt, Human
auaggcucugcacagaugg

SEQ ID NO: 2234771 - RNA, 15 nt, Human
auaggcucugcacag

SEQ ID NO: 2234772 - RNA, 14 nt, Human
auaggcucugcaca

SEQ ID NO: 2234773 - RNA, 13 nt, Human
auaggcucugcac

SEQ ID NO: 2234774 - RNA, 12 nt, Human
auaggcucugca

SEQ ID NO: 2234775 - RNA, 11 nt, Human
auaggcucugc

SEQ ID NO: 2234776 - RNA, 21 nt, Human
auaggcgaucacaacgugcau

SEQ ID NO: 2234777 - RNA, 20 nt, Human
auagucuagauggcuccucu

SEQ ID NO: 2234778 - RNA, 13 nt, Human
auagucuuucagu

SEQ ID NO: 2234779 - RNA, 13 nt, Human
auagucuguguga

SEQ ID NO: 2234780 - RNA, 14 nt, Human
auagucuuuugcuu

SEQ ID NO: 2234781 - RNA, 16 nt, Human
auagucuuuugcuuuu

SEQ ID NO: 2234782 - RNA, 17 nt, Human
auagucuuuugcuuuug

SEQ ID NO: 2234783 - RNA, 18 nt, Human
auagugacuaugaacuuc

SEQ ID NO: 2234784 - RNA, 20 nt, Human
auagugauguaaucuugaau

SEQ ID NO: 2234785 - RNA, 21 nt, Human
auagugaggcaucgcaaugua

SEQ ID NO: 2234786 - RNA, 14 nt, Human
auauaaaaaacuuu

SEQ ID NO: 2234787 - RNA, 19 nt, Human
auaguuuuuaagguuauuu

SEQ ID NO: 2234788 - RNA, 20 nt, Human
auaguuuuuaagguuauuua

SEQ ID NO: 2234789 - RNA, 23 nt, Human
auauaaaaaccccaaacuguuga

SEQ ID NO: 2234790 - RNA, 17 nt, Human
auauaaaaagaaaagau

SEQ ID NO: 2234791 - RNA, 18 nt, Human
auauaaaaagaaaagaua

SEQ ID NO: 2234792 - RNA, 20 nt, Human
auauaaaaagaaaagauaaa

SEQ ID NO: 2234793 - RNA, 23 nt, Human
auauaaaaagaaaagauaaagau

SEQ ID NO: 2234794 - RNA, 22 nt, Human
auauaaaaagaaaagauaaaga

SEQ ID NO: 2234795 - RNA, 13 nt, Human
auauaaaacugcg

SEQ ID NO: 2234796 - RNA, 22 nt, Human
auauaaaacugcguuaaaggcu

SEQ ID NO: 2234797 - RNA, 17 nt, Human
auauaaaacuguacuuc

SEQ ID NO: 2234798 - RNA, 22 nt, Human
auaguuuacuauuuuacuucua

SEQ ID NO: 2234799 - RNA, 16 nt, Human
auaguuuacuauuuua

SEQ ID NO: 2234800 - RNA, 15 nt, Human
auaguuuacuauuuu

SEQ ID NO: 2234801 - RNA, 17 nt, Human
auaguuuaccugaauaa

SEQ ID NO: 2234802 - RNA, 13 nt, Human
auaguuuauugac

SEQ ID NO: 2234803 - RNA, 14 nt, Human
auaguuuauugaca

SEQ ID NO: 2234804 - RNA, 18 nt, Human
auaguuuuuaagguuauu

SEQ ID NO: 2234805 - RNA, 19 nt, Human
auaguugcuccgccucugc

SEQ ID NO: 2234806 - RNA, 13 nt, Human
auaguugagcccc

SEQ ID NO: 2234807 - RNA, 20 nt, Human
auaguugagccagcagacau

SEQ ID NO: 2234808 - RNA, 21 nt, Human
auaguugagccagcagacauu

SEQ ID NO: 2234809 - RNA, 22 nt, Human
auaguugagccagcagacauug

SEQ ID NO: 2234810 - RNA, 23 nt, Human
auaguugagccagcagacauugu

SEQ ID NO: 2234811 - RNA, 22 nt, Human
auaguuggcuaggaccccucca

SEQ ID NO: 2234812 - RNA, 20 nt, Human
auaguuguaccgcaauguga

SEQ ID NO: 2234813 - RNA, 13 nt, Human
auaguuguaacua

SEQ ID NO: 2234814 - RNA, 17 nt, Human
auaguuguggacauuua

SEQ ID NO: 2234815 - RNA, 18 nt, Human
auaguugugggugggaga

SEQ ID NO: 2234816 - RNA, 14 nt, Human
auaguuuacaugua

SEQ ID NO: 2234817 - RNA, 17 nt, Human
auaguugagccagcaga

SEQ ID NO: 2234818 - RNA, 18 nt, Human
auaguugagccagcagac

SEQ ID NO: 2234819 - RNA, 22 nt, Human
auaguucccuagucuauucauu

SEQ ID NO: 2234820 - RNA, 17 nt, Human
auaguucccauguuaaa

SEQ ID NO: 2234821 - RNA, 15 nt, Human
auaguucaaagccaa

SEQ ID NO: 2234822 - RNA, 16 nt, Human
auaguuacuguuguga

SEQ ID NO: 2234823 - RNA, 23 nt, Human
auaguuaggauagcauuuuugau

SEQ ID NO: 2234824 - RNA, 22 nt, Human
auaguuaagcgugcauaaguua

SEQ ID NO: 2234825 - RNA, 20 nt, Human
auaguuacuccagugccaac

SEQ ID NO: 2234826 - RNA, 12 nt, Human
auaguuacuguu

SEQ ID NO: 2234827 - RNA, 15 nt, Human
auaguuagaaccugg

SEQ ID NO: 2234828 - RNA, 22 nt, Human
uucacuguccuccaagccagcg

SEQ ID NO: 2234829 - RNA, 22 nt, Human
uucacugucaggaagaaaucac

SEQ ID NO: 2234830 - RNA, 13 nt, Human
auauaugaggacu

SEQ ID NO: 2234831 - RNA, 21 nt, Human
uucacugucaggaagaaauca

SEQ ID NO: 2234832 - RNA, 22 nt, Human
uucacuguauaaauaggagagg

SEQ ID NO: 2234833 - RNA, 23 nt, Human
uucacuguauaaauaggagagga

SEQ ID NO: 2234834 - RNA, 15 nt, Human
uucacuuauauguuc

SEQ ID NO: 2234835 - RNA, 15 nt, Human
uucacuuacagcacc

SEQ ID NO: 2234836 - RNA, 21 nt, Human
uucacuguugaaaauuauuuu

SEQ ID NO: 2234837 - RNA, 14 nt, Human
auauaucuaucuua

SEQ ID NO: 2234838 - RNA, 17 nt, Human
auauaucuaaauuuaga

SEQ ID NO: 2234839 - RNA, 18 nt, Human
auauaucuaaauugaaua

SEQ ID NO: 2234840 - RNA, 19 nt, Human
auauaucuaaauugaauaa

SEQ ID NO: 2234841 - RNA, 12 nt, Human
auauauccucug

SEQ ID NO: 2234842 - RNA, 16 nt, Human
auauaucccagaaauu

SEQ ID NO: 2234843 - RNA, 15 nt, Human
auauaucuaucuuau

SEQ ID NO: 2234844 - RNA, 19 nt, Human
auauaucugcuguccagac

SEQ ID NO: 2234845 - RNA, 20 nt, Human
auauaucugcuguccagaca

SEQ ID NO: 2234846 - RNA, 15 nt, Human
auauaucugcuucag

SEQ ID NO: 2234847 - RNA, 17 nt, Human
auauaucugcuucagug

SEQ ID NO: 2234848 - RNA, 18 nt, Human
auauaucugcuucagugg

SEQ ID NO: 2234849 - RNA, 13 nt, Human
auauauauuuuaa

SEQ ID NO: 2234850 - RNA, 10 nt, Human
auauauauuu

SEQ ID NO: 2234851 - RNA, 15 nt, Human
auauaucaugaguga

SEQ ID NO: 2234852 - RNA, 13 nt, Human
auauaucauauug

SEQ ID NO: 2234853 - RNA, 20 nt, Human
auauaucauauugguauuca

SEQ ID NO: 2234854 - RNA, 20 nt, Human
auauauauguguguguaugu

SEQ ID NO: 2234855 - RNA, 21 nt, Human
auauauaucugcuguccagac

SEQ ID NO: 2234856 - RNA, 16 nt, Human
auauauaugccaugau

SEQ ID NO: 2234857 - RNA, 12 nt, Human
auauauauaaau

SEQ ID NO: 2234858 - RNA, 22 nt, Human
auauauaagauggaagcuucca

SEQ ID NO: 2234859 - RNA, 15 nt, Human
auauauaauucugua

SEQ ID NO: 2234860 - RNA, 14 nt, Human
auauauauauauaa

SEQ ID NO: 2234861 - RNA, 19 nt, Human
auauauaauucuguacaua

SEQ ID NO: 2234862 - RNA, 14 nt, Human
auauauauaaauaa

SEQ ID NO: 2234863 - RNA, 13 nt, Human
auauauauauaaa

SEQ ID NO: 2234864 - RNA, 14 nt, Human
auauauauccucug

SEQ ID NO: 2234865 - RNA, 15 nt, Human
auauauauauauauu

SEQ ID NO: 2234866 - RNA, 16 nt, Human
auauauauauauauaa

SEQ ID NO: 2234867 - RNA, 18 nt, Human
auauaaauaaaacauuuu

SEQ ID NO: 2234868 - RNA, 14 nt, Human
auauaaauaaauau

SEQ ID NO: 2234869 - RNA, 15 nt, Human
auauaaauaaaacau

SEQ ID NO: 2234870 - RNA, 22 nt, Human
auauaaauaaauauauauaucc

SEQ ID NO: 2234871 - RNA, 15 nt, Human
auauaaauaaauaua

SEQ ID NO: 2234872 - RNA, 16 nt, Human
auauaaauaaauauau

SEQ ID NO: 2234873 - RNA, 17 nt, Human
auauaaauaaauauaua

SEQ ID NO: 2234874 - RNA, 19 nt, Human
auauaaauaaauauauaua

SEQ ID NO: 2234875 - RNA, 16 nt, Human
auauaaaagacugacc

SEQ ID NO: 2234876 - RNA, 14 nt, Human
auauaaagauguua

SEQ ID NO: 2234877 - RNA, 13 nt, Human
auauaaaggaaaa

SEQ ID NO: 2234878 - RNA, 22 nt, Human
auauaaaacuguacuucacugu

SEQ ID NO: 2234879 - RNA, 20 nt, Human
auauaaaaggcaaaugugua

SEQ ID NO: 2234880 - RNA, 19 nt, Human
auauaaaguaguccuguga

SEQ ID NO: 2234881 - RNA, 13 nt, Human
auauaacugccuu

SEQ ID NO: 2234882 - RNA, 18 nt, Human
auauaacuauugcccagg

SEQ ID NO: 2234883 - RNA, 20 nt, Human
auauaacugccuuaaaacuu

SEQ ID NO: 2234884 - RNA, 14 nt, Human
auauaaauauauau

SEQ ID NO: 2234885 - RNA, 21 nt, Human
auauaacuuauauuguaagaa

SEQ ID NO: 2234886 - RNA, 20 nt, Human
auauaacuuauauuguaaga

SEQ ID NO: 2234887 - RNA, 16 nt, Human
auauaacuuauauugu

SEQ ID NO: 2234888 - RNA, 21 nt, Human
auauaacuuaaaaauguaaau

SEQ ID NO: 2234889 - RNA, 23 nt, Human
auauaaccacaaagcacaguuug

SEQ ID NO: 2234890 - RNA, 11 nt, Human
auauaaauaua

SEQ ID NO: 2234891 - RNA, 12 nt, Human
auauaaauauau

SEQ ID NO: 2234892 - RNA, 13 nt, Human
auauaaauauaua

SEQ ID NO: 2234893 - RNA, 15 nt, Human
auauaaauauauaua

SEQ ID NO: 2234894 - RNA, 22 nt, Human
auauaacuuauauuguaagaaa

SEQ ID NO: 2234895 - RNA, 21 nt, Human
auauauaaaaagaaaagauaa

SEQ ID NO: 2234896 - RNA, 13 nt, Human
auauauaaaauaa

SEQ ID NO: 2234897 - RNA, 14 nt, Human
auauauaaaauaaa

SEQ ID NO: 2234898 - RNA, 16 nt, Human
auauauaaaauaaaua

SEQ ID NO: 2234899 - RNA, 10 nt, Human
auauauaaau

SEQ ID NO: 2234900 - RNA, 18 nt, Human
auauauaaaauaaauaua

SEQ ID NO: 2234901 - RNA, 20 nt, Human
auauauaaaauaaauauaua

SEQ ID NO: 2234902 - RNA, 21 nt, Human
auauauaaaccuaaaaaagau

SEQ ID NO: 2234903 - RNA, 14 nt, Human
auauauaacaaugc

SEQ ID NO: 2234904 - RNA, 11 nt, Human
auauauaaaua

SEQ ID NO: 2234905 - RNA, 12 nt, Human
auauauaaauaa

SEQ ID NO: 2234906 - RNA, 13 nt, Human
auauauaaauaaa

SEQ ID NO: 2234907 - RNA, 13 nt, Human
auauauaaauaua

SEQ ID NO: 2234908 - RNA, 16 nt, Human
auauauaaauaaauau

SEQ ID NO: 2234909 - RNA, 17 nt, Human
auauauaaauaaauaua

SEQ ID NO: 2234910 - RNA, 12 nt, Human
auauauaaccag

SEQ ID NO: 2234911 - RNA, 14 nt, Human
auauauaaauauau

SEQ ID NO: 2234912 - RNA, 18 nt, Human
auauauaaauauauauaa

SEQ ID NO: 2234913 - RNA, 13 nt, Human
auauauaaccagu

SEQ ID NO: 2234914 - RNA, 15 nt, Human
auauauaaguguaca

SEQ ID NO: 2234915 - RNA, 16 nt, Human
auauauaaguguacau

SEQ ID NO: 2234916 - RNA, 20 nt, Human
auauauaaguguacauaugu

SEQ ID NO: 2234917 - RNA, 22 nt, Human
auuuguaaaaacagcauugcuu

SEQ ID NO: 2234918 - RNA, 23 nt, Human
auuuguaaaaacagcauugcuuu

SEQ ID NO: 2234919 - RNA, 23 nt, Human
auuuguaaaagaacaguaaacau

SEQ ID NO: 2234920 - RNA, 23 nt, Human
auuuguacugaaaaaugguaauu

SEQ ID NO: 2234921 - RNA, 18 nt, Human
auuuguaguguuggagaa

SEQ ID NO: 2234922 - RNA, 20 nt, Human
auuuggugguuucagaaaug

SEQ ID NO: 2234923 - RNA, 18 nt, Human
auuuggugguuucagaaa

SEQ ID NO: 2234924 - RNA, 18 nt, Human
auuuggaauuuauauaca

SEQ ID NO: 2234925 - RNA, 20 nt, Human
auuuggagacacaacuauuu

SEQ ID NO: 2234926 - RNA, 13 nt, Human
auuuggaauacuu

SEQ ID NO: 2234927 - RNA, 15 nt, Human
auuuggaauacuuuu

SEQ ID NO: 2234928 - RNA, 14 nt, Human
auuuggaauacuuu

SEQ ID NO: 2234929 - RNA, 21 nt, Human
auuugggguagcuagaggaac

SEQ ID NO: 2234930 - RNA, 16 nt, Human
auuuggggcuuauuuu

SEQ ID NO: 2234931 - RNA, 21 nt, Human
auuuggggcuugcaugccaaa

SEQ ID NO: 2234932 - RNA, 23 nt, Human
auuugggguagcuagaggaacca

SEQ ID NO: 2234933 - RNA, 12 nt, Human
auuuggggugga

SEQ ID NO: 2234934 - RNA, 21 nt, Human
auuuggagacacaacuauuuu

SEQ ID NO: 2234935 - RNA, 23 nt, Human
auuugguaaggggaauugaggac

SEQ ID NO: 2234936 - RNA, 21 nt, Human
auuugguaaauuaguauuuau

SEQ ID NO: 2234937 - RNA, 17 nt, Human
auuuggguucugccugc

SEQ ID NO: 2234938 - RNA, 23 nt, Human
auuuggucaagauuuugaaugcu

SEQ ID NO: 2234939 - RNA, 17 nt, Human
auuuggugguuucagaa

SEQ ID NO: 2234940 - RNA, 18 nt, Human
auuugaauggguccauuu

SEQ ID NO: 2234941 - RNA, 17 nt, Human
auuugaauggguccauu

SEQ ID NO: 2234942 - RNA, 18 nt, Human
auuugaaugcauuuuguu

SEQ ID NO: 2234943 - RNA, 15 nt, Human
auuugaaugcauuuu

SEQ ID NO: 2234944 - RNA, 16 nt, Human
auuugaaugcauuuug

SEQ ID NO: 2234945 - RNA, 18 nt, Human
auuugaauguaugcuuca

SEQ ID NO: 2234946 - RNA, 17 nt, Human
auuugaauguaugcuuc

SEQ ID NO: 2234947 - RNA, 22 nt, Human
auuugaauguaugcuucauaca

SEQ ID NO: 2234948 - RNA, 21 nt, Human
auuugaauguaugcuucauac

SEQ ID NO: 2234949 - RNA, 20 nt, Human
auuugaauguaugcuucaua

SEQ ID NO: 2234950 - RNA, 19 nt, Human
auuugaaugaaaaauuuaa

SEQ ID NO: 2234951 - RNA, 12 nt, Human
auuugaaugcau

SEQ ID NO: 2234952 - RNA, 14 nt, Human
auuugaaugcauuu

SEQ ID NO: 2234953 - RNA, 20 nt, Human
auuucuuuugccguuauuaa

SEQ ID NO: 2234954 - RNA, 19 nt, Human
auuucuuugugcuuuggcu

SEQ ID NO: 2234955 - RNA, 21 nt, Human
auuucuuuguuaucaaacuuc

SEQ ID NO: 2234956 - RNA, 23 nt, Human
auuucuuugccuguucaguuaca

SEQ ID NO: 2234957 - RNA, 22 nt, Human
auuucuuuguuaucaaacuuca

SEQ ID NO: 2234958 - RNA, 23 nt, Human
auuucuuuguuaucaaacuucag

SEQ ID NO: 2234959 - RNA, 17 nt, Human
auuucuuugccuguuca

SEQ ID NO: 2234960 - RNA, 19 nt, Human
auuucuuugccuguucagu

SEQ ID NO: 2234961 - RNA, 20 nt, Human
auuucuuugccuguucaguu

SEQ ID NO: 2234962 - RNA, 21 nt, Human
auuucuuugccuguucaguua

SEQ ID NO: 2234963 - RNA, 22 nt, Human
auuugaggucaaguaagaagac

SEQ ID NO: 2234964 - RNA, 13 nt, Human
auuugaggucaag

SEQ ID NO: 2234965 - RNA, 17 nt, Human
auuugaggggaaaacac

SEQ ID NO: 2234966 - RNA, 22 nt, Human
auuugaggggaaaacaccauaa

SEQ ID NO: 2234967 - RNA, 15 nt, Human
auuugaggucuguuc

SEQ ID NO: 2234968 - RNA, 23 nt, Human
auuugaggucuguucuuuccaaa

SEQ ID NO: 2234969 - RNA, 17 nt, Human
auuugagcagggcucag

SEQ ID NO: 2234970 - RNA, 22 nt, Human
auuugaggacaaccauuccaga

SEQ ID NO: 2234971 - RNA, 19 nt, Human
auuugaggagcagcuucag

SEQ ID NO: 2234972 - RNA, 22 nt, Human
auuugaggagcagcuucaguug

SEQ ID NO: 2234973 - RNA, 23 nt, Human
auuugaggagcagcuucaguugu

SEQ ID NO: 2234974 - RNA, 12 nt, Human
auuugaguguuu

SEQ ID NO: 2234975 - RNA, 16 nt, Human
auuugagugcucugau

SEQ ID NO: 2234976 - RNA, 14 nt, Human
auuugagugcucug

SEQ ID NO: 2234977 - RNA, 19 nt, Human
auuugaguguuuuaagaua

SEQ ID NO: 2234978 - RNA, 22 nt, Human
auuugaggucuguucuuuccaa

SEQ ID NO: 2234979 - RNA, 18 nt, Human
auuugagugauuauuugu

SEQ ID NO: 2234980 - RNA, 18 nt, Human
auuugagguuaagacaaa

SEQ ID NO: 2234981 - RNA, 23 nt, Human
auuuagcuaaacggauuccaaag

SEQ ID NO: 2234982 - RNA, 16 nt, Human
auuuagggaacugcuu

SEQ ID NO: 2234983 - RNA, 22 nt, Human
auuuaggcagauugaaaaggac

SEQ ID NO: 2234984 - RNA, 21 nt, Human
auuuagggaaagguaguguau

SEQ ID NO: 2234985 - RNA, 17 nt, Human
auuuaggagaagccagg

SEQ ID NO: 2234986 - RNA, 14 nt, Human
auuuaggagaagcc

SEQ ID NO: 2234987 - RNA, 15 nt, Human
auuuagggcaaggag

SEQ ID NO: 2234988 - RNA, 14 nt, Human
auuuagguuucuga

SEQ ID NO: 2234989 - RNA, 21 nt, Human
auuuagguuucugaguuccug

SEQ ID NO: 2234990 - RNA, 17 nt, Human
auuuagguuucugaguu

SEQ ID NO: 2234991 - RNA, 18 nt, Human
auuuagggaacugcuuga

SEQ ID NO: 2234992 - RNA, 20 nt, Human
auuuagggagaaauguuguu

SEQ ID NO: 2234993 - RNA, 22 nt, Human
auuuagggagaaauguuguuca

SEQ ID NO: 2234994 - RNA, 17 nt, Human
auuuacgcuuugauuca

SEQ ID NO: 2234995 - RNA, 15 nt, Human
auuuacgcuuugauu

SEQ ID NO: 2234996 - RNA, 19 nt, Human
auuuacgcuuugauucaua

SEQ ID NO: 2234997 - RNA, 16 nt, Human
auuuacguuuuuguaa

SEQ ID NO: 2234998 - RNA, 18 nt, Human
auuuagcguagcuaagug

SEQ ID NO: 2234999 - RNA, 22 nt, Human
auuuagcuaaacggauuccaaa

SEQ ID NO: 2235000 - RNA, 21 nt, Human
auuuagcuaaacggauuccaa

SEQ ID NO: 2235001 - RNA, 18 nt, Human
auuuagccaccaucuuug

SEQ ID NO: 2235002 - RNA, 17 nt, Human
auuuagccaaugcuuac

SEQ ID NO: 2235003 - RNA, 13 nt, Human
auuuauuauggca

SEQ ID NO: 2235004 - RNA, 22 nt, Human
auuuauuaaaugcccagccccu

SEQ ID NO: 2235005 - RNA, 16 nt, Human
auuuauuaguuaauau

SEQ ID NO: 2235006 - RNA, 20 nt, Human
auuuauuaaaugcccagccc

SEQ ID NO: 2235007 - RNA, 22 nt, Human
auuuauuacuguaagaaaauau

SEQ ID NO: 2235008 - RNA, 17 nt, Human
auuuagguuuuuauuag

SEQ ID NO: 2235009 - RNA, 23 nt, Human
auuuagguuucugaguuccugca

SEQ ID NO: 2235010 - RNA, 19 nt, Human
auuuagguuuuuauuagua

SEQ ID NO: 2235011 - RNA, 18 nt, Human
auuuagguuuuuauuagu

SEQ ID NO: 2235012 - RNA, 23 nt, Human
auuuagguuuuuguuuguuuccu

SEQ ID NO: 2235013 - RNA, 22 nt, Human
auuuauguuugcacuugugauu

SEQ ID NO: 2235014 - RNA, 19 nt, Human
auuuauuaaaaugauugua

SEQ ID NO: 2235015 - RNA, 21 nt, Human
auuuauuaaaaugauuguaaa

SEQ ID NO: 2235016 - RNA, 23 nt, Human
auuuauuaaaaugauuguaaaau

SEQ ID NO: 2235017 - RNA, 22 nt, Human
auuuauuaaacagauuuuuaca

SEQ ID NO: 2235018 - RNA, 23 nt, Human
auuuauuaaacagauuuuuacaa

SEQ ID NO: 2235019 - RNA, 18 nt, Human
auuuccuuaaacugugug

SEQ ID NO: 2235020 - RNA, 14 nt, Human
auuuccuugaaugu

SEQ ID NO: 2235021 - RNA, 21 nt, Human
auuucuaaaucuccaaaauaa

SEQ ID NO: 2235022 - RNA, 13 nt, Human
auuucuaaaucuc

SEQ ID NO: 2235023 - RNA, 12 nt, Human
auuucuaaaucu

SEQ ID NO: 2235024 - RNA, 14 nt, Human
auuuccugugucuu

SEQ ID NO: 2235025 - RNA, 12 nt, Human
auuuauuauuga

SEQ ID NO: 2235026 - RNA, 17 nt, Human
auuuccuggugugaagg

SEQ ID NO: 2235027 - RNA, 21 nt, Human
auuuccuggugugaagguccu

SEQ ID NO: 2235028 - RNA, 16 nt, Human
auuuccuguuggauuu

SEQ ID NO: 2235029 - RNA, 21 nt, Human
auuuccuguuggauuuguuua

SEQ ID NO: 2235030 - RNA, 22 nt, Human
auuuccuguuggauuuguuuaa

SEQ ID NO: 2235031 - RNA, 23 nt, Human
auuuccuguuggauuuguuuaaa

SEQ ID NO: 2235032 - RNA, 16 nt, Human
auuuauuauggcacau

SEQ ID NO: 2235033 - RNA, 14 nt, Human
auuuuauuugacaa

SEQ ID NO: 2235034 - RNA, 22 nt, Human
auuuuauuguaacagacauugu

SEQ ID NO: 2235035 - RNA, 19 nt, Human
auuuuauuuagacaagaga

SEQ ID NO: 2235036 - RNA, 23 nt, Human
auuuuauuuccuggacauccucu

SEQ ID NO: 2235037 - RNA, 17 nt, Human
auuuuauuuagacaaga

SEQ ID NO: 2235038 - RNA, 20 nt, Human
auuuuauuguaacagacauu

SEQ ID NO: 2235039 - RNA, 21 nt, Human
auuuuauuguaacagacauug

SEQ ID NO: 2235040 - RNA, 22 nt, Human
auuuuauuuagacaagagaugg

SEQ ID NO: 2235041 - RNA, 14 nt, Human
auuuuauugcuuga

SEQ ID NO: 2235042 - RNA, 14 nt, Human
auuuuauuguaaca

SEQ ID NO: 2235043 - RNA, 15 nt, Human
auuuuauuguaacag

SEQ ID NO: 2235044 - RNA, 16 nt, Human
auuuuauuguaacaga

SEQ ID NO: 2235045 - RNA, 18 nt, Human
auuuuauuguaacagaca

SEQ ID NO: 2235046 - RNA, 15 nt, Human
auuuuauuaugcaug

SEQ ID NO: 2235047 - RNA, 14 nt, Human
auuuuauuaugcau

SEQ ID NO: 2235048 - RNA, 17 nt, Human
auuuuauuaugcaugaa

SEQ ID NO: 2235049 - RNA, 20 nt, Human
auuuuauuacaucuuucaca

SEQ ID NO: 2235050 - RNA, 18 nt, Human
auuuuacuacuguggaaa

SEQ ID NO: 2235051 - RNA, 14 nt, Human
auuuuauguugcau

SEQ ID NO: 2235052 - RNA, 21 nt, Human
auuuuauguugcauagaauaa

SEQ ID NO: 2235053 - RNA, 21 nt, Human
auuuuacuuuaaaaggagcca

SEQ ID NO: 2235054 - RNA, 18 nt, Human
auuuuauguugcauagaa

SEQ ID NO: 2235055 - RNA, 13 nt, Human
auuuuauuaugca

SEQ ID NO: 2235056 - RNA, 20 nt, Human
auuuguagaaggguuauauu

SEQ ID NO: 2235057 - RNA, 16 nt, Human
auuuguauaguugcuu

SEQ ID NO: 2235058 - RNA, 21 nt, Human
auuuguauaaaauaauuuuua

SEQ ID NO: 2235059 - RNA, 19 nt, Human
auuuguaucucugaagcau

SEQ ID NO: 2235060 - RNA, 20 nt, Human
auuuguaucucugaagcaug

SEQ ID NO: 2235061 - RNA, 21 nt, Human
auuuguaucucugaagcaugu

SEQ ID NO: 2235062 - RNA, 18 nt, Human
auuuguauaguugcuugc

SEQ ID NO: 2235063 - RNA, 21 nt, Human
auuuguauaguugcuugccug

SEQ ID NO: 2235064 - RNA, 15 nt, Human
auuuguaucacaaau

SEQ ID NO: 2235065 - RNA, 14 nt, Human
auuuuaauaauguu

SEQ ID NO: 2235066 - RNA, 22 nt, Human
auuuguaucucugaagcauguu

SEQ ID NO: 2235067 - RNA, 23 nt, Human
auuuguaucucugaagcauguuu

SEQ ID NO: 2235068 - RNA, 14 nt, Human
auuuguaucugaag

SEQ ID NO: 2235069 - RNA, 17 nt, Human
auuuguaucugaaggag

SEQ ID NO: 2235070 - RNA, 15 nt, Human
auuuuaauaauguuu

SEQ ID NO: 2235071 - RNA, 16 nt, Human
auuuuaauaauguuuc

SEQ ID NO: 2235072 - RNA, 18 nt, Human
auuuuacuucuagagaua

SEQ ID NO: 2235073 - RNA, 22 nt, Human
auuuuacuacuguggaaaaaua

SEQ ID NO: 2235074 - RNA, 17 nt, Human
auuuuacuacuguggaa

SEQ ID NO: 2235075 - RNA, 22 nt, Human
auuuuacuguacagacagaaaa

SEQ ID NO: 2235076 - RNA, 20 nt, Human
auuuuacuguacagacagaa

SEQ ID NO: 2235077 - RNA, 17 nt, Human
auuuuaccuuugacaaa

SEQ ID NO: 2235078 - RNA, 21 nt, Human
auuuuacaauugaaaugacua

SEQ ID NO: 2235079 - RNA, 17 nt, Human
auuuuacaauugaaaug

SEQ ID NO: 2235080 - RNA, 12 nt, Human
auuuuacaauuu

SEQ ID NO: 2235081 - RNA, 18 nt, Human
auuuuaauuuaugaguuu

SEQ ID NO: 2235082 - RNA, 21 nt, Human
auuuguaucugaaggagauuu

SEQ ID NO: 2235083 - RNA, 18 nt, Human
auuuuaauuuuaaccaaa

SEQ ID NO: 2235084 - RNA, 13 nt, Human
auuuuacaauuga

SEQ ID NO: 2235085 - RNA, 23 nt, Human
auuucuuuugccguuauuaaaaa

SEQ ID NO: 2235086 - RNA, 14 nt, Human
auucucagaaucuc

SEQ ID NO: 2235087 - RNA, 16 nt, Human
auucucacuccaccac

SEQ ID NO: 2235088 - RNA, 15 nt, Human
auucucacuccacca

SEQ ID NO: 2235089 - RNA, 14 nt, Human
auucucacuccacc

SEQ ID NO: 2235090 - RNA, 16 nt, Human
auucucaccaggaagg

SEQ ID NO: 2235091 - RNA, 13 nt, Human
auucucaccagga

SEQ ID NO: 2235092 - RNA, 14 nt, Human
auucucaccaggaa

SEQ ID NO: 2235093 - RNA, 17 nt, Human
auucuacuuuaagcacu

SEQ ID NO: 2235094 - RNA, 13 nt, Human
auucuacacagag

SEQ ID NO: 2235095 - RNA, 16 nt, Human
auucuacuuugagugc

SEQ ID NO: 2235096 - RNA, 13 nt, Human
auucuacuuugag

SEQ ID NO: 2235097 - RNA, 16 nt, Human
auucucagauauuuau

SEQ ID NO: 2235098 - RNA, 17 nt, Human
auucucacuccaccacc

SEQ ID NO: 2235099 - RNA, 23 nt, Human
auucucagauauuuauauuuuua

SEQ ID NO: 2235100 - RNA, 13 nt, Human
auucuccaccugc

SEQ ID NO: 2235101 - RNA, 20 nt, Human
auucucagaaucucaaauaa

SEQ ID NO: 2235102 - RNA, 18 nt, Human
auucucagaaucucaaau

SEQ ID NO: 2235103 - RNA, 20 nt, Human
auugacacuuaaaaaugguu

SEQ ID NO: 2235104 - RNA, 13 nt, Human
auugacagaagcu

SEQ ID NO: 2235105 - RNA, 21 nt, Human
auugacagaucaagcugugag

SEQ ID NO: 2235106 - RNA, 16 nt, Human
auucuccaccugccag

SEQ ID NO: 2235107 - RNA, 17 nt, Human
auucuccaccugccagg

SEQ ID NO: 2235108 - RNA, 18 nt, Human
auucuccaccugccaggg

SEQ ID NO: 2235109 - RNA, 13 nt, Human
auugcacaauauu

SEQ ID NO: 2235110 - RNA, 11 nt, Human
auugcacaaua

SEQ ID NO: 2235111 - RNA, 16 nt, Human
auugcaacaggcuggg

SEQ ID NO: 2235112 - RNA, 21 nt, Human
auugcaacaggcugggcuuca

SEQ ID NO: 2235113 - RNA, 16 nt, Human
auugcagguggaacuc

SEQ ID NO: 2235114 - RNA, 17 nt, Human
auugcagguggaacuca

SEQ ID NO: 2235115 - RNA, 23 nt, Human
auugcaggagucccugccaucau

SEQ ID NO: 2235116 - RNA, 22 nt, Human
auugcagaacuaaacucauuua

SEQ ID NO: 2235117 - RNA, 20 nt, Human
auugcagaacuaaacucauu

SEQ ID NO: 2235118 - RNA, 21 nt, Human
auugcacaugucuuaaugaag

SEQ ID NO: 2235119 - RNA, 23 nt, Human
auugcacucuaaaagguucaggg

SEQ ID NO: 2235120 - RNA, 14 nt, Human
auugcacagggaga

SEQ ID NO: 2235121 - RNA, 13 nt, Human
auugcacuuuuaa

SEQ ID NO: 2235122 - RNA, 16 nt, Human
auugcacaugucuuaa

SEQ ID NO: 2235123 - RNA, 22 nt, Human
auugcacaauauugaacuuuuu

SEQ ID NO: 2235124 - RNA, 18 nt, Human
auugcacaugucuuaaug

SEQ ID NO: 2235125 - RNA, 20 nt, Human
auugcacaugucuuaaugaa

SEQ ID NO: 2235126 - RNA, 18 nt, Human
auugacaggauuauugga

SEQ ID NO: 2235127 - RNA, 19 nt, Human
auugacagcuuugcugcug

SEQ ID NO: 2235128 - RNA, 18 nt, Human
auugacagcuuugcugcu

SEQ ID NO: 2235129 - RNA, 16 nt, Human
auugacagcuuugcug

SEQ ID NO: 2235130 - RNA, 15 nt, Human
auugacagcuuugcu

SEQ ID NO: 2235131 - RNA, 14 nt, Human
auugacagcuuugc

SEQ ID NO: 2235132 - RNA, 13 nt, Human
auugacagcuuug

SEQ ID NO: 2235133 - RNA, 16 nt, Human
auucuccacagcaacc

SEQ ID NO: 2235134 - RNA, 18 nt, Human
auugacagaucaagcugu

SEQ ID NO: 2235135 - RNA, 21 nt, Human
auugacccacaagaaaugaaa

SEQ ID NO: 2235136 - RNA, 23 nt, Human
auugaccgcgacuaauuucaaaa

SEQ ID NO: 2235137 - RNA, 20 nt, Human
auugaccgcgacuaauuuca

SEQ ID NO: 2235138 - RNA, 17 nt, Human
auugaccgcgacuaauu

SEQ ID NO: 2235139 - RNA, 15 nt, Human
auugcaacaggcugg

SEQ ID NO: 2235140 - RNA, 19 nt, Human
auugcaaaucuugaaauua

SEQ ID NO: 2235141 - RNA, 17 nt, Human
auugcaaaucuugaaau

SEQ ID NO: 2235142 - RNA, 16 nt, Human
auugcaaaucuugaaa

SEQ ID NO: 2235143 - RNA, 12 nt, Human
auugcaaaucuu

SEQ ID NO: 2235144 - RNA, 23 nt, Human
auugcaaagguuccaacuguaua

SEQ ID NO: 2235145 - RNA, 13 nt, Human
auugaccugaggc

SEQ ID NO: 2235146 - RNA, 11 nt, Human
auugcccuggu

SEQ ID NO: 2235147 - RNA, 14 nt, Human
auugccuauuucag

SEQ ID NO: 2235148 - RNA, 13 nt, Human
auugccuccuccu

SEQ ID NO: 2235149 - RNA, 14 nt, Human
auugccugcagaga

SEQ ID NO: 2235150 - RNA, 18 nt, Human
auugccuauuucaguggc

SEQ ID NO: 2235151 - RNA, 16 nt, Human
auugcggacagccacg

SEQ ID NO: 2235152 - RNA, 18 nt, Human
auugcggacagccacggc

SEQ ID NO: 2235153 - RNA, 19 nt, Human
auugcggacagccacggcc

SEQ ID NO: 2235154 - RNA, 17 nt, Human
auugcccacgcuggagu

SEQ ID NO: 2235155 - RNA, 21 nt, Human
auugcccacgcuggagugcag

SEQ ID NO: 2235156 - RNA, 18 nt, Human
auugccauauugcacaug

SEQ ID NO: 2235157 - RNA, 19 nt, Human
auugccauauugcacaugu

SEQ ID NO: 2235158 - RNA, 22 nt, Human
auugccauauugcacaugucuu

SEQ ID NO: 2235159 - RNA, 13 nt, Human
auugccuauuuca

SEQ ID NO: 2235160 - RNA, 16 nt, Human
auugcccccagggcac

SEQ ID NO: 2235161 - RNA, 22 nt, Human
auugcccccagggcacuucaca

SEQ ID NO: 2235162 - RNA, 18 nt, Human
auugcccauccaucugcu

SEQ ID NO: 2235163 - RNA, 18 nt, Human
auugccauucccugccug

SEQ ID NO: 2235164 - RNA, 15 nt, Human
auugcccccagggca

SEQ ID NO: 2235165 - RNA, 21 nt, Human
auugccaccaggagaaccacu

SEQ ID NO: 2235166 - RNA, 22 nt, Human
auugccaagcucaggaccaggc

SEQ ID NO: 2235167 - RNA, 15 nt, Human
auugccaccaggaga

SEQ ID NO: 2235168 - RNA, 14 nt, Human
auugccaccaggag

SEQ ID NO: 2235169 - RNA, 14 nt, Human
auugccaagggcuu

SEQ ID NO: 2235170 - RNA, 23 nt, Human
auugccauuucuuccacaagagc

SEQ ID NO: 2235171 - RNA, 12 nt, Human
auugccauauug

SEQ ID NO: 2235172 - RNA, 15 nt, Human
auugccauauugcac

SEQ ID NO: 2235173 - RNA, 16 nt, Human
auugccauauugcaca

SEQ ID NO: 2235174 - RNA, 17 nt, Human
auugccauauugcacau

SEQ ID NO: 2235175 - RNA, 16 nt, Human
auugcauuuccugaca

SEQ ID NO: 2235176 - RNA, 23 nt, Human
auugcaguuuaucauucaagugu

SEQ ID NO: 2235177 - RNA, 17 nt, Human
auugcauuuccugacag

SEQ ID NO: 2235178 - RNA, 14 nt, Human
auugcaguuuauca

SEQ ID NO: 2235179 - RNA, 17 nt, Human
auugcaguuuaucauuc

SEQ ID NO: 2235180 - RNA, 18 nt, Human
auugcaguuuaucauuca

SEQ ID NO: 2235181 - RNA, 19 nt, Human
auugcaguuuaucauucaa

SEQ ID NO: 2235182 - RNA, 14 nt, Human
auugcuacuguccu

SEQ ID NO: 2235183 - RNA, 23 nt, Human
auugucuucggaaaccuuggugu

SEQ ID NO: 2235184 - RNA, 18 nt, Human
auugucuucggaaaccuu

SEQ ID NO: 2235185 - RNA, 20 nt, Human
auugucuucggaaaccuugg

SEQ ID NO: 2235186 - RNA, 14 nt, Human
auugucuuguucug

SEQ ID NO: 2235187 - RNA, 15 nt, Human
auugugaaauuauuc

SEQ ID NO: 2235188 - RNA, 13 nt, Human
auugugccccugc

SEQ ID NO: 2235189 - RNA, 15 nt, Human
auuguauuacaaauc

SEQ ID NO: 2235190 - RNA, 15 nt, Human
auugucuccuugagu

SEQ ID NO: 2235191 - RNA, 18 nt, Human
auugucucuaaauugugg

SEQ ID NO: 2235192 - RNA, 14 nt, Human
auuguauuacaaau

SEQ ID NO: 2235193 - RNA, 13 nt, Human
auuguuugcuuau

SEQ ID NO: 2235194 - RNA, 20 nt, Human
auuguuugaaacaaagaagg

SEQ ID NO: 2235195 - RNA, 18 nt, Human
auuguuugcuuauuguuc

SEQ ID NO: 2235196 - RNA, 16 nt, Human
auuguuugcuuauugu

SEQ ID NO: 2235197 - RNA, 15 nt, Human
auuguuugcuuauug

SEQ ID NO: 2235198 - RNA, 14 nt, Human
auuguuugcuuauu

SEQ ID NO: 2235199 - RNA, 19 nt, Human
auuguuucuuuaagaaagu

SEQ ID NO: 2235200 - RNA, 20 nt, Human
auuguuucuuuaagaaagua

SEQ ID NO: 2235201 - RNA, 13 nt, Human
auuguuugaaaca

SEQ ID NO: 2235202 - RNA, 17 nt, Human
auuguuugaaacaaaga

SEQ ID NO: 2235203 - RNA, 18 nt, Human
auuguuugaaacaaagaa

SEQ ID NO: 2235204 - RNA, 19 nt, Human
auuguuugaaacaaagaag

SEQ ID NO: 2235205 - RNA, 22 nt, Human
auuguuugcuuauuguuccaag

SEQ ID NO: 2235206 - RNA, 15 nt, Human
auuuaaaacagacac

SEQ ID NO: 2235207 - RNA, 23 nt, Human
auuguuugcuuauuguuccaaga

SEQ ID NO: 2235208 - RNA, 21 nt, Human
auuguuugcuuauuguuccaa

SEQ ID NO: 2235209 - RNA, 19 nt, Human
auuguuugcuuauuguucc

SEQ ID NO: 2235210 - RNA, 23 nt, Human
auuuaaaacagacacuggcaugg

SEQ ID NO: 2235211 - RNA, 18 nt, Human
auuuaaaacagacacugg

SEQ ID NO: 2235212 - RNA, 17 nt, Human
auuuaaaacagacacug

SEQ ID NO: 2235213 - RNA, 16 nt, Human
auuuaaaacagacacu

SEQ ID NO: 2235214 - RNA, 22 nt, Human
auuguuucauugcgaaucuuuu

SEQ ID NO: 2235215 - RNA, 13 nt, Human
auuguuucaauug

SEQ ID NO: 2235216 - RNA, 22 nt, Human
auuguuucaauugcaucuccca

SEQ ID NO: 2235217 - RNA, 15 nt, Human
auugugcuucuuucu

SEQ ID NO: 2235218 - RNA, 23 nt, Human
auugugaaauaaaacuggcuuug

SEQ ID NO: 2235219 - RNA, 21 nt, Human
auuguaucuagugcagcugau

SEQ ID NO: 2235220 - RNA, 19 nt, Human
auuguaucuagugcagcug

SEQ ID NO: 2235221 - RNA, 18 nt, Human
auuguaucuagugcagcu

SEQ ID NO: 2235222 - RNA, 16 nt, Human
auuguaucuagugcag

SEQ ID NO: 2235223 - RNA, 15 nt, Human
auuguaucuagugca

SEQ ID NO: 2235224 - RNA, 14 nt, Human
auuguaucuagugc

SEQ ID NO: 2235225 - RNA, 24 nt, Human
auuguaucguauagcuguauugaa

SEQ ID NO: 2235226 - RNA, 13 nt, Human
auuguaugaugug

SEQ ID NO: 2235227 - RNA, 12 nt, Human
auuguaugaugu

SEQ ID NO: 2235228 - RNA, 21 nt, Human
auuguaugauguguugugaua

SEQ ID NO: 2235229 - RNA, 14 nt, Human
auuguaugaugugu

SEQ ID NO: 2235230 - RNA, 15 nt, Human
auuguaugauguguu

SEQ ID NO: 2235231 - RNA, 17 nt, Human
auuguauauuguguuug

SEQ ID NO: 2235232 - RNA, 14 nt, Human
auuguaucagaggc

SEQ ID NO: 2235233 - RNA, 15 nt, Human
auuguaucagaggcc

SEQ ID NO: 2235234 - RNA, 15 nt, Human
auuguaucgauguua

SEQ ID NO: 2235235 - RNA, 14 nt, Human
auuguauccugagg

SEQ ID NO: 2235236 - RNA, 16 nt, Human
auuguaucguauagcu

SEQ ID NO: 2235237 - RNA, 17 nt, Human
auuguaucguauagcug

SEQ ID NO: 2235238 - RNA, 17 nt, Human
auuguaucagaggccua

SEQ ID NO: 2235239 - RNA, 19 nt, Human
auuguaucagaggccuaua

SEQ ID NO: 2235240 - RNA, 20 nt, Human
auuguaucagaggccuauaa

SEQ ID NO: 2235241 - RNA, 21 nt, Human
auuguaucagaggccuauaau

SEQ ID NO: 2235242 - RNA, 15 nt, Human
auuguauauucacuu

SEQ ID NO: 2235243 - RNA, 22 nt, Human
auuguauauauguguguuuaaa

SEQ ID NO: 2235244 - RNA, 13 nt, Human
auuguauauucac

SEQ ID NO: 2235245 - RNA, 14 nt, Human
auuguauauucacu

SEQ ID NO: 2235246 - RNA, 13 nt, Human
auuguauauaugu

SEQ ID NO: 2235247 - RNA, 15 nt, Human
auuguauauaugugu

SEQ ID NO: 2235248 - RNA, 15 nt, Human
auuguauagagauau

SEQ ID NO: 2235249 - RNA, 21 nt, Human
auuguauagagauaugcagaa

SEQ ID NO: 2235250 - RNA, 22 nt, Human
auuguauagagauaugcagaag

SEQ ID NO: 2235251 - RNA, 11 nt, Human
auuguauauau

SEQ ID NO: 2235252 - RNA, 13 nt, Human
auuguauaacagg

SEQ ID NO: 2235253 - RNA, 14 nt, Human
auuguauaacaggu

SEQ ID NO: 2235254 - RNA, 15 nt, Human
auuguauaacagguu

SEQ ID NO: 2235255 - RNA, 16 nt, Human
auuguauaacagguua

SEQ ID NO: 2235256 - RNA, 17 nt, Human
auuguauaacagguuau

SEQ ID NO: 2235257 - RNA, 18 nt, Human
auuguauaacagguuauu

SEQ ID NO: 2235258 - RNA, 21 nt, Human
auuguauaagauuagaaugaa

SEQ ID NO: 2235259 - RNA, 22 nt, Human
auuguauaagauuagaaugaaa

SEQ ID NO: 2235260 - RNA, 19 nt, Human
auugcgccauugcacucca

SEQ ID NO: 2235261 - RNA, 15 nt, Human
auugccugcagagag

SEQ ID NO: 2235262 - RNA, 20 nt, Human
auugcguuugaccuuuuaug

SEQ ID NO: 2235263 - RNA, 21 nt, Human
auugcguuugaccuuuuaugu

SEQ ID NO: 2235264 - RNA, 13 nt, Human
auugcuaaaugua

SEQ ID NO: 2235265 - RNA, 14 nt, Human
auugcuaaauguaa

SEQ ID NO: 2235266 - RNA, 16 nt, Human
auugcuaaauguaaca

SEQ ID NO: 2235267 - RNA, 17 nt, Human
auugcuaaauguaacag

SEQ ID NO: 2235268 - RNA, 18 nt, Human
auugcuaaauguaacagu

SEQ ID NO: 2235269 - RNA, 21 nt, Human
auuggcucuugaacugagcuu

SEQ ID NO: 2235270 - RNA, 21 nt, Human
auuggcucacacugagaaugu

SEQ ID NO: 2235271 - RNA, 15 nt, Human
auugcuaagaugcuc

SEQ ID NO: 2235272 - RNA, 21 nt, Human
auugcuacuacuuaccuacca

SEQ ID NO: 2235273 - RNA, 21 nt, Human
auugcuaaucaccaaaggcuc

SEQ ID NO: 2235274 - RNA, 23 nt, Human
auuggcuuuaaacacccuucaca

SEQ ID NO: 2235275 - RNA, 21 nt, Human
auuguauaaaaauagaagaau

SEQ ID NO: 2235276 - RNA, 13 nt, Human
auuguauaaacua

SEQ ID NO: 2235277 - RNA, 17 nt, Human
auuguauaaacuaucag

SEQ ID NO: 2235278 - RNA, 21 nt, Human
auuguauaaacuaucaguuug

SEQ ID NO: 2235279 - RNA, 22 nt, Human
auuguauaaacuaucaguuugu

SEQ ID NO: 2235280 - RNA, 23 nt, Human
auuggcuuuggguugcaggaccu

SEQ ID NO: 2235281 - RNA, 14 nt, Human
auuggcuuuauccu

SEQ ID NO: 2235282 - RNA, 18 nt, Human
auuggcuuguguguuuca

SEQ ID NO: 2235283 - RNA, 22 nt, Human
auuggcuuguguguuucacuuu

SEQ ID NO: 2235284 - RNA, 17 nt, Human
auuggcuuuauccucuu

SEQ ID NO: 2235285 - RNA, 21 nt, Human
auuggcuuuauccucuuuaga

SEQ ID NO: 2235286 - RNA, 17 nt, Human
auuggcugggaguggug

SEQ ID NO: 2235287 - RNA, 21 nt, Human
auuggcucacccaagcaaggc

SEQ ID NO: 2235288 - RNA, 22 nt, Human
auuggcugaacucaugagaagu

SEQ ID NO: 2235289 - RNA, 14 nt, Human
auuggcugagagac

SEQ ID NO: 2235290 - RNA, 17 nt, Human
auuggcuuguguguuuc

SEQ ID NO: 2235291 - RNA, 14 nt, Human
auuuaaacagcagu

SEQ ID NO: 2235292 - RNA, 19 nt, Human
auuuaaacaggcccagcau

SEQ ID NO: 2235293 - RNA, 17 nt, Human
auuuaaacaggcccagc

SEQ ID NO: 2235294 - RNA, 18 nt, Human
auuuaaacaggcccagca

SEQ ID NO: 2235295 - RNA, 15 nt, Human
auuuaaacagcagug

SEQ ID NO: 2235296 - RNA, 16 nt, Human
auuuaaacagcagugu

SEQ ID NO: 2235297 - RNA, 20 nt, Human
auuuaaacagcaguguuccc

SEQ ID NO: 2235298 - RNA, 15 nt, Human
auuuaaacaggccca

SEQ ID NO: 2235299 - RNA, 19 nt, Human
auuuaaagcuuauuaaaac

SEQ ID NO: 2235300 - RNA, 15 nt, Human
auuuaaagccuccuc

SEQ ID NO: 2235301 - RNA, 15 nt, Human
auuuaaaagacacug

SEQ ID NO: 2235302 - RNA, 19 nt, Human
auuuaaaauugugaugugu

SEQ ID NO: 2235303 - RNA, 19 nt, Human
auuuaaacaauaaaugugc

SEQ ID NO: 2235304 - RNA, 20 nt, Human
auuuaaaauugugauguguc

SEQ ID NO: 2235305 - RNA, 13 nt, Human
auuuaaaacaugu

SEQ ID NO: 2235306 - RNA, 14 nt, Human
auuuaaaacaugua

SEQ ID NO: 2235307 - RNA, 15 nt, Human
auuuaaaacauguaa

SEQ ID NO: 2235308 - RNA, 11 nt, Human
auuuaaaacuu

SEQ ID NO: 2235309 - RNA, 20 nt, Human
auuuaaaggguguacuuaua

SEQ ID NO: 2235310 - RNA, 21 nt, Human
auuuaaaggcccuaucuguuu

SEQ ID NO: 2235311 - RNA, 20 nt, Human
auuuaaaggcccuaucuguu

SEQ ID NO: 2235312 - RNA, 18 nt, Human
auuuaaaggcccuaucug

SEQ ID NO: 2235313 - RNA, 16 nt, Human
auuuaacagaaaugua

SEQ ID NO: 2235314 - RNA, 15 nt, Human
auuuaacagaaaugu

SEQ ID NO: 2235315 - RNA, 19 nt, Human
auuuaacagaaauguacag

SEQ ID NO: 2235316 - RNA, 17 nt, Human
auuuaacagaaauguac

SEQ ID NO: 2235317 - RNA, 20 nt, Human
auuuaacagaaauguacagc

SEQ ID NO: 2235318 - RNA, 21 nt, Human
auuuaacagcugaauuaucua

SEQ ID NO: 2235319 - RNA, 15 nt, Human
auuuaacagcugaau

SEQ ID NO: 2235320 - RNA, 17 nt, Human
auuuaacagggagggga

SEQ ID NO: 2235321 - RNA, 22 nt, Human
auuuaacagggucucuagugcu

SEQ ID NO: 2235322 - RNA, 22 nt, Human
auuuaacagcugaauuaucuau

SEQ ID NO: 2235323 - RNA, 15 nt, Human
auuuaacagucauuu

SEQ ID NO: 2235324 - RNA, 16 nt, Human
auuuaacagucauuua

SEQ ID NO: 2235325 - RNA, 17 nt, Human
auuuaacagucauuuaa

SEQ ID NO: 2235326 - RNA, 18 nt, Human
auuuaacagucauuuaaa

SEQ ID NO: 2235327 - RNA, 13 nt, Human
auuuaauuuugac

SEQ ID NO: 2235328 - RNA, 19 nt, Human
auuuaacuugagcuuuaaa

SEQ ID NO: 2235329 - RNA, 18 nt, Human
auuuaauuugauaucaca

SEQ ID NO: 2235330 - RNA, 21 nt, Human
auuuaacuuaacauucuguaa

SEQ ID NO: 2235331 - RNA, 17 nt, Human
auuuaacuugagcuuua

SEQ ID NO: 2235332 - RNA, 13 nt, Human
auuuaacuugagc

SEQ ID NO: 2235333 - RNA, 13 nt, Human
auuuaacuggcuu

SEQ ID NO: 2235334 - RNA, 20 nt, Human
auuuaacuuaacauucugua

SEQ ID NO: 2235335 - RNA, 13 nt, Human
auuuaacugccuu

SEQ ID NO: 2235336 - RNA, 19 nt, Human
auuuaauuuuuuugagaca

SEQ ID NO: 2235337 - RNA, 23 nt, Human
auuuaauuuuuuugagacagagu

SEQ ID NO: 2235338 - RNA, 19 nt, Human
auuuacccuucuuuucuga

SEQ ID NO: 2235339 - RNA, 23 nt, Human
auuuaccagccuccguauuucag

SEQ ID NO: 2235340 - RNA, 22 nt, Human
auuuacaacugggggaggguga

SEQ ID NO: 2235341 - RNA, 19 nt, Human
auuuacaaaguguguauua

SEQ ID NO: 2235342 - RNA, 20 nt, Human
auuuacaaaguguguauuaa

SEQ ID NO: 2235343 - RNA, 15 nt, Human
auuuacaaagugugu

SEQ ID NO: 2235344 - RNA, 16 nt, Human
auuuacaaagugugua

SEQ ID NO: 2235345 - RNA, 17 nt, Human
auuuacaaaguguguau

SEQ ID NO: 2235346 - RNA, 18 nt, Human
auuuacaaaguguguauu

SEQ ID NO: 2235347 - RNA, 16 nt, Human
auuuacaaaugggaaa

SEQ ID NO: 2235348 - RNA, 19 nt, Human
auuuacaaaaauauaaaau

SEQ ID NO: 2235349 - RNA, 19 nt, Human
auuuaauuuugacacuaua

SEQ ID NO: 2235350 - RNA, 22 nt, Human
auuuaauuugauaucacagucu

SEQ ID NO: 2235351 - RNA, 14 nt, Human
auuuaauuuugaca

SEQ ID NO: 2235352 - RNA, 16 nt, Human
auuuaauuuugacacu

SEQ ID NO: 2235353 - RNA, 18 nt, Human
auuuaauuuugacacuau

SEQ ID NO: 2235354 - RNA, 20 nt, Human
auuuacaaaaauauaaaaua

SEQ ID NO: 2235355 - RNA, 23 nt, Human
auuuacaaaaauauaaaauauga

SEQ ID NO: 2235356 - RNA, 13 nt, Human
auuuacaaagugu

SEQ ID NO: 2235357 - RNA, 14 nt, Human
auuuacaaagugug

SEQ ID NO: 2235358 - RNA, 15 nt, Human
auuuauuauugaaau

SEQ ID NO: 2235359 - RNA, 19 nt, Human
auucccuucaucuggaacc

SEQ ID NO: 2235360 - RNA, 16 nt, Human
auucccuucaucugga

SEQ ID NO: 2235361 - RNA, 21 nt, Human
auucccuguacaauauuuaaa

SEQ ID NO: 2235362 - RNA, 19 nt, Human
auucccuguacaauauuua

SEQ ID NO: 2235363 - RNA, 21 nt, Human
auucccuggccuuucauauuu

SEQ ID NO: 2235364 - RNA, 19 nt, Human
auuccccaggaggccagcc

SEQ ID NO: 2235365 - RNA, 21 nt, Human
auuccgacaaccgaugcucca

SEQ ID NO: 2235366 - RNA, 23 nt, Human
auuccguagccagcugcucccca

SEQ ID NO: 2235367 - RNA, 16 nt, Human
auuccguagccagcug

SEQ ID NO: 2235368 - RNA, 17 nt, Human
auuccauuuaucuuucu

SEQ ID NO: 2235369 - RNA, 18 nt, Human
auuccauuuaucuuucua

SEQ ID NO: 2235370 - RNA, 16 nt, Human
auuccauugugugagu

SEQ ID NO: 2235371 - RNA, 15 nt, Human
auuccauugugugag

SEQ ID NO: 2235372 - RNA, 15 nt, Human
auuccauuuaucuuu

SEQ ID NO: 2235373 - RNA, 16 nt, Human
auuccccaggaggcca

SEQ ID NO: 2235374 - RNA, 20 nt, Human
auuccccagauugcaacagg

SEQ ID NO: 2235375 - RNA, 22 nt, Human
auuccccacccugaaagcccug

SEQ ID NO: 2235376 - RNA, 16 nt, Human
auuccacuacaccugg

SEQ ID NO: 2235377 - RNA, 11 nt, Human
auucauaauaa

SEQ ID NO: 2235378 - RNA, 12 nt, Human
auuccacaucua

SEQ ID NO: 2235379 - RNA, 16 nt, Human
auuccaccugcaauca

SEQ ID NO: 2235380 - RNA, 20 nt, Human
auuccacuuauaggaauuga

SEQ ID NO: 2235381 - RNA, 13 nt, Human
auuccacagcugc

SEQ ID NO: 2235382 - RNA, 21 nt, Human
auucauaagccaauuuuucug

SEQ ID NO: 2235383 - RNA, 23 nt, Human
auucauaagccaauuuuucugca

SEQ ID NO: 2235384 - RNA, 14 nt, Human
auucaguuuucauu

SEQ ID NO: 2235385 - RNA, 12 nt, Human
auucauaaaucu

SEQ ID NO: 2235386 - RNA, 15 nt, Human
auucaguuuucauuu

SEQ ID NO: 2235387 - RNA, 13 nt, Human
auucaguuuucau

SEQ ID NO: 2235388 - RNA, 21 nt, Human
auuccauucuggaagugacuu

SEQ ID NO: 2235389 - RNA, 16 nt, Human
auuccauucuggauuu

SEQ ID NO: 2235390 - RNA, 12 nt, Human
auuccacuggac

SEQ ID NO: 2235391 - RNA, 17 nt, Human
auuccacuacaccuggc

SEQ ID NO: 2235392 - RNA, 18 nt, Human
auuccacuacaccuggcu

SEQ ID NO: 2235393 - RNA, 19 nt, Human
auuccacuacaccuggcug

SEQ ID NO: 2235394 - RNA, 22 nt, Human
auuccacuacaccuggcugagg

SEQ ID NO: 2235395 - RNA, 16 nt, Human
auuccaugaauguauc

SEQ ID NO: 2235396 - RNA, 15 nt, Human
auuccaugaauguau

SEQ ID NO: 2235397 - RNA, 18 nt, Human
auuccacugcguugucca

SEQ ID NO: 2235398 - RNA, 12 nt, Human
auuccagaauau

SEQ ID NO: 2235399 - RNA, 13 nt, Human
auuccaugaaugu

SEQ ID NO: 2235400 - RNA, 18 nt, Human
auuccaugaauguaucag

SEQ ID NO: 2235401 - RNA, 17 nt, Human
auuccaugaauguauca

SEQ ID NO: 2235402 - RNA, 23 nt, Human
auuccaugaauguaucaggaaau

SEQ ID NO: 2235403 - RNA, 18 nt, Human
auucagcucugcaagaau

SEQ ID NO: 2235404 - RNA, 14 nt, Human
auucagcucugcaa

SEQ ID NO: 2235405 - RNA, 21 nt, Human
auucaggaagcucagggccug

SEQ ID NO: 2235406 - RNA, 22 nt, Human
auucaggaagcucagggccugg

SEQ ID NO: 2235407 - RNA, 21 nt, Human
auucaguuguuagugugucuu

SEQ ID NO: 2235408 - RNA, 21 nt, Human
auucaggaauguguggccugc

SEQ ID NO: 2235409 - RNA, 21 nt, Human
auucaggacuuaacggcucca

SEQ ID NO: 2235410 - RNA, 22 nt, Human
auucagcuagaacuuugaagga

SEQ ID NO: 2235411 - RNA, 23 nt, Human
auucaggaagcucagggccuggc

SEQ ID NO: 2235412 - RNA, 16 nt, Human
auucaguuguuagugu

SEQ ID NO: 2235413 - RNA, 16 nt, Human
auucaaaaguugaaau

SEQ ID NO: 2235414 - RNA, 14 nt, Human
auuauuuuccaaaa

SEQ ID NO: 2235415 - RNA, 16 nt, Human
auucaaaaugauguau

SEQ ID NO: 2235416 - RNA, 19 nt, Human
auucaaaauugacauugcu

SEQ ID NO: 2235417 - RNA, 21 nt, Human
auucaaaauugacauugcuuu

SEQ ID NO: 2235418 - RNA, 13 nt, Human
auuauuuuccaaa

SEQ ID NO: 2235419 - RNA, 15 nt, Human
auuauuuuaaacaaa

SEQ ID NO: 2235420 - RNA, 21 nt, Human
auuauuuuaaacaaaauagaa

SEQ ID NO: 2235421 - RNA, 13 nt, Human
auuauuuucaagg

SEQ ID NO: 2235422 - RNA, 17 nt, Human
auucagcggaauauuga

SEQ ID NO: 2235423 - RNA, 22 nt, Human
auucaaaauugacauugcuuua

SEQ ID NO: 2235424 - RNA, 14 nt, Human
auucagcucaugga

SEQ ID NO: 2235425 - RNA, 15 nt, Human
auucaaacagucuca

SEQ ID NO: 2235426 - RNA, 14 nt, Human
auucaaacagucuc

SEQ ID NO: 2235427 - RNA, 22 nt, Human
uuuuuguucuuaauugcacucu

SEQ ID NO: 2235428 - RNA, 20 nt, Human
uuuuuguucuuaauugcacu

SEQ ID NO: 2235429 - RNA, 23 nt, Human
uuuuuuaaaaaagaaacauuugg

SEQ ID NO: 2235430 - RNA, 17 nt, Human
auuaagaggcagaaaau

SEQ ID NO: 2235431 - RNA, 21 nt, Human
auuaagauaugggacauuuuu

SEQ ID NO: 2235432 - RNA, 23 nt, Human
auuaagauggauucucagauauu

SEQ ID NO: 2235433 - RNA, 20 nt, Human
auuaagauggauucucagau

SEQ ID NO: 2235434 - RNA, 15 nt, Human
auuaagauggauucu

SEQ ID NO: 2235435 - RNA, 16 nt, Human
auuaagaucucagugg

SEQ ID NO: 2235436 - RNA, 22 nt, Human
uuuuuguuccacaaguuaaaua

SEQ ID NO: 2235437 - RNA, 20 nt, Human
auuaauauggggaugcagca

SEQ ID NO: 2235438 - RNA, 19 nt, Human
auuaaucaugaauguguaa

SEQ ID NO: 2235439 - RNA, 15 nt, Human
auuaauaugaaaacu

SEQ ID NO: 2235440 - RNA, 14 nt, Human
auuaauaugaaaac

SEQ ID NO: 2235441 - RNA, 12 nt, Human
auuaauaugaaa

SEQ ID NO: 2235442 - RNA, 18 nt, Human
auuaauaucccuacaugu

SEQ ID NO: 2235443 - RNA, 19 nt, Human
auuaauaucccuacaugua

SEQ ID NO: 2235444 - RNA, 20 nt, Human
auuaauaucccuacauguau

SEQ ID NO: 2235445 - RNA, 14 nt, Human
auuaauccagaaua

SEQ ID NO: 2235446 - RNA, 18 nt, Human
auuaauagcuuuuauugu

SEQ ID NO: 2235447 - RNA, 19 nt, Human
auuaauagcuuuuauugua

SEQ ID NO: 2235448 - RNA, 23 nt, Human
auuaauagcuuuuauuguauaaa

SEQ ID NO: 2235449 - RNA, 13 nt, Human
auuaaguaaugau

SEQ ID NO: 2235450 - RNA, 15 nt, Human
auuaaguaaugauaa

SEQ ID NO: 2235451 - RNA, 12 nt, Human
auuacugcuaag

SEQ ID NO: 2235452 - RNA, 16 nt, Human
auuacugcuaaguauu

SEQ ID NO: 2235453 - RNA, 17 nt, Human
auuacugcuaaguauuu

SEQ ID NO: 2235454 - RNA, 20 nt, Human
auuacugccauucacuucau

SEQ ID NO: 2235455 - RNA, 13 nt, Human
auuacugccauuc

SEQ ID NO: 2235456 - RNA, 17 nt, Human
auuacugcaugcacuuc

SEQ ID NO: 2235457 - RNA, 14 nt, Human
auuacugcaugcac

SEQ ID NO: 2235458 - RNA, 12 nt, Human
auuaccuucucc

SEQ ID NO: 2235459 - RNA, 13 nt, Human
auuaccuuacugu

SEQ ID NO: 2235460 - RNA, 21 nt, Human
auuaccuuagauuagcucugg

SEQ ID NO: 2235461 - RNA, 13 nt, Human
auuaccucugaua

SEQ ID NO: 2235462 - RNA, 21 nt, Human
auuaccuaguagucauuucau

SEQ ID NO: 2235463 - RNA, 23 nt, Human
auuaccagacgguucaccagccu

SEQ ID NO: 2235464 - RNA, 17 nt, Human
auuaccagaguuguucu

SEQ ID NO: 2235465 - RNA, 19 nt, Human
auuaccgcguuguaaaaua

SEQ ID NO: 2235466 - RNA, 20 nt, Human
auuaccgcguuguaaaauau

SEQ ID NO: 2235467 - RNA, 20 nt, Human
auuaccagacgguucaccag

SEQ ID NO: 2235468 - RNA, 14 nt, Human
auuaccaaccuguu

SEQ ID NO: 2235469 - RNA, 22 nt, Human
auuaccugaauuuuggcugugu

SEQ ID NO: 2235470 - RNA, 17 nt, Human
auuaccuccugagaaaa

SEQ ID NO: 2235471 - RNA, 13 nt, Human
auuaccuccugag

SEQ ID NO: 2235472 - RNA, 12 nt, Human
auuaccuccuga

SEQ ID NO: 2235473 - RNA, 21 nt, Human
auuaccgcguuguaaaauaua

SEQ ID NO: 2235474 - RNA, 16 nt, Human
auuaaugacagagcca

SEQ ID NO: 2235475 - RNA, 20 nt, Human
auuaaugacacuugucccca

SEQ ID NO: 2235476 - RNA, 16 nt, Human
auuaaugacacuuguc

SEQ ID NO: 2235477 - RNA, 19 nt, Human
auuaaugaaauaucuguau

SEQ ID NO: 2235478 - RNA, 13 nt, Human
auuaaugaaauau

SEQ ID NO: 2235479 - RNA, 15 nt, Human
auuaaugaaauaucu

SEQ ID NO: 2235480 - RNA, 17 nt, Human
auuaaugaaauaucugu

SEQ ID NO: 2235481 - RNA, 18 nt, Human
auuaaugaaauaucugua

SEQ ID NO: 2235482 - RNA, 17 nt, Human
auuaaugaaaauaagaa

SEQ ID NO: 2235483 - RNA, 18 nt, Human
auuaaucuuucuuuaccu

SEQ ID NO: 2235484 - RNA, 23 nt, Human
auuaaucuuucuuuaccugagac

SEQ ID NO: 2235485 - RNA, 19 nt, Human
auuaaugaaaauaagaauu

SEQ ID NO: 2235486 - RNA, 17 nt, Human
auuaaucuuuuauauug

SEQ ID NO: 2235487 - RNA, 12 nt, Human
auuaaugaaaua

SEQ ID NO: 2235488 - RNA, 11 nt, Human
auuaaugcacu

SEQ ID NO: 2235489 - RNA, 22 nt, Human
auuacauuuccaaaugaaugac

SEQ ID NO: 2235490 - RNA, 13 nt, Human
auuacauuuguau

SEQ ID NO: 2235491 - RNA, 18 nt, Human
auuaccaaaaaucuuggg

SEQ ID NO: 2235492 - RNA, 16 nt, Human
auuaccaaccuguuac

SEQ ID NO: 2235493 - RNA, 19 nt, Human
auuaccacagacauacuaa

SEQ ID NO: 2235494 - RNA, 15 nt, Human
auuacauuuguauaa

SEQ ID NO: 2235495 - RNA, 16 nt, Human
auuacauuuguauaaa

SEQ ID NO: 2235496 - RNA, 21 nt, Human
auuagagcagaugaccccucc

SEQ ID NO: 2235497 - RNA, 13 nt, Human
auuagagcaggcg

SEQ ID NO: 2235498 - RNA, 14 nt, Human
auuagagcauugaa

SEQ ID NO: 2235499 - RNA, 16 nt, Human
auuauaacuuaaaaua

SEQ ID NO: 2235500 - RNA, 20 nt, Human
auuagagauuaccuccugag

SEQ ID NO: 2235501 - RNA, 13 nt, Human
auuagaauuauuu

SEQ ID NO: 2235502 - RNA, 20 nt, Human
auuauaacuuaaaauauuuu

SEQ ID NO: 2235503 - RNA, 22 nt, Human
auuauaacuugucuaaauaagu

SEQ ID NO: 2235504 - RNA, 20 nt, Human
auuauaagaggcugauaauu

SEQ ID NO: 2235505 - RNA, 22 nt, Human
auuauaauauacuauauuuaug

SEQ ID NO: 2235506 - RNA, 20 nt, Human
auuagaaguguuaacuuagc

SEQ ID NO: 2235507 - RNA, 18 nt, Human
auuagaaguguuaacuua

SEQ ID NO: 2235508 - RNA, 14 nt, Human
auuagaaguguuaa

SEQ ID NO: 2235509 - RNA, 21 nt, Human
auuagaagauauuagucuugg

SEQ ID NO: 2235510 - RNA, 22 nt, Human
auuagaauaguguucugcaaaa

SEQ ID NO: 2235511 - RNA, 13 nt, Human
auuagaauagugu

SEQ ID NO: 2235512 - RNA, 14 nt, Human
auuagaaugaaaau

SEQ ID NO: 2235513 - RNA, 14 nt, Human
auuagaauuauuua

SEQ ID NO: 2235514 - RNA, 11 nt, Human
auuagaaauga

SEQ ID NO: 2235515 - RNA, 22 nt, Human
auuagaaauagacaguauauuu

SEQ ID NO: 2235516 - RNA, 17 nt, Human
auuagaaacauaaauaa

SEQ ID NO: 2235517 - RNA, 16 nt, Human
auuagaaauagacagu

SEQ ID NO: 2235518 - RNA, 22 nt, Human
auuagaaaauguuauuuaacag

SEQ ID NO: 2235519 - RNA, 19 nt, Human
auuagaaaauguuauuuaa

SEQ ID NO: 2235520 - RNA, 18 nt, Human
auuagaaaauguuauuua

SEQ ID NO: 2235521 - RNA, 13 nt, Human
auuagaaaauguu

SEQ ID NO: 2235522 - RNA, 17 nt, Human
auuagaaauuggcugga

SEQ ID NO: 2235523 - RNA, 23 nt, Human
auuagaaauuagcugugugaaau

SEQ ID NO: 2235524 - RNA, 20 nt, Human
auuagaaauuagcuguguga

SEQ ID NO: 2235525 - RNA, 15 nt, Human
auuagaaauuagcug

SEQ ID NO: 2235526 - RNA, 23 nt, Human
auuagaacaggcaagugaagaaa

SEQ ID NO: 2235527 - RNA, 18 nt, Human
auuagaacaggcaaguga

SEQ ID NO: 2235528 - RNA, 19 nt, Human
auuagaacaggcaagugaa

SEQ ID NO: 2235529 - RNA, 13 nt, Human
auuagaagacauu

SEQ ID NO: 2235530 - RNA, 19 nt, Human
auuacugcuaaguauuucc

SEQ ID NO: 2235531 - RNA, 21 nt, Human
auuacugcuaaguauuuccca

SEQ ID NO: 2235532 - RNA, 23 nt, Human
auuacugcuaaguauuucccagc

SEQ ID NO: 2235533 - RNA, 21 nt, Human
auuacuuuuccacaaaucagu

SEQ ID NO: 2235534 - RNA, 14 nt, Human
auuacuuugugaau

SEQ ID NO: 2235535 - RNA, 12 nt, Human
auuacuuuacca

SEQ ID NO: 2235536 - RNA, 23 nt, Human
auuacuuuaccacccccacaccu

SEQ ID NO: 2235537 - RNA, 16 nt, Human
auuauaggccaaacug

SEQ ID NO: 2235538 - RNA, 17 nt, Human
auuauaggaucauuugu

SEQ ID NO: 2235539 - RNA, 16 nt, Human
auuauauuuacaaaug

SEQ ID NO: 2235540 - RNA, 13 nt, Human
auuauaaugaauu

SEQ ID NO: 2235541 - RNA, 13 nt, Human
auuauaauuguau

SEQ ID NO: 2235542 - RNA, 15 nt, Human
auuauaauuguauca

SEQ ID NO: 2235543 - RNA, 23 nt, Human
auuauaauuguaucagaggccua

SEQ ID NO: 2235544 - RNA, 15 nt, Human
auuauaauuuaaugc

SEQ ID NO: 2235545 - RNA, 21 nt, Human
auuauagaugggaaugaagcu

SEQ ID NO: 2235546 - RNA, 17 nt, Human
auuaucaugcaaaugcu

SEQ ID NO: 2235547 - RNA, 12 nt, Human
auuaucaugugu

SEQ ID NO: 2235548 - RNA, 13 nt, Human
auuaucaugugua

SEQ ID NO: 2235549 - RNA, 14 nt, Human
auuaucauguguaa

SEQ ID NO: 2235550 - RNA, 16 nt, Human
auuaucauguguaauc

SEQ ID NO: 2235551 - RNA, 17 nt, Human
auuaucauguguaauca

SEQ ID NO: 2235552 - RNA, 19 nt, Human
auuaucauguguaaucaau

SEQ ID NO: 2235553 - RNA, 15 nt, Human
auuaucaugcaaaug

SEQ ID NO: 2235554 - RNA, 12 nt, Human
auuaucagaugc

SEQ ID NO: 2235555 - RNA, 16 nt, Human
auuaucggaagcagug

SEQ ID NO: 2235556 - RNA, 23 nt, Human
auuaucauuuuagaagacucuac

SEQ ID NO: 2235557 - RNA, 16 nt, Human
auuauccuugcuauga

SEQ ID NO: 2235558 - RNA, 12 nt, Human
auuaucccugaa

SEQ ID NO: 2235559 - RNA, 17 nt, Human
auuauccauauugaguc

SEQ ID NO: 2235560 - RNA, 14 nt, Human
auuauccauauuga

SEQ ID NO: 2235561 - RNA, 17 nt, Human
auuauccagguaaucca

SEQ ID NO: 2235562 - RNA, 21 nt, Human
auuaucauguguaaucaauaa

SEQ ID NO: 2235563 - RNA, 22 nt, Human
auuaucauguguaaucaauaaa

SEQ ID NO: 2235564 - RNA, 17 nt, Human
auuauauuuacaaaugg

SEQ ID NO: 2235565 - RNA, 20 nt, Human
auuaucgggaacaguguuuc

SEQ ID NO: 2235566 - RNA, 19 nt, Human
auuaucgggaacaguguuu

SEQ ID NO: 2235567 - RNA, 18 nt, Human
auuaucgggaacaguguu

SEQ ID NO: 2235568 - RNA, 17 nt, Human
auuaucgggaacagugu

SEQ ID NO: 2235569 - RNA, 16 nt, Human
auuaucgggaacagug

SEQ ID NO: 2235570 - RNA, 21 nt, Human
auuaucggaagcagugccuuc

SEQ ID NO: 2235571 - RNA, 19 nt, Human
auuaucggaagcagugccu

SEQ ID NO: 2235572 - RNA, 17 nt, Human
auuaucggaagcagugc

SEQ ID NO: 2235573 - RNA, 19 nt, Human
auuaucgggagcagugucu

SEQ ID NO: 2235574 - RNA, 17 nt, Human
auuaucgggagcagugu

SEQ ID NO: 2235575 - RNA, 16 nt, Human
auuaucgggagcagug

SEQ ID NO: 2235576 - RNA, 22 nt, Human
auuaucgggaacaguguuuccc

SEQ ID NO: 2235577 - RNA, 21 nt, Human
auuaucgggagcagugucuuc

SEQ ID NO: 2235578 - RNA, 20 nt, Human
auuaucgggagcagugucuu

SEQ ID NO: 2235579 - RNA, 22 nt, Human
auuaucuauacauaucuuuauu

SEQ ID NO: 2235580 - RNA, 23 nt, Human
auuaucucaaaacugcacuguca

SEQ ID NO: 2235581 - RNA, 18 nt, Human
auuaucucaaaacugcac

SEQ ID NO: 2235582 - RNA, 18 nt, Human
auuaucuuggaaagaaac

SEQ ID NO: 2235583 - RNA, 17 nt, Human
auuaucucacuugugcc

SEQ ID NO: 2235584 - RNA, 12 nt, Human
auuauguuuaua

SEQ ID NO: 2235585 - RNA, 16 nt, Human
auuauguuuauauaaa

SEQ ID NO: 2235586 - RNA, 20 nt, Human
auuauguuuauauaaaugcu

SEQ ID NO: 2235587 - RNA, 16 nt, Human
auuauguuuuuuaaaa

SEQ ID NO: 2235588 - RNA, 20 nt, Human
auuauguuuuuuaaaauauu

SEQ ID NO: 2235589 - RNA, 14 nt, Human
auuauuaaugaaaa

SEQ ID NO: 2235590 - RNA, 18 nt, Human
auuauuuuauguugcaua

SEQ ID NO: 2235591 - RNA, 16 nt, Human
auuauuuuauguugca

SEQ ID NO: 2235592 - RNA, 14 nt, Human
auuauuuuaaaaga

SEQ ID NO: 2235593 - RNA, 22 nt, Human
auuauuuguuauuuguacaguu

SEQ ID NO: 2235594 - RNA, 14 nt, Human
auuauuuguuuucc

SEQ ID NO: 2235595 - RNA, 13 nt, Human
auuauuuuaaaca

SEQ ID NO: 2235596 - RNA, 14 nt, Human
auuauuuuaaacaa

SEQ ID NO: 2235597 - RNA, 18 nt, Human
auuauuuguguaauagaa

SEQ ID NO: 2235598 - RNA, 13 nt, Human
auuauuuauuauu

SEQ ID NO: 2235599 - RNA, 12 nt, Human
auuauuuguguu

SEQ ID NO: 2235600 - RNA, 20 nt, Human
auuauuuguguaauagaaaa

SEQ ID NO: 2235601 - RNA, 23 nt, Human
auuauuuguguaauagaaaacug

SEQ ID NO: 2235602 - RNA, 13 nt, Human
auuauuuuaaaag

SEQ ID NO: 2235603 - RNA, 15 nt, Human
auuauuuguguuuua

SEQ ID NO: 2235604 - RNA, 22 nt, Human
auuauuuguguuuuaauuuaaa

SEQ ID NO: 2235605 - RNA, 23 nt, Human
auuauuuauuaaaugcccagccc

SEQ ID NO: 2235606 - RNA, 13 nt, Human
auuauucugcagc

SEQ ID NO: 2235607 - RNA, 16 nt, Human
auuauucugauuccac

SEQ ID NO: 2235608 - RNA, 12 nt, Human
auuauucuugua

SEQ ID NO: 2235609 - RNA, 13 nt, Human
auuauucuuguag

SEQ ID NO: 2235610 - RNA, 12 nt, Human
auuauugaaauu

SEQ ID NO: 2235611 - RNA, 13 nt, Human
auuauuuaauaac

SEQ ID NO: 2235612 - RNA, 14 nt, Human
auuauuuaauaaca

SEQ ID NO: 2235613 - RNA, 15 nt, Human
auuauuuaauaacau

SEQ ID NO: 2235614 - RNA, 18 nt, Human
auuauuuaauaacauuac

SEQ ID NO: 2235615 - RNA, 16 nt, Human
auuauuuauauaugua

SEQ ID NO: 2235616 - RNA, 21 nt, Human
auuauuuaauaacauuaccuu

SEQ ID NO: 2235617 - RNA, 22 nt, Human
auuauuuaauaacauuaccuua

SEQ ID NO: 2235618 - RNA, 22 nt, Human
auuauucccuguacaauauuua

SEQ ID NO: 2235619 - RNA, 21 nt, Human
auuauucccuguacaauauuu

SEQ ID NO: 2235620 - RNA, 17 nt, Human
auuauucccuguacaau

SEQ ID NO: 2235621 - RNA, 12 nt, Human
auuauucccucu

SEQ ID NO: 2235622 - RNA, 21 nt, Human
auuauucauuuaaaaugauua

SEQ ID NO: 2235623 - RNA, 20 nt, Human
auuauucauuuaaaaugauu

SEQ ID NO: 2235624 - RNA, 15 nt, Human
auuauuccagaucug

SEQ ID NO: 2235625 - RNA, 13 nt, Human
auuauucauuuaa

SEQ ID NO: 2235626 - RNA, 14 nt, Human
auuauucauuuaaa

SEQ ID NO: 2235627 - RNA, 15 nt, Human
auuauucauuuaaaa

SEQ ID NO: 2235628 - RNA, 16 nt, Human
auuauucauuuaaaau

SEQ ID NO: 2235629 - RNA, 18 nt, Human
auuauucauuuaaaauga

SEQ ID NO: 2235630 - RNA, 19 nt, Human
auuauucauuuaaaaugau

SEQ ID NO: 2235631 - RNA, 22 nt, Human
auuauuaaugaaaauaagaauu

SEQ ID NO: 2235632 - RNA, 20 nt, Human
auuauuaccuuacagaaguu

SEQ ID NO: 2235633 - RNA, 13 nt, Human
auguuuauuuaua

SEQ ID NO: 2235634 - RNA, 21 nt, Human
auguuuauuuauucugcauuu

SEQ ID NO: 2235635 - RNA, 17 nt, Human
auguuuauuuacuaauu

SEQ ID NO: 2235636 - RNA, 18 nt, Human
auguuucaaacauauaua

SEQ ID NO: 2235637 - RNA, 14 nt, Human
auguuuuccaugag

SEQ ID NO: 2235638 - RNA, 21 nt, Human
auguuucaaacauauauaaca

SEQ ID NO: 2235639 - RNA, 22 nt, Human
auguuuacagguggacacacaa

SEQ ID NO: 2235640 - RNA, 22 nt, Human
auguuuacacucuuuguaagag

SEQ ID NO: 2235641 - RNA, 19 nt, Human
auguuuacagaggacagua

SEQ ID NO: 2235642 - RNA, 17 nt, Human
auguuuacagaggacag

SEQ ID NO: 2235643 - RNA, 15 nt, Human
auguuuacagaggac

SEQ ID NO: 2235644 - RNA, 14 nt, Human
auguuuaguaaacu

SEQ ID NO: 2235645 - RNA, 18 nt, Human
auguuuaccuuuuaauua

SEQ ID NO: 2235646 - RNA, 19 nt, Human
auguuuaccuuuuaauuaa

SEQ ID NO: 2235647 - RNA, 21 nt, Human
auguuuacagggagccuccug

SEQ ID NO: 2235648 - RNA, 13 nt, Human
auguuuacauauc

SEQ ID NO: 2235649 - RNA, 20 nt, Human
auguuuacauaucaccucau

SEQ ID NO: 2235650 - RNA, 15 nt, Human
auguuuaccuuuuaa

SEQ ID NO: 2235651 - RNA, 21 nt, Human
auguuguguuucuguucaccu

SEQ ID NO: 2235652 - RNA, 16 nt, Human
auguuguguucuaaua

SEQ ID NO: 2235653 - RNA, 15 nt, Human
auguugugauguauu

SEQ ID NO: 2235654 - RNA, 18 nt, Human
auguuguaaacaggaagc

SEQ ID NO: 2235655 - RNA, 22 nt, Human
auguuguccaauuguugacagu

SEQ ID NO: 2235656 - RNA, 14 nt, Human
auguugucaaagag

SEQ ID NO: 2235657 - RNA, 15 nt, Human
auguugucaaagaga

SEQ ID NO: 2235658 - RNA, 13 nt, Human
auguugucaaaga

SEQ ID NO: 2235659 - RNA, 20 nt, Human
uuuucuccaauaucagugcu

SEQ ID NO: 2235660 - RNA, 21 nt, Human
uuuucuccaauaucagugcuc

SEQ ID NO: 2235661 - RNA, 12 nt, Human
uuuucucagcug

SEQ ID NO: 2235662 - RNA, 19 nt, Human
uuuucucaaaguuuugaaa

SEQ ID NO: 2235663 - RNA, 20 nt, Human
uuuucucaaaguuuugaaaa

SEQ ID NO: 2235664 - RNA, 15 nt, Human
uuuucucaaaguuuu

SEQ ID NO: 2235665 - RNA, 23 nt, Human
uuuucucaaaguuuugaaaagcu

SEQ ID NO: 2235666 - RNA, 23 nt, Human
uuuucuauuguuacucugguucu

SEQ ID NO: 2235667 - RNA, 17 nt, Human
auguuuuuguguauuug

SEQ ID NO: 2235668 - RNA, 19 nt, Human
auguuuuuguucaaagcca

SEQ ID NO: 2235669 - RNA, 19 nt, Human
auguuuuugaaggcagaaa

SEQ ID NO: 2235670 - RNA, 15 nt, Human
auguuuuugaaggca

SEQ ID NO: 2235671 - RNA, 21 nt, Human
auguuuuugaaggcagaaagc

SEQ ID NO: 2235672 - RNA, 18 nt, Human
auguuuuucuucucccuc

SEQ ID NO: 2235673 - RNA, 14 nt, Human
auguuuuugaaggc

SEQ ID NO: 2235674 - RNA, 12 nt, Human
auguuuuugaag

SEQ ID NO: 2235675 - RNA, 12 nt, Human
auguuuugauaa

SEQ ID NO: 2235676 - RNA, 18 nt, Human
auguuuugauaaaguagu

SEQ ID NO: 2235677 - RNA, 20 nt, Human
auguuuugauaaaguaguaa

SEQ ID NO: 2235678 - RNA, 17 nt, Human
auguuuuugaaacagaa

SEQ ID NO: 2235679 - RNA, 18 nt, Human
auguuuucuuugcuuuaa

SEQ ID NO: 2235680 - RNA, 12 nt, Human
auguuuugacau

SEQ ID NO: 2235681 - RNA, 14 nt, Human
auguuuugacauuu

SEQ ID NO: 2235682 - RNA, 16 nt, Human
auguuuugacauuuuu

SEQ ID NO: 2235683 - RNA, 17 nt, Human
auguuuuucuucucccu

SEQ ID NO: 2235684 - RNA, 23 nt, Human
auguuuuccuuugucaucauugu

SEQ ID NO: 2235685 - RNA, 19 nt, Human
auguuuuccagcuccucau

SEQ ID NO: 2235686 - RNA, 16 nt, Human
auguuuuccauuguuu

SEQ ID NO: 2235687 - RNA, 20 nt, Human
auguuuuccauuguuugaaa

SEQ ID NO: 2235688 - RNA, 18 nt, Human
auguuuucugaaaauaua

SEQ ID NO: 2235689 - RNA, 20 nt, Human
auguuuucugaaaauauaac

SEQ ID NO: 2235690 - RNA, 21 nt, Human
auguuuucugaaaauauaacc

SEQ ID NO: 2235691 - RNA, 19 nt, Human
auuaaaauaaauaaaugca

SEQ ID NO: 2235692 - RNA, 22 nt, Human
auuaaaagggauuacccaagca

SEQ ID NO: 2235693 - RNA, 21 nt, Human
auuaaaaauauggaacuucua

SEQ ID NO: 2235694 - RNA, 14 nt, Human
auuaaaagaauuuu

SEQ ID NO: 2235695 - RNA, 16 nt, Human
auuaaaagaauauuuu

SEQ ID NO: 2235696 - RNA, 12 nt, Human
auuaaaaaauuu

SEQ ID NO: 2235697 - RNA, 21 nt, Human
auguuuugauaaaguaguaaa

SEQ ID NO: 2235698 - RNA, 21 nt, Human
auguuuuuguuuucuuugaau

SEQ ID NO: 2235699 - RNA, 17 nt, Human
auuaaaaaauuuccagu

SEQ ID NO: 2235700 - RNA, 12 nt, Human
auuaaaaauaua

SEQ ID NO: 2235701 - RNA, 13 nt, Human
auuaaaaauauaa

SEQ ID NO: 2235702 - RNA, 15 nt, Human
auuaaaaauauaaaa

SEQ ID NO: 2235703 - RNA, 14 nt, Human
auuaaaaauaugga

SEQ ID NO: 2235704 - RNA, 16 nt, Human
auuaaaaauauaaaac

SEQ ID NO: 2235705 - RNA, 17 nt, Human
auuaaaaauauaaaacu

SEQ ID NO: 2235706 - RNA, 14 nt, Human
auuaagaaagacua

SEQ ID NO: 2235707 - RNA, 13 nt, Human
auuaagaaagacu

SEQ ID NO: 2235708 - RNA, 18 nt, Human
auuaacuucucuggaaag

SEQ ID NO: 2235709 - RNA, 12 nt, Human
auuaagaaaauc

SEQ ID NO: 2235710 - RNA, 13 nt, Human
auuaagaaaauca

SEQ ID NO: 2235711 - RNA, 14 nt, Human
auuaagaaaaucau

SEQ ID NO: 2235712 - RNA, 23 nt, Human
auuaacuuuuauaaacuuuaccu

SEQ ID NO: 2235713 - RNA, 14 nt, Human
auuaagaagaaacu

SEQ ID NO: 2235714 - RNA, 20 nt, Human
auuaagaacacuuuuaauaa

SEQ ID NO: 2235715 - RNA, 15 nt, Human
auuaagaaaaucuau

SEQ ID NO: 2235716 - RNA, 15 nt, Human
auuaagaaaaucaua

SEQ ID NO: 2235717 - RNA, 16 nt, Human
auuaagaaaaucauau

SEQ ID NO: 2235718 - RNA, 20 nt, Human
auuaagaaaaucauauugcu

SEQ ID NO: 2235719 - RNA, 22 nt, Human
auuaagaaggcaaaaauguaaa

SEQ ID NO: 2235720 - RNA, 19 nt, Human
auuaagaaggcaaaaaugu

SEQ ID NO: 2235721 - RNA, 15 nt, Human
auuaagaaggcaaaa

SEQ ID NO: 2235722 - RNA, 22 nt, Human
auuaagaaugaaauacuguuug

SEQ ID NO: 2235723 - RNA, 21 nt, Human
auuaagaaugaaauacuguuu

SEQ ID NO: 2235724 - RNA, 20 nt, Human
auuaagaaugaaauacuguu

SEQ ID NO: 2235725 - RNA, 16 nt, Human
auuaagaaugaaauac

SEQ ID NO: 2235726 - RNA, 15 nt, Human
auuaacuuagcaugu

SEQ ID NO: 2235727 - RNA, 12 nt, Human
auuaacuuuuau

SEQ ID NO: 2235728 - RNA, 17 nt, Human
auuaaccuggugcugga

SEQ ID NO: 2235729 - RNA, 14 nt, Human
auuaaccuggugcu

SEQ ID NO: 2235730 - RNA, 22 nt, Human
auuaaccugccagggagacaga

SEQ ID NO: 2235731 - RNA, 14 nt, Human
auuaaccucugcac

SEQ ID NO: 2235732 - RNA, 17 nt, Human
auuaacuaaucuauugg

SEQ ID NO: 2235733 - RNA, 16 nt, Human
auuaaccuggugcugg

SEQ ID NO: 2235734 - RNA, 20 nt, Human
auuaacuuuuauaaacuuua

SEQ ID NO: 2235735 - RNA, 19 nt, Human
auuaacuuuuauaaacuuu

SEQ ID NO: 2235736 - RNA, 17 nt, Human
auuaacuuuuauaaacu

SEQ ID NO: 2235737 - RNA, 16 nt, Human
auuaacuuuuauaaac

SEQ ID NO: 2235738 - RNA, 18 nt, Human
auuaaagcuaaaguaucu

SEQ ID NO: 2235739 - RNA, 14 nt, Human
auuaaaggaauaaa

SEQ ID NO: 2235740 - RNA, 17 nt, Human
auuaaagcuaaaguauc

SEQ ID NO: 2235741 - RNA, 16 nt, Human
auuaaaggcuucucuc

SEQ ID NO: 2235742 - RNA, 20 nt, Human
auuaaaggcuucucucucac

SEQ ID NO: 2235743 - RNA, 18 nt, Human
auuaaagugauacugaaa

SEQ ID NO: 2235744 - RNA, 21 nt, Human
auuaaacuuaaucuaaaugga

SEQ ID NO: 2235745 - RNA, 19 nt, Human
auuaaacuuaaucuaaaug

SEQ ID NO: 2235746 - RNA, 16 nt, Human
auuaaacuuaaucuaa

SEQ ID NO: 2235747 - RNA, 17 nt, Human
auuaaacuuaaucuaaa

SEQ ID NO: 2235748 - RNA, 21 nt, Human
auuaacauugggaaaucuuau

SEQ ID NO: 2235749 - RNA, 19 nt, Human
auuaacauugggaaaucuu

SEQ ID NO: 2235750 - RNA, 19 nt, Human
auuaaaggcuucucucuca

SEQ ID NO: 2235751 - RNA, 17 nt, Human
auuaaccacuucagcug

SEQ ID NO: 2235752 - RNA, 20 nt, Human
auuaaccacuucagcugacu

SEQ ID NO: 2235753 - RNA, 18 nt, Human
auuaaccacuucagcuga

SEQ ID NO: 2235754 - RNA, 15 nt, Human
auuaaccauagaugu

SEQ ID NO: 2235755 - RNA, 18 nt, Human
auuaaccagaaauccagu

SEQ ID NO: 2235756 - RNA, 22 nt, Human
auuaacauugggaaaucuuaua

SEQ ID NO: 2235757 - RNA, 17 nt, Human
auuaaccaaaaaaguua

SEQ ID NO: 2235758 - RNA, 19 nt, Human
auuaaccaaaaaaguuaca

SEQ ID NO: 2235759 - RNA, 13 nt, Human
auuaaccucucac

SEQ ID NO: 2235760 - RNA, 13 nt, Human
auuaaccucugca

SEQ ID NO: 2235761 - RNA, 19 nt, Human
uuuuaugccuuuuauuucu

SEQ ID NO: 2235762 - RNA, 18 nt, Human
uuuuaugcuuuaaacauu

SEQ ID NO: 2235763 - RNA, 14 nt, Human
uuuuauaauuuugu

SEQ ID NO: 2235764 - RNA, 20 nt, Human
uuuuauaaaucgcuuuugau

SEQ ID NO: 2235765 - RNA, 12 nt, Human
uuuuauaaaucg

SEQ ID NO: 2235766 - RNA, 19 nt, Human
uuuuauaaaccucuaauuu

SEQ ID NO: 2235767 - RNA, 20 nt, Human
uuuuauaacuaguccuuuac

SEQ ID NO: 2235768 - RNA, 16 nt, Human
uuuuauaaaaaauggu

SEQ ID NO: 2235769 - RNA, 19 nt, Human
uuuuauaaacuuuaccuuu

SEQ ID NO: 2235770 - RNA, 17 nt, Human
uuuuauaaacuuuaccu

SEQ ID NO: 2235771 - RNA, 14 nt, Human
uuuuauaaacuuua

SEQ ID NO: 2235772 - RNA, 23 nt, Human
uuuuauaauaaaaggaaaagcaa

SEQ ID NO: 2235773 - RNA, 18 nt, Human
uuuuaugugaaacauguu

SEQ ID NO: 2235774 - RNA, 19 nt, Human
uuuuauggcacuaguauuu

SEQ ID NO: 2235775 - RNA, 23 nt, Human
uuuuauggaggcuuugcauagau

SEQ ID NO: 2235776 - RNA, 18 nt, Human
uuuuaugugagagaaagu

SEQ ID NO: 2235777 - RNA, 19 nt, Human
uuuuauguaguaauugaca

SEQ ID NO: 2235778 - RNA, 19 nt, Human
uuuuaugugaaacauguuu

SEQ ID NO: 2235779 - RNA, 22 nt, Human
uuuuauguugcauagaauaaaa

SEQ ID NO: 2235780 - RNA, 18 nt, Human
uuuuccaugaaaaugcaa

SEQ ID NO: 2235781 - RNA, 19 nt, Human
uuuuccaugaaaaugcaac

SEQ ID NO: 2235782 - RNA, 16 nt, Human
uuuuccaugaaaacgu

SEQ ID NO: 2235783 - RNA, 14 nt, Human
uuuuccaugaaaac

SEQ ID NO: 2235784 - RNA, 11 nt, Human
uuuuccaugaa

SEQ ID NO: 2235785 - RNA, 14 nt, Human
uuuuccauaaagaa

SEQ ID NO: 2235786 - RNA, 19 nt, Human
uuuuccagguuuaagcugu

SEQ ID NO: 2235787 - RNA, 13 nt, Human
uuuuccaggcugg

SEQ ID NO: 2235788 - RNA, 21 nt, Human
uuuucauucagguauuuguaa

SEQ ID NO: 2235789 - RNA, 14 nt, Human
uuuucaugugugau

SEQ ID NO: 2235790 - RNA, 21 nt, Human
uuuucauggugaaaauguacu

SEQ ID NO: 2235791 - RNA, 16 nt, Human
uuuucauguuuuaaca

SEQ ID NO: 2235792 - RNA, 12 nt, Human
uuuucauguuuu

SEQ ID NO: 2235793 - RNA, 20 nt, Human
uuuucauguuuuaacaaaaa

SEQ ID NO: 2235794 - RNA, 19 nt, Human
uuuucauguuuuaacaaaa

SEQ ID NO: 2235795 - RNA, 19 nt, Human
uuuucagcccauauuucau

SEQ ID NO: 2235796 - RNA, 19 nt, Human
uuuucagcaaacucuuuuc

SEQ ID NO: 2235797 - RNA, 18 nt, Human
uuuucauggugaaaaugu

SEQ ID NO: 2235798 - RNA, 18 nt, Human
uuuucagcgauguaugca

SEQ ID NO: 2235799 - RNA, 18 nt, Human
uuuucagcaaacucuuuu

SEQ ID NO: 2235800 - RNA, 22 nt, Human
uuuucagauauaaaagacugac

SEQ ID NO: 2235801 - RNA, 20 nt, Human
uuuuauucauaagccaauuu

SEQ ID NO: 2235802 - RNA, 19 nt, Human
uuuucagauauaaaagacu

SEQ ID NO: 2235803 - RNA, 21 nt, Human
uuuucagauauaaaagacuga

SEQ ID NO: 2235804 - RNA, 17 nt, Human
uuuucagauauaaaaga

SEQ ID NO: 2235805 - RNA, 14 nt, Human
uuuuauucaaguua

SEQ ID NO: 2235806 - RNA, 13 nt, Human
uuuuauuauuugu

SEQ ID NO: 2235807 - RNA, 18 nt, Human
uuuuauucauaagccaau

SEQ ID NO: 2235808 - RNA, 21 nt, Human
uuuuauucagcucauggacuu

SEQ ID NO: 2235809 - RNA, 16 nt, Human
uuuuauuauuacuguu

SEQ ID NO: 2235810 - RNA, 16 nt, Human
uuuuagaucaaauacu

SEQ ID NO: 2235811 - RNA, 23 nt, Human
uuuuagaguugauacuacaguuu

SEQ ID NO: 2235812 - RNA, 20 nt, Human
uuuuagaugagauuguuuua

SEQ ID NO: 2235813 - RNA, 17 nt, Human
uuuuagaucaaauacuu

SEQ ID NO: 2235814 - RNA, 19 nt, Human
uuuuagaucaaauacuuua

SEQ ID NO: 2235815 - RNA, 19 nt, Human
uuuuagaugagauuguuuu

SEQ ID NO: 2235816 - RNA, 19 nt, Human
uuuuagccuaguucaucca

SEQ ID NO: 2235817 - RNA, 22 nt, Human
uuuuagcauguguuugguucug

SEQ ID NO: 2235818 - RNA, 16 nt, Human
uuuuagccuucucugu

SEQ ID NO: 2235819 - RNA, 23 nt, Human
uuuuagccuucucuguucauuuc

SEQ ID NO: 2235820 - RNA, 19 nt, Human
uuuuagcuccuugacuccu

SEQ ID NO: 2235821 - RNA, 20 nt, Human
uuuuagcugaugaacuuauu

SEQ ID NO: 2235822 - RNA, 21 nt, Human
uuuuagcaauuuauacaauau

SEQ ID NO: 2235823 - RNA, 23 nt, Human
uuuuagcaaagauaucucaucuc

SEQ ID NO: 2235824 - RNA, 11 nt, Human
uuuuagcaugu

SEQ ID NO: 2235825 - RNA, 13 nt, Human
uuuuaguuuuagu

SEQ ID NO: 2235826 - RNA, 22 nt, Human
uuuuaguuucuguucuguggaa

SEQ ID NO: 2235827 - RNA, 20 nt, Human
uuuuaguuucuguucugugg

SEQ ID NO: 2235828 - RNA, 21 nt, Human
uuuuaguuucuguucugugga

SEQ ID NO: 2235829 - RNA, 19 nt, Human
uuuuaguugcaacuuugua

SEQ ID NO: 2235830 - RNA, 20 nt, Human
uuuuaguuuaaaaaccuugu

SEQ ID NO: 2235831 - RNA, 18 nt, Human
uuuuaguuucuguucugu

SEQ ID NO: 2235832 - RNA, 19 nt, Human
uuuuaguuucuguucugug

SEQ ID NO: 2235833 - RNA, 13 nt, Human
uuuuauaaacuuu

SEQ ID NO: 2235834 - RNA, 12 nt, Human
uuuuauaaacuu

SEQ ID NO: 2235835 - RNA, 20 nt, Human
auguugagggaacagacagg

SEQ ID NO: 2235836 - RNA, 14 nt, Human
auguugagggaaca

SEQ ID NO: 2235837 - RNA, 18 nt, Human
auguugagccaggccugg

SEQ ID NO: 2235838 - RNA, 22 nt, Human
auguugagaaucccaaauuuga

SEQ ID NO: 2235839 - RNA, 16 nt, Human
auguugagaaucccaa

SEQ ID NO: 2235840 - RNA, 22 nt, Human
auguugaaugcccacaggcaaa

SEQ ID NO: 2235841 - RNA, 16 nt, Human
auguuggccaggcugg

SEQ ID NO: 2235842 - RNA, 16 nt, Human
auguuggccaggcugc

SEQ ID NO: 2235843 - RNA, 22 nt, Human
auguugcacacccacucagcuc

SEQ ID NO: 2235844 - RNA, 21 nt, Human
auguugcacacccacucagcu

SEQ ID NO: 2235845 - RNA, 13 nt, Human
auguuggccaggc

SEQ ID NO: 2235846 - RNA, 14 nt, Human
auguuggccaggcu

SEQ ID NO: 2235847 - RNA, 21 nt, Human
uuuuaaguuacacauuuuuca

SEQ ID NO: 2235848 - RNA, 22 nt, Human
uuuuaaguuacacauuuuucag

SEQ ID NO: 2235849 - RNA, 14 nt, Human
uuuuaaguugcuga

SEQ ID NO: 2235850 - RNA, 19 nt, Human
uuuuaaguauuuauauauu

SEQ ID NO: 2235851 - RNA, 19 nt, Human
uuuuaagugcuuuguaaug

SEQ ID NO: 2235852 - RNA, 17 nt, Human
uuuuaagugcuuuguaa

SEQ ID NO: 2235853 - RNA, 21 nt, Human
uuuuaagugcugcauuuaaaa

SEQ ID NO: 2235854 - RNA, 17 nt, Human
uuuuaagugcugcauuu

SEQ ID NO: 2235855 - RNA, 16 nt, Human
uuuuaagugcugcauu

SEQ ID NO: 2235856 - RNA, 23 nt, Human
auguucauuguaauguuacugau

SEQ ID NO: 2235857 - RNA, 15 nt, Human
auguuccaauaaaca

SEQ ID NO: 2235858 - RNA, 11 nt, Human
auguucauuua

SEQ ID NO: 2235859 - RNA, 22 nt, Human
auguucauuguaauguuacuga

SEQ ID NO: 2235860 - RNA, 21 nt, Human
auguucauuguaauguuacug

SEQ ID NO: 2235861 - RNA, 14 nt, Human
auguucauuguaau

SEQ ID NO: 2235862 - RNA, 19 nt, Human
auguucaucccaugaugua

SEQ ID NO: 2235863 - RNA, 15 nt, Human
auguugaagccuuug

SEQ ID NO: 2235864 - RNA, 16 nt, Human
auguugaagccuuugu

SEQ ID NO: 2235865 - RNA, 19 nt, Human
auguugaauacuuuuuaca

SEQ ID NO: 2235866 - RNA, 15 nt, Human
auguugaauacuuuu

SEQ ID NO: 2235867 - RNA, 14 nt, Human
auguugaauacuuu

SEQ ID NO: 2235868 - RNA, 16 nt, Human
auguuccaauaaacag

SEQ ID NO: 2235869 - RNA, 18 nt, Human
auguuccaauaaacagga

SEQ ID NO: 2235870 - RNA, 15 nt, Human
auguugacaugggac

SEQ ID NO: 2235871 - RNA, 21 nt, Human
auguucaucauccuaagcuau

SEQ ID NO: 2235872 - RNA, 19 nt, Human
auguucaucaaugaaugaa

SEQ ID NO: 2235873 - RNA, 13 nt, Human
auguuauauauuu

SEQ ID NO: 2235874 - RNA, 17 nt, Human
auguuauauauuuuuug

SEQ ID NO: 2235875 - RNA, 13 nt, Human
uuuguuugugcau

SEQ ID NO: 2235876 - RNA, 15 nt, Human
uuuguuugcuaucuu

SEQ ID NO: 2235877 - RNA, 12 nt, Human
uuuguuugugcu

SEQ ID NO: 2235878 - RNA, 15 nt, Human
uuuguuugugcuucu

SEQ ID NO: 2235879 - RNA, 16 nt, Human
uuuguuugugcuucua

SEQ ID NO: 2235880 - RNA, 13 nt, Human
uuuuaaaaaagaa

SEQ ID NO: 2235881 - RNA, 18 nt, Human
uuuguuugaacugauaaa

SEQ ID NO: 2235882 - RNA, 15 nt, Human
uuuguuugguauugu

SEQ ID NO: 2235883 - RNA, 13 nt, Human
uuuguuugcuauc

SEQ ID NO: 2235884 - RNA, 16 nt, Human
uuuguuugguauugua

SEQ ID NO: 2235885 - RNA, 18 nt, Human
uuuguuugguauuguauu

SEQ ID NO: 2235886 - RNA, 22 nt, Human
uuuuaaaaagaaacaagaugcu

SEQ ID NO: 2235887 - RNA, 23 nt, Human
uuuuaaaaaucauaaacugugug

SEQ ID NO: 2235888 - RNA, 22 nt, Human
uuuuaaaaaucuaccuucugua

SEQ ID NO: 2235889 - RNA, 12 nt, Human
uuuuaaaaauga

SEQ ID NO: 2235890 - RNA, 22 nt, Human
uuuuaaaaaucauaaacugugu

SEQ ID NO: 2235891 - RNA, 15 nt, Human
uuuuaaaaaucauaa

SEQ ID NO: 2235892 - RNA, 17 nt, Human
uuuuaaaaauagacacu

SEQ ID NO: 2235893 - RNA, 14 nt, Human
uuuuaaaaaugcaa

SEQ ID NO: 2235894 - RNA, 16 nt, Human
uuuuaaaaaugaaauu

SEQ ID NO: 2235895 - RNA, 14 nt, Human
uuuuaaaaaugaau

SEQ ID NO: 2235896 - RNA, 22 nt, Human
uuuuaaaaauuaaaucaaccuu

SEQ ID NO: 2235897 - RNA, 20 nt, Human
uuuuaaaaauuguuaauuuu

SEQ ID NO: 2235898 - RNA, 15 nt, Human
uuuuaaaaaugaauc

SEQ ID NO: 2235899 - RNA, 16 nt, Human
uuuuaaaacacuucca

SEQ ID NO: 2235900 - RNA, 22 nt, Human
uuuuaaaacacuuccauaaucu

SEQ ID NO: 2235901 - RNA, 13 nt, Human
uuuuaaaacccag

SEQ ID NO: 2235902 - RNA, 17 nt, Human
uuuuaacaccugaugug

SEQ ID NO: 2235903 - RNA, 19 nt, Human
uuuuaacaccugaugugua

SEQ ID NO: 2235904 - RNA, 20 nt, Human
uuuuaacaccugauguguac

SEQ ID NO: 2235905 - RNA, 12 nt, Human
uuuuaaccaaag

SEQ ID NO: 2235906 - RNA, 22 nt, Human
uuuuaacaauaacuacuguguu

SEQ ID NO: 2235907 - RNA, 21 nt, Human
uuuuaacaauaacuacugugu

SEQ ID NO: 2235908 - RNA, 14 nt, Human
uuuuaaaagaauga

SEQ ID NO: 2235909 - RNA, 15 nt, Human
uuuuaaaagaaugau

SEQ ID NO: 2235910 - RNA, 19 nt, Human
uuuuaagacguguuugugu

SEQ ID NO: 2235911 - RNA, 22 nt, Human
uuuuaagauaaauuauaaguua

SEQ ID NO: 2235912 - RNA, 16 nt, Human
uuuuaagaggcagggu

SEQ ID NO: 2235913 - RNA, 15 nt, Human
uuuuaagaggcaggg

SEQ ID NO: 2235914 - RNA, 11 nt, Human
uuuuaagaaau

SEQ ID NO: 2235915 - RNA, 21 nt, Human
uuuuaaccauugucuuguucu

SEQ ID NO: 2235916 - RNA, 14 nt, Human
uuuuaaccaaaggu

SEQ ID NO: 2235917 - RNA, 15 nt, Human
uuuuaaccaaaggug

SEQ ID NO: 2235918 - RNA, 16 nt, Human
uuuuaaccaaagguga

SEQ ID NO: 2235919 - RNA, 21 nt, Human
uuuuaaccaaaggugaaggaa

SEQ ID NO: 2235920 - RNA, 12 nt, Human
uuuuaacuagaa

SEQ ID NO: 2235921 - RNA, 13 nt, Human
uuuuaacucaaua

SEQ ID NO: 2235922 - RNA, 16 nt, Human
uuuuaacuagaauuua

SEQ ID NO: 2235923 - RNA, 12 nt, Human
uuuuaacucacc

SEQ ID NO: 2235924 - RNA, 14 nt, Human
uuuuaacucugucu

SEQ ID NO: 2235925 - RNA, 16 nt, Human
uuuuaacuuuaaguuu

SEQ ID NO: 2235926 - RNA, 19 nt, Human
uuuuaacuuuaaguuucag

SEQ ID NO: 2235927 - RNA, 18 nt, Human
uuuuaaguauuuauauau

SEQ ID NO: 2235928 - RNA, 17 nt, Human
uuuuaaguauuuauaua

SEQ ID NO: 2235929 - RNA, 15 nt, Human
uuuuaaguauuuagg

SEQ ID NO: 2235930 - RNA, 21 nt, Human
uuuuaaguauugcaucuguau

SEQ ID NO: 2235931 - RNA, 15 nt, Human
uuuuaagugcugcau

SEQ ID NO: 2235932 - RNA, 23 nt, Human
uuuuaaggguuuguggaaaauga

SEQ ID NO: 2235933 - RNA, 16 nt, Human
uuuuaaguaaggaauu

SEQ ID NO: 2235934 - RNA, 12 nt, Human
uuuuaagcuguu

SEQ ID NO: 2235935 - RNA, 12 nt, Human
uuuuaaggaaac

SEQ ID NO: 2235936 - RNA, 21 nt, Human
uuuuaagcguaauuuugccaa

SEQ ID NO: 2235937 - RNA, 22 nt, Human
uuuuaagcuguaaaaagagaga

SEQ ID NO: 2235938 - RNA, 20 nt, Human
uuuuaaggguuuguggaaaa

SEQ ID NO: 2235939 - RNA, 12 nt, Human
uuuuaagauuuu

SEQ ID NO: 2235940 - RNA, 21 nt, Human
uuuuaagauaauaauauaugu

SEQ ID NO: 2235941 - RNA, 17 nt, Human
uuuuaagauuuuucuca

SEQ ID NO: 2235942 - RNA, 18 nt, Human
uuuuaagauuuuucucaa

SEQ ID NO: 2235943 - RNA, 19 nt, Human
uuuuaagauuuuucucaaa

SEQ ID NO: 2235944 - RNA, 15 nt, Human
uuuuaagcaaaauau

SEQ ID NO: 2235945 - RNA, 23 nt, Human
uuuuaagcccaucaauuauagaa

SEQ ID NO: 2235946 - RNA, 21 nt, Human
uuuuaagauuuuucucaaagu

SEQ ID NO: 2235947 - RNA, 11 nt, Human
augucugugcu

SEQ ID NO: 2235948 - RNA, 19 nt, Human
augucuguagcuccucaac

SEQ ID NO: 2235949 - RNA, 18 nt, Human
augucuguagcuccucaa

SEQ ID NO: 2235950 - RNA, 16 nt, Human
augucuguagcuccuc

SEQ ID NO: 2235951 - RNA, 13 nt, Human
augucuguuacca

SEQ ID NO: 2235952 - RNA, 12 nt, Human
augucugugcua

SEQ ID NO: 2235953 - RNA, 20 nt, Human
augucugugcuagggaaacu

SEQ ID NO: 2235954 - RNA, 14 nt, Human
augucuguucuaca

SEQ ID NO: 2235955 - RNA, 20 nt, Human
augucuguuaccaugucacu

SEQ ID NO: 2235956 - RNA, 23 nt, Human
augucuguuaccaugucacugug

SEQ ID NO: 2235957 - RNA, 16 nt, Human
augucuguugaugacu

SEQ ID NO: 2235958 - RNA, 12 nt, Human
augucuuaauga

SEQ ID NO: 2235959 - RNA, 16 nt, Human
augucuguucuacaua

SEQ ID NO: 2235960 - RNA, 13 nt, Human
augucuuaaugaa

SEQ ID NO: 2235961 - RNA, 16 nt, Human
augucuuaaugaaguu

SEQ ID NO: 2235962 - RNA, 18 nt, Human
augucuuaaugaaguuug

SEQ ID NO: 2235963 - RNA, 20 nt, Human
augucugcugaauaauaaac

SEQ ID NO: 2235964 - RNA, 23 nt, Human
augucugccaauuuuugccuuca

SEQ ID NO: 2235965 - RNA, 15 nt, Human
augucugccacacaa

SEQ ID NO: 2235966 - RNA, 22 nt, Human
augucugagugaaccuguauaa

SEQ ID NO: 2235967 - RNA, 15 nt, Human
augucuauuuaagcc

SEQ ID NO: 2235968 - RNA, 23 nt, Human
augucuauuuaagccucauauuu

SEQ ID NO: 2235969 - RNA, 17 nt, Human
augucugaacucuccag

SEQ ID NO: 2235970 - RNA, 16 nt, Human
augucugagugaaccu

SEQ ID NO: 2235971 - RNA, 15 nt, Human
augucugagugaacc

SEQ ID NO: 2235972 - RNA, 14 nt, Human
augucugcauuucg

SEQ ID NO: 2235973 - RNA, 13 nt, Human
augucugccaauu

SEQ ID NO: 2235974 - RNA, 14 nt, Human
augucugccaauuu

SEQ ID NO: 2235975 - RNA, 16 nt, Human
augucugccaauuuuu

SEQ ID NO: 2235976 - RNA, 21 nt, Human
augucugccaauuuuugccuu

SEQ ID NO: 2235977 - RNA, 14 nt, Human
uuuguaccauggug

SEQ ID NO: 2235978 - RNA, 19 nt, Human
uuuguacauauguaaaaua

SEQ ID NO: 2235979 - RNA, 18 nt, Human
uuuguaaccucagcucug

SEQ ID NO: 2235980 - RNA, 19 nt, Human
uuuguaaccucagcucugg

SEQ ID NO: 2235981 - RNA, 21 nt, Human
uuuguaacccagauuuugcug

SEQ ID NO: 2235982 - RNA, 15 nt, Human
uuuguaaccucagcu

SEQ ID NO: 2235983 - RNA, 16 nt, Human
uuuguaaccucagcuc

SEQ ID NO: 2235984 - RNA, 13 nt, Human
uuuguaaauuguc

SEQ ID NO: 2235985 - RNA, 20 nt, Human
uuuguaacccagauuuugcu

SEQ ID NO: 2235986 - RNA, 17 nt, Human
uuuguaaauuuauguga

SEQ ID NO: 2235987 - RNA, 13 nt, Human
uuuguagagccag

SEQ ID NO: 2235988 - RNA, 16 nt, Human
uuuguacuguaaagag

SEQ ID NO: 2235989 - RNA, 13 nt, Human
uuuguacuguaaa

SEQ ID NO: 2235990 - RNA, 15 nt, Human
uuuguacuguaaaga

SEQ ID NO: 2235991 - RNA, 20 nt, Human
uuuguacuguaaagagaccu

SEQ ID NO: 2235992 - RNA, 17 nt, Human
uuuguaccaugguguga

SEQ ID NO: 2235993 - RNA, 18 nt, Human
uuuguaccccccaacccc

SEQ ID NO: 2235994 - RNA, 15 nt, Human
uuuguacugaaaaau

SEQ ID NO: 2235995 - RNA, 14 nt, Human
uuuguacugaaaaa

SEQ ID NO: 2235996 - RNA, 19 nt, Human
uuuguaccccccaaccccu

SEQ ID NO: 2235997 - RNA, 20 nt, Human
uuuguaccccccaaccccug

SEQ ID NO: 2235998 - RNA, 17 nt, Human
uuuguagccuuccucca

SEQ ID NO: 2235999 - RNA, 19 nt, Human
uuuguaggggucaaagaaa

SEQ ID NO: 2236000 - RNA, 20 nt, Human
uuuguaggggucaaagaaau

SEQ ID NO: 2236001 - RNA, 21 nt, Human
uuuguaggggucaaagaaaug

SEQ ID NO: 2236002 - RNA, 23 nt, Human
uuuguaggggucaaagaaaugcu

SEQ ID NO: 2236003 - RNA, 16 nt, Human
uuugucgaauuuuuau

SEQ ID NO: 2236004 - RNA, 20 nt, Human
uuugucgaauuuuuauuauu

SEQ ID NO: 2236005 - RNA, 19 nt, Human
uuugucgcucaugugugca

SEQ ID NO: 2236006 - RNA, 19 nt, Human
uuugucuaaaacaauaaaa

SEQ ID NO: 2236007 - RNA, 16 nt, Human
uuugucuaaaacaaua

SEQ ID NO: 2236008 - RNA, 14 nt, Human
uuugucuaaaacaa

SEQ ID NO: 2236009 - RNA, 11 nt, Human
uuugucuaaaa

SEQ ID NO: 2236010 - RNA, 17 nt, Human
uuugucugucuucauag

SEQ ID NO: 2236011 - RNA, 20 nt, Human
uuugugacuauauagagaug

SEQ ID NO: 2236012 - RNA, 22 nt, Human
uuugugacuauauagagauguu

SEQ ID NO: 2236013 - RNA, 16 nt, Human
uuugugagcaggcugu

SEQ ID NO: 2236014 - RNA, 14 nt, Human
uuugucugaaaaau

SEQ ID NO: 2236015 - RNA, 14 nt, Human
uuugucucauccca

SEQ ID NO: 2236016 - RNA, 19 nt, Human
uuugucucaucccauucug

SEQ ID NO: 2236017 - RNA, 15 nt, Human
uuugucuaaaaugcc

SEQ ID NO: 2236018 - RNA, 23 nt, Human
uuugugacuauauagagauguuu

SEQ ID NO: 2236019 - RNA, 18 nt, Human
uuugugaggaagccgcug

SEQ ID NO: 2236020 - RNA, 19 nt, Human
uuugugaggaagccgcugg

SEQ ID NO: 2236021 - RNA, 16 nt, Human
uuuguuucuuccaaag

SEQ ID NO: 2236022 - RNA, 12 nt, Human
uuuguuugaacu

SEQ ID NO: 2236023 - RNA, 14 nt, Human
uuuguuugaacuga

SEQ ID NO: 2236024 - RNA, 13 nt, Human
uuuguuugaacug

SEQ ID NO: 2236025 - RNA, 14 nt, Human
auguagugccucuu

SEQ ID NO: 2236026 - RNA, 16 nt, Human
auguagugccucuuuc

SEQ ID NO: 2236027 - RNA, 22 nt, Human
uuugggggaaaauuuagaaaua

SEQ ID NO: 2236028 - RNA, 13 nt, Human
auguaucaggaaa

SEQ ID NO: 2236029 - RNA, 21 nt, Human
auguaucaggaaauauauaug

SEQ ID NO: 2236030 - RNA, 16 nt, Human
auguaucauagaaaug

SEQ ID NO: 2236031 - RNA, 20 nt, Human
auguauccaugggggcaggg

SEQ ID NO: 2236032 - RNA, 12 nt, Human
auguaucaucug

SEQ ID NO: 2236033 - RNA, 17 nt, Human
auguaucauagaaaugu

SEQ ID NO: 2236034 - RNA, 17 nt, Human
auguauaaagaacaagg

SEQ ID NO: 2236035 - RNA, 21 nt, Human
auguauaaagcaacuguuaug

SEQ ID NO: 2236036 - RNA, 22 nt, Human
auguauaaagcaacuguuauga

SEQ ID NO: 2236037 - RNA, 15 nt, Human
auguaucaaugagua

SEQ ID NO: 2236038 - RNA, 23 nt, Human
augucaggggcggggagggugac

SEQ ID NO: 2236039 - RNA, 12 nt, Human
augucaggccug

SEQ ID NO: 2236040 - RNA, 16 nt, Human
augucaggccugugug

SEQ ID NO: 2236041 - RNA, 13 nt, Human
augucaguaugug

SEQ ID NO: 2236042 - RNA, 20 nt, Human
augucaggaacagaaggaug

SEQ ID NO: 2236043 - RNA, 19 nt, Human
augucaggaacagaaggau

SEQ ID NO: 2236044 - RNA, 17 nt, Human
augucaggaacagaagg

SEQ ID NO: 2236045 - RNA, 15 nt, Human
augucaggaacagaa

SEQ ID NO: 2236046 - RNA, 12 nt, Human
auguauguguaa

SEQ ID NO: 2236047 - RNA, 19 nt, Human
augucagccgagccgggcc

SEQ ID NO: 2236048 - RNA, 23 nt, Human
augucagccgagccgggccuggg

SEQ ID NO: 2236049 - RNA, 20 nt, Human
auguaugugcacugucacuu

SEQ ID NO: 2236050 - RNA, 15 nt, Human
auguaugugcacugu

SEQ ID NO: 2236051 - RNA, 16 nt, Human
auguaugugcacuguc

SEQ ID NO: 2236052 - RNA, 17 nt, Human
auguaugugcacuguca

SEQ ID NO: 2236053 - RNA, 21 nt, Human
auguauggaauacaguguuau

SEQ ID NO: 2236054 - RNA, 20 nt, Human
auguauggaauacaguguua

SEQ ID NO: 2236055 - RNA, 18 nt, Human
auguauggaauacagugu

SEQ ID NO: 2236056 - RNA, 20 nt, Human
auguaugcuucauacaggga

SEQ ID NO: 2236057 - RNA, 15 nt, Human
auguaucugagcagg

SEQ ID NO: 2236058 - RNA, 15 nt, Human
auguaucuaccucac

SEQ ID NO: 2236059 - RNA, 17 nt, Human
auguaugcuucauacag

SEQ ID NO: 2236060 - RNA, 20 nt, Human
auguccacagaugccuccac

SEQ ID NO: 2236061 - RNA, 16 nt, Human
auguccacagaugccu

SEQ ID NO: 2236062 - RNA, 23 nt, Human
auguccaagaagcccaggaaagg

SEQ ID NO: 2236063 - RNA, 19 nt, Human
auguccaagaagcccagga

SEQ ID NO: 2236064 - RNA, 18 nt, Human
auguccaagaagcccagg

SEQ ID NO: 2236065 - RNA, 21 nt, Human
augucagugugacugaucucu

SEQ ID NO: 2236066 - RNA, 14 nt, Human
augucaguaugugg

SEQ ID NO: 2236067 - RNA, 17 nt, Human
augucaguaccuucaaa

SEQ ID NO: 2236068 - RNA, 15 nt, Human
augucagugugacug

SEQ ID NO: 2236069 - RNA, 16 nt, Human
augucagugugacuga

SEQ ID NO: 2236070 - RNA, 20 nt, Human
augucucaauaguaaaagau

SEQ ID NO: 2236071 - RNA, 17 nt, Human
augucuauuaaggugau

SEQ ID NO: 2236072 - RNA, 12 nt, Human
augucuauuuaa

SEQ ID NO: 2236073 - RNA, 13 nt, Human
augucuauuuaag

SEQ ID NO: 2236074 - RNA, 14 nt, Human
augucuauuuaagc

SEQ ID NO: 2236075 - RNA, 16 nt, Human
augucuauucagcuuc

SEQ ID NO: 2236076 - RNA, 15 nt, Human
augucuauucagcuu

SEQ ID NO: 2236077 - RNA, 14 nt, Human
augucuauucagcu

SEQ ID NO: 2236078 - RNA, 22 nt, Human
augucuauaaucccagcacuuu

SEQ ID NO: 2236079 - RNA, 19 nt, Human
augucuaaaugcugaaaaa

SEQ ID NO: 2236080 - RNA, 14 nt, Human
augucccuucucau

SEQ ID NO: 2236081 - RNA, 21 nt, Human
augucccuucacauaguuuuu

SEQ ID NO: 2236082 - RNA, 17 nt, Human
augucuaauguauuuua

SEQ ID NO: 2236083 - RNA, 18 nt, Human
augucuaauguauuuuau

SEQ ID NO: 2236084 - RNA, 19 nt, Human
augucuaauguauuuuauu

SEQ ID NO: 2236085 - RNA, 21 nt, Human
augucuaauguauuuuauugu

SEQ ID NO: 2236086 - RNA, 20 nt, Human
augucccaacuuguaaaaau

SEQ ID NO: 2236087 - RNA, 18 nt, Human
augucccaccucucugag

SEQ ID NO: 2236088 - RNA, 24 nt, Human
augucccuaccgagucucuucucc

SEQ ID NO: 2236089 - RNA, 21 nt, Human
augucccuacaccccuccccu

SEQ ID NO: 2236090 - RNA, 19 nt, Human
auguccccaaaccugcaag

SEQ ID NO: 2236091 - RNA, 16 nt, Human
auguccccaaaccugc

SEQ ID NO: 2236092 - RNA, 18 nt, Human
auguccccaaaccugcaa

SEQ ID NO: 2236093 - RNA, 19 nt, Human
uuuggcgggccaaggacug

SEQ ID NO: 2236094 - RNA, 12 nt, Human
uuugggaagggg

SEQ ID NO: 2236095 - RNA, 22 nt, Human
uuugggaagugaagacuggaag

SEQ ID NO: 2236096 - RNA, 20 nt, Human
uuugggaagugaagacugga

SEQ ID NO: 2236097 - RNA, 17 nt, Human
uuuggcgggccaaggac

SEQ ID NO: 2236098 - RNA, 14 nt, Human
uuuggcgggccaag

SEQ ID NO: 2236099 - RNA, 17 nt, Human
uuuggccugcacuaauu

SEQ ID NO: 2236100 - RNA, 18 nt, Human
uuuggccucauuacuuua

SEQ ID NO: 2236101 - RNA, 16 nt, Human
uuugggaauauuugaa

SEQ ID NO: 2236102 - RNA, 17 nt, Human
uuugggaauauuugaau

SEQ ID NO: 2236103 - RNA, 17 nt, Human
uuugggaauguuugucu

SEQ ID NO: 2236104 - RNA, 21 nt, Human
uuugggagacaugugacauuu

SEQ ID NO: 2236105 - RNA, 16 nt, Human
uuugggagacauguga

SEQ ID NO: 2236106 - RNA, 18 nt, Human
uuugggagacaugugaca

SEQ ID NO: 2236107 - RNA, 20 nt, Human
uuuggggagcagagacacua

SEQ ID NO: 2236108 - RNA, 16 nt, Human
uuuggggauaugcuua

SEQ ID NO: 2236109 - RNA, 22 nt, Human
uuugggaggccaaggugggagg

SEQ ID NO: 2236110 - RNA, 13 nt, Human
uuuggggccggga

SEQ ID NO: 2236111 - RNA, 14 nt, Human
uuuggggcgaggca

SEQ ID NO: 2236112 - RNA, 18 nt, Human
uuuggggcgaggcagagg

SEQ ID NO: 2236113 - RNA, 19 nt, Human
uuuggggcgaggcagagga

SEQ ID NO: 2236114 - RNA, 14 nt, Human
uuuggggauauuuu

SEQ ID NO: 2236115 - RNA, 15 nt, Human
uuugcuucaaaaaca

SEQ ID NO: 2236116 - RNA, 19 nt, Human
uuugcuuauuguuccaaga

SEQ ID NO: 2236117 - RNA, 17 nt, Human
uuugcuuauuguuccaa

SEQ ID NO: 2236118 - RNA, 16 nt, Human
uuugcuuauuguucca

SEQ ID NO: 2236119 - RNA, 15 nt, Human
uuugcuuauuguucc

SEQ ID NO: 2236120 - RNA, 20 nt, Human
uuugcuucauaaaugaagca

SEQ ID NO: 2236121 - RNA, 13 nt, Human
uuugcuucauaaa

SEQ ID NO: 2236122 - RNA, 21 nt, Human
uuuggcccccgagcugggggc

SEQ ID NO: 2236123 - RNA, 21 nt, Human
uuuggcccuucuccuuuugaa

SEQ ID NO: 2236124 - RNA, 20 nt, Human
uuuggcccccgagcuggggg

SEQ ID NO: 2236125 - RNA, 12 nt, Human
uuuggcccccga

SEQ ID NO: 2236126 - RNA, 13 nt, Human
uuuggccaucucu

SEQ ID NO: 2236127 - RNA, 23 nt, Human
uuuggccaucucuggaugccuga

SEQ ID NO: 2236128 - RNA, 13 nt, Human
uuugcuguagaag

SEQ ID NO: 2236129 - RNA, 18 nt, Human
uuugcuguauauuuguga

SEQ ID NO: 2236130 - RNA, 17 nt, Human
uuugcugugaggcuguc

SEQ ID NO: 2236131 - RNA, 16 nt, Human
uuugcuuagaaaagaa

SEQ ID NO: 2236132 - RNA, 12 nt, Human
uuugcuuagaaa

SEQ ID NO: 2236133 - RNA, 19 nt, Human
uuugcugugaggcuguccu

SEQ ID NO: 2236134 - RNA, 21 nt, Human
uuugcugugaggcuguccugu

SEQ ID NO: 2236135 - RNA, 21 nt, Human
uuugcuguagaagauggcacu

SEQ ID NO: 2236136 - RNA, 13 nt, Human
uuugcucauggaa

SEQ ID NO: 2236137 - RNA, 16 nt, Human
uuugcucaccuggggu

SEQ ID NO: 2236138 - RNA, 16 nt, Human
uuugcuauuguaaaua

SEQ ID NO: 2236139 - RNA, 23 nt, Human
uuugcucacacgggguauuuuag

SEQ ID NO: 2236140 - RNA, 23 nt, Human
uuugcucagugucuggcugcaga

SEQ ID NO: 2236141 - RNA, 23 nt, Human
uuugcuauugacaagucauuuua

SEQ ID NO: 2236142 - RNA, 20 nt, Human
uuugcuauugacaagucauu

SEQ ID NO: 2236143 - RNA, 13 nt, Human
uuugcuauugaca

SEQ ID NO: 2236144 - RNA, 19 nt, Human
uuugcuaucuuaauuuugg

SEQ ID NO: 2236145 - RNA, 19 nt, Human
uuugcuaugagcuggggau

SEQ ID NO: 2236146 - RNA, 11 nt, Human
uuugcucaugg

SEQ ID NO: 2236147 - RNA, 12 nt, Human
uuugcucaugga

SEQ ID NO: 2236148 - RNA, 19 nt, Human
uuugcccugguuucacugg

SEQ ID NO: 2236149 - RNA, 19 nt, Human
uuugcccugguagggcagu

SEQ ID NO: 2236150 - RNA, 21 nt, Human
uuugcccugguagggcaguaa

SEQ ID NO: 2236151 - RNA, 15 nt, Human
uuugcccuuaaggac

SEQ ID NO: 2236152 - RNA, 13 nt, Human
uuugcccucccau

SEQ ID NO: 2236153 - RNA, 13 nt, Human
uuugcuaguuuuu

SEQ ID NO: 2236154 - RNA, 18 nt, Human
uuugcuaucuuaauuuug

SEQ ID NO: 2236155 - RNA, 23 nt, Human
uuugcccaacaccagccccugcc

SEQ ID NO: 2236156 - RNA, 18 nt, Human
uuugcccagaaagaagau

SEQ ID NO: 2236157 - RNA, 14 nt, Human
uuugcccaacacca

SEQ ID NO: 2236158 - RNA, 16 nt, Human
uuugcccaacaccagc

SEQ ID NO: 2236159 - RNA, 18 nt, Human
uuugcccaacaccagccc

SEQ ID NO: 2236160 - RNA, 21 nt, Human
uuugcccaacaccagccccug

SEQ ID NO: 2236161 - RNA, 22 nt, Human
uuugccauguuggccaggcugg

SEQ ID NO: 2236162 - RNA, 16 nt, Human
uuugcacagcucuccg

SEQ ID NO: 2236163 - RNA, 12 nt, Human
uuugcacagcuc

SEQ ID NO: 2236164 - RNA, 19 nt, Human
uuugcacauguuuccucua

SEQ ID NO: 2236165 - RNA, 19 nt, Human
uuugcaauggcuauauggc

SEQ ID NO: 2236166 - RNA, 18 nt, Human
uuugcaagucauggcugu

SEQ ID NO: 2236167 - RNA, 21 nt, Human
uuugcaagucauggcugugcc

SEQ ID NO: 2236168 - RNA, 13 nt, Human
uuugcaagugaag

SEQ ID NO: 2236169 - RNA, 15 nt, Human
uuugcaagugaaggu

SEQ ID NO: 2236170 - RNA, 16 nt, Human
uuugcaagugaagguu

SEQ ID NO: 2236171 - RNA, 21 nt, Human
uuugcaagugaagguuuacaa

SEQ ID NO: 2236172 - RNA, 22 nt, Human
uuugcaagugaagguuuacaau

SEQ ID NO: 2236173 - RNA, 15 nt, Human
auggcuauaggugcu

SEQ ID NO: 2236174 - RNA, 17 nt, Human
uuugcaagucauggcug

SEQ ID NO: 2236175 - RNA, 16 nt, Human
auggcuauaaauauau

SEQ ID NO: 2236176 - RNA, 21 nt, Human
auggcuauaaauauauaaaaa

SEQ ID NO: 2236177 - RNA, 22 nt, Human
auggcuagaauauccuacuucu

SEQ ID NO: 2236178 - RNA, 13 nt, Human
auggcuauaaaua

SEQ ID NO: 2236179 - RNA, 14 nt, Human
auggcuauaaauau

SEQ ID NO: 2236180 - RNA, 15 nt, Human
auggcuauaaauaua

SEQ ID NO: 2236181 - RNA, 22 nt, Human
auaaauauauauaaaccuaaaa

SEQ ID NO: 2236182 - RNA, 14 nt, Human
auaaaucaauguca

SEQ ID NO: 2236183 - RNA, 14 nt, Human
auaaauauuuaugu

SEQ ID NO: 2236184 - RNA, 20 nt, Human
auaaauauuuauguagaugu

SEQ ID NO: 2236185 - RNA, 18 nt, Human
auaaauauuuuugccaua

SEQ ID NO: 2236186 - RNA, 16 nt, Human
auaaauaggagaggau

SEQ ID NO: 2236187 - RNA, 23 nt, Human
auaaauauauaaaaagaaaagau

SEQ ID NO: 2236188 - RNA, 12 nt, Human
auaaauauauau

SEQ ID NO: 2236189 - RNA, 15 nt, Human
auaaauauauauaaa

SEQ ID NO: 2236190 - RNA, 16 nt, Human
auaaauauauauaaac

SEQ ID NO: 2236191 - RNA, 21 nt, Human
auaaauauauauaaaccuaaa

SEQ ID NO: 2236192 - RNA, 15 nt, Human
auaaauaguuuauga

SEQ ID NO: 2236193 - RNA, 21 nt, Human
auaaauagcuauauccaugua

SEQ ID NO: 2236194 - RNA, 15 nt, Human
auaaauagcuauauc

SEQ ID NO: 2236195 - RNA, 14 nt, Human
auaaauagcuauau

SEQ ID NO: 2236196 - RNA, 16 nt, Human
auaaaguaguaaaaau

SEQ ID NO: 2236197 - RNA, 14 nt, Human
auaaauaaaaauaa

SEQ ID NO: 2236198 - RNA, 19 nt, Human
auaaaggugguaugugugu

SEQ ID NO: 2236199 - RNA, 14 nt, Human
auaaaggccuuuuu

SEQ ID NO: 2236200 - RNA, 21 nt, Human
auaaaggugguaugugugugu

SEQ ID NO: 2236201 - RNA, 20 nt, Human
auaaaggugguaugugugug

SEQ ID NO: 2236202 - RNA, 15 nt, Human
auaaagguucaugca

SEQ ID NO: 2236203 - RNA, 16 nt, Human
uuaauuggcagcagau

SEQ ID NO: 2236204 - RNA, 18 nt, Human
uuaauuggcagcagauuu

SEQ ID NO: 2236205 - RNA, 19 nt, Human
uuaauuggcagcagauuuu

SEQ ID NO: 2236206 - RNA, 22 nt, Human
auaaagguugacaauaaaugug

SEQ ID NO: 2236207 - RNA, 14 nt, Human
auaaaguaaagcua

SEQ ID NO: 2236208 - RNA, 21 nt, Human
auaaagguugacaauaaaugu

SEQ ID NO: 2236209 - RNA, 16 nt, Human
auaaagguugacaaua

SEQ ID NO: 2236210 - RNA, 13 nt, Human
auaaaguaguaaa

SEQ ID NO: 2236211 - RNA, 17 nt, Human
auaaaguaaagcuaaaa

SEQ ID NO: 2236212 - RNA, 17 nt, Human
auaaagguucaugcaaa

SEQ ID NO: 2236213 - RNA, 13 nt, Human
auaaauaaaaaua

SEQ ID NO: 2236214 - RNA, 20 nt, Human
auaaccccagcucccuagga

SEQ ID NO: 2236215 - RNA, 12 nt, Human
auaaccccaccc

SEQ ID NO: 2236216 - RNA, 13 nt, Human
auaaccuauauga

SEQ ID NO: 2236217 - RNA, 18 nt, Human
auaaccuauaugauuuau

SEQ ID NO: 2236218 - RNA, 23 nt, Human
auaaccguuuccuuucauuuacu

SEQ ID NO: 2236219 - RNA, 15 nt, Human
auaaauuccacugga

SEQ ID NO: 2236220 - RNA, 21 nt, Human
auaaauucccuggccuuucau

SEQ ID NO: 2236221 - RNA, 16 nt, Human
auaaauucagauauau

SEQ ID NO: 2236222 - RNA, 13 nt, Human
auaaauucagaua

SEQ ID NO: 2236223 - RNA, 12 nt, Human
auaaauucagau

SEQ ID NO: 2236224 - RNA, 22 nt, Human
auaaauucagauauauuuuuca

SEQ ID NO: 2236225 - RNA, 13 nt, Human
auaaauuccucuu

SEQ ID NO: 2236226 - RNA, 22 nt, Human
auaaauucccuggccuuucaua

SEQ ID NO: 2236227 - RNA, 20 nt, Human
auaaauuccucuuugcuuug

SEQ ID NO: 2236228 - RNA, 11 nt, Human
auaaauuauuu

SEQ ID NO: 2236229 - RNA, 14 nt, Human
auaaauuauuuauu

SEQ ID NO: 2236230 - RNA, 15 nt, Human
auaaauucaccuagu

SEQ ID NO: 2236231 - RNA, 19 nt, Human
auaaauucaccuagucuaa

SEQ ID NO: 2236232 - RNA, 15 nt, Human
auaaaucaaugucac

SEQ ID NO: 2236233 - RNA, 19 nt, Human
auaacuuaaaaaaaugaca

SEQ ID NO: 2236234 - RNA, 16 nt, Human
auaacuuaaaaaaaug

SEQ ID NO: 2236235 - RNA, 12 nt, Human
auaacuuaaaaa

SEQ ID NO: 2236236 - RNA, 22 nt, Human
auaacuguuauuuauaaucacu

SEQ ID NO: 2236237 - RNA, 20 nt, Human
auaacuguuauuuauaauca

SEQ ID NO: 2236238 - RNA, 18 nt, Human
auaacuguuauuuauaau

SEQ ID NO: 2236239 - RNA, 13 nt, Human
auaacugugaagu

SEQ ID NO: 2236240 - RNA, 17 nt, Human
auaacguuuuuccuuua

SEQ ID NO: 2236241 - RNA, 18 nt, Human
auaacguuuuuccuuuaa

SEQ ID NO: 2236242 - RNA, 15 nt, Human
auaacguuuuuccuu

SEQ ID NO: 2236243 - RNA, 13 nt, Human
auaacguuuuucc

SEQ ID NO: 2236244 - RNA, 20 nt, Human
auaacggaucagaaauacag

SEQ ID NO: 2236245 - RNA, 21 nt, Human
auaacggaucagaaauacaga

SEQ ID NO: 2236246 - RNA, 23 nt, Human
auaaccuauuuugaaaaauuccu

SEQ ID NO: 2236247 - RNA, 13 nt, Human
auaacgccccaga

SEQ ID NO: 2236248 - RNA, 21 nt, Human
auaacgccccagauaccagcc

SEQ ID NO: 2236249 - RNA, 14 nt, Human
auaacguauaaaag

SEQ ID NO: 2236250 - RNA, 22 nt, Human
auaacgauaaaagacagugaaa

SEQ ID NO: 2236251 - RNA, 16 nt, Human
uuacccuccuguaaau

SEQ ID NO: 2236252 - RNA, 16 nt, Human
uuaccuaccacagugu

SEQ ID NO: 2236253 - RNA, 16 nt, Human
uuaccccuuagccucc

SEQ ID NO: 2236254 - RNA, 22 nt, Human
uuacccucaggcauaggccugg

SEQ ID NO: 2236255 - RNA, 21 nt, Human
uuaccuaccacagugucugua

SEQ ID NO: 2236256 - RNA, 19 nt, Human
uuaccuaccacaugccaag

SEQ ID NO: 2236257 - RNA, 18 nt, Human
uuaccuaccacagugucu

SEQ ID NO: 2236258 - RNA, 17 nt, Human
uuaccuaccacaguguc

SEQ ID NO: 2236259 - RNA, 23 nt, Human
uuaccuacuuugacuuuuugcau

SEQ ID NO: 2236260 - RNA, 13 nt, Human
uuaccuacuuuga

SEQ ID NO: 2236261 - RNA, 20 nt, Human
uuaccuaguagucauuucau

SEQ ID NO: 2236262 - RNA, 19 nt, Human
uuaccuccugagaaaaaag

SEQ ID NO: 2236263 - RNA, 11 nt, Human
uuaccuccuga

SEQ ID NO: 2236264 - RNA, 15 nt, Human
uuaccuccugcccag

SEQ ID NO: 2236265 - RNA, 14 nt, Human
uuaccuccugccca

SEQ ID NO: 2236266 - RNA, 13 nt, Human
uuaccuccugccc

SEQ ID NO: 2236267 - RNA, 12 nt, Human
uuaccuccugcc

SEQ ID NO: 2236268 - RNA, 19 nt, Human
uuaccuccugcccaggaga

SEQ ID NO: 2236269 - RNA, 22 nt, Human
uuaccuuagauuagcucuggac

SEQ ID NO: 2236270 - RNA, 19 nt, Human
uuaccuucaauaaaguauc

SEQ ID NO: 2236271 - RNA, 18 nt, Human
uuaccuucaauaaaguau

SEQ ID NO: 2236272 - RNA, 17 nt, Human
uuaccuucaauaaagua

SEQ ID NO: 2236273 - RNA, 16 nt, Human
uuaccuucaauaaagu

SEQ ID NO: 2236274 - RNA, 15 nt, Human
uuaccuucaauaaag

SEQ ID NO: 2236275 - RNA, 14 nt, Human
uuaccuucaauaaa

SEQ ID NO: 2236276 - RNA, 15 nt, Human
uuaccuuauugcacu

SEQ ID NO: 2236277 - RNA, 13 nt, Human
uuaccuuugacaa

SEQ ID NO: 2236278 - RNA, 20 nt, Human
uuaccuuugacaaagguaaa

SEQ ID NO: 2236279 - RNA, 21 nt, Human
uuacccagagaauauauacau

SEQ ID NO: 2236280 - RNA, 22 nt, Human
uuacccagagaauauauacauu

SEQ ID NO: 2236281 - RNA, 16 nt, Human
uuacccagaguuuuua

SEQ ID NO: 2236282 - RNA, 13 nt, Human
uuacccauauccc

SEQ ID NO: 2236283 - RNA, 16 nt, Human
uuacccauauccccuc

SEQ ID NO: 2236284 - RNA, 17 nt, Human
uuacccauauccccucu

SEQ ID NO: 2236285 - RNA, 18 nt, Human
uuacccauauccccucuc

SEQ ID NO: 2236286 - RNA, 14 nt, Human
uuacagggagccuc

SEQ ID NO: 2236287 - RNA, 15 nt, Human
uuacagggagccucc

SEQ ID NO: 2236288 - RNA, 16 nt, Human
uuacagggagccuccu

SEQ ID NO: 2236289 - RNA, 17 nt, Human
uuacagggagccuccug

SEQ ID NO: 2236290 - RNA, 18 nt, Human
uuacagggagccuccugc

SEQ ID NO: 2236291 - RNA, 19 nt, Human
uuacagggagccuccugcc

SEQ ID NO: 2236292 - RNA, 14 nt, Human
uuaccccuuagccu

SEQ ID NO: 2236293 - RNA, 20 nt, Human
uuacccauauccccucuccc

SEQ ID NO: 2236294 - RNA, 19 nt, Human
uuacccucauguucuuaau

SEQ ID NO: 2236295 - RNA, 24 nt, Human
uuacaggcaccgagaauguuguau

SEQ ID NO: 2236296 - RNA, 18 nt, Human
uuacaggcaccgagaaug

SEQ ID NO: 2236297 - RNA, 24 nt, Human
uuacaggcgugagccaccgugccu

SEQ ID NO: 2236298 - RNA, 18 nt, Human
uuacaggcuccugccacc

SEQ ID NO: 2236299 - RNA, 16 nt, Human
uuacaggcuccugcca

SEQ ID NO: 2236300 - RNA, 16 nt, Human
auaacuuaaaauauuu

SEQ ID NO: 2236301 - RNA, 12 nt, Human
auaacuuaaaau

SEQ ID NO: 2236302 - RNA, 21 nt, Human
auaacuuaaaaauguaaauau

SEQ ID NO: 2236303 - RNA, 19 nt, Human
auaacuuaaaaauguaaau

SEQ ID NO: 2236304 - RNA, 20 nt, Human
auaacuuaaaaauguaaaua

SEQ ID NO: 2236305 - RNA, 17 nt, Human
uuacaggcaccgagaau

SEQ ID NO: 2236306 - RNA, 15 nt, Human
uuacaggcaccgaga

SEQ ID NO: 2236307 - RNA, 17 nt, Human
uuacaggcacaaaauga

SEQ ID NO: 2236308 - RNA, 15 nt, Human
auaacuuauauugua

SEQ ID NO: 2236309 - RNA, 17 nt, Human
uuagaaauuuauuuccu

SEQ ID NO: 2236310 - RNA, 18 nt, Human
uuagaacaggcaagugaa

SEQ ID NO: 2236311 - RNA, 20 nt, Human
uuagaacaggcaagugaaga

SEQ ID NO: 2236312 - RNA, 22 nt, Human
uuagaacaggcaagugaagaaa

SEQ ID NO: 2236313 - RNA, 13 nt, Human
uuagacagagucu

SEQ ID NO: 2236314 - RNA, 20 nt, Human
uuagacagagucucacuguu

SEQ ID NO: 2236315 - RNA, 13 nt, Human
uuagacagucccu

SEQ ID NO: 2236316 - RNA, 17 nt, Human
uuagaaaugaccaauau

SEQ ID NO: 2236317 - RNA, 23 nt, Human
uuagaaagcauuugaaugcauuu

SEQ ID NO: 2236318 - RNA, 21 nt, Human
uuagaaaguagccacguaugg

SEQ ID NO: 2236319 - RNA, 17 nt, Human
uuagaaagcauuugaau

SEQ ID NO: 2236320 - RNA, 18 nt, Human
uuagaaagcauuugaaug

SEQ ID NO: 2236321 - RNA, 19 nt, Human
uuagaaagcauuugaaugc

SEQ ID NO: 2236322 - RNA, 21 nt, Human
uuagaaagcauuugaaugcau

SEQ ID NO: 2236323 - RNA, 18 nt, Human
uuagaaaugaccaauauu

SEQ ID NO: 2236324 - RNA, 16 nt, Human
uuagaaaugcagaauc

SEQ ID NO: 2236325 - RNA, 17 nt, Human
uuagaaauugcauuucc

SEQ ID NO: 2236326 - RNA, 16 nt, Human
uuacugaagccuuucu

SEQ ID NO: 2236327 - RNA, 23 nt, Human
uuacugaacaaucaaagcacuug

SEQ ID NO: 2236328 - RNA, 23 nt, Human
uuacucuucaguuaagccuuugg

SEQ ID NO: 2236329 - RNA, 13 nt, Human
uuacucugaaggg

SEQ ID NO: 2236330 - RNA, 19 nt, Human
uuacucuccaaccuggaca

SEQ ID NO: 2236331 - RNA, 22 nt, Human
uuacucugaagggcaucaugca

SEQ ID NO: 2236332 - RNA, 16 nt, Human
uuacucuccaaccugg

SEQ ID NO: 2236333 - RNA, 19 nt, Human
uuaccuuuuaauuaaugaa

SEQ ID NO: 2236334 - RNA, 16 nt, Human
uuaccuuguauacugu

SEQ ID NO: 2236335 - RNA, 22 nt, Human
uuagaaagaagcccaauauuau

SEQ ID NO: 2236336 - RNA, 12 nt, Human
uuagaaagcauu

SEQ ID NO: 2236337 - RNA, 13 nt, Human
uuagaaagcauuu

SEQ ID NO: 2236338 - RNA, 14 nt, Human
uuagaaagcauuug

SEQ ID NO: 2236339 - RNA, 15 nt, Human
uuagaaagcauuuga

SEQ ID NO: 2236340 - RNA, 16 nt, Human
uuagaaagcauuugaa

SEQ ID NO: 2236341 - RNA, 20 nt, Human
uuacugaagguaaaauugaa

SEQ ID NO: 2236342 - RNA, 12 nt, Human
uuacugaaugca

SEQ ID NO: 2236343 - RNA, 19 nt, Human
uuacugaagguaaaauuga

SEQ ID NO: 2236344 - RNA, 18 nt, Human
uuacugaagguaaaauug

SEQ ID NO: 2236345 - RNA, 18 nt, Human
uuagaaaccuuaauaugu

SEQ ID NO: 2236346 - RNA, 17 nt, Human
uuagaaacaugguuuug

SEQ ID NO: 2236347 - RNA, 14 nt, Human
uuagaaaccuuaau

SEQ ID NO: 2236348 - RNA, 13 nt, Human
uuagaaacauaaa

SEQ ID NO: 2236349 - RNA, 16 nt, Human
uuagaaacauaaauaa

SEQ ID NO: 2236350 - RNA, 22 nt, Human
auaauacuauauuuauacugua

SEQ ID NO: 2236351 - RNA, 13 nt, Human
auaauagaagaac

SEQ ID NO: 2236352 - RNA, 12 nt, Human
auaauagaagaa

SEQ ID NO: 2236353 - RNA, 19 nt, Human
auaauacuugcuuuggaaa

SEQ ID NO: 2236354 - RNA, 12 nt, Human
auaauacaccac

SEQ ID NO: 2236355 - RNA, 15 nt, Human
auaauaaauguacau

SEQ ID NO: 2236356 - RNA, 16 nt, Human
auaauaaagcuacuga

SEQ ID NO: 2236357 - RNA, 20 nt, Human
auaauacaccacuacauucu

SEQ ID NO: 2236358 - RNA, 18 nt, Human
auaauacaccacuacauu

SEQ ID NO: 2236359 - RNA, 23 nt, Human
uuagacagucaaggaguggcuua

SEQ ID NO: 2236360 - RNA, 21 nt, Human
auaagaauaaaauguugaaaa

SEQ ID NO: 2236361 - RNA, 21 nt, Human
auaagaaugcugguuuuccua

SEQ ID NO: 2236362 - RNA, 18 nt, Human
auaagaaugguugccuua

SEQ ID NO: 2236363 - RNA, 22 nt, Human
auaagaaugcugguuuuccuaa

SEQ ID NO: 2236364 - RNA, 19 nt, Human
auaagaaugcugguuuucc

SEQ ID NO: 2236365 - RNA, 16 nt, Human
auaagaaugcugguuu

SEQ ID NO: 2236366 - RNA, 14 nt, Human
auaagacauaacgu

SEQ ID NO: 2236367 - RNA, 17 nt, Human
auaagaauuauuuugau

SEQ ID NO: 2236368 - RNA, 17 nt, Human
auaagacggauuuauuu

SEQ ID NO: 2236369 - RNA, 21 nt, Human
auaagacggauuuauuuuucc

SEQ ID NO: 2236370 - RNA, 23 nt, Human
auaagacauaacguuuuuccuuu

SEQ ID NO: 2236371 - RNA, 17 nt, Human
auaagacauaacguuuu

SEQ ID NO: 2236372 - RNA, 22 nt, Human
auaagaccaccaccucagagua

SEQ ID NO: 2236373 - RNA, 19 nt, Human
auaauaaacuuuuuugaaa

SEQ ID NO: 2236374 - RNA, 12 nt, Human
auaauaaacuuu

SEQ ID NO: 2236375 - RNA, 14 nt, Human
auaauaaaaggaaa

SEQ ID NO: 2236376 - RNA, 15 nt, Human
auaauaaaaggaaaa

SEQ ID NO: 2236377 - RNA, 20 nt, Human
auaauaaaaggaaaagcaaa

SEQ ID NO: 2236378 - RNA, 16 nt, Human
auaagagagucauaaa

SEQ ID NO: 2236379 - RNA, 20 nt, Human
auaagagagaacaacuacug

SEQ ID NO: 2236380 - RNA, 19 nt, Human
auaagagagucauaaaccu

SEQ ID NO: 2236381 - RNA, 15 nt, Human
auaagagaaucaaca

SEQ ID NO: 2236382 - RNA, 14 nt, Human
auaagagaaagaaa

SEQ ID NO: 2236383 - RNA, 18 nt, Human
auaagagaaagaaaauga

SEQ ID NO: 2236384 - RNA, 14 nt, Human
auaauaaaguguuu

SEQ ID NO: 2236385 - RNA, 14 nt, Human
auaaucuauuucua

SEQ ID NO: 2236386 - RNA, 17 nt, Human
auaaucuauuucuauga

SEQ ID NO: 2236387 - RNA, 21 nt, Human
auaaucuauuucuaugagaaa

SEQ ID NO: 2236388 - RNA, 18 nt, Human
auaaucucuccauucccg

SEQ ID NO: 2236389 - RNA, 22 nt, Human
auaaucggcccacagcucccac

SEQ ID NO: 2236390 - RNA, 12 nt, Human
auaaucuagaac

SEQ ID NO: 2236391 - RNA, 15 nt, Human
auaaucuagaacaca

SEQ ID NO: 2236392 - RNA, 18 nt, Human
auaaucuggacuccucug

SEQ ID NO: 2236393 - RNA, 19 nt, Human
auaaucuggacuccucugu

SEQ ID NO: 2236394 - RNA, 20 nt, Human
auaaucuggacuccucuguc

SEQ ID NO: 2236395 - RNA, 14 nt, Human
auaauaguuuacau

SEQ ID NO: 2236396 - RNA, 20 nt, Human
auaauaguuuacauguagua

SEQ ID NO: 2236397 - RNA, 16 nt, Human
auaaucccagcacuuu

SEQ ID NO: 2236398 - RNA, 17 nt, Human
auaaucccagcacuuug

SEQ ID NO: 2236399 - RNA, 18 nt, Human
auaauccuaaacauauga

SEQ ID NO: 2236400 - RNA, 19 nt, Human
auaauucuuguauauuaug

SEQ ID NO: 2236401 - RNA, 14 nt, Human
auaauucuuguaua

SEQ ID NO: 2236402 - RNA, 23 nt, Human
auaauucuguacauagccuauau

SEQ ID NO: 2236403 - RNA, 15 nt, Human
auaauucuguacuga

SEQ ID NO: 2236404 - RNA, 17 nt, Human
auaauucuguacugauu

SEQ ID NO: 2236405 - RNA, 18 nt, Human
auaaugccggugagaaua

SEQ ID NO: 2236406 - RNA, 12 nt, Human
auaauucuguaa

SEQ ID NO: 2236407 - RNA, 13 nt, Human
auaauucuguaaa

SEQ ID NO: 2236408 - RNA, 14 nt, Human
auaauucuguaaau

SEQ ID NO: 2236409 - RNA, 13 nt, Human
auaauucuguaca

SEQ ID NO: 2236410 - RNA, 14 nt, Human
auaauucuguacau

SEQ ID NO: 2236411 - RNA, 22 nt, Human
auaauucuguacauagccuaua

SEQ ID NO: 2236412 - RNA, 22 nt, Human
auaauugacaggauuauuggaa

SEQ ID NO: 2236413 - RNA, 15 nt, Human
auaaugaaugaaaca

SEQ ID NO: 2236414 - RNA, 13 nt, Human
auaaucugauuug

SEQ ID NO: 2236415 - RNA, 22 nt, Human
auaaugaggaugauuauuuuca

SEQ ID NO: 2236416 - RNA, 22 nt, Human
auaaugaugaugggaauugugu

SEQ ID NO: 2236417 - RNA, 17 nt, Human
auaaugccggugagaau

SEQ ID NO: 2236418 - RNA, 15 nt, Human
auaaugcgugcauac

SEQ ID NO: 2236419 - RNA, 22 nt, Human
uuagguuuuguacaauugaacu

SEQ ID NO: 2236420 - RNA, 14 nt, Human
uuagguuuuguaca

SEQ ID NO: 2236421 - RNA, 19 nt, Human
uuagguuuuuuuguauagu

SEQ ID NO: 2236422 - RNA, 16 nt, Human
uuagguuuuguacaau

SEQ ID NO: 2236423 - RNA, 18 nt, Human
uuagguggcaagcuguga

SEQ ID NO: 2236424 - RNA, 14 nt, Human
uuaguaaagaaaug

SEQ ID NO: 2236425 - RNA, 15 nt, Human
uuaguaaagaaauga

SEQ ID NO: 2236426 - RNA, 24 nt, Human
uuaguaacaugaggggacauuuug

SEQ ID NO: 2236427 - RNA, 23 nt, Human
uuaguaacauguguuaaguauuu

SEQ ID NO: 2236428 - RNA, 12 nt, Human
uuaguaacaugu

SEQ ID NO: 2236429 - RNA, 22 nt, Human
uuaguuuguaugccaagugaga

SEQ ID NO: 2236430 - RNA, 15 nt, Human
uuaguuuguguguug

SEQ ID NO: 2236431 - RNA, 18 nt, Human
uuaguuuggauucuuaug

SEQ ID NO: 2236432 - RNA, 14 nt, Human
uuaguuuggauucu

SEQ ID NO: 2236433 - RNA, 22 nt, Human
uuaguuugcaguuacacuaaaa

SEQ ID NO: 2236434 - RNA, 14 nt, Human
uuaguuucuuuggg

SEQ ID NO: 2236435 - RNA, 20 nt, Human
uuaguuucuguucuguggaa

SEQ ID NO: 2236436 - RNA, 21 nt, Human
uuaguuucuguucuguggaaa

SEQ ID NO: 2236437 - RNA, 15 nt, Human
uuaguuucuguucug

SEQ ID NO: 2236438 - RNA, 19 nt, Human
uuaguuucuguucugugga

SEQ ID NO: 2236439 - RNA, 15 nt, Human
uuaguuucuccaagc

SEQ ID NO: 2236440 - RNA, 17 nt, Human
uuagggaaaacauucca

SEQ ID NO: 2236441 - RNA, 15 nt, Human
uuagggaaaacauuc

SEQ ID NO: 2236442 - RNA, 20 nt, Human
uuagggaaggauacaaaagc

SEQ ID NO: 2236443 - RNA, 23 nt, Human
uuagggacucaauuucuccccag

SEQ ID NO: 2236444 - RNA, 14 nt, Human
uuagggaagggccu

SEQ ID NO: 2236445 - RNA, 14 nt, Human
uuagggagagaaga

SEQ ID NO: 2236446 - RNA, 15 nt, Human
uuaggugaggaagca

SEQ ID NO: 2236447 - RNA, 16 nt, Human
uuaggugugacugaau

SEQ ID NO: 2236448 - RNA, 16 nt, Human
uuaggugaggaagcaa

SEQ ID NO: 2236449 - RNA, 21 nt, Human
uuaggugugacugaauuucuu

SEQ ID NO: 2236450 - RNA, 17 nt, Human
uuagggagaaaauucaa

SEQ ID NO: 2236451 - RNA, 13 nt, Human
uuagggagaaaau

SEQ ID NO: 2236452 - RNA, 18 nt, Human
uuagcaaauucuguuuuu

SEQ ID NO: 2236453 - RNA, 14 nt, Human
uuagcaaacuuugu

SEQ ID NO: 2236454 - RNA, 15 nt, Human
uuagcaaauacauau

SEQ ID NO: 2236455 - RNA, 19 nt, Human
uuagcaaagaguuaauaua

SEQ ID NO: 2236456 - RNA, 13 nt, Human
uuagcaaagaguu

SEQ ID NO: 2236457 - RNA, 20 nt, Human
uuagcaaagaguuaauauau

SEQ ID NO: 2236458 - RNA, 22 nt, Human
uuagcaaagauaucucaucucu

SEQ ID NO: 2236459 - RNA, 15 nt, Human
auaauuuaaugcaug

SEQ ID NO: 2236460 - RNA, 18 nt, Human
auaauuuaccugaagucu

SEQ ID NO: 2236461 - RNA, 13 nt, Human
uuagccacaaaau

SEQ ID NO: 2236462 - RNA, 22 nt, Human
uuagcauuuaguccaaugucuu

SEQ ID NO: 2236463 - RNA, 17 nt, Human
uuagcauguguugaaaa

SEQ ID NO: 2236464 - RNA, 16 nt, Human
uuagcauguuugcuga

SEQ ID NO: 2236465 - RNA, 19 nt, Human
uuagccagguaaugugaau

SEQ ID NO: 2236466 - RNA, 23 nt, Human
uuagccaggaucaugguguaaua

SEQ ID NO: 2236467 - RNA, 15 nt, Human
uuagccaggaucaug

SEQ ID NO: 2236468 - RNA, 17 nt, Human
uuagccaggaucauggu

SEQ ID NO: 2236469 - RNA, 18 nt, Human
uuagccaagugugguaga

SEQ ID NO: 2236470 - RNA, 24 nt, Human
uuagcaugacaagccccaggcagg

SEQ ID NO: 2236471 - RNA, 22 nt, Human
uuagcaugacaagccccaggca

SEQ ID NO: 2236472 - RNA, 21 nt, Human
uuagcaugacaagccccaggc

SEQ ID NO: 2236473 - RNA, 14 nt, Human
uuagccuucucugu

SEQ ID NO: 2236474 - RNA, 12 nt, Human
uuagccuucucu

SEQ ID NO: 2236475 - RNA, 16 nt, Human
uuagccuuugucccag

SEQ ID NO: 2236476 - RNA, 17 nt, Human
uuagccuucucuguuca

SEQ ID NO: 2236477 - RNA, 15 nt, Human
uuagccuucucuguu

SEQ ID NO: 2236478 - RNA, 14 nt, Human
uuagcggagacgga

SEQ ID NO: 2236479 - RNA, 21 nt, Human
uuagccuucucuguucauuuc

SEQ ID NO: 2236480 - RNA, 22 nt, Human
uuaaacaaauguaugauuacau

SEQ ID NO: 2236481 - RNA, 13 nt, Human
uuaaacaccuccu

SEQ ID NO: 2236482 - RNA, 16 nt, Human
uuaaacaccuccucau

SEQ ID NO: 2236483 - RNA, 14 nt, Human
uuaaacaaagguug

SEQ ID NO: 2236484 - RNA, 16 nt, Human
uuaaacagauuuuuac

SEQ ID NO: 2236485 - RNA, 12 nt, Human
uuaaacagcagu

SEQ ID NO: 2236486 - RNA, 14 nt, Human
uuaaacagcagugu

SEQ ID NO: 2236487 - RNA, 23 nt, Human
uuaaacagugagccugaauuuug

SEQ ID NO: 2236488 - RNA, 18 nt, Human
uuaaacagugagccugaa

SEQ ID NO: 2236489 - RNA, 15 nt, Human
uuaaacaggcccagc

SEQ ID NO: 2236490 - RNA, 16 nt, Human
uuaaacaggcccagca

SEQ ID NO: 2236491 - RNA, 21 nt, Human
uuaaacagggcaucuccagga

SEQ ID NO: 2236492 - RNA, 17 nt, Human
uuaaaaaucucaaauuu

SEQ ID NO: 2236493 - RNA, 18 nt, Human
uuaaaauuuuuuuagaaa

SEQ ID NO: 2236494 - RNA, 20 nt, Human
uuaaacaaaauagaagcugu

SEQ ID NO: 2236495 - RNA, 16 nt, Human
uuaaaaaucucaaauu

SEQ ID NO: 2236496 - RNA, 15 nt, Human
uuaaaaaucucaaau

SEQ ID NO: 2236497 - RNA, 14 nt, Human
uuaaaaaucucaaa

SEQ ID NO: 2236498 - RNA, 18 nt, Human
uuaaagucagguccaauu

SEQ ID NO: 2236499 - RNA, 13 nt, Human
uuaaaguauucuu

SEQ ID NO: 2236500 - RNA, 18 nt, Human
uuaaaguaugaaucuaug

SEQ ID NO: 2236501 - RNA, 18 nt, Human
uuaaaguauguuauugca

SEQ ID NO: 2236502 - RNA, 23 nt, Human
uuaaaguauguuauugcauaauu

SEQ ID NO: 2236503 - RNA, 17 nt, Human
uuaaagugauacugaaa

SEQ ID NO: 2236504 - RNA, 12 nt, Human
uuaaagugauua

SEQ ID NO: 2236505 - RNA, 19 nt, Human
uuaaagucgagcuuuucua

SEQ ID NO: 2236506 - RNA, 19 nt, Human
uuaaaguguccauugacau

SEQ ID NO: 2236507 - RNA, 22 nt, Human
uuaaaguguccauugacaugua

SEQ ID NO: 2236508 - RNA, 15 nt, Human
uuaaauaaugugaaa

SEQ ID NO: 2236509 - RNA, 15 nt, Human
uuaaacauugaagua

SEQ ID NO: 2236510 - RNA, 13 nt, Human
uuaaacauugaag

SEQ ID NO: 2236511 - RNA, 16 nt, Human
uuaaaguauauauuua

SEQ ID NO: 2236512 - RNA, 15 nt, Human
uuaaaguaugaaucu

SEQ ID NO: 2236513 - RNA, 13 nt, Human
uuaaaguauauau

SEQ ID NO: 2236514 - RNA, 17 nt, Human
uuaaaggugucuuccuc

SEQ ID NO: 2236515 - RNA, 13 nt, Human
uuaaacauaaaua

SEQ ID NO: 2236516 - RNA, 16 nt, Human
uuaacacaaguccugu

SEQ ID NO: 2236517 - RNA, 11 nt, Human
uuaacacauuu

SEQ ID NO: 2236518 - RNA, 16 nt, Human
uuaacaauuccaaagg

SEQ ID NO: 2236519 - RNA, 15 nt, Human
uuaacaauuucuguc

SEQ ID NO: 2236520 - RNA, 23 nt, Human
uuaacaauuucuguccuucagau

SEQ ID NO: 2236521 - RNA, 12 nt, Human
uuaacacauuuu

SEQ ID NO: 2236522 - RNA, 14 nt, Human
uuaacacauuuugu

SEQ ID NO: 2236523 - RNA, 17 nt, Human
uuaacacauuuuguaua

SEQ ID NO: 2236524 - RNA, 22 nt, Human
uuaacacauuuuguauaauugu

SEQ ID NO: 2236525 - RNA, 15 nt, Human
uuaacaccugaugug

SEQ ID NO: 2236526 - RNA, 16 nt, Human
uuaacaccugaugugu

SEQ ID NO: 2236527 - RNA, 17 nt, Human
uuaacaccugaugugua

SEQ ID NO: 2236528 - RNA, 19 nt, Human
uuaacaccugauguguaca

SEQ ID NO: 2236529 - RNA, 20 nt, Human
uuaacaccugauguguacau

SEQ ID NO: 2236530 - RNA, 18 nt, Human
uuaacaccuuuaaagugu

SEQ ID NO: 2236531 - RNA, 19 nt, Human
uuaacagaaauguacagca

SEQ ID NO: 2236532 - RNA, 14 nt, Human
uuaacagagacaga

SEQ ID NO: 2236533 - RNA, 21 nt, Human
aguuucauguacaagaugaag

SEQ ID NO: 2236534 - RNA, 18 nt, Human
aguuucauguacaagaug

SEQ ID NO: 2236535 - RNA, 15 nt, Human
aguuucauguacaag

SEQ ID NO: 2236536 - RNA, 18 nt, Human
aguuucauagcuaagaaa

SEQ ID NO: 2236537 - RNA, 13 nt, Human
uuaacacugagcu

SEQ ID NO: 2236538 - RNA, 20 nt, Human
uuaacagaaauguacagcaa

SEQ ID NO: 2236539 - RNA, 23 nt, Human
uuaacaauaacuacuguguuccu

SEQ ID NO: 2236540 - RNA, 17 nt, Human
uuaacaaugauauaugg

SEQ ID NO: 2236541 - RNA, 21 nt, Human
uuaacaauaacuacuguguuc

SEQ ID NO: 2236542 - RNA, 20 nt, Human
uuaacaauaacuacuguguu

SEQ ID NO: 2236543 - RNA, 19 nt, Human
uuaacaauaacuacugugu

SEQ ID NO: 2236544 - RNA, 18 nt, Human
uuaacaauaacuacugug

SEQ ID NO: 2236545 - RNA, 19 nt, Human
uuaaauagaguauaugcac

SEQ ID NO: 2236546 - RNA, 19 nt, Human
uuaaauacgcacuacaugu

SEQ ID NO: 2236547 - RNA, 19 nt, Human
uuaacaagcucccaggccg

SEQ ID NO: 2236548 - RNA, 13 nt, Human
uuaaauacagucu

SEQ ID NO: 2236549 - RNA, 18 nt, Human
uuaaauagaguuugcuau

SEQ ID NO: 2236550 - RNA, 20 nt, Human
uuaaauacagacacuaaguu

SEQ ID NO: 2236551 - RNA, 18 nt, Human
uuaaauacagacacuaag

SEQ ID NO: 2236552 - RNA, 19 nt, Human
uuaaauacagacacuaagu

SEQ ID NO: 2236553 - RNA, 18 nt, Human
uuaaauaaugugaaacug

SEQ ID NO: 2236554 - RNA, 16 nt, Human
uuaaauaaugugaaac

SEQ ID NO: 2236555 - RNA, 13 nt, Human
uuaaauaauguga

SEQ ID NO: 2236556 - RNA, 18 nt, Human
uuaaauacaaaacuucca

SEQ ID NO: 2236557 - RNA, 17 nt, Human
uuaaauacagacacuaa

SEQ ID NO: 2236558 - RNA, 16 nt, Human
uuaaauacagacacua

SEQ ID NO: 2236559 - RNA, 16 nt, Human
uuaaauacaaaacuuc

SEQ ID NO: 2236560 - RNA, 21 nt, Human
uuaaaguguccauugacaugu

SEQ ID NO: 2236561 - RNA, 15 nt, Human
uuaaauacaaaacuu

SEQ ID NO: 2236562 - RNA, 13 nt, Human
uuaaaaaaaaucc

SEQ ID NO: 2236563 - RNA, 19 nt, Human
uuaaaaaaaggcauuguuu

SEQ ID NO: 2236564 - RNA, 17 nt, Human
uuaaaaaaauaaaacau

SEQ ID NO: 2236565 - RNA, 21 nt, Human
uuaaaaaaaggcauuguuuga

SEQ ID NO: 2236566 - RNA, 18 nt, Human
uuaaaaaaauaaaacauu

SEQ ID NO: 2236567 - RNA, 19 nt, Human
uuaaaaaaauaaaacauuu

SEQ ID NO: 2236568 - RNA, 23 nt, Human
uuaaaaaaauaaaacauuuuaaa

SEQ ID NO: 2236569 - RNA, 20 nt, Human
uuaaaaaaauugguuggaga

SEQ ID NO: 2236570 - RNA, 21 nt, Human
uuaaaaaucuaccuucuguag

SEQ ID NO: 2236571 - RNA, 14 nt, Human
uuaaaaaaaugaca

SEQ ID NO: 2236572 - RNA, 18 nt, Human
aguuuaauugacuuauuu

SEQ ID NO: 2236573 - RNA, 15 nt, Human
aguuuacaaguguau

SEQ ID NO: 2236574 - RNA, 16 nt, Human
aguuuacaaguguaua

SEQ ID NO: 2236575 - RNA, 17 nt, Human
aguuuacaaguguauau

SEQ ID NO: 2236576 - RNA, 14 nt, Human
aguuuaauugacuu

SEQ ID NO: 2236577 - RNA, 15 nt, Human
aguuuaauugacuua

SEQ ID NO: 2236578 - RNA, 23 nt, Human
uuaaaaaaaacaaaaagaacaaa

SEQ ID NO: 2236579 - RNA, 18 nt, Human
aguuuacaguaaauaaau

SEQ ID NO: 2236580 - RNA, 20 nt, Human
aguuuacaguaaauaaauug

SEQ ID NO: 2236581 - RNA, 22 nt, Human
aguuuacaguaaauaaauuguu

SEQ ID NO: 2236582 - RNA, 22 nt, Human
aguuuacaucauuuuuguaucu

SEQ ID NO: 2236583 - RNA, 19 nt, Human
aguuuacaaguguauauca

SEQ ID NO: 2236584 - RNA, 21 nt, Human
aguuuacaaguguauaucaga

SEQ ID NO: 2236585 - RNA, 23 nt, Human
aguuuacaaguguauaucagaaa

SEQ ID NO: 2236586 - RNA, 13 nt, Human
aguuuacaguaaa

SEQ ID NO: 2236587 - RNA, 14 nt, Human
aguuuacaguaaau

SEQ ID NO: 2236588 - RNA, 16 nt, Human
aguuuacaguaaauaa

SEQ ID NO: 2236589 - RNA, 15 nt, Human
aguuuaaaaaaauug

SEQ ID NO: 2236590 - RNA, 14 nt, Human
aguuuaaaaaaauu

SEQ ID NO: 2236591 - RNA, 17 nt, Human
aguuggucccccuucca

SEQ ID NO: 2236592 - RNA, 11 nt, Human
aguuggucccc

SEQ ID NO: 2236593 - RNA, 13 nt, Human
aguuggucccccu

SEQ ID NO: 2236594 - RNA, 12 nt, Human
aguuuaaagcaa

SEQ ID NO: 2236595 - RNA, 21 nt, Human
aguuuaaagcucgaaaacaau

SEQ ID NO: 2236596 - RNA, 22 nt, Human
aguuuaauggugccuucauuug

SEQ ID NO: 2236597 - RNA, 18 nt, Human
aguuuaaaacagaagccu

SEQ ID NO: 2236598 - RNA, 14 nt, Human
aguuuaaauuguaa

SEQ ID NO: 2236599 - RNA, 16 nt, Human
uguuucaaaauaaaaa

SEQ ID NO: 2236600 - RNA, 17 nt, Human
uguuucaaacacaaaug

SEQ ID NO: 2236601 - RNA, 18 nt, Human
uguuucaaacacaaaugc

SEQ ID NO: 2236602 - RNA, 23 nt, Human
aguugccagucaccccggccacc

SEQ ID NO: 2236603 - RNA, 13 nt, Human
uguuucaaacaua

SEQ ID NO: 2236604 - RNA, 12 nt, Human
uguuuauuuuuc

SEQ ID NO: 2236605 - RNA, 14 nt, Human
uguuuauuuuucau

SEQ ID NO: 2236606 - RNA, 15 nt, Human
uguuuauuuuucaua

SEQ ID NO: 2236607 - RNA, 19 nt, Human
uguuuauuuuucauauugu

SEQ ID NO: 2236608 - RNA, 16 nt, Human
uguuuauuuuucauau

SEQ ID NO: 2236609 - RNA, 18 nt, Human
uguuuauuuuucauauug

SEQ ID NO: 2236610 - RNA, 19 nt, Human
uguuucaaacacaaaugca

SEQ ID NO: 2236611 - RNA, 17 nt, Human
aguugcugggagcugaa

SEQ ID NO: 2236612 - RNA, 19 nt, Human
aguugggcuuccucauagu

SEQ ID NO: 2236613 - RNA, 21 nt, Human
aguuggggucuggcagccucc

SEQ ID NO: 2236614 - RNA, 17 nt, Human
aguuggggucuggcagc

SEQ ID NO: 2236615 - RNA, 15 nt, Human
aguugggugagaaca

SEQ ID NO: 2236616 - RNA, 13 nt, Human
aguugggcuuccu

SEQ ID NO: 2236617 - RNA, 19 nt, Human
aguuggagugaguguggcu

SEQ ID NO: 2236618 - RNA, 14 nt, Human
aguugcugucauaa

SEQ ID NO: 2236619 - RNA, 14 nt, Human
aguugcuuguaaaa

SEQ ID NO: 2236620 - RNA, 14 nt, Human
aguuggaaauauuc

SEQ ID NO: 2236621 - RNA, 21 nt, Human
uuaagggauggaaaaggaaga

SEQ ID NO: 2236622 - RNA, 9 nt, Human
uuaaggugg

SEQ ID NO: 2236623 - RNA, 15 nt, Human
uuaaggguuaagaaa

SEQ ID NO: 2236624 - RNA, 18 nt, Human
uuaaggugauauauuuaa

SEQ ID NO: 2236625 - RNA, 14 nt, Human
uuaagguuauuuau

SEQ ID NO: 2236626 - RNA, 17 nt, Human
uuaaguaucugacaucu

SEQ ID NO: 2236627 - RNA, 22 nt, Human
uuaagaaagacuaucuaaaugu

SEQ ID NO: 2236628 - RNA, 22 nt, Human
uuaagaaaaucauauugcuucu

SEQ ID NO: 2236629 - RNA, 14 nt, Human
uuaagaaaaucaua

SEQ ID NO: 2236630 - RNA, 13 nt, Human
uuaagaagaaacu

SEQ ID NO: 2236631 - RNA, 20 nt, Human
uuaagaagacugcauuauau

SEQ ID NO: 2236632 - RNA, 16 nt, Human
uuaaguauuuauauau

SEQ ID NO: 2236633 - RNA, 11 nt, Human
uuaaguauuua

SEQ ID NO: 2236634 - RNA, 15 nt, Human
uuaaguauugcaucu

SEQ ID NO: 2236635 - RNA, 19 nt, Human
uuaaguauugcaucuguau

SEQ ID NO: 2236636 - RNA, 20 nt, Human
uuaaguauugcaucuguaua

SEQ ID NO: 2236637 - RNA, 21 nt, Human
uuaaguauugcaucuguauaa

SEQ ID NO: 2236638 - RNA, 13 nt, Human
uuaaguauugcau

SEQ ID NO: 2236639 - RNA, 14 nt, Human
uuaaguaucuuuuu

SEQ ID NO: 2236640 - RNA, 19 nt, Human
uuaaguaucuuuuuucaaa

SEQ ID NO: 2236641 - RNA, 14 nt, Human
uuaaguauguguaa

SEQ ID NO: 2236642 - RNA, 19 nt, Human
uuaaguauuuauauauuua

SEQ ID NO: 2236643 - RNA, 17 nt, Human
uuaaguauuuauauauu

SEQ ID NO: 2236644 - RNA, 19 nt, Human
uuaagucuaaauauuuccu

SEQ ID NO: 2236645 - RNA, 14 nt, Human
uuaagugcugcauu

SEQ ID NO: 2236646 - RNA, 15 nt, Human
uuaagucuguuuuau

SEQ ID NO: 2236647 - RNA, 14 nt, Human
uuaagucuguuuua

SEQ ID NO: 2236648 - RNA, 19 nt, Human
uuaagugcugcauuuaaaa

SEQ ID NO: 2236649 - RNA, 12 nt, Human
uuaauauuuaaa

SEQ ID NO: 2236650 - RNA, 15 nt, Human
uuaauauuuaaacag

SEQ ID NO: 2236651 - RNA, 16 nt, Human
uuaauauuuaaacagc

SEQ ID NO: 2236652 - RNA, 17 nt, Human
uuaauauuuaaacagca

SEQ ID NO: 2236653 - RNA, 16 nt, Human
uuaagugcugcauuua

SEQ ID NO: 2236654 - RNA, 15 nt, Human
uuaagugcugcauuu

SEQ ID NO: 2236655 - RNA, 17 nt, Human
uuaaucuuuucacaaau

SEQ ID NO: 2236656 - RNA, 18 nt, Human
uuaaucuuuucacaaaua

SEQ ID NO: 2236657 - RNA, 19 nt, Human
uuaaucuuuucacaaauaa

SEQ ID NO: 2236658 - RNA, 20 nt, Human
uuaaucuuuucacaaauaaa

SEQ ID NO: 2236659 - RNA, 18 nt, Human
uuaaugaaagacuguaca

SEQ ID NO: 2236660 - RNA, 22 nt, Human
uuaaucugguuuauuuuuguuc

SEQ ID NO: 2236661 - RNA, 16 nt, Human
uuaaucuguauuuccc

SEQ ID NO: 2236662 - RNA, 21 nt, Human
uuaauugacuuauuuauauaa

SEQ ID NO: 2236663 - RNA, 13 nt, Human
uuaauugaaauuu

SEQ ID NO: 2236664 - RNA, 13 nt, Human
uuaauugcuuuga

SEQ ID NO: 2236665 - RNA, 12 nt, Human
uuaauugcuuug

SEQ ID NO: 2236666 - RNA, 22 nt, Human
uuaauugauuauucugauucca

SEQ ID NO: 2236667 - RNA, 16 nt, Human
uuaaugaaaaugucag

SEQ ID NO: 2236668 - RNA, 15 nt, Human
uuaaugaaaauguca

SEQ ID NO: 2236669 - RNA, 14 nt, Human
uuaaugaaaauguc

SEQ ID NO: 2236670 - RNA, 15 nt, Human
uuaaugaaaauaaga

SEQ ID NO: 2236671 - RNA, 19 nt, Human
uuaaugaaagacuguacaa

SEQ ID NO: 2236672 - RNA, 20 nt, Human
uuaauauuugcugacagcug

SEQ ID NO: 2236673 - RNA, 19 nt, Human
uuaauauuugcugacagcu

SEQ ID NO: 2236674 - RNA, 12 nt, Human
uuaauauuugcu

SEQ ID NO: 2236675 - RNA, 22 nt, Human
uuaauauuuauaggucacuuug

SEQ ID NO: 2236676 - RNA, 18 nt, Human
uuaauauuuaaacagcag

SEQ ID NO: 2236677 - RNA, 21 nt, Human
uuaauauuuaaacagcagugu

SEQ ID NO: 2236678 - RNA, 22 nt, Human
uuaauauuuaaacagcaguguu

SEQ ID NO: 2236679 - RNA, 13 nt, Human
uuaaucauuaggu

SEQ ID NO: 2236680 - RNA, 14 nt, Human
uuaaucaaguugaa

SEQ ID NO: 2236681 - RNA, 17 nt, Human
uuaaucaaguugaauug

SEQ ID NO: 2236682 - RNA, 13 nt, Human
uuaaucaugaaau

SEQ ID NO: 2236683 - RNA, 17 nt, Human
uuaaucaugaaugugua

SEQ ID NO: 2236684 - RNA, 13 nt, Human
uuaaucauugccu

SEQ ID NO: 2236685 - RNA, 18 nt, Human
uuaaucaugaauguguaa

SEQ ID NO: 2236686 - RNA, 15 nt, Human
uuaagguuauuuauu

SEQ ID NO: 2236687 - RNA, 21 nt, Human
uuaaucugggccagaauuuca

SEQ ID NO: 2236688 - RNA, 23 nt, Human
uuaaucauuaggugugacugaau

SEQ ID NO: 2236689 - RNA, 22 nt, Human
uuaaucauuaggugugacugaa

SEQ ID NO: 2236690 - RNA, 15 nt, Human
aguuuuuauugcuug

SEQ ID NO: 2236691 - RNA, 17 nt, Human
aguuuuuauggggcuga

SEQ ID NO: 2236692 - RNA, 18 nt, Human
aguuuuuauuccuuguga

SEQ ID NO: 2236693 - RNA, 19 nt, Human
auaaaagauggggucugua

SEQ ID NO: 2236694 - RNA, 21 nt, Human
auaaaagauggggucuguaaa

SEQ ID NO: 2236695 - RNA, 15 nt, Human
auaaaagcauaaaug

SEQ ID NO: 2236696 - RNA, 20 nt, Human
auaaaagcagcaucugcuaa

SEQ ID NO: 2236697 - RNA, 16 nt, Human
auaaaagcagcaucug

SEQ ID NO: 2236698 - RNA, 20 nt, Human
auaaaagcaauuccaaccuu

SEQ ID NO: 2236699 - RNA, 22 nt, Human
auaaaagauggggucuguaaaa

SEQ ID NO: 2236700 - RNA, 17 nt, Human
auaaaagcaauuccaac

SEQ ID NO: 2236701 - RNA, 19 nt, Human
auaaaagcaauuccaaccu

SEQ ID NO: 2236702 - RNA, 13 nt, Human
auaaaagccuguu

SEQ ID NO: 2236703 - RNA, 15 nt, Human
auaaaauaauucuaa

SEQ ID NO: 2236704 - RNA, 23 nt, Human
auaaaauaaugggauuuucuuuu

SEQ ID NO: 2236705 - RNA, 15 nt, Human
auaaaauaaauauau

SEQ ID NO: 2236706 - RNA, 16 nt, Human
auaaaauaaauauaua

SEQ ID NO: 2236707 - RNA, 21 nt, Human
auaaaauaaauauauauaaac

SEQ ID NO: 2236708 - RNA, 12 nt, Human
auaaaauaauuu

SEQ ID NO: 2236709 - RNA, 20 nt, Human
auaaaagcauaaaugcaaac

SEQ ID NO: 2236710 - RNA, 18 nt, Human
auaaaagcauaaaugcaa

SEQ ID NO: 2236711 - RNA, 14 nt, Human
auaaaauaaauaua

SEQ ID NO: 2236712 - RNA, 13 nt, Human
auaaaauaaauau

SEQ ID NO: 2236713 - RNA, 18 nt, Human
auaaaagccuguuuaaga

SEQ ID NO: 2236714 - RNA, 20 nt, Human
auaaaauagcaauccuaaag

SEQ ID NO: 2236715 - RNA, 21 nt, Human
auaaaauaugaagacauaaac

SEQ ID NO: 2236716 - RNA, 19 nt, Human
auaaaauauuuucauacag

SEQ ID NO: 2236717 - RNA, 15 nt, Human
auaaaauaauuuuua

SEQ ID NO: 2236718 - RNA, 16 nt, Human
auaaaauaauucuaaa

SEQ ID NO: 2236719 - RNA, 17 nt, Human
auaaaauaauucuaaag

SEQ ID NO: 2236720 - RNA, 18 nt, Human
auaaaauaauucuaaagg

SEQ ID NO: 2236721 - RNA, 16 nt, Human
auaaaauacuauuuuu

SEQ ID NO: 2236722 - RNA, 19 nt, Human
auaaaauacuauuuuuacu

SEQ ID NO: 2236723 - RNA, 11 nt, Human
uuaagaaaauc

SEQ ID NO: 2236724 - RNA, 15 nt, Human
auaaaaucagccaau

SEQ ID NO: 2236725 - RNA, 14 nt, Human
uuaagaaaagagau

SEQ ID NO: 2236726 - RNA, 21 nt, Human
uuaagaaaaaggaugcacaga

SEQ ID NO: 2236727 - RNA, 19 nt, Human
uuaagaaaaaggaugcaca

SEQ ID NO: 2236728 - RNA, 11 nt, Human
auaaaaucagc

SEQ ID NO: 2236729 - RNA, 20 nt, Human
uuaagaaaaaggaugcacag

SEQ ID NO: 2236730 - RNA, 14 nt, Human
aguuuuguauucau

SEQ ID NO: 2236731 - RNA, 19 nt, Human
aguuuuuaagguuauuuau

SEQ ID NO: 2236732 - RNA, 14 nt, Human
aguuuugucuugaa

SEQ ID NO: 2236733 - RNA, 12 nt, Human
aguuuugucuug

SEQ ID NO: 2236734 - RNA, 13 nt, Human
aguuuugucuuga

SEQ ID NO: 2236735 - RNA, 16 nt, Human
aguuuuuacuuucugu

SEQ ID NO: 2236736 - RNA, 23 nt, Human
aguuuuuaccuaccacagugucu

SEQ ID NO: 2236737 - RNA, 15 nt, Human
aguuuuuacugaaca

SEQ ID NO: 2236738 - RNA, 22 nt, Human
aguuuuuaccuaccacaguguc

SEQ ID NO: 2236739 - RNA, 21 nt, Human
aguuuuuaccuaccacagugu

SEQ ID NO: 2236740 - RNA, 17 nt, Human
aguuuuuaccuaccaca

SEQ ID NO: 2236741 - RNA, 23 nt, Human
aguuuuuauggcuuuugugcauu

SEQ ID NO: 2236742 - RNA, 16 nt, Human
aguuuugcauuuaugg

SEQ ID NO: 2236743 - RNA, 19 nt, Human
aguuuugccagaacaguuu

SEQ ID NO: 2236744 - RNA, 15 nt, Human
aguuuuggaugcagu

SEQ ID NO: 2236745 - RNA, 17 nt, Human
aguuuuggaugcagugc

SEQ ID NO: 2236746 - RNA, 18 nt, Human
aguuuuggaugcagugcu

SEQ ID NO: 2236747 - RNA, 19 nt, Human
aguuuuggaugcagugcuc

SEQ ID NO: 2236748 - RNA, 22 nt, Human
aguuuugguugcuuuaauauca

SEQ ID NO: 2236749 - RNA, 21 nt, Human
aguuuugguugcuuuaauauc

SEQ ID NO: 2236750 - RNA, 15 nt, Human
aguuuugguugcuuu

SEQ ID NO: 2236751 - RNA, 17 nt, Human
aguuuccucaggcugcu

SEQ ID NO: 2236752 - RNA, 19 nt, Human
aguuuucugagaaagacua

SEQ ID NO: 2236753 - RNA, 15 nt, Human
aguuuccaaaaccag

SEQ ID NO: 2236754 - RNA, 17 nt, Human
aguuucauucuccugcc

SEQ ID NO: 2236755 - RNA, 20 nt, Human
aguuucauucuccugccugu

SEQ ID NO: 2236756 - RNA, 16 nt, Human
aguuuccaaaaccaga

SEQ ID NO: 2236757 - RNA, 13 nt, Human
aguuuccucaggc

SEQ ID NO: 2236758 - RNA, 13 nt, Human
aguuuucuggcug

SEQ ID NO: 2236759 - RNA, 18 nt, Human
aguuuucuggcuggagcc

SEQ ID NO: 2236760 - RNA, 19 nt, Human
aguuuucuggcuggagccu

SEQ ID NO: 2236761 - RNA, 14 nt, Human
aguuuucuucugug

SEQ ID NO: 2236762 - RNA, 23 nt, Human
aguuuucugagaaagacuauuca

SEQ ID NO: 2236763 - RNA, 12 nt, Human
aguuuugaaaag

SEQ ID NO: 2236764 - RNA, 14 nt, Human
aguuuugaaaagcu

SEQ ID NO: 2236765 - RNA, 15 nt, Human
aguuuugaaaagcua

SEQ ID NO: 2236766 - RNA, 16 nt, Human
aguuuugaaaagcuau

SEQ ID NO: 2236767 - RNA, 17 nt, Human
aguuuugaaaagcuauu

SEQ ID NO: 2236768 - RNA, 11 nt, Human
uguuguuauuu

SEQ ID NO: 2236769 - RNA, 13 nt, Human
uguuguuauuuaa

SEQ ID NO: 2236770 - RNA, 20 nt, Human
uguuuagauaauacaccacu

SEQ ID NO: 2236771 - RNA, 21 nt, Human
uguuguguacguggagaggga

SEQ ID NO: 2236772 - RNA, 13 nt, Human
uguugugaauguc

SEQ ID NO: 2236773 - RNA, 15 nt, Human
uguugugugugggag

SEQ ID NO: 2236774 - RNA, 14 nt, Human
uguuguguguggga

SEQ ID NO: 2236775 - RNA, 18 nt, Human
uguuguuaaugaaaaugu

SEQ ID NO: 2236776 - RNA, 17 nt, Human
uguuguuaaugaaaaug

SEQ ID NO: 2236777 - RNA, 14 nt, Human
uguuguuaaauauc

SEQ ID NO: 2236778 - RNA, 21 nt, Human
uguuguuaaugaaaaugucag

SEQ ID NO: 2236779 - RNA, 20 nt, Human
uguuguuaaugaaaauguca

SEQ ID NO: 2236780 - RNA, 14 nt, Human
uguuguguuucugu

SEQ ID NO: 2236781 - RNA, 16 nt, Human
uguugugugugggagu

SEQ ID NO: 2236782 - RNA, 14 nt, Human
uguugguuccaagc

SEQ ID NO: 2236783 - RNA, 21 nt, Human
uguugguaauuauuuugguac

SEQ ID NO: 2236784 - RNA, 14 nt, Human
uguuggucauuuua

SEQ ID NO: 2236785 - RNA, 22 nt, Human
uguugggguggguauaaaagau

SEQ ID NO: 2236786 - RNA, 23 nt, Human
uguugggguggguauaaaagaug

SEQ ID NO: 2236787 - RNA, 14 nt, Human
uguugguuuugacu

SEQ ID NO: 2236788 - RNA, 17 nt, Human
uguugguuuugacugga

SEQ ID NO: 2236789 - RNA, 15 nt, Human
uguugucucuugagu

SEQ ID NO: 2236790 - RNA, 16 nt, Human
uguugguuccaagccc

SEQ ID NO: 2236791 - RNA, 19 nt, Human
uguugguuccaagcccugg

SEQ ID NO: 2236792 - RNA, 16 nt, Human
uguugucuugaaagau

SEQ ID NO: 2236793 - RNA, 17 nt, Human
uguugucuguuuguucu

SEQ ID NO: 2236794 - RNA, 12 nt, Human
uguugucuugaa

SEQ ID NO: 2236795 - RNA, 12 nt, Human
uguugugaaugu

SEQ ID NO: 2236796 - RNA, 13 nt, Human
uguugugaauguu

SEQ ID NO: 2236797 - RNA, 14 nt, Human
uguugugauguauu

SEQ ID NO: 2236798 - RNA, 20 nt, Human
uguugugauguauucuagcu

SEQ ID NO: 2236799 - RNA, 24 nt, Human
uguuuauggccucagcugccucac

SEQ ID NO: 2236800 - RNA, 21 nt, Human
uguuuaugcaaggaaggaaag

SEQ ID NO: 2236801 - RNA, 21 nt, Human
uguuuaugagccagacaaaug

SEQ ID NO: 2236802 - RNA, 16 nt, Human
uguuuaugagccagac

SEQ ID NO: 2236803 - RNA, 14 nt, Human
uguuuaugagccag

SEQ ID NO: 2236804 - RNA, 23 nt, Human
uguuuauggccucagcugccuca

SEQ ID NO: 2236805 - RNA, 15 nt, Human
uguuuauggccucag

SEQ ID NO: 2236806 - RNA, 14 nt, Human
uguuuauggccuca

SEQ ID NO: 2236807 - RNA, 13 nt, Human
uguuuauggccuc

SEQ ID NO: 2236808 - RNA, 16 nt, Human
uguuuauuuuauauua

SEQ ID NO: 2236809 - RNA, 14 nt, Human
uguuuauugucaaa

SEQ ID NO: 2236810 - RNA, 18 nt, Human
uguuuauuccugauaaua

SEQ ID NO: 2236811 - RNA, 13 nt, Human
uguuuauuccuug

SEQ ID NO: 2236812 - RNA, 13 nt, Human
uguuuauuccuga

SEQ ID NO: 2236813 - RNA, 13 nt, Human
uguuuaguaauca

SEQ ID NO: 2236814 - RNA, 19 nt, Human
uguuuaguaaacucaauaa

SEQ ID NO: 2236815 - RNA, 16 nt, Human
uguuuagcaaauacau

SEQ ID NO: 2236816 - RNA, 22 nt, Human
uguuuagcagcagccuuuaaug

SEQ ID NO: 2236817 - RNA, 17 nt, Human
uguuuagcagcagccuu

SEQ ID NO: 2236818 - RNA, 14 nt, Human
uguuuaguaaucau

SEQ ID NO: 2236819 - RNA, 17 nt, Human
uguuuaguaaucauauu

SEQ ID NO: 2236820 - RNA, 21 nt, Human
aguucgaugggcccaauucuu

SEQ ID NO: 2236821 - RNA, 15 nt, Human
aguucuacauaagua

SEQ ID NO: 2236822 - RNA, 20 nt, Human
aguucuaccucaggcagcuc

SEQ ID NO: 2236823 - RNA, 20 nt, Human
aguuccugcggagugaagag

SEQ ID NO: 2236824 - RNA, 16 nt, Human
aguuccucuuugcaug

SEQ ID NO: 2236825 - RNA, 18 nt, Human
aguuccugaaccugaugc

SEQ ID NO: 2236826 - RNA, 23 nt, Human
aguuccugcuacaacuucagcag

SEQ ID NO: 2236827 - RNA, 19 nt, Human
aguuccugaaccugaugcu

SEQ ID NO: 2236828 - RNA, 21 nt, Human
aguuccugcggagugaagagg

SEQ ID NO: 2236829 - RNA, 20 nt, Human
aguucggugagcuacaaaug

SEQ ID NO: 2236830 - RNA, 17 nt, Human
aguuccucgcccugggu

SEQ ID NO: 2236831 - RNA, 16 nt, Human
aguuccucgcccuggg

SEQ ID NO: 2236832 - RNA, 18 nt, Human
aguuccucuagugcccuc

SEQ ID NO: 2236833 - RNA, 15 nt, Human
aguuccucuuugcau

SEQ ID NO: 2236834 - RNA, 21 nt, Human
aguuccucuuugcauggaauu

SEQ ID NO: 2236835 - RNA, 15 nt, Human
aguuccucgcccugg

SEQ ID NO: 2236836 - RNA, 14 nt, Human
aguuccucgcccug

SEQ ID NO: 2236837 - RNA, 13 nt, Human
aguuccucgcccu

SEQ ID NO: 2236838 - RNA, 12 nt, Human
aguuccucgccc

SEQ ID NO: 2236839 - RNA, 19 nt, Human
aguucggugagcuacaaau

SEQ ID NO: 2236840 - RNA, 12 nt, Human
aguucucacugu

SEQ ID NO: 2236841 - RNA, 18 nt, Human
aguucucacuguucccuc

SEQ ID NO: 2236842 - RNA, 19 nt, Human
aguucucacuguucccucu

SEQ ID NO: 2236843 - RNA, 20 nt, Human
aguucucacuguucccucug

SEQ ID NO: 2236844 - RNA, 12 nt, Human
aguucucagggc

SEQ ID NO: 2236845 - RNA, 14 nt, Human
aguucucagggcuc

SEQ ID NO: 2236846 - RNA, 15 nt, Human
aguucucagggcucc

SEQ ID NO: 2236847 - RNA, 17 nt, Human
aguucuaguuugcauuc

SEQ ID NO: 2236848 - RNA, 15 nt, Human
aguucuaguugcuug

SEQ ID NO: 2236849 - RNA, 15 nt, Human
aguucuaguuugcau

SEQ ID NO: 2236850 - RNA, 16 nt, Human
aguucuaguuugcauu

SEQ ID NO: 2236851 - RNA, 17 nt, Human
uguugggguggguauaa

SEQ ID NO: 2236852 - RNA, 18 nt, Human
uguugggguggguauaaa

SEQ ID NO: 2236853 - RNA, 20 nt, Human
uguugggguggguauaaaag

SEQ ID NO: 2236854 - RNA, 15 nt, Human
uguuggggcaguggu

SEQ ID NO: 2236855 - RNA, 17 nt, Human
aguucucagggcuccug

SEQ ID NO: 2236856 - RNA, 18 nt, Human
aguucucagggcuccugc

SEQ ID NO: 2236857 - RNA, 19 nt, Human
aguucucagggcuccugcc

SEQ ID NO: 2236858 - RNA, 23 nt, Human
aguucucagggcuccugccuucu

SEQ ID NO: 2236859 - RNA, 17 nt, Human
aguucuagucucucugg

SEQ ID NO: 2236860 - RNA, 19 nt, Human
aguucuagucucucugggg

SEQ ID NO: 2236861 - RNA, 15 nt, Human
aguucuagagaagag

SEQ ID NO: 2236862 - RNA, 16 nt, Human
aguucuagagaagagg

SEQ ID NO: 2236863 - RNA, 17 nt, Human
aguucuagagaagaggc

SEQ ID NO: 2236864 - RNA, 20 nt, Human
aguucuagagaagaggcugg

SEQ ID NO: 2236865 - RNA, 22 nt, Human
aguucuaccucaggcagcucaa

SEQ ID NO: 2236866 - RNA, 23 nt, Human
aguucuaccucaggcagcucaag

SEQ ID NO: 2236867 - RNA, 13 nt, Human
aguucuagagaag

SEQ ID NO: 2236868 - RNA, 14 nt, Human
aguucuagagaaga

SEQ ID NO: 2236869 - RNA, 21 nt, Human
aguucacuauaaaugguguuu

SEQ ID NO: 2236870 - RNA, 15 nt, Human
aguucacuucaucuu

SEQ ID NO: 2236871 - RNA, 16 nt, Human
aguucacuauaaaugg

SEQ ID NO: 2236872 - RNA, 22 nt, Human
aguucacuucaucuucucagcu

SEQ ID NO: 2236873 - RNA, 12 nt, Human
aguucccagaau

SEQ ID NO: 2236874 - RNA, 13 nt, Human
aguucccagaauc

SEQ ID NO: 2236875 - RNA, 14 nt, Human
aguucccagaauca

SEQ ID NO: 2236876 - RNA, 14 nt, Human
aguucaauggcugc

SEQ ID NO: 2236877 - RNA, 17 nt, Human
aguucaauggcugcuga

SEQ ID NO: 2236878 - RNA, 18 nt, Human
aguucaauggcugcugaa

SEQ ID NO: 2236879 - RNA, 14 nt, Human
aguucaccauuaaa

SEQ ID NO: 2236880 - RNA, 23 nt, Human
aguuccucauuagcauuuugcua

SEQ ID NO: 2236881 - RNA, 15 nt, Human
aguucccuacuuccu

SEQ ID NO: 2236882 - RNA, 15 nt, Human
aguucccauguuaaa

SEQ ID NO: 2236883 - RNA, 14 nt, Human
aguuccccaugcag

SEQ ID NO: 2236884 - RNA, 16 nt, Human
aguuccccaugcagac

SEQ ID NO: 2236885 - RNA, 18 nt, Human
aguucccccaaccucaga

SEQ ID NO: 2236886 - RNA, 17 nt, Human
aguuccccaugcagaca

SEQ ID NO: 2236887 - RNA, 15 nt, Human
aguucccccaaccuc

SEQ ID NO: 2236888 - RNA, 15 nt, Human
aguucccagaaucaa

SEQ ID NO: 2236889 - RNA, 16 nt, Human
aguucccagaaucaaa

SEQ ID NO: 2236890 - RNA, 16 nt, Human
aguuaucuaaaagaaa

SEQ ID NO: 2236891 - RNA, 15 nt, Human
aguuauaguuucaga

SEQ ID NO: 2236892 - RNA, 16 nt, Human
aguuauaguuucagau

SEQ ID NO: 2236893 - RNA, 18 nt, Human
aguuauaguuucagauau

SEQ ID NO: 2236894 - RNA, 21 nt, Human
aguuauauagguuuuguuugc

SEQ ID NO: 2236895 - RNA, 23 nt, Human
aguuauauagguuuuguuugcua

SEQ ID NO: 2236896 - RNA, 22 nt, Human
aguuauauagguuuuguuugcu

SEQ ID NO: 2236897 - RNA, 21 nt, Human
aguuaucagacacucuggcug

SEQ ID NO: 2236898 - RNA, 18 nt, Human
aguuaucaugcauguuau

SEQ ID NO: 2236899 - RNA, 23 nt, Human
aguuaucagacacucuggcuggu

SEQ ID NO: 2236900 - RNA, 16 nt, Human
aguucaauucucauuu

SEQ ID NO: 2236901 - RNA, 13 nt, Human
aguucaaugaucu

SEQ ID NO: 2236902 - RNA, 14 nt, Human
aguucaaugaucua

SEQ ID NO: 2236903 - RNA, 15 nt, Human
aguucaaugaucuag

SEQ ID NO: 2236904 - RNA, 16 nt, Human
aguucaaugaucuagg

SEQ ID NO: 2236905 - RNA, 20 nt, Human
aguucaaugaucuagguuua

SEQ ID NO: 2236906 - RNA, 21 nt, Human
aguucaaugaucuagguuuaa

SEQ ID NO: 2236907 - RNA, 22 nt, Human
aguucaaugaucuagguuuaac

SEQ ID NO: 2236908 - RNA, 23 nt, Human
aguucaaugaucuagguuuaacu

SEQ ID NO: 2236909 - RNA, 18 nt, Human
aguucaauaaaugucugu

SEQ ID NO: 2236910 - RNA, 19 nt, Human
aguucaauaaaugucuguu

SEQ ID NO: 2236911 - RNA, 21 nt, Human
aguucaauaaaugucuguuga

SEQ ID NO: 2236912 - RNA, 13 nt, Human
aguucaauccuac

SEQ ID NO: 2236913 - RNA, 15 nt, Human
aguucaaucucccgc

SEQ ID NO: 2236914 - RNA, 22 nt, Human
aguucaaucucccgcugcugcu

SEQ ID NO: 2236915 - RNA, 10 nt, Human
aguucaauga

SEQ ID NO: 2236916 - RNA, 11 nt, Human
aguucaaugau

SEQ ID NO: 2236917 - RNA, 12 nt, Human
aguucaaugauc

SEQ ID NO: 2236918 - RNA, 18 nt, Human
uguucuacucauauauau

SEQ ID NO: 2236919 - RNA, 15 nt, Human
uguucuaguuuucag

SEQ ID NO: 2236920 - RNA, 16 nt, Human
uguucuaguuuucagu

SEQ ID NO: 2236921 - RNA, 18 nt, Human
uguucuuaguuugcaguu

SEQ ID NO: 2236922 - RNA, 13 nt, Human
uguucuugaagca

SEQ ID NO: 2236923 - RNA, 18 nt, Human
uguucccucucccuguug

SEQ ID NO: 2236924 - RNA, 18 nt, Human
uguuauuucuuacaggca

SEQ ID NO: 2236925 - RNA, 21 nt, Human
uguuccccucacuggaugaaa

SEQ ID NO: 2236926 - RNA, 17 nt, Human
uguucuaagucuuucca

SEQ ID NO: 2236927 - RNA, 18 nt, Human
uguucuagcauggcugcc

SEQ ID NO: 2236928 - RNA, 22 nt, Human
uguucuaauuaauaaauuauuu

SEQ ID NO: 2236929 - RNA, 23 nt, Human
uguuccccuuccacugagggcag

SEQ ID NO: 2236930 - RNA, 21 nt, Human
uguuccccuuccacugagggc

SEQ ID NO: 2236931 - RNA, 20 nt, Human
uguuccccuuccacugaggg

SEQ ID NO: 2236932 - RNA, 17 nt, Human
uguuccccuccuccacu

SEQ ID NO: 2236933 - RNA, 19 nt, Human
uguuccccuccuccacucu

SEQ ID NO: 2236934 - RNA, 17 nt, Human
uguuccccuuccacuga

SEQ ID NO: 2236935 - RNA, 14 nt, Human
uguuccccuuccac

SEQ ID NO: 2236936 - RNA, 23 nt, Human
uguuccccuccuccacucucccc

SEQ ID NO: 2236937 - RNA, 13 nt, Human
uguuccccuccuc

SEQ ID NO: 2236938 - RNA, 15 nt, Human
uguuccccuccucca

SEQ ID NO: 2236939 - RNA, 12 nt, Human
uguuccccuccu

SEQ ID NO: 2236940 - RNA, 17 nt, Human
uguuauuucucagacuu

SEQ ID NO: 2236941 - RNA, 15 nt, Human
uguuauuuaaaugag

SEQ ID NO: 2236942 - RNA, 14 nt, Human
uguuauuuaaagaa

SEQ ID NO: 2236943 - RNA, 22 nt, Human
uguuauugggcaagugauugaa

SEQ ID NO: 2236944 - RNA, 18 nt, Human
uguuauuuaacagcugaa

SEQ ID NO: 2236945 - RNA, 18 nt, Human
uguuauuuauaaucacuu

SEQ ID NO: 2236946 - RNA, 21 nt, Human
uguuauuuauaaucacuuuuu

SEQ ID NO: 2236947 - RNA, 17 nt, Human
uguuauuuagacucauc

SEQ ID NO: 2236948 - RNA, 14 nt, Human
uguuauuuauauau

SEQ ID NO: 2236949 - RNA, 21 nt, Human
uguuauuucuauuuuuguaga

SEQ ID NO: 2236950 - RNA, 22 nt, Human
uguuauuucuauuuuuguagaa

SEQ ID NO: 2236951 - RNA, 13 nt, Human
uguuauuucucag

SEQ ID NO: 2236952 - RNA, 23 nt, Human
uguuauuagagauuaccuccuga

SEQ ID NO: 2236953 - RNA, 21 nt, Human
uguuauuagagauuaccuccu

SEQ ID NO: 2236954 - RNA, 12 nt, Human
uguuauuauaua

SEQ ID NO: 2236955 - RNA, 22 nt, Human
uguuauuauuacuuauuuuuga

SEQ ID NO: 2236956 - RNA, 21 nt, Human
uguuauugggcaagugauuga

SEQ ID NO: 2236957 - RNA, 21 nt, Human
agugugguagggacuuaaaaa

SEQ ID NO: 2236958 - RNA, 23 nt, Human
aguggaucuccaaggaccagguu

SEQ ID NO: 2236959 - RNA, 18 nt, Human
aguggaucuccaaggacc

SEQ ID NO: 2236960 - RNA, 17 nt, Human
aguguggucccaacagg

SEQ ID NO: 2236961 - RNA, 23 nt, Human
agugugggucuguguguguguau

SEQ ID NO: 2236962 - RNA, 19 nt, Human
agugugggucugugugugu

SEQ ID NO: 2236963 - RNA, 20 nt, Human
uguuaucaaaacuuucuuuu

SEQ ID NO: 2236964 - RNA, 21 nt, Human
uguuaucagucaauauuuuua

SEQ ID NO: 2236965 - RNA, 19 nt, Human
uguuaucaccgugggcucc

SEQ ID NO: 2236966 - RNA, 13 nt, Human
uguuaucaaacuu

SEQ ID NO: 2236967 - RNA, 16 nt, Human
aguggagaauuauaua

SEQ ID NO: 2236968 - RNA, 22 nt, Human
aguggacuuuccacccccuccc

SEQ ID NO: 2236969 - RNA, 20 nt, Human
aguggacuuuccacccccuc

SEQ ID NO: 2236970 - RNA, 19 nt, Human
aguggacuuuccacccccu

SEQ ID NO: 2236971 - RNA, 18 nt, Human
aguggacuuuccaccccc

SEQ ID NO: 2236972 - RNA, 17 nt, Human
aguggacuuuccacccc

SEQ ID NO: 2236973 - RNA, 15 nt, Human
aguggacuuuccacc

SEQ ID NO: 2236974 - RNA, 17 nt, Human
aguggaagaagcagaug

SEQ ID NO: 2236975 - RNA, 16 nt, Human
aguggaagaagaggga

SEQ ID NO: 2236976 - RNA, 17 nt, Human
aguggaagaagagggag

SEQ ID NO: 2236977 - RNA, 22 nt, Human
aguggaaagacagcuucucauc

SEQ ID NO: 2236978 - RNA, 15 nt, Human
aguggaaauguucua

SEQ ID NO: 2236979 - RNA, 14 nt, Human
aguggaucuccaag

SEQ ID NO: 2236980 - RNA, 15 nt, Human
agugugggucugugu

SEQ ID NO: 2236981 - RNA, 17 nt, Human
agugugggucugugugu

SEQ ID NO: 2236982 - RNA, 16 nt, Human
agugugggucugugug

SEQ ID NO: 2236983 - RNA, 17 nt, Human
aguggaggcacuuuagg

SEQ ID NO: 2236984 - RNA, 14 nt, Human
aguggaggcacuuu

SEQ ID NO: 2236985 - RNA, 22 nt, Human
aguggagguuaaggcugaggaa

SEQ ID NO: 2236986 - RNA, 23 nt, Human
aguggagguuaaggcugaggaaa

SEQ ID NO: 2236987 - RNA, 14 nt, Human
aguuagaauuccuu

SEQ ID NO: 2236988 - RNA, 15 nt, Human
aguuagaauuccuuc

SEQ ID NO: 2236989 - RNA, 19 nt, Human
aguuagaauuccuucaggg

SEQ ID NO: 2236990 - RNA, 12 nt, Human
aguuagacuguu

SEQ ID NO: 2236991 - RNA, 21 nt, Human
aguuagaauuccuucagggug

SEQ ID NO: 2236992 - RNA, 13 nt, Human
aguuauaguuuca

SEQ ID NO: 2236993 - RNA, 19 nt, Human
aguuacuuugucagaggca

SEQ ID NO: 2236994 - RNA, 15 nt, Human
aguuacuuccuauca

SEQ ID NO: 2236995 - RNA, 14 nt, Human
aguuacuuccuauc

SEQ ID NO: 2236996 - RNA, 17 nt, Human
aguuacuguugugaccu

SEQ ID NO: 2236997 - RNA, 22 nt, Human
aguuacuucacuuuaauucuca

SEQ ID NO: 2236998 - RNA, 17 nt, Human
aguuacuguuauagagg

SEQ ID NO: 2236999 - RNA, 13 nt, Human
aguuacuguugug

SEQ ID NO: 2237000 - RNA, 16 nt, Human
aguuacucugaagggc

SEQ ID NO: 2237001 - RNA, 21 nt, Human
aguuacuccagugccaacaau

SEQ ID NO: 2237002 - RNA, 12 nt, Human
aguuacugaaug

SEQ ID NO: 2237003 - RNA, 13 nt, Human
aguuacugaaugc

SEQ ID NO: 2237004 - RNA, 14 nt, Human
aguuacugaaugca

SEQ ID NO: 2237005 - RNA, 18 nt, Human
aguuacugauucacugca

SEQ ID NO: 2237006 - RNA, 15 nt, Human
aguuacucugaaggg

SEQ ID NO: 2237007 - RNA, 17 nt, Human
aguuacuccagugccaa

SEQ ID NO: 2237008 - RNA, 21 nt, Human
aguuacucuucaguuaagccu

SEQ ID NO: 2237009 - RNA, 23 nt, Human
aguguuggagaagaacugaaauc

SEQ ID NO: 2237010 - RNA, 17 nt, Human
aguguuggagaagaacu

SEQ ID NO: 2237011 - RNA, 18 nt, Human
aguguuggagaagaacug

SEQ ID NO: 2237012 - RNA, 17 nt, Human
aguguugagccuuuucc

SEQ ID NO: 2237013 - RNA, 16 nt, Human
aguguugcauggaugu

SEQ ID NO: 2237014 - RNA, 14 nt, Human
aguguuggagaaga

SEQ ID NO: 2237015 - RNA, 16 nt, Human
aguguuggagaagaac

SEQ ID NO: 2237016 - RNA, 15 nt, Human
uguugcccaggcugg

SEQ ID NO: 2237017 - RNA, 14 nt, Human
uguugcccaggcug

SEQ ID NO: 2237018 - RNA, 21 nt, Human
uguugcccaggcuggagugca

SEQ ID NO: 2237019 - RNA, 13 nt, Human
uguugcccaggcu

SEQ ID NO: 2237020 - RNA, 19 nt, Human
uguucuuucacccuuuucu

SEQ ID NO: 2237021 - RNA, 23 nt, Human
uguucuugaauuuaauaaucugu

SEQ ID NO: 2237022 - RNA, 13 nt, Human
uguucuugaauuu

SEQ ID NO: 2237023 - RNA, 20 nt, Human
uguucuugguuuguaaauua

SEQ ID NO: 2237024 - RNA, 15 nt, Human
uguucuuuaggagau

SEQ ID NO: 2237025 - RNA, 20 nt, Human
uguucuugaagcaguagccu

SEQ ID NO: 2237026 - RNA, 22 nt, Human
uguucuugguuuguaaauuaac

SEQ ID NO: 2237027 - RNA, 22 nt, Human
aguguguuguugcuuuaggcuc

SEQ ID NO: 2237028 - RNA, 15 nt, Human
aguguuaaaugugau

SEQ ID NO: 2237029 - RNA, 15 nt, Human
aguguuaauacuagu

SEQ ID NO: 2237030 - RNA, 16 nt, Human
aguguuaauacuaguu

SEQ ID NO: 2237031 - RNA, 19 nt, Human
aguguuaauacuaguugug

SEQ ID NO: 2237032 - RNA, 20 nt, Human
aguguuaauacuaguuguga

SEQ ID NO: 2237033 - RNA, 20 nt, Human
aguguuaaucaauuuaaacc

SEQ ID NO: 2237034 - RNA, 12 nt, Human
aguguuaaucaa

SEQ ID NO: 2237035 - RNA, 15 nt, Human
aguguuaaucaauuu

SEQ ID NO: 2237036 - RNA, 15 nt, Human
aguguuaggccuggc

SEQ ID NO: 2237037 - RNA, 16 nt, Human
aguguuaggccuggca

SEQ ID NO: 2237038 - RNA, 20 nt, Human
aguguguuuccuucagugca

SEQ ID NO: 2237039 - RNA, 19 nt, Human
aguguguuuccuucagugc

SEQ ID NO: 2237040 - RNA, 21 nt, Human
aguguguucugauuagaaaug

SEQ ID NO: 2237041 - RNA, 15 nt, Human
aguguguuguugcuu

SEQ ID NO: 2237042 - RNA, 20 nt, Human
aguguguucugauuagaaau

SEQ ID NO: 2237043 - RNA, 17 nt, Human
aguguguucugauuaga

SEQ ID NO: 2237044 - RNA, 13 nt, Human
aguguguucugau

SEQ ID NO: 2237045 - RNA, 12 nt, Human
aguguguucuga

SEQ ID NO: 2237046 - RNA, 19 nt, Human
aguguguguuuuucauaaa

SEQ ID NO: 2237047 - RNA, 22 nt, Human
aguguuauuuucuuugaaauug

SEQ ID NO: 2237048 - RNA, 17 nt, Human
aguguugaaaauguuca

SEQ ID NO: 2237049 - RNA, 22 nt, Human
aguguuauuaguguaugcuuug

SEQ ID NO: 2237050 - RNA, 19 nt, Human
aguguuaugcggucuaggg

SEQ ID NO: 2237051 - RNA, 16 nt, Human
aguguuaucagucaua

SEQ ID NO: 2237052 - RNA, 23 nt, Human
aguguuaucagucauaacuaaau

SEQ ID NO: 2237053 - RNA, 20 nt, Human
aguguuaggccuggcacagu

SEQ ID NO: 2237054 - RNA, 23 nt, Human
aguguuagggaagggccugccac

SEQ ID NO: 2237055 - RNA, 19 nt, Human
aguguuagggaagggccug

SEQ ID NO: 2237056 - RNA, 18 nt, Human
aguguuagggaagggccu

SEQ ID NO: 2237057 - RNA, 15 nt, Human
aguguuagggaaggg

SEQ ID NO: 2237058 - RNA, 17 nt, Human
aguguuaggccuggcac

SEQ ID NO: 2237059 - RNA, 19 nt, Human
aguguuaggccuggcacag

SEQ ID NO: 2237060 - RNA, 16 nt, Human
ugugccuccucacccc

SEQ ID NO: 2237061 - RNA, 14 nt, Human
ugugccucccaaaa

SEQ ID NO: 2237062 - RNA, 15 nt, Human
ugugccuccucaccc

SEQ ID NO: 2237063 - RNA, 14 nt, Human
ugugccuccucacc

SEQ ID NO: 2237064 - RNA, 12 nt, Human
ugugccucugcc

SEQ ID NO: 2237065 - RNA, 21 nt, Human
ugugccucggcuuuucucagc

SEQ ID NO: 2237066 - RNA, 12 nt, Human
ugugccucggcu

SEQ ID NO: 2237067 - RNA, 22 nt, Human
ugugcucugaucauccacugug

SEQ ID NO: 2237068 - RNA, 12 nt, Human
ugugcucugauc

SEQ ID NO: 2237069 - RNA, 23 nt, Human
ugugcucugaucauccacugugc

SEQ ID NO: 2237070 - RNA, 15 nt, Human
ugugcucuggacagg

SEQ ID NO: 2237071 - RNA, 21 nt, Human
agucucacuguugcccaggcu

SEQ ID NO: 2237072 - RNA, 13 nt, Human
ugugccccccauc

SEQ ID NO: 2237073 - RNA, 20 nt, Human
agucucacuguugcccaggc

SEQ ID NO: 2237074 - RNA, 18 nt, Human
agucucacuguugcccag

SEQ ID NO: 2237075 - RNA, 19 nt, Human
agucucacuguugcccagg

SEQ ID NO: 2237076 - RNA, 21 nt, Human
ugugcccuaaaguguauuuuu

SEQ ID NO: 2237077 - RNA, 14 nt, Human
ugugcccccucuac

SEQ ID NO: 2237078 - RNA, 20 nt, Human
ugugcccuaaaguguauuuu

SEQ ID NO: 2237079 - RNA, 15 nt, Human
ugugccccccauccu

SEQ ID NO: 2237080 - RNA, 16 nt, Human
ugugccccccauccug

SEQ ID NO: 2237081 - RNA, 18 nt, Human
ugugccccccauccuggc

SEQ ID NO: 2237082 - RNA, 19 nt, Human
ugugccccccauccuggcc

SEQ ID NO: 2237083 - RNA, 20 nt, Human
ugugccccccauccuggccc

SEQ ID NO: 2237084 - RNA, 21 nt, Human
ugugccccccauccuggccca

SEQ ID NO: 2237085 - RNA, 22 nt, Human
ugugccccccauccuggcccau

SEQ ID NO: 2237086 - RNA, 23 nt, Human
ugugccccccauccuggcccauc

SEQ ID NO: 2237087 - RNA, 12 nt, Human
ugugcugcccug

SEQ ID NO: 2237088 - RNA, 19 nt, Human
ugugcucuggacaggcaug

SEQ ID NO: 2237089 - RNA, 16 nt, Human
ugugcucuggacaggc

SEQ ID NO: 2237090 - RNA, 18 nt, Human
ugugcucuggacaggcau

SEQ ID NO: 2237091 - RNA, 13 nt, Human
ugugcugcccugc

SEQ ID NO: 2237092 - RNA, 14 nt, Human
ugugcugcccugcc

SEQ ID NO: 2237093 - RNA, 15 nt, Human
ugugcugcccugccc

SEQ ID NO: 2237094 - RNA, 18 nt, Human
uguggcaagccccugccc

SEQ ID NO: 2237095 - RNA, 22 nt, Human
uguggcaaagccuucauugccu

SEQ ID NO: 2237096 - RNA, 21 nt, Human
uguggauuuuugugguaguga

SEQ ID NO: 2237097 - RNA, 20 nt, Human
uguggagccgaggccuaccc

SEQ ID NO: 2237098 - RNA, 12 nt, Human
uguggaggaagg

SEQ ID NO: 2237099 - RNA, 14 nt, Human
uguggaggaaggau

SEQ ID NO: 2237100 - RNA, 15 nt, Human
uguggaggaaggauu

SEQ ID NO: 2237101 - RNA, 16 nt, Human
uguggaggaaggauug

SEQ ID NO: 2237102 - RNA, 17 nt, Human
uguggaggaaggauugu

SEQ ID NO: 2237103 - RNA, 20 nt, Human
uguggaggaaggauuguaaa

SEQ ID NO: 2237104 - RNA, 19 nt, Human
uguggagcccgcaccccca

SEQ ID NO: 2237105 - RNA, 18 nt, Human
uguggagcccgcaccccc

SEQ ID NO: 2237106 - RNA, 16 nt, Human
uguggagcccgcaccc

SEQ ID NO: 2237107 - RNA, 16 nt, Human
uguggagccgaggccu

SEQ ID NO: 2237108 - RNA, 19 nt, Human
uguggagccgaggccuacc

SEQ ID NO: 2237109 - RNA, 19 nt, Human
uguggagagugcaacagua

SEQ ID NO: 2237110 - RNA, 13 nt, Human
uguggagacuggg

SEQ ID NO: 2237111 - RNA, 14 nt, Human
uguggcacauucuu

SEQ ID NO: 2237112 - RNA, 17 nt, Human
uguggcaaggaaaaaca

SEQ ID NO: 2237113 - RNA, 19 nt, Human
uguggcaauagugggcccu

SEQ ID NO: 2237114 - RNA, 12 nt, Human
uguggccccacc

SEQ ID NO: 2237115 - RNA, 13 nt, Human
uguggccccaccc

SEQ ID NO: 2237116 - RNA, 17 nt, Human
uguggccccacccuggg

SEQ ID NO: 2237117 - RNA, 19 nt, Human
uguggccccacccugggcc

SEQ ID NO: 2237118 - RNA, 20 nt, Human
agugccccauucuuuuguaa

SEQ ID NO: 2237119 - RNA, 14 nt, Human
agugcccccacuga

SEQ ID NO: 2237120 - RNA, 16 nt, Human
agugcccccacugacc

SEQ ID NO: 2237121 - RNA, 17 nt, Human
agugcccauuccucacc

SEQ ID NO: 2237122 - RNA, 19 nt, Human
agugccccauucuuuugua

SEQ ID NO: 2237123 - RNA, 23 nt, Human
agugcccagaacuggacucagga

SEQ ID NO: 2237124 - RNA, 19 nt, Human
agugcccaccaacauccca

SEQ ID NO: 2237125 - RNA, 13 nt, Human
agugcccauuccu

SEQ ID NO: 2237126 - RNA, 20 nt, Human
agugcccaccaacaucccau

SEQ ID NO: 2237127 - RNA, 17 nt, Human
agugcccaacuguuaua

SEQ ID NO: 2237128 - RNA, 16 nt, Human
agugcccaccaacauc

SEQ ID NO: 2237129 - RNA, 14 nt, Human
agugcccacaggau

SEQ ID NO: 2237130 - RNA, 19 nt, Human
agugccacucauuccugua

SEQ ID NO: 2237131 - RNA, 20 nt, Human
agugccacugcccgagcugg

SEQ ID NO: 2237132 - RNA, 14 nt, Human
agugccaagcacag

SEQ ID NO: 2237133 - RNA, 19 nt, Human
agugccaagcacagugccu

SEQ ID NO: 2237134 - RNA, 21 nt, Human
agugccaacaauccuagugcu

SEQ ID NO: 2237135 - RNA, 22 nt, Human
agugccacugcccgagcuggug

SEQ ID NO: 2237136 - RNA, 21 nt, Human
agugccacugcccgagcuggu

SEQ ID NO: 2237137 - RNA, 15 nt, Human
agugcccaacuguua

SEQ ID NO: 2237138 - RNA, 16 nt, Human
agugccaaaaacaaca

SEQ ID NO: 2237139 - RNA, 16 nt, Human
agugccaacaauccua

SEQ ID NO: 2237140 - RNA, 13 nt, Human
agugcacccacuc

SEQ ID NO: 2237141 - RNA, 24 nt, Human
agugcagcccguguggccccuuca

SEQ ID NO: 2237142 - RNA, 23 nt, Human
agugcagcccguguggccccuuc

SEQ ID NO: 2237143 - RNA, 17 nt, Human
agugcacccacucugcu

SEQ ID NO: 2237144 - RNA, 18 nt, Human
agugcagccguuugagaa

SEQ ID NO: 2237145 - RNA, 17 nt, Human
agugcagccguuugaga

SEQ ID NO: 2237146 - RNA, 17 nt, Human
agugcagcugauuuuaa

SEQ ID NO: 2237147 - RNA, 16 nt, Human
agugcagcugauuuua

SEQ ID NO: 2237148 - RNA, 15 nt, Human
agugcagcugauuuu

SEQ ID NO: 2237149 - RNA, 14 nt, Human
agugcagcugauuu

SEQ ID NO: 2237150 - RNA, 20 nt, Human
agugcagcugauuuuaacaa

SEQ ID NO: 2237151 - RNA, 18 nt, Human
agugcagcugauuuuaac

SEQ ID NO: 2237152 - RNA, 15 nt, Human
agugcaggcuggcac

SEQ ID NO: 2237153 - RNA, 13 nt, Human
agugcaggcuggc

SEQ ID NO: 2237154 - RNA, 11 nt, Human
agugcaggcug

SEQ ID NO: 2237155 - RNA, 22 nt, Human
agugcaguccugaucagagccg

SEQ ID NO: 2237156 - RNA, 16 nt, Human
agugcaguccugauca

SEQ ID NO: 2237157 - RNA, 15 nt, Human
agugcaucucagccc

SEQ ID NO: 2237158 - RNA, 14 nt, Human
agugcaucucagcc

SEQ ID NO: 2237159 - RNA, 22 nt, Human
agugcaugcucucugcagccag

SEQ ID NO: 2237160 - RNA, 20 nt, Human
agugcaugcucucugcagcc

SEQ ID NO: 2237161 - RNA, 17 nt, Human
agugcaugcucucugca

SEQ ID NO: 2237162 - RNA, 16 nt, Human
agugcaugcucucugc

SEQ ID NO: 2237163 - RNA, 15 nt, Human
agugcaugcucucug

SEQ ID NO: 2237164 - RNA, 16 nt, Human
agugcaucucagccca

SEQ ID NO: 2237165 - RNA, 17 nt, Human
agugcaucucagcccac

SEQ ID NO: 2237166 - RNA, 18 nt, Human
agugcaaugacacagucu

SEQ ID NO: 2237167 - RNA, 23 nt, Human
agugcaauggcgugaucucggcu

SEQ ID NO: 2237168 - RNA, 22 nt, Human
agugcaaugguauaaauuucaa

SEQ ID NO: 2237169 - RNA, 16 nt, Human
agugcaaugacacagu

SEQ ID NO: 2237170 - RNA, 18 nt, Human
uguggccguuaucuggaa

SEQ ID NO: 2237171 - RNA, 13 nt, Human
agugauuucuaga

SEQ ID NO: 2237172 - RNA, 15 nt, Human
agugauuucuagaaa

SEQ ID NO: 2237173 - RNA, 22 nt, Human
agugcaaauugucacaggacag

SEQ ID NO: 2237174 - RNA, 21 nt, Human
agugaguguggcuccccucua

SEQ ID NO: 2237175 - RNA, 16 nt, Human
agugauuguaugaauu

SEQ ID NO: 2237176 - RNA, 22 nt, Human
agugaguuacagcgagaggcag

SEQ ID NO: 2237177 - RNA, 15 nt, Human
agugauuguuggcac

SEQ ID NO: 2237178 - RNA, 17 nt, Human
agugauugggacagagg

SEQ ID NO: 2237179 - RNA, 18 nt, Human
agugcaaauugucacagg

SEQ ID NO: 2237180 - RNA, 21 nt, Human
agugcaaauugucacaggaca

SEQ ID NO: 2237181 - RNA, 22 nt, Human
agugauucuccugccucagccu

SEQ ID NO: 2237182 - RNA, 24 nt, Human
agugauucuccugccucagccucc

SEQ ID NO: 2237183 - RNA, 19 nt, Human
agugaguguggcuccccuc

SEQ ID NO: 2237184 - RNA, 18 nt, Human
agugaguguggcuccccu

SEQ ID NO: 2237185 - RNA, 16 nt, Human
agugaguguggcuccc

SEQ ID NO: 2237186 - RNA, 23 nt, Human
agugagugcaaaaagcugaguau

SEQ ID NO: 2237187 - RNA, 14 nt, Human
agugagugagccug

SEQ ID NO: 2237188 - RNA, 16 nt, Human
agugagugagccuggc

SEQ ID NO: 2237189 - RNA, 16 nt, Human
agugagucucuucaga

SEQ ID NO: 2237190 - RNA, 14 nt, Human
agugagucugucag

SEQ ID NO: 2237191 - RNA, 15 nt, Human
agugagucugucagc

SEQ ID NO: 2237192 - RNA, 13 nt, Human
agugagugagccu

SEQ ID NO: 2237193 - RNA, 12 nt, Human
uguggcccuggc

SEQ ID NO: 2237194 - RNA, 21 nt, Human
uguggcccugccaucuuccca

SEQ ID NO: 2237195 - RNA, 22 nt, Human
uguggcccugccaucuucccag

SEQ ID NO: 2237196 - RNA, 13 nt, Human
uguggccccuuca

SEQ ID NO: 2237197 - RNA, 13 nt, Human
uguggcccugcca

SEQ ID NO: 2237198 - RNA, 14 nt, Human
uguggcccugccau

SEQ ID NO: 2237199 - RNA, 12 nt, Human
uguggccccuuc

SEQ ID NO: 2237200 - RNA, 22 nt, Human
uguggccccugaacaagaauug

SEQ ID NO: 2237201 - RNA, 17 nt, Human
uguggccccugaacaag

SEQ ID NO: 2237202 - RNA, 23 nt, Human
uguggccccacccugggcccugg

SEQ ID NO: 2237203 - RNA, 20 nt, Human
uguggcccuggccugcuggg

SEQ ID NO: 2237204 - RNA, 14 nt, Human
uguggcccuggccu

SEQ ID NO: 2237205 - RNA, 23 nt, Human
uguggcccugccaucuucccagc

SEQ ID NO: 2237206 - RNA, 17 nt, Human
uguggcccuggccugcu

SEQ ID NO: 2237207 - RNA, 16 nt, Human
agugagucgaggacag

SEQ ID NO: 2237208 - RNA, 15 nt, Human
uguuaaccucagugu

SEQ ID NO: 2237209 - RNA, 16 nt, Human
uguuaaccagaauaaa

SEQ ID NO: 2237210 - RNA, 17 nt, Human
uguuaaccucaguguca

SEQ ID NO: 2237211 - RNA, 17 nt, Human
uguuaacucuugucuau

SEQ ID NO: 2237212 - RNA, 19 nt, Human
uguuaaccucagugucauu

SEQ ID NO: 2237213 - RNA, 19 nt, Human
uguuaacucuugucuauuu

SEQ ID NO: 2237214 - RNA, 12 nt, Human
uguuaaucaauu

SEQ ID NO: 2237215 - RNA, 13 nt, Human
uguuaaucaauuu

SEQ ID NO: 2237216 - RNA, 21 nt, Human
uguuaacauggacaugaucuu

SEQ ID NO: 2237217 - RNA, 18 nt, Human
uguuaacacauuuuguau

SEQ ID NO: 2237218 - RNA, 20 nt, Human
uguuaacacauuuuguauaa

SEQ ID NO: 2237219 - RNA, 21 nt, Human
uguuaacacauuuuguauaau

SEQ ID NO: 2237220 - RNA, 22 nt, Human
uguuaacacauuuuguauaauu

SEQ ID NO: 2237221 - RNA, 18 nt, Human
uguguugccaugugugcu

SEQ ID NO: 2237222 - RNA, 23 nt, Human
uguguugccacaggacacaguca

SEQ ID NO: 2237223 - RNA, 18 nt, Human
uguguugccacaggacac

SEQ ID NO: 2237224 - RNA, 16 nt, Human
uguguugccaagcucc

SEQ ID NO: 2237225 - RNA, 12 nt, Human
uguguuggcuug

SEQ ID NO: 2237226 - RNA, 22 nt, Human
uguguugggauugagucugugc

SEQ ID NO: 2237227 - RNA, 15 nt, Human
uguguugcuauccug

SEQ ID NO: 2237228 - RNA, 13 nt, Human
uguguugugaaug

SEQ ID NO: 2237229 - RNA, 18 nt, Human
uguguugucuugaaagau

SEQ ID NO: 2237230 - RNA, 13 nt, Human
uguuaacacauuu

SEQ ID NO: 2237231 - RNA, 13 nt, Human
uguguugucucua

SEQ ID NO: 2237232 - RNA, 19 nt, Human
uguguuggggccuuggccu

SEQ ID NO: 2237233 - RNA, 19 nt, Human
uguguugucucuugaguuu

SEQ ID NO: 2237234 - RNA, 14 nt, Human
uguguugucuugaa

SEQ ID NO: 2237235 - RNA, 19 nt, Human
agugcuuguccccuaagag

SEQ ID NO: 2237236 - RNA, 17 nt, Human
uguuaaugguuugaaua

SEQ ID NO: 2237237 - RNA, 19 nt, Human
uguuaaugaaaaugucaga

SEQ ID NO: 2237238 - RNA, 17 nt, Human
uguuaaugaaaauguca

SEQ ID NO: 2237239 - RNA, 14 nt, Human
uguuaaugaaaaug

SEQ ID NO: 2237240 - RNA, 23 nt, Human
uguuaaucuuaggggagagcuuu

SEQ ID NO: 2237241 - RNA, 14 nt, Human
uguuaaucaauuua

SEQ ID NO: 2237242 - RNA, 17 nt, Human
uguuaaucaauuuaaac

SEQ ID NO: 2237243 - RNA, 20 nt, Human
uguuaaucaauuuaaaccca

SEQ ID NO: 2237244 - RNA, 22 nt, Human
uguuaaucaauuuaaacccauu

SEQ ID NO: 2237245 - RNA, 19 nt, Human
uguuaaugauagcuacugu

SEQ ID NO: 2237246 - RNA, 19 nt, Human
aguggaaaaauagccugcc

SEQ ID NO: 2237247 - RNA, 18 nt, Human
aguggaaaaauagccugc

SEQ ID NO: 2237248 - RNA, 13 nt, Human
agugcuuuguaau

SEQ ID NO: 2237249 - RNA, 20 nt, Human
uguuaauggugcaaauccua

SEQ ID NO: 2237250 - RNA, 19 nt, Human
agugcuuuccuuuuuuaaa

SEQ ID NO: 2237251 - RNA, 22 nt, Human
agugcuuuccuuuuuuaaaaau

SEQ ID NO: 2237252 - RNA, 11 nt, Human
aguggaaaaau

SEQ ID NO: 2237253 - RNA, 19 nt, Human
ugugucuaggcaggaccug

SEQ ID NO: 2237254 - RNA, 13 nt, Human
ugugucuacagag

SEQ ID NO: 2237255 - RNA, 14 nt, Human
ugugucuacagaga

SEQ ID NO: 2237256 - RNA, 21 nt, Human
ugugucuacagagaaccugga

SEQ ID NO: 2237257 - RNA, 13 nt, Human
ugugucucuuggu

SEQ ID NO: 2237258 - RNA, 20 nt, Human
ugugucuaggcaggaccugu

SEQ ID NO: 2237259 - RNA, 16 nt, Human
ugugucucuugguccu

SEQ ID NO: 2237260 - RNA, 11 nt, Human
ugugugugugu

SEQ ID NO: 2237261 - RNA, 14 nt, Human
ugugugugugcgug

SEQ ID NO: 2237262 - RNA, 12 nt, Human
ugugugugugca

SEQ ID NO: 2237263 - RNA, 11 nt, Human
ugugugugugc

SEQ ID NO: 2237264 - RNA, 17 nt, Human
ugugucagguggggcag

SEQ ID NO: 2237265 - RNA, 19 nt, Human
ugugucagguggggcagcu

SEQ ID NO: 2237266 - RNA, 14 nt, Human
ugugguuuauguca

SEQ ID NO: 2237267 - RNA, 15 nt, Human
uguguguguguauga

SEQ ID NO: 2237268 - RNA, 12 nt, Human
ugugugugugug

SEQ ID NO: 2237269 - RNA, 13 nt, Human
ugugugugugugu

SEQ ID NO: 2237270 - RNA, 15 nt, Human
ugugugugugugucc

SEQ ID NO: 2237271 - RNA, 23 nt, Human
uguguuaucacccagaagaaaau

SEQ ID NO: 2237272 - RNA, 16 nt, Human
uguguguguguaugug

SEQ ID NO: 2237273 - RNA, 13 nt, Human
uguguguguguau

SEQ ID NO: 2237274 - RNA, 14 nt, Human
uguguuaugaagca

SEQ ID NO: 2237275 - RNA, 16 nt, Human
uguguuauuuaaauga

SEQ ID NO: 2237276 - RNA, 14 nt, Human
uguguuauuuaaau

SEQ ID NO: 2237277 - RNA, 13 nt, Human
uguguuauuuaaa

SEQ ID NO: 2237278 - RNA, 16 nt, Human
uguguuccaaccacug

SEQ ID NO: 2237279 - RNA, 15 nt, Human
uguguuccaaccacu

SEQ ID NO: 2237280 - RNA, 16 nt, Human
uguguucccauuucag

SEQ ID NO: 2237281 - RNA, 19 nt, Human
uguguuccaacugccccca

SEQ ID NO: 2237282 - RNA, 13 nt, Human
uguguugccaagc

SEQ ID NO: 2237283 - RNA, 20 nt, Human
ugugguuaaugccauggaca

SEQ ID NO: 2237284 - RNA, 15 nt, Human
ugugguuaaugccau

SEQ ID NO: 2237285 - RNA, 23 nt, Human
ugugguggguucuuuggaaggag

SEQ ID NO: 2237286 - RNA, 17 nt, Human
ugugguuauuucucuga

SEQ ID NO: 2237287 - RNA, 18 nt, Human
ugugguuuacuagcagga

SEQ ID NO: 2237288 - RNA, 12 nt, Human
ugugguuucauu

SEQ ID NO: 2237289 - RNA, 19 nt, Human
ugugucagcauagaaguaa

SEQ ID NO: 2237290 - RNA, 14 nt, Human
ugugguuaaugcca

SEQ ID NO: 2237291 - RNA, 13 nt, Human
uguggugcugaca

SEQ ID NO: 2237292 - RNA, 22 nt, Human
ugugguggguucuuuggaagga

SEQ ID NO: 2237293 - RNA, 17 nt, Human
uguggugcagugugaaa

SEQ ID NO: 2237294 - RNA, 16 nt, Human
uguggugcagugugaa

SEQ ID NO: 2237295 - RNA, 17 nt, Human
uguggucuccuuggaaa

SEQ ID NO: 2237296 - RNA, 15 nt, Human
uguggugccugaggu

SEQ ID NO: 2237297 - RNA, 19 nt, Human
uguggugccugaggucugu

SEQ ID NO: 2237298 - RNA, 16 nt, Human
uguggugcugacaaag

SEQ ID NO: 2237299 - RNA, 13 nt, Human
uguggugaugaaa

SEQ ID NO: 2237300 - RNA, 13 nt, Human
uguggucuccacu

SEQ ID NO: 2237301 - RNA, 21 nt, Human
agugcuucuuaaagaguucuu

SEQ ID NO: 2237302 - RNA, 14 nt, Human
agugcuucucuaca

SEQ ID NO: 2237303 - RNA, 16 nt, Human
agugcuuccaaggcag

SEQ ID NO: 2237304 - RNA, 17 nt, Human
agugcuuccaaggcaga

SEQ ID NO: 2237305 - RNA, 20 nt, Human
agugcuucagccugaggcug

SEQ ID NO: 2237306 - RNA, 19 nt, Human
agugcuucagccugaggcu

SEQ ID NO: 2237307 - RNA, 19 nt, Human
agugcuugaguuuggggaa

SEQ ID NO: 2237308 - RNA, 15 nt, Human
agugcuugccacaga

SEQ ID NO: 2237309 - RNA, 16 nt, Human
agugcuugccacagag

SEQ ID NO: 2237310 - RNA, 17 nt, Human
agugcuugccacagagc

SEQ ID NO: 2237311 - RNA, 19 nt, Human
agugcuugccacagagcgg

SEQ ID NO: 2237312 - RNA, 18 nt, Human
agugcuucagccugaggc

SEQ ID NO: 2237313 - RNA, 17 nt, Human
agugcuucagccugagg

SEQ ID NO: 2237314 - RNA, 16 nt, Human
agugcuucagccugag

SEQ ID NO: 2237315 - RNA, 15 nt, Human
agugcuucagccuga

SEQ ID NO: 2237316 - RNA, 16 nt, Human
agugcuuccaaggaug

SEQ ID NO: 2237317 - RNA, 16 nt, Human
uguggucccaccccac

SEQ ID NO: 2237318 - RNA, 17 nt, Human
agugcugggauuacagg

SEQ ID NO: 2237319 - RNA, 20 nt, Human
agugcugggauuacaggcgu

SEQ ID NO: 2237320 - RNA, 19 nt, Human
agugcugggauuacaggug

SEQ ID NO: 2237321 - RNA, 14 nt, Human
agugcuucagccug

SEQ ID NO: 2237322 - RNA, 19 nt, Human
agugcuuaaaaaucauuga

SEQ ID NO: 2237323 - RNA, 17 nt, Human
agugcuuaaaaaucauu

SEQ ID NO: 2237324 - RNA, 16 nt, Human
agugcuuaaaaaucau

SEQ ID NO: 2237325 - RNA, 20 nt, Human
agugcugggauuacaggcau

SEQ ID NO: 2237326 - RNA, 19 nt, Human
agugcugggauuacaggcu

SEQ ID NO: 2237327 - RNA, 22 nt, Human
agugcugggauuacaggcauga

SEQ ID NO: 2237328 - RNA, 22 nt, Human
agugccugggaauguauuauuc

SEQ ID NO: 2237329 - RNA, 20 nt, Human
agugccuuaauaguagggua

SEQ ID NO: 2237330 - RNA, 18 nt, Human
agugccugggaauguauu

SEQ ID NO: 2237331 - RNA, 17 nt, Human
agugccugggaauguau

SEQ ID NO: 2237332 - RNA, 15 nt, Human
agugcugcugaagau

SEQ ID NO: 2237333 - RNA, 22 nt, Human
agugcugcauuuaaaagauaca

SEQ ID NO: 2237334 - RNA, 20 nt, Human
agugcugggauuacaagcgu

SEQ ID NO: 2237335 - RNA, 13 nt, Human
agugccugggaau

SEQ ID NO: 2237336 - RNA, 18 nt, Human
agugccucuuucauccac

SEQ ID NO: 2237337 - RNA, 12 nt, Human
agugccugcuga

SEQ ID NO: 2237338 - RNA, 12 nt, Human
agugccucuggu

SEQ ID NO: 2237339 - RNA, 14 nt, Human
agugccucuggucu

SEQ ID NO: 2237340 - RNA, 23 nt, Human
agugccgccgccucgcccaccgc

SEQ ID NO: 2237341 - RNA, 16 nt, Human
agugccgccgccucgc

SEQ ID NO: 2237342 - RNA, 17 nt, Human
agugccgccgccucgcc

SEQ ID NO: 2237343 - RNA, 19 nt, Human
agugccgccgccucgccca

SEQ ID NO: 2237344 - RNA, 20 nt, Human
agugccgccgccucgcccac

SEQ ID NO: 2237345 - RNA, 22 nt, Human
agugccgccgccucgcccaccg

SEQ ID NO: 2237346 - RNA, 20 nt, Human
agugcugcauuuaaaagaua

SEQ ID NO: 2237347 - RNA, 17 nt, Human
agugccuuacacaaugg

SEQ ID NO: 2237348 - RNA, 15 nt, Human
agugccuuacacaau

SEQ ID NO: 2237349 - RNA, 21 nt, Human
agugccuguaaucacagcuac

SEQ ID NO: 2237350 - RNA, 20 nt, Human
aguccagaaacuguucccac

SEQ ID NO: 2237351 - RNA, 16 nt, Human
agucagggaccccugc

SEQ ID NO: 2237352 - RNA, 14 nt, Human
agucaggggcagcu

SEQ ID NO: 2237353 - RNA, 19 nt, Human
agucagggaccccugcccu

SEQ ID NO: 2237354 - RNA, 22 nt, Human
agucaggccuuaauuuucagua

SEQ ID NO: 2237355 - RNA, 11 nt, Human
agucaggauga

SEQ ID NO: 2237356 - RNA, 12 nt, Human
agucaggaaagg

SEQ ID NO: 2237357 - RNA, 22 nt, Human
agucagaggauggccagugucu

SEQ ID NO: 2237358 - RNA, 12 nt, Human
aguccaggcccc

SEQ ID NO: 2237359 - RNA, 19 nt, Human
aguccaggccauggaggca

SEQ ID NO: 2237360 - RNA, 13 nt, Human
aguccagccugga

SEQ ID NO: 2237361 - RNA, 22 nt, Human
aguccaggaugcuaacaucuaa

SEQ ID NO: 2237362 - RNA, 17 nt, Human
agucaggggcagcugac

SEQ ID NO: 2237363 - RNA, 15 nt, Human
aguccagauuuacac

SEQ ID NO: 2237364 - RNA, 16 nt, Human
aguccagauuuacacu

SEQ ID NO: 2237365 - RNA, 18 nt, Human
aguccagauuuacacugg

SEQ ID NO: 2237366 - RNA, 22 nt, Human
aguccagauuuacacugggaga

SEQ ID NO: 2237367 - RNA, 23 nt, Human
aguccagauuuacacugggagag

SEQ ID NO: 2237368 - RNA, 15 nt, Human
aguccagccuggaga

SEQ ID NO: 2237369 - RNA, 15 nt, Human
agucccgucaggacg

SEQ ID NO: 2237370 - RNA, 15 nt, Human
agucccuauguauuu

SEQ ID NO: 2237371 - RNA, 23 nt, Human
aguccaggccccaaaaccacagc

SEQ ID NO: 2237372 - RNA, 13 nt, Human
agucccgucagga

SEQ ID NO: 2237373 - RNA, 19 nt, Human
agucccugacucucuguga

SEQ ID NO: 2237374 - RNA, 20 nt, Human
agucccuauguauuugcagu

SEQ ID NO: 2237375 - RNA, 20 nt, Human
agucccugaggcaggucccc

SEQ ID NO: 2237376 - RNA, 19 nt, Human
agucccugaggcagguccc

SEQ ID NO: 2237377 - RNA, 18 nt, Human
aguccaggccccaaaacc

SEQ ID NO: 2237378 - RNA, 13 nt, Human
aguccaggcccca

SEQ ID NO: 2237379 - RNA, 14 nt, Human
aguccaggcugccg

SEQ ID NO: 2237380 - RNA, 17 nt, Human
aguccaggcugccgugg

SEQ ID NO: 2237381 - RNA, 18 nt, Human
aguccaggcugccguggg

SEQ ID NO: 2237382 - RNA, 22 nt, Human
aguccaggcuuuuuuaucaugu

SEQ ID NO: 2237383 - RNA, 21 nt, Human
agucccugacucucugugacc

SEQ ID NO: 2237384 - RNA, 12 nt, Human
agucccugccaa

SEQ ID NO: 2237385 - RNA, 23 nt, Human
agucccugaggcagguccccaga

SEQ ID NO: 2237386 - RNA, 22 nt, Human
agucccugaggcagguccccag

SEQ ID NO: 2237387 - RNA, 22 nt, Human
agucccugggggaagcccugga

SEQ ID NO: 2237388 - RNA, 17 nt, Human
agucccuguuuucugag

SEQ ID NO: 2237389 - RNA, 18 nt, Human
agucccuguuuucugagc

SEQ ID NO: 2237390 - RNA, 19 nt, Human
agucccuguuuucugagcc

SEQ ID NO: 2237391 - RNA, 20 nt, Human
agucccuguuuucugagccc

SEQ ID NO: 2237392 - RNA, 21 nt, Human
agucccuguuuucugagcccg

SEQ ID NO: 2237393 - RNA, 22 nt, Human
agucccuguuuucugagcccgg

SEQ ID NO: 2237394 - RNA, 15 nt, Human
agucccuuccacacc

SEQ ID NO: 2237395 - RNA, 13 nt, Human
agucccuguuuuc

SEQ ID NO: 2237396 - RNA, 23 nt, Human
agucccuguaauuguuguuugua

SEQ ID NO: 2237397 - RNA, 20 nt, Human
agucccuguaauuguuguuu

SEQ ID NO: 2237398 - RNA, 21 nt, Human
agucccugggggaagcccugg

SEQ ID NO: 2237399 - RNA, 20 nt, Human
agucccugggggaagcccug

SEQ ID NO: 2237400 - RNA, 17 nt, Human
agucccugggggaagcc

SEQ ID NO: 2237401 - RNA, 14 nt, Human
agucccugggggaa

SEQ ID NO: 2237402 - RNA, 18 nt, Human
agucccuguaauuguugu

SEQ ID NO: 2237403 - RNA, 16 nt, Human
agucccuguaauuguu

SEQ ID NO: 2237404 - RNA, 22 nt, Human
agucccuuccccucccuggcuc

SEQ ID NO: 2237405 - RNA, 21 nt, Human
agucccuuccccucccuggcu

SEQ ID NO: 2237406 - RNA, 20 nt, Human
agucccuuccccucccuggc

SEQ ID NO: 2237407 - RNA, 19 nt, Human
agucccuuccccucccugg

SEQ ID NO: 2237408 - RNA, 17 nt, Human
agucccuuccccucccu

SEQ ID NO: 2237409 - RNA, 15 nt, Human
agucccuuccccucc

SEQ ID NO: 2237410 - RNA, 14 nt, Human
agucccuuccccuc

SEQ ID NO: 2237411 - RNA, 13 nt, Human
agucccuuccccu

SEQ ID NO: 2237412 - RNA, 23 nt, Human
aguccgaaagggacuuggaagcu

SEQ ID NO: 2237413 - RNA, 23 nt, Human
agucccuuccccucccuggcucc

SEQ ID NO: 2237414 - RNA, 19 nt, Human
agucccuuccacaccccca

SEQ ID NO: 2237415 - RNA, 17 nt, Human
aguccgaggggcgggac

SEQ ID NO: 2237416 - RNA, 20 nt, Human
aguccgugcugacagcugcu

SEQ ID NO: 2237417 - RNA, 21 nt, Human
aguccgugcugacagcugcuc

SEQ ID NO: 2237418 - RNA, 23 nt, Human
aguccgugcugacagcugcuccu

SEQ ID NO: 2237419 - RNA, 22 nt, Human
aguccgugcugacagcugcucc

SEQ ID NO: 2237420 - RNA, 18 nt, Human
agucgugagcucuuguga

SEQ ID NO: 2237421 - RNA, 18 nt, Human
agucgucgcacagucucu

SEQ ID NO: 2237422 - RNA, 21 nt, Human
agucgugagcucuugugagga

SEQ ID NO: 2237423 - RNA, 12 nt, Human
agucgugccugu

SEQ ID NO: 2237424 - RNA, 13 nt, Human
agucgugccugug

SEQ ID NO: 2237425 - RNA, 14 nt, Human
agucgugccugugu

SEQ ID NO: 2237426 - RNA, 15 nt, Human
agucgugccuguguc

SEQ ID NO: 2237427 - RNA, 18 nt, Human
agucguggagaugucuuc

SEQ ID NO: 2237428 - RNA, 17 nt, Human
agucguggggugugcug

SEQ ID NO: 2237429 - RNA, 19 nt, Human
agucguggagaugucuucg

SEQ ID NO: 2237430 - RNA, 21 nt, Human
agucguggagaugucuucgua

SEQ ID NO: 2237431 - RNA, 16 nt, Human
agucucacuguugccc

SEQ ID NO: 2237432 - RNA, 17 nt, Human
agucucacuguugccca

SEQ ID NO: 2237433 - RNA, 16 nt, Human
agucuaggagcuggga

SEQ ID NO: 2237434 - RNA, 20 nt, Human
agucuagauggcuccucuca

SEQ ID NO: 2237435 - RNA, 19 nt, Human
agucuagauggcuccucuc

SEQ ID NO: 2237436 - RNA, 18 nt, Human
agucuagauggcuccucu

SEQ ID NO: 2237437 - RNA, 17 nt, Human
agucuagauggcuccuc

SEQ ID NO: 2237438 - RNA, 19 nt, Human
agucuacucuuaagccauc

SEQ ID NO: 2237439 - RNA, 20 nt, Human
agucuacucuuaagccaucu

SEQ ID NO: 2237440 - RNA, 21 nt, Human
agucuacucuuaagccaucuu

SEQ ID NO: 2237441 - RNA, 14 nt, Human
agucuagaaguugu

SEQ ID NO: 2237442 - RNA, 18 nt, Human
agucguggggugugcugg

SEQ ID NO: 2237443 - RNA, 19 nt, Human
agucguggggugugcuggg

SEQ ID NO: 2237444 - RNA, 20 nt, Human
agucguggggugugcuggga

SEQ ID NO: 2237445 - RNA, 21 nt, Human
agucguggggugugcugggag

SEQ ID NO: 2237446 - RNA, 14 nt, Human
agucguugugaggg

SEQ ID NO: 2237447 - RNA, 20 nt, Human
agucuacgcucuccuuucuu

SEQ ID NO: 2237448 - RNA, 13 nt, Human
agucuacucuuaa

SEQ ID NO: 2237449 - RNA, 18 nt, Human
agucuacucuuaagccau

SEQ ID NO: 2237450 - RNA, 13 nt, Human
ugucuaaaacaau

SEQ ID NO: 2237451 - RNA, 17 nt, Human
ugucuaaaacaauaaaa

SEQ ID NO: 2237452 - RNA, 15 nt, Human
ugucuaaaacaauaa

SEQ ID NO: 2237453 - RNA, 17 nt, Human
ugucuaaacaaugcuga

SEQ ID NO: 2237454 - RNA, 16 nt, Human
ugucuaaacaaugcug

SEQ ID NO: 2237455 - RNA, 13 nt, Human
ugucuaaaaacac

SEQ ID NO: 2237456 - RNA, 20 nt, Human
ugucguugacuuuagggacu

SEQ ID NO: 2237457 - RNA, 22 nt, Human
ugucguugacuuuagggacuca

SEQ ID NO: 2237458 - RNA, 15 nt, Human
agucagacugcuggg

SEQ ID NO: 2237459 - RNA, 22 nt, Human
ugucuaaacaaugcugauuugg

SEQ ID NO: 2237460 - RNA, 22 nt, Human
ugucuaaaaugccucaguguau

SEQ ID NO: 2237461 - RNA, 16 nt, Human
agucagacagaugugg

SEQ ID NO: 2237462 - RNA, 22 nt, Human
agucagaaguuucugccgcagc

SEQ ID NO: 2237463 - RNA, 21 nt, Human
ugucuaaacaaugcugauuug

SEQ ID NO: 2237464 - RNA, 20 nt, Human
ugucuaaacaaugcugauuu

SEQ ID NO: 2237465 - RNA, 14 nt, Human
agucagagagaauc

SEQ ID NO: 2237466 - RNA, 17 nt, Human
agucagagagaguguuu

SEQ ID NO: 2237467 - RNA, 14 nt, Human
agucagaggauggc

SEQ ID NO: 2237468 - RNA, 17 nt, Human
agucagaggauggccag

SEQ ID NO: 2237469 - RNA, 18 nt, Human
agucagaggauggccagu

SEQ ID NO: 2237470 - RNA, 19 nt, Human
agucagaggauggccagug

SEQ ID NO: 2237471 - RNA, 20 nt, Human
agucagaggauggccagugu

SEQ ID NO: 2237472 - RNA, 16 nt, Human
agucaggaaagagaac

SEQ ID NO: 2237473 - RNA, 15 nt, Human
agucaggaaagagaa

SEQ ID NO: 2237474 - RNA, 21 nt, Human
ugucguggguguguguagcca

SEQ ID NO: 2237475 - RNA, 23 nt, Human
ugucguagccaaggugggcugag

SEQ ID NO: 2237476 - RNA, 23 nt, Human
ugucgguuuuuuuuaaauaaaag

SEQ ID NO: 2237477 - RNA, 19 nt, Human
ugucggccugguguucugu

SEQ ID NO: 2237478 - RNA, 14 nt, Human
ugucgggcaugaca

SEQ ID NO: 2237479 - RNA, 15 nt, Human
ugucgggcaugacac

SEQ ID NO: 2237480 - RNA, 23 nt, Human
ugucggccucuaaccccaggccc

SEQ ID NO: 2237481 - RNA, 12 nt, Human
ugucgggcauga

SEQ ID NO: 2237482 - RNA, 14 nt, Human
ugucgcccagucug

SEQ ID NO: 2237483 - RNA, 15 nt, Human
ugucgcccagucugg

SEQ ID NO: 2237484 - RNA, 18 nt, Human
ugucauuuuugcaguaga

SEQ ID NO: 2237485 - RNA, 15 nt, Human
ugucauuuucuccau

SEQ ID NO: 2237486 - RNA, 15 nt, Human
ugucauuuuugcagu

SEQ ID NO: 2237487 - RNA, 14 nt, Human
ugucauuuucucca

SEQ ID NO: 2237488 - RNA, 12 nt, Human
ugucauuugcuu

SEQ ID NO: 2237489 - RNA, 17 nt, Human
ugucccuuuuccuuuuu

SEQ ID NO: 2237490 - RNA, 15 nt, Human
uguccgacucuucug

SEQ ID NO: 2237491 - RNA, 15 nt, Human
uguccgcuggguggu

SEQ ID NO: 2237492 - RNA, 20 nt, Human
uguccgcugggugguacccu

SEQ ID NO: 2237493 - RNA, 22 nt, Human
uguccuaaaacaccugguagga

SEQ ID NO: 2237494 - RNA, 22 nt, Human
uguccgcugggugguacccucu

SEQ ID NO: 2237495 - RNA, 23 nt, Human
uguccgcugggugguacccucug

SEQ ID NO: 2237496 - RNA, 14 nt, Human
uguccgagcuuuga

SEQ ID NO: 2237497 - RNA, 13 nt, Human
uguccgagcuuug

SEQ ID NO: 2237498 - RNA, 18 nt, Human
uguccuuucccuccacuc

SEQ ID NO: 2237499 - RNA, 17 nt, Human
uguccuuucccuccacu

SEQ ID NO: 2237500 - RNA, 13 nt, Human
uguccuuucccuu

SEQ ID NO: 2237501 - RNA, 14 nt, Human
uguccuuucccuuc

SEQ ID NO: 2237502 - RNA, 16 nt, Human
uguccuacccacccuc

SEQ ID NO: 2237503 - RNA, 15 nt, Human
uguccuaaggacaca

SEQ ID NO: 2237504 - RNA, 16 nt, Human
uguccuaaggacacac

SEQ ID NO: 2237505 - RNA, 18 nt, Human
uguccuaaggacacacua

SEQ ID NO: 2237506 - RNA, 20 nt, Human
uguccuaaggacacacuaau

SEQ ID NO: 2237507 - RNA, 16 nt, Human
uguccuuuuuguuauu

SEQ ID NO: 2237508 - RNA, 23 nt, Human
uguccuuucccuucaguacccuc

SEQ ID NO: 2237509 - RNA, 17 nt, Human
uguccuuuuuguuauua

SEQ ID NO: 2237510 - RNA, 21 nt, Human
ugucgaauuuuuauuauuugu

SEQ ID NO: 2237511 - RNA, 22 nt, Human
ugucgauguaggcauucuggag

SEQ ID NO: 2237512 - RNA, 13 nt, Human
ugucgagacacuu

SEQ ID NO: 2237513 - RNA, 15 nt, Human
ugucgagacacuugc

SEQ ID NO: 2237514 - RNA, 16 nt, Human
ugucgcccaggcugga

SEQ ID NO: 2237515 - RNA, 15 nt, Human
ugucgcccaggcugg

SEQ ID NO: 2237516 - RNA, 16 nt, Human
uguauuuuuuuacuaa

SEQ ID NO: 2237517 - RNA, 14 nt, Human
ugucaagaaagagc

SEQ ID NO: 2237518 - RNA, 19 nt, Human
ugucaagaagaugaucaga

SEQ ID NO: 2237519 - RNA, 14 nt, Human
uguauuuuuuuacu

SEQ ID NO: 2237520 - RNA, 14 nt, Human
uguauuuuuaaugg

SEQ ID NO: 2237521 - RNA, 19 nt, Human
uguauuuuucaauaaagca

SEQ ID NO: 2237522 - RNA, 21 nt, Human
ugucaauaaaauccauacauu

SEQ ID NO: 2237523 - RNA, 15 nt, Human
ugucaagccauaauu

SEQ ID NO: 2237524 - RNA, 19 nt, Human
ugucaagagggucugagga

SEQ ID NO: 2237525 - RNA, 15 nt, Human
uguaguaaagaaauu

SEQ ID NO: 2237526 - RNA, 13 nt, Human
uguaguaaagaaa

SEQ ID NO: 2237527 - RNA, 19 nt, Human
uguaguaaagccguuguuu

SEQ ID NO: 2237528 - RNA, 20 nt, Human
uguaguaaagccguuguuua

SEQ ID NO: 2237529 - RNA, 19 nt, Human
uguaguaaacuauuuaucu

SEQ ID NO: 2237530 - RNA, 22 nt, Human
uguaguaaagccguuguuuacu

SEQ ID NO: 2237531 - RNA, 16 nt, Human
uguauuauucugcagc

SEQ ID NO: 2237532 - RNA, 16 nt, Human
uguaguaauugacaug

SEQ ID NO: 2237533 - RNA, 15 nt, Human
uguaguaauugacau

SEQ ID NO: 2237534 - RNA, 14 nt, Human
uguaguaauugaca

SEQ ID NO: 2237535 - RNA, 17 nt, Human
uguauucagugaggguc

SEQ ID NO: 2237536 - RNA, 14 nt, Human
uguauucagcuuua

SEQ ID NO: 2237537 - RNA, 17 nt, Human
uguauucaucuuuugua

SEQ ID NO: 2237538 - RNA, 21 nt, Human
uguauucacccguccagaccu

SEQ ID NO: 2237539 - RNA, 21 nt, Human
uguauuauuucauuauguaaa

SEQ ID NO: 2237540 - RNA, 13 nt, Human
uguauuauuucau

SEQ ID NO: 2237541 - RNA, 20 nt, Human
uguauuauuucauuauguaa

SEQ ID NO: 2237542 - RNA, 22 nt, Human
uguauucauugaagucagaugu

SEQ ID NO: 2237543 - RNA, 21 nt, Human
uguauuccaagacaugucugu

SEQ ID NO: 2237544 - RNA, 20 nt, Human
uguauuccaagacaugucug

SEQ ID NO: 2237545 - RNA, 15 nt, Human
uguauuccaagacau

SEQ ID NO: 2237546 - RNA, 13 nt, Human
uguauuccaagac

SEQ ID NO: 2237547 - RNA, 20 nt, Human
aguagcuugggacaaaucaa

SEQ ID NO: 2237548 - RNA, 13 nt, Human
aguaggagcccag

SEQ ID NO: 2237549 - RNA, 13 nt, Human
aguagucauuuca

SEQ ID NO: 2237550 - RNA, 12 nt, Human
aguagucauuuc

SEQ ID NO: 2237551 - RNA, 14 nt, Human
aguagucauuucau

SEQ ID NO: 2237552 - RNA, 13 nt, Human
aguagggggucua

SEQ ID NO: 2237553 - RNA, 13 nt, Human
aguagucucugug

SEQ ID NO: 2237554 - RNA, 14 nt, Human
aguaguccugugaa

SEQ ID NO: 2237555 - RNA, 12 nt, Human
aguaguccugug

SEQ ID NO: 2237556 - RNA, 13 nt, Human
aguaguccuguga

SEQ ID NO: 2237557 - RNA, 15 nt, Human
aguaguuaauucugu

SEQ ID NO: 2237558 - RNA, 14 nt, Human
aguaguuaauucug

SEQ ID NO: 2237559 - RNA, 14 nt, Human
aguaguuccugcua

SEQ ID NO: 2237560 - RNA, 13 nt, Human
ugucaauauuaaa

SEQ ID NO: 2237561 - RNA, 14 nt, Human
ugucaauauuaaau

SEQ ID NO: 2237562 - RNA, 17 nt, Human
ugucaauauuaaauaca

SEQ ID NO: 2237563 - RNA, 18 nt, Human
ugucaauauuaaauacag

SEQ ID NO: 2237564 - RNA, 19 nt, Human
ugucaauauuaaauacaga

SEQ ID NO: 2237565 - RNA, 21 nt, Human
ugucaauauuaaauacagaca

SEQ ID NO: 2237566 - RNA, 23 nt, Human
ugucaauauuaaauacagacacu

SEQ ID NO: 2237567 - RNA, 20 nt, Human
ugucaaucagccuaguugau

SEQ ID NO: 2237568 - RNA, 17 nt, Human
ugucaauauuuaaacau

SEQ ID NO: 2237569 - RNA, 16 nt, Human
aguaggaagacuuugg

SEQ ID NO: 2237570 - RNA, 17 nt, Human
aguaggaagacuuugga

SEQ ID NO: 2237571 - RNA, 18 nt, Human
aguaggaagacuuuggaa

SEQ ID NO: 2237572 - RNA, 19 nt, Human
aguaggaagacuuuggaaa

SEQ ID NO: 2237573 - RNA, 22 nt, Human
aguaggaagacuuuggaaagac

SEQ ID NO: 2237574 - RNA, 22 nt, Human
ugucaggggcggggagggugac

SEQ ID NO: 2237575 - RNA, 20 nt, Human
ugucaggcugcuggcgccuc

SEQ ID NO: 2237576 - RNA, 22 nt, Human
ugucaggcugcuggcgccucug

SEQ ID NO: 2237577 - RNA, 23 nt, Human
ugucaggcugcuggcgccucugc

SEQ ID NO: 2237578 - RNA, 24 nt, Human
ugucaggcugcuggcgccucugca

SEQ ID NO: 2237579 - RNA, 16 nt, Human
ugucagguggggcagc

SEQ ID NO: 2237580 - RNA, 21 nt, Human
ugucaggccugacggggagga

SEQ ID NO: 2237581 - RNA, 14 nt, Human
ugucaggccugugu

SEQ ID NO: 2237582 - RNA, 15 nt, Human
ugucaggcugcuggc

SEQ ID NO: 2237583 - RNA, 16 nt, Human
ugucaggcugcuggcg

SEQ ID NO: 2237584 - RNA, 17 nt, Human
ugucaggcugcuggcgc

SEQ ID NO: 2237585 - RNA, 19 nt, Human
ugucaggcugcuggcgccu

SEQ ID NO: 2237586 - RNA, 23 nt, Human
ugucauuugcuggagcucugccc

SEQ ID NO: 2237587 - RNA, 20 nt, Human
ugucaguaucuguaucucuc

SEQ ID NO: 2237588 - RNA, 22 nt, Human
ugucaguauguggaaguguggg

SEQ ID NO: 2237589 - RNA, 20 nt, Human
ugucaguaccuucaaacuag

SEQ ID NO: 2237590 - RNA, 18 nt, Human
ugucaguauguggaagug

SEQ ID NO: 2237591 - RNA, 20 nt, Human
ugucaguauguggaagugug

SEQ ID NO: 2237592 - RNA, 19 nt, Human
ugucaguauguggaagugu

SEQ ID NO: 2237593 - RNA, 16 nt, Human
ugucagcugaaccugg

SEQ ID NO: 2237594 - RNA, 13 nt, Human
agucacugcacag

SEQ ID NO: 2237595 - RNA, 19 nt, Human
agucacugagacagcccgg

SEQ ID NO: 2237596 - RNA, 18 nt, Human
agucacugagacagcccg

SEQ ID NO: 2237597 - RNA, 20 nt, Human
agucacugccucucccuggc

SEQ ID NO: 2237598 - RNA, 17 nt, Human
agucacugccucucccu

SEQ ID NO: 2237599 - RNA, 14 nt, Human
agucacugccucuc

SEQ ID NO: 2237600 - RNA, 11 nt, Human
agucacugccu

SEQ ID NO: 2237601 - RNA, 19 nt, Human
ugucagcugaaccugggua

SEQ ID NO: 2237602 - RNA, 17 nt, Human
ugucaggaacagaagga

SEQ ID NO: 2237603 - RNA, 16 nt, Human
ugucaggaacagaagg

SEQ ID NO: 2237604 - RNA, 18 nt, Human
ugucagcuuuugcuucau

SEQ ID NO: 2237605 - RNA, 20 nt, Human
ugucaggaacagaaggauga

SEQ ID NO: 2237606 - RNA, 18 nt, Human
ugucaggaacagaaggau

SEQ ID NO: 2237607 - RNA, 17 nt, Human
ugucaggaagaaaucac

SEQ ID NO: 2237608 - RNA, 14 nt, Human
ugucaggagagcag

SEQ ID NO: 2237609 - RNA, 16 nt, Human
ugucaggagagcagcg

SEQ ID NO: 2237610 - RNA, 16 nt, Human
aguauuugcauauucu

SEQ ID NO: 2237611 - RNA, 17 nt, Human
aguauuugggaagugaa

SEQ ID NO: 2237612 - RNA, 16 nt, Human
aguauuugagaguucu

SEQ ID NO: 2237613 - RNA, 23 nt, Human
aguauuugaaacugaauguuuau

SEQ ID NO: 2237614 - RNA, 13 nt, Human
aguauuucccagc

SEQ ID NO: 2237615 - RNA, 22 nt, Human
aguauuucuaugaaauauuaug

SEQ ID NO: 2237616 - RNA, 13 nt, Human
agucaccaagccc

SEQ ID NO: 2237617 - RNA, 14 nt, Human
agucaccaagccca

SEQ ID NO: 2237618 - RNA, 21 nt, Human
aguauuugggaagugaagacu

SEQ ID NO: 2237619 - RNA, 19 nt, Human
aguauguggaagugugggu

SEQ ID NO: 2237620 - RNA, 23 nt, Human
aguaugugggcagauuuucagca

SEQ ID NO: 2237621 - RNA, 20 nt, Human
aguauuucaaauuggagcuu

SEQ ID NO: 2237622 - RNA, 21 nt, Human
aguauguaaaguauguaaaca

SEQ ID NO: 2237623 - RNA, 14 nt, Human
aguauguguaaaau

SEQ ID NO: 2237624 - RNA, 16 nt, Human
aguauuucaugcuggg

SEQ ID NO: 2237625 - RNA, 13 nt, Human
aguauuucuauga

SEQ ID NO: 2237626 - RNA, 15 nt, Human
aguauuucuaugaaa

SEQ ID NO: 2237627 - RNA, 17 nt, Human
aguauguggaagugugg

SEQ ID NO: 2237628 - RNA, 15 nt, Human
aguauguggaagugu

SEQ ID NO: 2237629 - RNA, 18 nt, Human
aguauaaaugguugucug

SEQ ID NO: 2237630 - RNA, 15 nt, Human
aguauguaaaguaug

SEQ ID NO: 2237631 - RNA, 16 nt, Human
aguauguaaaguaugu

SEQ ID NO: 2237632 - RNA, 12 nt, Human
aguaguuuguau

SEQ ID NO: 2237633 - RNA, 17 nt, Human
aguaguuuguauaacuu

SEQ ID NO: 2237634 - RNA, 19 nt, Human
aguauaaacaaaguuacua

SEQ ID NO: 2237635 - RNA, 17 nt, Human
aguauaaacaaaguuac

SEQ ID NO: 2237636 - RNA, 16 nt, Human
aguauaaacaaaguua

SEQ ID NO: 2237637 - RNA, 13 nt, Human
aguauaaacaaag

SEQ ID NO: 2237638 - RNA, 13 nt, Human
aguauaaaaacaa

SEQ ID NO: 2237639 - RNA, 22 nt, Human
uguaaauccuuuuucuuuauaa

SEQ ID NO: 2237640 - RNA, 20 nt, Human
uguaaauccuuuuucuuuau

SEQ ID NO: 2237641 - RNA, 15 nt, Human
aggugcacaagcucc

SEQ ID NO: 2237642 - RNA, 19 nt, Human
uguaaauccuuuuucuuua

SEQ ID NO: 2237643 - RNA, 12 nt, Human
uguaaauccuuu

SEQ ID NO: 2237644 - RNA, 19 nt, Human
aggucuuuugacaugugga

SEQ ID NO: 2237645 - RNA, 16 nt, Human
aggugcacaagcucca

SEQ ID NO: 2237646 - RNA, 17 nt, Human
aggugcacaagcuccaa

SEQ ID NO: 2237647 - RNA, 18 nt, Human
aggugcacaagcuccaag

SEQ ID NO: 2237648 - RNA, 20 nt, Human
aggugcacaagcuccaagcu

SEQ ID NO: 2237649 - RNA, 18 nt, Human
aggucuuuugacaugugg

SEQ ID NO: 2237650 - RNA, 16 nt, Human
aggucuuuugacaugu

SEQ ID NO: 2237651 - RNA, 15 nt, Human
aggucuuuugacaug

SEQ ID NO: 2237652 - RNA, 14 nt, Human
aggucuuuugacau

SEQ ID NO: 2237653 - RNA, 19 nt, Human
aggucuuggagcugagccu

SEQ ID NO: 2237654 - RNA, 21 nt, Human
aggucuuggagcugagccucu

SEQ ID NO: 2237655 - RNA, 22 nt, Human
aggucuuggagcugagccucuc

SEQ ID NO: 2237656 - RNA, 11 nt, Human
aggucuuuccu

SEQ ID NO: 2237657 - RNA, 18 nt, Human
aggucuuugguucagcua

SEQ ID NO: 2237658 - RNA, 14 nt, Human
aggucccaggcaga

SEQ ID NO: 2237659 - RNA, 18 nt, Human
agguccccagcuuuggcu

SEQ ID NO: 2237660 - RNA, 23 nt, Human
aggucuugaacuccuggccucaa

SEQ ID NO: 2237661 - RNA, 10 nt, Human
aggucccuaa

SEQ ID NO: 2237662 - RNA, 17 nt, Human
agguccccagcuuuggc

SEQ ID NO: 2237663 - RNA, 11 nt, Human
agguccccaga

SEQ ID NO: 2237664 - RNA, 18 nt, Human
agguggccaugccucagc

SEQ ID NO: 2237665 - RNA, 19 nt, Human
agguggccaugccucagcc

SEQ ID NO: 2237666 - RNA, 23 nt, Human
agguggccucuccuuguggccug

SEQ ID NO: 2237667 - RNA, 20 nt, Human
agguggcugacccagucccu

SEQ ID NO: 2237668 - RNA, 19 nt, Human
agguggcucuccaguuagu

SEQ ID NO: 2237669 - RNA, 19 nt, Human
agguggcugacccaguccc

SEQ ID NO: 2237670 - RNA, 17 nt, Human
agguggcuauggccacc

SEQ ID NO: 2237671 - RNA, 14 nt, Human
agguggcucuccag

SEQ ID NO: 2237672 - RNA, 15 nt, Human
agguggcucuccagu

SEQ ID NO: 2237673 - RNA, 17 nt, Human
agguggcucuccaguua

SEQ ID NO: 2237674 - RNA, 22 nt, Human
agguggcugacccagucccugg

SEQ ID NO: 2237675 - RNA, 21 nt, Human
agguggcugacccagucccug

SEQ ID NO: 2237676 - RNA, 22 nt, Human
aggugggcaggugguggcacug

SEQ ID NO: 2237677 - RNA, 13 nt, Human
aggugggcaggug

SEQ ID NO: 2237678 - RNA, 20 nt, Human
aggugggauccuccaggugc

SEQ ID NO: 2237679 - RNA, 23 nt, Human
agguggucugaauguucugacau

SEQ ID NO: 2237680 - RNA, 22 nt, Human
agguggucugaauguucugaca

SEQ ID NO: 2237681 - RNA, 20 nt, Human
agguggucugcucgggccca

SEQ ID NO: 2237682 - RNA, 21 nt, Human
agguggucugcucgggcccag

SEQ ID NO: 2237683 - RNA, 21 nt, Human
agguggucugaauguucugac

SEQ ID NO: 2237684 - RNA, 20 nt, Human
agguggucugaauguucuga

SEQ ID NO: 2237685 - RNA, 19 nt, Human
agguggucugaauguucug

SEQ ID NO: 2237686 - RNA, 23 nt, Human
aggugggccgcaggcgggaaaag

SEQ ID NO: 2237687 - RNA, 22 nt, Human
agguggucugcucgggcccagg

SEQ ID NO: 2237688 - RNA, 15 nt, Human
agguggugcuuacau

SEQ ID NO: 2237689 - RNA, 19 nt, Human
aggugguggcacugagccc

SEQ ID NO: 2237690 - RNA, 20 nt, Human
aggugguggcacugagcccc

SEQ ID NO: 2237691 - RNA, 22 nt, Human
aggugggccagccccucccacc

SEQ ID NO: 2237692 - RNA, 21 nt, Human
aggugggccagccccucccac

SEQ ID NO: 2237693 - RNA, 19 nt, Human
aggugggccagccccuccc

SEQ ID NO: 2237694 - RNA, 18 nt, Human
aggugggccagccccucc

SEQ ID NO: 2237695 - RNA, 17 nt, Human
aggugggccagccccuc

SEQ ID NO: 2237696 - RNA, 16 nt, Human
aggugggccagccccu

SEQ ID NO: 2237697 - RNA, 15 nt, Human
aggugggccagcccc

SEQ ID NO: 2237698 - RNA, 14 nt, Human
aggugggccagccc

SEQ ID NO: 2237699 - RNA, 23 nt, Human
aggugggcccaggaccagcuggg

SEQ ID NO: 2237700 - RNA, 18 nt, Human
aggugggcccaggaccag

SEQ ID NO: 2237701 - RNA, 22 nt, Human
aggugggcccaggaccagcugg

SEQ ID NO: 2237702 - RNA, 12 nt, Human
aggugggcccag

SEQ ID NO: 2237703 - RNA, 13 nt, Human
aggugggcccagg

SEQ ID NO: 2237704 - RNA, 14 nt, Human
aggugggcccagga

SEQ ID NO: 2237705 - RNA, 16 nt, Human
aggugggcccaggacc

SEQ ID NO: 2237706 - RNA, 16 nt, Human
aggugcaguggcucac

SEQ ID NO: 2237707 - RNA, 11 nt, Human
aggugcagugg

SEQ ID NO: 2237708 - RNA, 12 nt, Human
agguggccaugc

SEQ ID NO: 2237709 - RNA, 17 nt, Human
agguggccacuccagac

SEQ ID NO: 2237710 - RNA, 14 nt, Human
agguggccacucca

SEQ ID NO: 2237711 - RNA, 15 nt, Human
agguggcaucucuaa

SEQ ID NO: 2237712 - RNA, 16 nt, Human
aggugcaguuccccca

SEQ ID NO: 2237713 - RNA, 23 nt, Human
aggugcaguucccccaaccucag

SEQ ID NO: 2237714 - RNA, 20 nt, Human
aggugcagagugcccagaac

SEQ ID NO: 2237715 - RNA, 19 nt, Human
aggugcagagugcccagaa

SEQ ID NO: 2237716 - RNA, 18 nt, Human
aggugcagagugcccaga

SEQ ID NO: 2237717 - RNA, 17 nt, Human
aggugcagagugcccag

SEQ ID NO: 2237718 - RNA, 23 nt, Human
aggugcacagacgucccuccacg

SEQ ID NO: 2237719 - RNA, 22 nt, Human
aggugcacagacgucccuccac

SEQ ID NO: 2237720 - RNA, 21 nt, Human
aggugcacaagcuccaagcuc

SEQ ID NO: 2237721 - RNA, 17 nt, Human
agguuguaaauguguuu

SEQ ID NO: 2237722 - RNA, 17 nt, Human
uguaacuuucugaaaua

SEQ ID NO: 2237723 - RNA, 14 nt, Human
agguuggugggggc

SEQ ID NO: 2237724 - RNA, 17 nt, Human
agguuguaguaaagaaa

SEQ ID NO: 2237725 - RNA, 19 nt, Human
agguugggguguacuaguu

SEQ ID NO: 2237726 - RNA, 19 nt, Human
uguaagaagagacugggaa

SEQ ID NO: 2237727 - RNA, 20 nt, Human
uguaagacaaagguuuuccu

SEQ ID NO: 2237728 - RNA, 21 nt, Human
uguaagaagagacugggaaga

SEQ ID NO: 2237729 - RNA, 17 nt, Human
uguaagaagagacuggg

SEQ ID NO: 2237730 - RNA, 19 nt, Human
uguaagacaauccauguaa

SEQ ID NO: 2237731 - RNA, 21 nt, Human
uguaagacaaagguuuuccuc

SEQ ID NO: 2237732 - RNA, 18 nt, Human
uguaagagcaccuuccuc

SEQ ID NO: 2237733 - RNA, 19 nt, Human
uguaagaacuacaaacaaa

SEQ ID NO: 2237734 - RNA, 20 nt, Human
uguaacuuuuguaagacaaa

SEQ ID NO: 2237735 - RNA, 17 nt, Human
uguaacuuucucuauga

SEQ ID NO: 2237736 - RNA, 18 nt, Human
uguaacuuucucuaugaa

SEQ ID NO: 2237737 - RNA, 16 nt, Human
uguaacuuuuguaaga

SEQ ID NO: 2237738 - RNA, 15 nt, Human
uguaacuuuuguaag

SEQ ID NO: 2237739 - RNA, 12 nt, Human
agguugcaggga

SEQ ID NO: 2237740 - RNA, 18 nt, Human
agguugcagggagccgag

SEQ ID NO: 2237741 - RNA, 16 nt, Human
agguugaucagaucug

SEQ ID NO: 2237742 - RNA, 20 nt, Human
agguugauaacuuugcuugc

SEQ ID NO: 2237743 - RNA, 16 nt, Human
agguugauaacuuugc

SEQ ID NO: 2237744 - RNA, 17 nt, Human
agguugauaacuuugcu

SEQ ID NO: 2237745 - RNA, 18 nt, Human
agguugauaacuuugcuu

SEQ ID NO: 2237746 - RNA, 19 nt, Human
agguugauaacuuugcuug

SEQ ID NO: 2237747 - RNA, 22 nt, Human
agguugggaaugaggcuugcug

SEQ ID NO: 2237748 - RNA, 20 nt, Human
agguugggaaugaggcuugc

SEQ ID NO: 2237749 - RNA, 16 nt, Human
agguugggguguacua

SEQ ID NO: 2237750 - RNA, 22 nt, Human
agguugggccauacuggccucg

SEQ ID NO: 2237751 - RNA, 20 nt, Human
agguugggccauacuggccu

SEQ ID NO: 2237752 - RNA, 21 nt, Human
agguugggccauacuggccuc

SEQ ID NO: 2237753 - RNA, 23 nt, Human
agguugggagaaugucaguaugu

SEQ ID NO: 2237754 - RNA, 20 nt, Human
agguugaggggcuccuggaa

SEQ ID NO: 2237755 - RNA, 17 nt, Human
agguugaggggcuccug

SEQ ID NO: 2237756 - RNA, 17 nt, Human
agguugagcucuucuua

SEQ ID NO: 2237757 - RNA, 24 nt, Human
agguugagcucuucuuaaaguauu

SEQ ID NO: 2237758 - RNA, 11 nt, Human
agguugauaac

SEQ ID NO: 2237759 - RNA, 12 nt, Human
agguugauaacu

SEQ ID NO: 2237760 - RNA, 14 nt, Human
agguugauaacuuu

SEQ ID NO: 2237761 - RNA, 15 nt, Human
agguugauaacuuug

SEQ ID NO: 2237762 - RNA, 17 nt, Human
aggugguuauggagagg

SEQ ID NO: 2237763 - RNA, 21 nt, Human
agguugacaauaaaugugcuu

SEQ ID NO: 2237764 - RNA, 19 nt, Human
uguaagaucguucucugcc

SEQ ID NO: 2237765 - RNA, 20 nt, Human
uguaagaucguucucugccu

SEQ ID NO: 2237766 - RNA, 15 nt, Human
uguaagaguguagaa

SEQ ID NO: 2237767 - RNA, 19 nt, Human
uguaagagcaccuuccuca

SEQ ID NO: 2237768 - RNA, 22 nt, Human
uguaagagcaccuuccucacuu

SEQ ID NO: 2237769 - RNA, 18 nt, Human
uguaagaguguagaagca

SEQ ID NO: 2237770 - RNA, 19 nt, Human
uguaagaguguagaagcau

SEQ ID NO: 2237771 - RNA, 20 nt, Human
uguaagaguguagaagcauu

SEQ ID NO: 2237772 - RNA, 21 nt, Human
uguaagaguguagaagcauuc

SEQ ID NO: 2237773 - RNA, 12 nt, Human
uguaagaugcug

SEQ ID NO: 2237774 - RNA, 14 nt, Human
uguaagaugcuggg

SEQ ID NO: 2237775 - RNA, 15 nt, Human
uguaagaugcugggu

SEQ ID NO: 2237776 - RNA, 17 nt, Human
uguaagaugcuggguug

SEQ ID NO: 2237777 - RNA, 14 nt, Human
uguaaguaauuauc

SEQ ID NO: 2237778 - RNA, 21 nt, Human
uguaagugugaguaagagcug

SEQ ID NO: 2237779 - RNA, 17 nt, Human
uguaagugugaguaaga

SEQ ID NO: 2237780 - RNA, 14 nt, Human
uguaagugugagua

SEQ ID NO: 2237781 - RNA, 12 nt, Human
uguaagugugag

SEQ ID NO: 2237782 - RNA, 15 nt, Human
uguaagugugugugu

SEQ ID NO: 2237783 - RNA, 23 nt, Human
uguaauuaaguacuauguaucaa

SEQ ID NO: 2237784 - RNA, 20 nt, Human
uguaaguuuaccuauguaac

SEQ ID NO: 2237785 - RNA, 19 nt, Human
uguaaguuuaugucuaaag

SEQ ID NO: 2237786 - RNA, 20 nt, Human
uguaaguuuaugucuaaaga

SEQ ID NO: 2237787 - RNA, 13 nt, Human
uguaaguuucagg

SEQ ID NO: 2237788 - RNA, 19 nt, Human
uguaauuguuguuuguaug

SEQ ID NO: 2237789 - RNA, 17 nt, Human
uguaauuguuguuugua

SEQ ID NO: 2237790 - RNA, 11 nt, Human
uguaauuauug

SEQ ID NO: 2237791 - RNA, 12 nt, Human
uguaauuauugu

SEQ ID NO: 2237792 - RNA, 14 nt, Human
uguaauuauuguga

SEQ ID NO: 2237793 - RNA, 20 nt, Human
uguaauuuaaaauugugaug

SEQ ID NO: 2237794 - RNA, 18 nt, Human
uguaauuuaaaauuguga

SEQ ID NO: 2237795 - RNA, 23 nt, Human
uguaauuguuguuuguauguaua

SEQ ID NO: 2237796 - RNA, 20 nt, Human
uguaauuguuguuuguaugu

SEQ ID NO: 2237797 - RNA, 17 nt, Human
uguaauuuaaaauugug

SEQ ID NO: 2237798 - RNA, 18 nt, Human
uguagaggagaaacugga

SEQ ID NO: 2237799 - RNA, 14 nt, Human
uguagagugggagc

SEQ ID NO: 2237800 - RNA, 13 nt, Human
uguagagugggag

SEQ ID NO: 2237801 - RNA, 13 nt, Human
uguacuuugugcu

SEQ ID NO: 2237802 - RNA, 12 nt, Human
uguaccauguac

SEQ ID NO: 2237803 - RNA, 17 nt, Human
uguaccauguacaugaa

SEQ ID NO: 2237804 - RNA, 16 nt, Human
uguacuuuuaaggcag

SEQ ID NO: 2237805 - RNA, 15 nt, Human
uguacuuuuuccaga

SEQ ID NO: 2237806 - RNA, 21 nt, Human
uguaccaugaaacaaagcugc

SEQ ID NO: 2237807 - RNA, 20 nt, Human
uguaccagcccagauguuuu

SEQ ID NO: 2237808 - RNA, 17 nt, Human
uguaccagcccagaugu

SEQ ID NO: 2237809 - RNA, 23 nt, Human
uguaauuucuuugccuguucagu

SEQ ID NO: 2237810 - RNA, 21 nt, Human
uguaauuucuuugccuguuca

SEQ ID NO: 2237811 - RNA, 22 nt, Human
uguaauuuaaacaggcccagca

SEQ ID NO: 2237812 - RNA, 23 nt, Human
uguaauuuaaacaggcccagcau

SEQ ID NO: 2237813 - RNA, 18 nt, Human
uguaauuucuuugccugu

SEQ ID NO: 2237814 - RNA, 14 nt, Human
uguaauuugugaua

SEQ ID NO: 2237815 - RNA, 22 nt, Human
uguaauuuaaaauugugaugug

SEQ ID NO: 2237816 - RNA, 21 nt, Human
uguaauuuaaaauugugaugu

SEQ ID NO: 2237817 - RNA, 19 nt, Human
uguaauuguuugucuuuaa

SEQ ID NO: 2237818 - RNA, 15 nt, Human
uguaauuguuugucu

SEQ ID NO: 2237819 - RNA, 14 nt, Human
uguaauuuaaacag

SEQ ID NO: 2237820 - RNA, 15 nt, Human
uguaauuuaaacagg

SEQ ID NO: 2237821 - RNA, 16 nt, Human
uguaauuuaaacaggc

SEQ ID NO: 2237822 - RNA, 19 nt, Human
uguaauuuaaacaggccca

SEQ ID NO: 2237823 - RNA, 20 nt, Human
uguaauuuaaacaggcccag

SEQ ID NO: 2237824 - RNA, 21 nt, Human
uguaauuuaaacaggcccagc

SEQ ID NO: 2237825 - RNA, 19 nt, Human
aguaaaaauacaaaaauua

SEQ ID NO: 2237826 - RNA, 15 nt, Human
aguaaaaauuaaaaa

SEQ ID NO: 2237827 - RNA, 23 nt, Human
aguaaggaauuuuauuuuuuucu

SEQ ID NO: 2237828 - RNA, 12 nt, Human
aguaaggcugug

SEQ ID NO: 2237829 - RNA, 13 nt, Human
aguaaggcugugu

SEQ ID NO: 2237830 - RNA, 18 nt, Human
aguaagcugcucuauugu

SEQ ID NO: 2237831 - RNA, 20 nt, Human
aguaagcugcucuauuguag

SEQ ID NO: 2237832 - RNA, 16 nt, Human
aguaagggaaauagaa

SEQ ID NO: 2237833 - RNA, 17 nt, Human
aguaagggaaauagaaa

SEQ ID NO: 2237834 - RNA, 14 nt, Human
aguaaggugcaguu

SEQ ID NO: 2237835 - RNA, 17 nt, Human
aguaaguaccacucagg

SEQ ID NO: 2237836 - RNA, 18 nt, Human
aguaauauuuauauauuu

SEQ ID NO: 2237837 - RNA, 17 nt, Human
aguaauaugcacacauu

SEQ ID NO: 2237838 - RNA, 20 nt, Human
aguaauaugcacacauuuuu

SEQ ID NO: 2237839 - RNA, 19 nt, Human
aguaauaugcacacauuuu

SEQ ID NO: 2237840 - RNA, 18 nt, Human
aguaauaugcacacauuu

SEQ ID NO: 2237841 - RNA, 13 nt, Human
aguaaaaauacaa

SEQ ID NO: 2237842 - RNA, 12 nt, Human
aguaaaaauaca

SEQ ID NO: 2237843 - RNA, 15 nt, Human
aguaaaaauaaaauu

SEQ ID NO: 2237844 - RNA, 12 nt, Human
aguaaaaauaaa

SEQ ID NO: 2237845 - RNA, 14 nt, Human
agguuuuuaagccu

SEQ ID NO: 2237846 - RNA, 20 nt, Human
aguaagccgugauuuucauu

SEQ ID NO: 2237847 - RNA, 15 nt, Human
aguaaaaccacagca

SEQ ID NO: 2237848 - RNA, 15 nt, Human
agguuuuguaaagau

SEQ ID NO: 2237849 - RNA, 13 nt, Human
agguuuuguacaa

SEQ ID NO: 2237850 - RNA, 13 nt, Human
agguuuuguaaag

SEQ ID NO: 2237851 - RNA, 12 nt, Human
agguuuuguugu

SEQ ID NO: 2237852 - RNA, 17 nt, Human
agguuuuguuguuuuau

SEQ ID NO: 2237853 - RNA, 16 nt, Human
agguuuuguuugcuau

SEQ ID NO: 2237854 - RNA, 17 nt, Human
agguuuuguuugcuauc

SEQ ID NO: 2237855 - RNA, 18 nt, Human
agguuuuguuugcuaucu

SEQ ID NO: 2237856 - RNA, 19 nt, Human
agguuuuguuugcuaucuu

SEQ ID NO: 2237857 - RNA, 22 nt, Human
agguuuuguuugcuaucuuaau

SEQ ID NO: 2237858 - RNA, 23 nt, Human
agguuuuguuugcuaucuuaauu

SEQ ID NO: 2237859 - RNA, 14 nt, Human
agguuuucuccacu

SEQ ID NO: 2237860 - RNA, 14 nt, Human
uguagagggcccug

SEQ ID NO: 2237861 - RNA, 13 nt, Human
agguuuucuccac

SEQ ID NO: 2237862 - RNA, 22 nt, Human
agguuuuccucuucuauuuugu

SEQ ID NO: 2237863 - RNA, 11 nt, Human
agguuuuccug

SEQ ID NO: 2237864 - RNA, 20 nt, Human
aguagaaagacagagcuggg

SEQ ID NO: 2237865 - RNA, 21 nt, Human
aguagaaagacagagcuggga

SEQ ID NO: 2237866 - RNA, 14 nt, Human
aguagaaaggccuu

SEQ ID NO: 2237867 - RNA, 15 nt, Human
aguagaaaggccuuu

SEQ ID NO: 2237868 - RNA, 16 nt, Human
aguagaaaggccuuua

SEQ ID NO: 2237869 - RNA, 17 nt, Human
aguagaaaggccuuuaa

SEQ ID NO: 2237870 - RNA, 19 nt, Human
aguacuuuuggcauuuuac

SEQ ID NO: 2237871 - RNA, 19 nt, Human
aguacuuuggaggccccua

SEQ ID NO: 2237872 - RNA, 17 nt, Human
aguacuuuggaggcccc

SEQ ID NO: 2237873 - RNA, 22 nt, Human
aguacuuuggaggccccuaugu

SEQ ID NO: 2237874 - RNA, 14 nt, Human
aguacacuguuuca

SEQ ID NO: 2237875 - RNA, 20 nt, Human
aguacacuguuucaaacuuu

SEQ ID NO: 2237876 - RNA, 16 nt, Human
aguacacuguuucaaa

SEQ ID NO: 2237877 - RNA, 19 nt, Human
aguacaccacaagggucac

SEQ ID NO: 2237878 - RNA, 22 nt, Human
aguaaucccgccaccuaucucg

SEQ ID NO: 2237879 - RNA, 15 nt, Human
aguaauuugaggaca

SEQ ID NO: 2237880 - RNA, 15 nt, Human
aguaauuuguagauu

SEQ ID NO: 2237881 - RNA, 14 nt, Human
aguaauccaccugc

SEQ ID NO: 2237882 - RNA, 14 nt, Human
aguaaucccgccac

SEQ ID NO: 2237883 - RNA, 17 nt, Human
aguaaucccgccaccua

SEQ ID NO: 2237884 - RNA, 19 nt, Human
aguaaucccgccaccuauc

SEQ ID NO: 2237885 - RNA, 21 nt, Human
aguaauccaagcaaaugugaa

SEQ ID NO: 2237886 - RNA, 19 nt, Human
aguaaguaccacucaggcc

SEQ ID NO: 2237887 - RNA, 15 nt, Human
aguaauccaagcaaa

SEQ ID NO: 2237888 - RNA, 17 nt, Human
uguagguaugaauaagu

SEQ ID NO: 2237889 - RNA, 22 nt, Human
uguaggagcugccuuggcucag

SEQ ID NO: 2237890 - RNA, 19 nt, Human
uguaggugucugcacccag

SEQ ID NO: 2237891 - RNA, 20 nt, Human
uguaggugucugcacccagg

SEQ ID NO: 2237892 - RNA, 15 nt, Human
uguaggagcugccuu

SEQ ID NO: 2237893 - RNA, 12 nt, Human
uguaggagcugc

SEQ ID NO: 2237894 - RNA, 11 nt, Human
uguaggagaau

SEQ ID NO: 2237895 - RNA, 23 nt, Human
uguaggaauucuuuuggggaagu

SEQ ID NO: 2237896 - RNA, 21 nt, Human
aguagauggugaaauuuauua

SEQ ID NO: 2237897 - RNA, 20 nt, Human
uguaggaauucuuuugggga

SEQ ID NO: 2237898 - RNA, 21 nt, Human
uguaggaauucuuuuggggaa

SEQ ID NO: 2237899 - RNA, 20 nt, Human
uguaggaagguuaauguuca

SEQ ID NO: 2237900 - RNA, 17 nt, Human
aguagagucaucuccau

SEQ ID NO: 2237901 - RNA, 19 nt, Human
aguagauaggccaugggca

SEQ ID NO: 2237902 - RNA, 18 nt, Human
uguaggaagguuaauguu

SEQ ID NO: 2237903 - RNA, 15 nt, Human
aguagauggugaaau

SEQ ID NO: 2237904 - RNA, 16 nt, Human
aguagauggugaaauu

SEQ ID NO: 2237905 - RNA, 17 nt, Human
aguagauggugaaauuu

SEQ ID NO: 2237906 - RNA, 17 nt, Human
aguagaagucuuagaug

SEQ ID NO: 2237907 - RNA, 15 nt, Human
aguagaggcuuagag

SEQ ID NO: 2237908 - RNA, 21 nt, Human
aguagaaggucggaggcuugg

SEQ ID NO: 2237909 - RNA, 23 nt, Human
aguagagucaucuccaucagcug

SEQ ID NO: 2237910 - RNA, 16 nt, Human
aguagagucaucucca

SEQ ID NO: 2237911 - RNA, 14 nt, Human
aguagagucaucuc

SEQ ID NO: 2237912 - RNA, 19 nt, Human
aguagaaauaauaugcauu

SEQ ID NO: 2237913 - RNA, 18 nt, Human
aguagaaauaauaugcau

SEQ ID NO: 2237914 - RNA, 18 nt, Human
aguagaaaggccuuuaaa

SEQ ID NO: 2237915 - RNA, 13 nt, Human
aguagaacagaua

SEQ ID NO: 2237916 - RNA, 19 nt, Human
aguagaacagauaaucagu

SEQ ID NO: 2237917 - RNA, 12 nt, Human
aguagagacagg

SEQ ID NO: 2237918 - RNA, 20 nt, Human
aguagaagauuugaugcugg

SEQ ID NO: 2237919 - RNA, 16 nt, Human
aguagaaggucggagg

SEQ ID NO: 2237920 - RNA, 19 nt, Human
ugggcuggcucccucuugg

SEQ ID NO: 2237921 - RNA, 19 nt, Human
ugggcuggcaguccuggaa

SEQ ID NO: 2237922 - RNA, 16 nt, Human
ugggcugcuccucaug

SEQ ID NO: 2237923 - RNA, 15 nt, Human
ugggcugcuccucau

SEQ ID NO: 2237924 - RNA, 18 nt, Human
ugggcuggaaucaggaau

SEQ ID NO: 2237925 - RNA, 18 nt, Human
ugggcuggaacagauuca

SEQ ID NO: 2237926 - RNA, 18 nt, Human
ugggcuggguucuaccca

SEQ ID NO: 2237927 - RNA, 19 nt, Human
ugggcuggguucuacccag

SEQ ID NO: 2237928 - RNA, 18 nt, Human
uggggaagcuucuuaaau

SEQ ID NO: 2237929 - RNA, 13 nt, Human
uggggaaggaggc

SEQ ID NO: 2237930 - RNA, 16 nt, Human
uggggaagugaggaag

SEQ ID NO: 2237931 - RNA, 17 nt, Human
uggggaagacuguggcu

SEQ ID NO: 2237932 - RNA, 16 nt, Human
uggggaagacuguggc

SEQ ID NO: 2237933 - RNA, 24 nt, Human
uggggaagacuguggcugcuagca

SEQ ID NO: 2237934 - RNA, 14 nt, Human
uggggaagacugug

SEQ ID NO: 2237935 - RNA, 20 nt, Human
ugggcugggugcgaccccau

SEQ ID NO: 2237936 - RNA, 18 nt, Human
ugggcuggggccugaugg

SEQ ID NO: 2237937 - RNA, 17 nt, Human
uggggacagagcagaac

SEQ ID NO: 2237938 - RNA, 14 nt, Human
uggggaauuuccuc

SEQ ID NO: 2237939 - RNA, 16 nt, Human
uggggaauuuccucua

SEQ ID NO: 2237940 - RNA, 13 nt, Human
uggggacagggcu

SEQ ID NO: 2237941 - RNA, 22 nt, Human
uggggacaggggcaggaggaag

SEQ ID NO: 2237942 - RNA, 20 nt, Human
uggggacaggggcaggagga

SEQ ID NO: 2237943 - RNA, 14 nt, Human
uggggaccagagcu

SEQ ID NO: 2237944 - RNA, 15 nt, Human
uggggaccagagcug

SEQ ID NO: 2237945 - RNA, 18 nt, Human
uggggacaucucuuugaa

SEQ ID NO: 2237946 - RNA, 20 nt, Human
uggggacaucucuuugaauu

SEQ ID NO: 2237947 - RNA, 13 nt, Human
uggggaccucagg

SEQ ID NO: 2237948 - RNA, 17 nt, Human
uggggaccagagcugcc

SEQ ID NO: 2237949 - RNA, 18 nt, Human
uggggaccagagcugcca

SEQ ID NO: 2237950 - RNA, 12 nt, Human
ugggcugagccc

SEQ ID NO: 2237951 - RNA, 23 nt, Human
ugggcugagacuggauacugccc

SEQ ID NO: 2237952 - RNA, 15 nt, Human
ugggcugagacugga

SEQ ID NO: 2237953 - RNA, 14 nt, Human
ugggcugagacugg

SEQ ID NO: 2237954 - RNA, 18 nt, Human
ugggcugacggugcaguc

SEQ ID NO: 2237955 - RNA, 21 nt, Human
ugggcucugugggcugcacuc

SEQ ID NO: 2237956 - RNA, 19 nt, Human
ugggcugaacacuccaauu

SEQ ID NO: 2237957 - RNA, 17 nt, Human
ugggcugaacacuccaa

SEQ ID NO: 2237958 - RNA, 18 nt, Human
ugggcucugugcagucac

SEQ ID NO: 2237959 - RNA, 17 nt, Human
ugggcucugugggcugc

SEQ ID NO: 2237960 - RNA, 20 nt, Human
ugggcucccuucccaccucu

SEQ ID NO: 2237961 - RNA, 16 nt, Human
ugggcucugggagcag

SEQ ID NO: 2237962 - RNA, 12 nt, Human
ugggcucugugc

SEQ ID NO: 2237963 - RNA, 17 nt, Human
ugggcucugugcaguca

SEQ ID NO: 2237964 - RNA, 16 nt, Human
ugggcugagcccuggc

SEQ ID NO: 2237965 - RNA, 15 nt, Human
ugggcugagcccugg

SEQ ID NO: 2237966 - RNA, 14 nt, Human
ugggcugagccccu

SEQ ID NO: 2237967 - RNA, 17 nt, Human
ugggcugagccccuacc

SEQ ID NO: 2237968 - RNA, 18 nt, Human
ugggcugagccccuaccc

SEQ ID NO: 2237969 - RNA, 19 nt, Human
ugggcugagccccuacccc

SEQ ID NO: 2237970 - RNA, 18 nt, Human
ugggcugagcccuggcag

SEQ ID NO: 2237971 - RNA, 17 nt, Human
ugggcugagcccuggca

SEQ ID NO: 2237972 - RNA, 17 nt, Human
ugggcugcccuggugcu

SEQ ID NO: 2237973 - RNA, 19 nt, Human
ugggcugcccuggugcugc

SEQ ID NO: 2237974 - RNA, 20 nt, Human
ugggcugcccuggugcugcc

SEQ ID NO: 2237975 - RNA, 17 nt, Human
ugggcugcuacccagaa

SEQ ID NO: 2237976 - RNA, 16 nt, Human
ugggcugcccuggugc

SEQ ID NO: 2237977 - RNA, 21 nt, Human
ugggcugcccuggugcugcca

SEQ ID NO: 2237978 - RNA, 15 nt, Human
agggccugagccugg

SEQ ID NO: 2237979 - RNA, 20 nt, Human
agggccucaaaggcccgcuc

SEQ ID NO: 2237980 - RNA, 20 nt, Human
agggccuagcugcuacaaag

SEQ ID NO: 2237981 - RNA, 21 nt, Human
agggccuagcugcuacaaaga

SEQ ID NO: 2237982 - RNA, 17 nt, Human
agggccguaccccaccc

SEQ ID NO: 2237983 - RNA, 18 nt, Human
agggccguaccccacccu

SEQ ID NO: 2237984 - RNA, 19 nt, Human
agggccguaccccacccuc

SEQ ID NO: 2237985 - RNA, 20 nt, Human
agggccguaccccacccuca

SEQ ID NO: 2237986 - RNA, 15 nt, Human
agggccuagcugcua

SEQ ID NO: 2237987 - RNA, 16 nt, Human
agggccuagcugcuac

SEQ ID NO: 2237988 - RNA, 18 nt, Human
agggccuagcugcuacaa

SEQ ID NO: 2237989 - RNA, 19 nt, Human
agggccuagcugcuacaaa

SEQ ID NO: 2237990 - RNA, 23 nt, Human
agggcuucugccauuucugagau

SEQ ID NO: 2237991 - RNA, 12 nt, Human
agggcuuccucu

SEQ ID NO: 2237992 - RNA, 20 nt, Human
agggcuuccucuagaagcca

SEQ ID NO: 2237993 - RNA, 21 nt, Human
agggcuuccucuagaagccaa

SEQ ID NO: 2237994 - RNA, 22 nt, Human
agggcuuccucuagaagccaag

SEQ ID NO: 2237995 - RNA, 13 nt, Human
agggcuucugcac

SEQ ID NO: 2237996 - RNA, 14 nt, Human
agggcuucugcacc

SEQ ID NO: 2237997 - RNA, 15 nt, Human
agggcuucugcaccc

SEQ ID NO: 2237998 - RNA, 16 nt, Human
agggcuucugcacccu

SEQ ID NO: 2237999 - RNA, 17 nt, Human
agggcuucugcacccuc

SEQ ID NO: 2238000 - RNA, 18 nt, Human
agggcuucugcacccucc

SEQ ID NO: 2238001 - RNA, 19 nt, Human
agggcuucugcacccucca

SEQ ID NO: 2238002 - RNA, 22 nt, Human
agggcuucugcacccuccaccc

SEQ ID NO: 2238003 - RNA, 18 nt, Human
ugggcucccuucccaccu

SEQ ID NO: 2238004 - RNA, 19 nt, Human
ugggcucccuucccaccuc

SEQ ID NO: 2238005 - RNA, 13 nt, Human
uggggagugggac

SEQ ID NO: 2238006 - RNA, 19 nt, Human
uggggaguaggacauacca

SEQ ID NO: 2238007 - RNA, 19 nt, Human
uggggagugggacagaguc

SEQ ID NO: 2238008 - RNA, 16 nt, Human
uggggagugggacaga

SEQ ID NO: 2238009 - RNA, 16 nt, Human
uggggaguuaagaccu

SEQ ID NO: 2238010 - RNA, 20 nt, Human
uggggaguuaagaccuggca

SEQ ID NO: 2238011 - RNA, 19 nt, Human
uggggaguuaagaccuggc

SEQ ID NO: 2238012 - RNA, 18 nt, Human
uggggaguuaagaccugg

SEQ ID NO: 2238013 - RNA, 17 nt, Human
uggggaguuaagaccug

SEQ ID NO: 2238014 - RNA, 14 nt, Human
uggggcccugccuc

SEQ ID NO: 2238015 - RNA, 20 nt, Human
uggggacguccugccaccug

SEQ ID NO: 2238016 - RNA, 22 nt, Human
uggggacggggggccccaguca

SEQ ID NO: 2238017 - RNA, 19 nt, Human
uggggacggggggccccag

SEQ ID NO: 2238018 - RNA, 20 nt, Human
uggggacggggggccccagu

SEQ ID NO: 2238019 - RNA, 18 nt, Human
uggggaccugguacccuc

SEQ ID NO: 2238020 - RNA, 23 nt, Human
uggggaccucaggccugggggcu

SEQ ID NO: 2238021 - RNA, 12 nt, Human
uggggagaaagu

SEQ ID NO: 2238022 - RNA, 21 nt, Human
uggggacguccugccaccugg

SEQ ID NO: 2238023 - RNA, 15 nt, Human
uggggaggggcugug

SEQ ID NO: 2238024 - RNA, 18 nt, Human
uggggccuagauccacac

SEQ ID NO: 2238025 - RNA, 19 nt, Human
uggggccgccgccucuuuc

SEQ ID NO: 2238026 - RNA, 12 nt, Human
uggggccuuggu

SEQ ID NO: 2238027 - RNA, 13 nt, Human
uggggcgaggcag

SEQ ID NO: 2238028 - RNA, 14 nt, Human
uggggcgaggcaga

SEQ ID NO: 2238029 - RNA, 18 nt, Human
uggggccuacagcuuuga

SEQ ID NO: 2238030 - RNA, 14 nt, Human
uggggccuuggccu

SEQ ID NO: 2238031 - RNA, 15 nt, Human
uggggcccugccucc

SEQ ID NO: 2238032 - RNA, 16 nt, Human
uggggcccugccuccu

SEQ ID NO: 2238033 - RNA, 15 nt, Human
uggggcucugugcag

SEQ ID NO: 2238034 - RNA, 13 nt, Human
uggggcucuggga

SEQ ID NO: 2238035 - RNA, 13 nt, Human
uggggcucucagu

SEQ ID NO: 2238036 - RNA, 23 nt, Human
uggggcuaggaaauccagggugg

SEQ ID NO: 2238037 - RNA, 19 nt, Human
uggggcguggggagggccg

SEQ ID NO: 2238038 - RNA, 18 nt, Human
uggggcggugagagggga

SEQ ID NO: 2238039 - RNA, 15 nt, Human
uggggcgaggcagag

SEQ ID NO: 2238040 - RNA, 17 nt, Human
uggggcgaggcagagga

SEQ ID NO: 2238041 - RNA, 19 nt, Human
uggggcgaggcagaggaca

SEQ ID NO: 2238042 - RNA, 18 nt, Human
uggggcgaggcagaggac

SEQ ID NO: 2238043 - RNA, 17 nt, Human
uggggcgggaaagccag

SEQ ID NO: 2238044 - RNA, 19 nt, Human
uggggcgggaaagccagug

SEQ ID NO: 2238045 - RNA, 14 nt, Human
uggggcguggggag

SEQ ID NO: 2238046 - RNA, 16 nt, Human
ugggguagggcugacu

SEQ ID NO: 2238047 - RNA, 13 nt, Human
ugggguagggcug

SEQ ID NO: 2238048 - RNA, 15 nt, Human
ugggguagguuggga

SEQ ID NO: 2238049 - RNA, 15 nt, Human
ugggguaugggagag

SEQ ID NO: 2238050 - RNA, 21 nt, Human
ugggguagguugggagaaugu

SEQ ID NO: 2238051 - RNA, 17 nt, Human
uggggucacucuggcag

SEQ ID NO: 2238052 - RNA, 18 nt, Human
uggggucacucuggcagc

SEQ ID NO: 2238053 - RNA, 15 nt, Human
ugggguacccacugc

SEQ ID NO: 2238054 - RNA, 16 nt, Human
ugggguacccacugcu

SEQ ID NO: 2238055 - RNA, 20 nt, Human
ugggguagcuagaggaacca

SEQ ID NO: 2238056 - RNA, 18 nt, Human
ugggguagcuagaggaac

SEQ ID NO: 2238057 - RNA, 21 nt, Human
ugggguaccaagagacuccuu

SEQ ID NO: 2238058 - RNA, 14 nt, Human
ugggggaagcccug

SEQ ID NO: 2238059 - RNA, 20 nt, Human
ugggguacccacugcucugg

SEQ ID NO: 2238060 - RNA, 14 nt, Human
uggggcugauugua

SEQ ID NO: 2238061 - RNA, 19 nt, Human
uggggcugguagcucaggu

SEQ ID NO: 2238062 - RNA, 16 nt, Human
uggggcugguucugua

SEQ ID NO: 2238063 - RNA, 18 nt, Human
uggggcugaccuuccucg

SEQ ID NO: 2238064 - RNA, 23 nt, Human
uggggcugaccuuccucgcagag

SEQ ID NO: 2238065 - RNA, 11 nt, Human
uggggcugaac

SEQ ID NO: 2238066 - RNA, 20 nt, Human
uggggcugaagguugaagag

SEQ ID NO: 2238067 - RNA, 17 nt, Human
uggggcucugugcaggg

SEQ ID NO: 2238068 - RNA, 20 nt, Human
uggggcugcaccggcuggcc

SEQ ID NO: 2238069 - RNA, 15 nt, Human
uggggcuucuccuga

SEQ ID NO: 2238070 - RNA, 16 nt, Human
uggggcuucuccugac

SEQ ID NO: 2238071 - RNA, 18 nt, Human
uggggcuucuccugaccc

SEQ ID NO: 2238072 - RNA, 18 nt, Human
ugggggaacucagaucca

SEQ ID NO: 2238073 - RNA, 17 nt, Human
ugggggaaauggugccu

SEQ ID NO: 2238074 - RNA, 15 nt, Human
ugggggaaagcacag

SEQ ID NO: 2238075 - RNA, 14 nt, Human
ugggguacccacug

SEQ ID NO: 2238076 - RNA, 20 nt, Human
ugggggaacucagauccagg

SEQ ID NO: 2238077 - RNA, 17 nt, Human
ugggggaagaccuggca

SEQ ID NO: 2238078 - RNA, 18 nt, Human
ugggggaagagcacagcc

SEQ ID NO: 2238079 - RNA, 19 nt, Human
ugggggaagagcacagccc

SEQ ID NO: 2238080 - RNA, 21 nt, Human
ugggggaagagcacagcccuc

SEQ ID NO: 2238081 - RNA, 22 nt, Human
ugggggaagagcacagcccucc

SEQ ID NO: 2238082 - RNA, 23 nt, Human
ugggggaagagcacagcccuccc

SEQ ID NO: 2238083 - RNA, 23 nt, Human
ugggcccaagacagaugccccag

SEQ ID NO: 2238084 - RNA, 22 nt, Human
ugggcccaagacagaugcccca

SEQ ID NO: 2238085 - RNA, 14 nt, Human
ugggcccaacccug

SEQ ID NO: 2238086 - RNA, 16 nt, Human
ugggcccaacccuguc

SEQ ID NO: 2238087 - RNA, 12 nt, Human
ugggcccagaag

SEQ ID NO: 2238088 - RNA, 18 nt, Human
ugggcccaacccugucug

SEQ ID NO: 2238089 - RNA, 14 nt, Human
ugggcccagaucug

SEQ ID NO: 2238090 - RNA, 13 nt, Human
ugggcccagaucu

SEQ ID NO: 2238091 - RNA, 12 nt, Human
ugggcccagcug

SEQ ID NO: 2238092 - RNA, 13 nt, Human
ugggcccagcugg

SEQ ID NO: 2238093 - RNA, 14 nt, Human
ugggcccagcuggg

SEQ ID NO: 2238094 - RNA, 15 nt, Human
ugggcccagcugggc

SEQ ID NO: 2238095 - RNA, 16 nt, Human
ugggcccagcugggcu

SEQ ID NO: 2238096 - RNA, 17 nt, Human
ugggcccagcugggcuc

SEQ ID NO: 2238097 - RNA, 19 nt, Human
ugggcccagcugggcucug

SEQ ID NO: 2238098 - RNA, 20 nt, Human
ugggcccagcugggcucugc

SEQ ID NO: 2238099 - RNA, 22 nt, Human
ugggcccagcugggcucugcca

SEQ ID NO: 2238100 - RNA, 10 nt, Human
ugggcccagg

SEQ ID NO: 2238101 - RNA, 14 nt, Human
ugggcccaggacca

SEQ ID NO: 2238102 - RNA, 15 nt, Human
ugggcccaggaccag

SEQ ID NO: 2238103 - RNA, 23 nt, Human
ugggccccaccaccuaggccacu

SEQ ID NO: 2238104 - RNA, 18 nt, Human
ugggccccaccaccuagg

SEQ ID NO: 2238105 - RNA, 17 nt, Human
ugggccccaccaccuag

SEQ ID NO: 2238106 - RNA, 19 nt, Human
ugggcccagggacaccagc

SEQ ID NO: 2238107 - RNA, 23 nt, Human
ugggcccaggaccagcuggggcg

SEQ ID NO: 2238108 - RNA, 13 nt, Human
ugggcccagggac

SEQ ID NO: 2238109 - RNA, 22 nt, Human
ugggcccagggacaccagccag

SEQ ID NO: 2238110 - RNA, 12 nt, Human
ugggcccaggga

SEQ ID NO: 2238111 - RNA, 21 nt, Human
ugggcccaggaccagcugggg

SEQ ID NO: 2238112 - RNA, 22 nt, Human
ugggcccaggaccagcuggggc

SEQ ID NO: 2238113 - RNA, 17 nt, Human
ugggcccaggaccagcu

SEQ ID NO: 2238114 - RNA, 18 nt, Human
ugggcccaggaccagcug

SEQ ID NO: 2238115 - RNA, 19 nt, Human
ugggcccaggaccagcugg

SEQ ID NO: 2238116 - RNA, 20 nt, Human
ugggcccaggaccagcuggg

SEQ ID NO: 2238117 - RNA, 12 nt, Human
agggaggggacu

SEQ ID NO: 2238118 - RNA, 12 nt, Human
agggaggggccu

SEQ ID NO: 2238119 - RNA, 15 nt, Human
ugggccccagcccac

SEQ ID NO: 2238120 - RNA, 13 nt, Human
ugggccccagccc

SEQ ID NO: 2238121 - RNA, 14 nt, Human
ugggccccagccca

SEQ ID NO: 2238122 - RNA, 15 nt, Human
agggagggcuucugc

SEQ ID NO: 2238123 - RNA, 17 nt, Human
agggaggugaccccagg

SEQ ID NO: 2238124 - RNA, 20 nt, Human
agggaggggccuaggccuca

SEQ ID NO: 2238125 - RNA, 21 nt, Human
agggagguggggaugagaaga

SEQ ID NO: 2238126 - RNA, 21 nt, Human
agggaggucacuggaaagggg

SEQ ID NO: 2238127 - RNA, 19 nt, Human
agggaggggccuaggccuc

SEQ ID NO: 2238128 - RNA, 15 nt, Human
agggaggggccuagg

SEQ ID NO: 2238129 - RNA, 20 nt, Human
agggaggucacuggaaaggg

SEQ ID NO: 2238130 - RNA, 17 nt, Human
agggagugacagaggca

SEQ ID NO: 2238131 - RNA, 18 nt, Human
agggagugacagaggcag

SEQ ID NO: 2238132 - RNA, 19 nt, Human
agggagugacagaggcagc

SEQ ID NO: 2238133 - RNA, 19 nt, Human
agggcagagugagacccag

SEQ ID NO: 2238134 - RNA, 15 nt, Human
agggcagcagaaggg

SEQ ID NO: 2238135 - RNA, 21 nt, Human
agggcagcagaaggggguggu

SEQ ID NO: 2238136 - RNA, 16 nt, Human
agggccguaccccacc

SEQ ID NO: 2238137 - RNA, 16 nt, Human
agggcccagagcccag

SEQ ID NO: 2238138 - RNA, 18 nt, Human
agggcccagagcaggaag

SEQ ID NO: 2238139 - RNA, 15 nt, Human
agggccgagugagag

SEQ ID NO: 2238140 - RNA, 15 nt, Human
agggcccagagccca

SEQ ID NO: 2238141 - RNA, 14 nt, Human
agggcccagagccc

SEQ ID NO: 2238142 - RNA, 13 nt, Human
agggcccagagcc

SEQ ID NO: 2238143 - RNA, 15 nt, Human
agggcccagagcagg

SEQ ID NO: 2238144 - RNA, 17 nt, Human
agggcccagagcaggaa

SEQ ID NO: 2238145 - RNA, 12 nt, Human
agggcccagagc

SEQ ID NO: 2238146 - RNA, 13 nt, Human
agggcccagagca

SEQ ID NO: 2238147 - RNA, 14 nt, Human
agggcccagagcag

SEQ ID NO: 2238148 - RNA, 16 nt, Human
agggccaguccugccu

SEQ ID NO: 2238149 - RNA, 13 nt, Human
agggccaguccug

SEQ ID NO: 2238150 - RNA, 22 nt, Human
agggccagggcccugcagaggg

SEQ ID NO: 2238151 - RNA, 20 nt, Human
agggccaggggucucccugg

SEQ ID NO: 2238152 - RNA, 21 nt, Human
agggccaggggucucccugga

SEQ ID NO: 2238153 - RNA, 19 nt, Human
agggccagggcccugcaga

SEQ ID NO: 2238154 - RNA, 15 nt, Human
agggccagggcccug

SEQ ID NO: 2238155 - RNA, 14 nt, Human
agggccagggcccu

SEQ ID NO: 2238156 - RNA, 12 nt, Human
agggccagggcc

SEQ ID NO: 2238157 - RNA, 23 nt, Human
agggcccagagaggguggugacc

SEQ ID NO: 2238158 - RNA, 18 nt, Human
agggccaguccugccugg

SEQ ID NO: 2238159 - RNA, 17 nt, Human
agggccaguccugccug

SEQ ID NO: 2238160 - RNA, 18 nt, Human
agggcccagagagggugg

SEQ ID NO: 2238161 - RNA, 17 nt, Human
agggcagggcaucuccu

SEQ ID NO: 2238162 - RNA, 12 nt, Human
agggcagggcca

SEQ ID NO: 2238163 - RNA, 12 nt, Human
agggcagggccc

SEQ ID NO: 2238164 - RNA, 16 nt, Human
agggcagggcucugau

SEQ ID NO: 2238165 - RNA, 15 nt, Human
agggcagggcucuga

SEQ ID NO: 2238166 - RNA, 17 nt, Human
agggcagggccccaggc

SEQ ID NO: 2238167 - RNA, 16 nt, Human
agggcaggugcuucag

SEQ ID NO: 2238168 - RNA, 20 nt, Human
agggcagucauuggcugucu

SEQ ID NO: 2238169 - RNA, 12 nt, Human
agggccaggacu

SEQ ID NO: 2238170 - RNA, 17 nt, Human
agggccaggacugagcc

SEQ ID NO: 2238171 - RNA, 19 nt, Human
agggccaggacugagcccc

SEQ ID NO: 2238172 - RNA, 21 nt, Human
agggccaggacugagccccgc

SEQ ID NO: 2238173 - RNA, 10 nt, Human
agggccaggc

SEQ ID NO: 2238174 - RNA, 12 nt, Human
agggccaggcag

SEQ ID NO: 2238175 - RNA, 13 nt, Human
agggccaggcagg

SEQ ID NO: 2238176 - RNA, 14 nt, Human
agggccaggcaggu

SEQ ID NO: 2238177 - RNA, 21 nt, Human
agggccaggcaggugccugga

SEQ ID NO: 2238178 - RNA, 22 nt, Human
agggccaggcaggugccuggac

SEQ ID NO: 2238179 - RNA, 14 nt, Human
agggcagcgccagg

SEQ ID NO: 2238180 - RNA, 15 nt, Human
agggcagcagggcua

SEQ ID NO: 2238181 - RNA, 14 nt, Human
agggcagcagggcu

SEQ ID NO: 2238182 - RNA, 13 nt, Human
agggcagggcauc

SEQ ID NO: 2238183 - RNA, 12 nt, Human
agggcagggacu

SEQ ID NO: 2238184 - RNA, 22 nt, Human
agggcagggaccacacccugua

SEQ ID NO: 2238185 - RNA, 16 nt, Human
agggcagcgccaggcu

SEQ ID NO: 2238186 - RNA, 17 nt, Human
agggcagggacaggaua

SEQ ID NO: 2238187 - RNA, 20 nt, Human
ugggagguggagguugcagu

SEQ ID NO: 2238188 - RNA, 19 nt, Human
ugggagguugaucagaucu

SEQ ID NO: 2238189 - RNA, 22 nt, Human
ugggagguggaagaagggagaa

SEQ ID NO: 2238190 - RNA, 17 nt, Human
ugggauucaggaaugug

SEQ ID NO: 2238191 - RNA, 20 nt, Human
ugggauucccaccaaggucu

SEQ ID NO: 2238192 - RNA, 23 nt, Human
ugggauucccaccaaggucuuca

SEQ ID NO: 2238193 - RNA, 15 nt, Human
ugggauuccugaccc

SEQ ID NO: 2238194 - RNA, 16 nt, Human
ugggauuccugaccca

SEQ ID NO: 2238195 - RNA, 17 nt, Human
ugggauuccugacccag

SEQ ID NO: 2238196 - RNA, 20 nt, Human
ugggauuccugacccaggcc

SEQ ID NO: 2238197 - RNA, 21 nt, Human
ugggauuccugacccaggccg

SEQ ID NO: 2238198 - RNA, 13 nt, Human
ugggaggucgagg

SEQ ID NO: 2238199 - RNA, 19 nt, Human
ugggagguggaagaaggga

SEQ ID NO: 2238200 - RNA, 18 nt, Human
ugggagguggaagaaggg

SEQ ID NO: 2238201 - RNA, 10 nt, Human
ugggauugcu

SEQ ID NO: 2238202 - RNA, 14 nt, Human
ugggauugggggcu

SEQ ID NO: 2238203 - RNA, 18 nt, Human
ugggauugggggcuggug

SEQ ID NO: 2238204 - RNA, 19 nt, Human
ugggauugagucugugcca

SEQ ID NO: 2238205 - RNA, 16 nt, Human
ugggauugagucugug

SEQ ID NO: 2238206 - RNA, 23 nt, Human
ugggauugacagaagcuucugcc

SEQ ID NO: 2238207 - RNA, 22 nt, Human
ugggauuccugacccaggccgc

SEQ ID NO: 2238208 - RNA, 24 nt, Human
ugggauuccugacccaggccgcag

SEQ ID NO: 2238209 - RNA, 17 nt, Human
ugggauucuacuuuaag

SEQ ID NO: 2238210 - RNA, 22 nt, Human
ugggauucuacuuuaagcacua

SEQ ID NO: 2238211 - RNA, 16 nt, Human
ugggcaacccccagcc

SEQ ID NO: 2238212 - RNA, 19 nt, Human
ugggauugggggcuggugc

SEQ ID NO: 2238213 - RNA, 21 nt, Human
ugggauugggggcuggugcca

SEQ ID NO: 2238214 - RNA, 19 nt, Human
ugggauugugguacaaucu

SEQ ID NO: 2238215 - RNA, 19 nt, Human
aggccuuaucuccaagacc

SEQ ID NO: 2238216 - RNA, 17 nt, Human
aggccuuaucuccaaga

SEQ ID NO: 2238217 - RNA, 18 nt, Human
aggccuuaucauucauuc

SEQ ID NO: 2238218 - RNA, 19 nt, Human
aggccuuaucauucauucu

SEQ ID NO: 2238219 - RNA, 15 nt, Human
aggccuuccucucuc

SEQ ID NO: 2238220 - RNA, 20 nt, Human
aggccuuaucauucauucuu

SEQ ID NO: 2238221 - RNA, 17 nt, Human
ugggaggucaaggcugc

SEQ ID NO: 2238222 - RNA, 19 nt, Human
aggccuuccucucuccaga

SEQ ID NO: 2238223 - RNA, 13 nt, Human
aggccuucuccuc

SEQ ID NO: 2238224 - RNA, 22 nt, Human
aggccuucuccuccccacccgc

SEQ ID NO: 2238225 - RNA, 18 nt, Human
aggccuuccucucuccag

SEQ ID NO: 2238226 - RNA, 16 nt, Human
aggccuuccucucucc

SEQ ID NO: 2238227 - RNA, 23 nt, Human
ugggaggucaaggcugcagugag

SEQ ID NO: 2238228 - RNA, 20 nt, Human
ugggaggucaaggcugcagu

SEQ ID NO: 2238229 - RNA, 19 nt, Human
ugggaggucaaggcugcag

SEQ ID NO: 2238230 - RNA, 18 nt, Human
ugggaggucaaggcugca

SEQ ID NO: 2238231 - RNA, 22 nt, Human
ugggcacacgccucccacuggg

SEQ ID NO: 2238232 - RNA, 14 nt, Human
ugggcacaguuugg

SEQ ID NO: 2238233 - RNA, 17 nt, Human
ugggcaacccccagccu

SEQ ID NO: 2238234 - RNA, 20 nt, Human
ugggcaacccccagccugcu

SEQ ID NO: 2238235 - RNA, 20 nt, Human
ugggcacccacccugggacc

SEQ ID NO: 2238236 - RNA, 21 nt, Human
ugggcacccagccucuaggga

SEQ ID NO: 2238237 - RNA, 16 nt, Human
ugggcaccccacugca

SEQ ID NO: 2238238 - RNA, 14 nt, Human
ugggcacccacccu

SEQ ID NO: 2238239 - RNA, 16 nt, Human
ugggcacccacccugg

SEQ ID NO: 2238240 - RNA, 17 nt, Human
ugggccagaauuucaaa

SEQ ID NO: 2238241 - RNA, 22 nt, Human
ugggccacuucuggguggggca

SEQ ID NO: 2238242 - RNA, 18 nt, Human
ugggccaggacaggcccg

SEQ ID NO: 2238243 - RNA, 17 nt, Human
ugggccaggacaggccc

SEQ ID NO: 2238244 - RNA, 20 nt, Human
ugggccauucuccacagcaa

SEQ ID NO: 2238245 - RNA, 19 nt, Human
ugggccauucuccacagca

SEQ ID NO: 2238246 - RNA, 20 nt, Human
ugggcccaaugcacuuuguu

SEQ ID NO: 2238247 - RNA, 14 nt, Human
ugggccaggagccu

SEQ ID NO: 2238248 - RNA, 16 nt, Human
ugggccaggagccucc

SEQ ID NO: 2238249 - RNA, 23 nt, Human
ugggccagccccucccaccacag

SEQ ID NO: 2238250 - RNA, 22 nt, Human
ugggccagccccucccaccaca

SEQ ID NO: 2238251 - RNA, 14 nt, Human
ugggccaggacagg

SEQ ID NO: 2238252 - RNA, 20 nt, Human
ugggccagccccucccacca

SEQ ID NO: 2238253 - RNA, 18 nt, Human
ugggccagccccucccac

SEQ ID NO: 2238254 - RNA, 16 nt, Human
ugggccagccccuccc

SEQ ID NO: 2238255 - RNA, 13 nt, Human
ugggccaggagcc

SEQ ID NO: 2238256 - RNA, 15 nt, Human
ugggccagccccucc

SEQ ID NO: 2238257 - RNA, 14 nt, Human
ugggccagccccuc

SEQ ID NO: 2238258 - RNA, 13 nt, Human
ugggccagccccu

SEQ ID NO: 2238259 - RNA, 19 nt, Human
ugggccagacaugccacaa

SEQ ID NO: 2238260 - RNA, 18 nt, Human
ugggccagaauuucaaac

SEQ ID NO: 2238261 - RNA, 18 nt, Human
ugggccagacaugccaca

SEQ ID NO: 2238262 - RNA, 13 nt, Human
ugggccagacaug

SEQ ID NO: 2238263 - RNA, 23 nt, Human
aggggcgccgcaaaccacacugg

SEQ ID NO: 2238264 - RNA, 17 nt, Human
aggggagagggucugga

SEQ ID NO: 2238265 - RNA, 14 nt, Human
aggggcgcccaccu

SEQ ID NO: 2238266 - RNA, 10 nt, Human
aggggagagg

SEQ ID NO: 2238267 - RNA, 22 nt, Human
aggggagagccugcuggcaccc

SEQ ID NO: 2238268 - RNA, 18 nt, Human
aggggccuggcagccgug

SEQ ID NO: 2238269 - RNA, 23 nt, Human
aggggccuggcagccgugccuuc

SEQ ID NO: 2238270 - RNA, 23 nt, Human
aggggagcaaaaucgaugcagug

SEQ ID NO: 2238271 - RNA, 15 nt, Human
aggggccuggcagcc

SEQ ID NO: 2238272 - RNA, 15 nt, Human
aggggagagccugcu

SEQ ID NO: 2238273 - RNA, 16 nt, Human
aggggagagccugcug

SEQ ID NO: 2238274 - RNA, 17 nt, Human
aggggagagccugcugg

SEQ ID NO: 2238275 - RNA, 19 nt, Human
aggggacuauuuaugaagg

SEQ ID NO: 2238276 - RNA, 21 nt, Human
ugggguaggaggaugggcucg

SEQ ID NO: 2238277 - RNA, 20 nt, Human
uggggucacucuggcagcuc

SEQ ID NO: 2238278 - RNA, 19 nt, Human
uggggucacucuggcagcu

SEQ ID NO: 2238279 - RNA, 17 nt, Human
aggggacucagcccuga

SEQ ID NO: 2238280 - RNA, 14 nt, Human
aggggacucagccc

SEQ ID NO: 2238281 - RNA, 22 nt, Human
aggggacucagcccugagguga

SEQ ID NO: 2238282 - RNA, 20 nt, Human
aggggcgugggaguggccug

SEQ ID NO: 2238283 - RNA, 22 nt, Human
aggggcgucuguucccccuuca

SEQ ID NO: 2238284 - RNA, 22 nt, Human
aggggcguggagggcguggagg

SEQ ID NO: 2238285 - RNA, 21 nt, Human
aggggcgucuguucccccuuc

SEQ ID NO: 2238286 - RNA, 19 nt, Human
aggggcgucuguucccccu

SEQ ID NO: 2238287 - RNA, 16 nt, Human
aggggcgucuguuccc

SEQ ID NO: 2238288 - RNA, 19 nt, Human
aggggcgggacccaggcac

SEQ ID NO: 2238289 - RNA, 17 nt, Human
aggggcguguggcucac

SEQ ID NO: 2238290 - RNA, 14 nt, Human
aggggcguguggcu

SEQ ID NO: 2238291 - RNA, 15 nt, Human
aggggcuacaagagg

SEQ ID NO: 2238292 - RNA, 17 nt, Human
aggggcuacaagaggga

SEQ ID NO: 2238293 - RNA, 23 nt, Human
aggggcgcuggcccagccggccu

SEQ ID NO: 2238294 - RNA, 18 nt, Human
aggggcgggacccaggca

SEQ ID NO: 2238295 - RNA, 19 nt, Human
aggggcgcuggcccagccg

SEQ ID NO: 2238296 - RNA, 20 nt, Human
aggggcgcuggcccagccgg

SEQ ID NO: 2238297 - RNA, 21 nt, Human
aggggcgcuggcccagccggc

SEQ ID NO: 2238298 - RNA, 22 nt, Human
aggggcgcuggcccagccggcc

SEQ ID NO: 2238299 - RNA, 16 nt, Human
aggggcgcccaccucc

SEQ ID NO: 2238300 - RNA, 20 nt, Human
aggggcgcucgcuuccgcau

SEQ ID NO: 2238301 - RNA, 13 nt, Human
aggggcgcuggcc

SEQ ID NO: 2238302 - RNA, 14 nt, Human
aggggcgcuggccc

SEQ ID NO: 2238303 - RNA, 15 nt, Human
aggggcgcuggccca

SEQ ID NO: 2238304 - RNA, 16 nt, Human
aggggcgcuggcccag

SEQ ID NO: 2238305 - RNA, 17 nt, Human
aggggcgcuggcccagc

SEQ ID NO: 2238306 - RNA, 18 nt, Human
aggggcgcuggcccagcc

SEQ ID NO: 2238307 - RNA, 17 nt, Human
agggggauaugaaugga

SEQ ID NO: 2238308 - RNA, 22 nt, Human
agggggagccccuucugcucag

SEQ ID NO: 2238309 - RNA, 21 nt, Human
agggggagccccuucugcuca

SEQ ID NO: 2238310 - RNA, 15 nt, Human
agggggaaggcaggg

SEQ ID NO: 2238311 - RNA, 22 nt, Human
agggggaaggugggguccugga

SEQ ID NO: 2238312 - RNA, 15 nt, Human
aggggcucaggaaaa

SEQ ID NO: 2238313 - RNA, 18 nt, Human
aggggcuacaagagggaa

SEQ ID NO: 2238314 - RNA, 20 nt, Human
aggggcuagaaccuagagaa

SEQ ID NO: 2238315 - RNA, 21 nt, Human
agggguggguuccucuucccc

SEQ ID NO: 2238316 - RNA, 20 nt, Human
agggguggguuccucuuccc

SEQ ID NO: 2238317 - RNA, 15 nt, Human
aggggguggaggggu

SEQ ID NO: 2238318 - RNA, 19 nt, Human
agggguggggguggaggcu

SEQ ID NO: 2238319 - RNA, 22 nt, Human
aggggugggacacccugugaug

SEQ ID NO: 2238320 - RNA, 20 nt, Human
aggggugggacacccuguga

SEQ ID NO: 2238321 - RNA, 23 nt, Human
agggggugauuagagggaggaga

SEQ ID NO: 2238322 - RNA, 15 nt, Human
aggggguggccuccc

SEQ ID NO: 2238323 - RNA, 19 nt, Human
agggggauccgacugcuuu

SEQ ID NO: 2238324 - RNA, 20 nt, Human
agggggauccgacugcuuug

SEQ ID NO: 2238325 - RNA, 17 nt, Human
aggggguggccucccaa

SEQ ID NO: 2238326 - RNA, 18 nt, Human
aggggguggccucccaac

SEQ ID NO: 2238327 - RNA, 15 nt, Human
aggggugguccugac

SEQ ID NO: 2238328 - RNA, 13 nt, Human
aggggugguccug

SEQ ID NO: 2238329 - RNA, 14 nt, Human
aggggugucuuggg

SEQ ID NO: 2238330 - RNA, 22 nt, Human
aggggugucuugggcagagcug

SEQ ID NO: 2238331 - RNA, 24 nt, Human
aggggugucuugggcagagcuggc

SEQ ID NO: 2238332 - RNA, 24 nt, Human
agggguucccuuuuuuggcugcug

SEQ ID NO: 2238333 - RNA, 18 nt, Human
aggggugguccugacuca

SEQ ID NO: 2238334 - RNA, 16 nt, Human
agggguguggcagugg

SEQ ID NO: 2238335 - RNA, 15 nt, Human
agggguguggcuccu

SEQ ID NO: 2238336 - RNA, 18 nt, Human
agggguguggcagugguu

SEQ ID NO: 2238337 - RNA, 15 nt, Human
agggguucgagacca

SEQ ID NO: 2238338 - RNA, 20 nt, Human
agggguucgagaccagucug

SEQ ID NO: 2238339 - RNA, 21 nt, Human
agggucucacuauguugccca

SEQ ID NO: 2238340 - RNA, 23 nt, Human
agggguugagcagggauccuggu

SEQ ID NO: 2238341 - RNA, 18 nt, Human
agggguugcagugagcgg

SEQ ID NO: 2238342 - RNA, 16 nt, Human
agggguugccacaggc

SEQ ID NO: 2238343 - RNA, 19 nt, Human
agggguugccacaggccuc

SEQ ID NO: 2238344 - RNA, 21 nt, Human
agggguugccacaggccuccc

SEQ ID NO: 2238345 - RNA, 22 nt, Human
agggucucacuauguugcccag

SEQ ID NO: 2238346 - RNA, 23 nt, Human
agggucucacuauguugcccagg

SEQ ID NO: 2238347 - RNA, 21 nt, Human
uggguggggcugcuccuccag

SEQ ID NO: 2238348 - RNA, 18 nt, Human
ugggugggcaggaaaagg

SEQ ID NO: 2238349 - RNA, 15 nt, Human
ugggugggcucugug

SEQ ID NO: 2238350 - RNA, 16 nt, Human
ugggugggcucugugc

SEQ ID NO: 2238351 - RNA, 19 nt, Human
ugggugggcucugugcagu

SEQ ID NO: 2238352 - RNA, 16 nt, Human
uggguggggggcuuca

SEQ ID NO: 2238353 - RNA, 18 nt, Human
ugggugcuggcugcccag

SEQ ID NO: 2238354 - RNA, 15 nt, Human
uggguggcacugcca

SEQ ID NO: 2238355 - RNA, 14 nt, Human
ugggugcuggcugc

SEQ ID NO: 2238356 - RNA, 14 nt, Human
uggguggcccaucc

SEQ ID NO: 2238357 - RNA, 15 nt, Human
uggguggcccauccc

SEQ ID NO: 2238358 - RNA, 21 nt, Human
uggguggcccauccccccuca

SEQ ID NO: 2238359 - RNA, 15 nt, Human
uggguggccucggga

SEQ ID NO: 2238360 - RNA, 16 nt, Human
ugggugggcaggaaaa

SEQ ID NO: 2238361 - RNA, 12 nt, Human
ugggugggagag

SEQ ID NO: 2238362 - RNA, 13 nt, Human
uggguggggcugc

SEQ ID NO: 2238363 - RNA, 13 nt, Human
ugguaagcucugg

SEQ ID NO: 2238364 - RNA, 14 nt, Human
ugguaagcucuggc

SEQ ID NO: 2238365 - RNA, 15 nt, Human
ugguaagcucuggcu

SEQ ID NO: 2238366 - RNA, 20 nt, Human
ugguaaggggaauugaggac

SEQ ID NO: 2238367 - RNA, 14 nt, Human
ugguaauauugacu

SEQ ID NO: 2238368 - RNA, 21 nt, Human
ugguaauuaucauuuuagaag

SEQ ID NO: 2238369 - RNA, 22 nt, Human
ugguaauuauuuugguacuuuu

SEQ ID NO: 2238370 - RNA, 15 nt, Human
ugguaaucuugcucu

SEQ ID NO: 2238371 - RNA, 17 nt, Human
ugguacucauuaaaaaa

SEQ ID NO: 2238372 - RNA, 18 nt, Human
ugguacggagauguuuca

SEQ ID NO: 2238373 - RNA, 20 nt, Human
ugguacuacuagaugucuuu

SEQ ID NO: 2238374 - RNA, 16 nt, Human
ugguacuaacuuuccu

SEQ ID NO: 2238375 - RNA, 19 nt, Human
ugguacuuuuaugauguau

SEQ ID NO: 2238376 - RNA, 17 nt, Human
ugguacuuauuacugcu

SEQ ID NO: 2238377 - RNA, 18 nt, Human
ugguacuuauuacugcua

SEQ ID NO: 2238378 - RNA, 20 nt, Human
ugguagcuuuucccuucuuu

SEQ ID NO: 2238379 - RNA, 13 nt, Human
ugguacucuccua

SEQ ID NO: 2238380 - RNA, 17 nt, Human
ugguacucuccuagaga

SEQ ID NO: 2238381 - RNA, 21 nt, Human
ugguagcuuuucccuucuuuu

SEQ ID NO: 2238382 - RNA, 13 nt, Human
ugguaggaacugc

SEQ ID NO: 2238383 - RNA, 19 nt, Human
ugguacuuauuacugcuaa

SEQ ID NO: 2238384 - RNA, 17 nt, Human
ugguagcuuuucccuuc

SEQ ID NO: 2238385 - RNA, 20 nt, Human
ugguaggaacugcugggcuu

SEQ ID NO: 2238386 - RNA, 22 nt, Human
uggucacaggacucugccuccu

SEQ ID NO: 2238387 - RNA, 23 nt, Human
uggucacaggacucugccuccuc

SEQ ID NO: 2238388 - RNA, 20 nt, Human
uggucacaggacucugccuc

SEQ ID NO: 2238389 - RNA, 16 nt, Human
ugguaggaccaagcau

SEQ ID NO: 2238390 - RNA, 22 nt, Human
ugguaggaccaagcaucuuggg

SEQ ID NO: 2238391 - RNA, 13 nt, Human
ugggugcucccua

SEQ ID NO: 2238392 - RNA, 22 nt, Human
uggguggcaccagcagccugga

SEQ ID NO: 2238393 - RNA, 22 nt, Human
ugggugcuuggaggaaggaaac

SEQ ID NO: 2238394 - RNA, 15 nt, Human
ugggugcuuggagga

SEQ ID NO: 2238395 - RNA, 19 nt, Human
ugggugcuuggaggaagga

SEQ ID NO: 2238396 - RNA, 20 nt, Human
ugggucugugucucuuuucu

SEQ ID NO: 2238397 - RNA, 19 nt, Human
ugggucugugucucuuuuc

SEQ ID NO: 2238398 - RNA, 14 nt, Human
ugggucugugucuc

SEQ ID NO: 2238399 - RNA, 12 nt, Human
ugggucugugug

SEQ ID NO: 2238400 - RNA, 22 nt, Human
ugggucucgcuuuguugcccag

SEQ ID NO: 2238401 - RNA, 19 nt, Human
ugggucugagucauggccg

SEQ ID NO: 2238402 - RNA, 15 nt, Human
ugggucuggcugagc

SEQ ID NO: 2238403 - RNA, 17 nt, Human
ugggucuggcugagcug

SEQ ID NO: 2238404 - RNA, 20 nt, Human
ugggucucgcuuuguugccc

SEQ ID NO: 2238405 - RNA, 23 nt, Human
ugggucuaagggguugguugagg

SEQ ID NO: 2238406 - RNA, 21 nt, Human
ugggucgcccuggacugugug

SEQ ID NO: 2238407 - RNA, 15 nt, Human
agggugggagugggc

SEQ ID NO: 2238408 - RNA, 19 nt, Human
agggugggagagcccagcc

SEQ ID NO: 2238409 - RNA, 18 nt, Human
agggugggagagcccagc

SEQ ID NO: 2238410 - RNA, 17 nt, Human
agggugggagagcccag

SEQ ID NO: 2238411 - RNA, 16 nt, Human
agggugggagagccca

SEQ ID NO: 2238412 - RNA, 14 nt, Human
aggguggcccuugc

SEQ ID NO: 2238413 - RNA, 11 nt, Human
aggguggcccu

SEQ ID NO: 2238414 - RNA, 18 nt, Human
aggguggcccuugcaguu

SEQ ID NO: 2238415 - RNA, 21 nt, Human
aggguggcuggguccagggga

SEQ ID NO: 2238416 - RNA, 21 nt, Human
aggguggcaucccaguggccu

SEQ ID NO: 2238417 - RNA, 15 nt, Human
aggguggcaucccag

SEQ ID NO: 2238418 - RNA, 21 nt, Human
aggguggagacuaagcccugu

SEQ ID NO: 2238419 - RNA, 14 nt, Human
aggguggcagguga

SEQ ID NO: 2238420 - RNA, 16 nt, Human
agggucucugcugccg

SEQ ID NO: 2238421 - RNA, 12 nt, Human
aggguggagacu

SEQ ID NO: 2238422 - RNA, 22 nt, Human
agggucucacucugucgcccag

SEQ ID NO: 2238423 - RNA, 21 nt, Human
agggucucacucugucgccca

SEQ ID NO: 2238424 - RNA, 22 nt, Human
agggucucuagugcugugaaaa

SEQ ID NO: 2238425 - RNA, 21 nt, Human
agggucucuagugcugugaaa

SEQ ID NO: 2238426 - RNA, 13 nt, Human
agggucucugcug

SEQ ID NO: 2238427 - RNA, 14 nt, Human
agggucucugcugc

SEQ ID NO: 2238428 - RNA, 15 nt, Human
agggucucugcugcc

SEQ ID NO: 2238429 - RNA, 20 nt, Human
agggucucuagugcugugaa

SEQ ID NO: 2238430 - RNA, 18 nt, Human
agggucucuagugcugug

SEQ ID NO: 2238431 - RNA, 16 nt, Human
agggucucuagugcug

SEQ ID NO: 2238432 - RNA, 20 nt, Human
agggguugccacaggccucc

SEQ ID NO: 2238433 - RNA, 20 nt, Human
agguauucaauauccuuugc

SEQ ID NO: 2238434 - RNA, 22 nt, Human
agguauuccuuuuguguacagu

SEQ ID NO: 2238435 - RNA, 22 nt, Human
agguauggaaggguuuguggcu

SEQ ID NO: 2238436 - RNA, 20 nt, Human
agguauggaaggguuugugg

SEQ ID NO: 2238437 - RNA, 14 nt, Human
agguauguugccuu

SEQ ID NO: 2238438 - RNA, 20 nt, Human
agguauguugccuuuauggu

SEQ ID NO: 2238439 - RNA, 22 nt, Human
aggucaauacaguacaggcagc

SEQ ID NO: 2238440 - RNA, 21 nt, Human
aggucaauacaguacaggcag

SEQ ID NO: 2238441 - RNA, 21 nt, Human
aggucaaugccagagacggaa

SEQ ID NO: 2238442 - RNA, 23 nt, Human
aggucaauacaguacaggcagca

SEQ ID NO: 2238443 - RNA, 23 nt, Human
aggucacacgaggggccccgugu

SEQ ID NO: 2238444 - RNA, 15 nt, Human
aggucacauucagga

SEQ ID NO: 2238445 - RNA, 18 nt, Human
aggucaauacaguacagg

SEQ ID NO: 2238446 - RNA, 17 nt, Human
agguauucgugcagcau

SEQ ID NO: 2238447 - RNA, 22 nt, Human
aggucaaguaagaagacaugaa

SEQ ID NO: 2238448 - RNA, 19 nt, Human
aggucaaguaagaagacau

SEQ ID NO: 2238449 - RNA, 19 nt, Human
aggucacuccuggggccuc

SEQ ID NO: 2238450 - RNA, 21 nt, Human
aggucacucuuccugcaagga

SEQ ID NO: 2238451 - RNA, 23 nt, Human
aggucacucuuccugcaaggacu

SEQ ID NO: 2238452 - RNA, 16 nt, Human
aggucacuggaaaggg

SEQ ID NO: 2238453 - RNA, 20 nt, Human
aggucacuggaaaggggaga

SEQ ID NO: 2238454 - RNA, 21 nt, Human
aggucacuggaaaggggagag

SEQ ID NO: 2238455 - RNA, 14 nt, Human
aggucacuggcucu

SEQ ID NO: 2238456 - RNA, 15 nt, Human
aggucacuggcucuc

SEQ ID NO: 2238457 - RNA, 18 nt, Human
aggucacuccuggggccu

SEQ ID NO: 2238458 - RNA, 15 nt, Human
aggucacuccugggg

SEQ ID NO: 2238459 - RNA, 14 nt, Human
aggucacuccuggg

SEQ ID NO: 2238460 - RNA, 19 nt, Human
aggucacuagauggcgagc

SEQ ID NO: 2238461 - RNA, 19 nt, Human
aggucaccuuuauucuggc

SEQ ID NO: 2238462 - RNA, 12 nt, Human
aggucaccagca

SEQ ID NO: 2238463 - RNA, 15 nt, Human
aggucacccuuugcu

SEQ ID NO: 2238464 - RNA, 18 nt, Human
aggucacauucaggaaga

SEQ ID NO: 2238465 - RNA, 19 nt, Human
aggucacauucaggaagau

SEQ ID NO: 2238466 - RNA, 18 nt, Human
aggucaccuuuauucugg

SEQ ID NO: 2238467 - RNA, 13 nt, Human
aggucccaggcag

SEQ ID NO: 2238468 - RNA, 12 nt, Human
aggucccaggca

SEQ ID NO: 2238469 - RNA, 11 nt, Human
aggucccaggc

SEQ ID NO: 2238470 - RNA, 23 nt, Human
agguccagcucuggaggggaggg

SEQ ID NO: 2238471 - RNA, 18 nt, Human
agguccagcucuggaggg

SEQ ID NO: 2238472 - RNA, 20 nt, Human
aggucauuuuuuuuaagaaa

SEQ ID NO: 2238473 - RNA, 17 nt, Human
aggucauuuuuuuuaag

SEQ ID NO: 2238474 - RNA, 12 nt, Human
aggucagagccu

SEQ ID NO: 2238475 - RNA, 16 nt, Human
aggucacuggcucucc

SEQ ID NO: 2238476 - RNA, 17 nt, Human
aggucacuggcucucca

SEQ ID NO: 2238477 - RNA, 18 nt, Human
aggucacuggcucuccaa

SEQ ID NO: 2238478 - RNA, 19 nt, Human
aggucacuggcucuccaag

SEQ ID NO: 2238479 - RNA, 18 nt, Human
aggucauggaauggaaac

SEQ ID NO: 2238480 - RNA, 20 nt, Human
aggucacuggcucuccaagu

SEQ ID NO: 2238481 - RNA, 21 nt, Human
aggucacuggcucuccaagug

SEQ ID NO: 2238482 - RNA, 21 nt, Human
agguaugcaaucaaaucugcu

SEQ ID NO: 2238483 - RNA, 15 nt, Human
agguauaauuuuaug

SEQ ID NO: 2238484 - RNA, 11 nt, Human
agguauaauuu

SEQ ID NO: 2238485 - RNA, 20 nt, Human
agguauaaguggugugugua

SEQ ID NO: 2238486 - RNA, 19 nt, Human
agguauaaguggugugugu

SEQ ID NO: 2238487 - RNA, 23 nt, Human
agguauaauucacauuguauuca

SEQ ID NO: 2238488 - RNA, 23 nt, Human
agguagaaauaucugaaaaugua

SEQ ID NO: 2238489 - RNA, 20 nt, Human
agguagguggaucaccugag

SEQ ID NO: 2238490 - RNA, 15 nt, Human
agguaggguuuaauc

SEQ ID NO: 2238491 - RNA, 12 nt, Human
agguaggguuua

SEQ ID NO: 2238492 - RNA, 19 nt, Human
agguagaaauaucugaaaa

SEQ ID NO: 2238493 - RNA, 17 nt, Human
agguagaaauaucugaa

SEQ ID NO: 2238494 - RNA, 23 nt, Human
agguacuucaaauccuugaagau

SEQ ID NO: 2238495 - RNA, 18 nt, Human
aggguuggccccugcccg

SEQ ID NO: 2238496 - RNA, 23 nt, Human
aggguuggccccugcccggcugc

SEQ ID NO: 2238497 - RNA, 17 nt, Human
aggguuggccccugccc

SEQ ID NO: 2238498 - RNA, 15 nt, Human
aggguugggcccaga

SEQ ID NO: 2238499 - RNA, 13 nt, Human
uggucagcucccu

SEQ ID NO: 2238500 - RNA, 19 nt, Human
uggucagcucccuucucug

SEQ ID NO: 2238501 - RNA, 22 nt, Human
uggucagcccuaggguggagag

SEQ ID NO: 2238502 - RNA, 16 nt, Human
uggucagcguugcaug

SEQ ID NO: 2238503 - RNA, 17 nt, Human
uggucagcguugcaugu

SEQ ID NO: 2238504 - RNA, 13 nt, Human
uggucacagggca

SEQ ID NO: 2238505 - RNA, 17 nt, Human
uggucacagggcaugcc

SEQ ID NO: 2238506 - RNA, 19 nt, Human
uggucagcccuagggugga

SEQ ID NO: 2238507 - RNA, 15 nt, Human
uggucagcccuaggg

SEQ ID NO: 2238508 - RNA, 14 nt, Human
uggucccaccccac

SEQ ID NO: 2238509 - RNA, 15 nt, Human
uggucccaccccaca

SEQ ID NO: 2238510 - RNA, 20 nt, Human
uggucaccaaaucagcugcu

SEQ ID NO: 2238511 - RNA, 10 nt, Human
uggucagccc

SEQ ID NO: 2238512 - RNA, 12 nt, Human
uggucagcccaa

SEQ ID NO: 2238513 - RNA, 11 nt, Human
uggucagccca

SEQ ID NO: 2238514 - RNA, 22 nt, Human
uggucagauuugaacucuucaa

SEQ ID NO: 2238515 - RNA, 18 nt, Human
uggucaccaaaucagcug

SEQ ID NO: 2238516 - RNA, 18 nt, Human
uggucucaaacuccugac

SEQ ID NO: 2238517 - RNA, 15 nt, Human
uggucuauugucugu

SEQ ID NO: 2238518 - RNA, 14 nt, Human
uggucuccacuggg

SEQ ID NO: 2238519 - RNA, 12 nt, Human
uggucucagaaa

SEQ ID NO: 2238520 - RNA, 17 nt, Human
uggucucaaacucuuga

SEQ ID NO: 2238521 - RNA, 23 nt, Human
uggucucaaacucuugaccucag

SEQ ID NO: 2238522 - RNA, 16 nt, Human
uggucucaaacucuug

SEQ ID NO: 2238523 - RNA, 21 nt, Human
uggucauagcccagaucagcu

SEQ ID NO: 2238524 - RNA, 19 nt, Human
uggucuaucuuugagcgcc

SEQ ID NO: 2238525 - RNA, 16 nt, Human
uggucccaccccacac

SEQ ID NO: 2238526 - RNA, 16 nt, Human
uggucuccuuggaaau

SEQ ID NO: 2238527 - RNA, 17 nt, Human
uggucuccucagccucc

SEQ ID NO: 2238528 - RNA, 22 nt, Human
uggucucagcagcgaccacccc

SEQ ID NO: 2238529 - RNA, 19 nt, Human
uggucucagcagcgaccac

SEQ ID NO: 2238530 - RNA, 17 nt, Human
uggucugaauguucuga

SEQ ID NO: 2238531 - RNA, 16 nt, Human
uggucugaauguucug

SEQ ID NO: 2238532 - RNA, 15 nt, Human
uggucugaauguucu

SEQ ID NO: 2238533 - RNA, 14 nt, Human
uggucugaauguuc

SEQ ID NO: 2238534 - RNA, 13 nt, Human
uggucugaauguu

SEQ ID NO: 2238535 - RNA, 23 nt, Human
uggucuccucagccuccucaucu

SEQ ID NO: 2238536 - RNA, 22 nt, Human
uggucuccuuggaaauccgucu

SEQ ID NO: 2238537 - RNA, 16 nt, Human
uggucugacccacugc

SEQ ID NO: 2238538 - RNA, 17 nt, Human
uggucugacccacugcu

SEQ ID NO: 2238539 - RNA, 22 nt, Human
uggucugaauguucugacauua

SEQ ID NO: 2238540 - RNA, 21 nt, Human
uggucugaauguucugacauu

SEQ ID NO: 2238541 - RNA, 19 nt, Human
uggucugaauguucugaca

SEQ ID NO: 2238542 - RNA, 18 nt, Human
uggucugaauguucugac

SEQ ID NO: 2238543 - RNA, 15 nt, Human
uggucuucagccucu

SEQ ID NO: 2238544 - RNA, 17 nt, Human
uggucuugagaugucuu

SEQ ID NO: 2238545 - RNA, 17 nt, Human
uggucuuggcagcaccu

SEQ ID NO: 2238546 - RNA, 14 nt, Human
uggucuucccaggc

SEQ ID NO: 2238547 - RNA, 17 nt, Human
uggucuucccaggcugg

SEQ ID NO: 2238548 - RNA, 20 nt, Human
uggucuuggcagcaccuguc

SEQ ID NO: 2238549 - RNA, 16 nt, Human
uggucuuguggaauug

SEQ ID NO: 2238550 - RNA, 14 nt, Human
uggucuuuaaugaa

SEQ ID NO: 2238551 - RNA, 22 nt, Human
uggucuuuccuaucauggagug

SEQ ID NO: 2238552 - RNA, 17 nt, Human
uggucuuucuggagagg

SEQ ID NO: 2238553 - RNA, 15 nt, Human
uggucuuucuggaga

SEQ ID NO: 2238554 - RNA, 14 nt, Human
uggucuuucuggag

SEQ ID NO: 2238555 - RNA, 14 nt, Human
uggucuuuccucug

SEQ ID NO: 2238556 - RNA, 13 nt, Human
uggucuuuguaag

SEQ ID NO: 2238557 - RNA, 20 nt, Human
uggucuuucuuacaaggaag

SEQ ID NO: 2238558 - RNA, 15 nt, Human
aggguuauauuuuac

SEQ ID NO: 2238559 - RNA, 18 nt, Human
aggguuacuaugcacaau

SEQ ID NO: 2238560 - RNA, 16 nt, Human
aggguuagggaggggu

SEQ ID NO: 2238561 - RNA, 15 nt, Human
aggguuagggagggg

SEQ ID NO: 2238562 - RNA, 13 nt, Human
aggguuagggagg

SEQ ID NO: 2238563 - RNA, 17 nt, Human
aggguuaugauuaagua

SEQ ID NO: 2238564 - RNA, 13 nt, Human
aggguuauaauaa

SEQ ID NO: 2238565 - RNA, 12 nt, Human
agggugugugcu

SEQ ID NO: 2238566 - RNA, 22 nt, Human
aggguguggcccugccaucuuc

SEQ ID NO: 2238567 - RNA, 21 nt, Human
aggguguugggauacugcagg

SEQ ID NO: 2238568 - RNA, 17 nt, Human
aggguuaagaaaagaga

SEQ ID NO: 2238569 - RNA, 14 nt, Human
aggguguuuaugua

SEQ ID NO: 2238570 - RNA, 13 nt, Human
aggguuaagaaaa

SEQ ID NO: 2238571 - RNA, 21 nt, Human
aggguggugaccucugccuga

SEQ ID NO: 2238572 - RNA, 14 nt, Human
uggucuuuguaaga

SEQ ID NO: 2238573 - RNA, 15 nt, Human
uggucuuuguaagag

SEQ ID NO: 2238574 - RNA, 21 nt, Human
uggucuuuguaagaguguaga

SEQ ID NO: 2238575 - RNA, 22 nt, Human
uggucuuuguaagaguguagaa

SEQ ID NO: 2238576 - RNA, 22 nt, Human
aggguguccggucccuguccca

SEQ ID NO: 2238577 - RNA, 15 nt, Human
agggugguggagcca

SEQ ID NO: 2238578 - RNA, 17 nt, Human
agggugguggagccagu

SEQ ID NO: 2238579 - RNA, 14 nt, Human
aggguggugcuggg

SEQ ID NO: 2238580 - RNA, 16 nt, Human
aggguggugcugggac

SEQ ID NO: 2238581 - RNA, 17 nt, Human
aggguggugcugggacu

SEQ ID NO: 2238582 - RNA, 23 nt, Human
aggguggugcugggacugagcca

SEQ ID NO: 2238583 - RNA, 23 nt, Human
uggucuuuguaagaguguagaag

SEQ ID NO: 2238584 - RNA, 18 nt, Human
aggguguggcccugccau

SEQ ID NO: 2238585 - RNA, 13 nt, Human
agcuggccccgcc

SEQ ID NO: 2238586 - RNA, 21 nt, Human
agcuggcauuacagcuggaga

SEQ ID NO: 2238587 - RNA, 15 nt, Human
agcuggcauuacagc

SEQ ID NO: 2238588 - RNA, 23 nt, Human
agcuggauuggguuaugaauauu

SEQ ID NO: 2238589 - RNA, 19 nt, Human
agcuggcaaagguggcucu

SEQ ID NO: 2238590 - RNA, 22 nt, Human
agcuggaucuccauucucucag

SEQ ID NO: 2238591 - RNA, 20 nt, Human
agcuggaugauggucuucag

SEQ ID NO: 2238592 - RNA, 14 nt, Human
agcuggaugagaau

SEQ ID NO: 2238593 - RNA, 21 nt, Human
agcugcuuuugucuaugggac

SEQ ID NO: 2238594 - RNA, 21 nt, Human
agcugcuugugucccuccugg

SEQ ID NO: 2238595 - RNA, 19 nt, Human
agcugcuuucuguugucau

SEQ ID NO: 2238596 - RNA, 20 nt, Human
agcugcuuucuguugucauu

SEQ ID NO: 2238597 - RNA, 19 nt, Human
agcugccuguucagcucca

SEQ ID NO: 2238598 - RNA, 14 nt, Human
agcugcuugugucc

SEQ ID NO: 2238599 - RNA, 15 nt, Human
agcugcuuguguccc

SEQ ID NO: 2238600 - RNA, 20 nt, Human
agcugcuugugucccuccug

SEQ ID NO: 2238601 - RNA, 21 nt, Human
agcugcuugggcuucauccuc

SEQ ID NO: 2238602 - RNA, 21 nt, Human
agcugccuguucagcuccagc

SEQ ID NO: 2238603 - RNA, 22 nt, Human
agcugccuguucagcuccagcu

SEQ ID NO: 2238604 - RNA, 20 nt, Human
ugccuggagacuuagggcac

SEQ ID NO: 2238605 - RNA, 14 nt, Human
ugccuggauggggc

SEQ ID NO: 2238606 - RNA, 23 nt, Human
ugccuggaguguaugacugcaca

SEQ ID NO: 2238607 - RNA, 15 nt, Human
ugccuggauggggcu

SEQ ID NO: 2238608 - RNA, 18 nt, Human
agcugccgaccagagccc

SEQ ID NO: 2238609 - RNA, 17 nt, Human
agcugccgaccagagcc

SEQ ID NO: 2238610 - RNA, 13 nt, Human
agcugccgaccag

SEQ ID NO: 2238611 - RNA, 13 nt, Human
agcugccucacuu

SEQ ID NO: 2238612 - RNA, 20 nt, Human
agcugccuguucagcuccag

SEQ ID NO: 2238613 - RNA, 23 nt, Human
ugcccaggagagccagcccuccc

SEQ ID NO: 2238614 - RNA, 22 nt, Human
ugcccaggagagccagcccucc

SEQ ID NO: 2238615 - RNA, 12 nt, Human
ugcccaggcagg

SEQ ID NO: 2238616 - RNA, 13 nt, Human
ugcccaggcaggu

SEQ ID NO: 2238617 - RNA, 14 nt, Human
ugcccaggcagguc

SEQ ID NO: 2238618 - RNA, 13 nt, Human
ugccucugccucu

SEQ ID NO: 2238619 - RNA, 14 nt, Human
ugccucugccucug

SEQ ID NO: 2238620 - RNA, 13 nt, Human
ugccugcccaggc

SEQ ID NO: 2238621 - RNA, 15 nt, Human
ugccucugccucuga

SEQ ID NO: 2238622 - RNA, 18 nt, Human
ugccugccccaaacaaau

SEQ ID NO: 2238623 - RNA, 20 nt, Human
ugccugccccaaacaaauau

SEQ ID NO: 2238624 - RNA, 17 nt, Human
ugccugccccgccccca

SEQ ID NO: 2238625 - RNA, 18 nt, Human
ugccugccccccucaucu

SEQ ID NO: 2238626 - RNA, 12 nt, Human
ugccugccccgc

SEQ ID NO: 2238627 - RNA, 15 nt, Human
ugccugcccuauucu

SEQ ID NO: 2238628 - RNA, 14 nt, Human
ugccugccugucug

SEQ ID NO: 2238629 - RNA, 15 nt, Human
ugccugccugucugu

SEQ ID NO: 2238630 - RNA, 14 nt, Human
ugccugcccaggcc

SEQ ID NO: 2238631 - RNA, 15 nt, Human
ugccugcccaggccc

SEQ ID NO: 2238632 - RNA, 24 nt, Human
ugccugcccaggccccugccaccc

SEQ ID NO: 2238633 - RNA, 16 nt, Human
ugccugcccaggcccc

SEQ ID NO: 2238634 - RNA, 14 nt, Human
agcuggccccgccg

SEQ ID NO: 2238635 - RNA, 15 nt, Human
agcuggccccgccgc

SEQ ID NO: 2238636 - RNA, 18 nt, Human
agcuggccccgccgccug

SEQ ID NO: 2238637 - RNA, 19 nt, Human
agcuggccccgccgccugg

SEQ ID NO: 2238638 - RNA, 20 nt, Human
agcuggccgaggguccuggc

SEQ ID NO: 2238639 - RNA, 16 nt, Human
agcuggcagcagagug

SEQ ID NO: 2238640 - RNA, 15 nt, Human
agcuggcccgugaca

SEQ ID NO: 2238641 - RNA, 21 nt, Human
agcuggccgaggguccuggcu

SEQ ID NO: 2238642 - RNA, 18 nt, Human
agcuggcccgugacagac

SEQ ID NO: 2238643 - RNA, 23 nt, Human
agcuggcucugagcgccuccauc

SEQ ID NO: 2238644 - RNA, 13 nt, Human
agcuggcucugag

SEQ ID NO: 2238645 - RNA, 14 nt, Human
agcuggcucugagc

SEQ ID NO: 2238646 - RNA, 19 nt, Human
agcuggcucugagcgccuc

SEQ ID NO: 2238647 - RNA, 20 nt, Human
agcuggcucugagcgccucc

SEQ ID NO: 2238648 - RNA, 22 nt, Human
agcugucccugucaccaagcuc

SEQ ID NO: 2238649 - RNA, 18 nt, Human
agcugucccugucaccaa

SEQ ID NO: 2238650 - RNA, 15 nt, Human
agcugucccugucac

SEQ ID NO: 2238651 - RNA, 14 nt, Human
agcugucccuguca

SEQ ID NO: 2238652 - RNA, 21 nt, Human
agcugucacuucgcgugcccu

SEQ ID NO: 2238653 - RNA, 21 nt, Human
agcugugcucuggacaggcau

SEQ ID NO: 2238654 - RNA, 23 nt, Human
agcugugcucuggacaggcaugu

SEQ ID NO: 2238655 - RNA, 18 nt, Human
agcugugugcucuccaag

SEQ ID NO: 2238656 - RNA, 14 nt, Human
agcuguguggcagu

SEQ ID NO: 2238657 - RNA, 16 nt, Human
agcuguguggcagucu

SEQ ID NO: 2238658 - RNA, 20 nt, Human
agcugucccugucaccaagc

SEQ ID NO: 2238659 - RNA, 11 nt, Human
agcugucugcu

SEQ ID NO: 2238660 - RNA, 17 nt, Human
agcugucugcucagaca

SEQ ID NO: 2238661 - RNA, 20 nt, Human
agcugucuuguccuugcugg

SEQ ID NO: 2238662 - RNA, 19 nt, Human
agcugugcucuggacaggc

SEQ ID NO: 2238663 - RNA, 20 nt, Human
agcugugcucuggacaggca

SEQ ID NO: 2238664 - RNA, 15 nt, Human
ugccuuaaaacuuua

SEQ ID NO: 2238665 - RNA, 13 nt, Human
ugccuuaaagaaa

SEQ ID NO: 2238666 - RNA, 15 nt, Human
ugccuuaaagaaagu

SEQ ID NO: 2238667 - RNA, 17 nt, Human
ugccuuagagccaggca

SEQ ID NO: 2238668 - RNA, 15 nt, Human
ugccuuagucucagu

SEQ ID NO: 2238669 - RNA, 18 nt, Human
ugccuuagagccaggcac

SEQ ID NO: 2238670 - RNA, 19 nt, Human
ugccuuagagccaggcaca

SEQ ID NO: 2238671 - RNA, 23 nt, Human
ugccuuagagccaggcacacacu

SEQ ID NO: 2238672 - RNA, 15 nt, Human
ugccuuauggaacac

SEQ ID NO: 2238673 - RNA, 16 nt, Human
ugccuuauggaacacu

SEQ ID NO: 2238674 - RNA, 21 nt, Human
ugccuguucagcuccagcuca

SEQ ID NO: 2238675 - RNA, 19 nt, Human
ugccuguugggccaggagc

SEQ ID NO: 2238676 - RNA, 20 nt, Human
ugccuguugggccaggagcc

SEQ ID NO: 2238677 - RNA, 15 nt, Human
ugccuuaaaaccaaa

SEQ ID NO: 2238678 - RNA, 16 nt, Human
ugccuuaaaaccaaag

SEQ ID NO: 2238679 - RNA, 18 nt, Human
ugccuuaaaaccaaagag

SEQ ID NO: 2238680 - RNA, 20 nt, Human
ugccuuaaaaccaaagaggg

SEQ ID NO: 2238681 - RNA, 22 nt, Human
ugccuuaaaaccaaagagggcu

SEQ ID NO: 2238682 - RNA, 14 nt, Human
agcuguucagcugg

SEQ ID NO: 2238683 - RNA, 13 nt, Human
agcuguucagcug

SEQ ID NO: 2238684 - RNA, 18 nt, Human
ugccuguucagcuccagc

SEQ ID NO: 2238685 - RNA, 20 nt, Human
ugccuguucagcuccagcuc

SEQ ID NO: 2238686 - RNA, 20 nt, Human
agcugugugcucuccaagcc

SEQ ID NO: 2238687 - RNA, 19 nt, Human
agcuguucacagccagacu

SEQ ID NO: 2238688 - RNA, 16 nt, Human
agcuguucacagccag

SEQ ID NO: 2238689 - RNA, 22 nt, Human
agcuucuuccaggugcccagcu

SEQ ID NO: 2238690 - RNA, 20 nt, Human
agcuucuuccaggugcccag

SEQ ID NO: 2238691 - RNA, 17 nt, Human
agcuugaaacugagaug

SEQ ID NO: 2238692 - RNA, 17 nt, Human
agcuugaaaguuuucag

SEQ ID NO: 2238693 - RNA, 16 nt, Human
agcuugaaaguuuuca

SEQ ID NO: 2238694 - RNA, 22 nt, Human
agcuugaaaguuuucagaaccu

SEQ ID NO: 2238695 - RNA, 22 nt, Human
agcuugaagaucguuaguaucu

SEQ ID NO: 2238696 - RNA, 19 nt, Human
agcuugaccgugaggccag

SEQ ID NO: 2238697 - RNA, 19 nt, Human
agcuuagaccucagccugu

SEQ ID NO: 2238698 - RNA, 18 nt, Human
agcuuagaccucagccug

SEQ ID NO: 2238699 - RNA, 17 nt, Human
agcuuagaccucagccu

SEQ ID NO: 2238700 - RNA, 16 nt, Human
agcuuagaccucagcc

SEQ ID NO: 2238701 - RNA, 20 nt, Human
agcuuagaccucagccugug

SEQ ID NO: 2238702 - RNA, 15 nt, Human
agcuuagacuaaggc

SEQ ID NO: 2238703 - RNA, 12 nt, Human
agcuucuuccag

SEQ ID NO: 2238704 - RNA, 15 nt, Human
agcuuagagccuccc

SEQ ID NO: 2238705 - RNA, 15 nt, Human
agcuuagaccucagc

SEQ ID NO: 2238706 - RNA, 14 nt, Human
agcuuagaccucag

SEQ ID NO: 2238707 - RNA, 10 nt, Human
agcuuagaac

SEQ ID NO: 2238708 - RNA, 20 nt, Human
agcuuaccagaagcuuccau

SEQ ID NO: 2238709 - RNA, 16 nt, Human
agcuguuguacauuua

SEQ ID NO: 2238710 - RNA, 22 nt, Human
agcuuaccagaagcuuccauag

SEQ ID NO: 2238711 - RNA, 19 nt, Human
agcuugaaggaucuguuuu

SEQ ID NO: 2238712 - RNA, 21 nt, Human
agcuugagccgggccccuggg

SEQ ID NO: 2238713 - RNA, 20 nt, Human
agcuugaccugaggcugugg

SEQ ID NO: 2238714 - RNA, 23 nt, Human
agcuugagccgggccccugggcu

SEQ ID NO: 2238715 - RNA, 24 nt, Human
agcuugagccgggccccugggcuu

SEQ ID NO: 2238716 - RNA, 13 nt, Human
agcuugagccuga

SEQ ID NO: 2238717 - RNA, 15 nt, Human
agcuugagccugaaa

SEQ ID NO: 2238718 - RNA, 14 nt, Human
agcuugaggguugg

SEQ ID NO: 2238719 - RNA, 18 nt, Human
agcuugaggguugggcug

SEQ ID NO: 2238720 - RNA, 18 nt, Human
agcuugggaggcuucccc

SEQ ID NO: 2238721 - RNA, 18 nt, Human
agcuuggguuuuuguuac

SEQ ID NO: 2238722 - RNA, 18 nt, Human
agcuuguaaauagcucag

SEQ ID NO: 2238723 - RNA, 10 nt, Human
agcuugggcc

SEQ ID NO: 2238724 - RNA, 12 nt, Human
agcuugggccca

SEQ ID NO: 2238725 - RNA, 16 nt, Human
agcuugggcccagcug

SEQ ID NO: 2238726 - RNA, 17 nt, Human
agcuugggcccagcugg

SEQ ID NO: 2238727 - RNA, 18 nt, Human
agcuugggcccagcuggg

SEQ ID NO: 2238728 - RNA, 19 nt, Human
agcuugggcccagcugggc

SEQ ID NO: 2238729 - RNA, 23 nt, Human
agcuuggggacaggggcaggagg

SEQ ID NO: 2238730 - RNA, 23 nt, Human
agcuugggcccagcugggcucug

SEQ ID NO: 2238731 - RNA, 20 nt, Human
agcuugggcccagcugggcu

SEQ ID NO: 2238732 - RNA, 21 nt, Human
agcuugggcccagcugggcuc

SEQ ID NO: 2238733 - RNA, 15 nt, Human
agcuguugagcuguu

SEQ ID NO: 2238734 - RNA, 16 nt, Human
agcuguugagcuguuu

SEQ ID NO: 2238735 - RNA, 17 nt, Human
agcuguugagcuguuuu

SEQ ID NO: 2238736 - RNA, 22 nt, Human
agcuguuggccucugcaaagga

SEQ ID NO: 2238737 - RNA, 13 nt, Human
agcuguugccuca

SEQ ID NO: 2238738 - RNA, 15 nt, Human
agcuguuguacauuu

SEQ ID NO: 2238739 - RNA, 19 nt, Human
agcuuacaagccagcugga

SEQ ID NO: 2238740 - RNA, 13 nt, Human
agcuguugagcug

SEQ ID NO: 2238741 - RNA, 14 nt, Human
agcuguugagcugu

SEQ ID NO: 2238742 - RNA, 19 nt, Human
ugcuacaacuucagcagua

SEQ ID NO: 2238743 - RNA, 15 nt, Human
agcuguucugucccu

SEQ ID NO: 2238744 - RNA, 20 nt, Human
agcuguucugucccuuggag

SEQ ID NO: 2238745 - RNA, 22 nt, Human
agcuguucugucccuuggagcu

SEQ ID NO: 2238746 - RNA, 20 nt, Human
ugcuacaaaaacacagcaag

SEQ ID NO: 2238747 - RNA, 12 nt, Human
ugcuacaaagaa

SEQ ID NO: 2238748 - RNA, 16 nt, Human
ugcuacaaagaagaca

SEQ ID NO: 2238749 - RNA, 17 nt, Human
ugcuacaaagaagacau

SEQ ID NO: 2238750 - RNA, 18 nt, Human
ugcuacaaagaagacaug

SEQ ID NO: 2238751 - RNA, 20 nt, Human
ugcuacaaagaagacauguu

SEQ ID NO: 2238752 - RNA, 21 nt, Human
ugcuacaaagaagacauguuu

SEQ ID NO: 2238753 - RNA, 23 nt, Human
ugcuacaaagaagacauguuuua

SEQ ID NO: 2238754 - RNA, 13 nt, Human
ugcuacaacuuca

SEQ ID NO: 2238755 - RNA, 12 nt, Human
ugcuaaguauuu

SEQ ID NO: 2238756 - RNA, 16 nt, Human
ugcuaaguauuuccca

SEQ ID NO: 2238757 - RNA, 17 nt, Human
ugcuaaguauuucccag

SEQ ID NO: 2238758 - RNA, 20 nt, Human
ugcuaagccccagcaagcaa

SEQ ID NO: 2238759 - RNA, 19 nt, Human
ugcuacaaaaacacagcaa

SEQ ID NO: 2238760 - RNA, 18 nt, Human
ugcuacaaaaacacagca

SEQ ID NO: 2238761 - RNA, 17 nt, Human
ugcuacaaaaacacagc

SEQ ID NO: 2238762 - RNA, 16 nt, Human
ugcuacaaaaacacag

SEQ ID NO: 2238763 - RNA, 17 nt, Human
ugccuuuggcagaguuc

SEQ ID NO: 2238764 - RNA, 15 nt, Human
ugccuuuguuuugau

SEQ ID NO: 2238765 - RNA, 22 nt, Human
ugccuuugaguuuccucaggcu

SEQ ID NO: 2238766 - RNA, 21 nt, Human
ugccuuugaguuuccucaggc

SEQ ID NO: 2238767 - RNA, 19 nt, Human
ugccuuugaguuuccucag

SEQ ID NO: 2238768 - RNA, 18 nt, Human
ugccuuugaguuuccuca

SEQ ID NO: 2238769 - RNA, 23 nt, Human
ugccuuugagacaguuucuuagc

SEQ ID NO: 2238770 - RNA, 12 nt, Human
ugccuuugagac

SEQ ID NO: 2238771 - RNA, 13 nt, Human
ugccuuugagaca

SEQ ID NO: 2238772 - RNA, 15 nt, Human
ugccuuugagacagu

SEQ ID NO: 2238773 - RNA, 17 nt, Human
ugccuuugagacaguuu

SEQ ID NO: 2238774 - RNA, 18 nt, Human
ugccuuugagacaguuuc

SEQ ID NO: 2238775 - RNA, 19 nt, Human
ugccuuugagacaguuucu

SEQ ID NO: 2238776 - RNA, 20 nt, Human
ugccuuugagacaguuucuu

SEQ ID NO: 2238777 - RNA, 21 nt, Human
ugccuuugagacaguuucuua

SEQ ID NO: 2238778 - RNA, 13 nt, Human
ugccuuucuaguc

SEQ ID NO: 2238779 - RNA, 16 nt, Human
ugccuuagucucaguu

SEQ ID NO: 2238780 - RNA, 20 nt, Human
ugccuuagucucaguuugug

SEQ ID NO: 2238781 - RNA, 14 nt, Human
ugccuuaucuugca

SEQ ID NO: 2238782 - RNA, 11 nt, Human
ugccuuucucg

SEQ ID NO: 2238783 - RNA, 20 nt, Human
ugccuuucucgauuuuaucu

SEQ ID NO: 2238784 - RNA, 13 nt, Human
ugccuuugaccug

SEQ ID NO: 2238785 - RNA, 23 nt, Human
ugccuuugaccugccucccuuca

SEQ ID NO: 2238786 - RNA, 17 nt, Human
ugccuuugaccugccuc

SEQ ID NO: 2238787 - RNA, 18 nt, Human
ugcggccgcauucccuga

SEQ ID NO: 2238788 - RNA, 16 nt, Human
ugcggcccagcccggc

SEQ ID NO: 2238789 - RNA, 18 nt, Human
ugcggcccagcccggcuc

SEQ ID NO: 2238790 - RNA, 17 nt, Human
ugcggcauuaaagccau

SEQ ID NO: 2238791 - RNA, 13 nt, Human
ugcggcccagccc

SEQ ID NO: 2238792 - RNA, 14 nt, Human
ugcggcccagcccg

SEQ ID NO: 2238793 - RNA, 15 nt, Human
ugcggcccagcccgg

SEQ ID NO: 2238794 - RNA, 13 nt, Human
ugcggauggccgg

SEQ ID NO: 2238795 - RNA, 23 nt, Human
ugcggcagguucacaggcgaggc

SEQ ID NO: 2238796 - RNA, 20 nt, Human
ugcggagugaagaggggcag

SEQ ID NO: 2238797 - RNA, 14 nt, Human
ugcggaucucugga

SEQ ID NO: 2238798 - RNA, 15 nt, Human
ugcggaucucuggag

SEQ ID NO: 2238799 - RNA, 15 nt, Human
ugcggagugaagagg

SEQ ID NO: 2238800 - RNA, 16 nt, Human
ugcggagugaagaggg

SEQ ID NO: 2238801 - RNA, 21 nt, Human
ugcggagugaagaggggcagc

SEQ ID NO: 2238802 - RNA, 23 nt, Human
ugcggaccccagcugugagccuu

SEQ ID NO: 2238803 - RNA, 15 nt, Human
ugcggagaacaaaug

SEQ ID NO: 2238804 - RNA, 19 nt, Human
ugcggagaaccuugugccu

SEQ ID NO: 2238805 - RNA, 13 nt, Human
ugcggagaacaaa

SEQ ID NO: 2238806 - RNA, 14 nt, Human
ugcggaccccagcu

SEQ ID NO: 2238807 - RNA, 22 nt, Human
ugcggaccccagcugugagccu

SEQ ID NO: 2238808 - RNA, 13 nt, Human
ugcggaccccagc

SEQ ID NO: 2238809 - RNA, 23 nt, Human
ugcggacagccacggccaggcca

SEQ ID NO: 2238810 - RNA, 22 nt, Human
ugcggacagccacggccaggcc

SEQ ID NO: 2238811 - RNA, 13 nt, Human
ugccuuuuauagc

SEQ ID NO: 2238812 - RNA, 17 nt, Human
ugccuuuuauagcuauu

SEQ ID NO: 2238813 - RNA, 22 nt, Human
ugccuuuuauagcuauuacugu

SEQ ID NO: 2238814 - RNA, 17 nt, Human
ugcgggcugggcagcug

SEQ ID NO: 2238815 - RNA, 17 nt, Human
ugcgggcuuuuccccgg

SEQ ID NO: 2238816 - RNA, 21 nt, Human
ugcgggaccgguacagaaagg

SEQ ID NO: 2238817 - RNA, 16 nt, Human
ugcgggucacaggagg

SEQ ID NO: 2238818 - RNA, 14 nt, Human
ugcgggucacagga

SEQ ID NO: 2238819 - RNA, 17 nt, Human
ugcgguccacccaggag

SEQ ID NO: 2238820 - RNA, 17 nt, Human
ugcgggucacaggaggg

SEQ ID NO: 2238821 - RNA, 21 nt, Human
ugcgggugaacaaagcagcca

SEQ ID NO: 2238822 - RNA, 18 nt, Human
ugcgggugaacaaagcag

SEQ ID NO: 2238823 - RNA, 18 nt, Human
ugcgguccacccaggagc

SEQ ID NO: 2238824 - RNA, 23 nt, Human
ugcgggugaacaaagcagccacg

SEQ ID NO: 2238825 - RNA, 22 nt, Human
ugcgggugaacaaagcagccac

SEQ ID NO: 2238826 - RNA, 23 nt, Human
ugcggguggggcuuggggcucac

SEQ ID NO: 2238827 - RNA, 14 nt, Human
ugcggucuagggaa

SEQ ID NO: 2238828 - RNA, 17 nt, Human
ugcggugcuaucucccc

SEQ ID NO: 2238829 - RNA, 21 nt, Human
ugcggugcuaucucccccagc

SEQ ID NO: 2238830 - RNA, 13 nt, Human
ugcgggcugggca

SEQ ID NO: 2238831 - RNA, 14 nt, Human
ugcgggcugggcag

SEQ ID NO: 2238832 - RNA, 15 nt, Human
ugcgggcugggcagc

SEQ ID NO: 2238833 - RNA, 16 nt, Human
ugcgggcugggcagcu

SEQ ID NO: 2238834 - RNA, 20 nt, Human
ugcgggcuuccuccuggugu

SEQ ID NO: 2238835 - RNA, 19 nt, Human
ugcgggaugguccuggggc

SEQ ID NO: 2238836 - RNA, 18 nt, Human
ugcgggaugguccugggg

SEQ ID NO: 2238837 - RNA, 17 nt, Human
ugcgggaugguccuggg

SEQ ID NO: 2238838 - RNA, 13 nt, Human
ugcggcugugcag

SEQ ID NO: 2238839 - RNA, 20 nt, Human
ugcggcugugcagccugucc

SEQ ID NO: 2238840 - RNA, 21 nt, Human
ugcggcugugcagccuguccu

SEQ ID NO: 2238841 - RNA, 19 nt, Human
ugcggccuuuggcuucacg

SEQ ID NO: 2238842 - RNA, 17 nt, Human
ugcggccuuuggcuuca

SEQ ID NO: 2238843 - RNA, 19 nt, Human
ugcggccgcauucccugag

SEQ ID NO: 2238844 - RNA, 21 nt, Human
ugcggcccagcccggcuccca

SEQ ID NO: 2238845 - RNA, 16 nt, Human
ugcuauuguaaauaug

SEQ ID NO: 2238846 - RNA, 17 nt, Human
ugcuauuguaaauaugu

SEQ ID NO: 2238847 - RNA, 14 nt, Human
ugcucauggaauug

SEQ ID NO: 2238848 - RNA, 21 nt, Human
ugcucccccauccuccccuuc

SEQ ID NO: 2238849 - RNA, 20 nt, Human
ugcucccccauccuccccuu

SEQ ID NO: 2238850 - RNA, 19 nt, Human
ugcucccccauccuccccu

SEQ ID NO: 2238851 - RNA, 18 nt, Human
ugcucccccauccucccc

SEQ ID NO: 2238852 - RNA, 14 nt, Human
ugcuccaccacauc

SEQ ID NO: 2238853 - RNA, 13 nt, Human
ugcuccacagugu

SEQ ID NO: 2238854 - RNA, 12 nt, Human
ugcuccacagug

SEQ ID NO: 2238855 - RNA, 14 nt, Human
ugcucauuucagga

SEQ ID NO: 2238856 - RNA, 18 nt, Human
ugcucccuccccugcccu

SEQ ID NO: 2238857 - RNA, 17 nt, Human
ugcucccuccccugccc

SEQ ID NO: 2238858 - RNA, 15 nt, Human
ugcuccgugccucca

SEQ ID NO: 2238859 - RNA, 16 nt, Human
ugcuccgugccuccac

SEQ ID NO: 2238860 - RNA, 17 nt, Human
ugcuccgugccuccacc

SEQ ID NO: 2238861 - RNA, 15 nt, Human
ugcucccuccccugc

SEQ ID NO: 2238862 - RNA, 14 nt, Human
ugcucccuccccug

SEQ ID NO: 2238863 - RNA, 13 nt, Human
ugcucccuccccu

SEQ ID NO: 2238864 - RNA, 20 nt, Human
ugcucccuaccaccucccca

SEQ ID NO: 2238865 - RNA, 16 nt, Human
ugcucccuaccaccuc

SEQ ID NO: 2238866 - RNA, 15 nt, Human
ugcucccucacaugu

SEQ ID NO: 2238867 - RNA, 17 nt, Human
ugcuccccucccuccuc

SEQ ID NO: 2238868 - RNA, 16 nt, Human
ugcuccccucccuccu

SEQ ID NO: 2238869 - RNA, 14 nt, Human
ugcuccccucccuc

SEQ ID NO: 2238870 - RNA, 23 nt, Human
ugcucccccauccuccccuuccc

SEQ ID NO: 2238871 - RNA, 22 nt, Human
ugcucccccauccuccccuucc

SEQ ID NO: 2238872 - RNA, 13 nt, Human
ugcuccgugcuug

SEQ ID NO: 2238873 - RNA, 18 nt, Human
ugcuccgugccuccacca

SEQ ID NO: 2238874 - RNA, 19 nt, Human
ugcuccgugccuccaccac

SEQ ID NO: 2238875 - RNA, 24 nt, Human
ugcuccuagagggaggggccuagg

SEQ ID NO: 2238876 - RNA, 14 nt, Human
ugcuccuagaggga

SEQ ID NO: 2238877 - RNA, 20 nt, Human
ugcuccgugccuccaccacc

SEQ ID NO: 2238878 - RNA, 22 nt, Human
ugcuccuccagggccacgugcc

SEQ ID NO: 2238879 - RNA, 21 nt, Human
ugcuccuccagggccacgugc

SEQ ID NO: 2238880 - RNA, 16 nt, Human
ugcuccuccagggcca

SEQ ID NO: 2238881 - RNA, 13 nt, Human
ugcuccuccaggg

SEQ ID NO: 2238882 - RNA, 12 nt, Human
ugcuccuccagg

SEQ ID NO: 2238883 - RNA, 11 nt, Human
ugcuccuccag

SEQ ID NO: 2238884 - RNA, 20 nt, Human
ugcuccuagagggaggggcc

SEQ ID NO: 2238885 - RNA, 14 nt, Human
ugcucuggacaggc

SEQ ID NO: 2238886 - RNA, 12 nt, Human
ugcuccucccug

SEQ ID NO: 2238887 - RNA, 13 nt, Human
ugcuccucccugg

SEQ ID NO: 2238888 - RNA, 14 nt, Human
ugcuccucccuggc

SEQ ID NO: 2238889 - RNA, 15 nt, Human
ugcuccucccuggcu

SEQ ID NO: 2238890 - RNA, 17 nt, Human
ugcuccucccuggcugc

SEQ ID NO: 2238891 - RNA, 19 nt, Human
ugcuccucccuggcugccc

SEQ ID NO: 2238892 - RNA, 20 nt, Human
ugcuccucccuggcugcccu

SEQ ID NO: 2238893 - RNA, 22 nt, Human
ugcuccucccuggcugcccugg

SEQ ID NO: 2238894 - RNA, 15 nt, Human
ugcucuggacaggca

SEQ ID NO: 2238895 - RNA, 16 nt, Human
ugcucuggacaggcau

SEQ ID NO: 2238896 - RNA, 14 nt, Human
ugcugacuguacuc

SEQ ID NO: 2238897 - RNA, 19 nt, Human
ugcuccuccuuggugccug

SEQ ID NO: 2238898 - RNA, 23 nt, Human
ugcuccucccuggcugcccuggc

SEQ ID NO: 2238899 - RNA, 16 nt, Human
ugcucuggaagagagg

SEQ ID NO: 2238900 - RNA, 16 nt, Human
ugcugacuguacuccu

SEQ ID NO: 2238901 - RNA, 19 nt, Human
ugcugacuguacuccuccc

SEQ ID NO: 2238902 - RNA, 15 nt, Human
agcuuuaaaagaaaa

SEQ ID NO: 2238903 - RNA, 13 nt, Human
agcuuuaaaagaa

SEQ ID NO: 2238904 - RNA, 21 nt, Human
agcuugggggaugacuagagg

SEQ ID NO: 2238905 - RNA, 15 nt, Human
agcuuuaaacaaauu

SEQ ID NO: 2238906 - RNA, 19 nt, Human
agcuuuaaacucagggaca

SEQ ID NO: 2238907 - RNA, 20 nt, Human
agcuuuaaacucagggacag

SEQ ID NO: 2238908 - RNA, 21 nt, Human
agcuuuaaacucagggacaga

SEQ ID NO: 2238909 - RNA, 20 nt, Human
agcuuuaaccauuaaaacug

SEQ ID NO: 2238910 - RNA, 22 nt, Human
agcuuuaaccauuaaaacugaa

SEQ ID NO: 2238911 - RNA, 21 nt, Human
agcuuuacaugcaauuuauua

SEQ ID NO: 2238912 - RNA, 15 nt, Human
agcuuuacaugcaau

SEQ ID NO: 2238913 - RNA, 19 nt, Human
agcuuuacaugcaauuuau

SEQ ID NO: 2238914 - RNA, 20 nt, Human
agcuuuacccucaggcauag

SEQ ID NO: 2238915 - RNA, 17 nt, Human
agcuuuacccucaggca

SEQ ID NO: 2238916 - RNA, 13 nt, Human
agcuuuacccuca

SEQ ID NO: 2238917 - RNA, 15 nt, Human
agcuuuacuguuugu

SEQ ID NO: 2238918 - RNA, 18 nt, Human
agcuuuacccucaggcau

SEQ ID NO: 2238919 - RNA, 13 nt, Human
agcuuuagacccu

SEQ ID NO: 2238920 - RNA, 16 nt, Human
agcuuuagacccuggg

SEQ ID NO: 2238921 - RNA, 17 nt, Human
agcuuuagacccugggu

SEQ ID NO: 2238922 - RNA, 22 nt, Human
agcuuuauguaauaaugugaau

SEQ ID NO: 2238923 - RNA, 14 nt, Human
agcuuuauguaaua

SEQ ID NO: 2238924 - RNA, 14 nt, Human
agcuuuauacgugu

SEQ ID NO: 2238925 - RNA, 23 nt, Human
agcuuuaucaccagagagggacu

SEQ ID NO: 2238926 - RNA, 19 nt, Human
agcuuuagacccugggugg

SEQ ID NO: 2238927 - RNA, 22 nt, Human
agcuuuagacccugggugggcu

SEQ ID NO: 2238928 - RNA, 18 nt, Human
agcuuuauacguguagcu

SEQ ID NO: 2238929 - RNA, 22 nt, Human
agcuuuauuuuuuaaguauuua

SEQ ID NO: 2238930 - RNA, 19 nt, Human
agcuuuauuuuuuaaguau

SEQ ID NO: 2238931 - RNA, 16 nt, Human
agcuuuauguaauaau

SEQ ID NO: 2238932 - RNA, 14 nt, Human
agcuuuauucuuca

SEQ ID NO: 2238933 - RNA, 19 nt, Human
ugcuaucucccccagcccc

SEQ ID NO: 2238934 - RNA, 16 nt, Human
ugcuauugacaaguca

SEQ ID NO: 2238935 - RNA, 13 nt, Human
ugcuauuguaaau

SEQ ID NO: 2238936 - RNA, 15 nt, Human
ugcuauuguaaauau

SEQ ID NO: 2238937 - RNA, 18 nt, Human
ugcuauuguagagccaga

SEQ ID NO: 2238938 - RNA, 14 nt, Human
ugcuauuagacugu

SEQ ID NO: 2238939 - RNA, 20 nt, Human
ugcuauguuuugacauuuuu

SEQ ID NO: 2238940 - RNA, 17 nt, Human
agcuuucaaagaaggaa

SEQ ID NO: 2238941 - RNA, 16 nt, Human
ugcuaucucugugugc

SEQ ID NO: 2238942 - RNA, 20 nt, Human
ugcuaucucccccagcccca

SEQ ID NO: 2238943 - RNA, 22 nt, Human
ugcuauggggagaaaagacaug

SEQ ID NO: 2238944 - RNA, 17 nt, Human
ugcuaucuuaauuuugg

SEQ ID NO: 2238945 - RNA, 18 nt, Human
ugcuaucuuaauuuuggu

SEQ ID NO: 2238946 - RNA, 16 nt, Human
ugcuaucuuaauuuug

SEQ ID NO: 2238947 - RNA, 20 nt, Human
ugcuaucucugugugcacaa

SEQ ID NO: 2238948 - RNA, 21 nt, Human
ugcuaucucugugugcacaaa

SEQ ID NO: 2238949 - RNA, 20 nt, Human
aggaaauaagaaaaaucaug

SEQ ID NO: 2238950 - RNA, 20 nt, Human
aggaaauauauaugugugug

SEQ ID NO: 2238951 - RNA, 14 nt, Human
aggaaauccagggu

SEQ ID NO: 2238952 - RNA, 11 nt, Human
aggaagcacau

SEQ ID NO: 2238953 - RNA, 16 nt, Human
aggaagcacaugccuc

SEQ ID NO: 2238954 - RNA, 17 nt, Human
aggaagcacaugccucu

SEQ ID NO: 2238955 - RNA, 15 nt, Human
aggaaaucaccgaaa

SEQ ID NO: 2238956 - RNA, 19 nt, Human
aggaaaucaccgaaaacgu

SEQ ID NO: 2238957 - RNA, 13 nt, Human
aggaaauauuuau

SEQ ID NO: 2238958 - RNA, 23 nt, Human
aggaaaucaaauaugcaaagcac

SEQ ID NO: 2238959 - RNA, 22 nt, Human
aggaaauaaaaccuuucaaauu

SEQ ID NO: 2238960 - RNA, 16 nt, Human
aggaaauaagaaaaau

SEQ ID NO: 2238961 - RNA, 18 nt, Human
aggaaauaagaaaaauca

SEQ ID NO: 2238962 - RNA, 21 nt, Human
aggaaauaaaaccuuucaaau

SEQ ID NO: 2238963 - RNA, 20 nt, Human
aggaaauaaaaccuuucaaa

SEQ ID NO: 2238964 - RNA, 12 nt, Human
aggaaauauuua

SEQ ID NO: 2238965 - RNA, 19 nt, Human
aggaaauaaaaccuuucaa

SEQ ID NO: 2238966 - RNA, 24 nt, Human
aggaaaggccagcuggcagcagag

SEQ ID NO: 2238967 - RNA, 16 nt, Human
aggaaaggcuccagga

SEQ ID NO: 2238968 - RNA, 15 nt, Human
aggaaaggcuccagg

SEQ ID NO: 2238969 - RNA, 16 nt, Human
ugcugacuguuuucuc

SEQ ID NO: 2238970 - RNA, 14 nt, Human
ugcucuggaauuug

SEQ ID NO: 2238971 - RNA, 21 nt, Human
ugcugacuguacuccucccag

SEQ ID NO: 2238972 - RNA, 22 nt, Human
ugcugacuguacuccucccagg

SEQ ID NO: 2238973 - RNA, 13 nt, Human
aggaaaggcucca

SEQ ID NO: 2238974 - RNA, 14 nt, Human
aggaaaggcuccag

SEQ ID NO: 2238975 - RNA, 12 nt, Human
aggaaggaaaga

SEQ ID NO: 2238976 - RNA, 17 nt, Human
aggaagcucagacuggu

SEQ ID NO: 2238977 - RNA, 16 nt, Human
aggaagcucagacugg

SEQ ID NO: 2238978 - RNA, 14 nt, Human
aggaagcucagacu

SEQ ID NO: 2238979 - RNA, 20 nt, Human
aggaagccugcaguccugga

SEQ ID NO: 2238980 - RNA, 23 nt, Human
aggaaggaaacccagcucugguc

SEQ ID NO: 2238981 - RNA, 20 nt, Human
aggaaggaaacccagcucug

SEQ ID NO: 2238982 - RNA, 22 nt, Human
aggaaggaaacccagcucuggu

SEQ ID NO: 2238983 - RNA, 21 nt, Human
aggaagccgugcccugccccc

SEQ ID NO: 2238984 - RNA, 20 nt, Human
aggaagccgugcccugcccc

SEQ ID NO: 2238985 - RNA, 22 nt, Human
aggaagcccccaccgugggcag

SEQ ID NO: 2238986 - RNA, 12 nt, Human
aggaagcucagg

SEQ ID NO: 2238987 - RNA, 19 nt, Human
aggaagccugcaguccugg

SEQ ID NO: 2238988 - RNA, 18 nt, Human
aggaagccgcuggggcca

SEQ ID NO: 2238989 - RNA, 18 nt, Human
aggaagccagcaggcucu

SEQ ID NO: 2238990 - RNA, 19 nt, Human
aggaagccgcuggggccag

SEQ ID NO: 2238991 - RNA, 20 nt, Human
aggaagccgcuggggccagu

SEQ ID NO: 2238992 - RNA, 22 nt, Human
aggaagcacaugccucucucag

SEQ ID NO: 2238993 - RNA, 16 nt, Human
aggaaauauugcuggg

SEQ ID NO: 2238994 - RNA, 21 nt, Human
aggaagccagcaggcucucag

SEQ ID NO: 2238995 - RNA, 22 nt, Human
aggaagccagcaggcucucagg

SEQ ID NO: 2238996 - RNA, 23 nt, Human
aggaagccagcaggcucucaggc

SEQ ID NO: 2238997 - RNA, 13 nt, Human
ugcuucaaaaaca

SEQ ID NO: 2238998 - RNA, 21 nt, Human
ugcuucaaaaacauucuuaca

SEQ ID NO: 2238999 - RNA, 21 nt, Human
ugcuuauuguuccaagacauu

SEQ ID NO: 2239000 - RNA, 17 nt, Human
ugcuuauuguuccaaga

SEQ ID NO: 2239001 - RNA, 23 nt, Human
ugcuuauuguuccaagacauugu

SEQ ID NO: 2239002 - RNA, 23 nt, Human
ugcuuauuugacaacguuucagc

SEQ ID NO: 2239003 - RNA, 16 nt, Human
ugcuuauuguuccaag

SEQ ID NO: 2239004 - RNA, 15 nt, Human
ugcuuauuguuccaa

SEQ ID NO: 2239005 - RNA, 14 nt, Human
ugcuuauuguucca

SEQ ID NO: 2239006 - RNA, 18 nt, Human
ugcuuagucacugccugc

SEQ ID NO: 2239007 - RNA, 18 nt, Human
ugcuuaguaaugcuacgu

SEQ ID NO: 2239008 - RNA, 14 nt, Human
ugcuuagucacugc

SEQ ID NO: 2239009 - RNA, 15 nt, Human
ugcuuagucacugcc

SEQ ID NO: 2239010 - RNA, 16 nt, Human
ugcuuagucacugccu

SEQ ID NO: 2239011 - RNA, 14 nt, Human
ugcuuaggaugugu

SEQ ID NO: 2239012 - RNA, 16 nt, Human
ugcuuaggaugugugc

SEQ ID NO: 2239013 - RNA, 23 nt, Human
ugcuuaggauguuuuucaugaaa

SEQ ID NO: 2239014 - RNA, 14 nt, Human
ugcuuaggauguuu

SEQ ID NO: 2239015 - RNA, 13 nt, Human
ugcuuaguaaugc

SEQ ID NO: 2239016 - RNA, 14 nt, Human
ugcuuaguaaugcu

SEQ ID NO: 2239017 - RNA, 15 nt, Human
ugcuuaguaaugcua

SEQ ID NO: 2239018 - RNA, 15 nt, Human
ugcuguggccugggc

SEQ ID NO: 2239019 - RNA, 14 nt, Human
ugcuguggccuggg

SEQ ID NO: 2239020 - RNA, 12 nt, Human
ugcuguggccug

SEQ ID NO: 2239021 - RNA, 17 nt, Human
ugcuguggccaggguga

SEQ ID NO: 2239022 - RNA, 23 nt, Human
ugcuguggccagggugagagcug

SEQ ID NO: 2239023 - RNA, 16 nt, Human
ugcuguggccugggca

SEQ ID NO: 2239024 - RNA, 10 nt, Human
ugcuguggga

SEQ ID NO: 2239025 - RNA, 23 nt, Human
ugcuuacuaagcuuugccagcug

SEQ ID NO: 2239026 - RNA, 22 nt, Human
ugcuuacugauauauuuuacaa

SEQ ID NO: 2239027 - RNA, 14 nt, Human
ugcuuacugauaua

SEQ ID NO: 2239028 - RNA, 14 nt, Human
ugcuuacuuuggaa

SEQ ID NO: 2239029 - RNA, 18 nt, Human
ugcuuacuuuggaauaca

SEQ ID NO: 2239030 - RNA, 22 nt, Human
ugcuuacuuuggaauacauuuc

SEQ ID NO: 2239031 - RNA, 17 nt, Human
ugcuuagacauaacaaa

SEQ ID NO: 2239032 - RNA, 19 nt, Human
ugcuuagaauccaaacuug

SEQ ID NO: 2239033 - RNA, 14 nt, Human
ugcuuagccuccug

SEQ ID NO: 2239034 - RNA, 14 nt, Human
ugcuuagaaaagaa

SEQ ID NO: 2239035 - RNA, 15 nt, Human
ugcuuagccuccuga

SEQ ID NO: 2239036 - RNA, 18 nt, Human
ugcuuagccuccugaccu

SEQ ID NO: 2239037 - RNA, 19 nt, Human
ugcuuagccuccugaccug

SEQ ID NO: 2239038 - RNA, 18 nt, Human
ugcuuagcucaucuuaga

SEQ ID NO: 2239039 - RNA, 17 nt, Human
ugcugucccuuacguga

SEQ ID NO: 2239040 - RNA, 21 nt, Human
ugcuguauauuugugauagca

SEQ ID NO: 2239041 - RNA, 23 nt, Human
ugcuguauuuuaaaagaaugauu

SEQ ID NO: 2239042 - RNA, 19 nt, Human
ugcugucccuuacgugagu

SEQ ID NO: 2239043 - RNA, 15 nt, Human
ugcugucccuuuucc

SEQ ID NO: 2239044 - RNA, 15 nt, Human
ugcugugccucccaa

SEQ ID NO: 2239045 - RNA, 13 nt, Human
ugcuguggaagca

SEQ ID NO: 2239046 - RNA, 14 nt, Human
ugcuguggccaggg

SEQ ID NO: 2239047 - RNA, 12 nt, Human
ugcuguggccag

SEQ ID NO: 2239048 - RNA, 13 nt, Human
ugcugugcaaaug

SEQ ID NO: 2239049 - RNA, 17 nt, Human
ugcugucccuuuuccuu

SEQ ID NO: 2239050 - RNA, 17 nt, Human
ugcuucaaauccaucca

SEQ ID NO: 2239051 - RNA, 19 nt, Human
ugcuucaaauccauccaga

SEQ ID NO: 2239052 - RNA, 17 nt, Human
ugcuuauuuuaaaauuu

SEQ ID NO: 2239053 - RNA, 15 nt, Human
ugcuuauuuuaaaau

SEQ ID NO: 2239054 - RNA, 20 nt, Human
ugcuucaaggauccugagcc

SEQ ID NO: 2239055 - RNA, 21 nt, Human
ugcuucaaggauccugagcca

SEQ ID NO: 2239056 - RNA, 23 nt, Human
ugcuucaaggauccugagccaga

SEQ ID NO: 2239057 - RNA, 17 nt, Human
ugcuucaugcucagccc

SEQ ID NO: 2239058 - RNA, 23 nt, Human
ugcuucaauacccaaauccucuc

SEQ ID NO: 2239059 - RNA, 15 nt, Human
ugcuucaauuaauaa

SEQ ID NO: 2239060 - RNA, 16 nt, Human
ugcuucaauuaauaaa

SEQ ID NO: 2239061 - RNA, 23 nt, Human
ugcuucaauuaauaaaaaaugga

SEQ ID NO: 2239062 - RNA, 16 nt, Human
ugcuuccaggaaacuc

SEQ ID NO: 2239063 - RNA, 17 nt, Human
ugcuuccaccucacccc

SEQ ID NO: 2239064 - RNA, 18 nt, Human
ugcuuccaccucacccca

SEQ ID NO: 2239065 - RNA, 19 nt, Human
ugcuuccaccucaccccac

SEQ ID NO: 2239066 - RNA, 20 nt, Human
ugcuuccaccucaccccacu

SEQ ID NO: 2239067 - RNA, 15 nt, Human
ugcuuccaauuuucu

SEQ ID NO: 2239068 - RNA, 11 nt, Human
ugcuuccaccu

SEQ ID NO: 2239069 - RNA, 14 nt, Human
ugcuuccaccucac

SEQ ID NO: 2239070 - RNA, 15 nt, Human
ugcuuccaccucacc

SEQ ID NO: 2239071 - RNA, 16 nt, Human
ugcuuccaccucaccc

SEQ ID NO: 2239072 - RNA, 18 nt, Human
aggacacuaaccacgcug

SEQ ID NO: 2239073 - RNA, 19 nt, Human
ugcuuccaggaaacuccac

SEQ ID NO: 2239074 - RNA, 17 nt, Human
aggacaccacacccagc

SEQ ID NO: 2239075 - RNA, 18 nt, Human
aggacaccacacccagcc

SEQ ID NO: 2239076 - RNA, 19 nt, Human
aggacaccacacccagccu

SEQ ID NO: 2239077 - RNA, 20 nt, Human
aggacaccacacccagccuc

SEQ ID NO: 2239078 - RNA, 21 nt, Human
aggacaccacacccagccuca

SEQ ID NO: 2239079 - RNA, 22 nt, Human
aggacaccacacccagccucag

SEQ ID NO: 2239080 - RNA, 23 nt, Human
aggacaccacacccagccucagu

SEQ ID NO: 2239081 - RNA, 16 nt, Human
ugcuuccagugaggcu

SEQ ID NO: 2239082 - RNA, 15 nt, Human
aggacaccacaccca

SEQ ID NO: 2239083 - RNA, 14 nt, Human
aggacacuuccugc

SEQ ID NO: 2239084 - RNA, 17 nt, Human
aggacacugauaugggu

SEQ ID NO: 2239085 - RNA, 15 nt, Human
aggacacuuccugcc

SEQ ID NO: 2239086 - RNA, 16 nt, Human
aggacacuuccugccu

SEQ ID NO: 2239087 - RNA, 17 nt, Human
aggacagccccuccucc

SEQ ID NO: 2239088 - RNA, 19 nt, Human
aggacagauccagggacug

SEQ ID NO: 2239089 - RNA, 19 nt, Human
ugcugggauuacaagcgug

SEQ ID NO: 2239090 - RNA, 16 nt, Human
ugcugggacucagccu

SEQ ID NO: 2239091 - RNA, 18 nt, Human
ugcugggacucagccuuc

SEQ ID NO: 2239092 - RNA, 22 nt, Human
ugcugggacucagccuucagac

SEQ ID NO: 2239093 - RNA, 23 nt, Human
ugcugggacucagccuucagaca

SEQ ID NO: 2239094 - RNA, 19 nt, Human
ugcuggcuguuggcugggg

SEQ ID NO: 2239095 - RNA, 21 nt, Human
ugcuggcuguuggcugggggc

SEQ ID NO: 2239096 - RNA, 21 nt, Human
ugcuggcugcccagaccccuc

SEQ ID NO: 2239097 - RNA, 14 nt, Human
ugcuggcugcccag

SEQ ID NO: 2239098 - RNA, 13 nt, Human
ugcuggcugccca

SEQ ID NO: 2239099 - RNA, 16 nt, Human
ugcuggcgccucugca

SEQ ID NO: 2239100 - RNA, 13 nt, Human
ugcuggcucuucu

SEQ ID NO: 2239101 - RNA, 14 nt, Human
ugcuggcgccucug

SEQ ID NO: 2239102 - RNA, 15 nt, Human
ugcuggcgccucugc

SEQ ID NO: 2239103 - RNA, 13 nt, Human
ugcuggcugccuu

SEQ ID NO: 2239104 - RNA, 17 nt, Human
ugcuggccgccucaccc

SEQ ID NO: 2239105 - RNA, 15 nt, Human
ugcuggccgccucac

SEQ ID NO: 2239106 - RNA, 12 nt, Human
ugcuggccugga

SEQ ID NO: 2239107 - RNA, 14 nt, Human
ugcuggccuggauc

SEQ ID NO: 2239108 - RNA, 15 nt, Human
ugcuggccuggaucu

SEQ ID NO: 2239109 - RNA, 16 nt, Human
ugcuggccuggaucuc

SEQ ID NO: 2239110 - RNA, 18 nt, Human
ugcuggccuggaucuccc

SEQ ID NO: 2239111 - RNA, 13 nt, Human
ugcuggccuggcc

SEQ ID NO: 2239112 - RNA, 21 nt, Human
ugcugggauuacaagcgugag

SEQ ID NO: 2239113 - RNA, 17 nt, Human
ugcugggauuacaggug

SEQ ID NO: 2239114 - RNA, 15 nt, Human
ugcugggacugagcc

SEQ ID NO: 2239115 - RNA, 15 nt, Human
ugcuguagacauuug

SEQ ID NO: 2239116 - RNA, 13 nt, Human
ugcuguauaaaau

SEQ ID NO: 2239117 - RNA, 14 nt, Human
ugcuguauaaaauc

SEQ ID NO: 2239118 - RNA, 15 nt, Human
ugcuguauaaaauca

SEQ ID NO: 2239119 - RNA, 16 nt, Human
ugcuguauaaaaucag

SEQ ID NO: 2239120 - RNA, 23 nt, Human
ugcuguauccauccauggggcug

SEQ ID NO: 2239121 - RNA, 17 nt, Human
ugcuguauaaaaucagc

SEQ ID NO: 2239122 - RNA, 18 nt, Human
ugcuguauaaaaucagcc

SEQ ID NO: 2239123 - RNA, 13 nt, Human
ugcuguauuuuaa

SEQ ID NO: 2239124 - RNA, 21 nt, Human
ugcuguauuuuaaaagaauga

SEQ ID NO: 2239125 - RNA, 22 nt, Human
ugcuguauuuuaaaagaaugau

SEQ ID NO: 2239126 - RNA, 22 nt, Human
ugcuggauauuuucaaauugua

SEQ ID NO: 2239127 - RNA, 22 nt, Human
ugcuggaucacagcugcuuucu

SEQ ID NO: 2239128 - RNA, 17 nt, Human
ugcuggauauuuucaaa

SEQ ID NO: 2239129 - RNA, 16 nt, Human
ugcuggauauuuucaa

SEQ ID NO: 2239130 - RNA, 17 nt, Human
ugcuggauaaaaugagg

SEQ ID NO: 2239131 - RNA, 15 nt, Human
ugcuggauaaaauga

SEQ ID NO: 2239132 - RNA, 20 nt, Human
ugcuggaguuucauguacaa

SEQ ID NO: 2239133 - RNA, 13 nt, Human
ugcugcccugcgg

SEQ ID NO: 2239134 - RNA, 17 nt, Human
ugcuggaggugggagca

SEQ ID NO: 2239135 - RNA, 18 nt, Human
ugcuggaggugggagcag

SEQ ID NO: 2239136 - RNA, 22 nt, Human
ugcuggaggugggagcaggaga

SEQ ID NO: 2239137 - RNA, 23 nt, Human
ugcuggaggugggagcaggagau

SEQ ID NO: 2239138 - RNA, 17 nt, Human
ugcuggauggagcccag

SEQ ID NO: 2239139 - RNA, 23 nt, Human
ugcuggaucacagcugcuuucug

SEQ ID NO: 2239140 - RNA, 18 nt, Human
ugcuggauggagcccagg

SEQ ID NO: 2239141 - RNA, 19 nt, Human
ugcuggauggagcccaggc

SEQ ID NO: 2239142 - RNA, 20 nt, Human
ugcuggauggagcccaggcg

SEQ ID NO: 2239143 - RNA, 18 nt, Human
ugcuggaugucugccaau

SEQ ID NO: 2239144 - RNA, 22 nt, Human
ugcuggaugucugccaauuuuu

SEQ ID NO: 2239145 - RNA, 20 nt, Human
ugcuggcacauuuccccaga

SEQ ID NO: 2239146 - RNA, 18 nt, Human
ugcuggcacauuucccca

SEQ ID NO: 2239147 - RNA, 24 nt, Human
ugcuggccccucaccugggcaccu

SEQ ID NO: 2239148 - RNA, 22 nt, Human
ugcuggccccucaccugggcac

SEQ ID NO: 2239149 - RNA, 20 nt, Human
ugcuggccccucaccugggc

SEQ ID NO: 2239150 - RNA, 11 nt, Human
ugcugcccugu

SEQ ID NO: 2239151 - RNA, 19 nt, Human
ugcugcccugcccaccugg

SEQ ID NO: 2239152 - RNA, 21 nt, Human
ugcugcccugcccaccuggcc

SEQ ID NO: 2239153 - RNA, 20 nt, Human
aggaaugcucccccauccuc

SEQ ID NO: 2239154 - RNA, 22 nt, Human
aggaaugcucccccauccuccc

SEQ ID NO: 2239155 - RNA, 12 nt, Human
aggaauggacag

SEQ ID NO: 2239156 - RNA, 20 nt, Human
aggaauggacagacagagga

SEQ ID NO: 2239157 - RNA, 21 nt, Human
aggaaggagacucaccucugc

SEQ ID NO: 2239158 - RNA, 20 nt, Human
aggaagcucagacugguuga

SEQ ID NO: 2239159 - RNA, 14 nt, Human
aggaaggacccuga

SEQ ID NO: 2239160 - RNA, 19 nt, Human
aggaaggagacucaccucu

SEQ ID NO: 2239161 - RNA, 15 nt, Human
aggaaugcuccccca

SEQ ID NO: 2239162 - RNA, 14 nt, Human
aggaaugcuccccc

SEQ ID NO: 2239163 - RNA, 13 nt, Human
aggaaugcucccc

SEQ ID NO: 2239164 - RNA, 16 nt, Human
aggaaugccuguguga

SEQ ID NO: 2239165 - RNA, 12 nt, Human
aggaaugcuccc

SEQ ID NO: 2239166 - RNA, 24 nt, Human
aggaaugccuccucccugggcaga

SEQ ID NO: 2239167 - RNA, 13 nt, Human
ugcugcccugccc

SEQ ID NO: 2239168 - RNA, 16 nt, Human
ugcugcccugcccacc

SEQ ID NO: 2239169 - RNA, 17 nt, Human
ugcugcccugcccaccu

SEQ ID NO: 2239170 - RNA, 18 nt, Human
ugcugcccugcccaccug

SEQ ID NO: 2239171 - RNA, 13 nt, Human
aggagcuucucug

SEQ ID NO: 2239172 - RNA, 21 nt, Human
aggagcuggggaucccucccc

SEQ ID NO: 2239173 - RNA, 17 nt, Human
aggagcugggaggaaaa

SEQ ID NO: 2239174 - RNA, 16 nt, Human
aggagcugggaggaaa

SEQ ID NO: 2239175 - RNA, 21 nt, Human
aggagcugcuggcuugcagug

SEQ ID NO: 2239176 - RNA, 20 nt, Human
aggagcugggcagaaggcca

SEQ ID NO: 2239177 - RNA, 18 nt, Human
aggagcugggauccuaag

SEQ ID NO: 2239178 - RNA, 20 nt, Human
aggagcuggggaucccuccc

SEQ ID NO: 2239179 - RNA, 12 nt, Human
aggagcugggga

SEQ ID NO: 2239180 - RNA, 21 nt, Human
aggagcucuucaggccucccu

SEQ ID NO: 2239181 - RNA, 19 nt, Human
aggagcucuucaggccucc

SEQ ID NO: 2239182 - RNA, 17 nt, Human
aggagcucuucaggccu

SEQ ID NO: 2239183 - RNA, 23 nt, Human
aggagcucacuguggugucugug

SEQ ID NO: 2239184 - RNA, 15 nt, Human
aggaucccucucugg

SEQ ID NO: 2239185 - RNA, 19 nt, Human
aggaucccucucuggauug

SEQ ID NO: 2239186 - RNA, 16 nt, Human
aggaucccucucugga

SEQ ID NO: 2239187 - RNA, 17 nt, Human
aggaucccucucuggau

SEQ ID NO: 2239188 - RNA, 20 nt, Human
aggauccuauucucaccagg

SEQ ID NO: 2239189 - RNA, 21 nt, Human
aggauccuauucucaccagga

SEQ ID NO: 2239190 - RNA, 22 nt, Human
aggauccuauucucaccaggaa

SEQ ID NO: 2239191 - RNA, 13 nt, Human
aggauccugagcc

SEQ ID NO: 2239192 - RNA, 14 nt, Human
aggauccugagcca

SEQ ID NO: 2239193 - RNA, 23 nt, Human
aggauagaaguauaccugauuuu

SEQ ID NO: 2239194 - RNA, 18 nt, Human
aggauacuguaacacuuu

SEQ ID NO: 2239195 - RNA, 22 nt, Human
aggauacuguaacacuuuacaa

SEQ ID NO: 2239196 - RNA, 16 nt, Human
aggauacucugucaga

SEQ ID NO: 2239197 - RNA, 13 nt, Human
aggauacucuguc

SEQ ID NO: 2239198 - RNA, 18 nt, Human
aggauacuauauuuuagg

SEQ ID NO: 2239199 - RNA, 22 nt, Human
aggauaccauauacagcucaga

SEQ ID NO: 2239200 - RNA, 15 nt, Human
aggauaccauauaca

SEQ ID NO: 2239201 - RNA, 14 nt, Human
aggauacaugugcc

SEQ ID NO: 2239202 - RNA, 21 nt, Human
aggauacaugugccgaaugug

SEQ ID NO: 2239203 - RNA, 15 nt, Human
uggaagggacuagga

SEQ ID NO: 2239204 - RNA, 14 nt, Human
uggaaggaggcgca

SEQ ID NO: 2239205 - RNA, 19 nt, Human
uggaaggaccacauuuuau

SEQ ID NO: 2239206 - RNA, 14 nt, Human
uggaagcuuccagu

SEQ ID NO: 2239207 - RNA, 22 nt, Human
uggaaggaccacauuuuauauu

SEQ ID NO: 2239208 - RNA, 20 nt, Human
uggaagcuucuggugaccuu

SEQ ID NO: 2239209 - RNA, 21 nt, Human
uggaagguuuguauauuguca

SEQ ID NO: 2239210 - RNA, 20 nt, Human
uggaaguaaccauuugcacu

SEQ ID NO: 2239211 - RNA, 13 nt, Human
uggaaggugggga

SEQ ID NO: 2239212 - RNA, 20 nt, Human
uggaagguuuggugugugga

SEQ ID NO: 2239213 - RNA, 17 nt, Human
uggaaggguuuguggcu

SEQ ID NO: 2239214 - RNA, 15 nt, Human
uggaaggugcuguua

SEQ ID NO: 2239215 - RNA, 21 nt, Human
uggaaggugcuguuauccaug

SEQ ID NO: 2239216 - RNA, 18 nt, Human
uggaaguacuauaauuua

SEQ ID NO: 2239217 - RNA, 15 nt, Human
uggaaggguuugugg

SEQ ID NO: 2239218 - RNA, 18 nt, Human
uggaaggguucuggcugc

SEQ ID NO: 2239219 - RNA, 19 nt, Human
uggaaggguucuggcugcc

SEQ ID NO: 2239220 - RNA, 23 nt, Human
uggaaggggacacgugacagccg

SEQ ID NO: 2239221 - RNA, 16 nt, Human
uggaagcacagcuuca

SEQ ID NO: 2239222 - RNA, 16 nt, Human
uggaagauuuuaaauu

SEQ ID NO: 2239223 - RNA, 14 nt, Human
uggaagauuuuaaa

SEQ ID NO: 2239224 - RNA, 18 nt, Human
uggaagcaacaggaauca

SEQ ID NO: 2239225 - RNA, 13 nt, Human
uggaagauccugc

SEQ ID NO: 2239226 - RNA, 21 nt, Human
uggaagauccugcgggugggg

SEQ ID NO: 2239227 - RNA, 21 nt, Human
uggaagaggggacaggucccu

SEQ ID NO: 2239228 - RNA, 16 nt, Human
uggaaaugcugggcug

SEQ ID NO: 2239229 - RNA, 16 nt, Human
uggaagaggggacagg

SEQ ID NO: 2239230 - RNA, 17 nt, Human
uggaaaugggcagagca

SEQ ID NO: 2239231 - RNA, 15 nt, Human
uggaaaugcugggcu

SEQ ID NO: 2239232 - RNA, 20 nt, Human
uggaaaugcugggcugacgg

SEQ ID NO: 2239233 - RNA, 18 nt, Human
uggaaaugggcagagcag

SEQ ID NO: 2239234 - RNA, 13 nt, Human
uggaaaggcucag

SEQ ID NO: 2239235 - RNA, 23 nt, Human
uggaaaggcucagucucaggagc

SEQ ID NO: 2239236 - RNA, 21 nt, Human
uggaaaggcucagucucagga

SEQ ID NO: 2239237 - RNA, 20 nt, Human
uggaaaggcucagucucagg

SEQ ID NO: 2239238 - RNA, 17 nt, Human
uggaaaggcucagucuc

SEQ ID NO: 2239239 - RNA, 23 nt, Human
uggaaagggugcugcuucccucu

SEQ ID NO: 2239240 - RNA, 23 nt, Human
uggaaaggggagagccugcuggc

SEQ ID NO: 2239241 - RNA, 17 nt, Human
uggaaaggggggagcug

SEQ ID NO: 2239242 - RNA, 18 nt, Human
uggaaaggggggagcugg

SEQ ID NO: 2239243 - RNA, 19 nt, Human
uggaaaggggggagcuggg

SEQ ID NO: 2239244 - RNA, 13 nt, Human
uggaaaggggaga

SEQ ID NO: 2239245 - RNA, 14 nt, Human
uggaaaggggagag

SEQ ID NO: 2239246 - RNA, 15 nt, Human
uggaaaggggagagc

SEQ ID NO: 2239247 - RNA, 17 nt, Human
uggaaaggggagagccu

SEQ ID NO: 2239248 - RNA, 19 nt, Human
uggaaaggggagagccugc

SEQ ID NO: 2239249 - RNA, 21 nt, Human
uggaaaggggagagccugcug

SEQ ID NO: 2239250 - RNA, 22 nt, Human
uggaaaggggagagccugcugg

SEQ ID NO: 2239251 - RNA, 14 nt, Human
ugcuuuuggucugu

SEQ ID NO: 2239252 - RNA, 17 nt, Human
ugcuuuuggucugugug

SEQ ID NO: 2239253 - RNA, 14 nt, Human
ugcuuugugaacaa

SEQ ID NO: 2239254 - RNA, 16 nt, Human
ugcuuuucugcccugg

SEQ ID NO: 2239255 - RNA, 18 nt, Human
ugcuuuucugcccuggcu

SEQ ID NO: 2239256 - RNA, 17 nt, Human
ugcuuuucuguauuuua

SEQ ID NO: 2239257 - RNA, 13 nt, Human
ugcuuuucugucu

SEQ ID NO: 2239258 - RNA, 19 nt, Human
ugcuuuuggcaaaacucua

SEQ ID NO: 2239259 - RNA, 21 nt, Human
ugcuuuuggcaaaacucuacu

SEQ ID NO: 2239260 - RNA, 15 nt, Human
ugcuuguauagguuu

SEQ ID NO: 2239261 - RNA, 22 nt, Human
ugcuuguacauaaugcgugcau

SEQ ID NO: 2239262 - RNA, 16 nt, Human
ugcuuguacauaaugc

SEQ ID NO: 2239263 - RNA, 14 nt, Human
ugcuuguacauaau

SEQ ID NO: 2239264 - RNA, 22 nt, Human
ugcuuggguggagaagccauug

SEQ ID NO: 2239265 - RNA, 12 nt, Human
ugcuuugugauu

SEQ ID NO: 2239266 - RNA, 16 nt, Human
ugcuuugugauuuuug

SEQ ID NO: 2239267 - RNA, 14 nt, Human
ugcuuugugauuuu

SEQ ID NO: 2239268 - RNA, 20 nt, Human
ugcuuggguggagaagccau

SEQ ID NO: 2239269 - RNA, 21 nt, Human
ugcuuggguggagaagccauu

SEQ ID NO: 2239270 - RNA, 13 nt, Human
ugcuuguacauaa

SEQ ID NO: 2239271 - RNA, 12 nt, Human
ugcuuguacaua

SEQ ID NO: 2239272 - RNA, 14 nt, Human
ugcuuggaggaagg

SEQ ID NO: 2239273 - RNA, 19 nt, Human
ugcuugcaguagauuuucu

SEQ ID NO: 2239274 - RNA, 15 nt, Human
ugcuuggaggaagga

SEQ ID NO: 2239275 - RNA, 16 nt, Human
ugcuuggaggaaggaa

SEQ ID NO: 2239276 - RNA, 22 nt, Human
aggacagugcuucagccugagg

SEQ ID NO: 2239277 - RNA, 21 nt, Human
aggacagugcuucagccugag

SEQ ID NO: 2239278 - RNA, 20 nt, Human
aggacagugcuucagccuga

SEQ ID NO: 2239279 - RNA, 19 nt, Human
aggacagugcuucagccug

SEQ ID NO: 2239280 - RNA, 18 nt, Human
aggacagugcuucagccu

SEQ ID NO: 2239281 - RNA, 17 nt, Human
aggacagugcuucagcc

SEQ ID NO: 2239282 - RNA, 16 nt, Human
aggacagugcuucagc

SEQ ID NO: 2239283 - RNA, 15 nt, Human
aggacagugcuucag

SEQ ID NO: 2239284 - RNA, 23 nt, Human
aggacagcccuucuuuccacaga

SEQ ID NO: 2239285 - RNA, 19 nt, Human
aggacaguauuugugggga

SEQ ID NO: 2239286 - RNA, 12 nt, Human
aggacaguauuu

SEQ ID NO: 2239287 - RNA, 12 nt, Human
ugcuugauuuuu

SEQ ID NO: 2239288 - RNA, 22 nt, Human
ugcuugcacuuuguaacauguu

SEQ ID NO: 2239289 - RNA, 15 nt, Human
ugcuugcaguagauu

SEQ ID NO: 2239290 - RNA, 16 nt, Human
ugcuugcaguagauuu

SEQ ID NO: 2239291 - RNA, 17 nt, Human
ugcuugcaguagauuuu

SEQ ID NO: 2239292 - RNA, 23 nt, Human
ugcuugagucagguuugaguaga

SEQ ID NO: 2239293 - RNA, 20 nt, Human
aggacauaaauuagaggucu

SEQ ID NO: 2239294 - RNA, 13 nt, Human
aggacauaauggg

SEQ ID NO: 2239295 - RNA, 20 nt, Human
ugcuugagucagguuugagu

SEQ ID NO: 2239296 - RNA, 14 nt, Human
ugcuugagucaggu

SEQ ID NO: 2239297 - RNA, 15 nt, Human
aggacauaauggggu

SEQ ID NO: 2239298 - RNA, 21 nt, Human
ugcuugaggcaacucaucuua

SEQ ID NO: 2239299 - RNA, 19 nt, Human
aggcaccucacagaaauga

SEQ ID NO: 2239300 - RNA, 20 nt, Human
aggcaccucacaggccccag

SEQ ID NO: 2239301 - RNA, 20 nt, Human
aggcaccuaccaccacgccc

SEQ ID NO: 2239302 - RNA, 16 nt, Human
aggcacccccuggaga

SEQ ID NO: 2239303 - RNA, 15 nt, Human
aggcacccccuggag

SEQ ID NO: 2239304 - RNA, 18 nt, Human
aggcaccgagaauguugu

SEQ ID NO: 2239305 - RNA, 16 nt, Human
aggcaccgagaauguu

SEQ ID NO: 2239306 - RNA, 15 nt, Human
aggcaccgagaaugu

SEQ ID NO: 2239307 - RNA, 20 nt, Human
aggcacccuucuuuccucuu

SEQ ID NO: 2239308 - RNA, 20 nt, Human
aggcacccccuggagagaag

SEQ ID NO: 2239309 - RNA, 17 nt, Human
aggcacccccuggagag

SEQ ID NO: 2239310 - RNA, 19 nt, Human
aggcacccccuggagagaa

SEQ ID NO: 2239311 - RNA, 14 nt, Human
aggcaaugcuggcu

SEQ ID NO: 2239312 - RNA, 20 nt, Human
aggcacccaccaucaugucu

SEQ ID NO: 2239313 - RNA, 21 nt, Human
aggcacccaccaucaugucug

SEQ ID NO: 2239314 - RNA, 22 nt, Human
aggcacccaccaucaugucugg

SEQ ID NO: 2239315 - RNA, 13 nt, Human
aggcaagugaaga

SEQ ID NO: 2239316 - RNA, 13 nt, Human
aggcaaggucugg

SEQ ID NO: 2239317 - RNA, 15 nt, Human
aggcaaguuucuagc

SEQ ID NO: 2239318 - RNA, 17 nt, Human
aggcaagugaagaaaag

SEQ ID NO: 2239319 - RNA, 14 nt, Human
uggagcucguggaa

SEQ ID NO: 2239320 - RNA, 17 nt, Human
aggcaauaaaaaucaua

SEQ ID NO: 2239321 - RNA, 22 nt, Human
aggcaaugauuguuaauuuaca

SEQ ID NO: 2239322 - RNA, 14 nt, Human
aggcaauaaaaauc

SEQ ID NO: 2239323 - RNA, 18 nt, Human
aggcaaguuucuagcuag

SEQ ID NO: 2239324 - RNA, 13 nt, Human
aggcaaucauggu

SEQ ID NO: 2239325 - RNA, 16 nt, Human
uggagcgcaccugccc

SEQ ID NO: 2239326 - RNA, 14 nt, Human
uggagcgcaccugc

SEQ ID NO: 2239327 - RNA, 21 nt, Human
uggagccuguguaacagcucc

SEQ ID NO: 2239328 - RNA, 22 nt, Human
uggagccuguguaacagcuccu

SEQ ID NO: 2239329 - RNA, 19 nt, Human
uggagccuuugaauaaaaa

SEQ ID NO: 2239330 - RNA, 19 nt, Human
uggagcccgcacccccacc

SEQ ID NO: 2239331 - RNA, 17 nt, Human
uggagccuguguaacag

SEQ ID NO: 2239332 - RNA, 18 nt, Human
uggagccuguguaacagc

SEQ ID NO: 2239333 - RNA, 20 nt, Human
uggagccuguguaacagcuc

SEQ ID NO: 2239334 - RNA, 22 nt, Human
uggagcccgcacccccacccuu

SEQ ID NO: 2239335 - RNA, 15 nt, Human
uggagcccuuggguu

SEQ ID NO: 2239336 - RNA, 18 nt, Human
uggagcucagagagggca

SEQ ID NO: 2239337 - RNA, 22 nt, Human
uggagcgcaccugcccccuggu

SEQ ID NO: 2239338 - RNA, 21 nt, Human
uggagcgcaccugcccccugg

SEQ ID NO: 2239339 - RNA, 19 nt, Human
uggacuuuccacccccucc

SEQ ID NO: 2239340 - RNA, 18 nt, Human
uggacuuuccacccccuc

SEQ ID NO: 2239341 - RNA, 13 nt, Human
uggacuuuccugc

SEQ ID NO: 2239342 - RNA, 16 nt, Human
uggacuuuccaccccc

SEQ ID NO: 2239343 - RNA, 15 nt, Human
uggacuuguccucag

SEQ ID NO: 2239344 - RNA, 20 nt, Human
uggacuuguccucagcagcu

SEQ ID NO: 2239345 - RNA, 13 nt, Human
uggacuuguauau

SEQ ID NO: 2239346 - RNA, 14 nt, Human
uggacuuguauauu

SEQ ID NO: 2239347 - RNA, 15 nt, Human
uggacuuguauauuu

SEQ ID NO: 2239348 - RNA, 17 nt, Human
uggacuuguauauuugu

SEQ ID NO: 2239349 - RNA, 18 nt, Human
uggacuuguauauuugua

SEQ ID NO: 2239350 - RNA, 20 nt, Human
uggacuuguauauuuguaca

SEQ ID NO: 2239351 - RNA, 21 nt, Human
uggacuuguauauuuguacaa

SEQ ID NO: 2239352 - RNA, 22 nt, Human
uggacuuguauauuuguacaaa

SEQ ID NO: 2239353 - RNA, 17 nt, Human
uggacuugagcuuggca

SEQ ID NO: 2239354 - RNA, 14 nt, Human
uggaccuuccugcc

SEQ ID NO: 2239355 - RNA, 19 nt, Human
uggaccuuccugccaccag

SEQ ID NO: 2239356 - RNA, 18 nt, Human
uggacuuggucaccagcu

SEQ ID NO: 2239357 - RNA, 18 nt, Human
uggacuugaggauuuuga

SEQ ID NO: 2239358 - RNA, 20 nt, Human
uggacuuggucaccagcucc

SEQ ID NO: 2239359 - RNA, 15 nt, Human
uggacugugugcuca

SEQ ID NO: 2239360 - RNA, 15 nt, Human
uggagaacuccuagg

SEQ ID NO: 2239361 - RNA, 21 nt, Human
uggagaacuagaaccuggagg

SEQ ID NO: 2239362 - RNA, 19 nt, Human
uggagaacuagaaccugga

SEQ ID NO: 2239363 - RNA, 20 nt, Human
uggagaacuagaaccuggag

SEQ ID NO: 2239364 - RNA, 14 nt, Human
uggagaacuagaga

SEQ ID NO: 2239365 - RNA, 13 nt, Human
uggagaagaacug

SEQ ID NO: 2239366 - RNA, 20 nt, Human
uggacuuuccacccccuccc

SEQ ID NO: 2239367 - RNA, 19 nt, Human
uggacuuuccugcaacuca

SEQ ID NO: 2239368 - RNA, 18 nt, Human
uggagaacuagaaccugg

SEQ ID NO: 2239369 - RNA, 21 nt, Human
uggagaaauuauuuaauaaaa

SEQ ID NO: 2239370 - RNA, 14 nt, Human
uggacuuuccugca

SEQ ID NO: 2239371 - RNA, 18 nt, Human
uggacuuuccugcaacuc

SEQ ID NO: 2239372 - RNA, 18 nt, Human
uggagcccgcacccccac

SEQ ID NO: 2239373 - RNA, 17 nt, Human
uggagcccgcaccccca

SEQ ID NO: 2239374 - RNA, 16 nt, Human
uggagcccgcaccccc

SEQ ID NO: 2239375 - RNA, 13 nt, Human
uggagccccuggg

SEQ ID NO: 2239376 - RNA, 14 nt, Human
uggagccccugggu

SEQ ID NO: 2239377 - RNA, 15 nt, Human
uggagccccugggug

SEQ ID NO: 2239378 - RNA, 23 nt, Human
uggagccccuggguggguggugg

SEQ ID NO: 2239379 - RNA, 14 nt, Human
uggagccccaucag

SEQ ID NO: 2239380 - RNA, 22 nt, Human
uggagccccagcccccuuuggg

SEQ ID NO: 2239381 - RNA, 12 nt, Human
uggagccccugg

SEQ ID NO: 2239382 - RNA, 13 nt, Human
uggagccccagcc

SEQ ID NO: 2239383 - RNA, 14 nt, Human
uggagccccagccc

SEQ ID NO: 2239384 - RNA, 15 nt, Human
uggagccccagcccc

SEQ ID NO: 2239385 - RNA, 16 nt, Human
uggagccccagccccc

SEQ ID NO: 2239386 - RNA, 12 nt, Human
uggagccccagc

SEQ ID NO: 2239387 - RNA, 20 nt, Human
uggagcccagggagcggaaa

SEQ ID NO: 2239388 - RNA, 15 nt, Human
uggagccccacacug

SEQ ID NO: 2239389 - RNA, 15 nt, Human
uggagcccagggagc

SEQ ID NO: 2239390 - RNA, 22 nt, Human
uggagcccaggcgggagcggug

SEQ ID NO: 2239391 - RNA, 14 nt, Human
uggagccccacacu

SEQ ID NO: 2239392 - RNA, 18 nt, Human
uggagcccaggcgggagc

SEQ ID NO: 2239393 - RNA, 16 nt, Human
uggagaagcucaccca

SEQ ID NO: 2239394 - RNA, 19 nt, Human
uggagaagcucccaggaac

SEQ ID NO: 2239395 - RNA, 14 nt, Human
uggagaagccauug

SEQ ID NO: 2239396 - RNA, 17 nt, Human
uggagaagccauugucu

SEQ ID NO: 2239397 - RNA, 18 nt, Human
uggagaagccauugucuu

SEQ ID NO: 2239398 - RNA, 19 nt, Human
uggagaagccauugucuuc

SEQ ID NO: 2239399 - RNA, 17 nt, Human
uggagaacuccuagggu

SEQ ID NO: 2239400 - RNA, 22 nt, Human
uggagaagccacaggccugaga

SEQ ID NO: 2239401 - RNA, 23 nt, Human
uggagaagccacaggccugagau

SEQ ID NO: 2239402 - RNA, 12 nt, Human
uggagaagccau

SEQ ID NO: 2239403 - RNA, 13 nt, Human
uggagaagccauu

SEQ ID NO: 2239404 - RNA, 14 nt, Human
uggagaagaacuga

SEQ ID NO: 2239405 - RNA, 22 nt, Human
uggagaagcggcuggcagccca

SEQ ID NO: 2239406 - RNA, 13 nt, Human
uggagaagcggcu

SEQ ID NO: 2239407 - RNA, 18 nt, Human
uggacaccaggagucccu

SEQ ID NO: 2239408 - RNA, 23 nt, Human
uggacacagcucuucuccaggcu

SEQ ID NO: 2239409 - RNA, 16 nt, Human
uggacccugaggccca

SEQ ID NO: 2239410 - RNA, 18 nt, Human
uggacccugaggcccaga

SEQ ID NO: 2239411 - RNA, 23 nt, Human
uggacccuguggaugauaaaaca

SEQ ID NO: 2239412 - RNA, 21 nt, Human
uggacccugaggcccagaggg

SEQ ID NO: 2239413 - RNA, 19 nt, Human
uggacccugaggcccagag

SEQ ID NO: 2239414 - RNA, 20 nt, Human
uggacccugaggcccagagg

SEQ ID NO: 2239415 - RNA, 16 nt, Human
uggaccugccuccugc

SEQ ID NO: 2239416 - RNA, 15 nt, Human
uggacccuguugcua

SEQ ID NO: 2239417 - RNA, 16 nt, Human
uggacccuguugcuaa

SEQ ID NO: 2239418 - RNA, 17 nt, Human
uggaccugccuccugcc

SEQ ID NO: 2239419 - RNA, 18 nt, Human
uggaccugccuccugccu

SEQ ID NO: 2239420 - RNA, 19 nt, Human
uggaccugccuccugccug

SEQ ID NO: 2239421 - RNA, 15 nt, Human
uggacccugaggccc

SEQ ID NO: 2239422 - RNA, 13 nt, Human
uggacccuguugc

SEQ ID NO: 2239423 - RNA, 14 nt, Human
uggacccuguugcu

SEQ ID NO: 2239424 - RNA, 21 nt, Human
uggaccuuaggccuuccucuc

SEQ ID NO: 2239425 - RNA, 12 nt, Human
uggaccuuccug

SEQ ID NO: 2239426 - RNA, 13 nt, Human
uggaccuuccugc

SEQ ID NO: 2239427 - RNA, 19 nt, Human
uggaccuuaggccuuccuc

SEQ ID NO: 2239428 - RNA, 17 nt, Human
uggaccuuaggccuucc

SEQ ID NO: 2239429 - RNA, 16 nt, Human
uggaccuuaggccuuc

SEQ ID NO: 2239430 - RNA, 15 nt, Human
uggaccuuaggccuu

SEQ ID NO: 2239431 - RNA, 20 nt, Human
uggaccugccuccugccugc

SEQ ID NO: 2239432 - RNA, 20 nt, Human
uggaccuugaacuggguacu

SEQ ID NO: 2239433 - RNA, 22 nt, Human
aggcaaacccaucaacaaaaau

SEQ ID NO: 2239434 - RNA, 20 nt, Human
uggaauuauuuuaaaagaua

SEQ ID NO: 2239435 - RNA, 14 nt, Human
aggcaaauguguac

SEQ ID NO: 2239436 - RNA, 19 nt, Human
uggaauuauuuuaaaagau

SEQ ID NO: 2239437 - RNA, 13 nt, Human
aggcaaaugugua

SEQ ID NO: 2239438 - RNA, 18 nt, Human
aggcaaaugacuuuggac

SEQ ID NO: 2239439 - RNA, 14 nt, Human
aggcaaaugcccaa

SEQ ID NO: 2239440 - RNA, 15 nt, Human
aggcaaaugcccaag

SEQ ID NO: 2239441 - RNA, 15 nt, Human
aggcaaaugacuuug

SEQ ID NO: 2239442 - RNA, 14 nt, Human
aggcaaaugacuuu

SEQ ID NO: 2239443 - RNA, 18 nt, Human
aggaucucuugagccugg

SEQ ID NO: 2239444 - RNA, 17 nt, Human
aggaucucuugagccug

SEQ ID NO: 2239445 - RNA, 19 nt, Human
aggaucucuugagccuggg

SEQ ID NO: 2239446 - RNA, 20 nt, Human
aggcaaaauugcaaaucuug

SEQ ID NO: 2239447 - RNA, 19 nt, Human
aggcaaaauugcaaaucuu

SEQ ID NO: 2239448 - RNA, 12 nt, Human
aggaucucuuga

SEQ ID NO: 2239449 - RNA, 16 nt, Human
uggacaaucaugaaau

SEQ ID NO: 2239450 - RNA, 14 nt, Human
uggacaaggagguc

SEQ ID NO: 2239451 - RNA, 16 nt, Human
uggacaaggaggucug

SEQ ID NO: 2239452 - RNA, 13 nt, Human
uggacaaggaggu

SEQ ID NO: 2239453 - RNA, 22 nt, Human
uggaauugauuugcauugaaca

SEQ ID NO: 2239454 - RNA, 17 nt, Human
uggacaagccaacuugu

SEQ ID NO: 2239455 - RNA, 20 nt, Human
uggaauugauuugcauugaa

SEQ ID NO: 2239456 - RNA, 19 nt, Human
uggaauugauuugcauuga

SEQ ID NO: 2239457 - RNA, 18 nt, Human
uggaauugauuugcauug

SEQ ID NO: 2239458 - RNA, 17 nt, Human
uggaauugauuugcauu

SEQ ID NO: 2239459 - RNA, 16 nt, Human
uggaauugauuugcau

SEQ ID NO: 2239460 - RNA, 15 nt, Human
uggaauugauuugca

SEQ ID NO: 2239461 - RNA, 12 nt, Human
uggaauugauuu

SEQ ID NO: 2239462 - RNA, 13 nt, Human
uggaauucuaaca

SEQ ID NO: 2239463 - RNA, 17 nt, Human
uggacacacaaggugca

SEQ ID NO: 2239464 - RNA, 18 nt, Human
uggacaauacccccaggc

SEQ ID NO: 2239465 - RNA, 21 nt, Human
uggacacagcucuucuccagg

SEQ ID NO: 2239466 - RNA, 22 nt, Human
uggacacagcucuucuccaggc

SEQ ID NO: 2239467 - RNA, 13 nt, Human
uggacacagcucu

SEQ ID NO: 2239468 - RNA, 14 nt, Human
uggacacagcucuu

SEQ ID NO: 2239469 - RNA, 14 nt, Human
uggccaucucugga

SEQ ID NO: 2239470 - RNA, 13 nt, Human
uggccaucuccac

SEQ ID NO: 2239471 - RNA, 17 nt, Human
uggccaucucuggaugc

SEQ ID NO: 2239472 - RNA, 16 nt, Human
uggccaucuccacccc

SEQ ID NO: 2239473 - RNA, 16 nt, Human
uggccaucucuggaug

SEQ ID NO: 2239474 - RNA, 16 nt, Human
uggccaguuaucccuu

SEQ ID NO: 2239475 - RNA, 13 nt, Human
uggccaucccaca

SEQ ID NO: 2239476 - RNA, 16 nt, Human
uggccagugugauccc

SEQ ID NO: 2239477 - RNA, 14 nt, Human
uggccagugucugu

SEQ ID NO: 2239478 - RNA, 23 nt, Human
uggccagugugacaaggauugcu

SEQ ID NO: 2239479 - RNA, 16 nt, Human
uggccagguggccacu

SEQ ID NO: 2239480 - RNA, 17 nt, Human
uggccagguggccacuc

SEQ ID NO: 2239481 - RNA, 19 nt, Human
uggccagguggccacucca

SEQ ID NO: 2239482 - RNA, 14 nt, Human
uggccaguccaggc

SEQ ID NO: 2239483 - RNA, 15 nt, Human
uggccaguccaggcu

SEQ ID NO: 2239484 - RNA, 21 nt, Human
uggccaaagccaaagcuaggc

SEQ ID NO: 2239485 - RNA, 23 nt, Human
uggccaaagccaaagcuaggccu

SEQ ID NO: 2239486 - RNA, 20 nt, Human
uggccaccucucuccuuugc

SEQ ID NO: 2239487 - RNA, 15 nt, Human
uggccaccucucucc

SEQ ID NO: 2239488 - RNA, 23 nt, Human
uggccaccaggcuggcgcagcca

SEQ ID NO: 2239489 - RNA, 22 nt, Human
uggccacccguucugcuggccu

SEQ ID NO: 2239490 - RNA, 19 nt, Human
uggccacccguucugcugg

SEQ ID NO: 2239491 - RNA, 21 nt, Human
uggccaccaggcuggcgcagc

SEQ ID NO: 2239492 - RNA, 22 nt, Human
uggccaccaggcuggcgcagcc

SEQ ID NO: 2239493 - RNA, 11 nt, Human
uggccaggugg

SEQ ID NO: 2239494 - RNA, 15 nt, Human
uggccagguggccac

SEQ ID NO: 2239495 - RNA, 17 nt, Human
uggccacaguagucuug

SEQ ID NO: 2239496 - RNA, 13 nt, Human
uggccaccacccc

SEQ ID NO: 2239497 - RNA, 15 nt, Human
uggccaccacccccc

SEQ ID NO: 2239498 - RNA, 18 nt, Human
uggccaccaccccccacu

SEQ ID NO: 2239499 - RNA, 23 nt, Human
uggccaccaccccccacucugug

SEQ ID NO: 2239500 - RNA, 12 nt, Human
uggccaccaggc

SEQ ID NO: 2239501 - RNA, 13 nt, Human
uggccaccaggcu

SEQ ID NO: 2239502 - RNA, 14 nt, Human
uggccaccaggcug

SEQ ID NO: 2239503 - RNA, 15 nt, Human
uggccaccaggcugg

SEQ ID NO: 2239504 - RNA, 16 nt, Human
uggccaccaggcuggc

SEQ ID NO: 2239505 - RNA, 17 nt, Human
uggccaccaggcuggcg

SEQ ID NO: 2239506 - RNA, 18 nt, Human
uggccaccaggcuggcgc

SEQ ID NO: 2239507 - RNA, 19 nt, Human
uggccaccaggcuggcgca

SEQ ID NO: 2239508 - RNA, 20 nt, Human
uggccaccaggcuggcgcag

SEQ ID NO: 2239509 - RNA, 18 nt, Human
aggccccgcuuguccagc

SEQ ID NO: 2239510 - RNA, 17 nt, Human
aggccccgcuuguccag

SEQ ID NO: 2239511 - RNA, 15 nt, Human
aggccccgcuugucc

SEQ ID NO: 2239512 - RNA, 13 nt, Human
aggccccaggaag

SEQ ID NO: 2239513 - RNA, 21 nt, Human
aggccccgcuuguccagcgcc

SEQ ID NO: 2239514 - RNA, 20 nt, Human
aggccccgcuuguccagcgc

SEQ ID NO: 2239515 - RNA, 22 nt, Human
aggccccgcuuguccagcgccu

SEQ ID NO: 2239516 - RNA, 21 nt, Human
aggccccuauguaguccgugc

SEQ ID NO: 2239517 - RNA, 17 nt, Human
aggccccgcccaggcuu

SEQ ID NO: 2239518 - RNA, 12 nt, Human
aggccccugcca

SEQ ID NO: 2239519 - RNA, 16 nt, Human
aggccugagauuucau

SEQ ID NO: 2239520 - RNA, 14 nt, Human
aggccugaggauga

SEQ ID NO: 2239521 - RNA, 22 nt, Human
aggccugagcgcuccugccgca

SEQ ID NO: 2239522 - RNA, 19 nt, Human
aggccugagcgcuccugcc

SEQ ID NO: 2239523 - RNA, 21 nt, Human
aggccugagcgcuccugccgc

SEQ ID NO: 2239524 - RNA, 17 nt, Human
aggccugagauuucauc

SEQ ID NO: 2239525 - RNA, 19 nt, Human
aggccugagauuucaucug

SEQ ID NO: 2239526 - RNA, 20 nt, Human
aggccugagauuucaucugc

SEQ ID NO: 2239527 - RNA, 21 nt, Human
aggccugagauuucaucugcu

SEQ ID NO: 2239528 - RNA, 22 nt, Human
aggccugagauuucaucugcuc

SEQ ID NO: 2239529 - RNA, 23 nt, Human
aggccugagauuucaucugcucu

SEQ ID NO: 2239530 - RNA, 14 nt, Human
aggccugagcgcuc

SEQ ID NO: 2239531 - RNA, 18 nt, Human
aggccugagcgcuccugc

SEQ ID NO: 2239532 - RNA, 20 nt, Human
uggcaucuuugccuugggcu

SEQ ID NO: 2239533 - RNA, 16 nt, Human
uggcaucuuugccuug

SEQ ID NO: 2239534 - RNA, 17 nt, Human
uggcauccugugaaguc

SEQ ID NO: 2239535 - RNA, 21 nt, Human
uggcaucgcaccauucugacu

SEQ ID NO: 2239536 - RNA, 15 nt, Human
uggcauccugugaag

SEQ ID NO: 2239537 - RNA, 16 nt, Human
uggcauccugugaagu

SEQ ID NO: 2239538 - RNA, 22 nt, Human
uggcaucgcaccauucugacuc

SEQ ID NO: 2239539 - RNA, 23 nt, Human
uggcaucgcaccauucugacucg

SEQ ID NO: 2239540 - RNA, 20 nt, Human
uggcauugucccugugccua

SEQ ID NO: 2239541 - RNA, 16 nt, Human
uggcauugucccugug

SEQ ID NO: 2239542 - RNA, 19 nt, Human
uggcauugucccugugccu

SEQ ID NO: 2239543 - RNA, 19 nt, Human
uggcauuggcagcaggugc

SEQ ID NO: 2239544 - RNA, 20 nt, Human
uggcauuggcagcaggugcu

SEQ ID NO: 2239545 - RNA, 21 nt, Human
uggcauuggcagcaggugcug

SEQ ID NO: 2239546 - RNA, 23 nt, Human
uggcaucuuugccuugggcugcu

SEQ ID NO: 2239547 - RNA, 21 nt, Human
uggcaucuuugccuugggcug

SEQ ID NO: 2239548 - RNA, 14 nt, Human
uggcauuggcagca

SEQ ID NO: 2239549 - RNA, 16 nt, Human
aggccugaggaugagc

SEQ ID NO: 2239550 - RNA, 17 nt, Human
uggcauagcccagacac

SEQ ID NO: 2239551 - RNA, 22 nt, Human
uggcauacgccuguaguccuag

SEQ ID NO: 2239552 - RNA, 19 nt, Human
uggcauagcccagacacag

SEQ ID NO: 2239553 - RNA, 13 nt, Human
uggcauccuguga

SEQ ID NO: 2239554 - RNA, 21 nt, Human
uggccugaagaguccucugaa

SEQ ID NO: 2239555 - RNA, 23 nt, Human
uggccucuuuucagaucauggca

SEQ ID NO: 2239556 - RNA, 14 nt, Human
uggccugagaagag

SEQ ID NO: 2239557 - RNA, 12 nt, Human
uggccuggcccc

SEQ ID NO: 2239558 - RNA, 22 nt, Human
uggccguugauguuggcuggga

SEQ ID NO: 2239559 - RNA, 14 nt, Human
uggccguuggccac

SEQ ID NO: 2239560 - RNA, 17 nt, Human
uggccucuugagcagug

SEQ ID NO: 2239561 - RNA, 19 nt, Human
uggccucuugagcaguggc

SEQ ID NO: 2239562 - RNA, 22 nt, Human
uggccucuuugucuaaaacaau

SEQ ID NO: 2239563 - RNA, 14 nt, Human
uggccucuuuucag

SEQ ID NO: 2239564 - RNA, 14 nt, Human
uggccucuuugucu

SEQ ID NO: 2239565 - RNA, 20 nt, Human
uggccucuugagcaguggcu

SEQ ID NO: 2239566 - RNA, 22 nt, Human
uggccucuugagcaguggcugg

SEQ ID NO: 2239567 - RNA, 13 nt, Human
uggccugggagag

SEQ ID NO: 2239568 - RNA, 13 nt, Human
uggccuggccggc

SEQ ID NO: 2239569 - RNA, 16 nt, Human
uggccuggcuucuccu

SEQ ID NO: 2239570 - RNA, 21 nt, Human
uggccuguucuucuauggguu

SEQ ID NO: 2239571 - RNA, 16 nt, Human
uggccuggccggcaac

SEQ ID NO: 2239572 - RNA, 18 nt, Human
uggccuggccccucaggg

SEQ ID NO: 2239573 - RNA, 21 nt, Human
uggccuggccccucagggucc

SEQ ID NO: 2239574 - RNA, 12 nt, Human
aggccuggggac

SEQ ID NO: 2239575 - RNA, 18 nt, Human
aggccugggggcugggca

SEQ ID NO: 2239576 - RNA, 17 nt, Human
aggccugggggcaggga

SEQ ID NO: 2239577 - RNA, 12 nt, Human
aggccugugugu

SEQ ID NO: 2239578 - RNA, 23 nt, Human
aggccugugugugaaaggaagcu

SEQ ID NO: 2239579 - RNA, 20 nt, Human
aggccugggggcugggcaga

SEQ ID NO: 2239580 - RNA, 17 nt, Human
uggccuuccccagccuc

SEQ ID NO: 2239581 - RNA, 23 nt, Human
uggccuguuuuagaagguucucu

SEQ ID NO: 2239582 - RNA, 16 nt, Human
uggccuuccccagccu

SEQ ID NO: 2239583 - RNA, 18 nt, Human
uggccuuccauuuauaug

SEQ ID NO: 2239584 - RNA, 18 nt, Human
uggccuguuucaacacag

SEQ ID NO: 2239585 - RNA, 18 nt, Human
uggccuuccccagccucu

SEQ ID NO: 2239586 - RNA, 14 nt, Human
uggccuuccugccc

SEQ ID NO: 2239587 - RNA, 16 nt, Human
uggccuuccugcccua

SEQ ID NO: 2239588 - RNA, 20 nt, Human
aggccugggccgcugccacg

SEQ ID NO: 2239589 - RNA, 21 nt, Human
aggccugggccgcugccacgu

SEQ ID NO: 2239590 - RNA, 14 nt, Human
uggccuucggccuc

SEQ ID NO: 2239591 - RNA, 14 nt, Human
uggccaugccucag

SEQ ID NO: 2239592 - RNA, 15 nt, Human
uggccaugccucagc

SEQ ID NO: 2239593 - RNA, 17 nt, Human
uggccaugccucagccc

SEQ ID NO: 2239594 - RNA, 18 nt, Human
uggccaugccucagcccu

SEQ ID NO: 2239595 - RNA, 20 nt, Human
uggccaugccucagcccuga

SEQ ID NO: 2239596 - RNA, 22 nt, Human
uggccaugccacccuguuuuca

SEQ ID NO: 2239597 - RNA, 16 nt, Human
uggccaugguaccccc

SEQ ID NO: 2239598 - RNA, 18 nt, Human
uggccaugguacccccuu

SEQ ID NO: 2239599 - RNA, 22 nt, Human
uggccaugguacccccuucugg

SEQ ID NO: 2239600 - RNA, 13 nt, Human
uggcccacgcacu

SEQ ID NO: 2239601 - RNA, 14 nt, Human
uggcccugcccugg

SEQ ID NO: 2239602 - RNA, 16 nt, Human
uggccauuuagccacc

SEQ ID NO: 2239603 - RNA, 17 nt, Human
uggccauucuauugugg

SEQ ID NO: 2239604 - RNA, 15 nt, Human
uggccauuugcuuuu

SEQ ID NO: 2239605 - RNA, 14 nt, Human
uggccauuugcuuu

SEQ ID NO: 2239606 - RNA, 19 nt, Human
uggcccaaguggcagagcu

SEQ ID NO: 2239607 - RNA, 21 nt, Human
uggcccaaguggcagagcuug

SEQ ID NO: 2239608 - RNA, 19 nt, Human
uggcccacagcaggugcug

SEQ ID NO: 2239609 - RNA, 19 nt, Human
uggccauuuagccaccauc

SEQ ID NO: 2239610 - RNA, 19 nt, Human
uggcccaaaacgucuuauu

SEQ ID NO: 2239611 - RNA, 12 nt, Human
uggcccuggggu

SEQ ID NO: 2239612 - RNA, 13 nt, Human
uggcccugggguc

SEQ ID NO: 2239613 - RNA, 13 nt, Human
uggcccugucccu

SEQ ID NO: 2239614 - RNA, 23 nt, Human
uggccgggcgcgguggcucacgc

SEQ ID NO: 2239615 - RNA, 18 nt, Human
uggcccuggccugcuggg

SEQ ID NO: 2239616 - RNA, 17 nt, Human
uggcccuggccugcugg

SEQ ID NO: 2239617 - RNA, 16 nt, Human
uggcccuggccugcug

SEQ ID NO: 2239618 - RNA, 15 nt, Human
uggcccuggccugcu

SEQ ID NO: 2239619 - RNA, 14 nt, Human
uggcccuggccugc

SEQ ID NO: 2239620 - RNA, 13 nt, Human
uggcccuggccug

SEQ ID NO: 2239621 - RNA, 12 nt, Human
uggcccugccuu

SEQ ID NO: 2239622 - RNA, 11 nt, Human
uggcccugccu

SEQ ID NO: 2239623 - RNA, 16 nt, Human
uggcccugccuucuuc

SEQ ID NO: 2239624 - RNA, 16 nt, Human
uggccuaaaaaugcaa

SEQ ID NO: 2239625 - RNA, 13 nt, Human
uggccucuucaga

SEQ ID NO: 2239626 - RNA, 14 nt, Human
uggccgugggccug

SEQ ID NO: 2239627 - RNA, 22 nt, Human
uggccggucugcaagucagagg

SEQ ID NO: 2239628 - RNA, 19 nt, Human
uggccgugggccuggggua

SEQ ID NO: 2239629 - RNA, 14 nt, Human
uggccguuaucugg

SEQ ID NO: 2239630 - RNA, 19 nt, Human
uggccguugauguuggcug

SEQ ID NO: 2239631 - RNA, 21 nt, Human
uggccguugauguuggcuggg

SEQ ID NO: 2239632 - RNA, 19 nt, Human
uggcccuggggucccacga

SEQ ID NO: 2239633 - RNA, 15 nt, Human
uggcccugucccucc

SEQ ID NO: 2239634 - RNA, 17 nt, Human
uggccgggugcgguggc

SEQ ID NO: 2239635 - RNA, 18 nt, Human
uggccgggugcgguggcu

SEQ ID NO: 2239636 - RNA, 15 nt, Human
uggccggucugcaag

SEQ ID NO: 2239637 - RNA, 18 nt, Human
uggccggucugcaaguca

SEQ ID NO: 2239638 - RNA, 20 nt, Human
uggccggucugcaagucaga

SEQ ID NO: 2239639 - RNA, 21 nt, Human
uggccggucugcaagucagag

SEQ ID NO: 2239640 - RNA, 18 nt, Human
aggccaaggcggguggau

SEQ ID NO: 2239641 - RNA, 17 nt, Human
aggccaaggccuucucc

SEQ ID NO: 2239642 - RNA, 16 nt, Human
aggccaaggugggagg

SEQ ID NO: 2239643 - RNA, 20 nt, Human
aggccaagagcagaggcagc

SEQ ID NO: 2239644 - RNA, 18 nt, Human
aggccaagagcagaggca

SEQ ID NO: 2239645 - RNA, 17 nt, Human
aggccaagagcagaggc

SEQ ID NO: 2239646 - RNA, 14 nt, Human
aggccaagagcaga

SEQ ID NO: 2239647 - RNA, 14 nt, Human
aggccaagaggcug

SEQ ID NO: 2239648 - RNA, 20 nt, Human
uggaggggugguccugacuc

SEQ ID NO: 2239649 - RNA, 19 nt, Human
uggaggggugguccugacu

SEQ ID NO: 2239650 - RNA, 13 nt, Human
uggaggggugugg

SEQ ID NO: 2239651 - RNA, 14 nt, Human
uggagggguguggc

SEQ ID NO: 2239652 - RNA, 11 nt, Human
uggaggggugu

SEQ ID NO: 2239653 - RNA, 17 nt, Human
uggagggguguggcagu

SEQ ID NO: 2239654 - RNA, 18 nt, Human
uggagggguguggcagug

SEQ ID NO: 2239655 - RNA, 19 nt, Human
uggagggguguggcagugg

SEQ ID NO: 2239656 - RNA, 14 nt, Human
uggagguacacucu

SEQ ID NO: 2239657 - RNA, 20 nt, Human
uggagggugggagagcccag

SEQ ID NO: 2239658 - RNA, 20 nt, Human
uggagguacgaaaagagggg

SEQ ID NO: 2239659 - RNA, 23 nt, Human
uggagggguguggcuccuuccca

SEQ ID NO: 2239660 - RNA, 15 nt, Human
uggagggucccaagc

SEQ ID NO: 2239661 - RNA, 16 nt, Human
uggagggucccaagcu

SEQ ID NO: 2239662 - RNA, 17 nt, Human
uggagggucccaagcug

SEQ ID NO: 2239663 - RNA, 18 nt, Human
uggagggucccaagcugg

SEQ ID NO: 2239664 - RNA, 19 nt, Human
uggagggucccaagcuggg

SEQ ID NO: 2239665 - RNA, 21 nt, Human
uggagggucccaagcugggcc

SEQ ID NO: 2239666 - RNA, 21 nt, Human
aggcaccuauaaaacagguca

SEQ ID NO: 2239667 - RNA, 22 nt, Human
aggcaccucacagaaaugagau

SEQ ID NO: 2239668 - RNA, 18 nt, Human
aggcagccaggccacaag

SEQ ID NO: 2239669 - RNA, 16 nt, Human
aggcagccccauucug

SEQ ID NO: 2239670 - RNA, 17 nt, Human
aggcagccccauucugc

SEQ ID NO: 2239671 - RNA, 16 nt, Human
aggccaaaggaagcac

SEQ ID NO: 2239672 - RNA, 18 nt, Human
aggccaaaggaagcacau

SEQ ID NO: 2239673 - RNA, 19 nt, Human
aggccaaaggaagcacaug

SEQ ID NO: 2239674 - RNA, 14 nt, Human
aggccaagaaucaa

SEQ ID NO: 2239675 - RNA, 17 nt, Human
uggauugguguaaaagg

SEQ ID NO: 2239676 - RNA, 18 nt, Human
uggauuggguuaugaaua

SEQ ID NO: 2239677 - RNA, 14 nt, Human
uggauugggguccc

SEQ ID NO: 2239678 - RNA, 23 nt, Human
uggauuggauuauuuaauaacau

SEQ ID NO: 2239679 - RNA, 15 nt, Human
uggauuauuuaauaa

SEQ ID NO: 2239680 - RNA, 20 nt, Human
uggauuggagauagggaaag

SEQ ID NO: 2239681 - RNA, 21 nt, Human
uggauuggagauagggaaaga

SEQ ID NO: 2239682 - RNA, 15 nt, Human
uggauuggauuauuu

SEQ ID NO: 2239683 - RNA, 16 nt, Human
uggauuggauuauuua

SEQ ID NO: 2239684 - RNA, 17 nt, Human
uggauuggauuauuuaa

SEQ ID NO: 2239685 - RNA, 20 nt, Human
uggauuggauuauuuaauaa

SEQ ID NO: 2239686 - RNA, 21 nt, Human
uggauuggauuauuuaauaac

SEQ ID NO: 2239687 - RNA, 21 nt, Human
uggauuguccccgacccuugc

SEQ ID NO: 2239688 - RNA, 13 nt, Human
uggcaauauagaa

SEQ ID NO: 2239689 - RNA, 13 nt, Human
uggauuguccccg

SEQ ID NO: 2239690 - RNA, 20 nt, Human
uggauuacugccauucacuu

SEQ ID NO: 2239691 - RNA, 17 nt, Human
uggauuauauuaugaag

SEQ ID NO: 2239692 - RNA, 17 nt, Human
uggauuaauuaaaugca

SEQ ID NO: 2239693 - RNA, 13 nt, Human
uggauuauucauu

SEQ ID NO: 2239694 - RNA, 14 nt, Human
uggauuauucauuu

SEQ ID NO: 2239695 - RNA, 16 nt, Human
uggauuauucauuuaa

SEQ ID NO: 2239696 - RNA, 17 nt, Human
uggauuauucauuuaaa

SEQ ID NO: 2239697 - RNA, 18 nt, Human
uggauuauucauuuaaaa

SEQ ID NO: 2239698 - RNA, 19 nt, Human
uggauuauucauuuaaaau

SEQ ID NO: 2239699 - RNA, 20 nt, Human
uggauuauucauuuaaaaug

SEQ ID NO: 2239700 - RNA, 13 nt, Human
uggauuauuuaau

SEQ ID NO: 2239701 - RNA, 14 nt, Human
uggauuauuuaaua

SEQ ID NO: 2239702 - RNA, 16 nt, Human
uggauuauuuaauaac

SEQ ID NO: 2239703 - RNA, 14 nt, Human
uggagguugcagug

SEQ ID NO: 2239704 - RNA, 20 nt, Human
uggagguugauaacuuugcu

SEQ ID NO: 2239705 - RNA, 14 nt, Human
uggagguugauaac

SEQ ID NO: 2239706 - RNA, 17 nt, Human
uggagguugauaacuuu

SEQ ID NO: 2239707 - RNA, 15 nt, Human
uggagguugaagcca

SEQ ID NO: 2239708 - RNA, 17 nt, Human
uggagguugaagccaag

SEQ ID NO: 2239709 - RNA, 18 nt, Human
uggagguugaagccaagu

SEQ ID NO: 2239710 - RNA, 22 nt, Human
uggagguugaagccaagugggg

SEQ ID NO: 2239711 - RNA, 22 nt, Human
uggagguuaaggcugaggaaag

SEQ ID NO: 2239712 - RNA, 21 nt, Human
uggagguuaaggcugaggaaa

SEQ ID NO: 2239713 - RNA, 20 nt, Human
uggagguuaaggcugaggaa

SEQ ID NO: 2239714 - RNA, 22 nt, Human
uggagggucccaagcugggccc

SEQ ID NO: 2239715 - RNA, 24 nt, Human
uggagguuaaggcugaggaaaggc

SEQ ID NO: 2239716 - RNA, 14 nt, Human
uggaguauauguca

SEQ ID NO: 2239717 - RNA, 16 nt, Human
uggaguauaauauuca

SEQ ID NO: 2239718 - RNA, 15 nt, Human
uggagguuucauacu

SEQ ID NO: 2239719 - RNA, 20 nt, Human
uggagguugcagugagcuga

SEQ ID NO: 2239720 - RNA, 21 nt, Human
uggagguugcagugagccaag

SEQ ID NO: 2239721 - RNA, 13 nt, Human
uggauggcuucua

SEQ ID NO: 2239722 - RNA, 21 nt, Human
uggauggccccagcacagcuu

SEQ ID NO: 2239723 - RNA, 17 nt, Human
uggaugggagugagaca

SEQ ID NO: 2239724 - RNA, 21 nt, Human
uggaugggggaaauggugccu

SEQ ID NO: 2239725 - RNA, 22 nt, Human
uggaugggggaacucagaucca

SEQ ID NO: 2239726 - RNA, 21 nt, Human
uggaugggggaacucagaucc

SEQ ID NO: 2239727 - RNA, 18 nt, Human
uggaugggggaacucaga

SEQ ID NO: 2239728 - RNA, 15 nt, Human
uggauggaaggggcu

SEQ ID NO: 2239729 - RNA, 15 nt, Human
uggauggagcccagg

SEQ ID NO: 2239730 - RNA, 14 nt, Human
uggauggccccagc

SEQ ID NO: 2239731 - RNA, 15 nt, Human
uggauggccccagca

SEQ ID NO: 2239732 - RNA, 16 nt, Human
uggauggccccagcac

SEQ ID NO: 2239733 - RNA, 17 nt, Human
uggauggccccagcaca

SEQ ID NO: 2239734 - RNA, 18 nt, Human
uggauggccccagcacag

SEQ ID NO: 2239735 - RNA, 18 nt, Human
aggccccaaaaccacagc

SEQ ID NO: 2239736 - RNA, 18 nt, Human
aggcccaugguugagaaa

SEQ ID NO: 2239737 - RNA, 17 nt, Human
aggcccagugagaugca

SEQ ID NO: 2239738 - RNA, 17 nt, Human
aggcccaguucacccug

SEQ ID NO: 2239739 - RNA, 13 nt, Human
aggcccagugaga

SEQ ID NO: 2239740 - RNA, 13 nt, Human
aggcccagcauug

SEQ ID NO: 2239741 - RNA, 10 nt, Human
aggcccagca

SEQ ID NO: 2239742 - RNA, 18 nt, Human
aggcccagcauugcuggu

SEQ ID NO: 2239743 - RNA, 19 nt, Human
aggcccagcauugcugguu

SEQ ID NO: 2239744 - RNA, 20 nt, Human
aggcccagcauugcugguuc

SEQ ID NO: 2239745 - RNA, 21 nt, Human
aggcccagcauugcugguucu

SEQ ID NO: 2239746 - RNA, 22 nt, Human
aggcccagcauugcugguucua

SEQ ID NO: 2239747 - RNA, 12 nt, Human
aggccccaggaa

SEQ ID NO: 2239748 - RNA, 22 nt, Human
aggccccagagacucagaggga

SEQ ID NO: 2239749 - RNA, 14 nt, Human
aggccccagccucc

SEQ ID NO: 2239750 - RNA, 13 nt, Human
aggccccagccuc

SEQ ID NO: 2239751 - RNA, 12 nt, Human
aggccccagccu

SEQ ID NO: 2239752 - RNA, 16 nt, Human
aggccccgcccaggcu

SEQ ID NO: 2239753 - RNA, 20 nt, Human
aggccccagagacucagagg

SEQ ID NO: 2239754 - RNA, 14 nt, Human
aggccccagagacu

SEQ ID NO: 2239755 - RNA, 13 nt, Human
aggccccagagac

SEQ ID NO: 2239756 - RNA, 17 nt, Human
aggccccacuggggaaa

SEQ ID NO: 2239757 - RNA, 15 nt, Human
aggccccacugggga

SEQ ID NO: 2239758 - RNA, 13 nt, Human
aggccccacuggg

SEQ ID NO: 2239759 - RNA, 23 nt, Human
aggccccaaaaccacagcccugu

SEQ ID NO: 2239760 - RNA, 21 nt, Human
aggccccaaaaccacagcccu

SEQ ID NO: 2239761 - RNA, 13 nt, Human
aggccccaaagga

SEQ ID NO: 2239762 - RNA, 21 nt, Human
aggccccaaaggaaaaagcac

SEQ ID NO: 2239763 - RNA, 22 nt, Human
aggccccaaaggaaaaagcaca

SEQ ID NO: 2239764 - RNA, 16 nt, Human
aggccagccccaccca

SEQ ID NO: 2239765 - RNA, 15 nt, Human
aggccagccccaccc

SEQ ID NO: 2239766 - RNA, 14 nt, Human
aggccagccccacc

SEQ ID NO: 2239767 - RNA, 13 nt, Human
aggccagccccac

SEQ ID NO: 2239768 - RNA, 18 nt, Human
aggccagccccacccagg

SEQ ID NO: 2239769 - RNA, 17 nt, Human
aggccagccccacccag

SEQ ID NO: 2239770 - RNA, 21 nt, Human
aggccagccccacccaggagg

SEQ ID NO: 2239771 - RNA, 10 nt, Human
aggccagccu

SEQ ID NO: 2239772 - RNA, 21 nt, Human
aggcccagagggccugcaagg

SEQ ID NO: 2239773 - RNA, 23 nt, Human
aggccagccuccgagagggagag

SEQ ID NO: 2239774 - RNA, 18 nt, Human
aggccagccuccgagagg

SEQ ID NO: 2239775 - RNA, 22 nt, Human
aggccagccuccgagagggaga

SEQ ID NO: 2239776 - RNA, 11 nt, Human
aggccagccuc

SEQ ID NO: 2239777 - RNA, 13 nt, Human
aggccagccuccg

SEQ ID NO: 2239778 - RNA, 14 nt, Human
aggccagccuccga

SEQ ID NO: 2239779 - RNA, 17 nt, Human
aggccagccuccgagag

SEQ ID NO: 2239780 - RNA, 22 nt, Human
aggccagaguggccuggccagg

SEQ ID NO: 2239781 - RNA, 21 nt, Human
aggccagaguggccuggccag

SEQ ID NO: 2239782 - RNA, 20 nt, Human
aggccagaguggccuggcca

SEQ ID NO: 2239783 - RNA, 19 nt, Human
aggccagaguggccuggcc

SEQ ID NO: 2239784 - RNA, 22 nt, Human
aggccagccagugaccugagga

SEQ ID NO: 2239785 - RNA, 13 nt, Human
aggccagccagug

SEQ ID NO: 2239786 - RNA, 17 nt, Human
aggccagaguggccugg

SEQ ID NO: 2239787 - RNA, 16 nt, Human
aggccagaguggccug

SEQ ID NO: 2239788 - RNA, 22 nt, Human
aggccagaggcccccagcccag

SEQ ID NO: 2239789 - RNA, 20 nt, Human
aggccagagggagugacaga

SEQ ID NO: 2239790 - RNA, 17 nt, Human
uggcagccuuggcaaac

SEQ ID NO: 2239791 - RNA, 15 nt, Human
uggcagcucaccucu

SEQ ID NO: 2239792 - RNA, 16 nt, Human
aggccacaagacccuu

SEQ ID NO: 2239793 - RNA, 19 nt, Human
uggcagcucaccucucccu

SEQ ID NO: 2239794 - RNA, 14 nt, Human
aggccagagggagu

SEQ ID NO: 2239795 - RNA, 19 nt, Human
aggccacaagacccuugug

SEQ ID NO: 2239796 - RNA, 17 nt, Human
aggccacaagacccuug

SEQ ID NO: 2239797 - RNA, 18 nt, Human
aggccacaagacccuugu

SEQ ID NO: 2239798 - RNA, 23 nt, Human
uggcaauucuuugaccucaaccu

SEQ ID NO: 2239799 - RNA, 13 nt, Human
uggcaauuuugua

SEQ ID NO: 2239800 - RNA, 15 nt, Human
uggcaauuuuguaac

SEQ ID NO: 2239801 - RNA, 14 nt, Human
uggcaauuuuguaa

SEQ ID NO: 2239802 - RNA, 18 nt, Human
uggcacagggcaguggga

SEQ ID NO: 2239803 - RNA, 23 nt, Human
uggcacaauggcuaauucccaga

SEQ ID NO: 2239804 - RNA, 16 nt, Human
uggcacagggcagugg

SEQ ID NO: 2239805 - RNA, 14 nt, Human
uggcaauucuuuga

SEQ ID NO: 2239806 - RNA, 19 nt, Human
uggcaaugccaucaucucc

SEQ ID NO: 2239807 - RNA, 16 nt, Human
uggcacagugucuggg

SEQ ID NO: 2239808 - RNA, 18 nt, Human
uggcacagugucugggcu

SEQ ID NO: 2239809 - RNA, 19 nt, Human
uggcacagugucugggcug

SEQ ID NO: 2239810 - RNA, 20 nt, Human
uggcacagugucugggcuga

SEQ ID NO: 2239811 - RNA, 18 nt, Human
uggcacaguuuucugaga

SEQ ID NO: 2239812 - RNA, 13 nt, Human
uggcagccuuggc

SEQ ID NO: 2239813 - RNA, 19 nt, Human
uggcacaguuuucugagaa

SEQ ID NO: 2239814 - RNA, 23 nt, Human
ugcaccauugcgcucuagccugg

SEQ ID NO: 2239815 - RNA, 23 nt, Human
ugcaccaucccuuuuugaagugu

SEQ ID NO: 2239816 - RNA, 21 nt, Human
ugcaccaucccuuuuugaagu

SEQ ID NO: 2239817 - RNA, 22 nt, Human
ugcaccaucccuuuuugaagug

SEQ ID NO: 2239818 - RNA, 21 nt, Human
ugcacccacucugcuuugacu

SEQ ID NO: 2239819 - RNA, 18 nt, Human
ugcacccacccaggagug

SEQ ID NO: 2239820 - RNA, 17 nt, Human
ugcacccacccaggagu

SEQ ID NO: 2239821 - RNA, 19 nt, Human
ugcacacuagccucuccag

SEQ ID NO: 2239822 - RNA, 21 nt, Human
ugcacacuccccugcacugga

SEQ ID NO: 2239823 - RNA, 21 nt, Human
ugcacacuagccucuccagga

SEQ ID NO: 2239824 - RNA, 18 nt, Human
ugcacacuccccugcacu

SEQ ID NO: 2239825 - RNA, 16 nt, Human
ugcaccaucccuuuuu

SEQ ID NO: 2239826 - RNA, 19 nt, Human
agcccuggagucaugccaa

SEQ ID NO: 2239827 - RNA, 14 nt, Human
ugcacacccacuca

SEQ ID NO: 2239828 - RNA, 14 nt, Human
ugcacacagugcuu

SEQ ID NO: 2239829 - RNA, 17 nt, Human
ugcacacccacucagcu

SEQ ID NO: 2239830 - RNA, 16 nt, Human
ugcacacccacucagc

SEQ ID NO: 2239831 - RNA, 18 nt, Human
ugcacacccacucagcuc

SEQ ID NO: 2239832 - RNA, 20 nt, Human
ugcacacauuuuuuaaaugc

SEQ ID NO: 2239833 - RNA, 10 nt, Human
ugcacacauu

SEQ ID NO: 2239834 - RNA, 17 nt, Human
ugcacccucaggcaggu

SEQ ID NO: 2239835 - RNA, 16 nt, Human
ugcacccucaggcagg

SEQ ID NO: 2239836 - RNA, 13 nt, Human
ugcacccagcccu

SEQ ID NO: 2239837 - RNA, 14 nt, Human
ugcacccagcccug

SEQ ID NO: 2239838 - RNA, 15 nt, Human
ugcacccagcccugg

SEQ ID NO: 2239839 - RNA, 16 nt, Human
ugcacccagcccuggu

SEQ ID NO: 2239840 - RNA, 17 nt, Human
ugcacccagcccugguc

SEQ ID NO: 2239841 - RNA, 15 nt, Human
ugcacccaggggugg

SEQ ID NO: 2239842 - RNA, 15 nt, Human
ugcacccaugggcuc

SEQ ID NO: 2239843 - RNA, 18 nt, Human
ugcacccaugggcucuga

SEQ ID NO: 2239844 - RNA, 20 nt, Human
ugcacccaugggcucugaca

SEQ ID NO: 2239845 - RNA, 21 nt, Human
ugcacccaugggcucugacag

SEQ ID NO: 2239846 - RNA, 22 nt, Human
ugcacccaugggcucugacaga

SEQ ID NO: 2239847 - RNA, 15 nt, Human
ugcaccccuucucuc

SEQ ID NO: 2239848 - RNA, 19 nt, Human
ugcaccccuucucuccucc

SEQ ID NO: 2239849 - RNA, 20 nt, Human
ugcaccccuucucuccuccc

SEQ ID NO: 2239850 - RNA, 14 nt, Human
ugcacccgccucuc

SEQ ID NO: 2239851 - RNA, 14 nt, Human
ugcacccuccgccu

SEQ ID NO: 2239852 - RNA, 17 nt, Human
ugcacccuccacccugu

SEQ ID NO: 2239853 - RNA, 18 nt, Human
ugcacccuccacccuguc

SEQ ID NO: 2239854 - RNA, 16 nt, Human
ugcacccgccucuccc

SEQ ID NO: 2239855 - RNA, 14 nt, Human
ugcacccuccaccc

SEQ ID NO: 2239856 - RNA, 15 nt, Human
ugcacccuccacccu

SEQ ID NO: 2239857 - RNA, 16 nt, Human
ugcacccuccacccug

SEQ ID NO: 2239858 - RNA, 12 nt, Human
ugcacgugugca

SEQ ID NO: 2239859 - RNA, 22 nt, Human
ugcacguggccucuugagcagu

SEQ ID NO: 2239860 - RNA, 16 nt, Human
ugcacccuccgccuuc

SEQ ID NO: 2239861 - RNA, 19 nt, Human
ugcacguggccucuugagc

SEQ ID NO: 2239862 - RNA, 14 nt, Human
ugcacgugugugca

SEQ ID NO: 2239863 - RNA, 15 nt, Human
ugcacgugugugcac

SEQ ID NO: 2239864 - RNA, 20 nt, Human
agccccuugcucuccccugc

SEQ ID NO: 2239865 - RNA, 17 nt, Human
agccccuugagaaaccu

SEQ ID NO: 2239866 - RNA, 21 nt, Human
agcccugcuuugggcugcccu

SEQ ID NO: 2239867 - RNA, 22 nt, Human
agccccuucugcucagcucugg

SEQ ID NO: 2239868 - RNA, 19 nt, Human
agccccuucugcucagcuc

SEQ ID NO: 2239869 - RNA, 16 nt, Human
agccccuucugcucag

SEQ ID NO: 2239870 - RNA, 15 nt, Human
agccccuucugcuca

SEQ ID NO: 2239871 - RNA, 20 nt, Human
agccccuucugacccaugcu

SEQ ID NO: 2239872 - RNA, 24 nt, Human
agccccuucugacccaugcugccc

SEQ ID NO: 2239873 - RNA, 21 nt, Human
agcccugguggcagugggagc

SEQ ID NO: 2239874 - RNA, 23 nt, Human
agcccuggagccaacugcugcuu

SEQ ID NO: 2239875 - RNA, 11 nt, Human
agcccuggagg

SEQ ID NO: 2239876 - RNA, 12 nt, Human
agcccuggaggu

SEQ ID NO: 2239877 - RNA, 15 nt, Human
agcccuggaggugcc

SEQ ID NO: 2239878 - RNA, 16 nt, Human
agcccuggaggugcca

SEQ ID NO: 2239879 - RNA, 17 nt, Human
agcccuggaggugccag

SEQ ID NO: 2239880 - RNA, 18 nt, Human
agcccuggaggugccagc

SEQ ID NO: 2239881 - RNA, 21 nt, Human
agcccuggaggugccagcaaa

SEQ ID NO: 2239882 - RNA, 22 nt, Human
agcccugcuuugggcugcccug

SEQ ID NO: 2239883 - RNA, 23 nt, Human
agcccugcuuugggcugcccugg

SEQ ID NO: 2239884 - RNA, 23 nt, Human
agccccuugcucuccccugcccu

SEQ ID NO: 2239885 - RNA, 18 nt, Human
agcccuggagccaacugc

SEQ ID NO: 2239886 - RNA, 19 nt, Human
agcccuggagccaacugcu

SEQ ID NO: 2239887 - RNA, 20 nt, Human
agcccuggagccaacugcug

SEQ ID NO: 2239888 - RNA, 21 nt, Human
agcccuggagccaacugcugc

SEQ ID NO: 2239889 - RNA, 22 nt, Human
agcccuggagccaacugcugcu

SEQ ID NO: 2239890 - RNA, 21 nt, Human
ugcacaagcugcacccucagg

SEQ ID NO: 2239891 - RNA, 18 nt, Human
ugcacaagcugcacccuc

SEQ ID NO: 2239892 - RNA, 22 nt, Human
ugcacacaccagagcccaccuu

SEQ ID NO: 2239893 - RNA, 24 nt, Human
ugcacacagcacgggggccaagga

SEQ ID NO: 2239894 - RNA, 12 nt, Human
ugcacacagcac

SEQ ID NO: 2239895 - RNA, 14 nt, Human
agcccugucagugc

SEQ ID NO: 2239896 - RNA, 22 nt, Human
agcccuggaggugccagcaaag

SEQ ID NO: 2239897 - RNA, 15 nt, Human
agcccuguaauuuuu

SEQ ID NO: 2239898 - RNA, 15 nt, Human
ugcacaagcugcacc

SEQ ID NO: 2239899 - RNA, 22 nt, Human
agcccugguggcagugggagcu

SEQ ID NO: 2239900 - RNA, 23 nt, Human
agcccugguggcagugggagcug

SEQ ID NO: 2239901 - RNA, 19 nt, Human
ugauucuccugccucagcc

SEQ ID NO: 2239902 - RNA, 15 nt, Human
ugauucuccugccuc

SEQ ID NO: 2239903 - RNA, 16 nt, Human
ugauucgcccaaagcc

SEQ ID NO: 2239904 - RNA, 22 nt, Human
ugauucgcccaaagccagacag

SEQ ID NO: 2239905 - RNA, 21 nt, Human
ugauucgcccaaagccagaca

SEQ ID NO: 2239906 - RNA, 15 nt, Human
ugauucuaaugucuu

SEQ ID NO: 2239907 - RNA, 22 nt, Human
ugauucuauuuauauguacaug

SEQ ID NO: 2239908 - RNA, 11 nt, Human
ugauucucagg

SEQ ID NO: 2239909 - RNA, 12 nt, Human
ugauucucaggg

SEQ ID NO: 2239910 - RNA, 21 nt, Human
ugauucuauuuauauguacau

SEQ ID NO: 2239911 - RNA, 17 nt, Human
ugauucuaaugucuuca

SEQ ID NO: 2239912 - RNA, 19 nt, Human
ugauucuaaugucuucauu

SEQ ID NO: 2239913 - RNA, 22 nt, Human
agcccaggguucccccagcccu

SEQ ID NO: 2239914 - RNA, 21 nt, Human
agcccaggguucccccagccc

SEQ ID NO: 2239915 - RNA, 19 nt, Human
agcccaggguucccccagc

SEQ ID NO: 2239916 - RNA, 18 nt, Human
agcccaggguucccccag

SEQ ID NO: 2239917 - RNA, 15 nt, Human
agcccaguagaccuu

SEQ ID NO: 2239918 - RNA, 23 nt, Human
agcccagguccucugauacccag

SEQ ID NO: 2239919 - RNA, 23 nt, Human
agcccaggguucccccagcccug

SEQ ID NO: 2239920 - RNA, 18 nt, Human
agcccaguagaccuuguu

SEQ ID NO: 2239921 - RNA, 18 nt, Human
agcccaguucagcuuggg

SEQ ID NO: 2239922 - RNA, 17 nt, Human
agcccaggguuccccca

SEQ ID NO: 2239923 - RNA, 16 nt, Human
agcccaggguuccccc

SEQ ID NO: 2239924 - RNA, 15 nt, Human
ugauucucagggucu

SEQ ID NO: 2239925 - RNA, 19 nt, Human
ugauucucagggucucugc

SEQ ID NO: 2239926 - RNA, 20 nt, Human
ugauucucagggucucugcu

SEQ ID NO: 2239927 - RNA, 20 nt, Human
ugauucuccugccucagccu

SEQ ID NO: 2239928 - RNA, 20 nt, Human
agcccaugcccaccugccca

SEQ ID NO: 2239929 - RNA, 16 nt, Human
agcccaugcccaccug

SEQ ID NO: 2239930 - RNA, 22 nt, Human
agcccaugcccaccugcccauc

SEQ ID NO: 2239931 - RNA, 17 nt, Human
agcccauggacuucaca

SEQ ID NO: 2239932 - RNA, 11 nt, Human
agcccaugccc

SEQ ID NO: 2239933 - RNA, 17 nt, Human
agcccaugaguccuuga

SEQ ID NO: 2239934 - RNA, 13 nt, Human
agcccaucaauua

SEQ ID NO: 2239935 - RNA, 20 nt, Human
agcccaucccugccugguca

SEQ ID NO: 2239936 - RNA, 13 nt, Human
agcccaucccugc

SEQ ID NO: 2239937 - RNA, 15 nt, Human
agcccaucccugccu

SEQ ID NO: 2239938 - RNA, 17 nt, Human
agcccaucccugccugg

SEQ ID NO: 2239939 - RNA, 18 nt, Human
agcccaucccugccuggu

SEQ ID NO: 2239940 - RNA, 21 nt, Human
agccccaaaacucuccucugc

SEQ ID NO: 2239941 - RNA, 22 nt, Human
agccccaaaacucuccucugcu

SEQ ID NO: 2239942 - RNA, 20 nt, Human
agccccaaaacucuccucug

SEQ ID NO: 2239943 - RNA, 18 nt, Human
agcccauggcacucuaug

SEQ ID NO: 2239944 - RNA, 17 nt, Human
agccccgaggccuucuc

SEQ ID NO: 2239945 - RNA, 22 nt, Human
agccccgaggccuucucugaag

SEQ ID NO: 2239946 - RNA, 16 nt, Human
agccccgaggccuucu

SEQ ID NO: 2239947 - RNA, 22 nt, Human
agcccccagcuaagaaccugga

SEQ ID NO: 2239948 - RNA, 20 nt, Human
agcccccagcuaagaaccug

SEQ ID NO: 2239949 - RNA, 19 nt, Human
agcccccagcuaagaaccu

SEQ ID NO: 2239950 - RNA, 24 nt, Human
agccccaaaacucuccucugcugc

SEQ ID NO: 2239951 - RNA, 16 nt, Human
agcccccacagugcug

SEQ ID NO: 2239952 - RNA, 19 nt, Human
agcccccacagugcugucu

SEQ ID NO: 2239953 - RNA, 19 nt, Human
agcccccacccacuucccu

SEQ ID NO: 2239954 - RNA, 12 nt, Human
agcccccagcua

SEQ ID NO: 2239955 - RNA, 19 nt, Human
agcccccaccgugggcagg

SEQ ID NO: 2239956 - RNA, 17 nt, Human
agccccucccaccacag

SEQ ID NO: 2239957 - RNA, 16 nt, Human
agccccucccaccaca

SEQ ID NO: 2239958 - RNA, 22 nt, Human
agccccuggaugcagccucaca

SEQ ID NO: 2239959 - RNA, 19 nt, Human
agccccuggaugcagccuc

SEQ ID NO: 2239960 - RNA, 17 nt, Human
agccccuggaugcagcc

SEQ ID NO: 2239961 - RNA, 18 nt, Human
agccccuggaugcagccu

SEQ ID NO: 2239962 - RNA, 14 nt, Human
agccccucccacca

SEQ ID NO: 2239963 - RNA, 13 nt, Human
agccccucccacc

SEQ ID NO: 2239964 - RNA, 21 nt, Human
agccccuagcccaggagagag

SEQ ID NO: 2239965 - RNA, 22 nt, Human
agccccuagcccaggagagaga

SEQ ID NO: 2239966 - RNA, 23 nt, Human
agccccuagcccaggagagagaa

SEQ ID NO: 2239967 - RNA, 18 nt, Human
agccccgcagaccucccc

SEQ ID NO: 2239968 - RNA, 21 nt, Human
agccccuaccccacaccaggc

SEQ ID NO: 2239969 - RNA, 12 nt, Human
agccccuagccc

SEQ ID NO: 2239970 - RNA, 14 nt, Human
agccccuagcccag

SEQ ID NO: 2239971 - RNA, 15 nt, Human
agccccuagcccagg

SEQ ID NO: 2239972 - RNA, 16 nt, Human
agccccuagcccagga

SEQ ID NO: 2239973 - RNA, 18 nt, Human
agccccuagcccaggaga

SEQ ID NO: 2239974 - RNA, 19 nt, Human
agccccuagcccaggagag

SEQ ID NO: 2239975 - RNA, 14 nt, Human
agccccgcagaccu

SEQ ID NO: 2239976 - RNA, 19 nt, Human
agccccgcagaccucccca

SEQ ID NO: 2239977 - RNA, 16 nt, Human
agccccgcagaccucc

SEQ ID NO: 2239978 - RNA, 17 nt, Human
agccccuaccccacacc

SEQ ID NO: 2239979 - RNA, 12 nt, Human
agccucaucucu

SEQ ID NO: 2239980 - RNA, 19 nt, Human
agccucauccgaggcaggg

SEQ ID NO: 2239981 - RNA, 15 nt, Human
agccucauguccacu

SEQ ID NO: 2239982 - RNA, 22 nt, Human
agccucagcauccuggcacccg

SEQ ID NO: 2239983 - RNA, 23 nt, Human
agccucagcauccuggcacccgg

SEQ ID NO: 2239984 - RNA, 18 nt, Human
agccuccaugcugccucc

SEQ ID NO: 2239985 - RNA, 20 nt, Human
agccuccaugcugccuccag

SEQ ID NO: 2239986 - RNA, 20 nt, Human
agccucauguccacugguuc

SEQ ID NO: 2239987 - RNA, 17 nt, Human
agccuccauuuaguucu

SEQ ID NO: 2239988 - RNA, 15 nt, Human
agccuccauuuaguu

SEQ ID NO: 2239989 - RNA, 20 nt, Human
agccucauccgaggcagggu

SEQ ID NO: 2239990 - RNA, 21 nt, Human
agccuccauuuaguucuuugu

SEQ ID NO: 2239991 - RNA, 20 nt, Human
agccuccauuuaguucuuug

SEQ ID NO: 2239992 - RNA, 16 nt, Human
agccucccaaagugcu

SEQ ID NO: 2239993 - RNA, 17 nt, Human
agccucagcauccuggc

SEQ ID NO: 2239994 - RNA, 19 nt, Human
agccucagcauccuggcac

SEQ ID NO: 2239995 - RNA, 20 nt, Human
agccucagcauccuggcacc

SEQ ID NO: 2239996 - RNA, 21 nt, Human
agccucagcauccuggcaccc

SEQ ID NO: 2239997 - RNA, 16 nt, Human
agccucagcauccugg

SEQ ID NO: 2239998 - RNA, 21 nt, Human
agccuagccgaccucagccuu

SEQ ID NO: 2239999 - RNA, 20 nt, Human
agccuagccgaccucagccu

SEQ ID NO: 2240000 - RNA, 19 nt, Human
agccuagccgaccucagcc

SEQ ID NO: 2240001 - RNA, 18 nt, Human
agccuagccgaccucagc

SEQ ID NO: 2240002 - RNA, 17 nt, Human
agccuagccgaccucag

SEQ ID NO: 2240003 - RNA, 19 nt, Human
agccuagaagagcuucuga

SEQ ID NO: 2240004 - RNA, 17 nt, Human
agccuagaagagcuucu

SEQ ID NO: 2240005 - RNA, 17 nt, Human
agccuaccugcucucca

SEQ ID NO: 2240006 - RNA, 18 nt, Human
agccuagacccuccuccu

SEQ ID NO: 2240007 - RNA, 15 nt, Human
agccuagacccuccu

SEQ ID NO: 2240008 - RNA, 16 nt, Human
agccuacgcugaagau

SEQ ID NO: 2240009 - RNA, 15 nt, Human
agccuagagugaggg

SEQ ID NO: 2240010 - RNA, 17 nt, Human
ugcacguuaugguguuu

SEQ ID NO: 2240011 - RNA, 19 nt, Human
ugcacguuaugguguuucu

SEQ ID NO: 2240012 - RNA, 15 nt, Human
ugcacuaugaggaau

SEQ ID NO: 2240013 - RNA, 23 nt, Human
ugcacuauagccuaggugacaga

SEQ ID NO: 2240014 - RNA, 14 nt, Human
ugcacccucuaucc

SEQ ID NO: 2240015 - RNA, 15 nt, Human
ugcacguuauggugu

SEQ ID NO: 2240016 - RNA, 23 nt, Human
agcccuucuaccuuccugcaaca

SEQ ID NO: 2240017 - RNA, 21 nt, Human
agccgagagccugcuccccca

SEQ ID NO: 2240018 - RNA, 16 nt, Human
agccuaccugcucucc

SEQ ID NO: 2240019 - RNA, 16 nt, Human
agccgugguccuuugg

SEQ ID NO: 2240020 - RNA, 22 nt, Human
agccguggcuucccgcucagcc

SEQ ID NO: 2240021 - RNA, 23 nt, Human
agccguggcuucccgcucagccc

SEQ ID NO: 2240022 - RNA, 14 nt, Human
agccguggcuuccc

SEQ ID NO: 2240023 - RNA, 21 nt, Human
agccguggcuucccgcucagc

SEQ ID NO: 2240024 - RNA, 18 nt, Human
agccgagagccugcuccc

SEQ ID NO: 2240025 - RNA, 17 nt, Human
agccgagagccugcucc

SEQ ID NO: 2240026 - RNA, 16 nt, Human
agccgagagccugcuc

SEQ ID NO: 2240027 - RNA, 15 nt, Human
agccgagagccugcu

SEQ ID NO: 2240028 - RNA, 13 nt, Human
agccguggcuucc

SEQ ID NO: 2240029 - RNA, 13 nt, Human
agccgaccucagc

SEQ ID NO: 2240030 - RNA, 12 nt, Human
agccgaccucag

SEQ ID NO: 2240031 - RNA, 17 nt, Human
agcccuucuuuccacag

SEQ ID NO: 2240032 - RNA, 14 nt, Human
agccgagagccugc

SEQ ID NO: 2240033 - RNA, 13 nt, Human
agccgagagccug

SEQ ID NO: 2240034 - RNA, 23 nt, Human
agccgacugcacagcggccccug

SEQ ID NO: 2240035 - RNA, 17 nt, Human
agccgacuccacuuuca

SEQ ID NO: 2240036 - RNA, 15 nt, Human
agccgaccucagccu

SEQ ID NO: 2240037 - RNA, 14 nt, Human
agccgaccucagcc

SEQ ID NO: 2240038 - RNA, 16 nt, Human
agccgaccucagccuu

SEQ ID NO: 2240039 - RNA, 22 nt, Human
ugcaguagagucaucuccauca

SEQ ID NO: 2240040 - RNA, 19 nt, Human
ugcaguagagucaucucca

SEQ ID NO: 2240041 - RNA, 16 nt, Human
ugcaguagagucaucu

SEQ ID NO: 2240042 - RNA, 18 nt, Human
ugcaguacuuuaccuccu

SEQ ID NO: 2240043 - RNA, 21 nt, Human
ugcaguaaaucuuuuacaacu

SEQ ID NO: 2240044 - RNA, 18 nt, Human
ugcaguaaaucuuuuaca

SEQ ID NO: 2240045 - RNA, 14 nt, Human
ugcagcuaucuggu

SEQ ID NO: 2240046 - RNA, 15 nt, Human
ugcaguaaaucuuuu

SEQ ID NO: 2240047 - RNA, 14 nt, Human
ugcaguaaaucuuu

SEQ ID NO: 2240048 - RNA, 13 nt, Human
ugcaguaaaucuu

SEQ ID NO: 2240049 - RNA, 12 nt, Human
ugcaggucccua

SEQ ID NO: 2240050 - RNA, 14 nt, Human
ugcaggucccuaau

SEQ ID NO: 2240051 - RNA, 15 nt, Human
ugcaggucccuaaua

SEQ ID NO: 2240052 - RNA, 16 nt, Human
ugcaggucccuaauaa

SEQ ID NO: 2240053 - RNA, 14 nt, Human
ugcagucuggcuga

SEQ ID NO: 2240054 - RNA, 13 nt, Human
ugcaguccuggga

SEQ ID NO: 2240055 - RNA, 19 nt, Human
ugcagucuggcugagcccu

SEQ ID NO: 2240056 - RNA, 22 nt, Human
ugcaguccugaucagagccgug

SEQ ID NO: 2240057 - RNA, 19 nt, Human
ugcaguccugaucagagcc

SEQ ID NO: 2240058 - RNA, 14 nt, Human
ugcaguccugggau

SEQ ID NO: 2240059 - RNA, 14 nt, Human
ugcaguagauuuuc

SEQ ID NO: 2240060 - RNA, 17 nt, Human
ugcauaaguuaacuucc

SEQ ID NO: 2240061 - RNA, 14 nt, Human
ugcauaaguuaacu

SEQ ID NO: 2240062 - RNA, 13 nt, Human
ugcagucugggug

SEQ ID NO: 2240063 - RNA, 20 nt, Human
ugcagucuggcugagcccug

SEQ ID NO: 2240064 - RNA, 21 nt, Human
ugcagucuggcugagcccugc

SEQ ID NO: 2240065 - RNA, 22 nt, Human
ugcauaacguauaaaagccugu

SEQ ID NO: 2240066 - RNA, 23 nt, Human
ugcauaacguauaaaagccuguu

SEQ ID NO: 2240067 - RNA, 14 nt, Human
ugcagccuccuccu

SEQ ID NO: 2240068 - RNA, 15 nt, Human
ugcagccuccuccug

SEQ ID NO: 2240069 - RNA, 16 nt, Human
ugcagccuccuccuga

SEQ ID NO: 2240070 - RNA, 17 nt, Human
ugcagccuccuccugac

SEQ ID NO: 2240071 - RNA, 14 nt, Human
ugcagccugcgcca

SEQ ID NO: 2240072 - RNA, 19 nt, Human
ugcagccuccuccugacca

SEQ ID NO: 2240073 - RNA, 15 nt, Human
ugcagccuggaggcc

SEQ ID NO: 2240074 - RNA, 14 nt, Human
ugcagccuggaggc

SEQ ID NO: 2240075 - RNA, 12 nt, Human
ugcagccugggu

SEQ ID NO: 2240076 - RNA, 20 nt, Human
ugcagccuguccugggcugg

SEQ ID NO: 2240077 - RNA, 19 nt, Human
ugcagcgaaccaauauuug

SEQ ID NO: 2240078 - RNA, 13 nt, Human
ugcagcuaucugg

SEQ ID NO: 2240079 - RNA, 23 nt, Human
ugcagccuuugccuccccggcuc

SEQ ID NO: 2240080 - RNA, 11 nt, Human
ugcaggucccu

SEQ ID NO: 2240081 - RNA, 16 nt, Human
ugcagccucacagucc

SEQ ID NO: 2240082 - RNA, 13 nt, Human
ugcagccucacag

SEQ ID NO: 2240083 - RNA, 15 nt, Human
ugcagccucacaguc

SEQ ID NO: 2240084 - RNA, 21 nt, Human
ugcagccccgcgccuccuucc

SEQ ID NO: 2240085 - RNA, 20 nt, Human
ugcagcccggcgccaccauc

SEQ ID NO: 2240086 - RNA, 22 nt, Human
ugcagcccggcgccaccauccu

SEQ ID NO: 2240087 - RNA, 20 nt, Human
ugcagccccgccuccaggcc

SEQ ID NO: 2240088 - RNA, 21 nt, Human
ugcagccccgccuccaggcca

SEQ ID NO: 2240089 - RNA, 23 nt, Human
ugcagccccgccuccaggccaca

SEQ ID NO: 2240090 - RNA, 23 nt, Human
ugcagcccguguggccccuucac

SEQ ID NO: 2240091 - RNA, 21 nt, Human
ugcagcccguguggccccuuc

SEQ ID NO: 2240092 - RNA, 19 nt, Human
ugcagcccguguggccccu

SEQ ID NO: 2240093 - RNA, 23 nt, Human
ugcagccucaaccuccugggcua

SEQ ID NO: 2240094 - RNA, 21 nt, Human
ugcagcccaugcccaccugcc

SEQ ID NO: 2240095 - RNA, 19 nt, Human
ugcagcccaugcccaccug

SEQ ID NO: 2240096 - RNA, 18 nt, Human
ugcagcccaugcccaccu

SEQ ID NO: 2240097 - RNA, 14 nt, Human
ugcagcccaugccc

SEQ ID NO: 2240098 - RNA, 23 nt, Human
ugcagcccaugcccaccugccca

SEQ ID NO: 2240099 - RNA, 23 nt, Human
ugcagcccccacugccuuugacc

SEQ ID NO: 2240100 - RNA, 17 nt, Human
ugcagcccccacugccu

SEQ ID NO: 2240101 - RNA, 22 nt, Human
agccugaaggggcgucuguucc

SEQ ID NO: 2240102 - RNA, 22 nt, Human
agccugaaagaggaaugaagua

SEQ ID NO: 2240103 - RNA, 20 nt, Human
agccugaccaacauggagaa

SEQ ID NO: 2240104 - RNA, 21 nt, Human
agccugaauuuuguugcuguu

SEQ ID NO: 2240105 - RNA, 20 nt, Human
agccugaauuuuguugcugu

SEQ ID NO: 2240106 - RNA, 16 nt, Human
agccuuccacacucac

SEQ ID NO: 2240107 - RNA, 18 nt, Human
agccuugguguccaccug

SEQ ID NO: 2240108 - RNA, 17 nt, Human
agccuugguguccaccu

SEQ ID NO: 2240109 - RNA, 16 nt, Human
agccuugguguccacc

SEQ ID NO: 2240110 - RNA, 20 nt, Human
agccuuggggcugaugcagu

SEQ ID NO: 2240111 - RNA, 21 nt, Human
agccuugguguccaccuggcc

SEQ ID NO: 2240112 - RNA, 19 nt, Human
agccuugguguccaccugg

SEQ ID NO: 2240113 - RNA, 16 nt, Human
agccuuguaauucuaa

SEQ ID NO: 2240114 - RNA, 22 nt, Human
agccuugguguccaccuggccc

SEQ ID NO: 2240115 - RNA, 18 nt, Human
agccuuguaauucuaaau

SEQ ID NO: 2240116 - RNA, 16 nt, Human
agccuugugucuacag

SEQ ID NO: 2240117 - RNA, 17 nt, Human
agccuugugucuacaga

SEQ ID NO: 2240118 - RNA, 22 nt, Human
agcgccuaguggggucucccuc

SEQ ID NO: 2240119 - RNA, 11 nt, Human
agccuuccagg

SEQ ID NO: 2240120 - RNA, 14 nt, Human
agccuuccaggggu

SEQ ID NO: 2240121 - RNA, 16 nt, Human
agccuuccaggggugg

SEQ ID NO: 2240122 - RNA, 17 nt, Human
agccuuccagggguggg

SEQ ID NO: 2240123 - RNA, 19 nt, Human
agcgccugccccucccaga

SEQ ID NO: 2240124 - RNA, 12 nt, Human
agcgccugcccc

SEQ ID NO: 2240125 - RNA, 23 nt, Human
agcgccuaguggggucucccucu

SEQ ID NO: 2240126 - RNA, 22 nt, Human
agcgccuccauccaaggccagg

SEQ ID NO: 2240127 - RNA, 16 nt, Human
agcggagaaaggaagg

SEQ ID NO: 2240128 - RNA, 18 nt, Human
agcgccuccauccaaggc

SEQ ID NO: 2240129 - RNA, 20 nt, Human
agcgccuccauccaaggcca

SEQ ID NO: 2240130 - RNA, 23 nt, Human
agcgccuccauccaaggccaggu

SEQ ID NO: 2240131 - RNA, 18 nt, Human
agcgccugccccucccag

SEQ ID NO: 2240132 - RNA, 15 nt, Human
agcgccugccccucc

SEQ ID NO: 2240133 - RNA, 20 nt, Human
agcgccuuucccaacucuag

SEQ ID NO: 2240134 - RNA, 17 nt, Human
agcgccuuucccaacuc

SEQ ID NO: 2240135 - RNA, 14 nt, Human
agcggaggugugga

SEQ ID NO: 2240136 - RNA, 20 nt, Human
ugcauuaucuagauacugua

SEQ ID NO: 2240137 - RNA, 18 nt, Human
agcggagacggaguccca

SEQ ID NO: 2240138 - RNA, 20 nt, Human
agcggagaaaggaagggcug

SEQ ID NO: 2240139 - RNA, 15 nt, Human
ugccaauuagcaauu

SEQ ID NO: 2240140 - RNA, 13 nt, Human
ugccaauuucaag

SEQ ID NO: 2240141 - RNA, 22 nt, Human
ugccaauaauaauaccucccuu

SEQ ID NO: 2240142 - RNA, 21 nt, Human
ugccaauaauaauaccucccu

SEQ ID NO: 2240143 - RNA, 20 nt, Human
ugccaaguuguuugagaaau

SEQ ID NO: 2240144 - RNA, 19 nt, Human
ugccaaguuguuugagaaa

SEQ ID NO: 2240145 - RNA, 15 nt, Human
ugccaaguuguuuga

SEQ ID NO: 2240146 - RNA, 13 nt, Human
ugccacacuucag

SEQ ID NO: 2240147 - RNA, 14 nt, Human
ugccacacuucagg

SEQ ID NO: 2240148 - RNA, 15 nt, Human
ugccacacuucaggc

SEQ ID NO: 2240149 - RNA, 16 nt, Human
ugccacacuucaggcu

SEQ ID NO: 2240150 - RNA, 19 nt, Human
ugccaauuuuugccuucau

SEQ ID NO: 2240151 - RNA, 16 nt, Human
ugccacaaggacuucc

SEQ ID NO: 2240152 - RNA, 15 nt, Human
ugccacaaggacuuc

SEQ ID NO: 2240153 - RNA, 17 nt, Human
ugccaauuuuugccuuc

SEQ ID NO: 2240154 - RNA, 18 nt, Human
ugccaauuuuugccuuca

SEQ ID NO: 2240155 - RNA, 21 nt, Human
ugccaauuuuugccuucauua

SEQ ID NO: 2240156 - RNA, 17 nt, Human
ugcauugagaacugcau

SEQ ID NO: 2240157 - RNA, 15 nt, Human
ugcauugagaacugc

SEQ ID NO: 2240158 - RNA, 15 nt, Human
ugcauugaauauauu

SEQ ID NO: 2240159 - RNA, 20 nt, Human
ugcauugaccgcgacuaauu

SEQ ID NO: 2240160 - RNA, 22 nt, Human
ugcauugaccgcgacuaauuuc

SEQ ID NO: 2240161 - RNA, 19 nt, Human
ugcauugcugugaauuagc

SEQ ID NO: 2240162 - RNA, 18 nt, Human
ugcauuggaagaccccac

SEQ ID NO: 2240163 - RNA, 21 nt, Human
ugccaagggcuuuguuuugca

SEQ ID NO: 2240164 - RNA, 23 nt, Human
agcggagguugcagggagccgag

SEQ ID NO: 2240165 - RNA, 18 nt, Human
ugcauuaucuagauacug

SEQ ID NO: 2240166 - RNA, 16 nt, Human
ugcauugaauauauua

SEQ ID NO: 2240167 - RNA, 14 nt, Human
ugcauugaauauau

SEQ ID NO: 2240168 - RNA, 13 nt, Human
ugcauugaauaua

SEQ ID NO: 2240169 - RNA, 23 nt, Human
ugcauugaacacaaacuguaaau

SEQ ID NO: 2240170 - RNA, 22 nt, Human
ugcauuaucuagauacuguauc

SEQ ID NO: 2240171 - RNA, 21 nt, Human
ugcauuaucuagauacuguau

SEQ ID NO: 2240172 - RNA, 18 nt, Human
ugcauaccaaccugggca

SEQ ID NO: 2240173 - RNA, 14 nt, Human
ugcauaccaaccug

SEQ ID NO: 2240174 - RNA, 12 nt, Human
ugcauaccaacc

SEQ ID NO: 2240175 - RNA, 12 nt, Human
ugcauaccacuu

SEQ ID NO: 2240176 - RNA, 14 nt, Human
ugcauacacacaca

SEQ ID NO: 2240177 - RNA, 16 nt, Human
ugcauacacacacaca

SEQ ID NO: 2240178 - RNA, 15 nt, Human
ugcauacacacacac

SEQ ID NO: 2240179 - RNA, 23 nt, Human
ugcauacacacacacacacagcc

SEQ ID NO: 2240180 - RNA, 22 nt, Human
ugcauacacacacacacacagc

SEQ ID NO: 2240181 - RNA, 21 nt, Human
ugcauacacacacacacacag

SEQ ID NO: 2240182 - RNA, 17 nt, Human
agccugcuccagcuguu

SEQ ID NO: 2240183 - RNA, 16 nt, Human
agccugcuccagcugu

SEQ ID NO: 2240184 - RNA, 15 nt, Human
agccugcuccagcug

SEQ ID NO: 2240185 - RNA, 14 nt, Human
agccugcuccagcu

SEQ ID NO: 2240186 - RNA, 22 nt, Human
agccugcuccagcuguucagcu

SEQ ID NO: 2240187 - RNA, 19 nt, Human
agccugcuccagcuguuca

SEQ ID NO: 2240188 - RNA, 17 nt, Human
agccugcucccccaccc

SEQ ID NO: 2240189 - RNA, 15 nt, Human
agccugcucccccac

SEQ ID NO: 2240190 - RNA, 14 nt, Human
agccugcuccccca

SEQ ID NO: 2240191 - RNA, 11 nt, Human
agccugcuccc

SEQ ID NO: 2240192 - RNA, 21 nt, Human
agccugcucccccacccccuc

SEQ ID NO: 2240193 - RNA, 19 nt, Human
agccugcucccccaccccc

SEQ ID NO: 2240194 - RNA, 23 nt, Human
agccugcucccccacccccuccc

SEQ ID NO: 2240195 - RNA, 20 nt, Human
agccugcuccuucccaggag

SEQ ID NO: 2240196 - RNA, 22 nt, Human
agccugcuccuucccaggagug

SEQ ID NO: 2240197 - RNA, 22 nt, Human
agccugggugacagagcaagug

SEQ ID NO: 2240198 - RNA, 15 nt, Human
agccuggggucugga

SEQ ID NO: 2240199 - RNA, 16 nt, Human
agccuggucagcccaa

SEQ ID NO: 2240200 - RNA, 15 nt, Human
agccuggucagccca

SEQ ID NO: 2240201 - RNA, 23 nt, Human
agccugggguggggucaugcccu

SEQ ID NO: 2240202 - RNA, 19 nt, Human
agccugggguggggucaug

SEQ ID NO: 2240203 - RNA, 20 nt, Human
agccugggguggggucaugc

SEQ ID NO: 2240204 - RNA, 21 nt, Human
agccugggugacagagugaga

SEQ ID NO: 2240205 - RNA, 23 nt, Human
agccuucagucuugaauuucuaa

SEQ ID NO: 2240206 - RNA, 15 nt, Human
agccuuauccucuga

SEQ ID NO: 2240207 - RNA, 17 nt, Human
agccuuauccucugauc

SEQ ID NO: 2240208 - RNA, 18 nt, Human
agccuuauccucugaucu

SEQ ID NO: 2240209 - RNA, 14 nt, Human
agccuuaucaagug

SEQ ID NO: 2240210 - RNA, 15 nt, Human
agccuuaucaagugu

SEQ ID NO: 2240211 - RNA, 17 nt, Human
agccuuaucaagugucu

SEQ ID NO: 2240212 - RNA, 18 nt, Human
agccuuaucaagugucuu

SEQ ID NO: 2240213 - RNA, 19 nt, Human
agccuuaucaagugucuuc

SEQ ID NO: 2240214 - RNA, 14 nt, Human
agccuuauccucug

SEQ ID NO: 2240215 - RNA, 14 nt, Human
agccuguuggaccc

SEQ ID NO: 2240216 - RNA, 20 nt, Human
agccuguuccccucacugga

SEQ ID NO: 2240217 - RNA, 22 nt, Human
agccuguuccccucacuggaug

SEQ ID NO: 2240218 - RNA, 22 nt, Human
agccuguuggacccgcucugga

SEQ ID NO: 2240219 - RNA, 21 nt, Human
agccuguguaacagcuccuug

SEQ ID NO: 2240220 - RNA, 19 nt, Human
agccuguguaacagcuccu

SEQ ID NO: 2240221 - RNA, 20 nt, Human
agccuguguaacagcuccuu

SEQ ID NO: 2240222 - RNA, 14 nt, Human
agccuguuccccuc

SEQ ID NO: 2240223 - RNA, 17 nt, Human
agccuguuccccucacu

SEQ ID NO: 2240224 - RNA, 18 nt, Human
agccuguuccccucacug

SEQ ID NO: 2240225 - RNA, 13 nt, Human
agccuguuuaaga

SEQ ID NO: 2240226 - RNA, 20 nt, Human
agccuguggcggugccuggg

SEQ ID NO: 2240227 - RNA, 13 nt, Human
agccuguguaaca

SEQ ID NO: 2240228 - RNA, 19 nt, Human
agccuguggcggugccugg

SEQ ID NO: 2240229 - RNA, 18 nt, Human
agccuguggcggugccug

SEQ ID NO: 2240230 - RNA, 15 nt, Human
agccuguguaacagc

SEQ ID NO: 2240231 - RNA, 16 nt, Human
agccuguguaacagcu

SEQ ID NO: 2240232 - RNA, 17 nt, Human
agccuguguaacagcuc

SEQ ID NO: 2240233 - RNA, 18 nt, Human
agccuguguaacagcucc

SEQ ID NO: 2240234 - RNA, 22 nt, Human
agccuguggcggugccugggug

SEQ ID NO: 2240235 - RNA, 21 nt, Human
agccuguggcaucuuugccuu

SEQ ID NO: 2240236 - RNA, 17 nt, Human
agccuguggcggugccu

SEQ ID NO: 2240237 - RNA, 22 nt, Human
agccuguggcaucuuugccuug

SEQ ID NO: 2240238 - RNA, 14 nt, Human
agccuguggcaucu

SEQ ID NO: 2240239 - RNA, 11 nt, Human
agccuguggca

SEQ ID NO: 2240240 - RNA, 22 nt, Human
agccuggugggccuccucuguc

SEQ ID NO: 2240241 - RNA, 21 nt, Human
agccuggugggccuccucugu

SEQ ID NO: 2240242 - RNA, 18 nt, Human
agccuggugggccuccuc

SEQ ID NO: 2240243 - RNA, 16 nt, Human
agccuggugggccucc

SEQ ID NO: 2240244 - RNA, 14 nt, Human
agccuggugggccu

SEQ ID NO: 2240245 - RNA, 11 nt, Human
agccugguggg

SEQ ID NO: 2240246 - RNA, 21 nt, Human
agccugugccucugggacugg

SEQ ID NO: 2240247 - RNA, 16 nt, Human
agccuggugcugcugc

SEQ ID NO: 2240248 - RNA, 15 nt, Human
agccuggugcugcug

SEQ ID NO: 2240249 - RNA, 14 nt, Human
agccuggugcugcu

SEQ ID NO: 2240250 - RNA, 20 nt, Human
agccuggucagcccaaacca

SEQ ID NO: 2240251 - RNA, 11 nt, Human
agccuggugcc

SEQ ID NO: 2240252 - RNA, 20 nt, Human
ugcccagcccggaccuuggc

SEQ ID NO: 2240253 - RNA, 14 nt, Human
ugcccacaggccgc

SEQ ID NO: 2240254 - RNA, 21 nt, Human
ugcccagccccuucugaccca

SEQ ID NO: 2240255 - RNA, 20 nt, Human
ugcccagccccuucugaccc

SEQ ID NO: 2240256 - RNA, 20 nt, Human
ugcccacaggaucagucuga

SEQ ID NO: 2240257 - RNA, 12 nt, Human
ugcccacaggcc

SEQ ID NO: 2240258 - RNA, 20 nt, Human
ugcccaagccagaggcuggg

SEQ ID NO: 2240259 - RNA, 16 nt, Human
ugcccaagccagaggc

SEQ ID NO: 2240260 - RNA, 18 nt, Human
ugcccaagccagaggcug

SEQ ID NO: 2240261 - RNA, 19 nt, Human
ugcccacaggaucagucug

SEQ ID NO: 2240262 - RNA, 16 nt, Human
ugcccacaggaucagu

SEQ ID NO: 2240263 - RNA, 19 nt, Human
agcucaguuuauccaaggu

SEQ ID NO: 2240264 - RNA, 23 nt, Human
agcucaguucuagucucucuggg

SEQ ID NO: 2240265 - RNA, 14 nt, Human
agcucaucucuguc

SEQ ID NO: 2240266 - RNA, 14 nt, Human
agcucauauuuugu

SEQ ID NO: 2240267 - RNA, 15 nt, Human
agcucauauuuugua

SEQ ID NO: 2240268 - RNA, 18 nt, Human
agcucauauuuuguauau

SEQ ID NO: 2240269 - RNA, 21 nt, Human
agcucauucuccuuguguuac

SEQ ID NO: 2240270 - RNA, 20 nt, Human
agcucauucuccuuguguua

SEQ ID NO: 2240271 - RNA, 21 nt, Human
ugcccaagaauagaugcugac

SEQ ID NO: 2240272 - RNA, 18 nt, Human
agcuccaaccugcaaaga

SEQ ID NO: 2240273 - RNA, 16 nt, Human
agcuccaaccugcaaa

SEQ ID NO: 2240274 - RNA, 15 nt, Human
agcuccaaccugcaa

SEQ ID NO: 2240275 - RNA, 14 nt, Human
agcuccaaccugca

SEQ ID NO: 2240276 - RNA, 13 nt, Human
agcuccaaccugc

SEQ ID NO: 2240277 - RNA, 12 nt, Human
agcucauuucac

SEQ ID NO: 2240278 - RNA, 15 nt, Human
agcucauuucacuuu

SEQ ID NO: 2240279 - RNA, 22 nt, Human
ugcccaagaauagaugcugacu

SEQ ID NO: 2240280 - RNA, 23 nt, Human
ugcccaagaauagaugcugacug

SEQ ID NO: 2240281 - RNA, 11 nt, Human
ugcccaagcca

SEQ ID NO: 2240282 - RNA, 13 nt, Human
ugcccaagccaga

SEQ ID NO: 2240283 - RNA, 14 nt, Human
ugcccaagccagag

SEQ ID NO: 2240284 - RNA, 15 nt, Human
ugcccaagccagagg

SEQ ID NO: 2240285 - RNA, 12 nt, Human
agcuaggccugg

SEQ ID NO: 2240286 - RNA, 13 nt, Human
agcuaggaaugaa

SEQ ID NO: 2240287 - RNA, 12 nt, Human
agcuaggaauga

SEQ ID NO: 2240288 - RNA, 18 nt, Human
agcuaggaauuguguuua

SEQ ID NO: 2240289 - RNA, 16 nt, Human
agcuaggccuggccag

SEQ ID NO: 2240290 - RNA, 21 nt, Human
agcucagcuacugauuuuugu

SEQ ID NO: 2240291 - RNA, 17 nt, Human
agcucagcgccagccug

SEQ ID NO: 2240292 - RNA, 14 nt, Human
agcuaggccuggcc

SEQ ID NO: 2240293 - RNA, 15 nt, Human
agcuaggccuggcca

SEQ ID NO: 2240294 - RNA, 22 nt, Human
agcucagcuuuuugucuuuucu

SEQ ID NO: 2240295 - RNA, 20 nt, Human
agcucagcuuuuugucuuuu

SEQ ID NO: 2240296 - RNA, 18 nt, Human
agcucaggugucccugca

SEQ ID NO: 2240297 - RNA, 18 nt, Human
agcucaggacagaugcca

SEQ ID NO: 2240298 - RNA, 17 nt, Human
agcucaggacagaugcc

SEQ ID NO: 2240299 - RNA, 13 nt, Human
agcucaggacaga

SEQ ID NO: 2240300 - RNA, 21 nt, Human
agcucagucccaucagagagc

SEQ ID NO: 2240301 - RNA, 13 nt, Human
agcucagucccau

SEQ ID NO: 2240302 - RNA, 21 nt, Human
agcucaguucuagucucucug

SEQ ID NO: 2240303 - RNA, 22 nt, Human
agcucaguucuagucucucugg

SEQ ID NO: 2240304 - RNA, 22 nt, Human
agcucaggugucccugcacuug

SEQ ID NO: 2240305 - RNA, 20 nt, Human
agcucaggugucccugcacu

SEQ ID NO: 2240306 - RNA, 21 nt, Human
agcucaggugucccugcacuu

SEQ ID NO: 2240307 - RNA, 23 nt, Human
agcuaccucaaccaaugccaaaa

SEQ ID NO: 2240308 - RNA, 20 nt, Human
agcuacccuuuuucuccagc

SEQ ID NO: 2240309 - RNA, 14 nt, Human
agcuaccucaacca

SEQ ID NO: 2240310 - RNA, 16 nt, Human
agcuaccucaaacuuc

SEQ ID NO: 2240311 - RNA, 23 nt, Human
agcguagcuaagugaaaagguca

SEQ ID NO: 2240312 - RNA, 19 nt, Human
agcgugcaccaucccuuuu

SEQ ID NO: 2240313 - RNA, 21 nt, Human
agcuacccuuuuucuccagcu

SEQ ID NO: 2240314 - RNA, 19 nt, Human
agcuacuaauuuuaaaaug

SEQ ID NO: 2240315 - RNA, 18 nt, Human
agcguacucaucaucaac

SEQ ID NO: 2240316 - RNA, 22 nt, Human
agcgguuuggggagcagagaca

SEQ ID NO: 2240317 - RNA, 14 nt, Human
agcguagccucucc

SEQ ID NO: 2240318 - RNA, 19 nt, Human
agcgguuuggggagcagag

SEQ ID NO: 2240319 - RNA, 19 nt, Human
agcgugagccacugcaccg

SEQ ID NO: 2240320 - RNA, 15 nt, Human
agcgugcauaaguua

SEQ ID NO: 2240321 - RNA, 22 nt, Human
agcgugagccacugcaccgggc

SEQ ID NO: 2240322 - RNA, 22 nt, Human
agcggugcuguccucagguggc

SEQ ID NO: 2240323 - RNA, 13 nt, Human
agcggucucaggc

SEQ ID NO: 2240324 - RNA, 22 nt, Human
agcggucucaggcuggugggag

SEQ ID NO: 2240325 - RNA, 14 nt, Human
agcgguuuggggag

SEQ ID NO: 2240326 - RNA, 15 nt, Human
agcgguggcccuguc

SEQ ID NO: 2240327 - RNA, 23 nt, Human
agcggucucaggcuggugggagg

SEQ ID NO: 2240328 - RNA, 12 nt, Human
agcgguggcccu

SEQ ID NO: 2240329 - RNA, 21 nt, Human
agcgguggcccugucccuccc

SEQ ID NO: 2240330 - RNA, 16 nt, Human
agcgggggccagggaa

SEQ ID NO: 2240331 - RNA, 21 nt, Human
ugccagacggcacccacccag

SEQ ID NO: 2240332 - RNA, 20 nt, Human
ugccagaagauccccucagg

SEQ ID NO: 2240333 - RNA, 21 nt, Human
ugccagagacggaagccuuuu

SEQ ID NO: 2240334 - RNA, 22 nt, Human
ugccagagacggaagccuuuuu

SEQ ID NO: 2240335 - RNA, 20 nt, Human
ugccagaacaguuuguacag

SEQ ID NO: 2240336 - RNA, 18 nt, Human
ugccagaagauccccuca

SEQ ID NO: 2240337 - RNA, 21 nt, Human
ugccagaagauccccucagga

SEQ ID NO: 2240338 - RNA, 19 nt, Human
ugccagaacaguuuguaca

SEQ ID NO: 2240339 - RNA, 18 nt, Human
ugccagaacaguuuguac

SEQ ID NO: 2240340 - RNA, 14 nt, Human
ugccagaacaguuu

SEQ ID NO: 2240341 - RNA, 12 nt, Human
ugccacuuuuua

SEQ ID NO: 2240342 - RNA, 13 nt, Human
ugccagacaugug

SEQ ID NO: 2240343 - RNA, 12 nt, Human
ugccagacaugu

SEQ ID NO: 2240344 - RNA, 17 nt, Human
ugccagacccccuggag

SEQ ID NO: 2240345 - RNA, 22 nt, Human
ugccacacuucaggcucuucuc

SEQ ID NO: 2240346 - RNA, 23 nt, Human
ugccacacuucaggcucuucucc

SEQ ID NO: 2240347 - RNA, 23 nt, Human
ugccacuuugguacauggccagu

SEQ ID NO: 2240348 - RNA, 19 nt, Human
ugccacuuugcaaaggagc

SEQ ID NO: 2240349 - RNA, 19 nt, Human
ugcauuggaagaccccacc

SEQ ID NO: 2240350 - RNA, 18 nt, Human
agcuagcgcugccgcacc

SEQ ID NO: 2240351 - RNA, 16 nt, Human
agcuagcgcugccgca

SEQ ID NO: 2240352 - RNA, 14 nt, Human
agcuagcgcugccg

SEQ ID NO: 2240353 - RNA, 20 nt, Human
agcuagaggaaccaaccccc

SEQ ID NO: 2240354 - RNA, 12 nt, Human
agcuagaggaac

SEQ ID NO: 2240355 - RNA, 21 nt, Human
agcuagcgcugccgcacccca

SEQ ID NO: 2240356 - RNA, 20 nt, Human
agcuagcgcugccgcacccc

SEQ ID NO: 2240357 - RNA, 14 nt, Human
agcuagcuccccuc

SEQ ID NO: 2240358 - RNA, 15 nt, Human
agcuagcuccccucc

SEQ ID NO: 2240359 - RNA, 16 nt, Human
agcuagcuccccuccu

SEQ ID NO: 2240360 - RNA, 17 nt, Human
agcuagcuccccuccuc

SEQ ID NO: 2240361 - RNA, 17 nt, Human
agcuagcugcagagcca

SEQ ID NO: 2240362 - RNA, 18 nt, Human
agcuagcuccccuccucu

SEQ ID NO: 2240363 - RNA, 20 nt, Human
agcuagcuccccuccucucc

SEQ ID NO: 2240364 - RNA, 21 nt, Human
agcuagcuccccuccucuccc

SEQ ID NO: 2240365 - RNA, 23 nt, Human
agcuagcuccccuccucuccccu

SEQ ID NO: 2240366 - RNA, 18 nt, Human
agcuagacgagcaggcuu

SEQ ID NO: 2240367 - RNA, 22 nt, Human
agcuagaauucccucucucuga

SEQ ID NO: 2240368 - RNA, 12 nt, Human
agcuagaaauga

SEQ ID NO: 2240369 - RNA, 19 nt, Human
agcuacuugggccauagcu

SEQ ID NO: 2240370 - RNA, 15 nt, Human
agcuagaaauaugau

SEQ ID NO: 2240371 - RNA, 16 nt, Human
agcuagaacccggcag

SEQ ID NO: 2240372 - RNA, 15 nt, Human
agcuagaaccuggag

SEQ ID NO: 2240373 - RNA, 16 nt, Human
agcuagaaccuggaga

SEQ ID NO: 2240374 - RNA, 18 nt, Human
agcuagaaccuggagagc

SEQ ID NO: 2240375 - RNA, 16 nt, Human
agcuagaaccuggagg

SEQ ID NO: 2240376 - RNA, 19 nt, Human
agcuagaacuuugaaggac

SEQ ID NO: 2240377 - RNA, 24 nt, Human
agcuagaagugggccaggacaggc

SEQ ID NO: 2240378 - RNA, 22 nt, Human
agcuagaagugggccaggacag

SEQ ID NO: 2240379 - RNA, 21 nt, Human
agcuagaagugggccaggaca

SEQ ID NO: 2240380 - RNA, 19 nt, Human
agcuagaagugggccagga

SEQ ID NO: 2240381 - RNA, 15 nt, Human
agcuagaagugggcc

SEQ ID NO: 2240382 - RNA, 16 nt, Human
agcuagaaggccacau

SEQ ID NO: 2240383 - RNA, 14 nt, Human
agcuagaaggccac

SEQ ID NO: 2240384 - RNA, 15 nt, Human
agcuagaaggccaca

SEQ ID NO: 2240385 - RNA, 11 nt, Human
agcuagaaaug

SEQ ID NO: 2240386 - RNA, 14 nt, Human
agcuacuugggcca

SEQ ID NO: 2240387 - RNA, 15 nt, Human
agcuacuugggccau

SEQ ID NO: 2240388 - RNA, 22 nt, Human
agcuacuugggccauagcuccu

SEQ ID NO: 2240389 - RNA, 18 nt, Human
agcuacuaaugauguuuu

SEQ ID NO: 2240390 - RNA, 16 nt, Human
agcuacuaaugauguu

SEQ ID NO: 2240391 - RNA, 13 nt, Human
agcuacuaaugau

SEQ ID NO: 2240392 - RNA, 16 nt, Human
agcuacuugggaggcu

SEQ ID NO: 2240393 - RNA, 13 nt, Human
agcuacuugggcc

SEQ ID NO: 2240394 - RNA, 17 nt, Human
agcuacuugggaggcug

SEQ ID NO: 2240395 - RNA, 18 nt, Human
agcuacuugggaggcuga

SEQ ID NO: 2240396 - RNA, 15 nt, Human
ugaugagcuccucuu

SEQ ID NO: 2240397 - RNA, 16 nt, Human
ugaugagcuccucuuc

SEQ ID NO: 2240398 - RNA, 21 nt, Human
ugaugacaacuggaauaguuu

SEQ ID NO: 2240399 - RNA, 19 nt, Human
ugaugacaacuggaauagu

SEQ ID NO: 2240400 - RNA, 14 nt, Human
ugaugaauacugua

SEQ ID NO: 2240401 - RNA, 17 nt, Human
ugaugaggccucuugga

SEQ ID NO: 2240402 - RNA, 18 nt, Human
ugaugaggccucuuggac

SEQ ID NO: 2240403 - RNA, 22 nt, Human
ugaugaggccucuuggaccucu

SEQ ID NO: 2240404 - RNA, 14 nt, Human
ugaugaagaggagu

SEQ ID NO: 2240405 - RNA, 13 nt, Human
ugaugaagaggag

SEQ ID NO: 2240406 - RNA, 19 nt, Human
ugaucgugacgcugaauaa

SEQ ID NO: 2240407 - RNA, 20 nt, Human
ugaucgugacgcugaauaaa

SEQ ID NO: 2240408 - RNA, 21 nt, Human
ugaucgugacgcugaauaaau

SEQ ID NO: 2240409 - RNA, 23 nt, Human
ugaucgugacgcugaauaaaugu

SEQ ID NO: 2240410 - RNA, 17 nt, Human
ugaucgccuuucccagg

SEQ ID NO: 2240411 - RNA, 15 nt, Human
ugaucgccuuuccca

SEQ ID NO: 2240412 - RNA, 18 nt, Human
ugaucggagccuccucuc

SEQ ID NO: 2240413 - RNA, 15 nt, Human
ugaucgugacgcuga

SEQ ID NO: 2240414 - RNA, 16 nt, Human
ugaucgugacgcugaa

SEQ ID NO: 2240415 - RNA, 17 nt, Human
ugaugaagaaguugaua

SEQ ID NO: 2240416 - RNA, 21 nt, Human
ugauccaugaguuugcccugg

SEQ ID NO: 2240417 - RNA, 18 nt, Human
ugauccagccucuccccu

SEQ ID NO: 2240418 - RNA, 19 nt, Human
ugauccagccucuccccug

SEQ ID NO: 2240419 - RNA, 20 nt, Human
ugauccuggaggcccaguuc

SEQ ID NO: 2240420 - RNA, 13 nt, Human
ugauccugugaag

SEQ ID NO: 2240421 - RNA, 18 nt, Human
ugauccuuuuggagucag

SEQ ID NO: 2240422 - RNA, 15 nt, Human
ugauccuuacaaguu

SEQ ID NO: 2240423 - RNA, 14 nt, Human
ugauccugugaagu

SEQ ID NO: 2240424 - RNA, 20 nt, Human
ugauccuuuuauguuauuua

SEQ ID NO: 2240425 - RNA, 15 nt, Human
agccacggccaggcc

SEQ ID NO: 2240426 - RNA, 23 nt, Human
agccaccuuuugggaauguuuua

SEQ ID NO: 2240427 - RNA, 15 nt, Human
ugauccagcccugag

SEQ ID NO: 2240428 - RNA, 18 nt, Human
ugauccagcccugaguuc

SEQ ID NO: 2240429 - RNA, 17 nt, Human
ugauccagcccugaguu

SEQ ID NO: 2240430 - RNA, 16 nt, Human
agccaccaacucuugc

SEQ ID NO: 2240431 - RNA, 17 nt, Human
agccaccaacucuugca

SEQ ID NO: 2240432 - RNA, 13 nt, Human
agccaccaacucu

SEQ ID NO: 2240433 - RNA, 23 nt, Human
agccacauuuggaauacuuuuug

SEQ ID NO: 2240434 - RNA, 22 nt, Human
agccacauuuggaauacuuuuu

SEQ ID NO: 2240435 - RNA, 21 nt, Human
agccacauuuggaauacuuuu

SEQ ID NO: 2240436 - RNA, 21 nt, Human
agccaccgaagccgccugugg

SEQ ID NO: 2240437 - RNA, 20 nt, Human
agccaccgaagccgccugug

SEQ ID NO: 2240438 - RNA, 15 nt, Human
agccaccgaagccgc

SEQ ID NO: 2240439 - RNA, 14 nt, Human
agccaccucucuuu

SEQ ID NO: 2240440 - RNA, 16 nt, Human
agccaccucucccuca

SEQ ID NO: 2240441 - RNA, 22 nt, Human
agccaccucucccucaacaagg

SEQ ID NO: 2240442 - RNA, 12 nt, Human
agccaccucucc

SEQ ID NO: 2240443 - RNA, 14 nt, Human
agccaccucucccu

SEQ ID NO: 2240444 - RNA, 15 nt, Human
agccaccucucccuc

SEQ ID NO: 2240445 - RNA, 18 nt, Human
agccaccgugccuggcca

SEQ ID NO: 2240446 - RNA, 22 nt, Human
agccaccgaagccgccugugga

SEQ ID NO: 2240447 - RNA, 22 nt, Human
agccaccuuuugggaauguuuu

SEQ ID NO: 2240448 - RNA, 18 nt, Human
agccaccucucuuuuuca

SEQ ID NO: 2240449 - RNA, 14 nt, Human
agccacggccaggc

SEQ ID NO: 2240450 - RNA, 14 nt, Human
agccacauuccuga

SEQ ID NO: 2240451 - RNA, 18 nt, Human
agccacauuccugaugcu

SEQ ID NO: 2240452 - RNA, 11 nt, Human
agcauuugaau

SEQ ID NO: 2240453 - RNA, 13 nt, Human
agcauuucugaag

SEQ ID NO: 2240454 - RNA, 12 nt, Human
agcauuugaaug

SEQ ID NO: 2240455 - RNA, 13 nt, Human
agcauuugaaugc

SEQ ID NO: 2240456 - RNA, 14 nt, Human
agcauuugaaugca

SEQ ID NO: 2240457 - RNA, 15 nt, Human
agcauuugaaugcau

SEQ ID NO: 2240458 - RNA, 11 nt, Human
agccacauccc

SEQ ID NO: 2240459 - RNA, 19 nt, Human
agccaccaacauacuccca

SEQ ID NO: 2240460 - RNA, 20 nt, Human
agccacauuuggaauacuuu

SEQ ID NO: 2240461 - RNA, 15 nt, Human
agccacauuuggaau

SEQ ID NO: 2240462 - RNA, 22 nt, Human
agccacaguuuccucaucuguc

SEQ ID NO: 2240463 - RNA, 22 nt, Human
agcauuucugaaguggacucuu

SEQ ID NO: 2240464 - RNA, 23 nt, Human
agccacaucccuuugaaacaaga

SEQ ID NO: 2240465 - RNA, 20 nt, Human
agccaccaacauacucccau

SEQ ID NO: 2240466 - RNA, 23 nt, Human
agccaccaacauacucccaucug

SEQ ID NO: 2240467 - RNA, 16 nt, Human
agccacugaagcuggg

SEQ ID NO: 2240468 - RNA, 13 nt, Human
agccacugaagcu

SEQ ID NO: 2240469 - RNA, 12 nt, Human
agccacugaagc

SEQ ID NO: 2240470 - RNA, 22 nt, Human
agccacuccucugacucagggc

SEQ ID NO: 2240471 - RNA, 21 nt, Human
agccacuccucugacucaggg

SEQ ID NO: 2240472 - RNA, 15 nt, Human
agccacucgggaggc

SEQ ID NO: 2240473 - RNA, 19 nt, Human
agccacucgggaggcugag

SEQ ID NO: 2240474 - RNA, 14 nt, Human
ugauuaccagggac

SEQ ID NO: 2240475 - RNA, 15 nt, Human
agccacuccucugac

SEQ ID NO: 2240476 - RNA, 14 nt, Human
agccacuccucuga

SEQ ID NO: 2240477 - RNA, 13 nt, Human
agccacuccucug

SEQ ID NO: 2240478 - RNA, 14 nt, Human
ugauuacacaaaac

SEQ ID NO: 2240479 - RNA, 15 nt, Human
ugauuacacaaaaca

SEQ ID NO: 2240480 - RNA, 17 nt, Human
ugauuacacaaaacaaa

SEQ ID NO: 2240481 - RNA, 14 nt, Human
ugauuacacaguug

SEQ ID NO: 2240482 - RNA, 13 nt, Human
ugauuacacaguu

SEQ ID NO: 2240483 - RNA, 18 nt, Human
ugauuacaccagccucgu

SEQ ID NO: 2240484 - RNA, 21 nt, Human
ugauuaauucaccuuccagug

SEQ ID NO: 2240485 - RNA, 20 nt, Human
ugauuaaacgugcagacuau

SEQ ID NO: 2240486 - RNA, 15 nt, Human
ugauuaauuaaaaca

SEQ ID NO: 2240487 - RNA, 12 nt, Human
ugauuaaaccaa

SEQ ID NO: 2240488 - RNA, 14 nt, Human
agccacugugcuga

SEQ ID NO: 2240489 - RNA, 17 nt, Human
agccacuuaaaauguuc

SEQ ID NO: 2240490 - RNA, 22 nt, Human
agccacuuaccuucaauaaagu

SEQ ID NO: 2240491 - RNA, 21 nt, Human
agccacuuaccuucaauaaag

SEQ ID NO: 2240492 - RNA, 18 nt, Human
agccacuuaccuucaaua

SEQ ID NO: 2240493 - RNA, 17 nt, Human
agccacuuaccuucaau

SEQ ID NO: 2240494 - RNA, 16 nt, Human
agccacuuaccuucaa

SEQ ID NO: 2240495 - RNA, 15 nt, Human
agccacuuaccuuca

SEQ ID NO: 2240496 - RNA, 13 nt, Human
agccacuuaccuu

SEQ ID NO: 2240497 - RNA, 18 nt, Human
agccacugugcugaauuc

SEQ ID NO: 2240498 - RNA, 23 nt, Human
agccagaaauaaaguuggugaca

SEQ ID NO: 2240499 - RNA, 14 nt, Human
agccagaaccugga

SEQ ID NO: 2240500 - RNA, 20 nt, Human
agccagaacguggcucugcu

SEQ ID NO: 2240501 - RNA, 19 nt, Human
agccagaaauaaaguuggu

SEQ ID NO: 2240502 - RNA, 23 nt, Human
agccacuuaccuucaauaaagua

SEQ ID NO: 2240503 - RNA, 13 nt, Human
agccacugcaccg

SEQ ID NO: 2240504 - RNA, 21 nt, Human
agccacugcaccgggccacag

SEQ ID NO: 2240505 - RNA, 22 nt, Human
agccacugcaccgggccacaga

SEQ ID NO: 2240506 - RNA, 20 nt, Human
ugaugauccuaggcauuugc

SEQ ID NO: 2240507 - RNA, 14 nt, Human
ugaugaucuuuaaa

SEQ ID NO: 2240508 - RNA, 13 nt, Human
ugaugaguuguga

SEQ ID NO: 2240509 - RNA, 14 nt, Human
ugaugaggggaggg

SEQ ID NO: 2240510 - RNA, 15 nt, Human
ugaugaggggagggg

SEQ ID NO: 2240511 - RNA, 14 nt, Human
ugaugauccuaggc

SEQ ID NO: 2240512 - RNA, 17 nt, Human
ugauggugcaaugaccu

SEQ ID NO: 2240513 - RNA, 23 nt, Human
ugauggugcaaugaccuuucaau

SEQ ID NO: 2240514 - RNA, 16 nt, Human
ugauggugcaaugacc

SEQ ID NO: 2240515 - RNA, 17 nt, Human
ugaugaucuuuaaaaua

SEQ ID NO: 2240516 - RNA, 18 nt, Human
ugauguuuuccuauaaua

SEQ ID NO: 2240517 - RNA, 18 nt, Human
ugauguuuuaaggaugcu

SEQ ID NO: 2240518 - RNA, 17 nt, Human
ugauguuuuaaggaugc

SEQ ID NO: 2240519 - RNA, 21 nt, Human
ugaugaucagcuguuugucau

SEQ ID NO: 2240520 - RNA, 15 nt, Human
ugaugauacaagauu

SEQ ID NO: 2240521 - RNA, 15 nt, Human
ugauggugcugaccu

SEQ ID NO: 2240522 - RNA, 20 nt, Human
ugauguuuguggccucagaa

SEQ ID NO: 2240523 - RNA, 19 nt, Human
ugauguuuguggccucaga

SEQ ID NO: 2240524 - RNA, 18 nt, Human
ugauguuuguggccucag

SEQ ID NO: 2240525 - RNA, 17 nt, Human
ugauguuuguggccuca

SEQ ID NO: 2240526 - RNA, 11 nt, Human
ugauguuugug

SEQ ID NO: 2240527 - RNA, 13 nt, Human
ugauguuuguccu

SEQ ID NO: 2240528 - RNA, 16 nt, Human
ugauguuuguggccuc

SEQ ID NO: 2240529 - RNA, 14 nt, Human
agccaggccccagg

SEQ ID NO: 2240530 - RNA, 23 nt, Human
agccaggcacacacugugcuuuc

SEQ ID NO: 2240531 - RNA, 21 nt, Human
agccaggcagguagccagggg

SEQ ID NO: 2240532 - RNA, 15 nt, Human
agccaggccccaggc

SEQ ID NO: 2240533 - RNA, 12 nt, Human
agccaggccugg

SEQ ID NO: 2240534 - RNA, 15 nt, Human
agccaggccacuggc

SEQ ID NO: 2240535 - RNA, 12 nt, Human
agccaggcacac

SEQ ID NO: 2240536 - RNA, 17 nt, Human
agccaggcacacacugu

SEQ ID NO: 2240537 - RNA, 18 nt, Human
agccaggcacacacugug

SEQ ID NO: 2240538 - RNA, 20 nt, Human
agccaggcacacacugugcu

SEQ ID NO: 2240539 - RNA, 21 nt, Human
agccaggccacaagacccuug

SEQ ID NO: 2240540 - RNA, 22 nt, Human
agccaggccacaagacccuugu

SEQ ID NO: 2240541 - RNA, 12 nt, Human
agccagggucuc

SEQ ID NO: 2240542 - RNA, 23 nt, Human
agccagggggacuagccccugug

SEQ ID NO: 2240543 - RNA, 21 nt, Human
agccagggggacuagccccug

SEQ ID NO: 2240544 - RNA, 22 nt, Human
agccagggggacuagccccugu

SEQ ID NO: 2240545 - RNA, 18 nt, Human
agccaggcgggcucaagg

SEQ ID NO: 2240546 - RNA, 18 nt, Human
agccagggggacuagccc

SEQ ID NO: 2240547 - RNA, 22 nt, Human
agccaggccugggucugugucu

SEQ ID NO: 2240548 - RNA, 13 nt, Human
agccaggcgggcu

SEQ ID NO: 2240549 - RNA, 14 nt, Human
agccaggcgggcuc

SEQ ID NO: 2240550 - RNA, 15 nt, Human
agccaggcgggcuca

SEQ ID NO: 2240551 - RNA, 19 nt, Human
agccaggcgggcucaagga

SEQ ID NO: 2240552 - RNA, 21 nt, Human
agccagugaccugaggaagcg

SEQ ID NO: 2240553 - RNA, 19 nt, Human
agccagugaccugaggaag

SEQ ID NO: 2240554 - RNA, 18 nt, Human
agccagugaccugaggaa

SEQ ID NO: 2240555 - RNA, 17 nt, Human
agccagugaccugagga

SEQ ID NO: 2240556 - RNA, 13 nt, Human
agccagucuuuac

SEQ ID NO: 2240557 - RNA, 14 nt, Human
agccagucccaggg

SEQ ID NO: 2240558 - RNA, 22 nt, Human
agccaguaaaugggggugcauu

SEQ ID NO: 2240559 - RNA, 23 nt, Human
agccaguaaaugggggugcauuu

SEQ ID NO: 2240560 - RNA, 21 nt, Human
agccaggguguggcccugcca

SEQ ID NO: 2240561 - RNA, 22 nt, Human
agccaggguguggcccugccau

SEQ ID NO: 2240562 - RNA, 18 nt, Human
agccagguaaugagggac

SEQ ID NO: 2240563 - RNA, 23 nt, Human
agccagguaaugagggacuggaa

SEQ ID NO: 2240564 - RNA, 22 nt, Human
agccauacuuaucucucugugc

SEQ ID NO: 2240565 - RNA, 16 nt, Human
agccauacuuaucucu

SEQ ID NO: 2240566 - RNA, 19 nt, Human
agccauacuuaucucucug

SEQ ID NO: 2240567 - RNA, 21 nt, Human
agccauauaaguuugaaggaa

SEQ ID NO: 2240568 - RNA, 21 nt, Human
agccaguucaguaccuggagg

SEQ ID NO: 2240569 - RNA, 22 nt, Human
agccaguucaguaccuggagga

SEQ ID NO: 2240570 - RNA, 17 nt, Human
agccaguucaguaccug

SEQ ID NO: 2240571 - RNA, 19 nt, Human
agccaguucaguaccugga

SEQ ID NO: 2240572 - RNA, 13 nt, Human
agccagugacucc

SEQ ID NO: 2240573 - RNA, 15 nt, Human
agccagugacuccag

SEQ ID NO: 2240574 - RNA, 16 nt, Human
agccagugacuccagg

SEQ ID NO: 2240575 - RNA, 17 nt, Human
agccagugacuccagga

SEQ ID NO: 2240576 - RNA, 18 nt, Human
agccagugacuccaggag

SEQ ID NO: 2240577 - RNA, 19 nt, Human
agccagugacuccaggaga

SEQ ID NO: 2240578 - RNA, 21 nt, Human
agccagugacuccaggagagg

SEQ ID NO: 2240579 - RNA, 22 nt, Human
agccagugacuccaggagagga

SEQ ID NO: 2240580 - RNA, 14 nt, Human
agccaggagcuggg

SEQ ID NO: 2240581 - RNA, 18 nt, Human
agccaggagcugggcaga

SEQ ID NO: 2240582 - RNA, 14 nt, Human
agccaggaucaugg

SEQ ID NO: 2240583 - RNA, 15 nt, Human
agccaggaucauggu

SEQ ID NO: 2240584 - RNA, 18 nt, Human
agccaggaucauggugua

SEQ ID NO: 2240585 - RNA, 20 nt, Human
agccaggaucaugguguaau

SEQ ID NO: 2240586 - RNA, 23 nt, Human
agccaggaucaugguguaauaag

SEQ ID NO: 2240587 - RNA, 22 nt, Human
agccaggaucaugguguaauaa

SEQ ID NO: 2240588 - RNA, 11 nt, Human
agccaggcaca

SEQ ID NO: 2240589 - RNA, 12 nt, Human
agccaggccaca

SEQ ID NO: 2240590 - RNA, 14 nt, Human
agccaggccacaag

SEQ ID NO: 2240591 - RNA, 19 nt, Human
agccaggaauuucccagga

SEQ ID NO: 2240592 - RNA, 17 nt, Human
agccaggaauuucccag

SEQ ID NO: 2240593 - RNA, 22 nt, Human
agccagcuuucccugccucuca

SEQ ID NO: 2240594 - RNA, 18 nt, Human
agccagcuuucccugccu

SEQ ID NO: 2240595 - RNA, 16 nt, Human
agccagcuuucccugc

SEQ ID NO: 2240596 - RNA, 23 nt, Human
agccaggaauuucccaggacccu

SEQ ID NO: 2240597 - RNA, 22 nt, Human
agccaggaauuucccaggaccc

SEQ ID NO: 2240598 - RNA, 21 nt, Human
agccaggaauuucccaggacc

SEQ ID NO: 2240599 - RNA, 20 nt, Human
agccaggaauuucccaggac

SEQ ID NO: 2240600 - RNA, 13 nt, Human
agccaggagcaaa

SEQ ID NO: 2240601 - RNA, 22 nt, Human
agccaggagcaaauguuucugc

SEQ ID NO: 2240602 - RNA, 23 nt, Human
agccaggagcaaauguuucugca

SEQ ID NO: 2240603 - RNA, 16 nt, Human
agccagcucugcauua

SEQ ID NO: 2240604 - RNA, 18 nt, Human
agccagacucuggucuuc

SEQ ID NO: 2240605 - RNA, 14 nt, Human
agccagacucuggu

SEQ ID NO: 2240606 - RNA, 16 nt, Human
agccagacucuggucu

SEQ ID NO: 2240607 - RNA, 19 nt, Human
agccagacuggcacaguuu

SEQ ID NO: 2240608 - RNA, 16 nt, Human
agccagcugccgacca

SEQ ID NO: 2240609 - RNA, 20 nt, Human
agccagcugccgaccagagc

SEQ ID NO: 2240610 - RNA, 16 nt, Human
agccagcugcucccca

SEQ ID NO: 2240611 - RNA, 14 nt, Human
agccagcuuucccu

SEQ ID NO: 2240612 - RNA, 13 nt, Human
agccagcuuuccc

SEQ ID NO: 2240613 - RNA, 21 nt, Human
agccagacagcaacggggagg

SEQ ID NO: 2240614 - RNA, 18 nt, Human
agccagaccuauuccucc

SEQ ID NO: 2240615 - RNA, 20 nt, Human
agccagaccuauuccuccug

SEQ ID NO: 2240616 - RNA, 20 nt, Human
agccagacacucugcucugc

SEQ ID NO: 2240617 - RNA, 19 nt, Human
agccagaccuauuccuccu

SEQ ID NO: 2240618 - RNA, 14 nt, Human
agccagacuggcac

SEQ ID NO: 2240619 - RNA, 15 nt, Human
agccagaagcugagc

SEQ ID NO: 2240620 - RNA, 14 nt, Human
agccagacacucug

SEQ ID NO: 2240621 - RNA, 20 nt, Human
agccagaagcugagcaccag

SEQ ID NO: 2240622 - RNA, 16 nt, Human
agccagacacucugcu

SEQ ID NO: 2240623 - RNA, 19 nt, Human
agccagacacucugcucug

SEQ ID NO: 2240624 - RNA, 22 nt, Human
agccagacacucugcucugccc

SEQ ID NO: 2240625 - RNA, 14 nt, Human
agccagaagcugag

SEQ ID NO: 2240626 - RNA, 12 nt, Human
agccagaagcug

SEQ ID NO: 2240627 - RNA, 21 nt, Human
agccagaacguggcucugcug

SEQ ID NO: 2240628 - RNA, 22 nt, Human
agccagaacguggcucugcugg

SEQ ID NO: 2240629 - RNA, 14 nt, Human
agccaugucugcau

SEQ ID NO: 2240630 - RNA, 22 nt, Human
agccauguagaagcugcaucuu

SEQ ID NO: 2240631 - RNA, 16 nt, Human
agccaucaaaaugcuu

SEQ ID NO: 2240632 - RNA, 15 nt, Human
agccaucaaaaugcu

SEQ ID NO: 2240633 - RNA, 14 nt, Human
agccaucaaaaugc

SEQ ID NO: 2240634 - RNA, 13 nt, Human
agccaucaaaaug

SEQ ID NO: 2240635 - RNA, 15 nt, Human
agccaugucugcauu

SEQ ID NO: 2240636 - RNA, 12 nt, Human
agcccagacaaa

SEQ ID NO: 2240637 - RNA, 11 nt, Human
agcccagagac

SEQ ID NO: 2240638 - RNA, 10 nt, Human
agcccagaga

SEQ ID NO: 2240639 - RNA, 22 nt, Human
agcccagagacauacuugaagg

SEQ ID NO: 2240640 - RNA, 15 nt, Human
agcccagacacagaa

SEQ ID NO: 2240641 - RNA, 21 nt, Human
agcccagagacauacuugaag

SEQ ID NO: 2240642 - RNA, 12 nt, Human
agcccagagaca

SEQ ID NO: 2240643 - RNA, 22 nt, Human
agcccacuucugccauauucug

SEQ ID NO: 2240644 - RNA, 17 nt, Human
agcccagaaaaggacag

SEQ ID NO: 2240645 - RNA, 23 nt, Human
agccaugugcugcgugccugugg

SEQ ID NO: 2240646 - RNA, 13 nt, Human
agcccagcccucc

SEQ ID NO: 2240647 - RNA, 12 nt, Human
agcccagcucca

SEQ ID NO: 2240648 - RNA, 16 nt, Human
agcccagcccagcugg

SEQ ID NO: 2240649 - RNA, 23 nt, Human
agcccagccauuaccauggagac

SEQ ID NO: 2240650 - RNA, 15 nt, Human
agcccagcccagcug

SEQ ID NO: 2240651 - RNA, 12 nt, Human
agcccagaggag

SEQ ID NO: 2240652 - RNA, 14 nt, Human
agcccagaggaggg

SEQ ID NO: 2240653 - RNA, 15 nt, Human
agcccagaggagggc

SEQ ID NO: 2240654 - RNA, 19 nt, Human
agcccaggaaaggcuccag

SEQ ID NO: 2240655 - RNA, 16 nt, Human
agcccagcugggucag

SEQ ID NO: 2240656 - RNA, 15 nt, Human
agcccagcuggguca

SEQ ID NO: 2240657 - RNA, 13 nt, Human
agcccagcugggu

SEQ ID NO: 2240658 - RNA, 14 nt, Human
agcccagcucugaa

SEQ ID NO: 2240659 - RNA, 20 nt, Human
agcccaggaaaggcuccagg

SEQ ID NO: 2240660 - RNA, 21 nt, Human
agcccaggaaaggcuccagga

SEQ ID NO: 2240661 - RNA, 19 nt, Human
ugauuccuuccuguucuga

SEQ ID NO: 2240662 - RNA, 18 nt, Human
ugauuccuuccuguucug

SEQ ID NO: 2240663 - RNA, 15 nt, Human
ugauuccacuuuuau

SEQ ID NO: 2240664 - RNA, 20 nt, Human
ugauuccuuccuguucugaa

SEQ ID NO: 2240665 - RNA, 22 nt, Human
ugauuccuugauggagauauuu

SEQ ID NO: 2240666 - RNA, 17 nt, Human
ugauuccuuugaagagg

SEQ ID NO: 2240667 - RNA, 20 nt, Human
ugauuccuuugaagaggaaa

SEQ ID NO: 2240668 - RNA, 21 nt, Human
ugauuccuuugaagaggaaaa

SEQ ID NO: 2240669 - RNA, 19 nt, Human
ugauucccaagcucugcuc

SEQ ID NO: 2240670 - RNA, 21 nt, Human
ugauucccaagcucugcuccu

SEQ ID NO: 2240671 - RNA, 17 nt, Human
ugauucauaauaaauau

SEQ ID NO: 2240672 - RNA, 19 nt, Human
ugauuccacuacaccuggc

SEQ ID NO: 2240673 - RNA, 22 nt, Human
ugauucauuuuaacaucugaga

SEQ ID NO: 2240674 - RNA, 20 nt, Human
ugauuccacuacaccuggcu

SEQ ID NO: 2240675 - RNA, 21 nt, Human
ugauuccacuacaccuggcug

SEQ ID NO: 2240676 - RNA, 22 nt, Human
ugauuccacuacaccuggcuga

SEQ ID NO: 2240677 - RNA, 23 nt, Human
ugauuccacuacaccuggcugag

SEQ ID NO: 2240678 - RNA, 15 nt, Human
ugauucccaagcucu

SEQ ID NO: 2240679 - RNA, 16 nt, Human
ugauucccaagcucug

SEQ ID NO: 2240680 - RNA, 18 nt, Human
ugauucccaagcucugcu

SEQ ID NO: 2240681 - RNA, 13 nt, Human
agcccaggagaga

SEQ ID NO: 2240682 - RNA, 14 nt, Human
agcccaggagagag

SEQ ID NO: 2240683 - RNA, 15 nt, Human
agcccaggagagaga

SEQ ID NO: 2240684 - RNA, 18 nt, Human
agcccaggaaaggcucca

SEQ ID NO: 2240685 - RNA, 24 nt, Human
agcccaggaaaggcuccaggagca

SEQ ID NO: 2240686 - RNA, 22 nt, Human
agcccaggaaaggcuccaggag

SEQ ID NO: 2240687 - RNA, 23 nt, Human
agcccaggaaaggcuccaggagc

SEQ ID NO: 2240688 - RNA, 14 nt, Human
ugauucagcucugc

SEQ ID NO: 2240689 - RNA, 13 nt, Human
ugauucagcucug

SEQ ID NO: 2240690 - RNA, 15 nt, Human
ugauucauaaugacu

SEQ ID NO: 2240691 - RNA, 17 nt, Human
ugauucauuuuaacauc

SEQ ID NO: 2240692 - RNA, 24 nt, Human
ugauucaguguuaaaugugaugaa

SEQ ID NO: 2240693 - RNA, 20 nt, Human
ugauucauuuuaacaucuga

SEQ ID NO: 2240694 - RNA, 21 nt, Human
ugauucaguguuaaaugugau

SEQ ID NO: 2240695 - RNA, 12 nt, Human
ugauucaguguu

SEQ ID NO: 2240696 - RNA, 16 nt, Human
agcccaggagagagaa

SEQ ID NO: 2240697 - RNA, 17 nt, Human
agcccaggagagagaaa

SEQ ID NO: 2240698 - RNA, 20 nt, Human
ugaguggacuggaguggagc

SEQ ID NO: 2240699 - RNA, 21 nt, Human
ugagugggguuaucucugugu

SEQ ID NO: 2240700 - RNA, 14 nt, Human
ugaguguaagugug

SEQ ID NO: 2240701 - RNA, 22 nt, Human
ugagugggguuaucucuguguu

SEQ ID NO: 2240702 - RNA, 11 nt, Human
ugaguguacca

SEQ ID NO: 2240703 - RNA, 15 nt, Human
ugaguguaaguguga

SEQ ID NO: 2240704 - RNA, 18 nt, Human
ugagugucuuaauuaaaa

SEQ ID NO: 2240705 - RNA, 15 nt, Human
ugaguucagguagcu

SEQ ID NO: 2240706 - RNA, 14 nt, Human
ugaguuauuuuaau

SEQ ID NO: 2240707 - RNA, 18 nt, Human
ugaguucauaaauuuaug

SEQ ID NO: 2240708 - RNA, 20 nt, Human
ugaguuauauguucacuguc

SEQ ID NO: 2240709 - RNA, 21 nt, Human
ugagugggugaauaauacagu

SEQ ID NO: 2240710 - RNA, 23 nt, Human
ugagugggggaucacagccucug

SEQ ID NO: 2240711 - RNA, 19 nt, Human
ugagugcucugaucccucu

SEQ ID NO: 2240712 - RNA, 13 nt, Human
ugaguggacugga

SEQ ID NO: 2240713 - RNA, 13 nt, Human
ugagugcucugau

SEQ ID NO: 2240714 - RNA, 12 nt, Human
ugagugcucuga

SEQ ID NO: 2240715 - RNA, 18 nt, Human
ugagucaaugugcagugu

SEQ ID NO: 2240716 - RNA, 15 nt, Human
ugagucaaugugcag

SEQ ID NO: 2240717 - RNA, 15 nt, Human
ugagucaaaaaaucu

SEQ ID NO: 2240718 - RNA, 13 nt, Human
ugagucaaugugc

SEQ ID NO: 2240719 - RNA, 14 nt, Human
ugagucaccaagcc

SEQ ID NO: 2240720 - RNA, 21 nt, Human
ugaguaucuccucgcaagcug

SEQ ID NO: 2240721 - RNA, 15 nt, Human
ugaguaucuccucgc

SEQ ID NO: 2240722 - RNA, 21 nt, Human
ugaguauccuuucaguguuau

SEQ ID NO: 2240723 - RNA, 16 nt, Human
ugagucaccaagccca

SEQ ID NO: 2240724 - RNA, 17 nt, Human
ugagucaccaagcccag

SEQ ID NO: 2240725 - RNA, 17 nt, Human
ugagugccuuacacaau

SEQ ID NO: 2240726 - RNA, 20 nt, Human
ugagugccuuacacaauggu

SEQ ID NO: 2240727 - RNA, 23 nt, Human
ugauacacuaugaagauguuuca

SEQ ID NO: 2240728 - RNA, 17 nt, Human
ugauacuaaaaguucuu

SEQ ID NO: 2240729 - RNA, 19 nt, Human
ugauacgcaacauaauuaa

SEQ ID NO: 2240730 - RNA, 17 nt, Human
ugauacuacaguuuguu

SEQ ID NO: 2240731 - RNA, 14 nt, Human
ugauacuacaguuu

SEQ ID NO: 2240732 - RNA, 21 nt, Human
ugauacaaugcugugcccuaa

SEQ ID NO: 2240733 - RNA, 20 nt, Human
ugauacaaugcugugcccua

SEQ ID NO: 2240734 - RNA, 14 nt, Human
ugauaauugcauuc

SEQ ID NO: 2240735 - RNA, 16 nt, Human
ugauaauugcauucau

SEQ ID NO: 2240736 - RNA, 19 nt, Human
ugauaauugcauucaucuu

SEQ ID NO: 2240737 - RNA, 18 nt, Human
ugauacaaugcugugccc

SEQ ID NO: 2240738 - RNA, 16 nt, Human
ugaguucagguagcug

SEQ ID NO: 2240739 - RNA, 17 nt, Human
ugaguuauuuuaauuau

SEQ ID NO: 2240740 - RNA, 17 nt, Human
ugauaagagaaucaaca

SEQ ID NO: 2240741 - RNA, 18 nt, Human
ugauaagagaaucaacau

SEQ ID NO: 2240742 - RNA, 24 nt, Human
ugauaagcagucauccucagauca

SEQ ID NO: 2240743 - RNA, 19 nt, Human
ugauaagagggcacacacu

SEQ ID NO: 2240744 - RNA, 21 nt, Human
ugauaagagggcacacacugu

SEQ ID NO: 2240745 - RNA, 17 nt, Human
ugaguucauacccuguu

SEQ ID NO: 2240746 - RNA, 20 nt, Human
ugauaagaaccuuuugagug

SEQ ID NO: 2240747 - RNA, 15 nt, Human
ugauaauuccagugg

SEQ ID NO: 2240748 - RNA, 17 nt, Human
ugauaauuccagugguc

SEQ ID NO: 2240749 - RNA, 21 nt, Human
ugauaauguuaaauuuguaag

SEQ ID NO: 2240750 - RNA, 22 nt, Human
ugauaauguuaaauuuguaagu

SEQ ID NO: 2240751 - RNA, 15 nt, Human
ugauaauguuaaauu

SEQ ID NO: 2240752 - RNA, 16 nt, Human
ugauaauguuaaauuu

SEQ ID NO: 2240753 - RNA, 17 nt, Human
ugauaauguuaaauuug

SEQ ID NO: 2240754 - RNA, 18 nt, Human
ugauaauguuaaauuugu

SEQ ID NO: 2240755 - RNA, 13 nt, Human
ugauaauguuaaa

SEQ ID NO: 2240756 - RNA, 14 nt, Human
ugauaauguuaaau

SEQ ID NO: 2240757 - RNA, 20 nt, Human
ugauaaggaucagaacagca

SEQ ID NO: 2240758 - RNA, 16 nt, Human
ugauaaggaucagaac

SEQ ID NO: 2240759 - RNA, 12 nt, Human
ugauaaguaaau

SEQ ID NO: 2240760 - RNA, 14 nt, Human
ugauaaucaacugg

SEQ ID NO: 2240761 - RNA, 24 nt, Human
ugauaaucaacugggcugaacacu

SEQ ID NO: 2240762 - RNA, 18 nt, Human
ugauaaucaacugggcug

SEQ ID NO: 2240763 - RNA, 13 nt, Human
agcauaaaugcaa

SEQ ID NO: 2240764 - RNA, 14 nt, Human
agcauaaaugcaaa

SEQ ID NO: 2240765 - RNA, 20 nt, Human
agcauaacaagguccaagau

SEQ ID NO: 2240766 - RNA, 17 nt, Human
agcauaaguuucuggga

SEQ ID NO: 2240767 - RNA, 23 nt, Human
agcauaaguuucugggaccucag

SEQ ID NO: 2240768 - RNA, 23 nt, Human
agcauaaauguugacaugggaca

SEQ ID NO: 2240769 - RNA, 21 nt, Human
agcauaauacuugcuuuggaa

SEQ ID NO: 2240770 - RNA, 15 nt, Human
agcauacguacacau

SEQ ID NO: 2240771 - RNA, 23 nt, Human
ugagaauuuuaaauuauaacuua

SEQ ID NO: 2240772 - RNA, 15 nt, Human
ugagaauuuuaaauu

SEQ ID NO: 2240773 - RNA, 13 nt, Human
ugagaauuuuaaa

SEQ ID NO: 2240774 - RNA, 20 nt, Human
ugagaauugugcucaaaauu

SEQ ID NO: 2240775 - RNA, 18 nt, Human
ugagacaaauggaggccu

SEQ ID NO: 2240776 - RNA, 20 nt, Human
ugagaaucagaucauuucaa

SEQ ID NO: 2240777 - RNA, 16 nt, Human
ugagaauuccaaggag

SEQ ID NO: 2240778 - RNA, 15 nt, Human
ugagaauuccaagga

SEQ ID NO: 2240779 - RNA, 20 nt, Human
ugagaauuugagugcucuga

SEQ ID NO: 2240780 - RNA, 19 nt, Human
ugagaauuuaaaaauaaga

SEQ ID NO: 2240781 - RNA, 12 nt, Human
ugagaauuaccc

SEQ ID NO: 2240782 - RNA, 21 nt, Human
agcauacguacacauuuuauu

SEQ ID NO: 2240783 - RNA, 20 nt, Human
agcauacguacacauuuuau

SEQ ID NO: 2240784 - RNA, 16 nt, Human
agcauaccuuuauugu

SEQ ID NO: 2240785 - RNA, 17 nt, Human
agcauaccuuuauugug

SEQ ID NO: 2240786 - RNA, 19 nt, Human
agcauaccuuuauugugau

SEQ ID NO: 2240787 - RNA, 17 nt, Human
agcauaucugccuuuau

SEQ ID NO: 2240788 - RNA, 20 nt, Human
agcauaucugccuuuauugu

SEQ ID NO: 2240789 - RNA, 22 nt, Human
agcauaucugccuuuauugugu

SEQ ID NO: 2240790 - RNA, 23 nt, Human
agcauaucugccuuuauuguguu

SEQ ID NO: 2240791 - RNA, 19 nt, Human
agcauacguacacauuuua

SEQ ID NO: 2240792 - RNA, 18 nt, Human
agcauacguacacauuuu

SEQ ID NO: 2240793 - RNA, 17 nt, Human
agcauacguacacauuu

SEQ ID NO: 2240794 - RNA, 16 nt, Human
agcauacguacacauu

SEQ ID NO: 2240795 - RNA, 17 nt, Human
ugaguaagaaaugcugc

SEQ ID NO: 2240796 - RNA, 15 nt, Human
ugaguacuacagucc

SEQ ID NO: 2240797 - RNA, 22 nt, Human
ugaguaacugauuuguaacaag

SEQ ID NO: 2240798 - RNA, 21 nt, Human
ugaguaaaggaguaagaaccu

SEQ ID NO: 2240799 - RNA, 15 nt, Human
ugagguuuuuaagcc

SEQ ID NO: 2240800 - RNA, 14 nt, Human
agcauauucaggaa

SEQ ID NO: 2240801 - RNA, 23 nt, Human
agcauaugaggaugcagagucag

SEQ ID NO: 2240802 - RNA, 16 nt, Human
agcauaugaggaugca

SEQ ID NO: 2240803 - RNA, 16 nt, Human
agcauaugaguuucau

SEQ ID NO: 2240804 - RNA, 20 nt, Human
agcauaugaguuucauagcu

SEQ ID NO: 2240805 - RNA, 21 nt, Human
agcauaugaguuucauagcua

SEQ ID NO: 2240806 - RNA, 16 nt, Human
agcauauguguuggcu

SEQ ID NO: 2240807 - RNA, 18 nt, Human
agcauauguguuggcuug

SEQ ID NO: 2240808 - RNA, 12 nt, Human
agcauaugagga

SEQ ID NO: 2240809 - RNA, 16 nt, Human
agcauaucugccuuua

SEQ ID NO: 2240810 - RNA, 13 nt, Human
ugaguagcuggau

SEQ ID NO: 2240811 - RNA, 13 nt, Human
ugaguagcuggga

SEQ ID NO: 2240812 - RNA, 13 nt, Human
ugaguaagagcug

SEQ ID NO: 2240813 - RNA, 17 nt, Human
ugaguagaaaggccuuu

SEQ ID NO: 2240814 - RNA, 19 nt, Human
ugaguaagaaaugcugccc

SEQ ID NO: 2240815 - RNA, 14 nt, Human
ugaguagaggcuua

SEQ ID NO: 2240816 - RNA, 18 nt, Human
ugaguagaaaggccuuua

SEQ ID NO: 2240817 - RNA, 23 nt, Human
ugaguagaaaggccuuuaaaauu

SEQ ID NO: 2240818 - RNA, 17 nt, Human
ugaguacuacaguccuc

SEQ ID NO: 2240819 - RNA, 21 nt, Human
ugaguacuacaguccucccau

SEQ ID NO: 2240820 - RNA, 22 nt, Human
ugaguacuacaguccucccauc

SEQ ID NO: 2240821 - RNA, 23 nt, Human
ugaguacuacaguccucccaucu

SEQ ID NO: 2240822 - RNA, 17 nt, Human
agcauugcuuucugaaa

SEQ ID NO: 2240823 - RNA, 16 nt, Human
agcauugcuuucugaa

SEQ ID NO: 2240824 - RNA, 15 nt, Human
agcauugcuuucuga

SEQ ID NO: 2240825 - RNA, 14 nt, Human
agcauugcuuucug

SEQ ID NO: 2240826 - RNA, 13 nt, Human
agcauugcuuucu

SEQ ID NO: 2240827 - RNA, 12 nt, Human
agcauugcuuuc

SEQ ID NO: 2240828 - RNA, 11 nt, Human
agcauugcuuu

SEQ ID NO: 2240829 - RNA, 18 nt, Human
agcauuguaaaugugcuu

SEQ ID NO: 2240830 - RNA, 17 nt, Human
agcauuguaaaugugcu

SEQ ID NO: 2240831 - RNA, 20 nt, Human
agcauuucgcgauggacaga

SEQ ID NO: 2240832 - RNA, 23 nt, Human
agcauuuccaacaccacagacac

SEQ ID NO: 2240833 - RNA, 20 nt, Human
agcauuucauucuucucuag

SEQ ID NO: 2240834 - RNA, 21 nt, Human
agcauuucauucuucucuagc

SEQ ID NO: 2240835 - RNA, 14 nt, Human
agcauuuccaacac

SEQ ID NO: 2240836 - RNA, 17 nt, Human
agcauuuccaacaccac

SEQ ID NO: 2240837 - RNA, 18 nt, Human
agcauuuccaacaccaca

SEQ ID NO: 2240838 - RNA, 19 nt, Human
agcauuuccaacaccacag

SEQ ID NO: 2240839 - RNA, 21 nt, Human
agcauuuccaacaccacagac

SEQ ID NO: 2240840 - RNA, 22 nt, Human
agcauuuccaacaccacagaca

SEQ ID NO: 2240841 - RNA, 15 nt, Human
agcauuguuugcuua

SEQ ID NO: 2240842 - RNA, 17 nt, Human
agcauuguuugcuuauu

SEQ ID NO: 2240843 - RNA, 13 nt, Human
agcauuucauucu

SEQ ID NO: 2240844 - RNA, 21 nt, Human
agcauuguggcugucagcagg

SEQ ID NO: 2240845 - RNA, 20 nt, Human
agcauuguggcugucagcag

SEQ ID NO: 2240846 - RNA, 17 nt, Human
agcauugugaacugaca

SEQ ID NO: 2240847 - RNA, 21 nt, Human
agcauugugaacugacaggca

SEQ ID NO: 2240848 - RNA, 15 nt, Human
agcauuacaaauugc

SEQ ID NO: 2240849 - RNA, 13 nt, Human
agcauugcaugga

SEQ ID NO: 2240850 - RNA, 13 nt, Human
agcauugccauuc

SEQ ID NO: 2240851 - RNA, 14 nt, Human
agcauugcugguuc

SEQ ID NO: 2240852 - RNA, 14 nt, Human
agcauugccauucc

SEQ ID NO: 2240853 - RNA, 22 nt, Human
agcauugccauucccugccugg

SEQ ID NO: 2240854 - RNA, 15 nt, Human
agcauugcugguucu

SEQ ID NO: 2240855 - RNA, 16 nt, Human
agcauugcugguucua

SEQ ID NO: 2240856 - RNA, 23 nt, Human
agcauugcugguucuauuuaaug

SEQ ID NO: 2240857 - RNA, 18 nt, Human
agcauuaacuaaucuauu

SEQ ID NO: 2240858 - RNA, 17 nt, Human
agcauuaacuucucugg

SEQ ID NO: 2240859 - RNA, 18 nt, Human
agcauuaacuucucugga

SEQ ID NO: 2240860 - RNA, 17 nt, Human
agcauuaagaacacuuu

SEQ ID NO: 2240861 - RNA, 14 nt, Human
agcauuaacuaauc

SEQ ID NO: 2240862 - RNA, 20 nt, Human
agcauguuugcugaacaccu

SEQ ID NO: 2240863 - RNA, 16 nt, Human
agcauguuugcugaac

SEQ ID NO: 2240864 - RNA, 17 nt, Human
agcauguuugcugaaca

SEQ ID NO: 2240865 - RNA, 18 nt, Human
agcauguuucauguuuug

SEQ ID NO: 2240866 - RNA, 21 nt, Human
agcauguuucauguuuuguga

SEQ ID NO: 2240867 - RNA, 14 nt, Human
agcauguuugcuga

SEQ ID NO: 2240868 - RNA, 15 nt, Human
agcauguuugcugaa

SEQ ID NO: 2240869 - RNA, 21 nt, Human
agcauguugagccaggccugg

SEQ ID NO: 2240870 - RNA, 20 nt, Human
agcauguugagccaggccug

SEQ ID NO: 2240871 - RNA, 19 nt, Human
agcauguugagccaggccu

SEQ ID NO: 2240872 - RNA, 22 nt, Human
agcauguguuugguucuggggc

SEQ ID NO: 2240873 - RNA, 17 nt, Human
agcauguugcugaggag

SEQ ID NO: 2240874 - RNA, 18 nt, Human
agcauguugcugaggagu

SEQ ID NO: 2240875 - RNA, 14 nt, Human
agcauguuucaugu

SEQ ID NO: 2240876 - RNA, 17 nt, Human
agcauguuucauguuuu

SEQ ID NO: 2240877 - RNA, 16 nt, Human
agcauguguugaaaaa

SEQ ID NO: 2240878 - RNA, 18 nt, Human
agcauguggcauguucau

SEQ ID NO: 2240879 - RNA, 16 nt, Human
agcauguugagccagg

SEQ ID NO: 2240880 - RNA, 19 nt, Human
agcauguguauuuccagug

SEQ ID NO: 2240881 - RNA, 17 nt, Human
agcauguggcauguuca

SEQ ID NO: 2240882 - RNA, 22 nt, Human
agcauguauugugucuuuugca

SEQ ID NO: 2240883 - RNA, 19 nt, Human
agcaugucuauucagcuuc

SEQ ID NO: 2240884 - RNA, 17 nt, Human
agcaugucuauucagcu

SEQ ID NO: 2240885 - RNA, 14 nt, Human
agcauguauugugu

SEQ ID NO: 2240886 - RNA, 16 nt, Human
agcauguauugugucu

SEQ ID NO: 2240887 - RNA, 23 nt, Human
agcauguauugugucuuuugcau

SEQ ID NO: 2240888 - RNA, 15 nt, Human
agcauguaggagaau

SEQ ID NO: 2240889 - RNA, 21 nt, Human
agcauguacugagccuuguaa

SEQ ID NO: 2240890 - RNA, 19 nt, Human
agcauguacaguguucugu

SEQ ID NO: 2240891 - RNA, 18 nt, Human
agcauggcucaaagugca

SEQ ID NO: 2240892 - RNA, 12 nt, Human
agcauggcugcc

SEQ ID NO: 2240893 - RNA, 20 nt, Human
agcaugucgucaaagcugaa

SEQ ID NO: 2240894 - RNA, 17 nt, Human
agcaugucgucaaagcu

SEQ ID NO: 2240895 - RNA, 14 nt, Human
agcaucaggccagg

SEQ ID NO: 2240896 - RNA, 16 nt, Human
agcaucaggccaggcc

SEQ ID NO: 2240897 - RNA, 17 nt, Human
agcaucaggccaggccc

SEQ ID NO: 2240898 - RNA, 18 nt, Human
agcaucaggccaggcccu

SEQ ID NO: 2240899 - RNA, 19 nt, Human
agcaucaggccaggcccuc

SEQ ID NO: 2240900 - RNA, 20 nt, Human
agcaucaggccaggcccucu

SEQ ID NO: 2240901 - RNA, 18 nt, Human
ugaucaaagccacacucu

SEQ ID NO: 2240902 - RNA, 20 nt, Human
ugauauuuucugugccugaa

SEQ ID NO: 2240903 - RNA, 17 nt, Human
ugauauuuucugugccu

SEQ ID NO: 2240904 - RNA, 19 nt, Human
ugauauuuuaccucuuauu

SEQ ID NO: 2240905 - RNA, 16 nt, Human
ugaucaaauucauuuu

SEQ ID NO: 2240906 - RNA, 17 nt, Human
ugaucaaauucauuuuu

SEQ ID NO: 2240907 - RNA, 22 nt, Human
ugaucaaauucauuuuuuucac

SEQ ID NO: 2240908 - RNA, 15 nt, Human
ugaucaaauucauuu

SEQ ID NO: 2240909 - RNA, 20 nt, Human
ugaucaaaguccgaggggcg

SEQ ID NO: 2240910 - RNA, 16 nt, Human
ugaucaauaaaaugug

SEQ ID NO: 2240911 - RNA, 15 nt, Human
ugaucaauaaaaugu

SEQ ID NO: 2240912 - RNA, 13 nt, Human
ugaucaauaaaau

SEQ ID NO: 2240913 - RNA, 22 nt, Human
ugaucaagggaauguaacugcu

SEQ ID NO: 2240914 - RNA, 19 nt, Human
ugaucacggcucacugcag

SEQ ID NO: 2240915 - RNA, 23 nt, Human
ugaucaacaucuuuucuugccuc

SEQ ID NO: 2240916 - RNA, 23 nt, Human
ugaucaaauucauuuuuuucacu

SEQ ID NO: 2240917 - RNA, 20 nt, Human
ugaucaagggaauguaacug

SEQ ID NO: 2240918 - RNA, 17 nt, Human
ugaucaagggaauguaa

SEQ ID NO: 2240919 - RNA, 14 nt, Human
ugaucaacaucuuu

SEQ ID NO: 2240920 - RNA, 17 nt, Human
ugaucaacaucuuuucu

SEQ ID NO: 2240921 - RNA, 18 nt, Human
ugaucaacaucuuuucuu

SEQ ID NO: 2240922 - RNA, 21 nt, Human
ugaucaacaucuuuucuugcc

SEQ ID NO: 2240923 - RNA, 14 nt, Human
agcaucaaacucuu

SEQ ID NO: 2240924 - RNA, 13 nt, Human
agcaucaaacucu

SEQ ID NO: 2240925 - RNA, 21 nt, Human
agcauauuuguauaguugcuu

SEQ ID NO: 2240926 - RNA, 22 nt, Human
agcauauuuguauaguugcuug

SEQ ID NO: 2240927 - RNA, 18 nt, Human
ugaucaauaaaaugugau

SEQ ID NO: 2240928 - RNA, 18 nt, Human
agcauauuuguauaguug

SEQ ID NO: 2240929 - RNA, 20 nt, Human
agcauauuuguauaguugcu

SEQ ID NO: 2240930 - RNA, 22 nt, Human
agcauauucaggaagcucaggg

SEQ ID NO: 2240931 - RNA, 20 nt, Human
ugaucacggcucacugcagc

SEQ ID NO: 2240932 - RNA, 21 nt, Human
ugaucacggcucacugcagcc

SEQ ID NO: 2240933 - RNA, 17 nt, Human
agcaucacaguuuuggu

SEQ ID NO: 2240934 - RNA, 15 nt, Human
agcaucacaguuuug

SEQ ID NO: 2240935 - RNA, 13 nt, Human
agcaucaggccag

SEQ ID NO: 2240936 - RNA, 12 nt, Human
agcaucaggcca

SEQ ID NO: 2240937 - RNA, 23 nt, Human
ugauauuucccuccccuggggac

SEQ ID NO: 2240938 - RNA, 19 nt, Human
ugauauuuccccaugguuu

SEQ ID NO: 2240939 - RNA, 19 nt, Human
ugauauuuucaacgcagcc

SEQ ID NO: 2240940 - RNA, 21 nt, Human
ugauauuuucaacgcagcccu

SEQ ID NO: 2240941 - RNA, 22 nt, Human
ugauauuuucaacgcagcccug

SEQ ID NO: 2240942 - RNA, 23 nt, Human
ugauauuuucaacgcagcccugc

SEQ ID NO: 2240943 - RNA, 21 nt, Human
ugauauguaaacauaauucuu

SEQ ID NO: 2240944 - RNA, 13 nt, Human
ugauauuaaagga

SEQ ID NO: 2240945 - RNA, 20 nt, Human
ugauauucaaauggacaaac

SEQ ID NO: 2240946 - RNA, 16 nt, Human
ugauauuaaaggaguu

SEQ ID NO: 2240947 - RNA, 23 nt, Human
ugauauuaaaggaguuaagagua

SEQ ID NO: 2240948 - RNA, 22 nt, Human
ugauauuccaugaauguaucag

SEQ ID NO: 2240949 - RNA, 20 nt, Human
ugauauuccaugaauguauc

SEQ ID NO: 2240950 - RNA, 19 nt, Human
ugauauuccaugaauguau

SEQ ID NO: 2240951 - RNA, 18 nt, Human
ugauauuccaugaaugua

SEQ ID NO: 2240952 - RNA, 16 nt, Human
ugauauuccaugaaug

SEQ ID NO: 2240953 - RNA, 21 nt, Human
ugauauuccccccacuuaaga

SEQ ID NO: 2240954 - RNA, 17 nt, Human
ugauauugcauaugcau

SEQ ID NO: 2240955 - RNA, 19 nt, Human
ugauauguugguagauucu

SEQ ID NO: 2240956 - RNA, 15 nt, Human
ugauauguaaacaua

SEQ ID NO: 2240957 - RNA, 19 nt, Human
ugauauggcagaagacacc

SEQ ID NO: 2240958 - RNA, 20 nt, Human
ugauauggcagaagacacca

SEQ ID NO: 2240959 - RNA, 17 nt, Human
ugauauggcagaagaca

SEQ ID NO: 2240960 - RNA, 18 nt, Human
ugauauggcagaagacac

SEQ ID NO: 2240961 - RNA, 12 nt, Human
ugauaugggucu

SEQ ID NO: 2240962 - RNA, 15 nt, Human
ugauacuuuugacaa

SEQ ID NO: 2240963 - RNA, 15 nt, Human
ugauacuuuuaagag

SEQ ID NO: 2240964 - RNA, 21 nt, Human
ugauacuuuugacaacaaauu

SEQ ID NO: 2240965 - RNA, 21 nt, Human
ugauagaaggcuauggggaua

SEQ ID NO: 2240966 - RNA, 17 nt, Human
ugaccuucuaggaagcu

SEQ ID NO: 2240967 - RNA, 14 nt, Human
ugaccuucugggaa

SEQ ID NO: 2240968 - RNA, 13 nt, Human
ugaccuucuggga

SEQ ID NO: 2240969 - RNA, 20 nt, Human
ugaccuugaacuccugggcu

SEQ ID NO: 2240970 - RNA, 19 nt, Human
ugaccuugaacuccugggc

SEQ ID NO: 2240971 - RNA, 18 nt, Human
ugaccuugaacuccuggg

SEQ ID NO: 2240972 - RNA, 17 nt, Human
ugaccuugaacuccugg

SEQ ID NO: 2240973 - RNA, 22 nt, Human
ugaccuugaggagucuugugug

SEQ ID NO: 2240974 - RNA, 21 nt, Human
ugacuagaagggccaguccug

SEQ ID NO: 2240975 - RNA, 20 nt, Human
ugaccuugaggagucuugug

SEQ ID NO: 2240976 - RNA, 21 nt, Human
ugaccuugaggagucuugugu

SEQ ID NO: 2240977 - RNA, 19 nt, Human
ugacuagggauucaggcug

SEQ ID NO: 2240978 - RNA, 18 nt, Human
ugacuagggauucaggcu

SEQ ID NO: 2240979 - RNA, 17 nt, Human
ugacuagggauucaggc

SEQ ID NO: 2240980 - RNA, 21 nt, Human
ugacuagaggcagggagggga

SEQ ID NO: 2240981 - RNA, 17 nt, Human
ugacuagaggcagggag

SEQ ID NO: 2240982 - RNA, 23 nt, Human
ugacuagaugauggaugccaaua

SEQ ID NO: 2240983 - RNA, 17 nt, Human
ugacuagggaaaugauc

SEQ ID NO: 2240984 - RNA, 20 nt, Human
ugacucaagugucucagucc

SEQ ID NO: 2240985 - RNA, 19 nt, Human
ugacucacaagaagaccag

SEQ ID NO: 2240986 - RNA, 23 nt, Human
ugacucaacauguuacugaccag

SEQ ID NO: 2240987 - RNA, 23 nt, Human
ugacuagggauucaggcugcuug

SEQ ID NO: 2240988 - RNA, 21 nt, Human
ugacuagggauucaggcugcu

SEQ ID NO: 2240989 - RNA, 20 nt, Human
ugacuagggauucaggcugc

SEQ ID NO: 2240990 - RNA, 22 nt, Human
ugacucaacauguuacugacca

SEQ ID NO: 2240991 - RNA, 15 nt, Human
ugacucaacauguua

SEQ ID NO: 2240992 - RNA, 14 nt, Human
ugacucaacauguu

SEQ ID NO: 2240993 - RNA, 16 nt, Human
ugacucaaaucuccag

SEQ ID NO: 2240994 - RNA, 19 nt, Human
ugacuagugaggaaagauu

SEQ ID NO: 2240995 - RNA, 13 nt, Human
ugacucacccaag

SEQ ID NO: 2240996 - RNA, 12 nt, Human
ugacucacccaa

SEQ ID NO: 2240997 - RNA, 11 nt, Human
ugacucaccca

SEQ ID NO: 2240998 - RNA, 20 nt, Human
ugacucacaagaagaccaga

SEQ ID NO: 2240999 - RNA, 15 nt, Human
ugacucacccaagca

SEQ ID NO: 2241000 - RNA, 14 nt, Human
ugacucacccaagc

SEQ ID NO: 2241001 - RNA, 18 nt, Human
ugacuccaggagaggagc

SEQ ID NO: 2241002 - RNA, 23 nt, Human
ugacuccaguggggcaagauuuu

SEQ ID NO: 2241003 - RNA, 21 nt, Human
ugacucgaggguuggguucau

SEQ ID NO: 2241004 - RNA, 15 nt, Human
ugacucgggcuccug

SEQ ID NO: 2241005 - RNA, 16 nt, Human
ugacucgggcuccugu

SEQ ID NO: 2241006 - RNA, 22 nt, Human
ugacuccuuagagacaucaaaa

SEQ ID NO: 2241007 - RNA, 20 nt, Human
ugacuccuaugaucucaggu

SEQ ID NO: 2241008 - RNA, 14 nt, Human
ugacuccuuguggu

SEQ ID NO: 2241009 - RNA, 21 nt, Human
ugacuccuugugguuuauguc

SEQ ID NO: 2241010 - RNA, 22 nt, Human
ugacucccuuaaaauagaaaua

SEQ ID NO: 2241011 - RNA, 16 nt, Human
ugacuccgcuggaggu

SEQ ID NO: 2241012 - RNA, 21 nt, Human
ugacuccgcuggagguggggc

SEQ ID NO: 2241013 - RNA, 17 nt, Human
ugacuccucuaagccac

SEQ ID NO: 2241014 - RNA, 16 nt, Human
ugacuuacuguacaug

SEQ ID NO: 2241015 - RNA, 15 nt, Human
ugacuuacuguacau

SEQ ID NO: 2241016 - RNA, 13 nt, Human
ugacuuacuguac

SEQ ID NO: 2241017 - RNA, 16 nt, Human
ugacucgggggugggg

SEQ ID NO: 2241018 - RNA, 17 nt, Human
ugacucgggggugggga

SEQ ID NO: 2241019 - RNA, 17 nt, Human
ugacucgggcuccugug

SEQ ID NO: 2241020 - RNA, 18 nt, Human
ugacucgggcuccugugc

SEQ ID NO: 2241021 - RNA, 19 nt, Human
ugacucgggcuccugugcc

SEQ ID NO: 2241022 - RNA, 20 nt, Human
ugacucgggcuccugugccc

SEQ ID NO: 2241023 - RNA, 20 nt, Human
ugaccugcaggccaagagca

SEQ ID NO: 2241024 - RNA, 11 nt, Human
ugaccugcagg

SEQ ID NO: 2241025 - RNA, 17 nt, Human
ugaccugaggcuguggu

SEQ ID NO: 2241026 - RNA, 20 nt, Human
ugaccugaggcuccugugcu

SEQ ID NO: 2241027 - RNA, 12 nt, Human
ugaccugagggc

SEQ ID NO: 2241028 - RNA, 12 nt, Human
ugaccugaggcu

SEQ ID NO: 2241029 - RNA, 18 nt, Human
ugaccugaggcuccugug

SEQ ID NO: 2241030 - RNA, 15 nt, Human
ugaccugaggcugug

SEQ ID NO: 2241031 - RNA, 15 nt, Human
ugaccugugucacua

SEQ ID NO: 2241032 - RNA, 14 nt, Human
ugaccugugucacu

SEQ ID NO: 2241033 - RNA, 14 nt, Human
ugaccuguggugca

SEQ ID NO: 2241034 - RNA, 23 nt, Human
ugaccuguggggauuucucccag

SEQ ID NO: 2241035 - RNA, 22 nt, Human
ugaccuguggggauuucuccca

SEQ ID NO: 2241036 - RNA, 21 nt, Human
ugaccuguggggauuucuccc

SEQ ID NO: 2241037 - RNA, 19 nt, Human
ugaccuguggggauuucuc

SEQ ID NO: 2241038 - RNA, 15 nt, Human
ugaccugugaccagc

SEQ ID NO: 2241039 - RNA, 13 nt, Human
ugaccugugacca

SEQ ID NO: 2241040 - RNA, 20 nt, Human
ugaccugucaugccccccuc

SEQ ID NO: 2241041 - RNA, 21 nt, Human
ugaccugucaugccccccuca

SEQ ID NO: 2241042 - RNA, 22 nt, Human
ugaccugugaccagcacugucu

SEQ ID NO: 2241043 - RNA, 18 nt, Human
ugaccugugaccagcacu

SEQ ID NO: 2241044 - RNA, 20 nt, Human
ugaccugugagcccagcugg

SEQ ID NO: 2241045 - RNA, 13 nt, Human
ugaccuuacauuu

SEQ ID NO: 2241046 - RNA, 15 nt, Human
ugaccuuaguguuuc

SEQ ID NO: 2241047 - RNA, 16 nt, Human
ugaccuuaguguuucu

SEQ ID NO: 2241048 - RNA, 21 nt, Human
ugaccuuaguguuucugugca

SEQ ID NO: 2241049 - RNA, 18 nt, Human
ugaccuuccaagagccug

SEQ ID NO: 2241050 - RNA, 23 nt, Human
ugaccuuaguguuucugugcaug

SEQ ID NO: 2241051 - RNA, 20 nt, Human
ugaccuuccaagagccugag

SEQ ID NO: 2241052 - RNA, 19 nt, Human
ugaccuuccaagagccuga

SEQ ID NO: 2241053 - RNA, 22 nt, Human
ugaccuuaguguuucugugcau

SEQ ID NO: 2241054 - RNA, 18 nt, Human
ugaccuuccucgcagaga

SEQ ID NO: 2241055 - RNA, 20 nt, Human
ugaccuuccucgcagagagg

SEQ ID NO: 2241056 - RNA, 21 nt, Human
ugaccuuccucgcagagaggc

SEQ ID NO: 2241057 - RNA, 23 nt, Human
ugaccuuccucgcagagaggcca

SEQ ID NO: 2241058 - RNA, 21 nt, Human
ugaccccuccucacuggccau

SEQ ID NO: 2241059 - RNA, 13 nt, Human
ugaccccugcuca

SEQ ID NO: 2241060 - RNA, 22 nt, Human
ugaccccuccucacuggccauc

SEQ ID NO: 2241061 - RNA, 23 nt, Human
ugaccccucauagcccucacccu

SEQ ID NO: 2241062 - RNA, 13 nt, Human
ugaccccuccuca

SEQ ID NO: 2241063 - RNA, 15 nt, Human
ugaccccuccucacu

SEQ ID NO: 2241064 - RNA, 20 nt, Human
ugaccccuccucacuggcca

SEQ ID NO: 2241065 - RNA, 13 nt, Human
ugaccccagagga

SEQ ID NO: 2241066 - RNA, 22 nt, Human
ugaccccaaacaccuuccagcu

SEQ ID NO: 2241067 - RNA, 19 nt, Human
ugaccccaaagagccugga

SEQ ID NO: 2241068 - RNA, 22 nt, Human
ugaccccaaagagccuggagaa

SEQ ID NO: 2241069 - RNA, 21 nt, Human
ugaccccuuuucagcuucugc

SEQ ID NO: 2241070 - RNA, 22 nt, Human
ugaccccuuuucagcuucugcu

SEQ ID NO: 2241071 - RNA, 14 nt, Human
ugacccggaggcca

SEQ ID NO: 2241072 - RNA, 21 nt, Human
ugacccggaggccacaugagu

SEQ ID NO: 2241073 - RNA, 17 nt, Human
ugacccggaggccacau

SEQ ID NO: 2241074 - RNA, 20 nt, Human
ugacccggaggccacaugag

SEQ ID NO: 2241075 - RNA, 18 nt, Human
ugaccugaggcccuucuc

SEQ ID NO: 2241076 - RNA, 19 nt, Human
ugaccugaggcccuucucu

SEQ ID NO: 2241077 - RNA, 22 nt, Human
agauggaacccuuuuggccccc

SEQ ID NO: 2241078 - RNA, 18 nt, Human
agauggaaccgcaggaag

SEQ ID NO: 2241079 - RNA, 17 nt, Human
agauggaaccgcaggaa

SEQ ID NO: 2241080 - RNA, 13 nt, Human
agaugcugauguu

SEQ ID NO: 2241081 - RNA, 14 nt, Human
agaugcugauguuc

SEQ ID NO: 2241082 - RNA, 15 nt, Human
agaugcugauguuca

SEQ ID NO: 2241083 - RNA, 22 nt, Human
agaugcugaaacaggagagaaa

SEQ ID NO: 2241084 - RNA, 11 nt, Human
agaugcugaug

SEQ ID NO: 2241085 - RNA, 21 nt, Human
agaugcugaaacaggagagaa

SEQ ID NO: 2241086 - RNA, 15 nt, Human
agaugcucuucugug

SEQ ID NO: 2241087 - RNA, 23 nt, Human
agaugcugacuguacuccuccca

SEQ ID NO: 2241088 - RNA, 13 nt, Human
agaugcucuuuua

SEQ ID NO: 2241089 - RNA, 18 nt, Human
agaugcugaaacaggaga

SEQ ID NO: 2241090 - RNA, 20 nt, Human
agaugcugacuguacuccuc

SEQ ID NO: 2241091 - RNA, 20 nt, Human
agaugcuccuugggcccuuu

SEQ ID NO: 2241092 - RNA, 15 nt, Human
agaugcuccuugggc

SEQ ID NO: 2241093 - RNA, 17 nt, Human
agaugcucuaucuugcu

SEQ ID NO: 2241094 - RNA, 18 nt, Human
agaugcucuaucuugcuc

SEQ ID NO: 2241095 - RNA, 21 nt, Human
agaugcucuaucuugcucugu

SEQ ID NO: 2241096 - RNA, 23 nt, Human
agaugcucuaucuugcucuguaa

SEQ ID NO: 2241097 - RNA, 21 nt, Human
agaugccuccaccgcugccua

SEQ ID NO: 2241098 - RNA, 17 nt, Human
agaugccuccaccgcug

SEQ ID NO: 2241099 - RNA, 16 nt, Human
agaugccuccaccgcu

SEQ ID NO: 2241100 - RNA, 15 nt, Human
agaugccuccaccgc

SEQ ID NO: 2241101 - RNA, 14 nt, Human
agaugccuccaccg

SEQ ID NO: 2241102 - RNA, 22 nt, Human
agaugccuccaccccccagaac

SEQ ID NO: 2241103 - RNA, 21 nt, Human
agaugccuccaccccccagaa

SEQ ID NO: 2241104 - RNA, 13 nt, Human
agaugccuccacc

SEQ ID NO: 2241105 - RNA, 12 nt, Human
agaugccuccac

SEQ ID NO: 2241106 - RNA, 17 nt, Human
agaugccccagagcugu

SEQ ID NO: 2241107 - RNA, 11 nt, Human
agaugcccuga

SEQ ID NO: 2241108 - RNA, 12 nt, Human
agaugccccaga

SEQ ID NO: 2241109 - RNA, 22 nt, Human
agaugcccagagggcccaggca

SEQ ID NO: 2241110 - RNA, 21 nt, Human
agaugcccagagggcccaggc

SEQ ID NO: 2241111 - RNA, 16 nt, Human
agaugcagggcaguca

SEQ ID NO: 2241112 - RNA, 16 nt, Human
agaugccgcauuugga

SEQ ID NO: 2241113 - RNA, 16 nt, Human
agaugcaguucugaag

SEQ ID NO: 2241114 - RNA, 19 nt, Human
agaugcagcaaaaugugaa

SEQ ID NO: 2241115 - RNA, 21 nt, Human
agaugcagcaaaaugugaaug

SEQ ID NO: 2241116 - RNA, 14 nt, Human
ugacacuuccaguc

SEQ ID NO: 2241117 - RNA, 19 nt, Human
agaugcagagagccauuuu

SEQ ID NO: 2241118 - RNA, 20 nt, Human
agaugcagagagccauuuug

SEQ ID NO: 2241119 - RNA, 14 nt, Human
agaugcagcaaaau

SEQ ID NO: 2241120 - RNA, 12 nt, Human
agaugcagcugg

SEQ ID NO: 2241121 - RNA, 13 nt, Human
agaugcagggcag

SEQ ID NO: 2241122 - RNA, 13 nt, Human
agaugcagcugga

SEQ ID NO: 2241123 - RNA, 15 nt, Human
agaugcagcuggaaa

SEQ ID NO: 2241124 - RNA, 16 nt, Human
ugacacuucagagagc

SEQ ID NO: 2241125 - RNA, 14 nt, Human
ugacacucccuugg

SEQ ID NO: 2241126 - RNA, 20 nt, Human
ugacacuucagagagcuggu

SEQ ID NO: 2241127 - RNA, 19 nt, Human
ugacacuucagagagcugg

SEQ ID NO: 2241128 - RNA, 18 nt, Human
ugacacuucagagagcug

SEQ ID NO: 2241129 - RNA, 17 nt, Human
ugacacuucagagagcu

SEQ ID NO: 2241130 - RNA, 24 nt, Human
ugacacuucagagagcugguaguu

SEQ ID NO: 2241131 - RNA, 23 nt, Human
ugacacuucagagagcugguagu

SEQ ID NO: 2241132 - RNA, 15 nt, Human
ugacacuugucccca

SEQ ID NO: 2241133 - RNA, 16 nt, Human
ugacacuuaaaaaugg

SEQ ID NO: 2241134 - RNA, 17 nt, Human
ugacacuuaaaaauggu

SEQ ID NO: 2241135 - RNA, 16 nt, Human
agauggaggaggaggc

SEQ ID NO: 2241136 - RNA, 12 nt, Human
agauggacacac

SEQ ID NO: 2241137 - RNA, 20 nt, Human
agauguucucuaucauuuaa

SEQ ID NO: 2241138 - RNA, 18 nt, Human
agauggaaugcuguguua

SEQ ID NO: 2241139 - RNA, 21 nt, Human
agauguucucuaucauuuaau

SEQ ID NO: 2241140 - RNA, 20 nt, Human
agauguucucucccaggggc

SEQ ID NO: 2241141 - RNA, 21 nt, Human
agauggaaccgcaggaagcug

SEQ ID NO: 2241142 - RNA, 20 nt, Human
agauggaaccgcaggaagcu

SEQ ID NO: 2241143 - RNA, 12 nt, Human
agauggaagcuu

SEQ ID NO: 2241144 - RNA, 16 nt, Human
agauggaagcuuccag

SEQ ID NO: 2241145 - RNA, 22 nt, Human
agauggaaguugcagugagcug

SEQ ID NO: 2241146 - RNA, 23 nt, Human
agauggaaguugcagugagcuga

SEQ ID NO: 2241147 - RNA, 13 nt, Human
agauggaaugcug

SEQ ID NO: 2241148 - RNA, 15 nt, Human
agauggaaugcugug

SEQ ID NO: 2241149 - RNA, 19 nt, Human
agauguuugucagauauga

SEQ ID NO: 2241150 - RNA, 17 nt, Human
agauguuugucagauau

SEQ ID NO: 2241151 - RNA, 15 nt, Human
agauguuugucagau

SEQ ID NO: 2241152 - RNA, 22 nt, Human
agauguuucuuuuguauguaaa

SEQ ID NO: 2241153 - RNA, 18 nt, Human
agauguuucuuuuguaug

SEQ ID NO: 2241154 - RNA, 21 nt, Human
agauguuucuuuuguauguaa

SEQ ID NO: 2241155 - RNA, 14 nt, Human
agauguuucacgaa

SEQ ID NO: 2241156 - RNA, 14 nt, Human
agauguuuccagac

SEQ ID NO: 2241157 - RNA, 23 nt, Human
agauguuuccagacuuccuugag

SEQ ID NO: 2241158 - RNA, 21 nt, Human
agauguuuccagacuuccuug

SEQ ID NO: 2241159 - RNA, 24 nt, Human
agauguuugucagauaugauaugu

SEQ ID NO: 2241160 - RNA, 22 nt, Human
agauguuuuaccguaauaauua

SEQ ID NO: 2241161 - RNA, 17 nt, Human
agauguuuuacgucugg

SEQ ID NO: 2241162 - RNA, 11 nt, Human
agauguuuuag

SEQ ID NO: 2241163 - RNA, 23 nt, Human
agauguuuuagaguuaacaauga

SEQ ID NO: 2241164 - RNA, 13 nt, Human
agauguuuuuaaa

SEQ ID NO: 2241165 - RNA, 16 nt, Human
agauguuuuuaaaagu

SEQ ID NO: 2241166 - RNA, 22 nt, Human
agauguuuuuaaaaguuucaau

SEQ ID NO: 2241167 - RNA, 18 nt, Human
agauguuuuuaaaaguuu

SEQ ID NO: 2241168 - RNA, 20 nt, Human
agauguuuuuaaaaguuuca

SEQ ID NO: 2241169 - RNA, 14 nt, Human
ugacccaugcugcc

SEQ ID NO: 2241170 - RNA, 15 nt, Human
ugacccaugcugccc

SEQ ID NO: 2241171 - RNA, 21 nt, Human
ugaccccaaacaccuuccagc

SEQ ID NO: 2241172 - RNA, 21 nt, Human
ugacccaugcugcccugugag

SEQ ID NO: 2241173 - RNA, 12 nt, Human
ugacccaugcug

SEQ ID NO: 2241174 - RNA, 16 nt, Human
ugacccaugcugcccu

SEQ ID NO: 2241175 - RNA, 21 nt, Human
agauuccccauugccuccucc

SEQ ID NO: 2241176 - RNA, 22 nt, Human
agauuccccauugccuccuccu

SEQ ID NO: 2241177 - RNA, 23 nt, Human
agauuccccauugccuccuccuu

SEQ ID NO: 2241178 - RNA, 24 nt, Human
agauuccccauugccuccuccuuc

SEQ ID NO: 2241179 - RNA, 19 nt, Human
agauuccccauugccuccu

SEQ ID NO: 2241180 - RNA, 17 nt, Human
agauucauuuuucuuuc

SEQ ID NO: 2241181 - RNA, 15 nt, Human
agauucccugagcag

SEQ ID NO: 2241182 - RNA, 22 nt, Human
agauugcugaaauuuuauaugc

SEQ ID NO: 2241183 - RNA, 16 nt, Human
agauucgcuuuccaug

SEQ ID NO: 2241184 - RNA, 13 nt, Human
agauuggaaggaa

SEQ ID NO: 2241185 - RNA, 16 nt, Human
agauugcuuaaaauag

SEQ ID NO: 2241186 - RNA, 15 nt, Human
agauugcuuaaaaua

SEQ ID NO: 2241187 - RNA, 23 nt, Human
agauuggagaaacccuugaaaag

SEQ ID NO: 2241188 - RNA, 23 nt, Human
agauugcuuugauuaauccagaa

SEQ ID NO: 2241189 - RNA, 22 nt, Human
agauucauauuuacuucuuaua

SEQ ID NO: 2241190 - RNA, 24 nt, Human
ugacuucuaaguaaaaccacagca

SEQ ID NO: 2241191 - RNA, 15 nt, Human
agauucauccauuua

SEQ ID NO: 2241192 - RNA, 12 nt, Human
agauucauuuuu

SEQ ID NO: 2241193 - RNA, 18 nt, Human
agauuccagagaguggcu

SEQ ID NO: 2241194 - RNA, 21 nt, Human
ugacucgggcuccugugcccu

SEQ ID NO: 2241195 - RNA, 21 nt, Human
agauucauuauuuuuccacuu

SEQ ID NO: 2241196 - RNA, 17 nt, Human
agauucauuuuuaauca

SEQ ID NO: 2241197 - RNA, 20 nt, Human
agauucauuuuuaaucauga

SEQ ID NO: 2241198 - RNA, 19 nt, Human
ugacuuacuguacaugaaa

SEQ ID NO: 2241199 - RNA, 15 nt, Human
ugacuucuaaguaaa

SEQ ID NO: 2241200 - RNA, 23 nt, Human
ugacuucuaaguaaaaccacagc

SEQ ID NO: 2241201 - RNA, 22 nt, Human
ugacuucuaaguaaaaccacag

SEQ ID NO: 2241202 - RNA, 17 nt, Human
agauuugaacucuucaa

SEQ ID NO: 2241203 - RNA, 20 nt, Human
agauuucucauuugccaaua

SEQ ID NO: 2241204 - RNA, 23 nt, Human
agauuuccagucuccaccaggaa

SEQ ID NO: 2241205 - RNA, 18 nt, Human
agauuuccauauaaauau

SEQ ID NO: 2241206 - RNA, 14 nt, Human
agauuggcucacac

SEQ ID NO: 2241207 - RNA, 19 nt, Human
agauuggcucacacugaga

SEQ ID NO: 2241208 - RNA, 15 nt, Human
agauuuccagucucc

SEQ ID NO: 2241209 - RNA, 22 nt, Human
agauuggcucacacugagaaug

SEQ ID NO: 2241210 - RNA, 19 nt, Human
agauuucuugaguuuuguu

SEQ ID NO: 2241211 - RNA, 14 nt, Human
agauuuuagguguu

SEQ ID NO: 2241212 - RNA, 15 nt, Human
agauuuuagguguug

SEQ ID NO: 2241213 - RNA, 14 nt, Human
agauuuucuuuaaa

SEQ ID NO: 2241214 - RNA, 17 nt, Human
agauuuucuuuaaaaga

SEQ ID NO: 2241215 - RNA, 18 nt, Human
agauuuucuuuaaaagaa

SEQ ID NO: 2241216 - RNA, 20 nt, Human
agauuuucuuuaaaagaaug

SEQ ID NO: 2241217 - RNA, 21 nt, Human
agauuuugaaauuuuuauuaa

SEQ ID NO: 2241218 - RNA, 13 nt, Human
agauuuucuuuaa

SEQ ID NO: 2241219 - RNA, 14 nt, Human
agauuuugaaugcu

SEQ ID NO: 2241220 - RNA, 15 nt, Human
agauuuugauagcaa

SEQ ID NO: 2241221 - RNA, 18 nt, Human
agauuuugauagcaaagc

SEQ ID NO: 2241222 - RNA, 19 nt, Human
agauuuugauagcaaagcg

SEQ ID NO: 2241223 - RNA, 16 nt, Human
agauuuugcuuuucca

SEQ ID NO: 2241224 - RNA, 22 nt, Human
agauuuugggguuguguuguca

SEQ ID NO: 2241225 - RNA, 16 nt, Human
agauuuuguuuugcuu

SEQ ID NO: 2241226 - RNA, 17 nt, Human
agauuuuguuuugcuuu

SEQ ID NO: 2241227 - RNA, 21 nt, Human
agauuuuguuuugcuuuuucu

SEQ ID NO: 2241228 - RNA, 14 nt, Human
agauuuuguuuugc

SEQ ID NO: 2241229 - RNA, 17 nt, Human
agauuuuucaugauuuu

SEQ ID NO: 2241230 - RNA, 13 nt, Human
agauuuuuacaaa

SEQ ID NO: 2241231 - RNA, 22 nt, Human
agauuuuguuuugcuuuuucug

SEQ ID NO: 2241232 - RNA, 23 nt, Human
agauuuuguuuugcuuuuucuga

SEQ ID NO: 2241233 - RNA, 24 nt, Human
agauuuuguuuugcuuuuucugac

SEQ ID NO: 2241234 - RNA, 16 nt, Human
agcaagacuguugcuc

SEQ ID NO: 2241235 - RNA, 12 nt, Human
agcaagacucug

SEQ ID NO: 2241236 - RNA, 23 nt, Human
agcaagacgcugugcugcccugc

SEQ ID NO: 2241237 - RNA, 17 nt, Human
agcaagagcuggcaaag

SEQ ID NO: 2241238 - RNA, 23 nt, Human
agcaagagcuggcaaagguggcu

SEQ ID NO: 2241239 - RNA, 21 nt, Human
agcaagauccugucuuuaagg

SEQ ID NO: 2241240 - RNA, 12 nt, Human
agcaagagagau

SEQ ID NO: 2241241 - RNA, 15 nt, Human
agcaagagagauguu

SEQ ID NO: 2241242 - RNA, 13 nt, Human
agcaagagcuggc

SEQ ID NO: 2241243 - RNA, 17 nt, Human
agcaagacgcugugcug

SEQ ID NO: 2241244 - RNA, 20 nt, Human
agcaagacgcugugcugccc

SEQ ID NO: 2241245 - RNA, 21 nt, Human
agcaagacgcugugcugcccu

SEQ ID NO: 2241246 - RNA, 22 nt, Human
agcaagacgcugugcugcccug

SEQ ID NO: 2241247 - RNA, 16 nt, Human
ugagaagauugugaau

SEQ ID NO: 2241248 - RNA, 16 nt, Human
ugagaaggcagccacc

SEQ ID NO: 2241249 - RNA, 17 nt, Human
ugagaaggcagccacca

SEQ ID NO: 2241250 - RNA, 16 nt, Human
ugagaagguccuuaau

SEQ ID NO: 2241251 - RNA, 20 nt, Human
ugagaaggcagccaccagcg

SEQ ID NO: 2241252 - RNA, 18 nt, Human
ugagaaguccccuuccau

SEQ ID NO: 2241253 - RNA, 18 nt, Human
ugagaagugaaugcuggg

SEQ ID NO: 2241254 - RNA, 19 nt, Human
ugagaagugaaugcuggga

SEQ ID NO: 2241255 - RNA, 17 nt, Human
ugagaaucagaucauuu

SEQ ID NO: 2241256 - RNA, 17 nt, Human
ugagaauaagagaguca

SEQ ID NO: 2241257 - RNA, 19 nt, Human
ugagaauaagagagucaua

SEQ ID NO: 2241258 - RNA, 16 nt, Human
ugagaaucaaaacucu

SEQ ID NO: 2241259 - RNA, 21 nt, Human
ugagaagugaaugcugggacu

SEQ ID NO: 2241260 - RNA, 22 nt, Human
ugagaagugaaugcugggacuc

SEQ ID NO: 2241261 - RNA, 19 nt, Human
ugagaaguccccuuccauc

SEQ ID NO: 2241262 - RNA, 17 nt, Human
ugagaaguuuuguacag

SEQ ID NO: 2241263 - RNA, 18 nt, Human
ugagaaguuuuguacaga

SEQ ID NO: 2241264 - RNA, 24 nt, Human
ugagaaguuuuguacagagaauua

SEQ ID NO: 2241265 - RNA, 23 nt, Human
ugagaagagggccugugggagcc

SEQ ID NO: 2241266 - RNA, 20 nt, Human
ugagaagagggccuguggga

SEQ ID NO: 2241267 - RNA, 21 nt, Human
ugagaagagggccugugggag

SEQ ID NO: 2241268 - RNA, 20 nt, Human
ugagaagcagaggaaggaga

SEQ ID NO: 2241269 - RNA, 18 nt, Human
ugagaagagagaucaaau

SEQ ID NO: 2241270 - RNA, 23 nt, Human
ugagaagaaaacaucuauucucu

SEQ ID NO: 2241271 - RNA, 15 nt, Human
ugagaagagggccug

SEQ ID NO: 2241272 - RNA, 16 nt, Human
ugagaagagggccugu

SEQ ID NO: 2241273 - RNA, 17 nt, Human
ugagaagagggccugug

SEQ ID NO: 2241274 - RNA, 17 nt, Human
ugagaagaaaacaucua

SEQ ID NO: 2241275 - RNA, 14 nt, Human
ugagaagaaaacau

SEQ ID NO: 2241276 - RNA, 20 nt, Human
ugagaacugcauauguuucg

SEQ ID NO: 2241277 - RNA, 17 nt, Human
ugagaacugcauauguu

SEQ ID NO: 2241278 - RNA, 19 nt, Human
ugagaacuacucagggaau

SEQ ID NO: 2241279 - RNA, 16 nt, Human
agauuuuuaacgaaug

SEQ ID NO: 2241280 - RNA, 13 nt, Human
agauuuuucucaa

SEQ ID NO: 2241281 - RNA, 22 nt, Human
agauuuuucucaaaguuuugaa

SEQ ID NO: 2241282 - RNA, 20 nt, Human
agcaacguagcuucuaccau

SEQ ID NO: 2241283 - RNA, 14 nt, Human
agcaacucuugauu

SEQ ID NO: 2241284 - RNA, 23 nt, Human
agcaaaaaaaaaaaaaagcaucu

SEQ ID NO: 2241285 - RNA, 23 nt, Human
agcaacgcaggcccccaggugcc

SEQ ID NO: 2241286 - RNA, 15 nt, Human
agcaacuugucuuuu

SEQ ID NO: 2241287 - RNA, 21 nt, Human
agcaacuguuaugaaauaaag

SEQ ID NO: 2241288 - RNA, 17 nt, Human
agcaacugucuauuucu

SEQ ID NO: 2241289 - RNA, 20 nt, Human
agcaacugucuauuucugcu

SEQ ID NO: 2241290 - RNA, 21 nt, Human
agcaacugucuauuucugcug

SEQ ID NO: 2241291 - RNA, 22 nt, Human
agcaacugucuauuucugcuga

SEQ ID NO: 2241292 - RNA, 13 nt, Human
agcaacuguuaug

SEQ ID NO: 2241293 - RNA, 17 nt, Human
agcaacuguuaugaaau

SEQ ID NO: 2241294 - RNA, 18 nt, Human
agcaacuguuaugaaaua

SEQ ID NO: 2241295 - RNA, 20 nt, Human
agcaacuguuaugaaauaaa

SEQ ID NO: 2241296 - RNA, 20 nt, Human
agcaacucuugauuauccau

SEQ ID NO: 2241297 - RNA, 16 nt, Human
agcaacucuugauuau

SEQ ID NO: 2241298 - RNA, 23 nt, Human
agcaacucuaagacuacagcaca

SEQ ID NO: 2241299 - RNA, 12 nt, Human
agcaacugaaua

SEQ ID NO: 2241300 - RNA, 13 nt, Human
agcaacugaauaa

SEQ ID NO: 2241301 - RNA, 14 nt, Human
agcaacugaauaaa

SEQ ID NO: 2241302 - RNA, 15 nt, Human
agcaacugaauaaau

SEQ ID NO: 2241303 - RNA, 19 nt, Human
agcaacugaauaaauaccu

SEQ ID NO: 2241304 - RNA, 21 nt, Human
agcaacugaauaaauaccucu

SEQ ID NO: 2241305 - RNA, 22 nt, Human
agcaacugaauaaauaccucuu

SEQ ID NO: 2241306 - RNA, 23 nt, Human
agcaacugaauaaauaccucuua

SEQ ID NO: 2241307 - RNA, 19 nt, Human
agcaacugcuguuggaagg

SEQ ID NO: 2241308 - RNA, 13 nt, Human
agcaacugucuau

SEQ ID NO: 2241309 - RNA, 16 nt, Human
agcaacugucuauuuc

SEQ ID NO: 2241310 - RNA, 23 nt, Human
agcaacuugucuuuuucuggacu

SEQ ID NO: 2241311 - RNA, 21 nt, Human
agcaacuugucuuuuucugga

SEQ ID NO: 2241312 - RNA, 20 nt, Human
agcaacuugucuuuuucugg

SEQ ID NO: 2241313 - RNA, 13 nt, Human
agcaacuuucuua

SEQ ID NO: 2241314 - RNA, 15 nt, Human
agcaagaaagaaacc

SEQ ID NO: 2241315 - RNA, 21 nt, Human
agcaagaagauccuaaaacaa

SEQ ID NO: 2241316 - RNA, 12 nt, Human
agcaagaaagaa

SEQ ID NO: 2241317 - RNA, 17 nt, Human
agcaacuuguucguggg

SEQ ID NO: 2241318 - RNA, 13 nt, Human
agcaagacgcugu

SEQ ID NO: 2241319 - RNA, 16 nt, Human
agcaagacgcugugcu

SEQ ID NO: 2241320 - RNA, 17 nt, Human
ugaauaaaguugaagcu

SEQ ID NO: 2241321 - RNA, 13 nt, Human
ugaauaaauaccu

SEQ ID NO: 2241322 - RNA, 16 nt, Human
ugaauaaauaaaugua

SEQ ID NO: 2241323 - RNA, 20 nt, Human
ugaauaaagccugcuuuuua

SEQ ID NO: 2241324 - RNA, 18 nt, Human
ugaagucacaucacagga

SEQ ID NO: 2241325 - RNA, 18 nt, Human
ugaauaaagccugcuuuu

SEQ ID NO: 2241326 - RNA, 15 nt, Human
ugaagucacugcaca

SEQ ID NO: 2241327 - RNA, 16 nt, Human
ugaagucacugcacag

SEQ ID NO: 2241328 - RNA, 21 nt, Human
ugaagucacugcacagugcau

SEQ ID NO: 2241329 - RNA, 16 nt, Human
ugaauaaagacaccua

SEQ ID NO: 2241330 - RNA, 21 nt, Human
ugaagguaaaauugaaaggca

SEQ ID NO: 2241331 - RNA, 14 nt, Human
ugaagucacacagu

SEQ ID NO: 2241332 - RNA, 22 nt, Human
ugaaggucacucuuccugcaag

SEQ ID NO: 2241333 - RNA, 14 nt, Human
ugaagucacugcac

SEQ ID NO: 2241334 - RNA, 16 nt, Human
ugaauacuguauuuug

SEQ ID NO: 2241335 - RNA, 15 nt, Human
ugaauacuuuauaaa

SEQ ID NO: 2241336 - RNA, 12 nt, Human
ugaauaaauguc

SEQ ID NO: 2241337 - RNA, 23 nt, Human
ugaauaaauaccucuuagcugag

SEQ ID NO: 2241338 - RNA, 14 nt, Human
ugaauaaauaccuc

SEQ ID NO: 2241339 - RNA, 15 nt, Human
ugaauaaauaccucu

SEQ ID NO: 2241340 - RNA, 17 nt, Human
ugaauaaauaccucuua

SEQ ID NO: 2241341 - RNA, 19 nt, Human
ugaauaaauaccucuuagc

SEQ ID NO: 2241342 - RNA, 13 nt, Human
ugaauaaaugucu

SEQ ID NO: 2241343 - RNA, 14 nt, Human
ugaauaaaugucuu

SEQ ID NO: 2241344 - RNA, 16 nt, Human
ugaauguaucaggaaa

SEQ ID NO: 2241345 - RNA, 15 nt, Human
ugaauguaucaggaa

SEQ ID NO: 2241346 - RNA, 18 nt, Human
ugaaugggaaaagagaug

SEQ ID NO: 2241347 - RNA, 17 nt, Human
ugaaugggcaaaacuga

SEQ ID NO: 2241348 - RNA, 18 nt, Human
ugaauauuguucauauug

SEQ ID NO: 2241349 - RNA, 17 nt, Human
ugaauauuuacguuuuu

SEQ ID NO: 2241350 - RNA, 22 nt, Human
ugaauauuuacguuuuuguaaa

SEQ ID NO: 2241351 - RNA, 14 nt, Human
ugaaugggaaaaga

SEQ ID NO: 2241352 - RNA, 16 nt, Human
ugaauguauugaacuu

SEQ ID NO: 2241353 - RNA, 11 nt, Human
ugaauguauuu

SEQ ID NO: 2241354 - RNA, 15 nt, Human
ugaauguaugugcac

SEQ ID NO: 2241355 - RNA, 18 nt, Human
ugaauguaugugcacugu

SEQ ID NO: 2241356 - RNA, 23 nt, Human
ugaauguaugcuucauacaggga

SEQ ID NO: 2241357 - RNA, 20 nt, Human
ugaauguaugcuucauacag

SEQ ID NO: 2241358 - RNA, 19 nt, Human
ugaauguaugcuucauaca

SEQ ID NO: 2241359 - RNA, 14 nt, Human
ugaauguaugcuuc

SEQ ID NO: 2241360 - RNA, 20 nt, Human
ugaauaugaacggugagcau

SEQ ID NO: 2241361 - RNA, 22 nt, Human
ugaauaugaggcauuuggcauu

SEQ ID NO: 2241362 - RNA, 18 nt, Human
ugaauaggcgaucacaac

SEQ ID NO: 2241363 - RNA, 19 nt, Human
ugaauaggcgaucacaacg

SEQ ID NO: 2241364 - RNA, 16 nt, Human
ugaauacuuuuuacaa

SEQ ID NO: 2241365 - RNA, 17 nt, Human
ugaauaggcgaucacaa

SEQ ID NO: 2241366 - RNA, 19 nt, Human
ugaauaugauuaguaaaga

SEQ ID NO: 2241367 - RNA, 21 nt, Human
ugaauauggacucaguuuucu

SEQ ID NO: 2241368 - RNA, 22 nt, Human
ugaaggggccaaggagggugag

SEQ ID NO: 2241369 - RNA, 23 nt, Human
ugaagcucaccuguugcuuacaa

SEQ ID NO: 2241370 - RNA, 10 nt, Human
ugaaggggcg

SEQ ID NO: 2241371 - RNA, 19 nt, Human
ugaagggggauaugaaugg

SEQ ID NO: 2241372 - RNA, 19 nt, Human
ugaagggccagagccaggg

SEQ ID NO: 2241373 - RNA, 18 nt, Human
ugaagggccagagccagg

SEQ ID NO: 2241374 - RNA, 16 nt, Human
ugaagcucacuucugg

SEQ ID NO: 2241375 - RNA, 18 nt, Human
ugaagcucaccuguugcu

SEQ ID NO: 2241376 - RNA, 19 nt, Human
ugaagcucaccuguugcuu

SEQ ID NO: 2241377 - RNA, 14 nt, Human
ugaagcuacugugu

SEQ ID NO: 2241378 - RNA, 19 nt, Human
ugaagcuauuuaucuguag

SEQ ID NO: 2241379 - RNA, 15 nt, Human
ugaagcuaagauuua

SEQ ID NO: 2241380 - RNA, 22 nt, Human
ugaagcuacugugugugugaau

SEQ ID NO: 2241381 - RNA, 20 nt, Human
ugaagcuaucguaaaauuaa

SEQ ID NO: 2241382 - RNA, 18 nt, Human
ugaagccuuucuuuugga

SEQ ID NO: 2241383 - RNA, 12 nt, Human
ugaagccuuugu

SEQ ID NO: 2241384 - RNA, 16 nt, Human
ugaagccacugaagcu

SEQ ID NO: 2241385 - RNA, 23 nt, Human
ugaagccaaguggggugcuggga

SEQ ID NO: 2241386 - RNA, 13 nt, Human
ugaagccuuucuu

SEQ ID NO: 2241387 - RNA, 19 nt, Human
ugaagccaauucagacagg

SEQ ID NO: 2241388 - RNA, 21 nt, Human
ugaagccaaguggggugcugg

SEQ ID NO: 2241389 - RNA, 22 nt, Human
ugaagccaaguggggugcuggg

SEQ ID NO: 2241390 - RNA, 22 nt, Human
ugaagcauuuuauaaaucgcuu

SEQ ID NO: 2241391 - RNA, 23 nt, Human
agaguauuggucuccucucagcc

SEQ ID NO: 2241392 - RNA, 11 nt, Human
ugaagccaaag

SEQ ID NO: 2241393 - RNA, 12 nt, Human
ugaagccaaaga

SEQ ID NO: 2241394 - RNA, 14 nt, Human
ugaagccaaagaaa

SEQ ID NO: 2241395 - RNA, 15 nt, Human
ugaagccaaagccaa

SEQ ID NO: 2241396 - RNA, 14 nt, Human
ugaagccaaguggg

SEQ ID NO: 2241397 - RNA, 18 nt, Human
ugaagcauuuuauaaauc

SEQ ID NO: 2241398 - RNA, 17 nt, Human
ugaagcauuuuauaaau

SEQ ID NO: 2241399 - RNA, 16 nt, Human
ugaagcauuuuauaaa

SEQ ID NO: 2241400 - RNA, 15 nt, Human
ugaagcauuuuauaa

SEQ ID NO: 2241401 - RNA, 16 nt, Human
agagguggggagcaga

SEQ ID NO: 2241402 - RNA, 23 nt, Human
agaggugugcaagagagggaugc

SEQ ID NO: 2241403 - RNA, 22 nt, Human
agaggugugcaagagagggaug

SEQ ID NO: 2241404 - RNA, 15 nt, Human
agagguuaagguggg

SEQ ID NO: 2241405 - RNA, 18 nt, Human
agagggaggcaagcccug

SEQ ID NO: 2241406 - RNA, 17 nt, Human
agagguuaucuguccca

SEQ ID NO: 2241407 - RNA, 14 nt, Human
agaguagcauuuca

SEQ ID NO: 2241408 - RNA, 24 nt, Human
agaggugggccagucuguggauca

SEQ ID NO: 2241409 - RNA, 16 nt, Human
agagguuaaggugcaa

SEQ ID NO: 2241410 - RNA, 19 nt, Human
agaguagccgagagccugc

SEQ ID NO: 2241411 - RNA, 18 nt, Human
agaguagccgagagccug

SEQ ID NO: 2241412 - RNA, 17 nt, Human
agaguagccgagagccu

SEQ ID NO: 2241413 - RNA, 13 nt, Human
agaguagccgaga

SEQ ID NO: 2241414 - RNA, 20 nt, Human
agagguuaucugucccaggu

SEQ ID NO: 2241415 - RNA, 15 nt, Human
agaguagcauuucau

SEQ ID NO: 2241416 - RNA, 18 nt, Human
agaguagcauuucauucu

SEQ ID NO: 2241417 - RNA, 23 nt, Human
agaguagccaggguguggcccug

SEQ ID NO: 2241418 - RNA, 23 nt, Human
agaguagccgagagccugcuccc

SEQ ID NO: 2241419 - RNA, 14 nt, Human
agaguaguccaggu

SEQ ID NO: 2241420 - RNA, 22 nt, Human
agaguagccgagagccugcucc

SEQ ID NO: 2241421 - RNA, 18 nt, Human
agaguauauuauguauuu

SEQ ID NO: 2241422 - RNA, 13 nt, Human
agaguauaugcac

SEQ ID NO: 2241423 - RNA, 14 nt, Human
ugaagcauuuuaua

SEQ ID NO: 2241424 - RNA, 14 nt, Human
agaguaugaacacc

SEQ ID NO: 2241425 - RNA, 13 nt, Human
agaguauggagcu

SEQ ID NO: 2241426 - RNA, 14 nt, Human
agaguauggagcuc

SEQ ID NO: 2241427 - RNA, 21 nt, Human
agaguauggagcucagagagg

SEQ ID NO: 2241428 - RNA, 16 nt, Human
ugaaaguccagaaacu

SEQ ID NO: 2241429 - RNA, 18 nt, Human
ugaaagucagaugcccag

SEQ ID NO: 2241430 - RNA, 15 nt, Human
ugaaagucagaugcc

SEQ ID NO: 2241431 - RNA, 15 nt, Human
ugaaaguauaacuga

SEQ ID NO: 2241432 - RNA, 23 nt, Human
ugaaaguacauuuggagacacaa

SEQ ID NO: 2241433 - RNA, 15 nt, Human
ugaaagguuuacauu

SEQ ID NO: 2241434 - RNA, 14 nt, Human
ugaaaguacauuug

SEQ ID NO: 2241435 - RNA, 18 nt, Human
ugaaaguccagaaacugu

SEQ ID NO: 2241436 - RNA, 12 nt, Human
agaggccccagc

SEQ ID NO: 2241437 - RNA, 16 nt, Human
agaggccccagccucc

SEQ ID NO: 2241438 - RNA, 15 nt, Human
agaggccccagccuc

SEQ ID NO: 2241439 - RNA, 14 nt, Human
agaggccccagccu

SEQ ID NO: 2241440 - RNA, 13 nt, Human
agaggccccagcc

SEQ ID NO: 2241441 - RNA, 23 nt, Human
agaggccccagccucccugaagc

SEQ ID NO: 2241442 - RNA, 14 nt, Human
agaggcccccagcc

SEQ ID NO: 2241443 - RNA, 16 nt, Human
agaggcccccagccca

SEQ ID NO: 2241444 - RNA, 17 nt, Human
agaggcccccagcccag

SEQ ID NO: 2241445 - RNA, 20 nt, Human
agaggcccccagcccagggc

SEQ ID NO: 2241446 - RNA, 21 nt, Human
agaggcccccagcccagggcu

SEQ ID NO: 2241447 - RNA, 22 nt, Human
agaggcccccagcccagggcuc

SEQ ID NO: 2241448 - RNA, 22 nt, Human
agaggcuggaggcagggccuug

SEQ ID NO: 2241449 - RNA, 20 nt, Human
agaggcuggaggcagggccu

SEQ ID NO: 2241450 - RNA, 14 nt, Human
agaggcuggguuca

SEQ ID NO: 2241451 - RNA, 14 nt, Human
agaggcuggugcug

SEQ ID NO: 2241452 - RNA, 16 nt, Human
agaggcuggugcugug

SEQ ID NO: 2241453 - RNA, 21 nt, Human
agaggcuggugcuguggccag

SEQ ID NO: 2241454 - RNA, 19 nt, Human
agaggcuggaggcagggcc

SEQ ID NO: 2241455 - RNA, 17 nt, Human
agaggcuggaggcaggg

SEQ ID NO: 2241456 - RNA, 18 nt, Human
agaggcccucuggagugg

SEQ ID NO: 2241457 - RNA, 14 nt, Human
agaggcccucugga

SEQ ID NO: 2241458 - RNA, 19 nt, Human
agaggcccucgcugccagc

SEQ ID NO: 2241459 - RNA, 14 nt, Human
agaggcccucgcug

SEQ ID NO: 2241460 - RNA, 22 nt, Human
agaggcuguucccaccaggcug

SEQ ID NO: 2241461 - RNA, 20 nt, Human
agaggcuuccuucauuuccu

SEQ ID NO: 2241462 - RNA, 16 nt, Human
agaggcugguuccaga

SEQ ID NO: 2241463 - RNA, 22 nt, Human
agaggcuggugcuguggccagg

SEQ ID NO: 2241464 - RNA, 12 nt, Human
agaggcuucucc

SEQ ID NO: 2241465 - RNA, 16 nt, Human
agaggcuucuccgcca

SEQ ID NO: 2241466 - RNA, 17 nt, Human
agaggcuucuccgccag

SEQ ID NO: 2241467 - RNA, 19 nt, Human
agaggcuucuccgccagcc

SEQ ID NO: 2241468 - RNA, 20 nt, Human
agaggcuucuccgccagccu

SEQ ID NO: 2241469 - RNA, 21 nt, Human
agaggcuucuccgccagccuc

SEQ ID NO: 2241470 - RNA, 22 nt, Human
agaggcuucuccgccagccucc

SEQ ID NO: 2241471 - RNA, 19 nt, Human
agagggagaagggauggag

SEQ ID NO: 2241472 - RNA, 12 nt, Human
agagggagagag

SEQ ID NO: 2241473 - RNA, 13 nt, Human
agagggagagaga

SEQ ID NO: 2241474 - RNA, 19 nt, Human
agagggagaagcaugaaaa

SEQ ID NO: 2241475 - RNA, 16 nt, Human
agagggagaagcauga

SEQ ID NO: 2241476 - RNA, 14 nt, Human
agagggagaagaag

SEQ ID NO: 2241477 - RNA, 15 nt, Human
agagggagaagaagu

SEQ ID NO: 2241478 - RNA, 13 nt, Human
agagggagaagaa

SEQ ID NO: 2241479 - RNA, 14 nt, Human
agaggcuucuucag

SEQ ID NO: 2241480 - RNA, 23 nt, Human
agaggcuucuccgccagccuccu

SEQ ID NO: 2241481 - RNA, 22 nt, Human
agagggacuguucuuuuguccc

SEQ ID NO: 2241482 - RNA, 16 nt, Human
agagggagggagggcu

SEQ ID NO: 2241483 - RNA, 17 nt, Human
agagggaggcaagcccu

SEQ ID NO: 2241484 - RNA, 16 nt, Human
agagggaggcaagccc

SEQ ID NO: 2241485 - RNA, 24 nt, Human
agagggaggagaaugagccucggc

SEQ ID NO: 2241486 - RNA, 16 nt, Human
agaguuuaguuguagc

SEQ ID NO: 2241487 - RNA, 13 nt, Human
agaguuuccugaa

SEQ ID NO: 2241488 - RNA, 23 nt, Human
ugaauguaugugcacugucacuu

SEQ ID NO: 2241489 - RNA, 20 nt, Human
agagucacacgggggcagcu

SEQ ID NO: 2241490 - RNA, 21 nt, Human
agagucacacgggggcagcug

SEQ ID NO: 2241491 - RNA, 20 nt, Human
agaguuguuacauuuuuaag

SEQ ID NO: 2241492 - RNA, 19 nt, Human
agaguuguuacauuuuuaa

SEQ ID NO: 2241493 - RNA, 17 nt, Human
agaguuguuacauuuuu

SEQ ID NO: 2241494 - RNA, 22 nt, Human
agagucagaaguuucugccgca

SEQ ID NO: 2241495 - RNA, 15 nt, Human
agagucacuggaaca

SEQ ID NO: 2241496 - RNA, 15 nt, Human
ugaauguauuuauuu

SEQ ID NO: 2241497 - RNA, 22 nt, Human
agaguuuguguguugucuugaa

SEQ ID NO: 2241498 - RNA, 18 nt, Human
agaguuuguguguugucu

SEQ ID NO: 2241499 - RNA, 19 nt, Human
agaguuuguguguugucuu

SEQ ID NO: 2241500 - RNA, 13 nt, Human
agaguuugugugu

SEQ ID NO: 2241501 - RNA, 16 nt, Human
agaguuuguguguugu

SEQ ID NO: 2241502 - RNA, 13 nt, Human
agaguuugaagga

SEQ ID NO: 2241503 - RNA, 19 nt, Human
agaguuugaaggaggugag

SEQ ID NO: 2241504 - RNA, 13 nt, Human
agauaacuaggaa

SEQ ID NO: 2241505 - RNA, 21 nt, Human
agauaaccagcuguaacacag

SEQ ID NO: 2241506 - RNA, 20 nt, Human
agaguuuuggaugcagugcu

SEQ ID NO: 2241507 - RNA, 13 nt, Human
agaguuuuggaug

SEQ ID NO: 2241508 - RNA, 17 nt, Human
agaguuuuggaugcagu

SEQ ID NO: 2241509 - RNA, 18 nt, Human
agaguuuuggaugcagug

SEQ ID NO: 2241510 - RNA, 19 nt, Human
agaguuuuggaugcagugc

SEQ ID NO: 2241511 - RNA, 16 nt, Human
agauaacuguuauuua

SEQ ID NO: 2241512 - RNA, 14 nt, Human
agauaacugagaau

SEQ ID NO: 2241513 - RNA, 22 nt, Human
agauaagaaugcugguuuuccu

SEQ ID NO: 2241514 - RNA, 19 nt, Human
agauaacuguuauuuauaa

SEQ ID NO: 2241515 - RNA, 20 nt, Human
agauaacuguuauuuauaau

SEQ ID NO: 2241516 - RNA, 20 nt, Human
agauaagcaagagagauguu

SEQ ID NO: 2241517 - RNA, 17 nt, Human
agauaagcaagagagau

SEQ ID NO: 2241518 - RNA, 16 nt, Human
agauaagcaagagaga

SEQ ID NO: 2241519 - RNA, 13 nt, Human
agauaagcaagag

SEQ ID NO: 2241520 - RNA, 15 nt, Human
agauaauaugagaau

SEQ ID NO: 2241521 - RNA, 22 nt, Human
agauaagcaagagagauguuuu

SEQ ID NO: 2241522 - RNA, 13 nt, Human
agauaauaguuua

SEQ ID NO: 2241523 - RNA, 18 nt, Human
agauaauacaccacuaca

SEQ ID NO: 2241524 - RNA, 18 nt, Human
agaucaaaagguuaauaa

SEQ ID NO: 2241525 - RNA, 12 nt, Human
agaucaaaauaa

SEQ ID NO: 2241526 - RNA, 21 nt, Human
agauauuuugcuuugugauuu

SEQ ID NO: 2241527 - RNA, 20 nt, Human
agauauuuugcuuugugauu

SEQ ID NO: 2241528 - RNA, 23 nt, Human
agauauuuauauuuuuauuuuau

SEQ ID NO: 2241529 - RNA, 20 nt, Human
agauauuuauauuuuuauuu

SEQ ID NO: 2241530 - RNA, 17 nt, Human
agauauuuauauuuuua

SEQ ID NO: 2241531 - RNA, 17 nt, Human
agauauuuauauauauu

SEQ ID NO: 2241532 - RNA, 18 nt, Human
agauacauaugagugugg

SEQ ID NO: 2241533 - RNA, 22 nt, Human
agauacauaugaguguggaagc

SEQ ID NO: 2241534 - RNA, 23 nt, Human
agauauuuauuguuuauuuauca

SEQ ID NO: 2241535 - RNA, 15 nt, Human
agauauuuuaaaaug

SEQ ID NO: 2241536 - RNA, 18 nt, Human
agauauuuuaaaaugaga

SEQ ID NO: 2241537 - RNA, 16 nt, Human
agauacuguaucauga

SEQ ID NO: 2241538 - RNA, 15 nt, Human
agauacuguaucaug

SEQ ID NO: 2241539 - RNA, 22 nt, Human
agauaauauuaaggaagacaau

SEQ ID NO: 2241540 - RNA, 18 nt, Human
agauaauauuaaggaaga

SEQ ID NO: 2241541 - RNA, 20 nt, Human
agauacaggaaaagcugcug

SEQ ID NO: 2241542 - RNA, 13 nt, Human
agauacaguuacu

SEQ ID NO: 2241543 - RNA, 17 nt, Human
agauaauaugagaauca

SEQ ID NO: 2241544 - RNA, 14 nt, Human
agauaaucagccuc

SEQ ID NO: 2241545 - RNA, 22 nt, Human
agauacaguuacucagaauucu

SEQ ID NO: 2241546 - RNA, 11 nt, Human
agauacuguau

SEQ ID NO: 2241547 - RNA, 22 nt, Human
ugacacagucuuggcucacugc

SEQ ID NO: 2241548 - RNA, 23 nt, Human
ugacacagucuuggcucacugca

SEQ ID NO: 2241549 - RNA, 17 nt, Human
ugacacaggucuuuccu

SEQ ID NO: 2241550 - RNA, 16 nt, Human
ugacacaggucuuucc

SEQ ID NO: 2241551 - RNA, 16 nt, Human
ugacacagcagcuuca

SEQ ID NO: 2241552 - RNA, 16 nt, Human
ugacacaggaugaagg

SEQ ID NO: 2241553 - RNA, 22 nt, Human
ugacacagcagcuucaccagag

SEQ ID NO: 2241554 - RNA, 19 nt, Human
ugacacacagcucuguccu

SEQ ID NO: 2241555 - RNA, 23 nt, Human
ugacacagaaaauguugagaauc

SEQ ID NO: 2241556 - RNA, 19 nt, Human
ugacaaagaaacccaagug

SEQ ID NO: 2241557 - RNA, 16 nt, Human
ugacaaagcuuggaag

SEQ ID NO: 2241558 - RNA, 17 nt, Human
ugacaaaggcaagcacu

SEQ ID NO: 2241559 - RNA, 21 nt, Human
ugacaaagaguagacauuucu

SEQ ID NO: 2241560 - RNA, 19 nt, Human
ugacaaagacugaguacgu

SEQ ID NO: 2241561 - RNA, 16 nt, Human
ugacacacagcucugu

SEQ ID NO: 2241562 - RNA, 18 nt, Human
ugacacacagcucugucc

SEQ ID NO: 2241563 - RNA, 22 nt, Human
ugacaccagccuuucucccagg

SEQ ID NO: 2241564 - RNA, 16 nt, Human
ugacaccagccuuucu

SEQ ID NO: 2241565 - RNA, 15 nt, Human
ugacaccagccuuuc

SEQ ID NO: 2241566 - RNA, 13 nt, Human
ugacaccagccuu

SEQ ID NO: 2241567 - RNA, 12 nt, Human
ugacaccagccu

SEQ ID NO: 2241568 - RNA, 18 nt, Human
ugacacaggucuuuccua

SEQ ID NO: 2241569 - RNA, 21 nt, Human
ugacacauaugcaccuugugu

SEQ ID NO: 2241570 - RNA, 22 nt, Human
ugacacauaugcaccuuguguc

SEQ ID NO: 2241571 - RNA, 22 nt, Human
ugacacauggccccucccccug

SEQ ID NO: 2241572 - RNA, 16 nt, Human
ugacacauggccccuc

SEQ ID NO: 2241573 - RNA, 20 nt, Human
ugacacaugcaaggucauuu

SEQ ID NO: 2241574 - RNA, 12 nt, Human
ugacacaugcaa

SEQ ID NO: 2241575 - RNA, 17 nt, Human
ugacacguccaccccag

SEQ ID NO: 2241576 - RNA, 18 nt, Human
ugacacuagcccaaugaa

SEQ ID NO: 2241577 - RNA, 21 nt, Human
ugacacuagcccaaugaaaug

SEQ ID NO: 2241578 - RNA, 19 nt, Human
ugacacuagcccaaugaaa

SEQ ID NO: 2241579 - RNA, 23 nt, Human
ugacaccagccuuucucccaggc

SEQ ID NO: 2241580 - RNA, 13 nt, Human
ugacacccauguu

SEQ ID NO: 2241581 - RNA, 24 nt, Human
ugacaccagcuguucugucccuug

SEQ ID NO: 2241582 - RNA, 19 nt, Human
ugacacccauguuucucug

SEQ ID NO: 2241583 - RNA, 22 nt, Human
ugacacucccuugggcucccug

SEQ ID NO: 2241584 - RNA, 22 nt, Human
ugacacuauaucuguauauaaa

SEQ ID NO: 2241585 - RNA, 17 nt, Human
ugacacuauaucuguau

SEQ ID NO: 2241586 - RNA, 18 nt, Human
ugacacuauaucuguaua

SEQ ID NO: 2241587 - RNA, 19 nt, Human
ugacacuauaucuguauau

SEQ ID NO: 2241588 - RNA, 23 nt, Human
ugacacuagcccaaugaaaugaa

SEQ ID NO: 2241589 - RNA, 22 nt, Human
ugacacuagcccaaugaaauga

SEQ ID NO: 2241590 - RNA, 20 nt, Human
ugaauuuggccugcacuaau

SEQ ID NO: 2241591 - RNA, 20 nt, Human
ugaauuuggagacucugugg

SEQ ID NO: 2241592 - RNA, 17 nt, Human
ugaauuuggagacucug

SEQ ID NO: 2241593 - RNA, 15 nt, Human
ugaauuuggagacuc

SEQ ID NO: 2241594 - RNA, 14 nt, Human
ugaauuuggagacu

SEQ ID NO: 2241595 - RNA, 18 nt, Human
ugaauuugaaugaaaaau

SEQ ID NO: 2241596 - RNA, 17 nt, Human
ugaauuugaaugaaaaa

SEQ ID NO: 2241597 - RNA, 16 nt, Human
ugaauuugaaugaaaa

SEQ ID NO: 2241598 - RNA, 15 nt, Human
ugaauuugaaugaaa

SEQ ID NO: 2241599 - RNA, 13 nt, Human
ugaauuugaauga

SEQ ID NO: 2241600 - RNA, 13 nt, Human
ugaauuugugaag

SEQ ID NO: 2241601 - RNA, 21 nt, Human
ugaauuugugaagguggaaau

SEQ ID NO: 2241602 - RNA, 23 nt, Human
agaucaaauuucacgucgucuuc

SEQ ID NO: 2241603 - RNA, 14 nt, Human
agaucaaauuucac

SEQ ID NO: 2241604 - RNA, 20 nt, Human
agaucaaauacuuuaaagga

SEQ ID NO: 2241605 - RNA, 16 nt, Human
agaucaaauacuuuaa

SEQ ID NO: 2241606 - RNA, 16 nt, Human
agaucaaauggaaagg

SEQ ID NO: 2241607 - RNA, 17 nt, Human
agaucaaaauaaaaagu

SEQ ID NO: 2241608 - RNA, 14 nt, Human
agaucaaaauaaaa

SEQ ID NO: 2241609 - RNA, 16 nt, Human
agaucaaaauaaaaag

SEQ ID NO: 2241610 - RNA, 13 nt, Human
agaucaaauacuu

SEQ ID NO: 2241611 - RNA, 14 nt, Human
agaucaaauacuuu

SEQ ID NO: 2241612 - RNA, 15 nt, Human
agaucaaauacuuua

SEQ ID NO: 2241613 - RNA, 23 nt, Human
ugaauuucuuuugccguuauuaa

SEQ ID NO: 2241614 - RNA, 21 nt, Human
ugaauuuggccugcacuaauu

SEQ ID NO: 2241615 - RNA, 19 nt, Human
ugaauuugaaugaaaaauu

SEQ ID NO: 2241616 - RNA, 23 nt, Human
ugaauuugugaagguggaaauaa

SEQ ID NO: 2241617 - RNA, 14 nt, Human
ugaauuuuguugcu

SEQ ID NO: 2241618 - RNA, 18 nt, Human
ugaauuuuguuuggacuu

SEQ ID NO: 2241619 - RNA, 16 nt, Human
ugaauuuuguugcugu

SEQ ID NO: 2241620 - RNA, 22 nt, Human
ugaauuuuuaaaacccauuuaa

SEQ ID NO: 2241621 - RNA, 13 nt, Human
ugaauuuuucucu

SEQ ID NO: 2241622 - RNA, 15 nt, Human
ugaauuuuucucuaa

SEQ ID NO: 2241623 - RNA, 17 nt, Human
ugacaaaccucuaaccc

SEQ ID NO: 2241624 - RNA, 17 nt, Human
ugacaaagaaacccaag

SEQ ID NO: 2241625 - RNA, 18 nt, Human
ugacaaaauuuguugaaa

SEQ ID NO: 2241626 - RNA, 15 nt, Human
ugacaaagaaaccca

SEQ ID NO: 2241627 - RNA, 13 nt, Human
agacauugucaau

SEQ ID NO: 2241628 - RNA, 19 nt, Human
agacauucugccaggcccc

SEQ ID NO: 2241629 - RNA, 12 nt, Human
agacauucuguc

SEQ ID NO: 2241630 - RNA, 15 nt, Human
agacauuggcaccua

SEQ ID NO: 2241631 - RNA, 15 nt, Human
agacauucugccagg

SEQ ID NO: 2241632 - RNA, 14 nt, Human
agacauucugccag

SEQ ID NO: 2241633 - RNA, 19 nt, Human
agacauucuuccaaaaaga

SEQ ID NO: 2241634 - RNA, 12 nt, Human
agacauuaaauc

SEQ ID NO: 2241635 - RNA, 14 nt, Human
agacauuaaaucua

SEQ ID NO: 2241636 - RNA, 15 nt, Human
agacauuaaaucuau

SEQ ID NO: 2241637 - RNA, 22 nt, Human
agacauuaaaucuaugaaguau

SEQ ID NO: 2241638 - RNA, 17 nt, Human
agacauuccugggcaca

SEQ ID NO: 2241639 - RNA, 16 nt, Human
agacaucucugcaccc

SEQ ID NO: 2241640 - RNA, 18 nt, Human
agacauguuuuccgugaa

SEQ ID NO: 2241641 - RNA, 18 nt, Human
agacauccauguuuguaa

SEQ ID NO: 2241642 - RNA, 21 nt, Human
agacauccauguuuguaaaac

SEQ ID NO: 2241643 - RNA, 22 nt, Human
agacauccauguuuguaaaacu

SEQ ID NO: 2241644 - RNA, 14 nt, Human
agacaucucugcac

SEQ ID NO: 2241645 - RNA, 16 nt, Human
agacauugucaauaaa

SEQ ID NO: 2241646 - RNA, 13 nt, Human
agacauugucagc

SEQ ID NO: 2241647 - RNA, 17 nt, Human
agacauugucagcaaau

SEQ ID NO: 2241648 - RNA, 19 nt, Human
agacauuguuuugccaaca

SEQ ID NO: 2241649 - RNA, 23 nt, Human
agacccccccccccaacagaaca

SEQ ID NO: 2241650 - RNA, 22 nt, Human
agacauuguuuugccaacauug

SEQ ID NO: 2241651 - RNA, 23 nt, Human
agacauuguuuugccaacauugc

SEQ ID NO: 2241652 - RNA, 14 nt, Human
agacccccuggaga

SEQ ID NO: 2241653 - RNA, 13 nt, Human
agacccccuggag

SEQ ID NO: 2241654 - RNA, 22 nt, Human
agaccccucuggccaggaugga

SEQ ID NO: 2241655 - RNA, 21 nt, Human
agaccccucuggccaggaugg

SEQ ID NO: 2241656 - RNA, 19 nt, Human
agaccccucuggccaggau

SEQ ID NO: 2241657 - RNA, 17 nt, Human
agaccccucuggccagg

SEQ ID NO: 2241658 - RNA, 19 nt, Human
agacccccggaacaagccu

SEQ ID NO: 2241659 - RNA, 14 nt, Human
agaccccucuggcc

SEQ ID NO: 2241660 - RNA, 19 nt, Human
agacccccuggagacuaac

SEQ ID NO: 2241661 - RNA, 15 nt, Human
agacccccuggagac

SEQ ID NO: 2241662 - RNA, 14 nt, Human
agacauaacguuuu

SEQ ID NO: 2241663 - RNA, 20 nt, Human
agacauaacguuuuuccuuu

SEQ ID NO: 2241664 - RNA, 19 nt, Human
agacauacuaaccagcaga

SEQ ID NO: 2241665 - RNA, 21 nt, Human
agacauagaauuaacacauga

SEQ ID NO: 2241666 - RNA, 20 nt, Human
agacaucaagcacagaagga

SEQ ID NO: 2241667 - RNA, 17 nt, Human
agacaucaagcacagaa

SEQ ID NO: 2241668 - RNA, 18 nt, Human
agacauaggccaugaaaa

SEQ ID NO: 2241669 - RNA, 17 nt, Human
agacauaacguuuuucc

SEQ ID NO: 2241670 - RNA, 19 nt, Human
agacauaggccaugaaaaa

SEQ ID NO: 2241671 - RNA, 15 nt, Human
agacauccauaaaga

SEQ ID NO: 2241672 - RNA, 18 nt, Human
agacauccauaaagaagc

SEQ ID NO: 2241673 - RNA, 19 nt, Human
agacauccauaaagaagca

SEQ ID NO: 2241674 - RNA, 22 nt, Human
agacauccauaaagaagcaaua

SEQ ID NO: 2241675 - RNA, 17 nt, Human
agacauccauguuugua

SEQ ID NO: 2241676 - RNA, 18 nt, Human
agacaucaacagauaaau

SEQ ID NO: 2241677 - RNA, 17 nt, Human
agacaucaacagauaaa

SEQ ID NO: 2241678 - RNA, 13 nt, Human
ucuucuuaacuua

SEQ ID NO: 2241679 - RNA, 16 nt, Human
ucuucuguuuucuguu

SEQ ID NO: 2241680 - RNA, 17 nt, Human
ucuucuguuuucuguuu

SEQ ID NO: 2241681 - RNA, 13 nt, Human
ucuucuguggacc

SEQ ID NO: 2241682 - RNA, 20 nt, Human
ucuucuguggguuucuaaag

SEQ ID NO: 2241683 - RNA, 15 nt, Human
agacaguuucuuagc

SEQ ID NO: 2241684 - RNA, 18 nt, Human
ucuucuguuuucuguuuc

SEQ ID NO: 2241685 - RNA, 18 nt, Human
ucuucuuaagacuuuugg

SEQ ID NO: 2241686 - RNA, 21 nt, Human
agacaguuucuuagcuuuuua

SEQ ID NO: 2241687 - RNA, 18 nt, Human
agacaguuucuuagcuuu

SEQ ID NO: 2241688 - RNA, 20 nt, Human
agacaguuucuuagcuuuuu

SEQ ID NO: 2241689 - RNA, 22 nt, Human
agacaguuucuuagcuuuuuaa

SEQ ID NO: 2241690 - RNA, 15 nt, Human
ucuucuguacgucug

SEQ ID NO: 2241691 - RNA, 22 nt, Human
ucuucuguauuuuuuuuucuaa

SEQ ID NO: 2241692 - RNA, 23 nt, Human
ucuucugugauucgguggagacu

SEQ ID NO: 2241693 - RNA, 14 nt, Human
ucuucuguauuuuu

SEQ ID NO: 2241694 - RNA, 19 nt, Human
ucuucuguauacuguggag

SEQ ID NO: 2241695 - RNA, 18 nt, Human
ucuucuggguuccuuccu

SEQ ID NO: 2241696 - RNA, 20 nt, Human
ucuucugcuccacccuuggc

SEQ ID NO: 2241697 - RNA, 19 nt, Human
ucuucugcuccacccuugg

SEQ ID NO: 2241698 - RNA, 17 nt, Human
ucuucugcuccacccuu

SEQ ID NO: 2241699 - RNA, 16 nt, Human
ucuucugcuccacccu

SEQ ID NO: 2241700 - RNA, 15 nt, Human
ucuucugcuccaccc

SEQ ID NO: 2241701 - RNA, 14 nt, Human
ucuucugcuccacc

SEQ ID NO: 2241702 - RNA, 24 nt, Human
ucuucugaacucaaacugaggaau

SEQ ID NO: 2241703 - RNA, 15 nt, Human
ucuucucuuccugua

SEQ ID NO: 2241704 - RNA, 21 nt, Human
ucuucugaacuuggcgcugcc

SEQ ID NO: 2241705 - RNA, 19 nt, Human
ucuucugaacucaaacuga

SEQ ID NO: 2241706 - RNA, 21 nt, Human
ucuucucuuccuuuuaucagu

SEQ ID NO: 2241707 - RNA, 19 nt, Human
ucuucucuuccuuuuauca

SEQ ID NO: 2241708 - RNA, 14 nt, Human
ucuucucuuccugu

SEQ ID NO: 2241709 - RNA, 23 nt, Human
ucuucugcuccacccuuggccug

SEQ ID NO: 2241710 - RNA, 22 nt, Human
ucuucugcuccacccuuggccu

SEQ ID NO: 2241711 - RNA, 23 nt, Human
ucuucugggagggcagcagggcu

SEQ ID NO: 2241712 - RNA, 22 nt, Human
ucuucugggagggcagcagggc

SEQ ID NO: 2241713 - RNA, 18 nt, Human
ucuucugcuuaggagaga

SEQ ID NO: 2241714 - RNA, 12 nt, Human
ucuucugcuuca

SEQ ID NO: 2241715 - RNA, 19 nt, Human
ucuucugcuucagccuccc

SEQ ID NO: 2241716 - RNA, 15 nt, Human
ucuucaacucccugc

SEQ ID NO: 2241717 - RNA, 16 nt, Human
ucuucaacugaccagc

SEQ ID NO: 2241718 - RNA, 19 nt, Human
ucuucaacugaccagccuc

SEQ ID NO: 2241719 - RNA, 22 nt, Human
agaaucacuucugagaacucau

SEQ ID NO: 2241720 - RNA, 14 nt, Human
agaaucacuugaac

SEQ ID NO: 2241721 - RNA, 17 nt, Human
ucuucagagacuccugc

SEQ ID NO: 2241722 - RNA, 18 nt, Human
ucuucagagacuccugca

SEQ ID NO: 2241723 - RNA, 12 nt, Human
ucuucagagacu

SEQ ID NO: 2241724 - RNA, 15 nt, Human
ucuucacaacagauu

SEQ ID NO: 2241725 - RNA, 13 nt, Human
ucuucacaaaauc

SEQ ID NO: 2241726 - RNA, 14 nt, Human
ucuucaagaaaucu

SEQ ID NO: 2241727 - RNA, 21 nt, Human
ucuuccaggcugggagagccu

SEQ ID NO: 2241728 - RNA, 14 nt, Human
ucuuccauuugcaa

SEQ ID NO: 2241729 - RNA, 18 nt, Human
ucuucccaggcuggggcu

SEQ ID NO: 2241730 - RNA, 12 nt, Human
ucuucccagggu

SEQ ID NO: 2241731 - RNA, 14 nt, Human
ucuucccaggguag

SEQ ID NO: 2241732 - RNA, 21 nt, Human
ucuucccaggguagcccgccu

SEQ ID NO: 2241733 - RNA, 13 nt, Human
ucuuccauuugca

SEQ ID NO: 2241734 - RNA, 16 nt, Human
ucuuccaucccaggac

SEQ ID NO: 2241735 - RNA, 20 nt, Human
ucuucagagacuccugcagg

SEQ ID NO: 2241736 - RNA, 15 nt, Human
ucuuccaggcuggga

SEQ ID NO: 2241737 - RNA, 17 nt, Human
ucuuccaggcugggaga

SEQ ID NO: 2241738 - RNA, 20 nt, Human
ucuuccaggcugggagagcc

SEQ ID NO: 2241739 - RNA, 17 nt, Human
ucuucccaucacuggag

SEQ ID NO: 2241740 - RNA, 16 nt, Human
ucuucccaucacugga

SEQ ID NO: 2241741 - RNA, 19 nt, Human
ucuuccccacuccccaccu

SEQ ID NO: 2241742 - RNA, 14 nt, Human
ucuuccccacuccc

SEQ ID NO: 2241743 - RNA, 20 nt, Human
ucuuccccagaaaggagacu

SEQ ID NO: 2241744 - RNA, 17 nt, Human
ucuucccgaaccccaag

SEQ ID NO: 2241745 - RNA, 23 nt, Human
ucuuccccuugcccuugcccuga

SEQ ID NO: 2241746 - RNA, 16 nt, Human
ucuuccccuugcccuu

SEQ ID NO: 2241747 - RNA, 22 nt, Human
ucuuccccuugcccuugcccug

SEQ ID NO: 2241748 - RNA, 14 nt, Human
ucuuccccucucag

SEQ ID NO: 2241749 - RNA, 13 nt, Human
ucuuccccuugcc

SEQ ID NO: 2241750 - RNA, 15 nt, Human
ucuuccccuugcccu

SEQ ID NO: 2241751 - RNA, 18 nt, Human
ucuucccccacuccucuu

SEQ ID NO: 2241752 - RNA, 22 nt, Human
ucuucccuacaguugaaaaaca

SEQ ID NO: 2241753 - RNA, 19 nt, Human
ucuucccuacaguugaaaa

SEQ ID NO: 2241754 - RNA, 14 nt, Human
ucuuccucccuccc

SEQ ID NO: 2241755 - RNA, 19 nt, Human
ucuucccgaaccccaagga

SEQ ID NO: 2241756 - RNA, 18 nt, Human
ucuucccgaaccccaagg

SEQ ID NO: 2241757 - RNA, 15 nt, Human
ucuuccucccucccu

SEQ ID NO: 2241758 - RNA, 17 nt, Human
ucuuccuccgaggccag

SEQ ID NO: 2241759 - RNA, 18 nt, Human
ucuuccuccgaggccagu

SEQ ID NO: 2241760 - RNA, 13 nt, Human
ucuuccucccaag

SEQ ID NO: 2241761 - RNA, 14 nt, Human
ucuuccucccaagu

SEQ ID NO: 2241762 - RNA, 22 nt, Human
ucuuccucccaaguggugccua

SEQ ID NO: 2241763 - RNA, 11 nt, Human
ucuuccucugc

SEQ ID NO: 2241764 - RNA, 12 nt, Human
ucuuccucugcu

SEQ ID NO: 2241765 - RNA, 14 nt, Human
ucuuccucugcuga

SEQ ID NO: 2241766 - RNA, 16 nt, Human
ucuuccucugaggcug

SEQ ID NO: 2241767 - RNA, 13 nt, Human
ucuuccucugagg

SEQ ID NO: 2241768 - RNA, 14 nt, Human
ucuuccucugaggc

SEQ ID NO: 2241769 - RNA, 21 nt, Human
ucuucucuggcgacaguuuuc

SEQ ID NO: 2241770 - RNA, 13 nt, Human
ucuucucuuccug

SEQ ID NO: 2241771 - RNA, 20 nt, Human
ucuucucucucaauuuuauc

SEQ ID NO: 2241772 - RNA, 13 nt, Human
ucuuccugacacu

SEQ ID NO: 2241773 - RNA, 16 nt, Human
ucuuccugacacuuua

SEQ ID NO: 2241774 - RNA, 15 nt, Human
ucuuccugacacuuu

SEQ ID NO: 2241775 - RNA, 14 nt, Human
ucuuccugaguggu

SEQ ID NO: 2241776 - RNA, 18 nt, Human
ucuuccugaguggugcca

SEQ ID NO: 2241777 - RNA, 18 nt, Human
ucuuccugcaaggacuac

SEQ ID NO: 2241778 - RNA, 18 nt, Human
agaccuguuagcagacag

SEQ ID NO: 2241779 - RNA, 17 nt, Human
agaccuguccuccuggu

SEQ ID NO: 2241780 - RNA, 15 nt, Human
agaccuguccuccug

SEQ ID NO: 2241781 - RNA, 18 nt, Human
agaccuggcagcucugga

SEQ ID NO: 2241782 - RNA, 17 nt, Human
agaccuggcagcucugg

SEQ ID NO: 2241783 - RNA, 23 nt, Human
agaccuggcagcucuggacagcc

SEQ ID NO: 2241784 - RNA, 13 nt, Human
agaccuguaauca

SEQ ID NO: 2241785 - RNA, 22 nt, Human
agaccuggcaaggacacagaug

SEQ ID NO: 2241786 - RNA, 12 nt, Human
agaccccuggcc

SEQ ID NO: 2241787 - RNA, 13 nt, Human
agaccccuggccu

SEQ ID NO: 2241788 - RNA, 14 nt, Human
agaccccuggccuc

SEQ ID NO: 2241789 - RNA, 16 nt, Human
agaccccuggccuccg

SEQ ID NO: 2241790 - RNA, 16 nt, Human
agaccuggcagcucug

SEQ ID NO: 2241791 - RNA, 15 nt, Human
agaccuggcagcucu

SEQ ID NO: 2241792 - RNA, 14 nt, Human
agaccuggcagcuc

SEQ ID NO: 2241793 - RNA, 11 nt, Human
agaccuggcag

SEQ ID NO: 2241794 - RNA, 11 nt, Human
agaccuucucc

SEQ ID NO: 2241795 - RNA, 19 nt, Human
agaccuguuagcagacagg

SEQ ID NO: 2241796 - RNA, 21 nt, Human
agaccuguugguuccaagccc

SEQ ID NO: 2241797 - RNA, 16 nt, Human
agaccuucaccaaaca

SEQ ID NO: 2241798 - RNA, 13 nt, Human
agaccuuccauaa

SEQ ID NO: 2241799 - RNA, 22 nt, Human
agaccuuccauaaugcuacugu

SEQ ID NO: 2241800 - RNA, 23 nt, Human
agaccuuccauaaugcuacuguc

SEQ ID NO: 2241801 - RNA, 18 nt, Human
agaccuucuaggacgcca

SEQ ID NO: 2241802 - RNA, 15 nt, Human
agaccuucuccuuca

SEQ ID NO: 2241803 - RNA, 18 nt, Human
agaccuucuccuucaccu

SEQ ID NO: 2241804 - RNA, 19 nt, Human
agaccuucuccaaaugaga

SEQ ID NO: 2241805 - RNA, 23 nt, Human
agaccuuggaucagaugaacucu

SEQ ID NO: 2241806 - RNA, 18 nt, Human
agaccuucuccaaaugag

SEQ ID NO: 2241807 - RNA, 16 nt, Human
agaccuucuccaaaug

SEQ ID NO: 2241808 - RNA, 18 nt, Human
agaccuuguuacuucuga

SEQ ID NO: 2241809 - RNA, 15 nt, Human
agaccuuguguguau

SEQ ID NO: 2241810 - RNA, 18 nt, Human
agaccuuguguguaugug

SEQ ID NO: 2241811 - RNA, 19 nt, Human
agaccuuguuacuucugag

SEQ ID NO: 2241812 - RNA, 21 nt, Human
agaccuuguuacuucugaggu

SEQ ID NO: 2241813 - RNA, 22 nt, Human
agaccuuguuacuucugaggua

SEQ ID NO: 2241814 - RNA, 16 nt, Human
agaccuuguucacacu

SEQ ID NO: 2241815 - RNA, 20 nt, Human
agaccuuguucacacucuca

SEQ ID NO: 2241816 - RNA, 21 nt, Human
agaccuucuccuucaccuuug

SEQ ID NO: 2241817 - RNA, 23 nt, Human
agaccuucuccuucaccuuuguc

SEQ ID NO: 2241818 - RNA, 14 nt, Human
agacuauucaaaca

SEQ ID NO: 2241819 - RNA, 12 nt, Human
agacuauucaaa

SEQ ID NO: 2241820 - RNA, 15 nt, Human
agacuauucaaacag

SEQ ID NO: 2241821 - RNA, 16 nt, Human
agacuauucaaacagu

SEQ ID NO: 2241822 - RNA, 21 nt, Human
agaccuuguucacacucucac

SEQ ID NO: 2241823 - RNA, 14 nt, Human
ucuugagggagcuu

SEQ ID NO: 2241824 - RNA, 16 nt, Human
ucuugaggccaggagu

SEQ ID NO: 2241825 - RNA, 15 nt, Human
ucuugaggccaggag

SEQ ID NO: 2241826 - RNA, 22 nt, Human
ucuugagcaguggcugguccag

SEQ ID NO: 2241827 - RNA, 13 nt, Human
ucuugaguuuguc

SEQ ID NO: 2241828 - RNA, 14 nt, Human
ucuugaguuugucg

SEQ ID NO: 2241829 - RNA, 20 nt, Human
ucuugaguuugucgcucaug

SEQ ID NO: 2241830 - RNA, 20 nt, Human
ucuugagguacucugcacau

SEQ ID NO: 2241831 - RNA, 13 nt, Human
ucuugauucauaa

SEQ ID NO: 2241832 - RNA, 23 nt, Human
ucuugauuauccauauugaguca

SEQ ID NO: 2241833 - RNA, 14 nt, Human
ucuugauuauccau

SEQ ID NO: 2241834 - RNA, 21 nt, Human
ucuugaugccuggcggggugg

SEQ ID NO: 2241835 - RNA, 16 nt, Human
ucuugauguugcuuag

SEQ ID NO: 2241836 - RNA, 18 nt, Human
ucuugauguggugaggca

SEQ ID NO: 2241837 - RNA, 19 nt, Human
agacucaccucugccucaa

SEQ ID NO: 2241838 - RNA, 20 nt, Human
agacucaggccaagaaacgu

SEQ ID NO: 2241839 - RNA, 19 nt, Human
agacucaggccaagaaacg

SEQ ID NO: 2241840 - RNA, 15 nt, Human
agacucagacuccau

SEQ ID NO: 2241841 - RNA, 18 nt, Human
agacucaccucugccuca

SEQ ID NO: 2241842 - RNA, 17 nt, Human
agacucaccucugccuc

SEQ ID NO: 2241843 - RNA, 16 nt, Human
agacucaccucugccu

SEQ ID NO: 2241844 - RNA, 17 nt, Human
agacucagggccccagc

SEQ ID NO: 2241845 - RNA, 16 nt, Human
agacucagggccccag

SEQ ID NO: 2241846 - RNA, 12 nt, Human
agacucagggcc

SEQ ID NO: 2241847 - RNA, 23 nt, Human
agacucaggccaagaaacgucuu

SEQ ID NO: 2241848 - RNA, 20 nt, Human
agacucagggccccagcacu

SEQ ID NO: 2241849 - RNA, 18 nt, Human
agacucagggccccagca

SEQ ID NO: 2241850 - RNA, 21 nt, Human
agacucagggccccagcacua

SEQ ID NO: 2241851 - RNA, 16 nt, Human
ucuugacuacagucag

SEQ ID NO: 2241852 - RNA, 16 nt, Human
ucuugagccugggagg

SEQ ID NO: 2241853 - RNA, 13 nt, Human
ucuugagccuggg

SEQ ID NO: 2241854 - RNA, 16 nt, Human
ucuugagaugucuucu

SEQ ID NO: 2241855 - RNA, 17 nt, Human
ucuugagcaaguuccuu

SEQ ID NO: 2241856 - RNA, 14 nt, Human
ucuugagcaguggc

SEQ ID NO: 2241857 - RNA, 20 nt, Human
ucuugagccuugaacuuuga

SEQ ID NO: 2241858 - RNA, 16 nt, Human
ucuugagccuugaacu

SEQ ID NO: 2241859 - RNA, 17 nt, Human
ucuuggcuuggugagga

SEQ ID NO: 2241860 - RNA, 19 nt, Human
ucuuggcuuacugcagccu

SEQ ID NO: 2241861 - RNA, 11 nt, Human
ucuugggaaau

SEQ ID NO: 2241862 - RNA, 15 nt, Human
ucuuggcuuucaugu

SEQ ID NO: 2241863 - RNA, 16 nt, Human
ucuuggcuuucauguu

SEQ ID NO: 2241864 - RNA, 12 nt, Human
ucuugggaaaua

SEQ ID NO: 2241865 - RNA, 14 nt, Human
ucuugggaaauaug

SEQ ID NO: 2241866 - RNA, 19 nt, Human
ucuugggaaauaugaaugc

SEQ ID NO: 2241867 - RNA, 20 nt, Human
ucuugggaaauaugaaugcc

SEQ ID NO: 2241868 - RNA, 13 nt, Human
ucuuggcagucac

SEQ ID NO: 2241869 - RNA, 21 nt, Human
ucuuggcccgcacagagcugg

SEQ ID NO: 2241870 - RNA, 18 nt, Human
ucuuggcccgcacagagc

SEQ ID NO: 2241871 - RNA, 15 nt, Human
ucuuggcggcagcag

SEQ ID NO: 2241872 - RNA, 18 nt, Human
ucuuggcggcagcagcca

SEQ ID NO: 2241873 - RNA, 19 nt, Human
ucuuggcggcagcagccau

SEQ ID NO: 2241874 - RNA, 13 nt, Human
ucuuggcucacug

SEQ ID NO: 2241875 - RNA, 19 nt, Human
ucuugcaauggcagccuug

SEQ ID NO: 2241876 - RNA, 18 nt, Human
ucuugcaauggcagccuu

SEQ ID NO: 2241877 - RNA, 22 nt, Human
ucuugcaauggcagccuuggca

SEQ ID NO: 2241878 - RNA, 19 nt, Human
ucuuggcagcaccugucuc

SEQ ID NO: 2241879 - RNA, 18 nt, Human
ucuuggcagcaccugucu

SEQ ID NO: 2241880 - RNA, 13 nt, Human
ucuugggcccucc

SEQ ID NO: 2241881 - RNA, 11 nt, Human
ucuugggcccu

SEQ ID NO: 2241882 - RNA, 23 nt, Human
ucuugggcagagcuggcucugag

SEQ ID NO: 2241883 - RNA, 17 nt, Human
ucuuggggacaucucuu

SEQ ID NO: 2241884 - RNA, 21 nt, Human
ucuuggggacaucucuuugaa

SEQ ID NO: 2241885 - RNA, 19 nt, Human
ucuugggcagagcuggcuc

SEQ ID NO: 2241886 - RNA, 20 nt, Human
ucuugggcagagcuggcucu

SEQ ID NO: 2241887 - RNA, 21 nt, Human
ucuugggcagagcuggcucug

SEQ ID NO: 2241888 - RNA, 16 nt, Human
ucuugggacuggguuu

SEQ ID NO: 2241889 - RNA, 22 nt, Human
ucuugggacuggguuuggaccc

SEQ ID NO: 2241890 - RNA, 14 nt, Human
ucuugggaacugaa

SEQ ID NO: 2241891 - RNA, 13 nt, Human
ucuugggaacuga

SEQ ID NO: 2241892 - RNA, 17 nt, Human
ucuuggucagauuugaa

SEQ ID NO: 2241893 - RNA, 14 nt, Human
ucuugguccugcug

SEQ ID NO: 2241894 - RNA, 14 nt, Human
ucuugguaagaagc

SEQ ID NO: 2241895 - RNA, 16 nt, Human
ucuugggucuaugccu

SEQ ID NO: 2241896 - RNA, 16 nt, Human
ucuuggguaggcggga

SEQ ID NO: 2241897 - RNA, 20 nt, Human
ucuuggggggguggccgcug

SEQ ID NO: 2241898 - RNA, 20 nt, Human
ucuugggggacagggcuggc

SEQ ID NO: 2241899 - RNA, 21 nt, Human
ucuugggggacagggcuggcc

SEQ ID NO: 2241900 - RNA, 22 nt, Human
ucuugggggacagggcuggccc

SEQ ID NO: 2241901 - RNA, 19 nt, Human
ucuuggggggguggccgcu

SEQ ID NO: 2241902 - RNA, 23 nt, Human
ucuugggggacagggcuggccca

SEQ ID NO: 2241903 - RNA, 24 nt, Human
ucuugggggacagggcuggcccag

SEQ ID NO: 2241904 - RNA, 15 nt, Human
ucuuuaugacuguuu

SEQ ID NO: 2241905 - RNA, 16 nt, Human
ucuuuauuaaucacua

SEQ ID NO: 2241906 - RNA, 13 nt, Human
ucuuuauugagaa

SEQ ID NO: 2241907 - RNA, 14 nt, Human
ucuuuauugagaaa

SEQ ID NO: 2241908 - RNA, 15 nt, Human
ucuuuauugagaaag

SEQ ID NO: 2241909 - RNA, 16 nt, Human
ucuuuauugagaaaga

SEQ ID NO: 2241910 - RNA, 19 nt, Human
ucuuuauugagaaagagca

SEQ ID NO: 2241911 - RNA, 15 nt, Human
ucuuuccuucuugcc

SEQ ID NO: 2241912 - RNA, 10 nt, Human
ucuuuccuug

SEQ ID NO: 2241913 - RNA, 13 nt, Human
ucuuuccuugcuc

SEQ ID NO: 2241914 - RNA, 18 nt, Human
ucuuuccuguuguuguua

SEQ ID NO: 2241915 - RNA, 11 nt, Human
ucuuuccuguc

SEQ ID NO: 2241916 - RNA, 14 nt, Human
ucuuuccugccuuc

SEQ ID NO: 2241917 - RNA, 16 nt, Human
ucuuuccugccuucuu

SEQ ID NO: 2241918 - RNA, 17 nt, Human
ucuuuccugaggcuggg

SEQ ID NO: 2241919 - RNA, 21 nt, Human
ucuuucuaacuccagugaagu

SEQ ID NO: 2241920 - RNA, 17 nt, Human
ucuuucgcacagcaguu

SEQ ID NO: 2241921 - RNA, 18 nt, Human
ucuuucuaaugugugaau

SEQ ID NO: 2241922 - RNA, 15 nt, Human
ucuugguagagauuc

SEQ ID NO: 2241923 - RNA, 15 nt, Human
ucuuuaacucauaaa

SEQ ID NO: 2241924 - RNA, 15 nt, Human
ucuuuaaucuucagu

SEQ ID NO: 2241925 - RNA, 14 nt, Human
ucuuuaaucuucag

SEQ ID NO: 2241926 - RNA, 23 nt, Human
ucuuuaaucauuuugccucuuuu

SEQ ID NO: 2241927 - RNA, 15 nt, Human
ucuuuauaugaagaa

SEQ ID NO: 2241928 - RNA, 11 nt, Human
ucuuuauauga

SEQ ID NO: 2241929 - RNA, 20 nt, Human
ucuuuaacuuaauugcuaug

SEQ ID NO: 2241930 - RNA, 14 nt, Human
ucuuuaagaaagua

SEQ ID NO: 2241931 - RNA, 15 nt, Human
ucuugguccugcugc

SEQ ID NO: 2241932 - RNA, 17 nt, Human
ucuugguccugcugcag

SEQ ID NO: 2241933 - RNA, 19 nt, Human
ucuugguccugcugcaguu

SEQ ID NO: 2241934 - RNA, 22 nt, Human
ucuugguaaauuuccccaacag

SEQ ID NO: 2241935 - RNA, 14 nt, Human
ucuugguagagauu

SEQ ID NO: 2241936 - RNA, 14 nt, Human
ucuugguauucuua

SEQ ID NO: 2241937 - RNA, 11 nt, Human
agagcugaggc

SEQ ID NO: 2241938 - RNA, 23 nt, Human
agagcugacacaaaccugccugg

SEQ ID NO: 2241939 - RNA, 23 nt, Human
agagcugacacaggaugaaggca

SEQ ID NO: 2241940 - RNA, 13 nt, Human
agagcugauccag

SEQ ID NO: 2241941 - RNA, 14 nt, Human
agagcugauccaga

SEQ ID NO: 2241942 - RNA, 17 nt, Human
agagcugauccagagca

SEQ ID NO: 2241943 - RNA, 18 nt, Human
agagcugauccagagcac

SEQ ID NO: 2241944 - RNA, 15 nt, Human
agagcucuccagcuc

SEQ ID NO: 2241945 - RNA, 18 nt, Human
agagcugacacaaaccug

SEQ ID NO: 2241946 - RNA, 20 nt, Human
agagcugacacaaaccugcc

SEQ ID NO: 2241947 - RNA, 22 nt, Human
agagcugacacaaaccugccug

SEQ ID NO: 2241948 - RNA, 14 nt, Human
agagcugccaccug

SEQ ID NO: 2241949 - RNA, 19 nt, Human
agagcugauccagagcaca

SEQ ID NO: 2241950 - RNA, 21 nt, Human
agagcugauccagagcacaga

SEQ ID NO: 2241951 - RNA, 16 nt, Human
agagcucuccagcucc

SEQ ID NO: 2241952 - RNA, 14 nt, Human
agagcucuccagcu

SEQ ID NO: 2241953 - RNA, 20 nt, Human
agagcucccggcguggugga

SEQ ID NO: 2241954 - RNA, 23 nt, Human
agagcuauuuaauggccggcugg

SEQ ID NO: 2241955 - RNA, 14 nt, Human
agagcuagcgcugc

SEQ ID NO: 2241956 - RNA, 13 nt, Human
agagcuagcgcug

SEQ ID NO: 2241957 - RNA, 18 nt, Human
agagcuagaaccuggagg

SEQ ID NO: 2241958 - RNA, 22 nt, Human
agagcuagaaccuggagggcua

SEQ ID NO: 2241959 - RNA, 21 nt, Human
agagcuagcgcugccgcaccc

SEQ ID NO: 2241960 - RNA, 16 nt, Human
agagcuagcgcugccg

SEQ ID NO: 2241961 - RNA, 20 nt, Human
agagcuagcagcagggaggg

SEQ ID NO: 2241962 - RNA, 18 nt, Human
agagcuagaacauggaga

SEQ ID NO: 2241963 - RNA, 19 nt, Human
agagcuagaacauggagag

SEQ ID NO: 2241964 - RNA, 22 nt, Human
agagcuagaacauggagagcua

SEQ ID NO: 2241965 - RNA, 23 nt, Human
agagcuagaacccggcaggcuag

SEQ ID NO: 2241966 - RNA, 16 nt, Human
agagcuagaaccugga

SEQ ID NO: 2241967 - RNA, 18 nt, Human
agagcuagaaccuggaga

SEQ ID NO: 2241968 - RNA, 22 nt, Human
agagcuagaaccuggagaacua

SEQ ID NO: 2241969 - RNA, 19 nt, Human
agagcuagaaccuggagag

SEQ ID NO: 2241970 - RNA, 23 nt, Human
agagccaggggggugaggagcug

SEQ ID NO: 2241971 - RNA, 20 nt, Human
agagccaggcacacacugug

SEQ ID NO: 2241972 - RNA, 16 nt, Human
agagcuacuugggcca

SEQ ID NO: 2241973 - RNA, 21 nt, Human
agagcuacuugggccauagcu

SEQ ID NO: 2241974 - RNA, 17 nt, Human
agagcuagaacauggag

SEQ ID NO: 2241975 - RNA, 13 nt, Human
agagccuuccagg

SEQ ID NO: 2241976 - RNA, 15 nt, Human
agagccuuccagggg

SEQ ID NO: 2241977 - RNA, 17 nt, Human
agagccuuccaggggug

SEQ ID NO: 2241978 - RNA, 22 nt, Human
agagccuuccaggggugggaca

SEQ ID NO: 2241979 - RNA, 21 nt, Human
agagccagcccucccuguccu

SEQ ID NO: 2241980 - RNA, 20 nt, Human
agagccagcccucccugucc

SEQ ID NO: 2241981 - RNA, 17 nt, Human
agagccagcccucccug

SEQ ID NO: 2241982 - RNA, 16 nt, Human
agagccagcccucccu

SEQ ID NO: 2241983 - RNA, 14 nt, Human
agagccagcccucc

SEQ ID NO: 2241984 - RNA, 13 nt, Human
agagccagcccuc

SEQ ID NO: 2241985 - RNA, 12 nt, Human
agagccagcccu

SEQ ID NO: 2241986 - RNA, 13 nt, Human
agagccagcaacu

SEQ ID NO: 2241987 - RNA, 23 nt, Human
agagcauccugcuucuaccaugu

SEQ ID NO: 2241988 - RNA, 17 nt, Human
agagcauuacgugagcc

SEQ ID NO: 2241989 - RNA, 20 nt, Human
agagccagagaagugacagg

SEQ ID NO: 2241990 - RNA, 21 nt, Human
agagccagagaagugacaggg

SEQ ID NO: 2241991 - RNA, 22 nt, Human
agagccagcccucccuguccuc

SEQ ID NO: 2241992 - RNA, 13 nt, Human
agagccagcuccc

SEQ ID NO: 2241993 - RNA, 22 nt, Human
agagccaggggggugaggagcu

SEQ ID NO: 2241994 - RNA, 19 nt, Human
agagccaggcacacacugu

SEQ ID NO: 2241995 - RNA, 13 nt, Human
agagccaggcaca

SEQ ID NO: 2241996 - RNA, 22 nt, Human
agagcaguuucuguccugcugg

SEQ ID NO: 2241997 - RNA, 23 nt, Human
agagcaguuucuguccugcuggu

SEQ ID NO: 2241998 - RNA, 14 nt, Human
agagcaagacucug

SEQ ID NO: 2241999 - RNA, 14 nt, Human
agagcaacucugag

SEQ ID NO: 2242000 - RNA, 14 nt, Human
agagcaccuuccuc

SEQ ID NO: 2242001 - RNA, 20 nt, Human
agagcaccuuccucacuucc

SEQ ID NO: 2242002 - RNA, 21 nt, Human
agagcaccuuccucacuucca

SEQ ID NO: 2242003 - RNA, 23 nt, Human
agagcaccuuagacagucccugc

SEQ ID NO: 2242004 - RNA, 22 nt, Human
agagcaccuuagacagucccug

SEQ ID NO: 2242005 - RNA, 21 nt, Human
agagcaccuuagacagucccu

SEQ ID NO: 2242006 - RNA, 17 nt, Human
agagcagccuguggcau

SEQ ID NO: 2242007 - RNA, 16 nt, Human
agagcagccuguggca

SEQ ID NO: 2242008 - RNA, 12 nt, Human
agagcagccugu

SEQ ID NO: 2242009 - RNA, 23 nt, Human
agagcagcagugaaaacaagugc

SEQ ID NO: 2242010 - RNA, 19 nt, Human
agagcagcagugaaaacaa

SEQ ID NO: 2242011 - RNA, 19 nt, Human
agagcagccuguggcaucu

SEQ ID NO: 2242012 - RNA, 23 nt, Human
agagcagcggggcgaagcccagg

SEQ ID NO: 2242013 - RNA, 13 nt, Human
agagcagcuucug

SEQ ID NO: 2242014 - RNA, 20 nt, Human
agagcagcuucugccacuuc

SEQ ID NO: 2242015 - RNA, 23 nt, Human
agagcagcuucugccacuuccca

SEQ ID NO: 2242016 - RNA, 18 nt, Human
agagcagcuuuaaacuca

SEQ ID NO: 2242017 - RNA, 23 nt, Human
agagcaggaagcauucagagagc

SEQ ID NO: 2242018 - RNA, 20 nt, Human
agagcagcuuuaaacucagg

SEQ ID NO: 2242019 - RNA, 21 nt, Human
agagcagcuuuaaacucaggg

SEQ ID NO: 2242020 - RNA, 18 nt, Human
agagcaggaagcauucag

SEQ ID NO: 2242021 - RNA, 20 nt, Human
agagcaggaagcauucagag

SEQ ID NO: 2242022 - RNA, 20 nt, Human
agagacucagggccccagca

SEQ ID NO: 2242023 - RNA, 19 nt, Human
agagacucagggccccagc

SEQ ID NO: 2242024 - RNA, 16 nt, Human
agagacuccagcuggg

SEQ ID NO: 2242025 - RNA, 15 nt, Human
agagacuccugcagg

SEQ ID NO: 2242026 - RNA, 17 nt, Human
agagacuccugcaggca

SEQ ID NO: 2242027 - RNA, 18 nt, Human
agagacuccugcaggcag

SEQ ID NO: 2242028 - RNA, 19 nt, Human
agagacuccugcaggcagc

SEQ ID NO: 2242029 - RNA, 20 nt, Human
agagacuccugcaggcagcc

SEQ ID NO: 2242030 - RNA, 21 nt, Human
agagacuccugcaggcagcca

SEQ ID NO: 2242031 - RNA, 22 nt, Human
agagacuccugcaggcagccag

SEQ ID NO: 2242032 - RNA, 23 nt, Human
ugaaacuuauuuuuuucugauug

SEQ ID NO: 2242033 - RNA, 21 nt, Human
ugaaacuuauuuuuuucugau

SEQ ID NO: 2242034 - RNA, 22 nt, Human
ugaaacuuauuuuuuucugauu

SEQ ID NO: 2242035 - RNA, 20 nt, Human
ugaaagaacauggacuugua

SEQ ID NO: 2242036 - RNA, 17 nt, Human
ugaaagaccuucuccaa

SEQ ID NO: 2242037 - RNA, 12 nt, Human
ugaaagaccuuc

SEQ ID NO: 2242038 - RNA, 19 nt, Human
ugaaagaccuucuccaaau

SEQ ID NO: 2242039 - RNA, 16 nt, Human
agagaccucaucagga

SEQ ID NO: 2242040 - RNA, 19 nt, Human
agagaccucaucaggauga

SEQ ID NO: 2242041 - RNA, 15 nt, Human
agagaccuccugccu

SEQ ID NO: 2242042 - RNA, 14 nt, Human
agagacguguacau

SEQ ID NO: 2242043 - RNA, 15 nt, Human
ugaaagacuguacaa

SEQ ID NO: 2242044 - RNA, 13 nt, Human
ugaaagacuguac

SEQ ID NO: 2242045 - RNA, 20 nt, Human
agagcaaaauugauguguuu

SEQ ID NO: 2242046 - RNA, 19 nt, Human
agagcaagacgcugugcug

SEQ ID NO: 2242047 - RNA, 23 nt, Human
agagcaagacgcugugcugcccu

SEQ ID NO: 2242048 - RNA, 19 nt, Human
agagaucaaauggaaagga

SEQ ID NO: 2242049 - RNA, 15 nt, Human
agagauggaggagga

SEQ ID NO: 2242050 - RNA, 21 nt, Human
agagaucauccuuuccagcau

SEQ ID NO: 2242051 - RNA, 18 nt, Human
agagauggaggaggaggc

SEQ ID NO: 2242052 - RNA, 20 nt, Human
agagauggccugagaagaga

SEQ ID NO: 2242053 - RNA, 22 nt, Human
agagaugggacugggagggccc

SEQ ID NO: 2242054 - RNA, 16 nt, Human
agagaugggacuggga

SEQ ID NO: 2242055 - RNA, 19 nt, Human
agagaugggaaugaggugg

SEQ ID NO: 2242056 - RNA, 23 nt, Human
agagaugggacugggagggccca

SEQ ID NO: 2242057 - RNA, 15 nt, Human
agagaugggagcucc

SEQ ID NO: 2242058 - RNA, 17 nt, Human
agagaugggagcuccuc

SEQ ID NO: 2242059 - RNA, 19 nt, Human
agagaugggagcuccucuc

SEQ ID NO: 2242060 - RNA, 20 nt, Human
agagaugggagcuccucucc

SEQ ID NO: 2242061 - RNA, 21 nt, Human
agagaugggagcuccucuccu

SEQ ID NO: 2242062 - RNA, 24 nt, Human
agagaugggagcuccucuccugga

SEQ ID NO: 2242063 - RNA, 17 nt, Human
agagaugugcacccaug

SEQ ID NO: 2242064 - RNA, 14 nt, Human
agagaugugcaccc

SEQ ID NO: 2242065 - RNA, 15 nt, Human
agagaugugcaccca

SEQ ID NO: 2242066 - RNA, 21 nt, Human
agagagaaagaaguaggcaug

SEQ ID NO: 2242067 - RNA, 14 nt, Human
agagagaaagccag

SEQ ID NO: 2242068 - RNA, 22 nt, Human
agagagaaaauaaaaaguuaaa

SEQ ID NO: 2242069 - RNA, 20 nt, Human
agagagaaaauaaaaaguua

SEQ ID NO: 2242070 - RNA, 18 nt, Human
agagagaaaauaaaaagu

SEQ ID NO: 2242071 - RNA, 17 nt, Human
agagagaaaauaaaaag

SEQ ID NO: 2242072 - RNA, 16 nt, Human
agagagaaaauaaaaa

SEQ ID NO: 2242073 - RNA, 15 nt, Human
agagagaaaauaaaa

SEQ ID NO: 2242074 - RNA, 23 nt, Human
agagacuccugcaggcagccagg

SEQ ID NO: 2242075 - RNA, 14 nt, Human
agagagaaaauaaa

SEQ ID NO: 2242076 - RNA, 13 nt, Human
agagagaaaauaa

SEQ ID NO: 2242077 - RNA, 18 nt, Human
agagagaagacccuucuc

SEQ ID NO: 2242078 - RNA, 13 nt, Human
agagauauuuuaa

SEQ ID NO: 2242079 - RNA, 17 nt, Human
agagauauuuuaaaaug

SEQ ID NO: 2242080 - RNA, 20 nt, Human
agagauauuuuaaaaugaga

SEQ ID NO: 2242081 - RNA, 20 nt, Human
agagagaacaacuacuguga

SEQ ID NO: 2242082 - RNA, 22 nt, Human
agagagaaagccaggcagguag

SEQ ID NO: 2242083 - RNA, 15 nt, Human
agagagaaagccagg

SEQ ID NO: 2242084 - RNA, 16 nt, Human
agagagaaagccaggc

SEQ ID NO: 2242085 - RNA, 22 nt, Human
agagaucaaccccuucgcuccu

SEQ ID NO: 2242086 - RNA, 18 nt, Human
agagauauuuuaaaauga

SEQ ID NO: 2242087 - RNA, 15 nt, Human
agagaucaaauggaa

SEQ ID NO: 2242088 - RNA, 13 nt, Human
ugaaaaagcaugu

SEQ ID NO: 2242089 - RNA, 21 nt, Human
ugaaaaagcagcuaccaggug

SEQ ID NO: 2242090 - RNA, 14 nt, Human
ugaaaaagcaugua

SEQ ID NO: 2242091 - RNA, 15 nt, Human
ugaaaaagcauguac

SEQ ID NO: 2242092 - RNA, 16 nt, Human
ugaaaaagcauguaca

SEQ ID NO: 2242093 - RNA, 17 nt, Human
ugaaaaagcauguacag

SEQ ID NO: 2242094 - RNA, 22 nt, Human
ugaaaaagaccuuuggagcaaa

SEQ ID NO: 2242095 - RNA, 16 nt, Human
ugaaaaaggaggaaga

SEQ ID NO: 2242096 - RNA, 18 nt, Human
ugaaaaagcauguacagu

SEQ ID NO: 2242097 - RNA, 20 nt, Human
ugaaaaagcauguacagugu

SEQ ID NO: 2242098 - RNA, 21 nt, Human
ugaaaaagcauguacaguguu

SEQ ID NO: 2242099 - RNA, 23 nt, Human
ugaaaaagcauguacaguguucu

SEQ ID NO: 2242100 - RNA, 12 nt, Human
ugaaaaacuucc

SEQ ID NO: 2242101 - RNA, 18 nt, Human
ugaaaaaauguauaugca

SEQ ID NO: 2242102 - RNA, 23 nt, Human
ugaaaaaauauauaucaaauaua

SEQ ID NO: 2242103 - RNA, 18 nt, Human
ugaaaaaaggacaauuuc

SEQ ID NO: 2242104 - RNA, 22 nt, Human
ugaaaaaauagagccugaggga

SEQ ID NO: 2242105 - RNA, 21 nt, Human
ugaaaaaaggacaauuucaaa

SEQ ID NO: 2242106 - RNA, 16 nt, Human
ugaaaaaaaguuuaca

SEQ ID NO: 2242107 - RNA, 17 nt, Human
ugaaaaaaaguuuacaa

SEQ ID NO: 2242108 - RNA, 16 nt, Human
ugaaaaaaaaguuuca

SEQ ID NO: 2242109 - RNA, 14 nt, Human
ugaaaaaaaaguuu

SEQ ID NO: 2242110 - RNA, 18 nt, Human
ucuuuuacucaugaucuu

SEQ ID NO: 2242111 - RNA, 14 nt, Human
ucuuuuacauucug

SEQ ID NO: 2242112 - RNA, 12 nt, Human
ucuuuuacaacu

SEQ ID NO: 2242113 - RNA, 21 nt, Human
ucuuuuaaaagacaagacuuc

SEQ ID NO: 2242114 - RNA, 14 nt, Human
ucuuuuaaaagaca

SEQ ID NO: 2242115 - RNA, 16 nt, Human
ucuuuuaaaagacaag

SEQ ID NO: 2242116 - RNA, 15 nt, Human
ucuuuguuacaggca

SEQ ID NO: 2242117 - RNA, 21 nt, Human
ucuuuguuaucaaacuucagc

SEQ ID NO: 2242118 - RNA, 16 nt, Human
ucuuuguucauagccc

SEQ ID NO: 2242119 - RNA, 23 nt, Human
ucuuuguucauagcccaguagac

SEQ ID NO: 2242120 - RNA, 12 nt, Human
ucuuuguucuca

SEQ ID NO: 2242121 - RNA, 16 nt, Human
ucuuuguucucagcuc

SEQ ID NO: 2242122 - RNA, 17 nt, Human
ucuuuguucucagcucc

SEQ ID NO: 2242123 - RNA, 18 nt, Human
ucuuuguucucagcuccc

SEQ ID NO: 2242124 - RNA, 19 nt, Human
ucuuuguucucagcucccc

SEQ ID NO: 2242125 - RNA, 20 nt, Human
ucuuuguucucagcuccccc

SEQ ID NO: 2242126 - RNA, 18 nt, Human
ucuuuguuggaaaagaau

SEQ ID NO: 2242127 - RNA, 22 nt, Human
ucuuuguucucagcucccccug

SEQ ID NO: 2242128 - RNA, 18 nt, Human
ucuuuuaaaaauucaaau

SEQ ID NO: 2242129 - RNA, 19 nt, Human
ucuuuuaaaaauucaaaug

SEQ ID NO: 2242130 - RNA, 13 nt, Human
ucuuuuaaaagac

SEQ ID NO: 2242131 - RNA, 18 nt, Human
ucuuuguguagcuuugcu

SEQ ID NO: 2242132 - RNA, 15 nt, Human
ucuuuguguagcuuu

SEQ ID NO: 2242133 - RNA, 13 nt, Human
ucuuuguguagcu

SEQ ID NO: 2242134 - RNA, 13 nt, Human
ucuuuguaagagu

SEQ ID NO: 2242135 - RNA, 14 nt, Human
ucuuuguaagagug

SEQ ID NO: 2242136 - RNA, 18 nt, Human
ucuuuguaagaguguaga

SEQ ID NO: 2242137 - RNA, 17 nt, Human
ucuuugguggcuuugca

SEQ ID NO: 2242138 - RNA, 12 nt, Human
agagacauuccu

SEQ ID NO: 2242139 - RNA, 14 nt, Human
agagacauuccucc

SEQ ID NO: 2242140 - RNA, 22 nt, Human
ucuuuggucuacacugugcuga

SEQ ID NO: 2242141 - RNA, 18 nt, Human
agagacaggcccaagaga

SEQ ID NO: 2242142 - RNA, 15 nt, Human
agagacaggcccaag

SEQ ID NO: 2242143 - RNA, 20 nt, Human
agagacaggcccaagagaug

SEQ ID NO: 2242144 - RNA, 22 nt, Human
agagacaguugggugagaacaa

SEQ ID NO: 2242145 - RNA, 20 nt, Human
agagacaguugggugagaac

SEQ ID NO: 2242146 - RNA, 12 nt, Human
agagacagucac

SEQ ID NO: 2242147 - RNA, 23 nt, Human
agagacaguugggugagaacaac

SEQ ID NO: 2242148 - RNA, 23 nt, Human
agagacauacuugaagggccaga

SEQ ID NO: 2242149 - RNA, 22 nt, Human
agagacauacuugaagggccag

SEQ ID NO: 2242150 - RNA, 17 nt, Human
agagacauacuugaagg

SEQ ID NO: 2242151 - RNA, 23 nt, Human
agagacaggaaaauccucuggcu

SEQ ID NO: 2242152 - RNA, 14 nt, Human
agagacaggagggc

SEQ ID NO: 2242153 - RNA, 14 nt, Human
ucuuucuuagaaau

SEQ ID NO: 2242154 - RNA, 20 nt, Human
ucuuucuuacaaggaaggug

SEQ ID NO: 2242155 - RNA, 15 nt, Human
agagacaggagggca

SEQ ID NO: 2242156 - RNA, 14 nt, Human
ucuuucuguauuga

SEQ ID NO: 2242157 - RNA, 13 nt, Human
ucuuucugucccu

SEQ ID NO: 2242158 - RNA, 14 nt, Human
ucuuucugucccuu

SEQ ID NO: 2242159 - RNA, 13 nt, Human
ucuuucuuagaaa

SEQ ID NO: 2242160 - RNA, 16 nt, Human
ucuuucugaugucaaa

SEQ ID NO: 2242161 - RNA, 10 nt, Human
ucuuucugua

SEQ ID NO: 2242162 - RNA, 21 nt, Human
ucuuucuggcuaugcauuuga

SEQ ID NO: 2242163 - RNA, 20 nt, Human
ucuuucuggcuaugcauuug

SEQ ID NO: 2242164 - RNA, 18 nt, Human
ucuuucugagcacacuuu

SEQ ID NO: 2242165 - RNA, 19 nt, Human
ucuuucugagcacacuuua

SEQ ID NO: 2242166 - RNA, 21 nt, Human
ucuuucugagcacacuuuagu

SEQ ID NO: 2242167 - RNA, 23 nt, Human
ucuuucugauaacuagauggugc

SEQ ID NO: 2242168 - RNA, 20 nt, Human
ucuuucugauaacuagaugg

SEQ ID NO: 2242169 - RNA, 14 nt, Human
ucuuucugauaacu

SEQ ID NO: 2242170 - RNA, 11 nt, Human
ucuuucucugc

SEQ ID NO: 2242171 - RNA, 12 nt, Human
ucuuucucugcc

SEQ ID NO: 2242172 - RNA, 13 nt, Human
ucuuucucugcca

SEQ ID NO: 2242173 - RNA, 15 nt, Human
ucuuucucugccagu

SEQ ID NO: 2242174 - RNA, 16 nt, Human
ucuuucucugccagug

SEQ ID NO: 2242175 - RNA, 17 nt, Human
ucuuucucugccaguga

SEQ ID NO: 2242176 - RNA, 16 nt, Human
ugaaaaggugaccuug

SEQ ID NO: 2242177 - RNA, 23 nt, Human
ugaaaaggugaccuugcaacuuc

SEQ ID NO: 2242178 - RNA, 16 nt, Human
ugaaaauauaaccagc

SEQ ID NO: 2242179 - RNA, 14 nt, Human
ugaaaauauaacca

SEQ ID NO: 2242180 - RNA, 12 nt, Human
ugaaaagucaaa

SEQ ID NO: 2242181 - RNA, 14 nt, Human
ugaaaagucaaacu

SEQ ID NO: 2242182 - RNA, 20 nt, Human
ugaaaaguuacuaccuguca

SEQ ID NO: 2242183 - RNA, 16 nt, Human
ugaaaaucgugacaac

SEQ ID NO: 2242184 - RNA, 14 nt, Human
ugaaaauauuuaaa

SEQ ID NO: 2242185 - RNA, 13 nt, Human
ugaaaauauuuaa

SEQ ID NO: 2242186 - RNA, 12 nt, Human
ugaaaauauuua

SEQ ID NO: 2242187 - RNA, 11 nt, Human
ugaaaauauuu

SEQ ID NO: 2242188 - RNA, 20 nt, Human
ugaaaauaugauguuucaca

SEQ ID NO: 2242189 - RNA, 22 nt, Human
ugaaaaaguauccugcuucuga

SEQ ID NO: 2242190 - RNA, 22 nt, Human
ugaaaaaguucugcagauaaac

SEQ ID NO: 2242191 - RNA, 22 nt, Human
ugaaaaaggaggaagagaaaaa

SEQ ID NO: 2242192 - RNA, 20 nt, Human
ugaaaaaggaggaagagaaa

SEQ ID NO: 2242193 - RNA, 19 nt, Human
ugaaaaauuuaagcauugu

SEQ ID NO: 2242194 - RNA, 18 nt, Human
ugaaaaauuuaagcauug

SEQ ID NO: 2242195 - RNA, 13 nt, Human
ugaaaaauucuca

SEQ ID NO: 2242196 - RNA, 19 nt, Human
ugaaaaauuccuuuguguu

SEQ ID NO: 2242197 - RNA, 20 nt, Human
ugaaaaauuccuauugugau

SEQ ID NO: 2242198 - RNA, 22 nt, Human
ugaaaaauuccuauugugauuu

SEQ ID NO: 2242199 - RNA, 12 nt, Human
ugaaaaauuccu

SEQ ID NO: 2242200 - RNA, 20 nt, Human
ugaaaaaugugcaaaacagc

SEQ ID NO: 2242201 - RNA, 13 nt, Human
ugaaaaauuccua

SEQ ID NO: 2242202 - RNA, 18 nt, Human
ugaaaaaucggcuuacca

SEQ ID NO: 2242203 - RNA, 16 nt, Human
ugaaaaaugugcaaaa

SEQ ID NO: 2242204 - RNA, 16 nt, Human
ugaaacuuacacacaa

SEQ ID NO: 2242205 - RNA, 12 nt, Human
ugaaacuuauuu

SEQ ID NO: 2242206 - RNA, 12 nt, Human
ugaaacuuggau

SEQ ID NO: 2242207 - RNA, 22 nt, Human
ugaaacugagaugugaacacau

SEQ ID NO: 2242208 - RNA, 19 nt, Human
ugaaacucguuaauuugua

SEQ ID NO: 2242209 - RNA, 21 nt, Human
ugaaacuccaccuugcgggga

SEQ ID NO: 2242210 - RNA, 13 nt, Human
ugaaacuccaccu

SEQ ID NO: 2242211 - RNA, 18 nt, Human
ugaaaaugucagaaacca

SEQ ID NO: 2242212 - RNA, 15 nt, Human
ugaaaaugucagaaa

SEQ ID NO: 2242213 - RNA, 14 nt, Human
ugaaaaugucagaa

SEQ ID NO: 2242214 - RNA, 14 nt, Human
ugaaaaugucaaag

SEQ ID NO: 2242215 - RNA, 21 nt, Human
ugaaaaugucagaaaccaguu

SEQ ID NO: 2242216 - RNA, 13 nt, Human
ugaaaaugucuug

SEQ ID NO: 2242217 - RNA, 16 nt, Human
ugaaacgcaaccacca

SEQ ID NO: 2242218 - RNA, 15 nt, Human
ugaaaaugucuugug

SEQ ID NO: 2242219 - RNA, 14 nt, Human
ugaaaaugucuugu

SEQ ID NO: 2242220 - RNA, 14 nt, Human
ugaaaaucuaauau

SEQ ID NO: 2242221 - RNA, 15 nt, Human
ugaaaaucuaauauu

SEQ ID NO: 2242222 - RNA, 17 nt, Human
ugaaaaucuaauauuaa

SEQ ID NO: 2242223 - RNA, 21 nt, Human
ugaaaaucuaauauuaaaaau

SEQ ID NO: 2242224 - RNA, 12 nt, Human
ugaaaauguacu

SEQ ID NO: 2242225 - RNA, 13 nt, Human
ugaaaauguacug

SEQ ID NO: 2242226 - RNA, 16 nt, Human
ugaaaauguacugaga

SEQ ID NO: 2242227 - RNA, 17 nt, Human
ugaaaauguauguguaa

SEQ ID NO: 2242228 - RNA, 19 nt, Human
ugaaaaucgugacaacacu

SEQ ID NO: 2242229 - RNA, 20 nt, Human
ugaaaaucuuauaauuuaaa

SEQ ID NO: 2242230 - RNA, 21 nt, Human
agaagcugaagugcauccaaa

SEQ ID NO: 2242231 - RNA, 23 nt, Human
agaagcuccucuccccagcccag

SEQ ID NO: 2242232 - RNA, 22 nt, Human
agaagcuccucuccccagccca

SEQ ID NO: 2242233 - RNA, 13 nt, Human
agaaggagagaaa

SEQ ID NO: 2242234 - RNA, 17 nt, Human
agaaggagacagagcug

SEQ ID NO: 2242235 - RNA, 14 nt, Human
agaaggagacagag

SEQ ID NO: 2242236 - RNA, 15 nt, Human
agaaggagaaggaag

SEQ ID NO: 2242237 - RNA, 15 nt, Human
agaaggaauuugagu

SEQ ID NO: 2242238 - RNA, 22 nt, Human
agaaggaauucuaggcauccca

SEQ ID NO: 2242239 - RNA, 23 nt, Human
agaagcucccugaaguaagcaaa

SEQ ID NO: 2242240 - RNA, 18 nt, Human
agaagcucccaggaacaa

SEQ ID NO: 2242241 - RNA, 20 nt, Human
agaagcuccucuccccagcc

SEQ ID NO: 2242242 - RNA, 18 nt, Human
agaagcuccucuccccag

SEQ ID NO: 2242243 - RNA, 17 nt, Human
agaagcuccucucccca

SEQ ID NO: 2242244 - RNA, 14 nt, Human
agaagcuccucucc

SEQ ID NO: 2242245 - RNA, 16 nt, Human
agaaggauguacauuu

SEQ ID NO: 2242246 - RNA, 21 nt, Human
agaaggaugaaugagguccca

SEQ ID NO: 2242247 - RNA, 14 nt, Human
agaaggaugaauga

SEQ ID NO: 2242248 - RNA, 20 nt, Human
agaaggagucagaaacuguu

SEQ ID NO: 2242249 - RNA, 20 nt, Human
agaaggagacagagcugguu

SEQ ID NO: 2242250 - RNA, 14 nt, Human
agaaggagagaaag

SEQ ID NO: 2242251 - RNA, 18 nt, Human
agaaggagagaaaguggg

SEQ ID NO: 2242252 - RNA, 19 nt, Human
agaaggagagaaagugggu

SEQ ID NO: 2242253 - RNA, 17 nt, Human
agaaggauguacauuuc

SEQ ID NO: 2242254 - RNA, 11 nt, Human
agaaggcaaaa

SEQ ID NO: 2242255 - RNA, 18 nt, Human
agaagugacagggaagcu

SEQ ID NO: 2242256 - RNA, 19 nt, Human
agaagugacagggaagcua

SEQ ID NO: 2242257 - RNA, 22 nt, Human
agaagugacagggaagcuacag

SEQ ID NO: 2242258 - RNA, 23 nt, Human
agaagugacagggaagcuacagg

SEQ ID NO: 2242259 - RNA, 22 nt, Human
agaaguuugagaucagccuggg

SEQ ID NO: 2242260 - RNA, 16 nt, Human
agaaguuucuggcccu

SEQ ID NO: 2242261 - RNA, 23 nt, Human
agaaguuucuggcccuggcugac

SEQ ID NO: 2242262 - RNA, 17 nt, Human
agaaguuuaaggaauau

SEQ ID NO: 2242263 - RNA, 16 nt, Human
agaaguuuaaggaaua

SEQ ID NO: 2242264 - RNA, 15 nt, Human
agaaguuuaaggaau

SEQ ID NO: 2242265 - RNA, 19 nt, Human
agaaguugaaugggcacag

SEQ ID NO: 2242266 - RNA, 18 nt, Human
agaaguugauauagaaca

SEQ ID NO: 2242267 - RNA, 19 nt, Human
agaaguugauauagaacag

SEQ ID NO: 2242268 - RNA, 14 nt, Human
agaaguuguuuguc

SEQ ID NO: 2242269 - RNA, 15 nt, Human
agaaguggaccagga

SEQ ID NO: 2242270 - RNA, 19 nt, Human
agaagugccccugcugccu

SEQ ID NO: 2242271 - RNA, 22 nt, Human
agaagugccccugcugccuccc

SEQ ID NO: 2242272 - RNA, 16 nt, Human
agaagugccccugcug

SEQ ID NO: 2242273 - RNA, 14 nt, Human
agaagugccccugc

SEQ ID NO: 2242274 - RNA, 13 nt, Human
agaagugccccug

SEQ ID NO: 2242275 - RNA, 23 nt, Human
agaagugagcuuugcugcuacag

SEQ ID NO: 2242276 - RNA, 21 nt, Human
agaagugagaauaggcagccc

SEQ ID NO: 2242277 - RNA, 18 nt, Human
agaagugagaauaggcag

SEQ ID NO: 2242278 - RNA, 19 nt, Human
agaagugagcuuugcugcu

SEQ ID NO: 2242279 - RNA, 19 nt, Human
agaaguggaccaggacagg

SEQ ID NO: 2242280 - RNA, 18 nt, Human
agaaguggaccaggacag

SEQ ID NO: 2242281 - RNA, 17 nt, Human
agaaguggaccaggaca

SEQ ID NO: 2242282 - RNA, 13 nt, Human
agaaguugauaug

SEQ ID NO: 2242283 - RNA, 16 nt, Human
agaauauaaaaaacuu

SEQ ID NO: 2242284 - RNA, 13 nt, Human
agaauauaauacu

SEQ ID NO: 2242285 - RNA, 23 nt, Human
agaauauaauuaucggaagcagu

SEQ ID NO: 2242286 - RNA, 15 nt, Human
agaauauaauuaucg

SEQ ID NO: 2242287 - RNA, 14 nt, Human
agaauauaauuauc

SEQ ID NO: 2242288 - RNA, 14 nt, Human
agaaucaaaacucu

SEQ ID NO: 2242289 - RNA, 17 nt, Human
agaauauaauuaucgga

SEQ ID NO: 2242290 - RNA, 20 nt, Human
agaauauuuuaaguauugca

SEQ ID NO: 2242291 - RNA, 13 nt, Human
agaauauauacau

SEQ ID NO: 2242292 - RNA, 13 nt, Human
agaaucaaagcaa

SEQ ID NO: 2242293 - RNA, 19 nt, Human
agaaucaaagcaaugcauu

SEQ ID NO: 2242294 - RNA, 21 nt, Human
agaaucaaagcaaugcauuuu

SEQ ID NO: 2242295 - RNA, 21 nt, Human
agaaucaacauuucucaauaa

SEQ ID NO: 2242296 - RNA, 23 nt, Human
agaaucaacauuucucaauaauu

SEQ ID NO: 2242297 - RNA, 18 nt, Human
agaauacaguaagcugcu

SEQ ID NO: 2242298 - RNA, 19 nt, Human
agaauagccacauuuggaa

SEQ ID NO: 2242299 - RNA, 20 nt, Human
agaauagccacauuuggaau

SEQ ID NO: 2242300 - RNA, 21 nt, Human
agaauagccacauuuggaaua

SEQ ID NO: 2242301 - RNA, 21 nt, Human
agaauacagaaagauggaugu

SEQ ID NO: 2242302 - RNA, 22 nt, Human
agaauacaguaagcugcucuau

SEQ ID NO: 2242303 - RNA, 18 nt, Human
agaauacagaaagaugga

SEQ ID NO: 2242304 - RNA, 12 nt, Human
agaauacagaaa

SEQ ID NO: 2242305 - RNA, 16 nt, Human
agaauacaaacauauu

SEQ ID NO: 2242306 - RNA, 15 nt, Human
agaauacaaacauau

SEQ ID NO: 2242307 - RNA, 16 nt, Human
agaauaaucuuugggu

SEQ ID NO: 2242308 - RNA, 15 nt, Human
agaauaaugaaugga

SEQ ID NO: 2242309 - RNA, 15 nt, Human
agaaguuugucaagu

SEQ ID NO: 2242310 - RNA, 20 nt, Human
agaaguuugauauuaaagga

SEQ ID NO: 2242311 - RNA, 16 nt, Human
agaaguuuuguacaga

SEQ ID NO: 2242312 - RNA, 11 nt, Human
agaaguuuuug

SEQ ID NO: 2242313 - RNA, 12 nt, Human
agaaguuuuugu

SEQ ID NO: 2242314 - RNA, 14 nt, Human
agaaguuuuuguac

SEQ ID NO: 2242315 - RNA, 15 nt, Human
agaaguuuuuguacu

SEQ ID NO: 2242316 - RNA, 11 nt, Human
agaauaaagca

SEQ ID NO: 2242317 - RNA, 12 nt, Human
agaauaaagcaa

SEQ ID NO: 2242318 - RNA, 13 nt, Human
agaauaaagcaau

SEQ ID NO: 2242319 - RNA, 14 nt, Human
agaauaaagcaauu

SEQ ID NO: 2242320 - RNA, 15 nt, Human
agaauaaagcaauuu

SEQ ID NO: 2242321 - RNA, 16 nt, Human
agaauaaagcaauuuu

SEQ ID NO: 2242322 - RNA, 17 nt, Human
agaauaaagcaauuuuc

SEQ ID NO: 2242323 - RNA, 13 nt, Human
agaauaaacuggc

SEQ ID NO: 2242324 - RNA, 16 nt, Human
agaaguuuuuguacug

SEQ ID NO: 2242325 - RNA, 17 nt, Human
agaaguuuuuguacugu

SEQ ID NO: 2242326 - RNA, 19 nt, Human
agaaguuuuuguacuguaa

SEQ ID NO: 2242327 - RNA, 13 nt, Human
agaauaaucuuug

SEQ ID NO: 2242328 - RNA, 21 nt, Human
agaauaaucacgcuuuccuga

SEQ ID NO: 2242329 - RNA, 20 nt, Human
agaauaaucacgcuuuccug

SEQ ID NO: 2242330 - RNA, 17 nt, Human
agaauaaucacgcuuuc

SEQ ID NO: 2242331 - RNA, 17 nt, Human
agaauaaaguucugagu

SEQ ID NO: 2242332 - RNA, 21 nt, Human
agaauaaaguucugaguguuu

SEQ ID NO: 2242333 - RNA, 23 nt, Human
agaauaaagcaauuuuccuugaa

SEQ ID NO: 2242334 - RNA, 18 nt, Human
agaauaaagcaauuuucc

SEQ ID NO: 2242335 - RNA, 19 nt, Human
agaauaaagcaauuuuccu

SEQ ID NO: 2242336 - RNA, 20 nt, Human
agaauaaagcaauuuuccuu

SEQ ID NO: 2242337 - RNA, 22 nt, Human
agaauaaagcaauuuuccuuga

SEQ ID NO: 2242338 - RNA, 14 nt, Human
ucuggccucccaca

SEQ ID NO: 2242339 - RNA, 13 nt, Human
ucuggccucccac

SEQ ID NO: 2242340 - RNA, 18 nt, Human
ucuggccuagucccuucc

SEQ ID NO: 2242341 - RNA, 20 nt, Human
ucuggccuagucccuuccac

SEQ ID NO: 2242342 - RNA, 13 nt, Human
ucuggccucaggu

SEQ ID NO: 2242343 - RNA, 18 nt, Human
ucuggccucaggugggcc

SEQ ID NO: 2242344 - RNA, 20 nt, Human
ucuggcagggugggauggag

SEQ ID NO: 2242345 - RNA, 13 nt, Human
ucuggccuagucc

SEQ ID NO: 2242346 - RNA, 19 nt, Human
ucuggcagggugggaugga

SEQ ID NO: 2242347 - RNA, 18 nt, Human
ucuggcagcucagagagg

SEQ ID NO: 2242348 - RNA, 21 nt, Human
ucuggcagcucagagagggug

SEQ ID NO: 2242349 - RNA, 17 nt, Human
ucuggcagcucagagag

SEQ ID NO: 2242350 - RNA, 20 nt, Human
ucuggcagaguugaagacag

SEQ ID NO: 2242351 - RNA, 23 nt, Human
ucuggcagaguugaagacagagc

SEQ ID NO: 2242352 - RNA, 14 nt, Human
agaagccucuggcu

SEQ ID NO: 2242353 - RNA, 13 nt, Human
agaagccucuggc

SEQ ID NO: 2242354 - RNA, 12 nt, Human
agaagccucugg

SEQ ID NO: 2242355 - RNA, 15 nt, Human
agaagccuccccagc

SEQ ID NO: 2242356 - RNA, 23 nt, Human
agaagccucuggcuagaggccag

SEQ ID NO: 2242357 - RNA, 16 nt, Human
agaagccucuggcuag

SEQ ID NO: 2242358 - RNA, 23 nt, Human
agaagccucugggucaguggucc

SEQ ID NO: 2242359 - RNA, 22 nt, Human
agaagccucugggucagugguc

SEQ ID NO: 2242360 - RNA, 14 nt, Human
agaagccugaggcu

SEQ ID NO: 2242361 - RNA, 12 nt, Human
agaagccugagg

SEQ ID NO: 2242362 - RNA, 17 nt, Human
agaagccugaggcuggg

SEQ ID NO: 2242363 - RNA, 17 nt, Human
agaagccugaugcugac

SEQ ID NO: 2242364 - RNA, 14 nt, Human
agaagccgugggug

SEQ ID NO: 2242365 - RNA, 15 nt, Human
agaagcucccaggaa

SEQ ID NO: 2242366 - RNA, 16 nt, Human
agaagcucccaggaac

SEQ ID NO: 2242367 - RNA, 17 nt, Human
agaagcucccaggaaca

SEQ ID NO: 2242368 - RNA, 22 nt, Human
agaagccgggaacagacaacag

SEQ ID NO: 2242369 - RNA, 18 nt, Human
agaagccgggaacagaca

SEQ ID NO: 2242370 - RNA, 16 nt, Human
agaagccgggaacaga

SEQ ID NO: 2242371 - RNA, 14 nt, Human
agaagccgggaaca

SEQ ID NO: 2242372 - RNA, 10 nt, Human
ucuggccuuc

SEQ ID NO: 2242373 - RNA, 23 nt, Human
ucuggccucccacccgaugcugc

SEQ ID NO: 2242374 - RNA, 11 nt, Human
ucuggccucca

SEQ ID NO: 2242375 - RNA, 14 nt, Human
ucuggccucccacc

SEQ ID NO: 2242376 - RNA, 15 nt, Human
ucuggccucccaccc

SEQ ID NO: 2242377 - RNA, 16 nt, Human
ucuggccucccacccg

SEQ ID NO: 2242378 - RNA, 20 nt, Human
ucuggaagagaggaaugccu

SEQ ID NO: 2242379 - RNA, 13 nt, Human
ucuggaagagagg

SEQ ID NO: 2242380 - RNA, 23 nt, Human
ucuggaaccucagccuggccaga

SEQ ID NO: 2242381 - RNA, 21 nt, Human
ucuggaaccucagccuggcca

SEQ ID NO: 2242382 - RNA, 20 nt, Human
ucuggaaccucagccuggcc

SEQ ID NO: 2242383 - RNA, 19 nt, Human
ucuggaaccucagccuggc

SEQ ID NO: 2242384 - RNA, 18 nt, Human
ucuggaaccucagccugg

SEQ ID NO: 2242385 - RNA, 13 nt, Human
ucuggaaguccaa

SEQ ID NO: 2242386 - RNA, 18 nt, Human
ucuggaagugacuuuggc

SEQ ID NO: 2242387 - RNA, 22 nt, Human
ucuggaagugacuuuggcugca

SEQ ID NO: 2242388 - RNA, 19 nt, Human
ucuggaagugacuuuggcu

SEQ ID NO: 2242389 - RNA, 14 nt, Human
ucuggauuguggga

SEQ ID NO: 2242390 - RNA, 16 nt, Human
ucuggauucuuggccc

SEQ ID NO: 2242391 - RNA, 15 nt, Human
ucuggauucuuggcc

SEQ ID NO: 2242392 - RNA, 16 nt, Human
ucuggcaacaucuuua

SEQ ID NO: 2242393 - RNA, 15 nt, Human
ucuggcaacaucuuu

SEQ ID NO: 2242394 - RNA, 13 nt, Human
ucuggauucccag

SEQ ID NO: 2242395 - RNA, 14 nt, Human
ucuggauucccagg

SEQ ID NO: 2242396 - RNA, 17 nt, Human
ucuggauucccaggaug

SEQ ID NO: 2242397 - RNA, 21 nt, Human
ucuggauucccaggaugagca

SEQ ID NO: 2242398 - RNA, 22 nt, Human
ucuggauucccaggaugagcau

SEQ ID NO: 2242399 - RNA, 22 nt, Human
ucuggcacacaguaggugcuca

SEQ ID NO: 2242400 - RNA, 21 nt, Human
ucuggcaaagcuuuuagaaau

SEQ ID NO: 2242401 - RNA, 22 nt, Human
ucugcuuugggguuuaucagaa

SEQ ID NO: 2242402 - RNA, 21 nt, Human
ucugcuuugacugagcagacu

SEQ ID NO: 2242403 - RNA, 20 nt, Human
ucugcuuugcucuucaagaa

SEQ ID NO: 2242404 - RNA, 18 nt, Human
ucugcuuuuaccaugccc

SEQ ID NO: 2242405 - RNA, 17 nt, Human
ucuggaaccucagccug

SEQ ID NO: 2242406 - RNA, 21 nt, Human
ucugcuuuucugcccuggcug

SEQ ID NO: 2242407 - RNA, 22 nt, Human
ucugcuuuucugcccuggcugc

SEQ ID NO: 2242408 - RNA, 13 nt, Human
ucugcuuuuacca

SEQ ID NO: 2242409 - RNA, 15 nt, Human
ucugcuuuucugccc

SEQ ID NO: 2242410 - RNA, 16 nt, Human
ucugcuuuucugcccu

SEQ ID NO: 2242411 - RNA, 17 nt, Human
ucugcuuuucugcccug

SEQ ID NO: 2242412 - RNA, 18 nt, Human
ucugcuuuucugcccugg

SEQ ID NO: 2242413 - RNA, 19 nt, Human
ucugcuuuucugcccuggc

SEQ ID NO: 2242414 - RNA, 20 nt, Human
ucugcuuuucugcccuggcu

SEQ ID NO: 2242415 - RNA, 16 nt, Human
ucugccuguggaacug

SEQ ID NO: 2242416 - RNA, 15 nt, Human
ucugccuguuauaac

SEQ ID NO: 2242417 - RNA, 19 nt, Human
ucugccuguuauaacucug

SEQ ID NO: 2242418 - RNA, 21 nt, Human
ucugccuguuauaacucugca

SEQ ID NO: 2242419 - RNA, 22 nt, Human
ucugccuguuauaacucugcac

SEQ ID NO: 2242420 - RNA, 16 nt, Human
ucugccuuaaaaccaa

SEQ ID NO: 2242421 - RNA, 17 nt, Human
ucugccuuaaaaccaaa

SEQ ID NO: 2242422 - RNA, 15 nt, Human
ucugccuuagucuca

SEQ ID NO: 2242423 - RNA, 20 nt, Human
ucugccuuaaaaccaaagag

SEQ ID NO: 2242424 - RNA, 19 nt, Human
ucugccuuagucucaguuu

SEQ ID NO: 2242425 - RNA, 13 nt, Human
ucugccuuccuug

SEQ ID NO: 2242426 - RNA, 18 nt, Human
ucugcuuugacugagcag

SEQ ID NO: 2242427 - RNA, 21 nt, Human
ucugccugucccucucaggca

SEQ ID NO: 2242428 - RNA, 18 nt, Human
ucugccugucccucucag

SEQ ID NO: 2242429 - RNA, 17 nt, Human
ucugccugucccucuca

SEQ ID NO: 2242430 - RNA, 13 nt, Human
ucugccugucccu

SEQ ID NO: 2242431 - RNA, 18 nt, Human
ucugcccuugccaacgga

SEQ ID NO: 2242432 - RNA, 17 nt, Human
ucugcccuggcugcugc

SEQ ID NO: 2242433 - RNA, 16 nt, Human
ucugcccuucacccca

SEQ ID NO: 2242434 - RNA, 12 nt, Human
ucugccugucuc

SEQ ID NO: 2242435 - RNA, 14 nt, Human
ucugccugucuccc

SEQ ID NO: 2242436 - RNA, 23 nt, Human
agaacuuggauguaccugccccc

SEQ ID NO: 2242437 - RNA, 18 nt, Human
agaacuuggauguaccug

SEQ ID NO: 2242438 - RNA, 16 nt, Human
agaacuuugaaggaca

SEQ ID NO: 2242439 - RNA, 14 nt, Human
agaacuuucauuuu

SEQ ID NO: 2242440 - RNA, 15 nt, Human
agaacuuucauuuuu

SEQ ID NO: 2242441 - RNA, 16 nt, Human
agaacuuucauuuuuu

SEQ ID NO: 2242442 - RNA, 18 nt, Human
agaacuuucauuuuuuuc

SEQ ID NO: 2242443 - RNA, 16 nt, Human
agaagcagaggaagga

SEQ ID NO: 2242444 - RNA, 19 nt, Human
agaagcaccaaucaugaau

SEQ ID NO: 2242445 - RNA, 15 nt, Human
agaagcaagaaagaa

SEQ ID NO: 2242446 - RNA, 19 nt, Human
agaagcaacccaaauguuc

SEQ ID NO: 2242447 - RNA, 15 nt, Human
agaagcauacaacuu

SEQ ID NO: 2242448 - RNA, 23 nt, Human
agaagcagugagccgcaucuucu

SEQ ID NO: 2242449 - RNA, 17 nt, Human
agaagcagugagccgca

SEQ ID NO: 2242450 - RNA, 14 nt, Human
agaagcagugagcc

SEQ ID NO: 2242451 - RNA, 13 nt, Human
agaagcagugagc

SEQ ID NO: 2242452 - RNA, 16 nt, Human
agaagcaugaaaaagc

SEQ ID NO: 2242453 - RNA, 15 nt, Human
agaagcaugaaaaag

SEQ ID NO: 2242454 - RNA, 13 nt, Human
agaagcaugaaaa

SEQ ID NO: 2242455 - RNA, 18 nt, Human
agaagcauuaacuucucu

SEQ ID NO: 2242456 - RNA, 21 nt, Human
agaagcauuaacuucucugga

SEQ ID NO: 2242457 - RNA, 13 nt, Human
agaagcauuccuu

SEQ ID NO: 2242458 - RNA, 14 nt, Human
agaagcauuccuuc

SEQ ID NO: 2242459 - RNA, 18 nt, Human
agaagccacaggccugag

SEQ ID NO: 2242460 - RNA, 13 nt, Human
agaagcagcucuu

SEQ ID NO: 2242461 - RNA, 15 nt, Human
agaagcagaaauaca

SEQ ID NO: 2242462 - RNA, 13 nt, Human
agaagcagaugag

SEQ ID NO: 2242463 - RNA, 18 nt, Human
agaagcaggcuacacuga

SEQ ID NO: 2242464 - RNA, 14 nt, Human
agaagcaggcugga

SEQ ID NO: 2242465 - RNA, 12 nt, Human
agaagcagcucu

SEQ ID NO: 2242466 - RNA, 21 nt, Human
agaagcaauaaagaagagugc

SEQ ID NO: 2242467 - RNA, 20 nt, Human
agaagcaauaaagaagagug

SEQ ID NO: 2242468 - RNA, 14 nt, Human
agaagcagaaauac

SEQ ID NO: 2242469 - RNA, 18 nt, Human
agaagcccaauauuauaa

SEQ ID NO: 2242470 - RNA, 14 nt, Human
agaagccauugucu

SEQ ID NO: 2242471 - RNA, 15 nt, Human
agaagccauugucuu

SEQ ID NO: 2242472 - RNA, 10 nt, Human
agaagccauu

SEQ ID NO: 2242473 - RNA, 11 nt, Human
agaagccauug

SEQ ID NO: 2242474 - RNA, 12 nt, Human
agaagccauugu

SEQ ID NO: 2242475 - RNA, 22 nt, Human
agaagccaggaauuucccagga

SEQ ID NO: 2242476 - RNA, 12 nt, Human
agaagccaggag

SEQ ID NO: 2242477 - RNA, 14 nt, Human
agaagccaggagca

SEQ ID NO: 2242478 - RNA, 20 nt, Human
agaagccaggagcaaauguu

SEQ ID NO: 2242479 - RNA, 19 nt, Human
agaagccacaggccugaga

SEQ ID NO: 2242480 - RNA, 21 nt, Human
agaagccacaggccugagauu

SEQ ID NO: 2242481 - RNA, 13 nt, Human
agaagccaggaau

SEQ ID NO: 2242482 - RNA, 12 nt, Human
agaagccaggaa

SEQ ID NO: 2242483 - RNA, 12 nt, Human
ucugcccagcuu

SEQ ID NO: 2242484 - RNA, 20 nt, Human
agaagcccgugugagaagug

SEQ ID NO: 2242485 - RNA, 19 nt, Human
ucugcccagcuugggccca

SEQ ID NO: 2242486 - RNA, 16 nt, Human
ucugcccagcuugggc

SEQ ID NO: 2242487 - RNA, 23 nt, Human
ucugcccacucccugcaaccuga

SEQ ID NO: 2242488 - RNA, 12 nt, Human
ucugcccaggac

SEQ ID NO: 2242489 - RNA, 23 nt, Human
ucugcccaggacggggccggcca

SEQ ID NO: 2242490 - RNA, 14 nt, Human
ucugcccaggggug

SEQ ID NO: 2242491 - RNA, 19 nt, Human
ucugcccaggggugccccc

SEQ ID NO: 2242492 - RNA, 20 nt, Human
ucugcccauccugccccuga

SEQ ID NO: 2242493 - RNA, 23 nt, Human
agaagcccaggaaaggcuccagg

SEQ ID NO: 2242494 - RNA, 14 nt, Human
agaagcccccagcu

SEQ ID NO: 2242495 - RNA, 12 nt, Human
agaagcccccag

SEQ ID NO: 2242496 - RNA, 24 nt, Human
agaagcccccagcuaagaaccugg

SEQ ID NO: 2242497 - RNA, 20 nt, Human
agaagccauugucuucggaa

SEQ ID NO: 2242498 - RNA, 15 nt, Human
agaagccccuucccc

SEQ ID NO: 2242499 - RNA, 23 nt, Human
agaagcccccagcuaagaaccug

SEQ ID NO: 2242500 - RNA, 17 nt, Human
agaagcccccagcuaag

SEQ ID NO: 2242501 - RNA, 20 nt, Human
agaagccccuuccccauggg

SEQ ID NO: 2242502 - RNA, 21 nt, Human
agaagccccuuccccauggga

SEQ ID NO: 2242503 - RNA, 17 nt, Human
ucugccccagcucuggc

SEQ ID NO: 2242504 - RNA, 16 nt, Human
ucugccccagcucugg

SEQ ID NO: 2242505 - RNA, 20 nt, Human
ucugccccagcucuggcuuc

SEQ ID NO: 2242506 - RNA, 21 nt, Human
ucugccccauccuccagcagg

SEQ ID NO: 2242507 - RNA, 19 nt, Human
ucugccccauccuccagca

SEQ ID NO: 2242508 - RNA, 18 nt, Human
ucugccccauccuccagc

SEQ ID NO: 2242509 - RNA, 15 nt, Human
ucugccccauccucc

SEQ ID NO: 2242510 - RNA, 14 nt, Human
ucugccccagcucu

SEQ ID NO: 2242511 - RNA, 14 nt, Human
ucugccccagaggc

SEQ ID NO: 2242512 - RNA, 15 nt, Human
ucugccccagaggcc

SEQ ID NO: 2242513 - RNA, 18 nt, Human
ucugccccagaggccucu

SEQ ID NO: 2242514 - RNA, 20 nt, Human
ucugcccaggggugcccccu

SEQ ID NO: 2242515 - RNA, 21 nt, Human
ucugcccaggggugcccccuc

SEQ ID NO: 2242516 - RNA, 22 nt, Human
ucugcccaggggugcccccucc

SEQ ID NO: 2242517 - RNA, 23 nt, Human
ucugcccaggggugcccccuccu

SEQ ID NO: 2242518 - RNA, 22 nt, Human
ucugcccugcgggucacaggag

SEQ ID NO: 2242519 - RNA, 14 nt, Human
ucugcccccugcug

SEQ ID NO: 2242520 - RNA, 16 nt, Human
ucugcccccugcuggc

SEQ ID NO: 2242521 - RNA, 13 nt, Human
ucugcccuggcug

SEQ ID NO: 2242522 - RNA, 14 nt, Human
ucugcccuggcugc

SEQ ID NO: 2242523 - RNA, 15 nt, Human
ucugcccuggcugcu

SEQ ID NO: 2242524 - RNA, 16 nt, Human
ucugcccuggcugcug

SEQ ID NO: 2242525 - RNA, 21 nt, Human
ucugcccuggcugcugccccc

SEQ ID NO: 2242526 - RNA, 12 nt, Human
ucugcccuuggu

SEQ ID NO: 2242527 - RNA, 23 nt, Human
ucugcccuugguuaggcauugug

SEQ ID NO: 2242528 - RNA, 15 nt, Human
agaacugagcuccuc

SEQ ID NO: 2242529 - RNA, 12 nt, Human
agaacugagcuc

SEQ ID NO: 2242530 - RNA, 14 nt, Human
agaacuccuagggu

SEQ ID NO: 2242531 - RNA, 15 nt, Human
agaacugaaugagaa

SEQ ID NO: 2242532 - RNA, 22 nt, Human
agaacugagcuccucugggcag

SEQ ID NO: 2242533 - RNA, 16 nt, Human
agaacugagcuccucu

SEQ ID NO: 2242534 - RNA, 12 nt, Human
agaacugcaggc

SEQ ID NO: 2242535 - RNA, 15 nt, Human
agaacugcaggcccu

SEQ ID NO: 2242536 - RNA, 21 nt, Human
agaacugcauauguuucgcug

SEQ ID NO: 2242537 - RNA, 20 nt, Human
agaacugcauauguuucgcu

SEQ ID NO: 2242538 - RNA, 19 nt, Human
agaacugcauauguuucgc

SEQ ID NO: 2242539 - RNA, 15 nt, Human
agaacugcauauguu

SEQ ID NO: 2242540 - RNA, 20 nt, Human
agaacugcaggcccuggccu

SEQ ID NO: 2242541 - RNA, 16 nt, Human
agaacugcaggcccug

SEQ ID NO: 2242542 - RNA, 18 nt, Human
agaacugcaggcccuggc

SEQ ID NO: 2242543 - RNA, 11 nt, Human
agaacuccuag

SEQ ID NO: 2242544 - RNA, 16 nt, Human
agaacucacuggggcc

SEQ ID NO: 2242545 - RNA, 14 nt, Human
agaacucacugggg

SEQ ID NO: 2242546 - RNA, 20 nt, Human
agaacucaaauggggccaga

SEQ ID NO: 2242547 - RNA, 17 nt, Human
agaacucccuuucaaca

SEQ ID NO: 2242548 - RNA, 16 nt, Human
agaacucccuuucaac

SEQ ID NO: 2242549 - RNA, 15 nt, Human
agaacucccuuucaa

SEQ ID NO: 2242550 - RNA, 16 nt, Human
agaacuauaugugaau

SEQ ID NO: 2242551 - RNA, 19 nt, Human
agaacuauaugugaauccu

SEQ ID NO: 2242552 - RNA, 21 nt, Human
agaacuauaugugaauccucu

SEQ ID NO: 2242553 - RNA, 19 nt, Human
agaacucaaauggggccag

SEQ ID NO: 2242554 - RNA, 22 nt, Human
agaacuacucagggaaugaagg

SEQ ID NO: 2242555 - RNA, 19 nt, Human
agaacuacucagggaauga

SEQ ID NO: 2242556 - RNA, 17 nt, Human
agaacuagaaccuggag

SEQ ID NO: 2242557 - RNA, 18 nt, Human
agaacuagaaccuggagg

SEQ ID NO: 2242558 - RNA, 17 nt, Human
agaacuagaauuugauu

SEQ ID NO: 2242559 - RNA, 21 nt, Human
agaacggagccccaggccucu

SEQ ID NO: 2242560 - RNA, 21 nt, Human
agaaccuguccuugcacacuc

SEQ ID NO: 2242561 - RNA, 14 nt, Human
agaaccuguccuug

SEQ ID NO: 2242562 - RNA, 14 nt, Human
agaaccuugccuga

SEQ ID NO: 2242563 - RNA, 19 nt, Human
agaaccuugccugaacauc

SEQ ID NO: 2242564 - RNA, 22 nt, Human
agaaccuugccugaacauccuu

SEQ ID NO: 2242565 - RNA, 19 nt, Human
agaaccuuuugagugccuu

SEQ ID NO: 2242566 - RNA, 23 nt, Human
agaacgcagcccuagagccugcc

SEQ ID NO: 2242567 - RNA, 13 nt, Human
agaacgcagcccu

SEQ ID NO: 2242568 - RNA, 22 nt, Human
agaacgcagcccuagagccugc

SEQ ID NO: 2242569 - RNA, 17 nt, Human
agaaccuugugccuggc

SEQ ID NO: 2242570 - RNA, 22 nt, Human
agaaccuugugccuggcucaga

SEQ ID NO: 2242571 - RNA, 23 nt, Human
agaaccuugugccuggcucagag

SEQ ID NO: 2242572 - RNA, 23 nt, Human
agaaccuuuugagugccuuacac

SEQ ID NO: 2242573 - RNA, 14 nt, Human
agaaauuagccggg

SEQ ID NO: 2242574 - RNA, 15 nt, Human
agaaauuagcugugu

SEQ ID NO: 2242575 - RNA, 17 nt, Human
agaaauuagaaaccuua

SEQ ID NO: 2242576 - RNA, 15 nt, Human
agaaauuagccgggc

SEQ ID NO: 2242577 - RNA, 17 nt, Human
agaaauuagcuguguga

SEQ ID NO: 2242578 - RNA, 13 nt, Human
ucugaaugcugcu

SEQ ID NO: 2242579 - RNA, 16 nt, Human
ucugaaugcugcuacu

SEQ ID NO: 2242580 - RNA, 15 nt, Human
ucugcaguaaaucuu

SEQ ID NO: 2242581 - RNA, 21 nt, Human
ucugcagguucuucuuccuga

SEQ ID NO: 2242582 - RNA, 17 nt, Human
agaaauuaaguaucuga

SEQ ID NO: 2242583 - RNA, 13 nt, Human
agaaauuaaguau

SEQ ID NO: 2242584 - RNA, 18 nt, Human
agaaauuacacccaaaga

SEQ ID NO: 2242585 - RNA, 17 nt, Human
ucugaaugcugcuacuu

SEQ ID NO: 2242586 - RNA, 13 nt, Human
agaaccuguccuu

SEQ ID NO: 2242587 - RNA, 12 nt, Human
agaaccuguccu

SEQ ID NO: 2242588 - RNA, 17 nt, Human
agaaccuguagagcuag

SEQ ID NO: 2242589 - RNA, 16 nt, Human
agaaccuggaagggcu

SEQ ID NO: 2242590 - RNA, 12 nt, Human
agaaccuggaga

SEQ ID NO: 2242591 - RNA, 17 nt, Human
agaaccuggagagcuag

SEQ ID NO: 2242592 - RNA, 12 nt, Human
agaaccuggagg

SEQ ID NO: 2242593 - RNA, 23 nt, Human
agaaccuggagggcuagaacugg

SEQ ID NO: 2242594 - RNA, 17 nt, Human
agaaccuggagggcugg

SEQ ID NO: 2242595 - RNA, 17 nt, Human
agaaccuggaguuccug

SEQ ID NO: 2242596 - RNA, 18 nt, Human
agaaccuggaguuccuga

SEQ ID NO: 2242597 - RNA, 12 nt, Human
agaaauuaugug

SEQ ID NO: 2242598 - RNA, 21 nt, Human
agaaccuggaacuuggggagu

SEQ ID NO: 2242599 - RNA, 15 nt, Human
agaaccuggaagggc

SEQ ID NO: 2242600 - RNA, 20 nt, Human
agaaccuggaacuuggggag

SEQ ID NO: 2242601 - RNA, 13 nt, Human
agaaccuggaacu

SEQ ID NO: 2242602 - RNA, 13 nt, Human
ucugaauccuaag

SEQ ID NO: 2242603 - RNA, 14 nt, Human
ucugaauaugcugc

SEQ ID NO: 2242604 - RNA, 16 nt, Human
ucugaauaauuucuua

SEQ ID NO: 2242605 - RNA, 15 nt, Human
ucugaauaauuucuu

SEQ ID NO: 2242606 - RNA, 16 nt, Human
ucugaauaacauuugu

SEQ ID NO: 2242607 - RNA, 14 nt, Human
ucugaagggaggug

SEQ ID NO: 2242608 - RNA, 16 nt, Human
ucugaagugaaacugc

SEQ ID NO: 2242609 - RNA, 12 nt, Human
ucugaagggagg

SEQ ID NO: 2242610 - RNA, 13 nt, Human
ucugaagggaggu

SEQ ID NO: 2242611 - RNA, 22 nt, Human
ucugaagugaaacugcuuguuu

SEQ ID NO: 2242612 - RNA, 18 nt, Human
ucugaagugaaacugcuu

SEQ ID NO: 2242613 - RNA, 21 nt, Human
ucugcaggucccuaauaaagc

SEQ ID NO: 2242614 - RNA, 19 nt, Human
ucugcaggucccuaauaaa

SEQ ID NO: 2242615 - RNA, 22 nt, Human
ucugcaggucccuaauaaagcu

SEQ ID NO: 2242616 - RNA, 23 nt, Human
ucugcaggucccuaauaaagcug

SEQ ID NO: 2242617 - RNA, 21 nt, Human
agaaacuguucccaccugcug

SEQ ID NO: 2242618 - RNA, 15 nt, Human
agaaacuguucccac

SEQ ID NO: 2242619 - RNA, 22 nt, Human
agaaacuguucccaccugcugg

SEQ ID NO: 2242620 - RNA, 23 nt, Human
agaaacuuaagguuaccuuuguu

SEQ ID NO: 2242621 - RNA, 20 nt, Human
agaaacuguagucucaggac

SEQ ID NO: 2242622 - RNA, 14 nt, Human
agaaacuguagucu

SEQ ID NO: 2242623 - RNA, 15 nt, Human
agaaacauuugguaa

SEQ ID NO: 2242624 - RNA, 23 nt, Human
agaaacaucaguuacucugaagg

SEQ ID NO: 2242625 - RNA, 21 nt, Human
agaaacaucaguuacucugaa

SEQ ID NO: 2242626 - RNA, 23 nt, Human
agaaacauaaauaaaaugaccag

SEQ ID NO: 2242627 - RNA, 14 nt, Human
agaaacaugguuuu

SEQ ID NO: 2242628 - RNA, 14 nt, Human
agaaacauugaaga

SEQ ID NO: 2242629 - RNA, 15 nt, Human
agaaacauugaagau

SEQ ID NO: 2242630 - RNA, 16 nt, Human
agaaacaucaguuacu

SEQ ID NO: 2242631 - RNA, 14 nt, Human
agaaacaucaguua

SEQ ID NO: 2242632 - RNA, 15 nt, Human
agaaacauaaauaaa

SEQ ID NO: 2242633 - RNA, 16 nt, Human
agaaacauaaauaaaa

SEQ ID NO: 2242634 - RNA, 17 nt, Human
agaaacauaaauaaaau

SEQ ID NO: 2242635 - RNA, 22 nt, Human
agaaacauaaauaaaaugacca

SEQ ID NO: 2242636 - RNA, 22 nt, Human
agaaacacacugaggcagggaa

SEQ ID NO: 2242637 - RNA, 20 nt, Human
agaaaagauacgacuuuauu

SEQ ID NO: 2242638 - RNA, 15 nt, Human
agaaaagauaaagau

SEQ ID NO: 2242639 - RNA, 16 nt, Human
agaaaagauaaagaug

SEQ ID NO: 2242640 - RNA, 19 nt, Human
agaaaagagauauuuuaaa

SEQ ID NO: 2242641 - RNA, 23 nt, Human
agaaaagagauauuuuaaaauga

SEQ ID NO: 2242642 - RNA, 16 nt, Human
agaaaacaaggaugaa

SEQ ID NO: 2242643 - RNA, 18 nt, Human
agaaaagcaccugccgac

SEQ ID NO: 2242644 - RNA, 16 nt, Human
agaaaagcaccugccg

SEQ ID NO: 2242645 - RNA, 15 nt, Human
agaaaagcaccugcc

SEQ ID NO: 2242646 - RNA, 20 nt, Human
agaaaagauuuuaaucaagu

SEQ ID NO: 2242647 - RNA, 18 nt, Human
agaaaagauuuuaaucaa

SEQ ID NO: 2242648 - RNA, 15 nt, Human
agaaaagauuuuaau

SEQ ID NO: 2242649 - RNA, 19 nt, Human
agaaaagauguagauuuau

SEQ ID NO: 2242650 - RNA, 12 nt, Human
agaaaagauuuu

SEQ ID NO: 2242651 - RNA, 17 nt, Human
agaaaagauaaagauga

SEQ ID NO: 2242652 - RNA, 20 nt, Human
agaaacacacugaggcaggg

SEQ ID NO: 2242653 - RNA, 19 nt, Human
agaaacacacugaggcagg

SEQ ID NO: 2242654 - RNA, 17 nt, Human
agaaacacacugaggca

SEQ ID NO: 2242655 - RNA, 15 nt, Human
agaaacacacugagg

SEQ ID NO: 2242656 - RNA, 14 nt, Human
agaaacacaauauu

SEQ ID NO: 2242657 - RNA, 16 nt, Human
agaaacacaacuauau

SEQ ID NO: 2242658 - RNA, 20 nt, Human
agaaacaacucuuugagaaa

SEQ ID NO: 2242659 - RNA, 14 nt, Human
agaaacaauaaaga

SEQ ID NO: 2242660 - RNA, 14 nt, Human
agaaaaggacagaa

SEQ ID NO: 2242661 - RNA, 15 nt, Human
agaaacaauaaagag

SEQ ID NO: 2242662 - RNA, 16 nt, Human
agaaacaauaaagaga

SEQ ID NO: 2242663 - RNA, 17 nt, Human
agaaacaauaaagagau

SEQ ID NO: 2242664 - RNA, 14 nt, Human
agaaaagcuuugaa

SEQ ID NO: 2242665 - RNA, 21 nt, Human
agaaaagcuauaaaaugaaua

SEQ ID NO: 2242666 - RNA, 13 nt, Human
agaaaagcuauaa

SEQ ID NO: 2242667 - RNA, 18 nt, Human
agaaaaaugagccuggca

SEQ ID NO: 2242668 - RNA, 19 nt, Human
ucucuugguuuccuuccuu

SEQ ID NO: 2242669 - RNA, 20 nt, Human
agaaaacaaaaaaaccucua

SEQ ID NO: 2242670 - RNA, 15 nt, Human
agaaaaauuauugua

SEQ ID NO: 2242671 - RNA, 19 nt, Human
agaaaaauuuacauggcaa

SEQ ID NO: 2242672 - RNA, 23 nt, Human
agaaaaaauauuuuccugccagg

SEQ ID NO: 2242673 - RNA, 17 nt, Human
agaaaaaauauuuuccu

SEQ ID NO: 2242674 - RNA, 18 nt, Human
ucucuugguuuccuuccu

SEQ ID NO: 2242675 - RNA, 17 nt, Human
ucucuugguuuccuucc

SEQ ID NO: 2242676 - RNA, 16 nt, Human
ucucuugguuuccuuc

SEQ ID NO: 2242677 - RNA, 18 nt, Human
ucucugcaggucccuaau

SEQ ID NO: 2242678 - RNA, 22 nt, Human
ucucuccccucaaagucugcaa

SEQ ID NO: 2242679 - RNA, 18 nt, Human
ucucugcaucuacuccca

SEQ ID NO: 2242680 - RNA, 19 nt, Human
agaaaaaauauuuucccua

SEQ ID NO: 2242681 - RNA, 14 nt, Human
ucucucccuccccu

SEQ ID NO: 2242682 - RNA, 20 nt, Human
ucucuccccucaaagucugc

SEQ ID NO: 2242683 - RNA, 21 nt, Human
ucucuccccucaaagucugca

SEQ ID NO: 2242684 - RNA, 20 nt, Human
ucucucccauggagccccag

SEQ ID NO: 2242685 - RNA, 21 nt, Human
ucucucccauggagccccagc

SEQ ID NO: 2242686 - RNA, 23 nt, Human
ucucucccauggagccccagccc

SEQ ID NO: 2242687 - RNA, 13 nt, Human
ucucuccccucaa

SEQ ID NO: 2242688 - RNA, 19 nt, Human
ucucugcaggucccuaaua

SEQ ID NO: 2242689 - RNA, 20 nt, Human
ucucugcaggucccuaauaa

SEQ ID NO: 2242690 - RNA, 21 nt, Human
ucucugcaggucccuaauaaa

SEQ ID NO: 2242691 - RNA, 22 nt, Human
ucucugcaggucccuaauaaag

SEQ ID NO: 2242692 - RNA, 16 nt, Human
ucucuugguccugcug

SEQ ID NO: 2242693 - RNA, 17 nt, Human
ucucuugguccugcugc

SEQ ID NO: 2242694 - RNA, 18 nt, Human
ucucuugguccugcugca

SEQ ID NO: 2242695 - RNA, 18 nt, Human
agaaagacagagcuggga

SEQ ID NO: 2242696 - RNA, 12 nt, Human
agaaagacugag

SEQ ID NO: 2242697 - RNA, 15 nt, Human
agaaagacagagcug

SEQ ID NO: 2242698 - RNA, 16 nt, Human
agaaagacuauucaaa

SEQ ID NO: 2242699 - RNA, 22 nt, Human
agaaagacuaucuaaauguuga

SEQ ID NO: 2242700 - RNA, 20 nt, Human
agaaagacuaucuaaauguu

SEQ ID NO: 2242701 - RNA, 13 nt, Human
agaaagagcacuu

SEQ ID NO: 2242702 - RNA, 23 nt, Human
agaaagagagagaauucuuucaa

SEQ ID NO: 2242703 - RNA, 22 nt, Human
agaaagagcacuuaagagaaua

SEQ ID NO: 2242704 - RNA, 19 nt, Human
agaaagagcacuuaagaga

SEQ ID NO: 2242705 - RNA, 16 nt, Human
agaaagaggagugcuu

SEQ ID NO: 2242706 - RNA, 22 nt, Human
agaaagagagaaaauaaaaagu

SEQ ID NO: 2242707 - RNA, 18 nt, Human
agaaagagagaaaauaaa

SEQ ID NO: 2242708 - RNA, 17 nt, Human
agaaagagagaaaauaa

SEQ ID NO: 2242709 - RNA, 16 nt, Human
agaaagagagaaaaua

SEQ ID NO: 2242710 - RNA, 11 nt, Human
agaaagagaga

SEQ ID NO: 2242711 - RNA, 10 nt, Human
agaaagagag

SEQ ID NO: 2242712 - RNA, 15 nt, Human
agaaagagagaaaau

SEQ ID NO: 2242713 - RNA, 14 nt, Human
agaaagagagaaaa

SEQ ID NO: 2242714 - RNA, 13 nt, Human
agaaagagagaaa

SEQ ID NO: 2242715 - RNA, 12 nt, Human
agaaagagagaa

SEQ ID NO: 2242716 - RNA, 19 nt, Human
agaaagauggaugugcuuu

SEQ ID NO: 2242717 - RNA, 18 nt, Human
agaaagaucauugaaauu

SEQ ID NO: 2242718 - RNA, 17 nt, Human
agaaagaucauugaaau

SEQ ID NO: 2242719 - RNA, 20 nt, Human
agaaagauuacuuagaggaa

SEQ ID NO: 2242720 - RNA, 21 nt, Human
agaaagcaaaauuauguuugc

SEQ ID NO: 2242721 - RNA, 17 nt, Human
agaaagcaaaauuaugu

SEQ ID NO: 2242722 - RNA, 15 nt, Human
agaaagcaaaauuau

SEQ ID NO: 2242723 - RNA, 18 nt, Human
agaaagcagaacagugau

SEQ ID NO: 2242724 - RNA, 17 nt, Human
agaaagcagaacaguga

SEQ ID NO: 2242725 - RNA, 14 nt, Human
agaaagcauaaaau

SEQ ID NO: 2242726 - RNA, 12 nt, Human
agaaagcagggg

SEQ ID NO: 2242727 - RNA, 14 nt, Human
agaaagcaggggcu

SEQ ID NO: 2242728 - RNA, 21 nt, Human
agaaagcagauaccucacccu

SEQ ID NO: 2242729 - RNA, 20 nt, Human
agaaagcagaacagugauua

SEQ ID NO: 2242730 - RNA, 19 nt, Human
agaaauacaauucuacauu

SEQ ID NO: 2242731 - RNA, 20 nt, Human
agaaagcaggggcuacaaga

SEQ ID NO: 2242732 - RNA, 13 nt, Human
agaaagcauuuga

SEQ ID NO: 2242733 - RNA, 16 nt, Human
agaaagcauuacauuu

SEQ ID NO: 2242734 - RNA, 20 nt, Human
agaaaugcugguuuuucagu

SEQ ID NO: 2242735 - RNA, 21 nt, Human
agaaaugcugguuuuucaguu

SEQ ID NO: 2242736 - RNA, 20 nt, Human
agaaaugggacuuaacuccu

SEQ ID NO: 2242737 - RNA, 23 nt, Human
agaaaugcugccugccugucugu

SEQ ID NO: 2242738 - RNA, 15 nt, Human
agaaaugcugcccau

SEQ ID NO: 2242739 - RNA, 13 nt, Human
agaaaugcugccu

SEQ ID NO: 2242740 - RNA, 14 nt, Human
agaaaugcugccug

SEQ ID NO: 2242741 - RNA, 15 nt, Human
agaaaugcugccugc

SEQ ID NO: 2242742 - RNA, 22 nt, Human
agaaaugcugccugccugucug

SEQ ID NO: 2242743 - RNA, 15 nt, Human
agaaaugccuuaccc

SEQ ID NO: 2242744 - RNA, 19 nt, Human
ucugaaggagauuuuccuu

SEQ ID NO: 2242745 - RNA, 21 nt, Human
ucugaaggagccccauuccug

SEQ ID NO: 2242746 - RNA, 12 nt, Human
ucugaaggagau

SEQ ID NO: 2242747 - RNA, 20 nt, Human
ucugaaggagccccauuccu

SEQ ID NO: 2242748 - RNA, 15 nt, Human
agaaaugguuguauu

SEQ ID NO: 2242749 - RNA, 16 nt, Human
agaaaugguuguauua

SEQ ID NO: 2242750 - RNA, 18 nt, Human
ucugaaggcuggguucug

SEQ ID NO: 2242751 - RNA, 23 nt, Human
ucugaaggcgucaacgugcauuu

SEQ ID NO: 2242752 - RNA, 18 nt, Human
agaaaucucacuuuucuc

SEQ ID NO: 2242753 - RNA, 13 nt, Human
agaaaugaaaaaa

SEQ ID NO: 2242754 - RNA, 14 nt, Human
agaaaucuagaaga

SEQ ID NO: 2242755 - RNA, 23 nt, Human
agaaaucuaguauuucaugcugg

SEQ ID NO: 2242756 - RNA, 22 nt, Human
agaaaucuauagaacugaauga

SEQ ID NO: 2242757 - RNA, 12 nt, Human
agaaaugaaaaa

SEQ ID NO: 2242758 - RNA, 18 nt, Human
agaaauaccaaaauuauu

SEQ ID NO: 2242759 - RNA, 23 nt, Human
agaaauaccaaaauuauuucaga

SEQ ID NO: 2242760 - RNA, 16 nt, Human
agaaauacagauuuug

SEQ ID NO: 2242761 - RNA, 21 nt, Human
agaaauacagauuuugauagc

SEQ ID NO: 2242762 - RNA, 16 nt, Human
agaaauacuguacaau

SEQ ID NO: 2242763 - RNA, 14 nt, Human
agaaauacuguaca

SEQ ID NO: 2242764 - RNA, 13 nt, Human
agaaauacuguac

SEQ ID NO: 2242765 - RNA, 20 nt, Human
agaaauagccugcgcuguuu

SEQ ID NO: 2242766 - RNA, 18 nt, Human
agaaauagacaguauauu

SEQ ID NO: 2242767 - RNA, 19 nt, Human
agaaauagcuccguggagc

SEQ ID NO: 2242768 - RNA, 10 nt, Human
acuuugugcu

SEQ ID NO: 2242769 - RNA, 16 nt, Human
acuuuguguucaccuu

SEQ ID NO: 2242770 - RNA, 15 nt, Human
acuuugucagaggca

SEQ ID NO: 2242771 - RNA, 20 nt, Human
acuuugucgcccaggcugga

SEQ ID NO: 2242772 - RNA, 22 nt, Human
acuuuguaugucauuuccuuca

SEQ ID NO: 2242773 - RNA, 14 nt, Human
acuuugucugaaaa

SEQ ID NO: 2242774 - RNA, 14 nt, Human
acuuugugaauaga

SEQ ID NO: 2242775 - RNA, 15 nt, Human
acuuugucugaaaaa

SEQ ID NO: 2242776 - RNA, 17 nt, Human
acuuugucugaaaaauu

SEQ ID NO: 2242777 - RNA, 18 nt, Human
acuuuguguucaccuugu

SEQ ID NO: 2242778 - RNA, 18 nt, Human
agaaaaaaaaagaaaaaa

SEQ ID NO: 2242779 - RNA, 17 nt, Human
agaaaaaaaaagaaaaa

SEQ ID NO: 2242780 - RNA, 16 nt, Human
acuuuguggaugucuu

SEQ ID NO: 2242781 - RNA, 17 nt, Human
acuuuguggaugucuuc

SEQ ID NO: 2242782 - RNA, 19 nt, Human
acuuuguggaugucuuccu

SEQ ID NO: 2242783 - RNA, 21 nt, Human
acuuuguggaugucuuccuug

SEQ ID NO: 2242784 - RNA, 21 nt, Human
agaaaaaaaguuugccagaag

SEQ ID NO: 2242785 - RNA, 17 nt, Human
agaaaaaaagauuuauu

SEQ ID NO: 2242786 - RNA, 19 nt, Human
agaaaaaaaaagaaaaaag

SEQ ID NO: 2242787 - RNA, 14 nt, Human
ucuccuuagucuuc

SEQ ID NO: 2242788 - RNA, 16 nt, Human
ucuccuuccugugugu

SEQ ID NO: 2242789 - RNA, 21 nt, Human
ucuccuuggugucgggcauga

SEQ ID NO: 2242790 - RNA, 23 nt, Human
ucuccuuggugucgggcaugaca

SEQ ID NO: 2242791 - RNA, 23 nt, Human
ucuccugugcaugggugaaggga

SEQ ID NO: 2242792 - RNA, 16 nt, Human
ucuccuguccaaccua

SEQ ID NO: 2242793 - RNA, 17 nt, Human
ucuccugugcaugggug

SEQ ID NO: 2242794 - RNA, 15 nt, Human
ucuccugugcccaca

SEQ ID NO: 2242795 - RNA, 16 nt, Human
ucuccugugcccacau

SEQ ID NO: 2242796 - RNA, 18 nt, Human
ucuccugugcccacaucc

SEQ ID NO: 2242797 - RNA, 17 nt, Human
ucuccugugcccacauc

SEQ ID NO: 2242798 - RNA, 14 nt, Human
ucuccuguuuuucu

SEQ ID NO: 2242799 - RNA, 17 nt, Human
ucuccuguuuuucuggg

SEQ ID NO: 2242800 - RNA, 19 nt, Human
ucuccuguuuuucugggug

SEQ ID NO: 2242801 - RNA, 14 nt, Human
ucuccuguccaacc

SEQ ID NO: 2242802 - RNA, 10 nt, Human
agaaaaaaga

SEQ ID NO: 2242803 - RNA, 17 nt, Human
ucucgcucuguugccca

SEQ ID NO: 2242804 - RNA, 20 nt, Human
ucucgcuauugucaccaggg

SEQ ID NO: 2242805 - RNA, 16 nt, Human
ucucgcauaggaccuu

SEQ ID NO: 2242806 - RNA, 23 nt, Human
ucucgcauaggaccuuuccacca

SEQ ID NO: 2242807 - RNA, 17 nt, Human
ucucggaaggcuggcug

SEQ ID NO: 2242808 - RNA, 21 nt, Human
ucucggaacugcaugcugcug

SEQ ID NO: 2242809 - RNA, 22 nt, Human
ucucgcugaugcugggcugggu

SEQ ID NO: 2242810 - RNA, 21 nt, Human
ucucggaccuuucagcuguga

SEQ ID NO: 2242811 - RNA, 19 nt, Human
ucucggacuaagccuaccu

SEQ ID NO: 2242812 - RNA, 18 nt, Human
ucucgcugaugcugggcu

SEQ ID NO: 2242813 - RNA, 19 nt, Human
ucucgcugaugcugggcug

SEQ ID NO: 2242814 - RNA, 20 nt, Human
ucucgcugaugcugggcugg

SEQ ID NO: 2242815 - RNA, 15 nt, Human
ucucgcucugucacc

SEQ ID NO: 2242816 - RNA, 23 nt, Human
ucucgaacauggaacucauuccu

SEQ ID NO: 2242817 - RNA, 14 nt, Human
ucuccuuguggccu

SEQ ID NO: 2242818 - RNA, 14 nt, Human
ucucgauuuuaucu

SEQ ID NO: 2242819 - RNA, 17 nt, Human
ucucgaugcaaugaaca

SEQ ID NO: 2242820 - RNA, 14 nt, Human
ucucgaugcaauga

SEQ ID NO: 2242821 - RNA, 15 nt, Human
ucuccuugcuaccca

SEQ ID NO: 2242822 - RNA, 18 nt, Human
ucuccuugcuacccagaa

SEQ ID NO: 2242823 - RNA, 17 nt, Human
ucucgaacuccugaccu

SEQ ID NO: 2242824 - RNA, 19 nt, Human
ucuccuuuuccucucuccc

SEQ ID NO: 2242825 - RNA, 14 nt, Human
ucucuccauucccg

SEQ ID NO: 2242826 - RNA, 17 nt, Human
ucucuccaucuaccuuc

SEQ ID NO: 2242827 - RNA, 14 nt, Human
ucucucccaggggc

SEQ ID NO: 2242828 - RNA, 20 nt, Human
ucucucccaggggcuggcuu

SEQ ID NO: 2242829 - RNA, 22 nt, Human
ucucucccaggggcuggcuuca

SEQ ID NO: 2242830 - RNA, 19 nt, Human
ucucucccagucuacccag

SEQ ID NO: 2242831 - RNA, 21 nt, Human
ucucucccagucuacccagag

SEQ ID NO: 2242832 - RNA, 22 nt, Human
ucucucccagucuacccagaga

SEQ ID NO: 2242833 - RNA, 23 nt, Human
ucucucccagucuacccagagaa

SEQ ID NO: 2242834 - RNA, 13 nt, Human
ucucucccaugga

SEQ ID NO: 2242835 - RNA, 15 nt, Human
ucucucccauggagc

SEQ ID NO: 2242836 - RNA, 17 nt, Human
ucucucccauggagccc

SEQ ID NO: 2242837 - RNA, 11 nt, Human
ucucuccaucu

SEQ ID NO: 2242838 - RNA, 11 nt, Human
ucucuccagga

SEQ ID NO: 2242839 - RNA, 13 nt, Human
ucucuccaggauc

SEQ ID NO: 2242840 - RNA, 21 nt, Human
ucucucaggccaaacucaccu

SEQ ID NO: 2242841 - RNA, 21 nt, Human
ucucucaggagcacaggcagc

SEQ ID NO: 2242842 - RNA, 22 nt, Human
ucucucaggagcacaggcagcu

SEQ ID NO: 2242843 - RNA, 19 nt, Human
ucucggaguaucugggaac

SEQ ID NO: 2242844 - RNA, 15 nt, Human
ucucggcucacugca

SEQ ID NO: 2242845 - RNA, 16 nt, Human
ucucucagaagggagg

SEQ ID NO: 2242846 - RNA, 12 nt, Human
ucucucaggcca

SEQ ID NO: 2242847 - RNA, 17 nt, Human
ucucucagaagggaggc

SEQ ID NO: 2242848 - RNA, 20 nt, Human
ucucucagaagggaggcugg

SEQ ID NO: 2242849 - RNA, 13 nt, Human
ucucucaggagca

SEQ ID NO: 2242850 - RNA, 14 nt, Human
ucucucaggagcac

SEQ ID NO: 2242851 - RNA, 15 nt, Human
ucucucaggagcaca

SEQ ID NO: 2242852 - RNA, 17 nt, Human
ucucucaggagcacagg

SEQ ID NO: 2242853 - RNA, 18 nt, Human
ucucucaggagcacaggc

SEQ ID NO: 2242854 - RNA, 19 nt, Human
ucucucaggagcacaggca

SEQ ID NO: 2242855 - RNA, 12 nt, Human
acuuugaaggac

SEQ ID NO: 2242856 - RNA, 23 nt, Human
acuuugaaauguguuucuguaua

SEQ ID NO: 2242857 - RNA, 17 nt, Human
acuuugaaauguguuuc

SEQ ID NO: 2242858 - RNA, 19 nt, Human
acuuugaaauguguuucug

SEQ ID NO: 2242859 - RNA, 17 nt, Human
acuuugcacugauauau

SEQ ID NO: 2242860 - RNA, 17 nt, Human
acuuugcucuuucuuga

SEQ ID NO: 2242861 - RNA, 20 nt, Human
acuuugcuugcaguagauuu

SEQ ID NO: 2242862 - RNA, 14 nt, Human
acuuugcuucccau

SEQ ID NO: 2242863 - RNA, 15 nt, Human
acuuugcucuuucuu

SEQ ID NO: 2242864 - RNA, 14 nt, Human
acuuugcucugggu

SEQ ID NO: 2242865 - RNA, 20 nt, Human
acuuugccuuuccauaauca

SEQ ID NO: 2242866 - RNA, 21 nt, Human
acuuugcacugauauaucaug

SEQ ID NO: 2242867 - RNA, 18 nt, Human
acuuugcacugauauauc

SEQ ID NO: 2242868 - RNA, 19 nt, Human
acuuugcacugauauauca

SEQ ID NO: 2242869 - RNA, 23 nt, Human
acuuugcagccggcacagggucu

SEQ ID NO: 2242870 - RNA, 19 nt, Human
acuuugccagcuuuuccuc

SEQ ID NO: 2242871 - RNA, 23 nt, Human
acuuugccagcuuuuccucccuu

SEQ ID NO: 2242872 - RNA, 19 nt, Human
acuuuguaugucauuuccu

SEQ ID NO: 2242873 - RNA, 18 nt, Human
acuuuggaaaaugcauug

SEQ ID NO: 2242874 - RNA, 15 nt, Human
acuuuggaaaaugca

SEQ ID NO: 2242875 - RNA, 19 nt, Human
acuuuguauaaaagggacu

SEQ ID NO: 2242876 - RNA, 23 nt, Human
acuuuggaaagaguaggaagacu

SEQ ID NO: 2242877 - RNA, 23 nt, Human
acuuuggaaagacuuuuccaacc

SEQ ID NO: 2242878 - RNA, 12 nt, Human
acuuuggaaaga

SEQ ID NO: 2242879 - RNA, 13 nt, Human
acuuuggaaagag

SEQ ID NO: 2242880 - RNA, 14 nt, Human
acuuuggaaagagu

SEQ ID NO: 2242881 - RNA, 20 nt, Human
acuuucuuuucgccguggcu

SEQ ID NO: 2242882 - RNA, 21 nt, Human
acuuucuuuucgccguggcug

SEQ ID NO: 2242883 - RNA, 15 nt, Human
acuuucuuuucugga

SEQ ID NO: 2242884 - RNA, 19 nt, Human
acuuucuuuucuggaaugu

SEQ ID NO: 2242885 - RNA, 15 nt, Human
acuuuagaugcugau

SEQ ID NO: 2242886 - RNA, 13 nt, Human
acuuuagaugcug

SEQ ID NO: 2242887 - RNA, 14 nt, Human
acuuuagaugcuga

SEQ ID NO: 2242888 - RNA, 13 nt, Human
acuuuagggaagu

SEQ ID NO: 2242889 - RNA, 22 nt, Human
acuuuagcugcauccuccaaga

SEQ ID NO: 2242890 - RNA, 21 nt, Human
acuuuagaguagcaugagaga

SEQ ID NO: 2242891 - RNA, 19 nt, Human
acuuuagaguagcaugaga

SEQ ID NO: 2242892 - RNA, 15 nt, Human
acuuuagaguagcau

SEQ ID NO: 2242893 - RNA, 15 nt, Human
acuuuagaaugagag

SEQ ID NO: 2242894 - RNA, 15 nt, Human
acuuuacuaagauga

SEQ ID NO: 2242895 - RNA, 16 nt, Human
acuuuacuaagaugac

SEQ ID NO: 2242896 - RNA, 18 nt, Human
acuuuacuaagaugacau

SEQ ID NO: 2242897 - RNA, 22 nt, Human
acuuuacuaagaugacauugcu

SEQ ID NO: 2242898 - RNA, 22 nt, Human
acuugugcugaucgugcuaaau

SEQ ID NO: 2242899 - RNA, 16 nt, Human
acuuguuuucugggaa

SEQ ID NO: 2242900 - RNA, 16 nt, Human
acuuuaaaaggagcca

SEQ ID NO: 2242901 - RNA, 16 nt, Human
acuugugauuauuuau

SEQ ID NO: 2242902 - RNA, 14 nt, Human
acuuguggacacag

SEQ ID NO: 2242903 - RNA, 13 nt, Human
acuugugccaaca

SEQ ID NO: 2242904 - RNA, 18 nt, Human
acuugugccaacacucaa

SEQ ID NO: 2242905 - RNA, 20 nt, Human
acuugugauuauuuauuauu

SEQ ID NO: 2242906 - RNA, 17 nt, Human
acuugugauuauuuauu

SEQ ID NO: 2242907 - RNA, 23 nt, Human
acuugccgcgucgcccucccagg

SEQ ID NO: 2242908 - RNA, 22 nt, Human
acuugccgcgucgcccucccag

SEQ ID NO: 2242909 - RNA, 21 nt, Human
acuuggaaaaauccagaaaga

SEQ ID NO: 2242910 - RNA, 12 nt, Human
acuugccucuuc

SEQ ID NO: 2242911 - RNA, 14 nt, Human
acuuggaagcuccg

SEQ ID NO: 2242912 - RNA, 11 nt, Human
acuuggagcca

SEQ ID NO: 2242913 - RNA, 18 nt, Human
acuuggacucuugcucuu

SEQ ID NO: 2242914 - RNA, 19 nt, Human
acuuggacucuugcucuuu

SEQ ID NO: 2242915 - RNA, 15 nt, Human
acuuggacucuugcu

SEQ ID NO: 2242916 - RNA, 16 nt, Human
acuuggacucuugcuc

SEQ ID NO: 2242917 - RNA, 22 nt, Human
acuuggaauuuguaaccucagc

SEQ ID NO: 2242918 - RNA, 23 nt, Human
acuuggaauuuguaaccucagcu

SEQ ID NO: 2242919 - RNA, 22 nt, Human
acuuggaaaaauccagaaagaa

SEQ ID NO: 2242920 - RNA, 16 nt, Human
acuuggaauuuguaac

SEQ ID NO: 2242921 - RNA, 18 nt, Human
acuuggaauuuguaaccu

SEQ ID NO: 2242922 - RNA, 21 nt, Human
acuuggaauuuguaaccucag

SEQ ID NO: 2242923 - RNA, 15 nt, Human
acuugaguuuuauuu

SEQ ID NO: 2242924 - RNA, 21 nt, Human
acuugaguuuuauuuauuuua

SEQ ID NO: 2242925 - RNA, 19 nt, Human
acuugcauccaacuccagg

SEQ ID NO: 2242926 - RNA, 11 nt, Human
acuugcauuuc

SEQ ID NO: 2242927 - RNA, 14 nt, Human
acuugcauuuuugc

SEQ ID NO: 2242928 - RNA, 13 nt, Human
acuugcaucugug

SEQ ID NO: 2242929 - RNA, 15 nt, Human
acuugcauggagcag

SEQ ID NO: 2242930 - RNA, 19 nt, Human
acuugcauugaauauauua

SEQ ID NO: 2242931 - RNA, 19 nt, Human
acuugcauuuuugcaggag

SEQ ID NO: 2242932 - RNA, 18 nt, Human
acuugcauuuuugcagga

SEQ ID NO: 2242933 - RNA, 17 nt, Human
acuugcauuuuugcagg

SEQ ID NO: 2242934 - RNA, 21 nt, Human
acuugcccacaccgagggcga

SEQ ID NO: 2242935 - RNA, 19 nt, Human
acuuggagccaaggguuca

SEQ ID NO: 2242936 - RNA, 14 nt, Human
acuuggagccaagg

SEQ ID NO: 2242937 - RNA, 14 nt, Human
acuuggagccccag

SEQ ID NO: 2242938 - RNA, 21 nt, Human
acuuggacuuguccucagcag

SEQ ID NO: 2242939 - RNA, 14 nt, Human
acuuguauauuuua

SEQ ID NO: 2242940 - RNA, 14 nt, Human
acuuguaugaaaga

SEQ ID NO: 2242941 - RNA, 19 nt, Human
acuuguauauuuguacaaa

SEQ ID NO: 2242942 - RNA, 20 nt, Human
acuuguauauuuuaagaaau

SEQ ID NO: 2242943 - RNA, 13 nt, Human
acuuguauuaugu

SEQ ID NO: 2242944 - RNA, 14 nt, Human
acuuguauuaugug

SEQ ID NO: 2242945 - RNA, 18 nt, Human
acuuguauuaaagacaga

SEQ ID NO: 2242946 - RNA, 23 nt, Human
acuuguccuuuuguaccauggug

SEQ ID NO: 2242947 - RNA, 15 nt, Human
acuuguauuaugugu

SEQ ID NO: 2242948 - RNA, 14 nt, Human
acuugucuuuggac

SEQ ID NO: 2242949 - RNA, 16 nt, Human
acuugucuauuaccug

SEQ ID NO: 2242950 - RNA, 15 nt, Human
acuugucuaaauaag

SEQ ID NO: 2242951 - RNA, 19 nt, Human
acuugucuaaauaaguuug

SEQ ID NO: 2242952 - RNA, 20 nt, Human
acuugucuaaauaaguuugc

SEQ ID NO: 2242953 - RNA, 22 nt, Human
acuugucuaaauaaguuugcaa

SEQ ID NO: 2242954 - RNA, 17 nt, Human
acuugacagaacacugu

SEQ ID NO: 2242955 - RNA, 18 nt, Human
acuugaauuuucccacug

SEQ ID NO: 2242956 - RNA, 19 nt, Human
acuugaauuuucccacugc

SEQ ID NO: 2242957 - RNA, 18 nt, Human
acuugacagaacacuguc

SEQ ID NO: 2242958 - RNA, 20 nt, Human
acuugacagaacacugucuu

SEQ ID NO: 2242959 - RNA, 19 nt, Human
acuugacccccuugagggu

SEQ ID NO: 2242960 - RNA, 20 nt, Human
acuugaauuuucccacugca

SEQ ID NO: 2242961 - RNA, 17 nt, Human
acuugacuuuuaaggcu

SEQ ID NO: 2242962 - RNA, 18 nt, Human
acuugaggauuuugagua

SEQ ID NO: 2242963 - RNA, 12 nt, Human
acuugaggauuu

SEQ ID NO: 2242964 - RNA, 19 nt, Human
acuugagaauuacccuuuu

SEQ ID NO: 2242965 - RNA, 17 nt, Human
acuugaggguaauaaac

SEQ ID NO: 2242966 - RNA, 18 nt, Human
acuugaggguaauaaacu

SEQ ID NO: 2242967 - RNA, 19 nt, Human
acuugaggguaauaaacuu

SEQ ID NO: 2242968 - RNA, 15 nt, Human
acuugagggcccaga

SEQ ID NO: 2242969 - RNA, 16 nt, Human
acuugagggcccagag

SEQ ID NO: 2242970 - RNA, 17 nt, Human
acuugagggcccagagc

SEQ ID NO: 2242971 - RNA, 18 nt, Human
acuugagggcccagagca

SEQ ID NO: 2242972 - RNA, 19 nt, Human
acuugagggcccagagcag

SEQ ID NO: 2242973 - RNA, 20 nt, Human
acuugagggcccagagcagg

SEQ ID NO: 2242974 - RNA, 21 nt, Human
acuugagggcccagagcagga

SEQ ID NO: 2242975 - RNA, 15 nt, Human
acuugaggguaauaa

SEQ ID NO: 2242976 - RNA, 20 nt, Human
acuugaaagcauccaugugu

SEQ ID NO: 2242977 - RNA, 18 nt, Human
acuugaaauaccagugaa

SEQ ID NO: 2242978 - RNA, 18 nt, Human
acuugaaagcauccaugu

SEQ ID NO: 2242979 - RNA, 14 nt, Human
acuugaaagcaucc

SEQ ID NO: 2242980 - RNA, 18 nt, Human
acuugaaaucuaggauua

SEQ ID NO: 2242981 - RNA, 19 nt, Human
acuugaaauaccagugaac

SEQ ID NO: 2242982 - RNA, 23 nt, Human
acuugaacccgggaggcagaggu

SEQ ID NO: 2242983 - RNA, 13 nt, Human
acuugaaagcauc

SEQ ID NO: 2242984 - RNA, 16 nt, Human
acuugaaaauuaacau

SEQ ID NO: 2242985 - RNA, 18 nt, Human
acuugaaaauuaacauga

SEQ ID NO: 2242986 - RNA, 17 nt, Human
acuugaaaauuaacaug

SEQ ID NO: 2242987 - RNA, 20 nt, Human
acuucucuggaaagggggga

SEQ ID NO: 2242988 - RNA, 13 nt, Human
acuucucugaagg

SEQ ID NO: 2242989 - RNA, 14 nt, Human
acuucucugaaggg

SEQ ID NO: 2242990 - RNA, 17 nt, Human
acuucucugaagggagg

SEQ ID NO: 2242991 - RNA, 10 nt, Human
acuucuccca

SEQ ID NO: 2242992 - RNA, 13 nt, Human
acuucuccagccu

SEQ ID NO: 2242993 - RNA, 15 nt, Human
acuucuccagccuag

SEQ ID NO: 2242994 - RNA, 16 nt, Human
acuucuccaggucuca

SEQ ID NO: 2242995 - RNA, 22 nt, Human
acuucuccauccuuucugccuc

SEQ ID NO: 2242996 - RNA, 22 nt, Human
acuucggcagauacugucucuu

SEQ ID NO: 2242997 - RNA, 22 nt, Human
acuucuccagacccaccacacc

SEQ ID NO: 2242998 - RNA, 21 nt, Human
acuucuaaguaaaaccacagc

SEQ ID NO: 2242999 - RNA, 18 nt, Human
acuucuccacccugcucu

SEQ ID NO: 2243000 - RNA, 20 nt, Human
acuucgcaucaaaagacaau

SEQ ID NO: 2243001 - RNA, 22 nt, Human
acuucgcaucaaaagacaauuc

SEQ ID NO: 2243002 - RNA, 23 nt, Human
acuucgcaucaaaagacaauucu

SEQ ID NO: 2243003 - RNA, 24 nt, Human
acuucgcaucaaaagacaauucuu

SEQ ID NO: 2243004 - RNA, 13 nt, Human
acuucuaaguaaa

SEQ ID NO: 2243005 - RNA, 19 nt, Human
acuucuaaguaaaaccaca

SEQ ID NO: 2243006 - RNA, 18 nt, Human
acuucuaaguaaaaccac

SEQ ID NO: 2243007 - RNA, 18 nt, Human
acuuccuccuccccacuu

SEQ ID NO: 2243008 - RNA, 15 nt, Human
acuuccuccucccca

SEQ ID NO: 2243009 - RNA, 17 nt, Human
acuuccuccuccccacu

SEQ ID NO: 2243010 - RNA, 22 nt, Human
acuucccuuucugcuuguguua

SEQ ID NO: 2243011 - RNA, 16 nt, Human
ucucacuccuaccugg

SEQ ID NO: 2243012 - RNA, 17 nt, Human
ucucacuccuaccuggu

SEQ ID NO: 2243013 - RNA, 18 nt, Human
ucucacuccuaccuggua

SEQ ID NO: 2243014 - RNA, 14 nt, Human
acuucccuuucugc

SEQ ID NO: 2243015 - RNA, 20 nt, Human
acuucgggaggucgaggcag

SEQ ID NO: 2243016 - RNA, 17 nt, Human
acuucgggaggucgagg

SEQ ID NO: 2243017 - RNA, 12 nt, Human
acuuccugccua

SEQ ID NO: 2243018 - RNA, 14 nt, Human
acuuccuguccaga

SEQ ID NO: 2243019 - RNA, 14 nt, Human
acuucgacugugac

SEQ ID NO: 2243020 - RNA, 16 nt, Human
acuucgcaucaaaaga

SEQ ID NO: 2243021 - RNA, 17 nt, Human
acuucgcaucaaaagac

SEQ ID NO: 2243022 - RNA, 13 nt, Human
acuuccuguccag

SEQ ID NO: 2243023 - RNA, 12 nt, Human
acuuccugucca

SEQ ID NO: 2243024 - RNA, 13 nt, Human
ucuauauauaauu

SEQ ID NO: 2243025 - RNA, 14 nt, Human
ucuauauauaauuc

SEQ ID NO: 2243026 - RNA, 18 nt, Human
ucuauauauaauucugua

SEQ ID NO: 2243027 - RNA, 19 nt, Human
ucuauauauaauucuguac

SEQ ID NO: 2243028 - RNA, 20 nt, Human
ucuauauauaauucuguaca

SEQ ID NO: 2243029 - RNA, 21 nt, Human
ucuauauauaauucuguacau

SEQ ID NO: 2243030 - RNA, 23 nt, Human
ucuauauauaauucuguacauag

SEQ ID NO: 2243031 - RNA, 14 nt, Human
ucuauauaugugua

SEQ ID NO: 2243032 - RNA, 15 nt, Human
ucuauauauguguau

SEQ ID NO: 2243033 - RNA, 18 nt, Human
ucuauuggguucauuauu

SEQ ID NO: 2243034 - RNA, 17 nt, Human
ucuauuggguucauuau

SEQ ID NO: 2243035 - RNA, 16 nt, Human
ucuauuggguucauua

SEQ ID NO: 2243036 - RNA, 15 nt, Human
ucuauuggguucauu

SEQ ID NO: 2243037 - RNA, 16 nt, Human
ucuauauauguguaug

SEQ ID NO: 2243038 - RNA, 19 nt, Human
ucuauauauguguauguac

SEQ ID NO: 2243039 - RNA, 12 nt, Human
ucuauaugaauu

SEQ ID NO: 2243040 - RNA, 14 nt, Human
ucuauaugaauuua

SEQ ID NO: 2243041 - RNA, 22 nt, Human
ucuauuggguucauuauuggaa

SEQ ID NO: 2243042 - RNA, 14 nt, Human
ucuauuguagcauu

SEQ ID NO: 2243043 - RNA, 13 nt, Human
ucuauuguacaga

SEQ ID NO: 2243044 - RNA, 15 nt, Human
ucuauuguagcauuu

SEQ ID NO: 2243045 - RNA, 17 nt, Human
ucuauuguagcauuucu

SEQ ID NO: 2243046 - RNA, 18 nt, Human
ucuauuguagcauuucuu

SEQ ID NO: 2243047 - RNA, 19 nt, Human
ucuauuguagcauuucuug

SEQ ID NO: 2243048 - RNA, 16 nt, Human
ucucaaaaaaagaaaa

SEQ ID NO: 2243049 - RNA, 12 nt, Human
ucuauuuaagcc

SEQ ID NO: 2243050 - RNA, 17 nt, Human
ucuauuguuuauucuuu

SEQ ID NO: 2243051 - RNA, 16 nt, Human
ucuauuguuucuuuca

SEQ ID NO: 2243052 - RNA, 22 nt, Human
ucuauuguuguacacagaaaua

SEQ ID NO: 2243053 - RNA, 20 nt, Human
ucuauuguagcauuucuuga

SEQ ID NO: 2243054 - RNA, 12 nt, Human
ucuauuguuacu

SEQ ID NO: 2243055 - RNA, 23 nt, Human
ucuauuguuguacacagaaauac

SEQ ID NO: 2243056 - RNA, 16 nt, Human
ucuauuguuacucugg

SEQ ID NO: 2243057 - RNA, 16 nt, Human
ucuauuguuuauucuu

SEQ ID NO: 2243058 - RNA, 12 nt, Human
ucucacaguggg

SEQ ID NO: 2243059 - RNA, 14 nt, Human
ucucaaaaauaaau

SEQ ID NO: 2243060 - RNA, 19 nt, Human
ucucacagugggagccagg

SEQ ID NO: 2243061 - RNA, 21 nt, Human
ucucacagugggagccagggc

SEQ ID NO: 2243062 - RNA, 22 nt, Human
ucucacagugggagccagggcu

SEQ ID NO: 2243063 - RNA, 23 nt, Human
ucucacagugggagccagggcug

SEQ ID NO: 2243064 - RNA, 14 nt, Human
ucuauuuuuguaga

SEQ ID NO: 2243065 - RNA, 13 nt, Human
ucuauuuuugucu

SEQ ID NO: 2243066 - RNA, 13 nt, Human
ucucaaaaaauaa

SEQ ID NO: 2243067 - RNA, 22 nt, Human
ucucaaaaaaaaaaaaaugcac

SEQ ID NO: 2243068 - RNA, 17 nt, Human
ucucaaaacugcacugu

SEQ ID NO: 2243069 - RNA, 17 nt, Human
ucucacuccaccaccca

SEQ ID NO: 2243070 - RNA, 18 nt, Human
ucucacuccaccacccaa

SEQ ID NO: 2243071 - RNA, 13 nt, Human
ucucacuccuacc

SEQ ID NO: 2243072 - RNA, 15 nt, Human
ucucacuccaccacc

SEQ ID NO: 2243073 - RNA, 14 nt, Human
ucucacuccaccac

SEQ ID NO: 2243074 - RNA, 13 nt, Human
ucucacuccacca

SEQ ID NO: 2243075 - RNA, 12 nt, Human
ucucacuccacc

SEQ ID NO: 2243076 - RNA, 12 nt, Human
ucucaccaggaa

SEQ ID NO: 2243077 - RNA, 15 nt, Human
ucucaccaggaaggg

SEQ ID NO: 2243078 - RNA, 23 nt, Human
ucucacauggugcuacgccugca

SEQ ID NO: 2243079 - RNA, 22 nt, Human
ucucacauggugcuacgccugc

SEQ ID NO: 2243080 - RNA, 17 nt, Human
ucuagcuggugguuuca

SEQ ID NO: 2243081 - RNA, 18 nt, Human
ucuagcuguugagcuguu

SEQ ID NO: 2243082 - RNA, 19 nt, Human
ucuagcuguugagcuguuu

SEQ ID NO: 2243083 - RNA, 11 nt, Human
ucuagcuguug

SEQ ID NO: 2243084 - RNA, 21 nt, Human
ucuagcugggggugggccagg

SEQ ID NO: 2243085 - RNA, 22 nt, Human
ucuaguggucuuuguaagagug

SEQ ID NO: 2243086 - RNA, 23 nt, Human
ucuaguggucuuuguaagagugu

SEQ ID NO: 2243087 - RNA, 13 nt, Human
ucuaguuugcauu

SEQ ID NO: 2243088 - RNA, 23 nt, Human
ucuaguuugauuaaauucuugca

SEQ ID NO: 2243089 - RNA, 21 nt, Human
ucuauaggaacauaugaaaau

SEQ ID NO: 2243090 - RNA, 20 nt, Human
ucuauaggaacauaugaaaa

SEQ ID NO: 2243091 - RNA, 18 nt, Human
ucuauaggaacauaugaa

SEQ ID NO: 2243092 - RNA, 15 nt, Human
ucuauacauaucuuu

SEQ ID NO: 2243093 - RNA, 18 nt, Human
ucuauacauaucuuuauu

SEQ ID NO: 2243094 - RNA, 19 nt, Human
ucuauaaucccagcacuuu

SEQ ID NO: 2243095 - RNA, 20 nt, Human
ucuauaaucccagcacuuug

SEQ ID NO: 2243096 - RNA, 21 nt, Human
ucuauaaucccagcacuuugg

SEQ ID NO: 2243097 - RNA, 13 nt, Human
ucuaguuuuguca

SEQ ID NO: 2243098 - RNA, 15 nt, Human
ucuaguuugcauucc

SEQ ID NO: 2243099 - RNA, 18 nt, Human
ucuaguuugcauuccuga

SEQ ID NO: 2243100 - RNA, 11 nt, Human
ucuaguuuuca

SEQ ID NO: 2243101 - RNA, 12 nt, Human
ucuaguuuucag

SEQ ID NO: 2243102 - RNA, 14 nt, Human
ucuaguuuucaguu

SEQ ID NO: 2243103 - RNA, 17 nt, Human
ucuaguuuucaguuugu

SEQ ID NO: 2243104 - RNA, 18 nt, Human
ucuaguuuucaguuugua

SEQ ID NO: 2243105 - RNA, 20 nt, Human
ucuaguuuucaguuuguaua

SEQ ID NO: 2243106 - RNA, 13 nt, Human
ucuauaauuuaaa

SEQ ID NO: 2243107 - RNA, 19 nt, Human
acuucccauuuuggaaguu

SEQ ID NO: 2243108 - RNA, 24 nt, Human
ucuagauacuguaucaugacaaag

SEQ ID NO: 2243109 - RNA, 24 nt, Human
acuucccaguucaggagucccaag

SEQ ID NO: 2243110 - RNA, 23 nt, Human
acuucccaguucaggagucccaa

SEQ ID NO: 2243111 - RNA, 22 nt, Human
acuucccaguucaggaguccca

SEQ ID NO: 2243112 - RNA, 20 nt, Human
acuuccauggcccucauuaa

SEQ ID NO: 2243113 - RNA, 20 nt, Human
acuucccacucuagggcagu

SEQ ID NO: 2243114 - RNA, 17 nt, Human
acuucccagugaauucu

SEQ ID NO: 2243115 - RNA, 21 nt, Human
ucuagauuacccccucauugu

SEQ ID NO: 2243116 - RNA, 20 nt, Human
ucuagauggcuccucucagu

SEQ ID NO: 2243117 - RNA, 19 nt, Human
ucuagauggcuccucucag

SEQ ID NO: 2243118 - RNA, 18 nt, Human
ucuagauggcuccucuca

SEQ ID NO: 2243119 - RNA, 23 nt, Human
ucuagaugaaguuuuacauuguu

SEQ ID NO: 2243120 - RNA, 22 nt, Human
ucuagaugaaguuuuacauugu

SEQ ID NO: 2243121 - RNA, 15 nt, Human
ucuagauaucgacuu

SEQ ID NO: 2243122 - RNA, 21 nt, Human
ucuagaugaaguuuuacauug

SEQ ID NO: 2243123 - RNA, 20 nt, Human
ucuagaugaaguuuuacauu

SEQ ID NO: 2243124 - RNA, 19 nt, Human
ucuagaugaaguuuuacau

SEQ ID NO: 2243125 - RNA, 16 nt, Human
ucuagcuagaaauaug

SEQ ID NO: 2243126 - RNA, 21 nt, Human
ucuagcuagaaauaugauuuu

SEQ ID NO: 2243127 - RNA, 23 nt, Human
ucuagcuagaaauaugauuuuau

SEQ ID NO: 2243128 - RNA, 12 nt, Human
ucuagccugggc

SEQ ID NO: 2243129 - RNA, 13 nt, Human
ucuagcccaugga

SEQ ID NO: 2243130 - RNA, 23 nt, Human
ucuagauuacccccucauuguuu

SEQ ID NO: 2243131 - RNA, 15 nt, Human
ucuagauugagagaa

SEQ ID NO: 2243132 - RNA, 16 nt, Human
ucuagcaaauguuaug

SEQ ID NO: 2243133 - RNA, 23 nt, Human
ucuagcaaucacaacacuggcug

SEQ ID NO: 2243134 - RNA, 15 nt, Human
ucuagcaaauguuau

SEQ ID NO: 2243135 - RNA, 19 nt, Human
ucuagauuuuguuuugcuu

SEQ ID NO: 2243136 - RNA, 17 nt, Human
ucuagcacuggccugca

SEQ ID NO: 2243137 - RNA, 14 nt, Human
ucuagcacuggccu

SEQ ID NO: 2243138 - RNA, 15 nt, Human
ucuagcacuggccug

SEQ ID NO: 2243139 - RNA, 16 nt, Human
ucuagcacuggccugc

SEQ ID NO: 2243140 - RNA, 19 nt, Human
acuucaucuucucagcucc

SEQ ID NO: 2243141 - RNA, 15 nt, Human
acuucaucuucucag

SEQ ID NO: 2243142 - RNA, 16 nt, Human
acuucaucuucucagc

SEQ ID NO: 2243143 - RNA, 14 nt, Human
acuucauucuugaa

SEQ ID NO: 2243144 - RNA, 15 nt, Human
acuucauucuugaaa

SEQ ID NO: 2243145 - RNA, 17 nt, Human
acuucauuaauaauaaa

SEQ ID NO: 2243146 - RNA, 19 nt, Human
acuucauucuugaaagcug

SEQ ID NO: 2243147 - RNA, 21 nt, Human
acuucauucuugaaagcugug

SEQ ID NO: 2243148 - RNA, 14 nt, Human
acuucaugucaacu

SEQ ID NO: 2243149 - RNA, 21 nt, Human
acuucauugagaguuuugucu

SEQ ID NO: 2243150 - RNA, 20 nt, Human
acuuccaaaccugacagaug

SEQ ID NO: 2243151 - RNA, 14 nt, Human
acuuaucuuaugcc

SEQ ID NO: 2243152 - RNA, 20 nt, Human
acuucaggcucuucuccuuu

SEQ ID NO: 2243153 - RNA, 17 nt, Human
acuucaggcucuucucc

SEQ ID NO: 2243154 - RNA, 18 nt, Human
acuucaggcucuucuccu

SEQ ID NO: 2243155 - RNA, 23 nt, Human
acuucagggcagggcucugauau

SEQ ID NO: 2243156 - RNA, 21 nt, Human
acuucagggcagggcucugau

SEQ ID NO: 2243157 - RNA, 15 nt, Human
acuucaggggcugcc

SEQ ID NO: 2243158 - RNA, 20 nt, Human
acuucagggcagggcucuga

SEQ ID NO: 2243159 - RNA, 19 nt, Human
acuucagggcagggcucug

SEQ ID NO: 2243160 - RNA, 20 nt, Human
acuuccagugcaacacugaa

SEQ ID NO: 2243161 - RNA, 16 nt, Human
acuuccauacagcucu

SEQ ID NO: 2243162 - RNA, 17 nt, Human
acuuccauacagcucua

SEQ ID NO: 2243163 - RNA, 17 nt, Human
acuuccauaaucuggac

SEQ ID NO: 2243164 - RNA, 17 nt, Human
acuuccaugaggccaaa

SEQ ID NO: 2243165 - RNA, 18 nt, Human
acuuccauggcccucauu

SEQ ID NO: 2243166 - RNA, 17 nt, Human
acuuccauggcccucau

SEQ ID NO: 2243167 - RNA, 21 nt, Human
acuuccagguguuacuguaau

SEQ ID NO: 2243168 - RNA, 20 nt, Human
acuuccagguguuacuguaa

SEQ ID NO: 2243169 - RNA, 20 nt, Human
acuuccagauccuggaaauc

SEQ ID NO: 2243170 - RNA, 18 nt, Human
acuuccaccagccugcac

SEQ ID NO: 2243171 - RNA, 16 nt, Human
acuuccaccagccugc

SEQ ID NO: 2243172 - RNA, 15 nt, Human
acuuccaccagccug

SEQ ID NO: 2243173 - RNA, 14 nt, Human
acuuccaccagccu

SEQ ID NO: 2243174 - RNA, 17 nt, Human
acuuccacugccauccu

SEQ ID NO: 2243175 - RNA, 21 nt, Human
acuuccaaauccccuaagcag

SEQ ID NO: 2243176 - RNA, 19 nt, Human
acuuccaaauccccuaagc

SEQ ID NO: 2243177 - RNA, 18 nt, Human
acuuccaauuuacauacu

SEQ ID NO: 2243178 - RNA, 20 nt, Human
acuuagagguggggagcaga

SEQ ID NO: 2243179 - RNA, 15 nt, Human
acuuacuguacauga

SEQ ID NO: 2243180 - RNA, 14 nt, Human
acuuacuguacaug

SEQ ID NO: 2243181 - RNA, 13 nt, Human
acuuacuguacau

SEQ ID NO: 2243182 - RNA, 12 nt, Human
ucuaccugaggg

SEQ ID NO: 2243183 - RNA, 19 nt, Human
ucuaccugaggggccucuu

SEQ ID NO: 2243184 - RNA, 15 nt, Human
ucuaccucuuggcug

SEQ ID NO: 2243185 - RNA, 12 nt, Human
ucuaccugccac

SEQ ID NO: 2243186 - RNA, 19 nt, Human
ucuaccucaggcagcucaa

SEQ ID NO: 2243187 - RNA, 16 nt, Human
ucuaccugccacucac

SEQ ID NO: 2243188 - RNA, 14 nt, Human
ucuaccugccacuc

SEQ ID NO: 2243189 - RNA, 15 nt, Human
ucuaccugccacuca

SEQ ID NO: 2243190 - RNA, 21 nt, Human
ucuaccugccacucacacagc

SEQ ID NO: 2243191 - RNA, 18 nt, Human
acuuauccuaaaacaaau

SEQ ID NO: 2243192 - RNA, 19 nt, Human
acuuauccuaaaacaaaua

SEQ ID NO: 2243193 - RNA, 20 nt, Human
acuuaucauccacauuguuu

SEQ ID NO: 2243194 - RNA, 22 nt, Human
acuuaucauccacauuguuuua

SEQ ID NO: 2243195 - RNA, 15 nt, Human
acuuaucccucucca

SEQ ID NO: 2243196 - RNA, 16 nt, Human
acuucaggcucuucuc

SEQ ID NO: 2243197 - RNA, 14 nt, Human
acuuaucccucucc

SEQ ID NO: 2243198 - RNA, 16 nt, Human
acuuaucucucugugc

SEQ ID NO: 2243199 - RNA, 17 nt, Human
acuuaucucucugugcu

SEQ ID NO: 2243200 - RNA, 22 nt, Human
acuuaucucucugugcugugga

SEQ ID NO: 2243201 - RNA, 19 nt, Human
acuuaucauccacauuguu

SEQ ID NO: 2243202 - RNA, 21 nt, Human
acuuauauuguaagaaauacu

SEQ ID NO: 2243203 - RNA, 20 nt, Human
acuuauauuguaagaaauac

SEQ ID NO: 2243204 - RNA, 19 nt, Human
acuuauauuguaagaaaua

SEQ ID NO: 2243205 - RNA, 18 nt, Human
acuuauauuguaagaaau

SEQ ID NO: 2243206 - RNA, 17 nt, Human
acuuauauuguaagaaa

SEQ ID NO: 2243207 - RNA, 15 nt, Human
acuuauauuguaaga

SEQ ID NO: 2243208 - RNA, 21 nt, Human
acuuagaggaaauaagaaaaa

SEQ ID NO: 2243209 - RNA, 18 nt, Human
acuuagaucuccaggaga

SEQ ID NO: 2243210 - RNA, 20 nt, Human
acuguaucaugacaaagacu

SEQ ID NO: 2243211 - RNA, 16 nt, Human
acuguaucaugacaaa

SEQ ID NO: 2243212 - RNA, 20 nt, Human
acuguauuuuuaccuuuuuc

SEQ ID NO: 2243213 - RNA, 23 nt, Human
acugucaaaaaguuugguucugu

SEQ ID NO: 2243214 - RNA, 15 nt, Human
acugucaaaauaauu

SEQ ID NO: 2243215 - RNA, 21 nt, Human
acuguauuuuguauuguuuca

SEQ ID NO: 2243216 - RNA, 22 nt, Human
acuguauuugugacuaauugua

SEQ ID NO: 2243217 - RNA, 23 nt, Human
acuguauuugugacuaauuguau

SEQ ID NO: 2243218 - RNA, 13 nt, Human
acuguauuuguau

SEQ ID NO: 2243219 - RNA, 14 nt, Human
acuguauuuguauc

SEQ ID NO: 2243220 - RNA, 13 nt, Human
acuguauuuguga

SEQ ID NO: 2243221 - RNA, 14 nt, Human
acuguauuugugac

SEQ ID NO: 2243222 - RNA, 15 nt, Human
acuguauuugugacu

SEQ ID NO: 2243223 - RNA, 16 nt, Human
acuguauuugugacua

SEQ ID NO: 2243224 - RNA, 17 nt, Human
acuguauuugugacuaa

SEQ ID NO: 2243225 - RNA, 20 nt, Human
acuguauuugugacuaauug

SEQ ID NO: 2243226 - RNA, 13 nt, Human
acuguaugcugga

SEQ ID NO: 2243227 - RNA, 11 nt, Human
acuguauggaa

SEQ ID NO: 2243228 - RNA, 12 nt, Human
acuguauugaug

SEQ ID NO: 2243229 - RNA, 13 nt, Human
acuguauuaagag

SEQ ID NO: 2243230 - RNA, 21 nt, Human
acuguauuaagagugaaaauu

SEQ ID NO: 2243231 - RNA, 18 nt, Human
acuguccuccaagccagc

SEQ ID NO: 2243232 - RNA, 16 nt, Human
acuguccuccaagcca

SEQ ID NO: 2243233 - RNA, 20 nt, Human
acugucccucaaaugaccca

SEQ ID NO: 2243234 - RNA, 13 nt, Human
acugucauagaaa

SEQ ID NO: 2243235 - RNA, 12 nt, Human
acugucaggaag

SEQ ID NO: 2243236 - RNA, 16 nt, Human
acugucaggaagaaau

SEQ ID NO: 2243237 - RNA, 13 nt, Human
acugucccucaaa

SEQ ID NO: 2243238 - RNA, 15 nt, Human
acuguccagagagca

SEQ ID NO: 2243239 - RNA, 14 nt, Human
acugucccucaaau

SEQ ID NO: 2243240 - RNA, 22 nt, Human
acugucaggaagaaaucacaga

SEQ ID NO: 2243241 - RNA, 13 nt, Human
acuguccagagag

SEQ ID NO: 2243242 - RNA, 14 nt, Human
acuguccagagagc

SEQ ID NO: 2243243 - RNA, 14 nt, Human
acugucacccucca

SEQ ID NO: 2243244 - RNA, 20 nt, Human
acugucaaggcugcuuagaa

SEQ ID NO: 2243245 - RNA, 19 nt, Human
acugucaaaauaauuuuau

SEQ ID NO: 2243246 - RNA, 15 nt, Human
acugucacucauugc

SEQ ID NO: 2243247 - RNA, 14 nt, Human
acugucacucauug

SEQ ID NO: 2243248 - RNA, 22 nt, Human
acugucaaggcugcuuagaauc

SEQ ID NO: 2243249 - RNA, 21 nt, Human
acugucaaggcugcuuagaau

SEQ ID NO: 2243250 - RNA, 15 nt, Human
acugucacccuccac

SEQ ID NO: 2243251 - RNA, 17 nt, Human
acugucacccuccaccu

SEQ ID NO: 2243252 - RNA, 23 nt, Human
acugucagcuccccucggagaag

SEQ ID NO: 2243253 - RNA, 22 nt, Human
acugucagcuccccucggagaa

SEQ ID NO: 2243254 - RNA, 18 nt, Human
acuguacuuaauaaauuc

SEQ ID NO: 2243255 - RNA, 17 nt, Human
acuguacuuaauaaauu

SEQ ID NO: 2243256 - RNA, 16 nt, Human
acuguacuucacuguc

SEQ ID NO: 2243257 - RNA, 13 nt, Human
acuguacuucacu

SEQ ID NO: 2243258 - RNA, 15 nt, Human
acuguacuucacugu

SEQ ID NO: 2243259 - RNA, 23 nt, Human
acuguacuugcucuugaugccug

SEQ ID NO: 2243260 - RNA, 14 nt, Human
acuguaucaugaca

SEQ ID NO: 2243261 - RNA, 20 nt, Human
acuguacuccucccaggcgc

SEQ ID NO: 2243262 - RNA, 15 nt, Human
acuguacuccuccca

SEQ ID NO: 2243263 - RNA, 22 nt, Human
acuguacaaugacuuuauugca

SEQ ID NO: 2243264 - RNA, 15 nt, Human
acuguacuugcucuu

SEQ ID NO: 2243265 - RNA, 21 nt, Human
acuguacaugaaaacacauuu

SEQ ID NO: 2243266 - RNA, 20 nt, Human
acuguacaugaaaacacauu

SEQ ID NO: 2243267 - RNA, 18 nt, Human
acuguacagacagaaaaa

SEQ ID NO: 2243268 - RNA, 16 nt, Human
acuguacaugaaaaca

SEQ ID NO: 2243269 - RNA, 19 nt, Human
acuguacaugaaaacacau

SEQ ID NO: 2243270 - RNA, 22 nt, Human
acuguacaaaguagaagucuua

SEQ ID NO: 2243271 - RNA, 16 nt, Human
acuguacaaaguagaa

SEQ ID NO: 2243272 - RNA, 17 nt, Human
acuggguacuuguggac

SEQ ID NO: 2243273 - RNA, 18 nt, Human
acuggguacuuguggaca

SEQ ID NO: 2243274 - RNA, 16 nt, Human
acugaaauauacacac

SEQ ID NO: 2243275 - RNA, 15 nt, Human
acugaaauauacaca

SEQ ID NO: 2243276 - RNA, 13 nt, Human
acugaaagguuac

SEQ ID NO: 2243277 - RNA, 22 nt, Human
acugaacaaacuaucagaggaa

SEQ ID NO: 2243278 - RNA, 17 nt, Human
acugaaauauacacaca

SEQ ID NO: 2243279 - RNA, 22 nt, Human
acugaagaagcaccaaucauga

SEQ ID NO: 2243280 - RNA, 18 nt, Human
acugaagccagaaauaaa

SEQ ID NO: 2243281 - RNA, 21 nt, Human
acugaagcagccucuccccag

SEQ ID NO: 2243282 - RNA, 13 nt, Human
acugaagcagccu

SEQ ID NO: 2243283 - RNA, 14 nt, Human
acugaagcagccuc

SEQ ID NO: 2243284 - RNA, 19 nt, Human
acugaagccugcaggaguu

SEQ ID NO: 2243285 - RNA, 16 nt, Human
acugaagccugcagga

SEQ ID NO: 2243286 - RNA, 15 nt, Human
ucgccccagaucacc

SEQ ID NO: 2243287 - RNA, 15 nt, Human
acugaagccugcagg

SEQ ID NO: 2243288 - RNA, 14 nt, Human
acugaagccugcag

SEQ ID NO: 2243289 - RNA, 12 nt, Human
acugaagccugc

SEQ ID NO: 2243290 - RNA, 20 nt, Human
ucgccccagcaggugcugac

SEQ ID NO: 2243291 - RNA, 22 nt, Human
ucgccccagaucaccagcccgg

SEQ ID NO: 2243292 - RNA, 13 nt, Human
ucgcccccaccuc

SEQ ID NO: 2243293 - RNA, 14 nt, Human
ucgccccagcaggu

SEQ ID NO: 2243294 - RNA, 18 nt, Human
ucgccccagaucaccagc

SEQ ID NO: 2243295 - RNA, 20 nt, Human
ucgccccagaucaccagccc

SEQ ID NO: 2243296 - RNA, 11 nt, Human
ucgcccgccca

SEQ ID NO: 2243297 - RNA, 13 nt, Human
ucgcccgcccacu

SEQ ID NO: 2243298 - RNA, 15 nt, Human
ucgcccgcccacugu

SEQ ID NO: 2243299 - RNA, 17 nt, Human
ucgcccgcccacugucc

SEQ ID NO: 2243300 - RNA, 18 nt, Human
ucgcccgcccacuguccu

SEQ ID NO: 2243301 - RNA, 19 nt, Human
ucgcccgcccacuguccug

SEQ ID NO: 2243302 - RNA, 20 nt, Human
ucgcccgcccacuguccugg

SEQ ID NO: 2243303 - RNA, 17 nt, Human
ucgcccucccaggcucu

SEQ ID NO: 2243304 - RNA, 13 nt, Human
ucgcccucccagg

SEQ ID NO: 2243305 - RNA, 21 nt, Human
ucgcccgcccacuguccuggg

SEQ ID NO: 2243306 - RNA, 22 nt, Human
ucgcccgcccacuguccugggc

SEQ ID NO: 2243307 - RNA, 18 nt, Human
ucgcccuggacugugugc

SEQ ID NO: 2243308 - RNA, 14 nt, Human
ucgcccucccaggc

SEQ ID NO: 2243309 - RNA, 23 nt, Human
ucgcccgcccacuguccugggcg

SEQ ID NO: 2243310 - RNA, 14 nt, Human
ucgccguggcugcg

SEQ ID NO: 2243311 - RNA, 15 nt, Human
ucgccgucugugaau

SEQ ID NO: 2243312 - RNA, 14 nt, Human
ucgcuccugugucu

SEQ ID NO: 2243313 - RNA, 12 nt, Human
ucgccuguaauc

SEQ ID NO: 2243314 - RNA, 15 nt, Human
ucgcucugcuggccu

SEQ ID NO: 2243315 - RNA, 17 nt, Human
ucgcucugcuggccugg

SEQ ID NO: 2243316 - RNA, 20 nt, Human
ucgcucugcuggccuggccg

SEQ ID NO: 2243317 - RNA, 21 nt, Human
ucgcucugcuggccuggccgg

SEQ ID NO: 2243318 - RNA, 23 nt, Human
ucgcucugcuggccuggccggca

SEQ ID NO: 2243319 - RNA, 17 nt, Human
ucgccguugaagaggaa

SEQ ID NO: 2243320 - RNA, 11 nt, Human
ucgccugacaa

SEQ ID NO: 2243321 - RNA, 20 nt, Human
ucgccugacaaccacugguc

SEQ ID NO: 2243322 - RNA, 21 nt, Human
ucgccugacaaccacuggucu

SEQ ID NO: 2243323 - RNA, 22 nt, Human
ucgccugacaaccacuggucug

SEQ ID NO: 2243324 - RNA, 14 nt, Human
ucgccuggccugag

SEQ ID NO: 2243325 - RNA, 15 nt, Human
ucgccuggccugagg

SEQ ID NO: 2243326 - RNA, 16 nt, Human
ucgcugugguuguuuu

SEQ ID NO: 2243327 - RNA, 13 nt, Human
acugggcccugcc

SEQ ID NO: 2243328 - RNA, 16 nt, Human
acugggcccugccucu

SEQ ID NO: 2243329 - RNA, 16 nt, Human
acugggcugaacacuc

SEQ ID NO: 2243330 - RNA, 23 nt, Human
ucgcuggacucucagucucugag

SEQ ID NO: 2243331 - RNA, 16 nt, Human
ucgcugucacaggcgg

SEQ ID NO: 2243332 - RNA, 23 nt, Human
ucgcugugucagcauagaaguaa

SEQ ID NO: 2243333 - RNA, 21 nt, Human
ucgcucuguugcccaggcugg

SEQ ID NO: 2243334 - RNA, 18 nt, Human
ucgcucugucacccaggc

SEQ ID NO: 2243335 - RNA, 22 nt, Human
ucgcucugucacccaggcugga

SEQ ID NO: 2243336 - RNA, 22 nt, Human
ucgcugauauauguguuuuuca

SEQ ID NO: 2243337 - RNA, 14 nt, Human
ucgcugaugcuggg

SEQ ID NO: 2243338 - RNA, 19 nt, Human
ucgcugauauauguguuuu

SEQ ID NO: 2243339 - RNA, 22 nt, Human
ucgcuggacucucagucucuga

SEQ ID NO: 2243340 - RNA, 20 nt, Human
ucgcuggacucucagucucu

SEQ ID NO: 2243341 - RNA, 20 nt, Human
ucgcugccagcucuguauca

SEQ ID NO: 2243342 - RNA, 11 nt, Human
ucgcugcugcg

SEQ ID NO: 2243343 - RNA, 19 nt, Human
ucgcugccagcucuguauc

SEQ ID NO: 2243344 - RNA, 20 nt, Human
ucgcugaugcugggcugggu

SEQ ID NO: 2243345 - RNA, 22 nt, Human
ucgcugaugcugggcugggugc

SEQ ID NO: 2243346 - RNA, 16 nt, Human
ucgcugaugcugggcu

SEQ ID NO: 2243347 - RNA, 17 nt, Human
ucgcugaugcugggcug

SEQ ID NO: 2243348 - RNA, 18 nt, Human
ucgcugaugcugggcugg

SEQ ID NO: 2243349 - RNA, 19 nt, Human
ucgcugaugcugggcuggg

SEQ ID NO: 2243350 - RNA, 13 nt, Human
acugggggagggg

SEQ ID NO: 2243351 - RNA, 13 nt, Human
acuggggggcuug

SEQ ID NO: 2243352 - RNA, 16 nt, Human
acuggggcuggcacaa

SEQ ID NO: 2243353 - RNA, 17 nt, Human
acuggggccuccagaac

SEQ ID NO: 2243354 - RNA, 14 nt, Human
acuggggcugaagg

SEQ ID NO: 2243355 - RNA, 15 nt, Human
acuggggcuggcaca

SEQ ID NO: 2243356 - RNA, 20 nt, Human
acugggguccuggggccucg

SEQ ID NO: 2243357 - RNA, 18 nt, Human
acugggguccuggggccu

SEQ ID NO: 2243358 - RNA, 19 nt, Human
acuggggguugcgggggga

SEQ ID NO: 2243359 - RNA, 15 nt, Human
acuggggugccgccu

SEQ ID NO: 2243360 - RNA, 19 nt, Human
acuggggugccgccugccc

SEQ ID NO: 2243361 - RNA, 15 nt, Human
acuggguacuugugg

SEQ ID NO: 2243362 - RNA, 21 nt, Human
acugggcuuggggaccagagc

SEQ ID NO: 2243363 - RNA, 17 nt, Human
acugggcugagggagcc

SEQ ID NO: 2243364 - RNA, 14 nt, Human
acugggcugaggga

SEQ ID NO: 2243365 - RNA, 13 nt, Human
acugggcugaggg

SEQ ID NO: 2243366 - RNA, 21 nt, Human
acugggcugaacacuccaauu

SEQ ID NO: 2243367 - RNA, 16 nt, Human
acuggggccuccagaa

SEQ ID NO: 2243368 - RNA, 13 nt, Human
acuggggccucca

SEQ ID NO: 2243369 - RNA, 12 nt, Human
acuggggccucc

SEQ ID NO: 2243370 - RNA, 21 nt, Human
acuggggccuacagcuuugau

SEQ ID NO: 2243371 - RNA, 21 nt, Human
ucuaaagaguuuauuuuaaga

SEQ ID NO: 2243372 - RNA, 17 nt, Human
ucuaaagcugccagccg

SEQ ID NO: 2243373 - RNA, 16 nt, Human
ucuaaaggcuaccuuu

SEQ ID NO: 2243374 - RNA, 13 nt, Human
ucuaaaggcuacc

SEQ ID NO: 2243375 - RNA, 20 nt, Human
ucuaaagaguuuauuuuaag

SEQ ID NO: 2243376 - RNA, 17 nt, Human
ucuaaacuuccccaucu

SEQ ID NO: 2243377 - RNA, 17 nt, Human
ucuaaacauuaaucaau

SEQ ID NO: 2243378 - RNA, 14 nt, Human
ucuaaacugcauua

SEQ ID NO: 2243379 - RNA, 21 nt, Human
ucuaaacuggauucacagcuc

SEQ ID NO: 2243380 - RNA, 23 nt, Human
ucuaaacugcccccucugcccug

SEQ ID NO: 2243381 - RNA, 22 nt, Human
ucuaaacugcccccucugcccu

SEQ ID NO: 2243382 - RNA, 16 nt, Human
ucuaaacugcccccuc

SEQ ID NO: 2243383 - RNA, 13 nt, Human
ucuaaacugcccc

SEQ ID NO: 2243384 - RNA, 20 nt, Human
ucuaagagaacaaugugcua

SEQ ID NO: 2243385 - RNA, 12 nt, Human
ucuaagagaagu

SEQ ID NO: 2243386 - RNA, 21 nt, Human
ucuaagauaguaacaaugaag

SEQ ID NO: 2243387 - RNA, 17 nt, Human
ucuaagccuuuccauaa

SEQ ID NO: 2243388 - RNA, 16 nt, Human
ucuaagccugaagggg

SEQ ID NO: 2243389 - RNA, 15 nt, Human
ucuaagccugaaggg

SEQ ID NO: 2243390 - RNA, 14 nt, Human
ucuaagccugaagg

SEQ ID NO: 2243391 - RNA, 14 nt, Human
ucuaagcagcauuu

SEQ ID NO: 2243392 - RNA, 21 nt, Human
ucuaagauucauccauuuauu

SEQ ID NO: 2243393 - RNA, 17 nt, Human
ucuaaguuccacugagc

SEQ ID NO: 2243394 - RNA, 19 nt, Human
ucuaagucaauccaagagu

SEQ ID NO: 2243395 - RNA, 16 nt, Human
ucuaaguauuugaaac

SEQ ID NO: 2243396 - RNA, 13 nt, Human
ucuaagugauaua

SEQ ID NO: 2243397 - RNA, 14 nt, Human
ucuaagucuuucca

SEQ ID NO: 2243398 - RNA, 13 nt, Human
ucuaagucuuucc

SEQ ID NO: 2243399 - RNA, 16 nt, Human
ucuacccucccacccc

SEQ ID NO: 2243400 - RNA, 15 nt, Human
ucuacccucccaccc

SEQ ID NO: 2243401 - RNA, 18 nt, Human
ucuacccucccacccccu

SEQ ID NO: 2243402 - RNA, 21 nt, Human
ucuacccucuuagaaaaacca

SEQ ID NO: 2243403 - RNA, 14 nt, Human
ucuacauuucuuag

SEQ ID NO: 2243404 - RNA, 15 nt, Human
ucuaccccuuacuua

SEQ ID NO: 2243405 - RNA, 16 nt, Human
ucuacauauucuuuaa

SEQ ID NO: 2243406 - RNA, 15 nt, Human
ucuacaucuucugcc

SEQ ID NO: 2243407 - RNA, 15 nt, Human
ucuacauauucuuua

SEQ ID NO: 2243408 - RNA, 23 nt, Human
ucuacauacuuucauccugacuc

SEQ ID NO: 2243409 - RNA, 16 nt, Human
ucuacaucuucugccu

SEQ ID NO: 2243410 - RNA, 17 nt, Human
ucuacaucuucugccuu

SEQ ID NO: 2243411 - RNA, 19 nt, Human
ucuacaucuuuuuucacaa

SEQ ID NO: 2243412 - RNA, 22 nt, Human
ucuacaucuuuuuucacaaauu

SEQ ID NO: 2243413 - RNA, 15 nt, Human
ucuacccauauuaca

SEQ ID NO: 2243414 - RNA, 17 nt, Human
ucuaccaaaaaucucaa

SEQ ID NO: 2243415 - RNA, 22 nt, Human
acuguggggugugcacaucucu

SEQ ID NO: 2243416 - RNA, 23 nt, Human
acuguggccguuaucuggaagua

SEQ ID NO: 2243417 - RNA, 20 nt, Human
acugugggaaggccagcugc

SEQ ID NO: 2243418 - RNA, 13 nt, Human
acuguggguagac

SEQ ID NO: 2243419 - RNA, 22 nt, Human
acugugugugugaaugaacacu

SEQ ID NO: 2243420 - RNA, 18 nt, Human
acugugugugugaaugaa

SEQ ID NO: 2243421 - RNA, 16 nt, Human
acugugugugugaaug

SEQ ID NO: 2243422 - RNA, 15 nt, Human
acugugugugugaau

SEQ ID NO: 2243423 - RNA, 20 nt, Human
acuguguguggaggagucca

SEQ ID NO: 2243424 - RNA, 19 nt, Human
acuguggcugcuagcacuu

SEQ ID NO: 2243425 - RNA, 20 nt, Human
acuguggccguuaucuggaa

SEQ ID NO: 2243426 - RNA, 12 nt, Human
acuguggcugcu

SEQ ID NO: 2243427 - RNA, 15 nt, Human
acuguggcacacgcc

SEQ ID NO: 2243428 - RNA, 23 nt, Human
acuguggaggaaggauuguaaaa

SEQ ID NO: 2243429 - RNA, 17 nt, Human
acuguggccguuaucug

SEQ ID NO: 2243430 - RNA, 10 nt, Human
acuguccugc

SEQ ID NO: 2243431 - RNA, 12 nt, Human
acuguccugcuc

SEQ ID NO: 2243432 - RNA, 13 nt, Human
acuguccugcucc

SEQ ID NO: 2243433 - RNA, 16 nt, Human
acuguccugcuccaca

SEQ ID NO: 2243434 - RNA, 17 nt, Human
acuguccugcuccacag

SEQ ID NO: 2243435 - RNA, 14 nt, Human
acuguccugggccu

SEQ ID NO: 2243436 - RNA, 22 nt, Human
acuguggaggaaggauuguaaa

SEQ ID NO: 2243437 - RNA, 18 nt, Human
acuguccugcuccacagu

SEQ ID NO: 2243438 - RNA, 19 nt, Human
acuguccugcuccacagug

SEQ ID NO: 2243439 - RNA, 20 nt, Human
acuguccugcuccacagugu

SEQ ID NO: 2243440 - RNA, 12 nt, Human
acuguccugggc

SEQ ID NO: 2243441 - RNA, 12 nt, Human
acuguguuccug

SEQ ID NO: 2243442 - RNA, 14 nt, Human
acuguguucauuag

SEQ ID NO: 2243443 - RNA, 22 nt, Human
acuguguguugccacaggacac

SEQ ID NO: 2243444 - RNA, 20 nt, Human
acuguguguugccacaggac

SEQ ID NO: 2243445 - RNA, 19 nt, Human
acuguguguugccacagga

SEQ ID NO: 2243446 - RNA, 14 nt, Human
acuguguguugcca

SEQ ID NO: 2243447 - RNA, 15 nt, Human
acuguguuccuggca

SEQ ID NO: 2243448 - RNA, 15 nt, Human
acuguguuucaaguu

SEQ ID NO: 2243449 - RNA, 14 nt, Human
acuguguuucaagu

SEQ ID NO: 2243450 - RNA, 17 nt, Human
acuguuaauaguucagg

SEQ ID NO: 2243451 - RNA, 16 nt, Human
acuguuaaaggaaaaa

SEQ ID NO: 2243452 - RNA, 20 nt, Human
acuguuaaauugcuguguau

SEQ ID NO: 2243453 - RNA, 18 nt, Human
acuguguuucaaguucaa

SEQ ID NO: 2243454 - RNA, 21 nt, Human
acuguuaauaguucagguaac

SEQ ID NO: 2243455 - RNA, 15 nt, Human
ucgggaaccucacuc

SEQ ID NO: 2243456 - RNA, 16 nt, Human
ucgggaaccucacucu

SEQ ID NO: 2243457 - RNA, 12 nt, Human
ucgggaagagag

SEQ ID NO: 2243458 - RNA, 15 nt, Human
ucgggaagagaggag

SEQ ID NO: 2243459 - RNA, 19 nt, Human
ucgggacaccugcccugcc

SEQ ID NO: 2243460 - RNA, 20 nt, Human
ucgggacaccugcccugccc

SEQ ID NO: 2243461 - RNA, 16 nt, Human
ucgggagacagcauca

SEQ ID NO: 2243462 - RNA, 21 nt, Human
ucgggagacagcaucaggguu

SEQ ID NO: 2243463 - RNA, 16 nt, Human
ucgggaagagaggagu

SEQ ID NO: 2243464 - RNA, 20 nt, Human
ucgggaagagaggaguucaa

SEQ ID NO: 2243465 - RNA, 21 nt, Human
ucgggaagagaggaguucaau

SEQ ID NO: 2243466 - RNA, 22 nt, Human
ucgggaagagaggaguucaaug

SEQ ID NO: 2243467 - RNA, 23 nt, Human
ucgggaagagaggaguucaauga

SEQ ID NO: 2243468 - RNA, 24 nt, Human
ucgggaagagaggaguucaaugau

SEQ ID NO: 2243469 - RNA, 20 nt, Human
ucgggaauacuagggagaag

SEQ ID NO: 2243470 - RNA, 16 nt, Human
ucgggacaccugcccu

SEQ ID NO: 2243471 - RNA, 19 nt, Human
ucguuaguaucuaacaugu

SEQ ID NO: 2243472 - RNA, 15 nt, Human
ucguuauguguguau

SEQ ID NO: 2243473 - RNA, 23 nt, Human
ucgucacugcuuaacuucacaua

SEQ ID NO: 2243474 - RNA, 13 nt, Human
ucguucucugccu

SEQ ID NO: 2243475 - RNA, 15 nt, Human
ucguucuguuuacau

SEQ ID NO: 2243476 - RNA, 11 nt, Human
ucguucugugg

SEQ ID NO: 2243477 - RNA, 19 nt, Human
ucguucuguuuacaucagu

SEQ ID NO: 2243478 - RNA, 21 nt, Human
ucguucuguuuacaucaguuu

SEQ ID NO: 2243479 - RNA, 17 nt, Human
ucguugacuuuagggac

SEQ ID NO: 2243480 - RNA, 16 nt, Human
ucguugacuuuaggga

SEQ ID NO: 2243481 - RNA, 12 nt, Human
ucguugugaggg

SEQ ID NO: 2243482 - RNA, 20 nt, Human
ucuaaacaaugcugauuugg

SEQ ID NO: 2243483 - RNA, 18 nt, Human
ucuaaacaagaaucaguc

SEQ ID NO: 2243484 - RNA, 19 nt, Human
ucuaaacaagauuuuaaag

SEQ ID NO: 2243485 - RNA, 19 nt, Human
ucuaaacccaauccaaaug

SEQ ID NO: 2243486 - RNA, 16 nt, Human
ucuaaacccaauccaa

SEQ ID NO: 2243487 - RNA, 13 nt, Human
ucuaaacauuaau

SEQ ID NO: 2243488 - RNA, 14 nt, Human
ucuaaacauuaauc

SEQ ID NO: 2243489 - RNA, 15 nt, Human
ucguuuacuaugccu

SEQ ID NO: 2243490 - RNA, 19 nt, Human
ucguuuauuuucaagaaua

SEQ ID NO: 2243491 - RNA, 12 nt, Human
ucguuucaaaaa

SEQ ID NO: 2243492 - RNA, 16 nt, Human
ucguuucaaaaacaca

SEQ ID NO: 2243493 - RNA, 19 nt, Human
ucguuucaaaaacacagug

SEQ ID NO: 2243494 - RNA, 21 nt, Human
ucuaaaaugccucaguguauu

SEQ ID NO: 2243495 - RNA, 22 nt, Human
ucuaaaaugccucaguguauuu

SEQ ID NO: 2243496 - RNA, 22 nt, Human
ucgggagcagugucuuccauaa

SEQ ID NO: 2243497 - RNA, 19 nt, Human
ucgggagcagugucuucca

SEQ ID NO: 2243498 - RNA, 16 nt, Human
ucgggaggcugagaca

SEQ ID NO: 2243499 - RNA, 16 nt, Human
ucgggagcagugucuu

SEQ ID NO: 2243500 - RNA, 15 nt, Human
ucgggagcagugucu

SEQ ID NO: 2243501 - RNA, 14 nt, Human
ucgggagcaguguc

SEQ ID NO: 2243502 - RNA, 13 nt, Human
ucgggagcagugu

SEQ ID NO: 2243503 - RNA, 23 nt, Human
ucgggagcagugucuuccauaau

SEQ ID NO: 2243504 - RNA, 15 nt, Human
ucgggcuccugugcc

SEQ ID NO: 2243505 - RNA, 14 nt, Human
ucgggcuccugugc

SEQ ID NO: 2243506 - RNA, 12 nt, Human
ucgggcugugcc

SEQ ID NO: 2243507 - RNA, 16 nt, Human
ucggggaacuccugga

SEQ ID NO: 2243508 - RNA, 15 nt, Human
ucggggaacuccugg

SEQ ID NO: 2243509 - RNA, 16 nt, Human
ucgggcuccugugccc

SEQ ID NO: 2243510 - RNA, 17 nt, Human
ucgggcuccugugcccu

SEQ ID NO: 2243511 - RNA, 13 nt, Human
ucgggcugugccc

SEQ ID NO: 2243512 - RNA, 19 nt, Human
ucggggagaggcugaggac

SEQ ID NO: 2243513 - RNA, 18 nt, Human
ucggggcaugcuggggca

SEQ ID NO: 2243514 - RNA, 17 nt, Human
ucggggcaugcuggggc

SEQ ID NO: 2243515 - RNA, 16 nt, Human
ucggggcaugcugggg

SEQ ID NO: 2243516 - RNA, 16 nt, Human
ucguacagaaagcugc

SEQ ID NO: 2243517 - RNA, 15 nt, Human
ucguacagaaagcug

SEQ ID NO: 2243518 - RNA, 21 nt, Human
ucguauaacacaauaugaaua

SEQ ID NO: 2243519 - RNA, 22 nt, Human
ucguagcuuucccaaauaaacu

SEQ ID NO: 2243520 - RNA, 12 nt, Human
ucguagcuuucc

SEQ ID NO: 2243521 - RNA, 14 nt, Human
ucguacaguucuuc

SEQ ID NO: 2243522 - RNA, 15 nt, Human
ucguacaguucuucg

SEQ ID NO: 2243523 - RNA, 17 nt, Human
ucguauagcuguauuga

SEQ ID NO: 2243524 - RNA, 21 nt, Human
ucguauagcuguauugaauca

SEQ ID NO: 2243525 - RNA, 19 nt, Human
ucagaaucuacccaaagga

SEQ ID NO: 2243526 - RNA, 20 nt, Human
ucagaaucuacccaaaggau

SEQ ID NO: 2243527 - RNA, 22 nt, Human
ucagaauccaagugaacacuag

SEQ ID NO: 2243528 - RNA, 14 nt, Human
ucagaaucuaccca

SEQ ID NO: 2243529 - RNA, 23 nt, Human
ucagaauagccacauuuggaaua

SEQ ID NO: 2243530 - RNA, 22 nt, Human
ucagaauagccacauuuggaau

SEQ ID NO: 2243531 - RNA, 17 nt, Human
ucagaaucacuucugag

SEQ ID NO: 2243532 - RNA, 19 nt, Human
ucagaaucacuucugagaa

SEQ ID NO: 2243533 - RNA, 16 nt, Human
ucagaauagaaauuag

SEQ ID NO: 2243534 - RNA, 21 nt, Human
ucagaauagccacauuuggaa

SEQ ID NO: 2243535 - RNA, 17 nt, Human
ucagaaguuuggcaaua

SEQ ID NO: 2243536 - RNA, 20 nt, Human
acccagccaucugcccaggg

SEQ ID NO: 2243537 - RNA, 21 nt, Human
acccagccaucugcccagggg

SEQ ID NO: 2243538 - RNA, 17 nt, Human
acccagcaacuccaacu

SEQ ID NO: 2243539 - RNA, 20 nt, Human
acccagauuuugcuguauau

SEQ ID NO: 2243540 - RNA, 19 nt, Human
acccagauuuugcuguaua

SEQ ID NO: 2243541 - RNA, 13 nt, Human
acccagccaucug

SEQ ID NO: 2243542 - RNA, 15 nt, Human
acccagccaucugcc

SEQ ID NO: 2243543 - RNA, 18 nt, Human
acccagccaucugcccag

SEQ ID NO: 2243544 - RNA, 19 nt, Human
acccagccaucugcccagg

SEQ ID NO: 2243545 - RNA, 15 nt, Human
acccagcccacuucu

SEQ ID NO: 2243546 - RNA, 23 nt, Human
ucagaaguuucugccgcagcccu

SEQ ID NO: 2243547 - RNA, 12 nt, Human
ucagaauucuca

SEQ ID NO: 2243548 - RNA, 10 nt, Human
ucagaauucu

SEQ ID NO: 2243549 - RNA, 20 nt, Human
ucagaauucucagaaucuca

SEQ ID NO: 2243550 - RNA, 13 nt, Human
ucagagaauuucu

SEQ ID NO: 2243551 - RNA, 23 nt, Human
ucagagaauuucuaccauuucag

SEQ ID NO: 2243552 - RNA, 20 nt, Human
ucagagacaggaagucuuca

SEQ ID NO: 2243553 - RNA, 23 nt, Human
ucagagacaggaagucuucaggg

SEQ ID NO: 2243554 - RNA, 15 nt, Human
ucagagaccauugca

SEQ ID NO: 2243555 - RNA, 20 nt, Human
ucagagacucagggccccag

SEQ ID NO: 2243556 - RNA, 19 nt, Human
ucagagacucagggcccca

SEQ ID NO: 2243557 - RNA, 17 nt, Human
ucagagacucagggccc

SEQ ID NO: 2243558 - RNA, 14 nt, Human
ucagagacucaggg

SEQ ID NO: 2243559 - RNA, 22 nt, Human
ucagagacuccugcaggcagcc

SEQ ID NO: 2243560 - RNA, 16 nt, Human
ucagagagcugguagu

SEQ ID NO: 2243561 - RNA, 14 nt, Human
ucagagagcuggua

SEQ ID NO: 2243562 - RNA, 13 nt, Human
ucagagagcuggu

SEQ ID NO: 2243563 - RNA, 22 nt, Human
ucagagagcgagcgcuacccac

SEQ ID NO: 2243564 - RNA, 20 nt, Human
ucagagaggagucagagaga

SEQ ID NO: 2243565 - RNA, 17 nt, Human
ucagagaggagucagag

SEQ ID NO: 2243566 - RNA, 16 nt, Human
ucagagaugcaccacc

SEQ ID NO: 2243567 - RNA, 21 nt, Human
ucagagaugcaccaccaagcc

SEQ ID NO: 2243568 - RNA, 14 nt, Human
ucagagagaguguu

SEQ ID NO: 2243569 - RNA, 15 nt, Human
ucagagacugcugug

SEQ ID NO: 2243570 - RNA, 12 nt, Human
ucagagagcagc

SEQ ID NO: 2243571 - RNA, 23 nt, Human
ucagagacuccugcaggcagcca

SEQ ID NO: 2243572 - RNA, 21 nt, Human
ucagagccaccccuaaagaga

SEQ ID NO: 2243573 - RNA, 17 nt, Human
ucagagcagcagugaaa

SEQ ID NO: 2243574 - RNA, 20 nt, Human
ucagagcagcagugaaaaca

SEQ ID NO: 2243575 - RNA, 21 nt, Human
ucagagcagcagugaaaacaa

SEQ ID NO: 2243576 - RNA, 16 nt, Human
ucagagcaaauuuggg

SEQ ID NO: 2243577 - RNA, 17 nt, Human
ucagagaugugcaccca

SEQ ID NO: 2243578 - RNA, 22 nt, Human
ucagagaugcaccaccaagcca

SEQ ID NO: 2243579 - RNA, 16 nt, Human
ucagagccgugguccu

SEQ ID NO: 2243580 - RNA, 14 nt, Human
ucagagcagggguc

SEQ ID NO: 2243581 - RNA, 22 nt, Human
ucagaugcccagagggcccagg

SEQ ID NO: 2243582 - RNA, 18 nt, Human
ucagaugcuucugggaga

SEQ ID NO: 2243583 - RNA, 14 nt, Human
ucagaugcuucugg

SEQ ID NO: 2243584 - RNA, 13 nt, Human
ucagaugcuucug

SEQ ID NO: 2243585 - RNA, 21 nt, Human
ucagaugcugugcaaauguua

SEQ ID NO: 2243586 - RNA, 23 nt, Human
ucagaucugacaugauuccuucc

SEQ ID NO: 2243587 - RNA, 16 nt, Human
ucagaucucuaacuuc

SEQ ID NO: 2243588 - RNA, 15 nt, Human
ucagaucucuaacuu

SEQ ID NO: 2243589 - RNA, 20 nt, Human
ucagagccgugguccuuugg

SEQ ID NO: 2243590 - RNA, 20 nt, Human
ucagauggaaccgcaggaag

SEQ ID NO: 2243591 - RNA, 22 nt, Human
ucagauggaaccgcaggaagcu

SEQ ID NO: 2243592 - RNA, 21 nt, Human
ucagauggaaccgcaggaagc

SEQ ID NO: 2243593 - RNA, 19 nt, Human
ucagauucccagagcaaaa

SEQ ID NO: 2243594 - RNA, 22 nt, Human
ucagauucccagagcaaaauaa

SEQ ID NO: 2243595 - RNA, 21 nt, Human
ucagauucccagagcaaaaua

SEQ ID NO: 2243596 - RNA, 23 nt, Human
ucagauggaaccgcaggaagcug

SEQ ID NO: 2243597 - RNA, 14 nt, Human
ucagauugcaugug

SEQ ID NO: 2243598 - RNA, 22 nt, Human
ucagauugcaugugacucugaa

SEQ ID NO: 2243599 - RNA, 21 nt, Human
ucagauugcaugugacucuga

SEQ ID NO: 2243600 - RNA, 19 nt, Human
ucagauugcaugugacucu

SEQ ID NO: 2243601 - RNA, 18 nt, Human
ucagauugcaugugacuc

SEQ ID NO: 2243602 - RNA, 17 nt, Human
ucagauugcaugugacu

SEQ ID NO: 2243603 - RNA, 16 nt, Human
ucagauugcaugugac

SEQ ID NO: 2243604 - RNA, 15 nt, Human
ucagauugcauguga

SEQ ID NO: 2243605 - RNA, 23 nt, Human
ucagccccucuugccccccaccc

SEQ ID NO: 2243606 - RNA, 22 nt, Human
ucagccccucuugccccccacc

SEQ ID NO: 2243607 - RNA, 21 nt, Human
ucagccccucuugccccccac

SEQ ID NO: 2243608 - RNA, 20 nt, Human
ucagccccucuugcccccca

SEQ ID NO: 2243609 - RNA, 19 nt, Human
ucagcccuaggguggagag

SEQ ID NO: 2243610 - RNA, 14 nt, Human
ucagccccugaucc

SEQ ID NO: 2243611 - RNA, 22 nt, Human
ucagccccugauccugugaagu

SEQ ID NO: 2243612 - RNA, 12 nt, Human
ucagccccucuu

SEQ ID NO: 2243613 - RNA, 11 nt, Human
ucagccccucu

SEQ ID NO: 2243614 - RNA, 23 nt, Human
ucagccccuccucugccaccucc

SEQ ID NO: 2243615 - RNA, 22 nt, Human
ucagccccuccucugccaccuc

SEQ ID NO: 2243616 - RNA, 21 nt, Human
ucagccccuccucugccaccu

SEQ ID NO: 2243617 - RNA, 20 nt, Human
ucagccccuccucugccacc

SEQ ID NO: 2243618 - RNA, 19 nt, Human
ucagccccuccucugccac

SEQ ID NO: 2243619 - RNA, 17 nt, Human
ucagauuuccagucucc

SEQ ID NO: 2243620 - RNA, 15 nt, Human
ucagauuuccagucu

SEQ ID NO: 2243621 - RNA, 13 nt, Human
acccaggagcccc

SEQ ID NO: 2243622 - RNA, 15 nt, Human
acccagccuguuuua

SEQ ID NO: 2243623 - RNA, 18 nt, Human
acccaggacgcuucugaa

SEQ ID NO: 2243624 - RNA, 23 nt, Human
acccaggagauggaaguugcagu

SEQ ID NO: 2243625 - RNA, 23 nt, Human
acccaggacuuauuuaaacucug

SEQ ID NO: 2243626 - RNA, 15 nt, Human
acccagggccugcag

SEQ ID NO: 2243627 - RNA, 22 nt, Human
acccaggagcauccaccuccuu

SEQ ID NO: 2243628 - RNA, 23 nt, Human
acccaggagcauccaccuccuuc

SEQ ID NO: 2243629 - RNA, 15 nt, Human
acccaggagccccga

SEQ ID NO: 2243630 - RNA, 23 nt, Human
ucagcccuaggguggagagccac

SEQ ID NO: 2243631 - RNA, 22 nt, Human
acccagccucaguccuccccuc

SEQ ID NO: 2243632 - RNA, 23 nt, Human
acccagccucaguccuccccuca

SEQ ID NO: 2243633 - RNA, 13 nt, Human
acccagcgagccc

SEQ ID NO: 2243634 - RNA, 16 nt, Human
acccagcgagcccugg

SEQ ID NO: 2243635 - RNA, 17 nt, Human
acccagcgagcccuggu

SEQ ID NO: 2243636 - RNA, 18 nt, Human
acccccacucucauuccc

SEQ ID NO: 2243637 - RNA, 17 nt, Human
acccccacucucauucc

SEQ ID NO: 2243638 - RNA, 13 nt, Human
acccccacucuca

SEQ ID NO: 2243639 - RNA, 15 nt, Human
acccccacuccagcu

SEQ ID NO: 2243640 - RNA, 12 nt, Human
acccccacccuu

SEQ ID NO: 2243641 - RNA, 11 nt, Human
acccccacccu

SEQ ID NO: 2243642 - RNA, 16 nt, Human
acccccaccccuugcu

SEQ ID NO: 2243643 - RNA, 17 nt, Human
acccccaccccuugcuc

SEQ ID NO: 2243644 - RNA, 20 nt, Human
acccccaccccuuccccacu

SEQ ID NO: 2243645 - RNA, 15 nt, Human
acccccaccccuucc

SEQ ID NO: 2243646 - RNA, 14 nt, Human
acccccaccccuuc

SEQ ID NO: 2243647 - RNA, 13 nt, Human
acccccaccccuu

SEQ ID NO: 2243648 - RNA, 18 nt, Human
acccccacccccagcuca

SEQ ID NO: 2243649 - RNA, 19 nt, Human
acccccacccccagcucaa

SEQ ID NO: 2243650 - RNA, 16 nt, Human
acccccaccccacacu

SEQ ID NO: 2243651 - RNA, 17 nt, Human
accccaguucugcuccu

SEQ ID NO: 2243652 - RNA, 15 nt, Human
acccccaccccacac

SEQ ID NO: 2243653 - RNA, 17 nt, Human
accccaguggccacuca

SEQ ID NO: 2243654 - RNA, 19 nt, Human
accccaguggccacucagc

SEQ ID NO: 2243655 - RNA, 23 nt, Human
accccaguggccacucagcuucc

SEQ ID NO: 2243656 - RNA, 15 nt, Human
accccaguucugcuc

SEQ ID NO: 2243657 - RNA, 17 nt, Human
acccccaccccacacuu

SEQ ID NO: 2243658 - RNA, 16 nt, Human
accccaguucugcucc

SEQ ID NO: 2243659 - RNA, 16 nt, Human
acccccacccccacca

SEQ ID NO: 2243660 - RNA, 14 nt, Human
acccccacccccag

SEQ ID NO: 2243661 - RNA, 15 nt, Human
acccccacccccagc

SEQ ID NO: 2243662 - RNA, 13 nt, Human
accccagguuucu

SEQ ID NO: 2243663 - RNA, 24 nt, Human
accccagggccugagccuggccag

SEQ ID NO: 2243664 - RNA, 17 nt, Human
accccagggccugagcc

SEQ ID NO: 2243665 - RNA, 16 nt, Human
accccaguggccacuc

SEQ ID NO: 2243666 - RNA, 15 nt, Human
accccagggccugag

SEQ ID NO: 2243667 - RNA, 14 nt, Human
accccagggccuga

SEQ ID NO: 2243668 - RNA, 13 nt, Human
accccagggccug

SEQ ID NO: 2243669 - RNA, 11 nt, Human
accccagggcc

SEQ ID NO: 2243670 - RNA, 20 nt, Human
accccagcugggaggcaaga

SEQ ID NO: 2243671 - RNA, 13 nt, Human
accccagcuggga

SEQ ID NO: 2243672 - RNA, 14 nt, Human
accccagcugggag

SEQ ID NO: 2243673 - RNA, 15 nt, Human
accccagcugggagg

SEQ ID NO: 2243674 - RNA, 17 nt, Human
accccagcugggaggca

SEQ ID NO: 2243675 - RNA, 23 nt, Human
accccagcucccuaggagaccaa

SEQ ID NO: 2243676 - RNA, 11 nt, Human
accccagcugg

SEQ ID NO: 2243677 - RNA, 12 nt, Human
accccagcuggg

SEQ ID NO: 2243678 - RNA, 10 nt, Human
accccagcug

SEQ ID NO: 2243679 - RNA, 17 nt, Human
accccagcucccuagga

SEQ ID NO: 2243680 - RNA, 14 nt, Human
accccagcucccua

SEQ ID NO: 2243681 - RNA, 13 nt, Human
accccagcggcug

SEQ ID NO: 2243682 - RNA, 22 nt, Human
ucagauggauugauaauugcau

SEQ ID NO: 2243683 - RNA, 19 nt, Human
accccagcuggggccaggc

SEQ ID NO: 2243684 - RNA, 22 nt, Human
accccagcuggggccaggcugg

SEQ ID NO: 2243685 - RNA, 11 nt, Human
acccaggugcu

SEQ ID NO: 2243686 - RNA, 23 nt, Human
acccaggugcuaggaacacuccu

SEQ ID NO: 2243687 - RNA, 13 nt, Human
acccagggguggg

SEQ ID NO: 2243688 - RNA, 17 nt, Human
acccagggccugcagga

SEQ ID NO: 2243689 - RNA, 20 nt, Human
accaugcccggcuaauuuuu

SEQ ID NO: 2243690 - RNA, 19 nt, Human
accaugcucaucugcuggu

SEQ ID NO: 2243691 - RNA, 20 nt, Human
accaugcucaucugcugguc

SEQ ID NO: 2243692 - RNA, 18 nt, Human
accaguaauugugaaaau

SEQ ID NO: 2243693 - RNA, 14 nt, Human
accaugcagagcgc

SEQ ID NO: 2243694 - RNA, 16 nt, Human
accaugcaaaugcuau

SEQ ID NO: 2243695 - RNA, 19 nt, Human
accagguguucuacacuca

SEQ ID NO: 2243696 - RNA, 22 nt, Human
accaggucuuggagcugagccu

SEQ ID NO: 2243697 - RNA, 23 nt, Human
accagguguucuacacucaucuu

SEQ ID NO: 2243698 - RNA, 20 nt, Human
accagguguucuacacucau

SEQ ID NO: 2243699 - RNA, 14 nt, Human
accagguugaaaga

SEQ ID NO: 2243700 - RNA, 19 nt, Human
accaggucuccuccaccgc

SEQ ID NO: 2243701 - RNA, 20 nt, Human
accaggucuccuccaccgcc

SEQ ID NO: 2243702 - RNA, 16 nt, Human
accaggucuuggagcu

SEQ ID NO: 2243703 - RNA, 21 nt, Human
accaggguugaccccagagga

SEQ ID NO: 2243704 - RNA, 20 nt, Human
accaggguugaccccagagg

SEQ ID NO: 2243705 - RNA, 18 nt, Human
ucacuucugaccacacuu

SEQ ID NO: 2243706 - RNA, 17 nt, Human
ucacuucugagaacuca

SEQ ID NO: 2243707 - RNA, 14 nt, Human
accagggguuucuc

SEQ ID NO: 2243708 - RNA, 16 nt, Human
accagggguuucucgc

SEQ ID NO: 2243709 - RNA, 17 nt, Human
accagggguuucucgca

SEQ ID NO: 2243710 - RNA, 13 nt, Human
accaugugccuga

SEQ ID NO: 2243711 - RNA, 22 nt, Human
accaugucagcaaaaagcaaaa

SEQ ID NO: 2243712 - RNA, 19 nt, Human
accaugucagcaaaaagca

SEQ ID NO: 2243713 - RNA, 21 nt, Human
accaugucagcaaaaagcaaa

SEQ ID NO: 2243714 - RNA, 13 nt, Human
accaugucacugu

SEQ ID NO: 2243715 - RNA, 23 nt, Human
accauggcugaaggaaaccagug

SEQ ID NO: 2243716 - RNA, 12 nt, Human
accaugggacca

SEQ ID NO: 2243717 - RNA, 20 nt, Human
accaugggaccaggucuugg

SEQ ID NO: 2243718 - RNA, 15 nt, Human
accaugucacugugg

SEQ ID NO: 2243719 - RNA, 15 nt, Human
accaugucagcaaaa

SEQ ID NO: 2243720 - RNA, 18 nt, Human
accaugucagcaaaaagc

SEQ ID NO: 2243721 - RNA, 15 nt, Human
accauggccagccaa

SEQ ID NO: 2243722 - RNA, 15 nt, Human
accauggcugaagga

SEQ ID NO: 2243723 - RNA, 16 nt, Human
accauggagacaagaa

SEQ ID NO: 2243724 - RNA, 12 nt, Human
accauguuugag

SEQ ID NO: 2243725 - RNA, 13 nt, Human
accauucugacuc

SEQ ID NO: 2243726 - RNA, 21 nt, Human
accauucugacucgguuucuc

SEQ ID NO: 2243727 - RNA, 22 nt, Human
accauuuugcugucccuuuucc

SEQ ID NO: 2243728 - RNA, 21 nt, Human
accauuuugggguacccacug

SEQ ID NO: 2243729 - RNA, 23 nt, Human
accauuuugcugucccuuuuccu

SEQ ID NO: 2243730 - RNA, 18 nt, Human
accauguuggccaggcug

SEQ ID NO: 2243731 - RNA, 16 nt, Human
accaugugccugaucc

SEQ ID NO: 2243732 - RNA, 19 nt, Human
accauucuccaccugccag

SEQ ID NO: 2243733 - RNA, 20 nt, Human
accauucuccaccugccagg

SEQ ID NO: 2243734 - RNA, 21 nt, Human
accauucuccaccugccaggg

SEQ ID NO: 2243735 - RNA, 20 nt, Human
acccacugcuuuuggucugu

SEQ ID NO: 2243736 - RNA, 17 nt, Human
acccacuggacucaccu

SEQ ID NO: 2243737 - RNA, 14 nt, Human
acccacuggacuca

SEQ ID NO: 2243738 - RNA, 21 nt, Human
acccacuggacucaccucccc

SEQ ID NO: 2243739 - RNA, 16 nt, Human
acccacuucccugggc

SEQ ID NO: 2243740 - RNA, 21 nt, Human
acccagauaaagguucaugca

SEQ ID NO: 2243741 - RNA, 14 nt, Human
acccagauccucac

SEQ ID NO: 2243742 - RNA, 22 nt, Human
acccagaugggggaaagcacag

SEQ ID NO: 2243743 - RNA, 19 nt, Human
accauguuugagcucagac

SEQ ID NO: 2243744 - RNA, 18 nt, Human
acccaaagagguauuuau

SEQ ID NO: 2243745 - RNA, 18 nt, Human
acccaaagaccaauauuc

SEQ ID NO: 2243746 - RNA, 14 nt, Human
acccaaauccucuc

SEQ ID NO: 2243747 - RNA, 15 nt, Human
acccaaauccucucc

SEQ ID NO: 2243748 - RNA, 17 nt, Human
acccaaauccucuccag

SEQ ID NO: 2243749 - RNA, 20 nt, Human
acccaaauguucaucaauga

SEQ ID NO: 2243750 - RNA, 16 nt, Human
acccaaauguucauca

SEQ ID NO: 2243751 - RNA, 15 nt, Human
ucacuucacccugga

SEQ ID NO: 2243752 - RNA, 19 nt, Human
ucacuuaucccaagagaau

SEQ ID NO: 2243753 - RNA, 17 nt, Human
ucacuuauauguucuaa

SEQ ID NO: 2243754 - RNA, 16 nt, Human
ucacuucauaauccag

SEQ ID NO: 2243755 - RNA, 14 nt, Human
ucacuucaucuucu

SEQ ID NO: 2243756 - RNA, 15 nt, Human
ucacuucaucuucuc

SEQ ID NO: 2243757 - RNA, 17 nt, Human
ucacuucugaccacacu

SEQ ID NO: 2243758 - RNA, 12 nt, Human
ucacuucuccca

SEQ ID NO: 2243759 - RNA, 16 nt, Human
ucacuucuaaaugcau

SEQ ID NO: 2243760 - RNA, 13 nt, Human
ucacuucuaaaug

SEQ ID NO: 2243761 - RNA, 16 nt, Human
ucacuucgugggaucu

SEQ ID NO: 2243762 - RNA, 23 nt, Human
ucacuucgcgugcccucgcugcu

SEQ ID NO: 2243763 - RNA, 17 nt, Human
ucacuuccuacaagagc

SEQ ID NO: 2243764 - RNA, 22 nt, Human
ucacuuccauacagcucuacgu

SEQ ID NO: 2243765 - RNA, 22 nt, Human
ucacuucgcgugcccucgcugc

SEQ ID NO: 2243766 - RNA, 19 nt, Human
ucacuucaucuucucagcu

SEQ ID NO: 2243767 - RNA, 20 nt, Human
ucacuucaucuucucagcuc

SEQ ID NO: 2243768 - RNA, 18 nt, Human
ucacuuccauacagcucu

SEQ ID NO: 2243769 - RNA, 19 nt, Human
ucacuuccauacagcucua

SEQ ID NO: 2243770 - RNA, 20 nt, Human
ucacuguuucucugcuguug

SEQ ID NO: 2243771 - RNA, 19 nt, Human
ucacuguugaaaauuauuu

SEQ ID NO: 2243772 - RNA, 20 nt, Human
ucacuguugaaaauuauuuu

SEQ ID NO: 2243773 - RNA, 15 nt, Human
ucacuguugcccagg

SEQ ID NO: 2243774 - RNA, 17 nt, Human
ucacuuaccuagauuua

SEQ ID NO: 2243775 - RNA, 15 nt, Human
ucacuuacuguuucu

SEQ ID NO: 2243776 - RNA, 16 nt, Human
ucacuuacuguuucug

SEQ ID NO: 2243777 - RNA, 21 nt, Human
ucacuuaggaaauggcuuugu

SEQ ID NO: 2243778 - RNA, 19 nt, Human
ucacuuacuguuucuguca

SEQ ID NO: 2243779 - RNA, 22 nt, Human
ucacuuacuguuucugucagga

SEQ ID NO: 2243780 - RNA, 16 nt, Human
ucacuuaauugcuaca

SEQ ID NO: 2243781 - RNA, 17 nt, Human
ucacugcaacuucugcc

SEQ ID NO: 2243782 - RNA, 18 nt, Human
ucacugcaacuucugccu

SEQ ID NO: 2243783 - RNA, 18 nt, Human
ucacugcaagcuccgccu

SEQ ID NO: 2243784 - RNA, 15 nt, Human
ucacugcacagugca

SEQ ID NO: 2243785 - RNA, 14 nt, Human
ucacuguugcccag

SEQ ID NO: 2243786 - RNA, 18 nt, Human
ucacuguucccucugcuc

SEQ ID NO: 2243787 - RNA, 19 nt, Human
ucacuguucccucugcucc

SEQ ID NO: 2243788 - RNA, 20 nt, Human
ucacuguucccucugcuccu

SEQ ID NO: 2243789 - RNA, 21 nt, Human
ucacuguucccucugcuccug

SEQ ID NO: 2243790 - RNA, 22 nt, Human
ucacuguucccucugcuccugg

SEQ ID NO: 2243791 - RNA, 22 nt, Human
ucacuguucuauucaucucaag

SEQ ID NO: 2243792 - RNA, 15 nt, Human
ucacuguugaaaauu

SEQ ID NO: 2243793 - RNA, 18 nt, Human
ucacuguugaaaauuauu

SEQ ID NO: 2243794 - RNA, 18 nt, Human
ucacugcaaccuccgccu

SEQ ID NO: 2243795 - RNA, 21 nt, Human
ucacugcaaccuucgccaccu

SEQ ID NO: 2243796 - RNA, 18 nt, Human
ucacugcaaccucugccu

SEQ ID NO: 2243797 - RNA, 16 nt, Human
ucacuccaccacccaa

SEQ ID NO: 2243798 - RNA, 15 nt, Human
ucacuccaccaccca

SEQ ID NO: 2243799 - RNA, 14 nt, Human
ucacuccaccaccc

SEQ ID NO: 2243800 - RNA, 13 nt, Human
ucacuccaccacc

SEQ ID NO: 2243801 - RNA, 22 nt, Human
ucacucauugcugagccucugc

SEQ ID NO: 2243802 - RNA, 20 nt, Human
ucacucauugcugagccucu

SEQ ID NO: 2243803 - RNA, 19 nt, Human
ucacucauugcugagccuc

SEQ ID NO: 2243804 - RNA, 18 nt, Human
ucacucauugcugagccu

SEQ ID NO: 2243805 - RNA, 17 nt, Human
ucacucauugcugagcc

SEQ ID NO: 2243806 - RNA, 15 nt, Human
ucacucauugcugag

SEQ ID NO: 2243807 - RNA, 18 nt, Human
ucacucuuggagccugca

SEQ ID NO: 2243808 - RNA, 17 nt, Human
ucacucuuggagccugc

SEQ ID NO: 2243809 - RNA, 16 nt, Human
ucacucuuggagccug

SEQ ID NO: 2243810 - RNA, 14 nt, Human
ucacucuuggagcc

SEQ ID NO: 2243811 - RNA, 16 nt, Human
ucacugaaggccuggc

SEQ ID NO: 2243812 - RNA, 22 nt, Human
ucacugaaugccucaaugugac

SEQ ID NO: 2243813 - RNA, 23 nt, Human
ucacugagacagcccgggcucug

SEQ ID NO: 2243814 - RNA, 14 nt, Human
ucacuccagccugg

SEQ ID NO: 2243815 - RNA, 21 nt, Human
ucacucuuguggauguuuuaa

SEQ ID NO: 2243816 - RNA, 20 nt, Human
ucacucuuguggauguuuua

SEQ ID NO: 2243817 - RNA, 17 nt, Human
ucacugaaaacaucugg

SEQ ID NO: 2243818 - RNA, 20 nt, Human
ucacugaaaacaucuggaag

SEQ ID NO: 2243819 - RNA, 18 nt, Human
ucacugaaaacaucugga

SEQ ID NO: 2243820 - RNA, 21 nt, Human
ucacugaacuuugcugagccu

SEQ ID NO: 2243821 - RNA, 14 nt, Human
ucacucagauggaa

SEQ ID NO: 2243822 - RNA, 13 nt, Human
ucacucauugcug

SEQ ID NO: 2243823 - RNA, 17 nt, Human
ucacucauacaucuggc

SEQ ID NO: 2243824 - RNA, 20 nt, Human
ucacuauuuuuauuuauauu

SEQ ID NO: 2243825 - RNA, 18 nt, Human
ucacuauuuccuuuauaa

SEQ ID NO: 2243826 - RNA, 19 nt, Human
ucacuauuuccuuuauaau

SEQ ID NO: 2243827 - RNA, 18 nt, Human
ucacuauucaaguauuag

SEQ ID NO: 2243828 - RNA, 13 nt, Human
ucacuauuuccuu

SEQ ID NO: 2243829 - RNA, 15 nt, Human
ucacuauuuccuuua

SEQ ID NO: 2243830 - RNA, 17 nt, Human
ucacuauuuccuuuaua

SEQ ID NO: 2243831 - RNA, 18 nt, Human
ucacuauuuuuauuuaua

SEQ ID NO: 2243832 - RNA, 22 nt, Human
ucaccagccccagugcccacag

SEQ ID NO: 2243833 - RNA, 13 nt, Human
ucaccagcuccuc

SEQ ID NO: 2243834 - RNA, 19 nt, Human
ucaccagcccggccugcuc

SEQ ID NO: 2243835 - RNA, 15 nt, Human
ucaccagcuccuccc

SEQ ID NO: 2243836 - RNA, 21 nt, Human
ucacuauguugcccaggcagg

SEQ ID NO: 2243837 - RNA, 14 nt, Human
ucaccagcugccuc

SEQ ID NO: 2243838 - RNA, 23 nt, Human
acccugaggcccagagggccugc

SEQ ID NO: 2243839 - RNA, 18 nt, Human
acccugcaaaggacuguu

SEQ ID NO: 2243840 - RNA, 20 nt, Human
acccugauuuaggagaagcc

SEQ ID NO: 2243841 - RNA, 23 nt, Human
acccugauuuaggagaagccagg

SEQ ID NO: 2243842 - RNA, 22 nt, Human
acccugauuuaggagaagccag

SEQ ID NO: 2243843 - RNA, 22 nt, Human
acccugcgcccaguccuuccac

SEQ ID NO: 2243844 - RNA, 22 nt, Human
acccugcgaaggggcccugguc

SEQ ID NO: 2243845 - RNA, 20 nt, Human
acccugcgaaggggcccugg

SEQ ID NO: 2243846 - RNA, 19 nt, Human
acccugcgaaggggcccug

SEQ ID NO: 2243847 - RNA, 18 nt, Human
acccugcgaaggggcccu

SEQ ID NO: 2243848 - RNA, 18 nt, Human
acccugccuuaucuugca

SEQ ID NO: 2243849 - RNA, 14 nt, Human
acccugccuuaucu

SEQ ID NO: 2243850 - RNA, 13 nt, Human
acccugccccugc

SEQ ID NO: 2243851 - RNA, 12 nt, Human
acccugccccug

SEQ ID NO: 2243852 - RNA, 14 nt, Human
acccugccccugcc

SEQ ID NO: 2243853 - RNA, 20 nt, Human
acccucgaagcgcgccacuc

SEQ ID NO: 2243854 - RNA, 16 nt, Human
acccucgaagcgcgcc

SEQ ID NO: 2243855 - RNA, 14 nt, Human
acccucgaggcgga

SEQ ID NO: 2243856 - RNA, 21 nt, Human
acccucgaagcgcgccacucg

SEQ ID NO: 2243857 - RNA, 23 nt, Human
acccugagcugaggcagcagugu

SEQ ID NO: 2243858 - RNA, 22 nt, Human
acccugagcugaggcagcagug

SEQ ID NO: 2243859 - RNA, 17 nt, Human
acccugagcugaggcag

SEQ ID NO: 2243860 - RNA, 11 nt, Human
acccugagccc

SEQ ID NO: 2243861 - RNA, 16 nt, Human
acccugagccccuucc

SEQ ID NO: 2243862 - RNA, 17 nt, Human
acccugagccccuuccu

SEQ ID NO: 2243863 - RNA, 11 nt, Human
acccugaggcc

SEQ ID NO: 2243864 - RNA, 13 nt, Human
acccugaggccca

SEQ ID NO: 2243865 - RNA, 19 nt, Human
acccugaggcccagagggc

SEQ ID NO: 2243866 - RNA, 21 nt, Human
acccugaggcccagagggccu

SEQ ID NO: 2243867 - RNA, 16 nt, Human
acccgcuuucuugcug

SEQ ID NO: 2243868 - RNA, 15 nt, Human
acccgcucuggacca

SEQ ID NO: 2243869 - RNA, 12 nt, Human
acccgcucugga

SEQ ID NO: 2243870 - RNA, 13 nt, Human
acccgcucuggac

SEQ ID NO: 2243871 - RNA, 24 nt, Human
acccgccucucccgucagggccca

SEQ ID NO: 2243872 - RNA, 16 nt, Human
acccgccuuuuauaaa

SEQ ID NO: 2243873 - RNA, 19 nt, Human
acccgccuuuuauaaaccu

SEQ ID NO: 2243874 - RNA, 18 nt, Human
acccgcucaucacuggau

SEQ ID NO: 2243875 - RNA, 23 nt, Human
acccggagcuaacacuggccccu

SEQ ID NO: 2243876 - RNA, 22 nt, Human
acccggagcuaacacuggcccc

SEQ ID NO: 2243877 - RNA, 12 nt, Human
acccggaggcca

SEQ ID NO: 2243878 - RNA, 15 nt, Human
acccggaggccacau

SEQ ID NO: 2243879 - RNA, 19 nt, Human
acccgggaagggggcuggg

SEQ ID NO: 2243880 - RNA, 20 nt, Human
acccgggaagggggcuggga

SEQ ID NO: 2243881 - RNA, 17 nt, Human
acccucauguucuuaau

SEQ ID NO: 2243882 - RNA, 15 nt, Human
acccucauguucuua

SEQ ID NO: 2243883 - RNA, 14 nt, Human
acccucauguucuu

SEQ ID NO: 2243884 - RNA, 22 nt, Human
acccgggaagggggcugggaca

SEQ ID NO: 2243885 - RNA, 23 nt, Human
acccucccccaggaggucgaccc

SEQ ID NO: 2243886 - RNA, 23 nt, Human
acccuccccgcaccccccaagcu

SEQ ID NO: 2243887 - RNA, 10 nt, Human
acccuccccc

SEQ ID NO: 2243888 - RNA, 19 nt, Human
acccggaggccacaugagu

SEQ ID NO: 2243889 - RNA, 15 nt, Human
acccgggaggcagag

SEQ ID NO: 2243890 - RNA, 17 nt, Human
acccucauucuacugaa

SEQ ID NO: 2243891 - RNA, 20 nt, Human
acccucaugcugugugacuc

SEQ ID NO: 2243892 - RNA, 17 nt, Human
acccucccucagccccu

SEQ ID NO: 2243893 - RNA, 14 nt, Human
acccucccucagcc

SEQ ID NO: 2243894 - RNA, 12 nt, Human
acccucccucag

SEQ ID NO: 2243895 - RNA, 12 nt, Human
acccuccccucc

SEQ ID NO: 2243896 - RNA, 13 nt, Human
acccuccccuccc

SEQ ID NO: 2243897 - RNA, 12 nt, Human
acccuccccucu

SEQ ID NO: 2243898 - RNA, 13 nt, Human
acccuccccucuc

SEQ ID NO: 2243899 - RNA, 14 nt, Human
acccuccccucucu

SEQ ID NO: 2243900 - RNA, 18 nt, Human
acccuccccucucuugca

SEQ ID NO: 2243901 - RNA, 19 nt, Human
acccuccccucucuugcac

SEQ ID NO: 2243902 - RNA, 23 nt, Human
acccucccucagccccucuugcc

SEQ ID NO: 2243903 - RNA, 20 nt, Human
acccucccucagccccucuu

SEQ ID NO: 2243904 - RNA, 19 nt, Human
acccucccucagccccucu

SEQ ID NO: 2243905 - RNA, 18 nt, Human
acccucccucagccccuc

SEQ ID NO: 2243906 - RNA, 16 nt, Human
acccucccuccgaucc

SEQ ID NO: 2243907 - RNA, 20 nt, Human
acccuccugucuucccaggg

SEQ ID NO: 2243908 - RNA, 22 nt, Human
acccucccuccgauccuuccuc

SEQ ID NO: 2243909 - RNA, 23 nt, Human
acccucccuccgauccuuccucc

SEQ ID NO: 2243910 - RNA, 21 nt, Human
acccuccugucuucccagggu

SEQ ID NO: 2243911 - RNA, 23 nt, Human
acccuccugucuucccaggguag

SEQ ID NO: 2243912 - RNA, 11 nt, Human
acccuccuguu

SEQ ID NO: 2243913 - RNA, 19 nt, Human
acccuccuguugcacccag

SEQ ID NO: 2243914 - RNA, 21 nt, Human
acccuccuuucaccacaugug

SEQ ID NO: 2243915 - RNA, 24 nt, Human
acccuccuguugcacccagcccug

SEQ ID NO: 2243916 - RNA, 20 nt, Human
acccuccuguugcacccagc

SEQ ID NO: 2243917 - RNA, 21 nt, Human
acccuccuguugcacccagcc

SEQ ID NO: 2243918 - RNA, 22 nt, Human
acccuccuguugcacccagccc

SEQ ID NO: 2243919 - RNA, 23 nt, Human
acccuccuguugcacccagcccu

SEQ ID NO: 2243920 - RNA, 22 nt, Human
acccccacucucauuccccagg

SEQ ID NO: 2243921 - RNA, 21 nt, Human
acccccacucucauuccccag

SEQ ID NO: 2243922 - RNA, 16 nt, Human
acccccagcaacccuc

SEQ ID NO: 2243923 - RNA, 13 nt, Human
acccccagcaccc

SEQ ID NO: 2243924 - RNA, 13 nt, Human
acccccagcaacc

SEQ ID NO: 2243925 - RNA, 11 nt, Human
acccccagcaa

SEQ ID NO: 2243926 - RNA, 12 nt, Human
acccccagccug

SEQ ID NO: 2243927 - RNA, 13 nt, Human
acccccagccugc

SEQ ID NO: 2243928 - RNA, 18 nt, Human
acccccagcacccgggcu

SEQ ID NO: 2243929 - RNA, 21 nt, Human
acccccagcacccgggcucag

SEQ ID NO: 2243930 - RNA, 17 nt, Human
ucaggcauaggccuggg

SEQ ID NO: 2243931 - RNA, 16 nt, Human
ucaggcauaggccugg

SEQ ID NO: 2243932 - RNA, 15 nt, Human
ucaggcauaggccug

SEQ ID NO: 2243933 - RNA, 22 nt, Human
acccccagcacccgggcucagg

SEQ ID NO: 2243934 - RNA, 18 nt, Human
ucaggcaggugggaugga

SEQ ID NO: 2243935 - RNA, 21 nt, Human
ucaggcaggaagggcaggaag

SEQ ID NO: 2243936 - RNA, 13 nt, Human
ucaggcaggaagg

SEQ ID NO: 2243937 - RNA, 13 nt, Human
ucaggcagcucaa

SEQ ID NO: 2243938 - RNA, 17 nt, Human
ucaggcaggugggaugg

SEQ ID NO: 2243939 - RNA, 17 nt, Human
ucaggccacggcagccu

SEQ ID NO: 2243940 - RNA, 13 nt, Human
ucaggccacuuga

SEQ ID NO: 2243941 - RNA, 14 nt, Human
ucaggccacggcag

SEQ ID NO: 2243942 - RNA, 16 nt, Human
ucaggccacggcagcc

SEQ ID NO: 2243943 - RNA, 21 nt, Human
ucaggccaccugcccccuucu

SEQ ID NO: 2243944 - RNA, 19 nt, Human
ucaggccaccugcccccuu

SEQ ID NO: 2243945 - RNA, 17 nt, Human
ucaggccaccugccccc

SEQ ID NO: 2243946 - RNA, 13 nt, Human
ucaggccagcugc

SEQ ID NO: 2243947 - RNA, 14 nt, Human
ucaggccagcugcu

SEQ ID NO: 2243948 - RNA, 13 nt, Human
ucaggccaggccc

SEQ ID NO: 2243949 - RNA, 14 nt, Human
ucaggccaggcccu

SEQ ID NO: 2243950 - RNA, 15 nt, Human
ucaggccaggcccuc

SEQ ID NO: 2243951 - RNA, 16 nt, Human
ucaggccaggcccucu

SEQ ID NO: 2243952 - RNA, 17 nt, Human
ucaggguuggccccugc

SEQ ID NO: 2243953 - RNA, 23 nt, Human
ucaggggugugcggccuuuggcu

SEQ ID NO: 2243954 - RNA, 19 nt, Human
ucaggggugugcggccuuu

SEQ ID NO: 2243955 - RNA, 12 nt, Human
ucaggggugugc

SEQ ID NO: 2243956 - RNA, 19 nt, Human
ucaggccaggcccucugcc

SEQ ID NO: 2243957 - RNA, 20 nt, Human
ucagggggguugugaggccu

SEQ ID NO: 2243958 - RNA, 17 nt, Human
ucaggccaggcccucug

SEQ ID NO: 2243959 - RNA, 18 nt, Human
ucaggccaggcccucugc

SEQ ID NO: 2243960 - RNA, 19 nt, Human
ucagguaguugcaauugaa

SEQ ID NO: 2243961 - RNA, 13 nt, Human
ucagguagcugcc

SEQ ID NO: 2243962 - RNA, 16 nt, Human
ucagguauguugccuu

SEQ ID NO: 2243963 - RNA, 15 nt, Human
ucagguauguugccu

SEQ ID NO: 2243964 - RNA, 23 nt, Human
ucaggggucgucaccaccucucc

SEQ ID NO: 2243965 - RNA, 21 nt, Human
ucagguaaucgaccugccucg

SEQ ID NO: 2243966 - RNA, 13 nt, Human
acccgccucuccc

SEQ ID NO: 2243967 - RNA, 18 nt, Human
acccgccucucccgucag

SEQ ID NO: 2243968 - RNA, 21 nt, Human
acccgccucucccgucagggc

SEQ ID NO: 2243969 - RNA, 23 nt, Human
acccgccucucccgucagggccc

SEQ ID NO: 2243970 - RNA, 19 nt, Human
acccgcuaagagggaggga

SEQ ID NO: 2243971 - RNA, 23 nt, Human
ucaggguuggccccugcccggcu

SEQ ID NO: 2243972 - RNA, 18 nt, Human
ucagguaaucgaccugcc

SEQ ID NO: 2243973 - RNA, 20 nt, Human
ucagguaaucgaccugccuc

SEQ ID NO: 2243974 - RNA, 19 nt, Human
ucagguaaucgaccugccu

SEQ ID NO: 2243975 - RNA, 18 nt, Human
ucaggguuggccccugcc

SEQ ID NO: 2243976 - RNA, 19 nt, Human
ucaggguuggccccugccc

SEQ ID NO: 2243977 - RNA, 17 nt, Human
acccuggaaaaugaauc

SEQ ID NO: 2243978 - RNA, 15 nt, Human
acccugcguggggac

SEQ ID NO: 2243979 - RNA, 16 nt, Human
acccugcguggggaca

SEQ ID NO: 2243980 - RNA, 17 nt, Human
acccugcguggggacag

SEQ ID NO: 2243981 - RNA, 20 nt, Human
acccuugccgucuaccugag

SEQ ID NO: 2243982 - RNA, 20 nt, Human
acccuggaccaguggucuca

SEQ ID NO: 2243983 - RNA, 17 nt, Human
acccuggaccagugguc

SEQ ID NO: 2243984 - RNA, 13 nt, Human
acccuuggacuug

SEQ ID NO: 2243985 - RNA, 15 nt, Human
acccuuggacuugag

SEQ ID NO: 2243986 - RNA, 17 nt, Human
acccuuggccugucuca

SEQ ID NO: 2243987 - RNA, 13 nt, Human
acccuuggccugu

SEQ ID NO: 2243988 - RNA, 17 nt, Human
acccuuggcucaauccu

SEQ ID NO: 2243989 - RNA, 17 nt, Human
acccuuggcuugcccac

SEQ ID NO: 2243990 - RNA, 12 nt, Human
acccuuggccug

SEQ ID NO: 2243991 - RNA, 11 nt, Human
acccuuggccu

SEQ ID NO: 2243992 - RNA, 21 nt, Human
acccuuggaggcugucuucuc

SEQ ID NO: 2243993 - RNA, 18 nt, Human
acccuuggacuugaggau

SEQ ID NO: 2243994 - RNA, 20 nt, Human
accgaaaacguggcugcuuc

SEQ ID NO: 2243995 - RNA, 15 nt, Human
ucaggugucccugca

SEQ ID NO: 2243996 - RNA, 23 nt, Human
ucagguggggucacucuggcagc

SEQ ID NO: 2243997 - RNA, 17 nt, Human
ucaggugucccugcacu

SEQ ID NO: 2243998 - RNA, 18 nt, Human
ucaggugucccugcacuu

SEQ ID NO: 2243999 - RNA, 22 nt, Human
ucagguggggucacucuggcag

SEQ ID NO: 2244000 - RNA, 21 nt, Human
accgaaaacguggcugcuuca

SEQ ID NO: 2244001 - RNA, 22 nt, Human
accgaaaacguggcugcuucaa

SEQ ID NO: 2244002 - RNA, 13 nt, Human
ucaguaagccgug

SEQ ID NO: 2244003 - RNA, 21 nt, Human
ucaguaacuuacccuuaggga

SEQ ID NO: 2244004 - RNA, 17 nt, Human
ucaguaagaaaaagaag

SEQ ID NO: 2244005 - RNA, 19 nt, Human
ucaguaagaaaaagaagaa

SEQ ID NO: 2244006 - RNA, 13 nt, Human
ucaguaagacgac

SEQ ID NO: 2244007 - RNA, 21 nt, Human
ucaguaagacgacaaggaaag

SEQ ID NO: 2244008 - RNA, 22 nt, Human
ucaguaagacgacaaggaaagg

SEQ ID NO: 2244009 - RNA, 17 nt, Human
ucaguaaguaucuggag

SEQ ID NO: 2244010 - RNA, 19 nt, Human
ucaguaauaaacuguguuu

SEQ ID NO: 2244011 - RNA, 14 nt, Human
ucaguaauauuuau

SEQ ID NO: 2244012 - RNA, 13 nt, Human
ucaguaauaacuc

SEQ ID NO: 2244013 - RNA, 16 nt, Human
ucaguacccucucagc

SEQ ID NO: 2244014 - RNA, 17 nt, Human
ucaguacccucucagcu

SEQ ID NO: 2244015 - RNA, 19 nt, Human
ucaguacccucucagcucc

SEQ ID NO: 2244016 - RNA, 18 nt, Human
ucaguaauuugaggacaa

SEQ ID NO: 2244017 - RNA, 17 nt, Human
ucaguaauuugaggaca

SEQ ID NO: 2244018 - RNA, 15 nt, Human
ucaguaauuugagga

SEQ ID NO: 2244019 - RNA, 14 nt, Human
ucaguaauuugagg

SEQ ID NO: 2244020 - RNA, 23 nt, Human
ucaguagaaacucuacauaauuu

SEQ ID NO: 2244021 - RNA, 23 nt, Human
ucaguaggugcccagaauaaguu

SEQ ID NO: 2244022 - RNA, 13 nt, Human
ucaguaccuggag

SEQ ID NO: 2244023 - RNA, 14 nt, Human
ucaguaccuggagg

SEQ ID NO: 2244024 - RNA, 15 nt, Human
ucaguaccuggagga

SEQ ID NO: 2244025 - RNA, 16 nt, Human
ucaguaccuggaggag

SEQ ID NO: 2244026 - RNA, 18 nt, Human
ucaguaccuggaggagga

SEQ ID NO: 2244027 - RNA, 18 nt, Human
ucagguuugccugagggc

SEQ ID NO: 2244028 - RNA, 13 nt, Human
ucagguuuggggu

SEQ ID NO: 2244029 - RNA, 17 nt, Human
ucagguuugccugaggg

SEQ ID NO: 2244030 - RNA, 17 nt, Human
ucagguuugaguagagg

SEQ ID NO: 2244031 - RNA, 20 nt, Human
ucagguuguaguaaagaaau

SEQ ID NO: 2244032 - RNA, 19 nt, Human
ucagguuguaguaaagaaa

SEQ ID NO: 2244033 - RNA, 17 nt, Human
ucagguuguaguaaaga

SEQ ID NO: 2244034 - RNA, 23 nt, Human
ucagguugcugguugcugugugg

SEQ ID NO: 2244035 - RNA, 22 nt, Human
ucagguugucugaagucacugc

SEQ ID NO: 2244036 - RNA, 13 nt, Human
ucagguuuuguaa

SEQ ID NO: 2244037 - RNA, 14 nt, Human
ucagguuuuguaaa

SEQ ID NO: 2244038 - RNA, 22 nt, Human
ucaggugucccugcacuugcag

SEQ ID NO: 2244039 - RNA, 12 nt, Human
accgaaacagcg

SEQ ID NO: 2244040 - RNA, 14 nt, Human
ucagguguugccaa

SEQ ID NO: 2244041 - RNA, 18 nt, Human
ucagguuaucgaaauaac

SEQ ID NO: 2244042 - RNA, 17 nt, Human
accgaaacagcgcuggg

SEQ ID NO: 2244043 - RNA, 18 nt, Human
ucagguucuuagugucac

SEQ ID NO: 2244044 - RNA, 15 nt, Human
ucagguugcugguug

SEQ ID NO: 2244045 - RNA, 17 nt, Human
ucagguugcugguugcu

SEQ ID NO: 2244046 - RNA, 19 nt, Human
ucagguugcugguugcugu

SEQ ID NO: 2244047 - RNA, 20 nt, Human
ucagguugcugguugcugug

SEQ ID NO: 2244048 - RNA, 21 nt, Human
ucagguugcugguugcugugu

SEQ ID NO: 2244049 - RNA, 22 nt, Human
ucagguugcugguugcugugug

SEQ ID NO: 2244050 - RNA, 19 nt, Human
ucagguuaucgaaauaaca

SEQ ID NO: 2244051 - RNA, 20 nt, Human
ucagguuaucgaaauaacaa

SEQ ID NO: 2244052 - RNA, 21 nt, Human
ucagguuaucgaaauaacaau

SEQ ID NO: 2244053 - RNA, 23 nt, Human
ucagguuaucgaaauaacaaugu

SEQ ID NO: 2244054 - RNA, 14 nt, Human
ucagguuccauccc

SEQ ID NO: 2244055 - RNA, 16 nt, Human
ucagguucuccuugau

SEQ ID NO: 2244056 - RNA, 16 nt, Human
ucauaaacugugugca

SEQ ID NO: 2244057 - RNA, 15 nt, Human
ucauaaacugugugc

SEQ ID NO: 2244058 - RNA, 14 nt, Human
ucauaaacugugug

SEQ ID NO: 2244059 - RNA, 13 nt, Human
ucauaaacugugu

SEQ ID NO: 2244060 - RNA, 16 nt, Human
ucauaaaccuuaagua

SEQ ID NO: 2244061 - RNA, 18 nt, Human
ucaguuuguccuguagag

SEQ ID NO: 2244062 - RNA, 21 nt, Human
ucauaaacaacuuaauguucu

SEQ ID NO: 2244063 - RNA, 24 nt, Human
ucauaaagcaggcagaacucaucu

SEQ ID NO: 2244064 - RNA, 11 nt, Human
ucauaaaugaa

SEQ ID NO: 2244065 - RNA, 18 nt, Human
ucauaaauaaaguuuguu

SEQ ID NO: 2244066 - RNA, 17 nt, Human
ucauaacuuucauuaaa

SEQ ID NO: 2244067 - RNA, 19 nt, Human
ucauaagacuuugggauag

SEQ ID NO: 2244068 - RNA, 18 nt, Human
ucauaagauauuuuucau

SEQ ID NO: 2244069 - RNA, 21 nt, Human
ucauaagauauuuuucaugau

SEQ ID NO: 2244070 - RNA, 12 nt, Human
ucauaaaugaag

SEQ ID NO: 2244071 - RNA, 14 nt, Human
ucauaaaugaauuu

SEQ ID NO: 2244072 - RNA, 15 nt, Human
ucauaagccaauuuu

SEQ ID NO: 2244073 - RNA, 18 nt, Human
ucauaagccaauuuuucu

SEQ ID NO: 2244074 - RNA, 20 nt, Human
ucauaagccaauuuuucugc

SEQ ID NO: 2244075 - RNA, 21 nt, Human
ucauaagccaauuuuucugca

SEQ ID NO: 2244076 - RNA, 16 nt, Human
ucauaagcgaucacuu

SEQ ID NO: 2244077 - RNA, 22 nt, Human
ucauaagccaauuuuucugcac

SEQ ID NO: 2244078 - RNA, 23 nt, Human
ucauaagccaauuuuucugcacu

SEQ ID NO: 2244079 - RNA, 20 nt, Human
ucauaaguauuucaaauugg

SEQ ID NO: 2244080 - RNA, 15 nt, Human
ucauaaguauuucaa

SEQ ID NO: 2244081 - RNA, 20 nt, Human
ucauaaguauuaugucucuu

SEQ ID NO: 2244082 - RNA, 19 nt, Human
ucaguuugcuagcagaaau

SEQ ID NO: 2244083 - RNA, 20 nt, Human
ucaguuuccuggucuguaga

SEQ ID NO: 2244084 - RNA, 19 nt, Human
ucaguuucaauucagugcu

SEQ ID NO: 2244085 - RNA, 16 nt, Human
ucaguuuccuggucug

SEQ ID NO: 2244086 - RNA, 21 nt, Human
ucauaaaauaaaguauauaua

SEQ ID NO: 2244087 - RNA, 16 nt, Human
ucauaaaauaaaguau

SEQ ID NO: 2244088 - RNA, 17 nt, Human
ucaguuugugugucuua

SEQ ID NO: 2244089 - RNA, 15 nt, Human
ucaguuugugugucu

SEQ ID NO: 2244090 - RNA, 16 nt, Human
ucaguuugugugucuu

SEQ ID NO: 2244091 - RNA, 15 nt, Human
ucaguuuguauauac

SEQ ID NO: 2244092 - RNA, 22 nt, Human
ucagugcuguggccugggcaag

SEQ ID NO: 2244093 - RNA, 12 nt, Human
ucaguuguuuuc

SEQ ID NO: 2244094 - RNA, 19 nt, Human
ucaguuguuagugugucuu

SEQ ID NO: 2244095 - RNA, 23 nt, Human
ucaguuuauccaagguguaacuc

SEQ ID NO: 2244096 - RNA, 15 nt, Human
ucaguuuaauccuuc

SEQ ID NO: 2244097 - RNA, 16 nt, Human
ucaguuuaauccuucu

SEQ ID NO: 2244098 - RNA, 19 nt, Human
ucaguuuaauccuucuagu

SEQ ID NO: 2244099 - RNA, 20 nt, Human
ucaguuuaauccuucuaguu

SEQ ID NO: 2244100 - RNA, 14 nt, Human
ucaguauugaagca

SEQ ID NO: 2244101 - RNA, 18 nt, Human
ucaguauugaagcauuuu

SEQ ID NO: 2244102 - RNA, 17 nt, Human
ucaguauugaagcauuu

SEQ ID NO: 2244103 - RNA, 16 nt, Human
ucaguauugaagcauu

SEQ ID NO: 2244104 - RNA, 15 nt, Human
ucaguauugaagcau

SEQ ID NO: 2244105 - RNA, 15 nt, Human
ucaguauguugucaa

SEQ ID NO: 2244106 - RNA, 16 nt, Human
ucaguauguugucaaa

SEQ ID NO: 2244107 - RNA, 17 nt, Human
ucaguauguugucaaag

SEQ ID NO: 2244108 - RNA, 18 nt, Human
ucaguauguugucaaaga

SEQ ID NO: 2244109 - RNA, 20 nt, Human
ucaguauguugucaaagaga

SEQ ID NO: 2244110 - RNA, 19 nt, Human
ucagugccuuauggaacac

SEQ ID NO: 2244111 - RNA, 20 nt, Human
ucagugccuuauggaacacu

SEQ ID NO: 2244112 - RNA, 22 nt, Human
ucagugccuuauggaacacucu

SEQ ID NO: 2244113 - RNA, 23 nt, Human
ucagugccuuauggaacacucug

SEQ ID NO: 2244114 - RNA, 14 nt, Human
ucaguggcagcugc

SEQ ID NO: 2244115 - RNA, 15 nt, Human
ucaguggcagcugcu

SEQ ID NO: 2244116 - RNA, 19 nt, Human
ucagugcuguggccugggc

SEQ ID NO: 2244117 - RNA, 17 nt, Human
ucagugcuguggccugg

SEQ ID NO: 2244118 - RNA, 16 nt, Human
ucaguggcagcugcuu

SEQ ID NO: 2244119 - RNA, 15 nt, Human
ucagugcuguggccu

SEQ ID NO: 2244120 - RNA, 14 nt, Human
ucagugcuguggcc

SEQ ID NO: 2244121 - RNA, 12 nt, Human
ucagugcugugg

SEQ ID NO: 2244122 - RNA, 13 nt, Human
ucaguggcagcug

SEQ ID NO: 2244123 - RNA, 18 nt, Human
ucagugcucgagacacag

SEQ ID NO: 2244124 - RNA, 19 nt, Human
ucagugcucccucacaugu

SEQ ID NO: 2244125 - RNA, 13 nt, Human
ucagugcucccuc

SEQ ID NO: 2244126 - RNA, 12 nt, Human
ucagugcucccu

SEQ ID NO: 2244127 - RNA, 19 nt, Human
ucaguauugaagcauuuua

SEQ ID NO: 2244128 - RNA, 17 nt, Human
acauuaagccuuccaca

SEQ ID NO: 2244129 - RNA, 21 nt, Human
acauuaaucaaucaucugugu

SEQ ID NO: 2244130 - RNA, 22 nt, Human
acauuaauguuaauucagcacu

SEQ ID NO: 2244131 - RNA, 15 nt, Human
acauuaauguuaauu

SEQ ID NO: 2244132 - RNA, 21 nt, Human
acauuaauguuaauucagcac

SEQ ID NO: 2244133 - RNA, 15 nt, Human
acauuaccuuacugu

SEQ ID NO: 2244134 - RNA, 18 nt, Human
acauuagaacacugcauu

SEQ ID NO: 2244135 - RNA, 16 nt, Human
acauuaccuuacugug

SEQ ID NO: 2244136 - RNA, 19 nt, Human
acauuaccuuacuguggag

SEQ ID NO: 2244137 - RNA, 21 nt, Human
acaugucuuuucuugcaugag

SEQ ID NO: 2244138 - RNA, 22 nt, Human
acaugucuuguacauguguagc

SEQ ID NO: 2244139 - RNA, 20 nt, Human
acauuaagauugaggccugc

SEQ ID NO: 2244140 - RNA, 16 nt, Human
acaugucuuguacaug

SEQ ID NO: 2244141 - RNA, 19 nt, Human
acaugucuuguacaugugu

SEQ ID NO: 2244142 - RNA, 13 nt, Human
acaugucuuguac

SEQ ID NO: 2244143 - RNA, 14 nt, Human
acaugucuuguaca

SEQ ID NO: 2244144 - RNA, 22 nt, Human
acaugucuuaaugaaguuugaa

SEQ ID NO: 2244145 - RNA, 23 nt, Human
acaugucuuaaugaaguuugaau

SEQ ID NO: 2244146 - RNA, 16 nt, Human
acaugucuuaaugaag

SEQ ID NO: 2244147 - RNA, 18 nt, Human
acaugucuuaaugaaguu

SEQ ID NO: 2244148 - RNA, 20 nt, Human
acaugucuuaaugaaguuug

SEQ ID NO: 2244149 - RNA, 21 nt, Human
acaugucuuaaugaaguuuga

SEQ ID NO: 2244150 - RNA, 14 nt, Human
acauguauaauauu

SEQ ID NO: 2244151 - RNA, 23 nt, Human
acauguaauaaaaaguauauguu

SEQ ID NO: 2244152 - RNA, 19 nt, Human
acauguaauaaaaaguaua

SEQ ID NO: 2244153 - RNA, 17 nt, Human
acauguaauaaaaagua

SEQ ID NO: 2244154 - RNA, 17 nt, Human
acaugguuugacucccg

SEQ ID NO: 2244155 - RNA, 20 nt, Human
acaugguugugaccugagga

SEQ ID NO: 2244156 - RNA, 18 nt, Human
acaugguugugaccugag

SEQ ID NO: 2244157 - RNA, 22 nt, Human
acaugguuacaaucauugcuga

SEQ ID NO: 2244158 - RNA, 23 nt, Human
acaugguuacaaucauugcugaa

SEQ ID NO: 2244159 - RNA, 18 nt, Human
acaugguggguccauggg

SEQ ID NO: 2244160 - RNA, 19 nt, Human
acaugguggguccaugggc

SEQ ID NO: 2244161 - RNA, 23 nt, Human
acauggugucuggauucccagga

SEQ ID NO: 2244162 - RNA, 18 nt, Human
acaugguuacaaucauug

SEQ ID NO: 2244163 - RNA, 19 nt, Human
acauggugcuacgccugca

SEQ ID NO: 2244164 - RNA, 20 nt, Human
acauggugccugagaggcag

SEQ ID NO: 2244165 - RNA, 23 nt, Human
acauggugccugagaggcaggca

SEQ ID NO: 2244166 - RNA, 23 nt, Human
acauggugcuacgccugcaugua

SEQ ID NO: 2244167 - RNA, 19 nt, Human
acauguauaauauuuuuaa

SEQ ID NO: 2244168 - RNA, 20 nt, Human
acauguauaauauuuuuaau

SEQ ID NO: 2244169 - RNA, 21 nt, Human
acauguaucuaugcauuuucu

SEQ ID NO: 2244170 - RNA, 18 nt, Human
acauguaucuaugcauuu

SEQ ID NO: 2244171 - RNA, 20 nt, Human
acauguaauaaaaaguauau

SEQ ID NO: 2244172 - RNA, 11 nt, Human
acauguauguu

SEQ ID NO: 2244173 - RNA, 14 nt, Human
acauguauguuuug

SEQ ID NO: 2244174 - RNA, 15 nt, Human
acauguauguuuugg

SEQ ID NO: 2244175 - RNA, 22 nt, Human
acauguauguuuugguaucugu

SEQ ID NO: 2244176 - RNA, 23 nt, Human
acauguauguuuugguaucuguu

SEQ ID NO: 2244177 - RNA, 15 nt, Human
acauguauuauuuca

SEQ ID NO: 2244178 - RNA, 18 nt, Human
acauguauugcacauugu

SEQ ID NO: 2244179 - RNA, 19 nt, Human
acauguauugcacauugua

SEQ ID NO: 2244180 - RNA, 15 nt, Human
acaugucuuaaugaa

SEQ ID NO: 2244181 - RNA, 12 nt, Human
acauguauuugu

SEQ ID NO: 2244182 - RNA, 21 nt, Human
acauguauugcacauuguaaa

SEQ ID NO: 2244183 - RNA, 18 nt, Human
acauggaauaacauguaa

SEQ ID NO: 2244184 - RNA, 14 nt, Human
acauggaaguacua

SEQ ID NO: 2244185 - RNA, 20 nt, Human
acauggaauaacauguaauu

SEQ ID NO: 2244186 - RNA, 19 nt, Human
acauggacccggagcuaac

SEQ ID NO: 2244187 - RNA, 13 nt, Human
acauggacuugua

SEQ ID NO: 2244188 - RNA, 22 nt, Human
acauggacccggagcuaacacu

SEQ ID NO: 2244189 - RNA, 16 nt, Human
acauggacccggagcu

SEQ ID NO: 2244190 - RNA, 13 nt, Human
acauggacccgga

SEQ ID NO: 2244191 - RNA, 12 nt, Human
acauggacccgg

SEQ ID NO: 2244192 - RNA, 21 nt, Human
acaugaggacaugauggagcg

SEQ ID NO: 2244193 - RNA, 22 nt, Human
acaugagcuauuuccauuccag

SEQ ID NO: 2244194 - RNA, 17 nt, Human
acaugaggggacauuuu

SEQ ID NO: 2244195 - RNA, 16 nt, Human
acaugaggggacauuu

SEQ ID NO: 2244196 - RNA, 14 nt, Human
acaugagauuuaua

SEQ ID NO: 2244197 - RNA, 23 nt, Human
acaugagcuauuuccauuccaga

SEQ ID NO: 2244198 - RNA, 23 nt, Human
acaugagcaucaggccaggcccu

SEQ ID NO: 2244199 - RNA, 19 nt, Human
acauggaguauaugucaag

SEQ ID NO: 2244200 - RNA, 15 nt, Human
acauggaguauaugu

SEQ ID NO: 2244201 - RNA, 21 nt, Human
acauggagacuccugcccugu

SEQ ID NO: 2244202 - RNA, 22 nt, Human
acauggagacuccugcccuguu

SEQ ID NO: 2244203 - RNA, 14 nt, Human
acauggacuuguau

SEQ ID NO: 2244204 - RNA, 15 nt, Human
acauggacuuguaua

SEQ ID NO: 2244205 - RNA, 17 nt, Human
acauggacuuguauauu

SEQ ID NO: 2244206 - RNA, 18 nt, Human
acauggacuuguauauuu

SEQ ID NO: 2244207 - RNA, 23 nt, Human
acauggacuuguauauuuguaca

SEQ ID NO: 2244208 - RNA, 15 nt, Human
acauggagacuccug

SEQ ID NO: 2244209 - RNA, 16 nt, Human
acauggagacuccugc

SEQ ID NO: 2244210 - RNA, 17 nt, Human
acauggagacuccugcc

SEQ ID NO: 2244211 - RNA, 15 nt, Human
acauggccaguguga

SEQ ID NO: 2244212 - RNA, 14 nt, Human
acauggccagugug

SEQ ID NO: 2244213 - RNA, 22 nt, Human
acauggccccucccccugccag

SEQ ID NO: 2244214 - RNA, 21 nt, Human
acauggccccucccccugcca

SEQ ID NO: 2244215 - RNA, 14 nt, Human
acauggccuuugcu

SEQ ID NO: 2244216 - RNA, 20 nt, Human
acauggcucuaaaaaguuuu

SEQ ID NO: 2244217 - RNA, 19 nt, Human
acauggugccugagaggca

SEQ ID NO: 2244218 - RNA, 17 nt, Human
acauggccuaugcacau

SEQ ID NO: 2244219 - RNA, 18 nt, Human
acauggccuaugcacaua

SEQ ID NO: 2244220 - RNA, 20 nt, Human
acauggccuaugcacauaug

SEQ ID NO: 2244221 - RNA, 16 nt, Human
ucaaaagcugggcagg

SEQ ID NO: 2244222 - RNA, 23 nt, Human
ucaaaaggugccugugaggcagg

SEQ ID NO: 2244223 - RNA, 13 nt, Human
ucaaaaggugccu

SEQ ID NO: 2244224 - RNA, 14 nt, Human
ucaaaaguauuuuc

SEQ ID NO: 2244225 - RNA, 15 nt, Human
ucaaaaguauuuucc

SEQ ID NO: 2244226 - RNA, 16 nt, Human
ucaaaaguauuuuccu

SEQ ID NO: 2244227 - RNA, 17 nt, Human
ucaaaaguauuuuccug

SEQ ID NO: 2244228 - RNA, 18 nt, Human
ucaaaaguauuuuccugu

SEQ ID NO: 2244229 - RNA, 20 nt, Human
ucaaaaguauuuuccuguaa

SEQ ID NO: 2244230 - RNA, 13 nt, Human
ucaaacagucuca

SEQ ID NO: 2244231 - RNA, 21 nt, Human
ucaaacagucucaggaaauca

SEQ ID NO: 2244232 - RNA, 20 nt, Human
ucaaacagucucaggaaauc

SEQ ID NO: 2244233 - RNA, 20 nt, Human
ucaaagcaccaaaauaagaa

SEQ ID NO: 2244234 - RNA, 18 nt, Human
ucaaagcaccaaaauaag

SEQ ID NO: 2244235 - RNA, 16 nt, Human
ucaaagcaaugcauuu

SEQ ID NO: 2244236 - RNA, 17 nt, Human
ucaaagcaaugcauuuu

SEQ ID NO: 2244237 - RNA, 18 nt, Human
ucaaagcaaugcauuuug

SEQ ID NO: 2244238 - RNA, 19 nt, Human
ucaaagcaaugcauuuugg

SEQ ID NO: 2244239 - RNA, 20 nt, Human
ucaaagcaaggaaacuaugu

SEQ ID NO: 2244240 - RNA, 14 nt, Human
ucaaagcaaugcau

SEQ ID NO: 2244241 - RNA, 15 nt, Human
ucaaagcaaugcauu

SEQ ID NO: 2244242 - RNA, 16 nt, Human
ucaaagcaaggaaacu

SEQ ID NO: 2244243 - RNA, 15 nt, Human
ucaaagcaaggaaac

SEQ ID NO: 2244244 - RNA, 23 nt, Human
ucaaagcaaaugucuuccuggau

SEQ ID NO: 2244245 - RNA, 15 nt, Human
ucaaagcaaaugucu

SEQ ID NO: 2244246 - RNA, 16 nt, Human
ucaaacagaauuuuaa

SEQ ID NO: 2244247 - RNA, 22 nt, Human
ucaaacaguacacuaucuuaau

SEQ ID NO: 2244248 - RNA, 15 nt, Human
ucaaacaguagguug

SEQ ID NO: 2244249 - RNA, 20 nt, Human
ucaaacaguagguuggcagu

SEQ ID NO: 2244250 - RNA, 22 nt, Human
ucaaagauauuuugcuuuguga

SEQ ID NO: 2244251 - RNA, 20 nt, Human
ucaaagauauuuugcuuugu

SEQ ID NO: 2244252 - RNA, 13 nt, Human
ucaaagauauuuu

SEQ ID NO: 2244253 - RNA, 20 nt, Human
ucaaaguguaaacaccauag

SEQ ID NO: 2244254 - RNA, 19 nt, Human
ucaaaguaaaacuugcugc

SEQ ID NO: 2244255 - RNA, 18 nt, Human
ucaaaguaggcaggacca

SEQ ID NO: 2244256 - RNA, 14 nt, Human
ucaaaguaaaacuu

SEQ ID NO: 2244257 - RNA, 19 nt, Human
ucaaagguagccaucaugg

SEQ ID NO: 2244258 - RNA, 21 nt, Human
ucaaagcaccaaaauaagaaa

SEQ ID NO: 2244259 - RNA, 22 nt, Human
ucaaagcaccaaaauaagaaaa

SEQ ID NO: 2244260 - RNA, 13 nt, Human
ucaaauauauuca

SEQ ID NO: 2244261 - RNA, 12 nt, Human
ucaaauacuuua

SEQ ID NO: 2244262 - RNA, 23 nt, Human
ucaaauacuuuaaaggaaaaaau

SEQ ID NO: 2244263 - RNA, 21 nt, Human
acaugacccuaaaucuugacu

SEQ ID NO: 2244264 - RNA, 19 nt, Human
acaugacccuaaaucuuga

SEQ ID NO: 2244265 - RNA, 15 nt, Human
acaugacaacuuugc

SEQ ID NO: 2244266 - RNA, 14 nt, Human
acaugacacagcuu

SEQ ID NO: 2244267 - RNA, 15 nt, Human
acaugagaacaaaca

SEQ ID NO: 2244268 - RNA, 13 nt, Human
acaugagcaucag

SEQ ID NO: 2244269 - RNA, 22 nt, Human
acaugaaaacacauuuuucuua

SEQ ID NO: 2244270 - RNA, 23 nt, Human
acaugaaaacacauuuuucuuag

SEQ ID NO: 2244271 - RNA, 15 nt, Human
acaugaaacagaaac

SEQ ID NO: 2244272 - RNA, 13 nt, Human
acaugaaacagaa

SEQ ID NO: 2244273 - RNA, 15 nt, Human
ucaaauacuuuaaag

SEQ ID NO: 2244274 - RNA, 14 nt, Human
acaugaacauacug

SEQ ID NO: 2244275 - RNA, 19 nt, Human
uauuuguacaguucaguuc

SEQ ID NO: 2244276 - RNA, 12 nt, Human
uauuuguacaua

SEQ ID NO: 2244277 - RNA, 12 nt, Human
uauuuguacaaa

SEQ ID NO: 2244278 - RNA, 15 nt, Human
acaugaaaacacauu

SEQ ID NO: 2244279 - RNA, 20 nt, Human
uauuuguuaaugguuugaau

SEQ ID NO: 2244280 - RNA, 22 nt, Human
uauuuguuaaugguuugaauau

SEQ ID NO: 2244281 - RNA, 17 nt, Human
uauuuguuaaauauuua

SEQ ID NO: 2244282 - RNA, 14 nt, Human
uauuuguuauuuuc

SEQ ID NO: 2244283 - RNA, 12 nt, Human
uauuuguguuuu

SEQ ID NO: 2244284 - RNA, 19 nt, Human
uauuuguguuuuaauuuaa

SEQ ID NO: 2244285 - RNA, 21 nt, Human
uauuuguguuuuaauuuaaac

SEQ ID NO: 2244286 - RNA, 22 nt, Human
uauuuguaucucugaagcaugu

SEQ ID NO: 2244287 - RNA, 23 nt, Human
uauuuguaucucugaagcauguu

SEQ ID NO: 2244288 - RNA, 17 nt, Human
uauuuguauaguugcuu

SEQ ID NO: 2244289 - RNA, 23 nt, Human
uauuuguauaguugcuugccuga

SEQ ID NO: 2244290 - RNA, 12 nt, Human
uauuuguaucuc

SEQ ID NO: 2244291 - RNA, 15 nt, Human
uauuuguaucucuga

SEQ ID NO: 2244292 - RNA, 21 nt, Human
uauuuguauuuuuuugcaagu

SEQ ID NO: 2244293 - RNA, 15 nt, Human
uauuugucuuucagg

SEQ ID NO: 2244294 - RNA, 18 nt, Human
uauuuuaaaaucugucac

SEQ ID NO: 2244295 - RNA, 13 nt, Human
uauuuuaaaauga

SEQ ID NO: 2244296 - RNA, 12 nt, Human
uauuuuaaacaa

SEQ ID NO: 2244297 - RNA, 14 nt, Human
uauuuuaaacaaaa

SEQ ID NO: 2244298 - RNA, 19 nt, Human
uauuuuaaacaaaauagaa

SEQ ID NO: 2244299 - RNA, 14 nt, Human
uauuuuaagacgaa

SEQ ID NO: 2244300 - RNA, 22 nt, Human
uauuuuaagacgaaacauuugu

SEQ ID NO: 2244301 - RNA, 21 nt, Human
uauuuuaaaagauaaauauua

SEQ ID NO: 2244302 - RNA, 17 nt, Human
uauuuguuauuuucagu

SEQ ID NO: 2244303 - RNA, 13 nt, Human
uauuuguuuucau

SEQ ID NO: 2244304 - RNA, 14 nt, Human
uauuuguuuucaug

SEQ ID NO: 2244305 - RNA, 18 nt, Human
uauuuuaaaagaaugauu

SEQ ID NO: 2244306 - RNA, 15 nt, Human
uauuuguuugcauag

SEQ ID NO: 2244307 - RNA, 18 nt, Human
uauuuguuauuuucagua

SEQ ID NO: 2244308 - RNA, 14 nt, Human
uauuuuaaaagaau

SEQ ID NO: 2244309 - RNA, 15 nt, Human
acaucuuucacauug

SEQ ID NO: 2244310 - RNA, 13 nt, Human
acaucuuucacau

SEQ ID NO: 2244311 - RNA, 15 nt, Human
acaucuuucacacuu

SEQ ID NO: 2244312 - RNA, 14 nt, Human
acaucuuucacacu

SEQ ID NO: 2244313 - RNA, 12 nt, Human
acaucuuucaca

SEQ ID NO: 2244314 - RNA, 13 nt, Human
acaucuuuauccg

SEQ ID NO: 2244315 - RNA, 17 nt, Human
acaucuuuaucuguucu

SEQ ID NO: 2244316 - RNA, 20 nt, Human
acaucuuucacacuuccacc

SEQ ID NO: 2244317 - RNA, 14 nt, Human
acaucuuuccuguc

SEQ ID NO: 2244318 - RNA, 15 nt, Human
acaucuuuuuucaca

SEQ ID NO: 2244319 - RNA, 19 nt, Human
acaucuuuuuucacaaauu

SEQ ID NO: 2244320 - RNA, 23 nt, Human
acaugaaaaaaggacaauuucaa

SEQ ID NO: 2244321 - RNA, 24 nt, Human
acaucuuuucuugccucugucccc

SEQ ID NO: 2244322 - RNA, 13 nt, Human
acaucuuggcaca

SEQ ID NO: 2244323 - RNA, 24 nt, Human
acaucuuggcacauuuaagagaca

SEQ ID NO: 2244324 - RNA, 14 nt, Human
acaucuugcucugc

SEQ ID NO: 2244325 - RNA, 19 nt, Human
acaucuuggucagauuuga

SEQ ID NO: 2244326 - RNA, 22 nt, Human
acaucuugcucugcugacagac

SEQ ID NO: 2244327 - RNA, 17 nt, Human
acaucuugcucugcuga

SEQ ID NO: 2244328 - RNA, 19 nt, Human
uaugugguuuccacgauga

SEQ ID NO: 2244329 - RNA, 22 nt, Human
acaggaggacaauucaugaacu

SEQ ID NO: 2244330 - RNA, 14 nt, Human
uauguguaaaaugu

SEQ ID NO: 2244331 - RNA, 17 nt, Human
uauguguaaaaugugaa

SEQ ID NO: 2244332 - RNA, 15 nt, Human
acaucuugcucugcu

SEQ ID NO: 2244333 - RNA, 16 nt, Human
acaucuugcucugcug

SEQ ID NO: 2244334 - RNA, 14 nt, Human
uaugugccagauuu

SEQ ID NO: 2244335 - RNA, 19 nt, Human
uaugugccagauuuaugca

SEQ ID NO: 2244336 - RNA, 20 nt, Human
uaugugggggucuguguguu

SEQ ID NO: 2244337 - RNA, 19 nt, Human
uaugugggggucugugugu

SEQ ID NO: 2244338 - RNA, 18 nt, Human
uaugugggggucugugug

SEQ ID NO: 2244339 - RNA, 17 nt, Human
uaugugcacugucacuu

SEQ ID NO: 2244340 - RNA, 20 nt, Human
uaugugcacugucacuuugc

SEQ ID NO: 2244341 - RNA, 21 nt, Human
uaugugcacugucacuuugcu

SEQ ID NO: 2244342 - RNA, 22 nt, Human
uaugugcacugucacuuugcuc

SEQ ID NO: 2244343 - RNA, 14 nt, Human
uauuuuguaauuau

SEQ ID NO: 2244344 - RNA, 21 nt, Human
uauuuuguaaacucaaaauau

SEQ ID NO: 2244345 - RNA, 19 nt, Human
uauuuugguucuuaguucu

SEQ ID NO: 2244346 - RNA, 16 nt, Human
uauuuuguaauuauug

SEQ ID NO: 2244347 - RNA, 15 nt, Human
uauuuuguauauauc

SEQ ID NO: 2244348 - RNA, 20 nt, Human
uauuuuguaaacucaaaaua

SEQ ID NO: 2244349 - RNA, 13 nt, Human
uauuuuguaaacu

SEQ ID NO: 2244350 - RNA, 21 nt, Human
uauuuugguucuuaguucuca

SEQ ID NO: 2244351 - RNA, 14 nt, Human
uauuuugucuaaaa

SEQ ID NO: 2244352 - RNA, 13 nt, Human
uauuuugugaaga

SEQ ID NO: 2244353 - RNA, 12 nt, Human
uauuuugucuaa

SEQ ID NO: 2244354 - RNA, 13 nt, Human
uauuuugucuaaa

SEQ ID NO: 2244355 - RNA, 17 nt, Human
uauuuuguguuuaggaa

SEQ ID NO: 2244356 - RNA, 20 nt, Human
uauuuuguguuuaggaacua

SEQ ID NO: 2244357 - RNA, 17 nt, Human
uauuuuuauuuguuugu

SEQ ID NO: 2244358 - RNA, 13 nt, Human
uauuuuuauuugu

SEQ ID NO: 2244359 - RNA, 12 nt, Human
uauuuuuaaugg

SEQ ID NO: 2244360 - RNA, 18 nt, Human
uauuuuucaauaaagcau

SEQ ID NO: 2244361 - RNA, 14 nt, Human
uauuuuuaagauaa

SEQ ID NO: 2244362 - RNA, 21 nt, Human
uauuuuuaauauauacuauga

SEQ ID NO: 2244363 - RNA, 15 nt, Human
uauuuuucacaguuu

SEQ ID NO: 2244364 - RNA, 20 nt, Human
uauuuuucaauaaagcauuu

SEQ ID NO: 2244365 - RNA, 11 nt, Human
uauuuuucaua

SEQ ID NO: 2244366 - RNA, 13 nt, Human
uauuuuucauauu

SEQ ID NO: 2244367 - RNA, 14 nt, Human
uauuuuucauauug

SEQ ID NO: 2244368 - RNA, 20 nt, Human
uauuuuuguaauuuuaaaua

SEQ ID NO: 2244369 - RNA, 17 nt, Human
uauuuuuguagagccag

SEQ ID NO: 2244370 - RNA, 19 nt, Human
uauuuuuggcagucugaau

SEQ ID NO: 2244371 - RNA, 20 nt, Human
uauuuuuggcagucugaauu

SEQ ID NO: 2244372 - RNA, 18 nt, Human
uauuuuugguugucaaua

SEQ ID NO: 2244373 - RNA, 20 nt, Human
uauuuuucaugauuuugaaa

SEQ ID NO: 2244374 - RNA, 12 nt, Human
uauuuuucauga

SEQ ID NO: 2244375 - RNA, 15 nt, Human
uauuuuucauauugu

SEQ ID NO: 2244376 - RNA, 19 nt, Human
uauuuuucauauugugcca

SEQ ID NO: 2244377 - RNA, 16 nt, Human
uauuuugauuauugua

SEQ ID NO: 2244378 - RNA, 17 nt, Human
uauuuugauuauuguau

SEQ ID NO: 2244379 - RNA, 14 nt, Human
uauuuugcuggaau

SEQ ID NO: 2244380 - RNA, 18 nt, Human
uauuuugauuauuguauu

SEQ ID NO: 2244381 - RNA, 14 nt, Human
uauuuugcacaguu

SEQ ID NO: 2244382 - RNA, 18 nt, Human
uauuuuacuucuagagau

SEQ ID NO: 2244383 - RNA, 16 nt, Human
uauuuuacuacugugg

SEQ ID NO: 2244384 - RNA, 15 nt, Human
uauuuugcuuuguga

SEQ ID NO: 2244385 - RNA, 13 nt, Human
uauuuugcuuugu

SEQ ID NO: 2244386 - RNA, 20 nt, Human
uauuuugcuuugugauuuuu

SEQ ID NO: 2244387 - RNA, 23 nt, Human
uauuuuggauuguauauuguguu

SEQ ID NO: 2244388 - RNA, 14 nt, Human
uauuuugguacuuu

SEQ ID NO: 2244389 - RNA, 17 nt, Human
uauuuugguacuuuuau

SEQ ID NO: 2244390 - RNA, 20 nt, Human
uauuuuggauuguauauugu

SEQ ID NO: 2244391 - RNA, 16 nt, Human
uauuuuggagaaauua

SEQ ID NO: 2244392 - RNA, 14 nt, Human
uauuuuaaguauug

SEQ ID NO: 2244393 - RNA, 19 nt, Human
uauuuuaauuuaugaguuu

SEQ ID NO: 2244394 - RNA, 22 nt, Human
uauuuuaauaauguuucaaaca

SEQ ID NO: 2244395 - RNA, 23 nt, Human
uauuuuacaauuuuuuaucaugc

SEQ ID NO: 2244396 - RNA, 14 nt, Human
uauuuuacaauuuu

SEQ ID NO: 2244397 - RNA, 14 nt, Human
uauuuuaauaaaca

SEQ ID NO: 2244398 - RNA, 17 nt, Human
uauuuuaauaaacacuc

SEQ ID NO: 2244399 - RNA, 19 nt, Human
uauuuuaauaauguuucaa

SEQ ID NO: 2244400 - RNA, 13 nt, Human
acauuguuuuaaa

SEQ ID NO: 2244401 - RNA, 15 nt, Human
acauuguuuuaaaaa

SEQ ID NO: 2244402 - RNA, 16 nt, Human
acauuguuuuaaaaag

SEQ ID NO: 2244403 - RNA, 17 nt, Human
acauuguuuuaaaaaga

SEQ ID NO: 2244404 - RNA, 18 nt, Human
acauuguuuuaaaaagaa

SEQ ID NO: 2244405 - RNA, 12 nt, Human
acauuguuuugc

SEQ ID NO: 2244406 - RNA, 23 nt, Human
acauugguucuuguauuaagaau

SEQ ID NO: 2244407 - RNA, 22 nt, Human
acauugguucuuguauuaagaa

SEQ ID NO: 2244408 - RNA, 17 nt, Human
acauuguaaauaguauu

SEQ ID NO: 2244409 - RNA, 19 nt, Human
acauuguaaauaguauuug

SEQ ID NO: 2244410 - RNA, 21 nt, Human
acauuguaaauaguauuugag

SEQ ID NO: 2244411 - RNA, 21 nt, Human
acauugguucuuguauuaaga

SEQ ID NO: 2244412 - RNA, 18 nt, Human
acauugguucuuguauua

SEQ ID NO: 2244413 - RNA, 16 nt, Human
acauugguucuuguau

SEQ ID NO: 2244414 - RNA, 14 nt, Human
acauugguucuugu

SEQ ID NO: 2244415 - RNA, 23 nt, Human
acauuggguccugggucuuucau

SEQ ID NO: 2244416 - RNA, 20 nt, Human
acauugggcagcgcccuucc

SEQ ID NO: 2244417 - RNA, 21 nt, Human
acauugggcagcgcccuuccu

SEQ ID NO: 2244418 - RNA, 22 nt, Human
acauugggcagcgcccuuccuc

SEQ ID NO: 2244419 - RNA, 16 nt, Human
acauugguaagaauga

SEQ ID NO: 2244420 - RNA, 15 nt, Human
acauugggaagggga

SEQ ID NO: 2244421 - RNA, 19 nt, Human
acauugggaaggggacccc

SEQ ID NO: 2244422 - RNA, 23 nt, Human
acauugggaaggggacccccgcc

SEQ ID NO: 2244423 - RNA, 17 nt, Human
acauugggaaaucuuau

SEQ ID NO: 2244424 - RNA, 17 nt, Human
acauugggcagcgcccu

SEQ ID NO: 2244425 - RNA, 22 nt, Human
acauuggcaccuaauccaggca

SEQ ID NO: 2244426 - RNA, 21 nt, Human
acauuggcaccuaauccaggc

SEQ ID NO: 2244427 - RNA, 16 nt, Human
acauuggagccugggc

SEQ ID NO: 2244428 - RNA, 20 nt, Human
acauugcuugugccacaccc

SEQ ID NO: 2244429 - RNA, 14 nt, Human
ucaauccucuaagc

SEQ ID NO: 2244430 - RNA, 14 nt, Human
acauugcuaagaug

SEQ ID NO: 2244431 - RNA, 17 nt, Human
acauugcuaagaugcuc

SEQ ID NO: 2244432 - RNA, 18 nt, Human
acauugcuuuacugucaa

SEQ ID NO: 2244433 - RNA, 21 nt, Human
acauugcuuuacugucaaaau

SEQ ID NO: 2244434 - RNA, 23 nt, Human
acauugcuuugaccacucuuccu

SEQ ID NO: 2244435 - RNA, 22 nt, Human
ucaauccccucauucaggaaaa

SEQ ID NO: 2244436 - RNA, 21 nt, Human
ucaauccuaauuucuccuccc

SEQ ID NO: 2244437 - RNA, 15 nt, Human
ucaauccuaccuguu

SEQ ID NO: 2244438 - RNA, 22 nt, Human
ucaauccuaauuucuccucccu

SEQ ID NO: 2244439 - RNA, 23 nt, Human
acauugcguuugaccuuuuaugu

SEQ ID NO: 2244440 - RNA, 15 nt, Human
acauugcguuugacc

SEQ ID NO: 2244441 - RNA, 21 nt, Human
acauugcggacagccacggcc

SEQ ID NO: 2244442 - RNA, 22 nt, Human
acauugcggacagccacggcca

SEQ ID NO: 2244443 - RNA, 19 nt, Human
acauuuuaaugcaccugaa

SEQ ID NO: 2244444 - RNA, 15 nt, Human
acauuuuaaugcacc

SEQ ID NO: 2244445 - RNA, 13 nt, Human
acauuuuaauuca

SEQ ID NO: 2244446 - RNA, 18 nt, Human
acauuuuaaauggacaga

SEQ ID NO: 2244447 - RNA, 17 nt, Human
acauuuaauacagcagu

SEQ ID NO: 2244448 - RNA, 20 nt, Human
acauuuaagagacagucacc

SEQ ID NO: 2244449 - RNA, 22 nt, Human
acauuuaacuuguuuccaaugu

SEQ ID NO: 2244450 - RNA, 16 nt, Human
acauuuaauacagcag

SEQ ID NO: 2244451 - RNA, 17 nt, Human
acauuuaaacuugucag

SEQ ID NO: 2244452 - RNA, 21 nt, Human
acauuguuuugccaacauugc

SEQ ID NO: 2244453 - RNA, 23 nt, Human
acauuuaaauuuuacccuuuaga

SEQ ID NO: 2244454 - RNA, 18 nt, Human
acauuuuacuuuuuccug

SEQ ID NO: 2244455 - RNA, 12 nt, Human
acauuuuguaua

SEQ ID NO: 2244456 - RNA, 15 nt, Human
acauuuuaguucuuu

SEQ ID NO: 2244457 - RNA, 13 nt, Human
acauuuuguauaa

SEQ ID NO: 2244458 - RNA, 16 nt, Human
acauuuuguauaauug

SEQ ID NO: 2244459 - RNA, 19 nt, Human
acauuuuguauaauuguau

SEQ ID NO: 2244460 - RNA, 21 nt, Human
acauuuuguauaauuguaucg

SEQ ID NO: 2244461 - RNA, 15 nt, Human
accaaaaaaguuaca

SEQ ID NO: 2244462 - RNA, 23 nt, Human
acauuuuucuuagggaaggauac

SEQ ID NO: 2244463 - RNA, 13 nt, Human
acauuuuucuuag

SEQ ID NO: 2244464 - RNA, 21 nt, Human
acauuuuucagauauaaaaga

SEQ ID NO: 2244465 - RNA, 15 nt, Human
acauuuuuacaauaa

SEQ ID NO: 2244466 - RNA, 14 nt, Human
acauuuuuacaaua

SEQ ID NO: 2244467 - RNA, 18 nt, Human
acauuuuuaagugcugca

SEQ ID NO: 2244468 - RNA, 15 nt, Human
acauuuuuaagugcu

SEQ ID NO: 2244469 - RNA, 19 nt, Human
ucaauaguaaaagauaaca

SEQ ID NO: 2244470 - RNA, 15 nt, Human
ucaauauuuuccaug

SEQ ID NO: 2244471 - RNA, 16 nt, Human
ucaauauuuuccauga

SEQ ID NO: 2244472 - RNA, 17 nt, Human
ucaauauuuuccaugaa

SEQ ID NO: 2244473 - RNA, 18 nt, Human
ucaauauuuuccaugaaa

SEQ ID NO: 2244474 - RNA, 16 nt, Human
ucaauauuuuuagaua

SEQ ID NO: 2244475 - RNA, 22 nt, Human
ucaauaggaaaaacugauuuuu

SEQ ID NO: 2244476 - RNA, 23 nt, Human
ucaauauuucagauaaucacaau

SEQ ID NO: 2244477 - RNA, 20 nt, Human
ucaauccccucauucaggaa

SEQ ID NO: 2244478 - RNA, 17 nt, Human
ucaauccccucauucag

SEQ ID NO: 2244479 - RNA, 15 nt, Human
ucaauccccucauuc

SEQ ID NO: 2244480 - RNA, 15 nt, Human
ucaauccagcuaugu

SEQ ID NO: 2244481 - RNA, 18 nt, Human
ucaaucauuguacaguuu

SEQ ID NO: 2244482 - RNA, 19 nt, Human
ucaaucaucugugugaaaa

SEQ ID NO: 2244483 - RNA, 14 nt, Human
ucaaucauuguaca

SEQ ID NO: 2244484 - RNA, 15 nt, Human
ucaaucauuguacag

SEQ ID NO: 2244485 - RNA, 16 nt, Human
ucaaucauuguacagu

SEQ ID NO: 2244486 - RNA, 16 nt, Human
ucaaucaucuguguga

SEQ ID NO: 2244487 - RNA, 20 nt, Human
ucaaucaucugugugaaaau

SEQ ID NO: 2244488 - RNA, 15 nt, Human
ucaaucaucugugug

SEQ ID NO: 2244489 - RNA, 22 nt, Human
ucaaucaguauaauucuguacu

SEQ ID NO: 2244490 - RNA, 12 nt, Human
ucaaucacagcu

SEQ ID NO: 2244491 - RNA, 20 nt, Human
ucaaucacagcuuguauuuu

SEQ ID NO: 2244492 - RNA, 14 nt, Human
ucaaucaguauaau

SEQ ID NO: 2244493 - RNA, 15 nt, Human
ucaaucaguauaauu

SEQ ID NO: 2244494 - RNA, 16 nt, Human
ucaaucaguauaauuc

SEQ ID NO: 2244495 - RNA, 21 nt, Human
ucaaucaguauaauucuguac

SEQ ID NO: 2244496 - RNA, 19 nt, Human
ucaaguaauccaccugccu

SEQ ID NO: 2244497 - RNA, 16 nt, Human
ucaaguaagaagacau

SEQ ID NO: 2244498 - RNA, 16 nt, Human
ucaaguaauugugaaa

SEQ ID NO: 2244499 - RNA, 15 nt, Human
ucaaguaauugugaa

SEQ ID NO: 2244500 - RNA, 23 nt, Human
ucaaguaagaagacaugaaccaa

SEQ ID NO: 2244501 - RNA, 17 nt, Human
ucaaguaauucugcugu

SEQ ID NO: 2244502 - RNA, 22 nt, Human
ucaaguaagaagacaugaacca

SEQ ID NO: 2244503 - RNA, 18 nt, Human
ucaaguaagaagacauga

SEQ ID NO: 2244504 - RNA, 16 nt, Human
ucaagugauucuccug

SEQ ID NO: 2244505 - RNA, 22 nt, Human
ucaagugauucucaugccucag

SEQ ID NO: 2244506 - RNA, 21 nt, Human
ucaagugauucucaugccuca

SEQ ID NO: 2244507 - RNA, 17 nt, Human
ucaagugauucuccugc

SEQ ID NO: 2244508 - RNA, 17 nt, Human
ucaauaggaaaaacuga

SEQ ID NO: 2244509 - RNA, 18 nt, Human
ucaauaggaaaaacugau

SEQ ID NO: 2244510 - RNA, 19 nt, Human
ucaauaggaaaaacugauu

SEQ ID NO: 2244511 - RNA, 17 nt, Human
ucaagagggucugagga

SEQ ID NO: 2244512 - RNA, 20 nt, Human
ucaagagggcacugguggcc

SEQ ID NO: 2244513 - RNA, 21 nt, Human
ucaagagggcacugguggccc

SEQ ID NO: 2244514 - RNA, 22 nt, Human
acauuaucgggagcagugucuu

SEQ ID NO: 2244515 - RNA, 19 nt, Human
acauuaucucacuugugcc

SEQ ID NO: 2244516 - RNA, 21 nt, Human
acauuaucgggagcagugucu

SEQ ID NO: 2244517 - RNA, 19 nt, Human
acauuaucgggagcagugu

SEQ ID NO: 2244518 - RNA, 18 nt, Human
acauuaucgggagcagug

SEQ ID NO: 2244519 - RNA, 13 nt, Human
acauuauuugcau

SEQ ID NO: 2244520 - RNA, 16 nt, Human
acauuauuuauucagc

SEQ ID NO: 2244521 - RNA, 18 nt, Human
acauuauuaucaacaaua

SEQ ID NO: 2244522 - RNA, 14 nt, Human
acauuauuugcaug

SEQ ID NO: 2244523 - RNA, 12 nt, Human
ucaagaggcuga

SEQ ID NO: 2244524 - RNA, 17 nt, Human
ucaagcaagauuucaga

SEQ ID NO: 2244525 - RNA, 16 nt, Human
ucaagcagauuggaga

SEQ ID NO: 2244526 - RNA, 16 nt, Human
ucaagauuuugaaugc

SEQ ID NO: 2244527 - RNA, 13 nt, Human
ucaagauuuugaa

SEQ ID NO: 2244528 - RNA, 17 nt, Human
ucaagauuucaggauua

SEQ ID NO: 2244529 - RNA, 19 nt, Human
ucaagauuuugaaugcuuc

SEQ ID NO: 2244530 - RNA, 18 nt, Human
ucaagauuuugaaugcuu

SEQ ID NO: 2244531 - RNA, 21 nt, Human
ucaagcaaacagcuucacaaa

SEQ ID NO: 2244532 - RNA, 17 nt, Human
ucaagcagauuggagaa

SEQ ID NO: 2244533 - RNA, 12 nt, Human
ucaagcagccaa

SEQ ID NO: 2244534 - RNA, 18 nt, Human
ucaagcagcgaccgcccc

SEQ ID NO: 2244535 - RNA, 21 nt, Human
ucaagcagcgaccgcccccuc

SEQ ID NO: 2244536 - RNA, 22 nt, Human
ucaagcagcgaccgcccccucc

SEQ ID NO: 2244537 - RNA, 23 nt, Human
ucaaggauccugagccagauuuc

SEQ ID NO: 2244538 - RNA, 19 nt, Human
ucaaggccucccacaguga

SEQ ID NO: 2244539 - RNA, 17 nt, Human
ucaaggccucccacagu

SEQ ID NO: 2244540 - RNA, 18 nt, Human
ucaaggccucccacagug

SEQ ID NO: 2244541 - RNA, 14 nt, Human
ucaaggccucccac

SEQ ID NO: 2244542 - RNA, 17 nt, Human
ucaaggcaucaugcaga

SEQ ID NO: 2244543 - RNA, 15 nt, Human
ucaaggccucccaca

SEQ ID NO: 2244544 - RNA, 16 nt, Human
ucaaggccucccacag

SEQ ID NO: 2244545 - RNA, 13 nt, Human
ucaaggcacugcc

SEQ ID NO: 2244546 - RNA, 14 nt, Human
ucaaggcacugccu

SEQ ID NO: 2244547 - RNA, 15 nt, Human
ucaaggcacugccug

SEQ ID NO: 2244548 - RNA, 16 nt, Human
ucaaggcacugccuga

SEQ ID NO: 2244549 - RNA, 20 nt, Human
ucaagguggccaaauuauuu

SEQ ID NO: 2244550 - RNA, 18 nt, Human
ucaaggcgugaggauggg

SEQ ID NO: 2244551 - RNA, 19 nt, Human
accaaaaacugaaagugaa

SEQ ID NO: 2244552 - RNA, 17 nt, Human
accaaaaagaccagacu

SEQ ID NO: 2244553 - RNA, 16 nt, Human
accaaauaaaaauauu

SEQ ID NO: 2244554 - RNA, 18 nt, Human
accaaauaaaaauauugu

SEQ ID NO: 2244555 - RNA, 19 nt, Human
accaaaucagcugcuacua

SEQ ID NO: 2244556 - RNA, 16 nt, Human
accaaaucagcugcua

SEQ ID NO: 2244557 - RNA, 11 nt, Human
accaaaugcuu

SEQ ID NO: 2244558 - RNA, 15 nt, Human
accaaaucuggaagc

SEQ ID NO: 2244559 - RNA, 13 nt, Human
accaaaugcuuua

SEQ ID NO: 2244560 - RNA, 19 nt, Human
accaaaugcuuuaaaaacu

SEQ ID NO: 2244561 - RNA, 22 nt, Human
accaaaugcuuuaaaaacuauu

SEQ ID NO: 2244562 - RNA, 13 nt, Human
accaaaucuggaa

SEQ ID NO: 2244563 - RNA, 16 nt, Human
accaacaguuccuuca

SEQ ID NO: 2244564 - RNA, 21 nt, Human
accaacaucccauugcccugg

SEQ ID NO: 2244565 - RNA, 16 nt, Human
accaacauacucccau

SEQ ID NO: 2244566 - RNA, 24 nt, Human
accaacauggagaaacccugucuc

SEQ ID NO: 2244567 - RNA, 12 nt, Human
accaacccagcc

SEQ ID NO: 2244568 - RNA, 23 nt, Human
accaacauggagaaacccugucu

SEQ ID NO: 2244569 - RNA, 16 nt, Human
accaacauggagaaac

SEQ ID NO: 2244570 - RNA, 15 nt, Human
accaacauggagaaa

SEQ ID NO: 2244571 - RNA, 22 nt, Human
accaacaucccauugcccuggu

SEQ ID NO: 2244572 - RNA, 20 nt, Human
accaaccacugcgaccacaa

SEQ ID NO: 2244573 - RNA, 14 nt, Human
accaaauuccuugg

SEQ ID NO: 2244574 - RNA, 19 nt, Human
accaacacgagcaggcuac

SEQ ID NO: 2244575 - RNA, 14 nt, Human
accaacacgagcag

SEQ ID NO: 2244576 - RNA, 21 nt, Human
accaaugccaaaaaaagacag

SEQ ID NO: 2244577 - RNA, 18 nt, Human
accaaugcaugcagccac

SEQ ID NO: 2244578 - RNA, 20 nt, Human
accaaugcaugcagccacug

SEQ ID NO: 2244579 - RNA, 22 nt, Human
accaaugcaugcagccacugug

SEQ ID NO: 2244580 - RNA, 18 nt, Human
accaaugcuuuuaucaaa

SEQ ID NO: 2244581 - RNA, 12 nt, Human
accaaugucuug

SEQ ID NO: 2244582 - RNA, 19 nt, Human
accaaugcuuuuaucaaac

SEQ ID NO: 2244583 - RNA, 13 nt, Human
accaaugucuuga

SEQ ID NO: 2244584 - RNA, 16 nt, Human
accacaagacugcaca

SEQ ID NO: 2244585 - RNA, 20 nt, Human
accacaaagcacaguuugaa

SEQ ID NO: 2244586 - RNA, 18 nt, Human
accacaaauagugcucgc

SEQ ID NO: 2244587 - RNA, 22 nt, Human
accaacccaucagaaggagaag

SEQ ID NO: 2244588 - RNA, 19 nt, Human
accaacccagccgcugccc

SEQ ID NO: 2244589 - RNA, 20 nt, Human
accaacccagccgcugcccg

SEQ ID NO: 2244590 - RNA, 20 nt, Human
accaaucauuuuaauuauua

SEQ ID NO: 2244591 - RNA, 15 nt, Human
accaacccucagagc

SEQ ID NO: 2244592 - RNA, 13 nt, Human
accaacccagccg

SEQ ID NO: 2244593 - RNA, 14 nt, Human
accaacccagccgc

SEQ ID NO: 2244594 - RNA, 15 nt, Human
accaacccagccgcu

SEQ ID NO: 2244595 - RNA, 16 nt, Human
accaacccagccgcug

SEQ ID NO: 2244596 - RNA, 13 nt, Human
accaauccuggac

SEQ ID NO: 2244597 - RNA, 14 nt, Human
accaaugaaaaaau

SEQ ID NO: 2244598 - RNA, 17 nt, Human
accaaugaaaaaaugua

SEQ ID NO: 2244599 - RNA, 12 nt, Human
accaaugcaugc

SEQ ID NO: 2244600 - RNA, 17 nt, Human
accaaugcaugcagcca

SEQ ID NO: 2244601 - RNA, 17 nt, Human
accacacagaggcugcc

SEQ ID NO: 2244602 - RNA, 21 nt, Human
accacaaggcuguugcauggg

SEQ ID NO: 2244603 - RNA, 15 nt, Human
accacacccagccca

SEQ ID NO: 2244604 - RNA, 15 nt, Human
accacaccaaaccuc

SEQ ID NO: 2244605 - RNA, 17 nt, Human
accacaccaaaccucuc

SEQ ID NO: 2244606 - RNA, 16 nt, Human
accacacccagcccac

SEQ ID NO: 2244607 - RNA, 20 nt, Human
accacacccagcccacuucu

SEQ ID NO: 2244608 - RNA, 21 nt, Human
accacacccagcccacuucug

SEQ ID NO: 2244609 - RNA, 23 nt, Human
accacacccagcccacuucugcc

SEQ ID NO: 2244610 - RNA, 21 nt, Human
ucacauggugcuacgccugca

SEQ ID NO: 2244611 - RNA, 16 nt, Human
ucacauggccuaugca

SEQ ID NO: 2244612 - RNA, 21 nt, Human
ucacauggccuaugcacauau

SEQ ID NO: 2244613 - RNA, 23 nt, Human
ucacauguauguuuugguaucug

SEQ ID NO: 2244614 - RNA, 21 nt, Human
ucacaugucaguaccuucaaa

SEQ ID NO: 2244615 - RNA, 13 nt, Human
ucacauguauguu

SEQ ID NO: 2244616 - RNA, 15 nt, Human
ucacauguauguuuu

SEQ ID NO: 2244617 - RNA, 16 nt, Human
ucacauguauguuuug

SEQ ID NO: 2244618 - RNA, 20 nt, Human
ucacauuaauauuugcugac

SEQ ID NO: 2244619 - RNA, 19 nt, Human
ucacauuacuguauauacu

SEQ ID NO: 2244620 - RNA, 19 nt, Human
ucacauuaauauuugcuga

SEQ ID NO: 2244621 - RNA, 16 nt, Human
ucacauuauuugcaug

SEQ ID NO: 2244622 - RNA, 13 nt, Human
ucacauucaggaa

SEQ ID NO: 2244623 - RNA, 15 nt, Human
ucacauuauuugcau

SEQ ID NO: 2244624 - RNA, 17 nt, Human
ucaccagccccagugcc

SEQ ID NO: 2244625 - RNA, 15 nt, Human
ucacagcuucagcca

SEQ ID NO: 2244626 - RNA, 16 nt, Human
ucacagcuucagccag

SEQ ID NO: 2244627 - RNA, 11 nt, Human
ucacagcuccu

SEQ ID NO: 2244628 - RNA, 14 nt, Human
ucacagcuccuccc

SEQ ID NO: 2244629 - RNA, 16 nt, Human
ucacagcuccucccac

SEQ ID NO: 2244630 - RNA, 13 nt, Human
ucacagccuccuc

SEQ ID NO: 2244631 - RNA, 11 nt, Human
ucacagcugcu

SEQ ID NO: 2244632 - RNA, 17 nt, Human
ucacagcuucagccagg

SEQ ID NO: 2244633 - RNA, 19 nt, Human
ucacagcuucagccaggag

SEQ ID NO: 2244634 - RNA, 16 nt, Human
ucacauauugauuucc

SEQ ID NO: 2244635 - RNA, 13 nt, Human
ucacaucacagga

SEQ ID NO: 2244636 - RNA, 13 nt, Human
ucacagcugcuuu

SEQ ID NO: 2244637 - RNA, 17 nt, Human
ucacagcuuguauuuug

SEQ ID NO: 2244638 - RNA, 20 nt, Human
ucacauauugauuuccguua

SEQ ID NO: 2244639 - RNA, 18 nt, Human
ucacauauugauuuccgu

SEQ ID NO: 2244640 - RNA, 16 nt, Human
ucacagccacuuggga

SEQ ID NO: 2244641 - RNA, 23 nt, Human
ucacagcccugcuuaccagauaa

SEQ ID NO: 2244642 - RNA, 20 nt, Human
ucacagccucaagucacucc

SEQ ID NO: 2244643 - RNA, 23 nt, Human
ucacagccagacuggcacaguuu

SEQ ID NO: 2244644 - RNA, 17 nt, Human
ucacagccagacuggca

SEQ ID NO: 2244645 - RNA, 17 nt, Human
ucacagaggcuucuuca

SEQ ID NO: 2244646 - RNA, 12 nt, Human
ucacagaggcuu

SEQ ID NO: 2244647 - RNA, 23 nt, Human
ucacagaccuggagccccugggu

SEQ ID NO: 2244648 - RNA, 22 nt, Human
ucacagagacauuccuccgagc

SEQ ID NO: 2244649 - RNA, 14 nt, Human
ucacagaugggugc

SEQ ID NO: 2244650 - RNA, 15 nt, Human
ucacagaugggugcu

SEQ ID NO: 2244651 - RNA, 16 nt, Human
ucacagccaccccuga

SEQ ID NO: 2244652 - RNA, 19 nt, Human
ucacagagugugcuggagg

SEQ ID NO: 2244653 - RNA, 23 nt, Human
ucacagagacauuccuccgagcc

SEQ ID NO: 2244654 - RNA, 14 nt, Human
ucacagagugugcu

SEQ ID NO: 2244655 - RNA, 15 nt, Human
ucacagagugugcug

SEQ ID NO: 2244656 - RNA, 18 nt, Human
ucacagagugugcuggag

SEQ ID NO: 2244657 - RNA, 21 nt, Human
ucacagaacccuuggagccaa

SEQ ID NO: 2244658 - RNA, 14 nt, Human
ucaauuuaaaccca

SEQ ID NO: 2244659 - RNA, 19 nt, Human
ucaauuuaaacccauuuua

SEQ ID NO: 2244660 - RNA, 21 nt, Human
ucaauuuaaacccauuuuagu

SEQ ID NO: 2244661 - RNA, 23 nt, Human
ucaauuuaaacccauuuuaguca

SEQ ID NO: 2244662 - RNA, 13 nt, Human
ucaauuuaaaaaa

SEQ ID NO: 2244663 - RNA, 13 nt, Human
accacacccagcc

SEQ ID NO: 2244664 - RNA, 12 nt, Human
accacacccagc

SEQ ID NO: 2244665 - RNA, 14 nt, Human
accacacccagccu

SEQ ID NO: 2244666 - RNA, 12 nt, Human
ucaauuuaaaaa

SEQ ID NO: 2244667 - RNA, 21 nt, Human
ucacagagacauuccuccgag

SEQ ID NO: 2244668 - RNA, 20 nt, Human
ucacagaccuggagccccug

SEQ ID NO: 2244669 - RNA, 22 nt, Human
ucacagaccuggagccccuggg

SEQ ID NO: 2244670 - RNA, 15 nt, Human
ucacagaccuggagc

SEQ ID NO: 2244671 - RNA, 17 nt, Human
ucacagaccuggagccc

SEQ ID NO: 2244672 - RNA, 18 nt, Human
ucacagaccuggagcccc

SEQ ID NO: 2244673 - RNA, 19 nt, Human
ucacagaccuggagccccu

SEQ ID NO: 2244674 - RNA, 16 nt, Human
ucacagaccuuugaac

SEQ ID NO: 2244675 - RNA, 12 nt, Human
ucacagaagaau

SEQ ID NO: 2244676 - RNA, 11 nt, Human
ucacagaagaa

SEQ ID NO: 2244677 - RNA, 15 nt, Human
ucaauuuaaauaacc

SEQ ID NO: 2244678 - RNA, 14 nt, Human
ucacagaccuggag

SEQ ID NO: 2244679 - RNA, 22 nt, Human
ucacagaaucauaugauucugc

SEQ ID NO: 2244680 - RNA, 19 nt, Human
accuucaguuaugauuuuu

SEQ ID NO: 2244681 - RNA, 18 nt, Human
accuucauuucaggaggg

SEQ ID NO: 2244682 - RNA, 15 nt, Human
accuuccaagagccu

SEQ ID NO: 2244683 - RNA, 21 nt, Human
accuucauuucaggagggauu

SEQ ID NO: 2244684 - RNA, 19 nt, Human
accuggguaaaugcagcgu

SEQ ID NO: 2244685 - RNA, 18 nt, Human
accuucaauuccugggcc

SEQ ID NO: 2244686 - RNA, 17 nt, Human
accuucagacuuugcuu

SEQ ID NO: 2244687 - RNA, 17 nt, Human
accuucaauuccugggc

SEQ ID NO: 2244688 - RNA, 21 nt, Human
accuggggugugggaggcccg

SEQ ID NO: 2244689 - RNA, 18 nt, Human
accuggggugugggaggc

SEQ ID NO: 2244690 - RNA, 22 nt, Human
accuggggggcaguggugugga

SEQ ID NO: 2244691 - RNA, 21 nt, Human
accuggguaacuagggaagau

SEQ ID NO: 2244692 - RNA, 24 nt, Human
accuggggagugggacagagucug

SEQ ID NO: 2244693 - RNA, 14 nt, Human
accuggggagccag

SEQ ID NO: 2244694 - RNA, 19 nt, Human
accuggggcagucaccugc

SEQ ID NO: 2244695 - RNA, 14 nt, Human
accuggggcugcug

SEQ ID NO: 2244696 - RNA, 15 nt, Human
accuggggaguggga

SEQ ID NO: 2244697 - RNA, 13 nt, Human
accuggggagugg

SEQ ID NO: 2244698 - RNA, 20 nt, Human
accuggggcugcuggccuga

SEQ ID NO: 2244699 - RNA, 15 nt, Human
accuggggcugcugg

SEQ ID NO: 2244700 - RNA, 18 nt, Human
accuggggcugcuggccu

SEQ ID NO: 2244701 - RNA, 19 nt, Human
accuucccagcucucccuc

SEQ ID NO: 2244702 - RNA, 18 nt, Human
accuucccagcucucccu

SEQ ID NO: 2244703 - RNA, 17 nt, Human
accuucccagcucuccc

SEQ ID NO: 2244704 - RNA, 13 nt, Human
accuucccagcuc

SEQ ID NO: 2244705 - RNA, 16 nt, Human
accuuccaagagccug

SEQ ID NO: 2244706 - RNA, 17 nt, Human
accuucccaugcccugg

SEQ ID NO: 2244707 - RNA, 19 nt, Human
accuucccucucaccaucc

SEQ ID NO: 2244708 - RNA, 12 nt, Human
accuuccucacu

SEQ ID NO: 2244709 - RNA, 19 nt, Human
accuuccuucccugggcug

SEQ ID NO: 2244710 - RNA, 22 nt, Human
accuuccuucccugggcugugc

SEQ ID NO: 2244711 - RNA, 18 nt, Human
accuuccugccaccaguc

SEQ ID NO: 2244712 - RNA, 24 nt, Human
accuuccuucccugggcugugcua

SEQ ID NO: 2244713 - RNA, 13 nt, Human
accuuccucgcag

SEQ ID NO: 2244714 - RNA, 15 nt, Human
accuuccucgcagag

SEQ ID NO: 2244715 - RNA, 16 nt, Human
accuuccucacuucca

SEQ ID NO: 2244716 - RNA, 17 nt, Human
accuuccucacuuccau

SEQ ID NO: 2244717 - RNA, 17 nt, Human
accuuccucgcagagag

SEQ ID NO: 2244718 - RNA, 16 nt, Human
accuuccucgcagaga

SEQ ID NO: 2244719 - RNA, 11 nt, Human
accuuccugcc

SEQ ID NO: 2244720 - RNA, 17 nt, Human
accuucgccaccugggu

SEQ ID NO: 2244721 - RNA, 15 nt, Human
accuucgccaccugg

SEQ ID NO: 2244722 - RNA, 15 nt, Human
accuucgggcugugc

SEQ ID NO: 2244723 - RNA, 14 nt, Human
accuucgggcugug

SEQ ID NO: 2244724 - RNA, 17 nt, Human
accuucgggcugugccc

SEQ ID NO: 2244725 - RNA, 16 nt, Human
accuucgggcugugcc

SEQ ID NO: 2244726 - RNA, 18 nt, Human
accuucgggcugugcccg

SEQ ID NO: 2244727 - RNA, 21 nt, Human
accuucguuuacuaugccugu

SEQ ID NO: 2244728 - RNA, 18 nt, Human
accuucuggccucccaca

SEQ ID NO: 2244729 - RNA, 22 nt, Human
accuucuggccucccacagacu

SEQ ID NO: 2244730 - RNA, 19 nt, Human
accuucuggcuuccuucuc

SEQ ID NO: 2244731 - RNA, 12 nt, Human
accuucucugga

SEQ ID NO: 2244732 - RNA, 22 nt, Human
accuucuaggacgccacccagc

SEQ ID NO: 2244733 - RNA, 15 nt, Human
accuucucuggagcc

SEQ ID NO: 2244734 - RNA, 17 nt, Human
accuucucuggagccaa

SEQ ID NO: 2244735 - RNA, 22 nt, Human
accuucucuggagccaagucca

SEQ ID NO: 2244736 - RNA, 23 nt, Human
accuucucuggagccaaguccag

SEQ ID NO: 2244737 - RNA, 14 nt, Human
accuucuccuucac

SEQ ID NO: 2244738 - RNA, 23 nt, Human
accuucguuuacuaugccugugu

SEQ ID NO: 2244739 - RNA, 22 nt, Human
accuucguuuacuaugccugug

SEQ ID NO: 2244740 - RNA, 22 nt, Human
accuucuccuucaccuuugucc

SEQ ID NO: 2244741 - RNA, 22 nt, Human
accuugaggucuuuugacaugu

SEQ ID NO: 2244742 - RNA, 16 nt, Human
accuugcaacacacag

SEQ ID NO: 2244743 - RNA, 15 nt, Human
accuugcaacacaca

SEQ ID NO: 2244744 - RNA, 11 nt, Human
accuugagguc

SEQ ID NO: 2244745 - RNA, 19 nt, Human
accuugaggagucuugugu

SEQ ID NO: 2244746 - RNA, 15 nt, Human
accuugagacagcuu

SEQ ID NO: 2244747 - RNA, 22 nt, Human
accuugaggaggggcagguaaa

SEQ ID NO: 2244748 - RNA, 11 nt, Human
accuucuguag

SEQ ID NO: 2244749 - RNA, 16 nt, Human
accuugacagggcaca

SEQ ID NO: 2244750 - RNA, 19 nt, Human
accuugcaacacacagaca

SEQ ID NO: 2244751 - RNA, 17 nt, Human
accuugcaacacacaga

SEQ ID NO: 2244752 - RNA, 15 nt, Human
accuugcaacuucau

SEQ ID NO: 2244753 - RNA, 19 nt, Human
accuugcaucucauugcuc

SEQ ID NO: 2244754 - RNA, 13 nt, Human
accuuugucccca

SEQ ID NO: 2244755 - RNA, 23 nt, Human
accuugccugaacauccuuccuu

SEQ ID NO: 2244756 - RNA, 24 nt, Human
accuugccugaacauccuuccuuc

SEQ ID NO: 2244757 - RNA, 18 nt, Human
accuugccugaacauccu

SEQ ID NO: 2244758 - RNA, 21 nt, Human
accuugccugaacauccuucc

SEQ ID NO: 2244759 - RNA, 18 nt, Human
accuuuuuuauacauaaa

SEQ ID NO: 2244760 - RNA, 17 nt, Human
accuuuuuuauacauaa

SEQ ID NO: 2244761 - RNA, 16 nt, Human
accuuuuuuauacaua

SEQ ID NO: 2244762 - RNA, 14 nt, Human
accuuuguccccac

SEQ ID NO: 2244763 - RNA, 15 nt, Human
accuuuguccccacc

SEQ ID NO: 2244764 - RNA, 16 nt, Human
accuuuguccccaccg

SEQ ID NO: 2244765 - RNA, 14 nt, Human
accuuuuuuauaca

SEQ ID NO: 2244766 - RNA, 13 nt, Human
accugggaagggg

SEQ ID NO: 2244767 - RNA, 22 nt, Human
accugggaggcggauguugaag

SEQ ID NO: 2244768 - RNA, 20 nt, Human
accuggcuuuucuuucuacc

SEQ ID NO: 2244769 - RNA, 16 nt, Human
accuggcugccauacu

SEQ ID NO: 2244770 - RNA, 13 nt, Human
accugggcaccug

SEQ ID NO: 2244771 - RNA, 18 nt, Human
accugggauucaggaaug

SEQ ID NO: 2244772 - RNA, 19 nt, Human
accugggcaccuggggagu

SEQ ID NO: 2244773 - RNA, 18 nt, Human
accugggcaccuggggag

SEQ ID NO: 2244774 - RNA, 14 nt, Human
accugggcaccugg

SEQ ID NO: 2244775 - RNA, 21 nt, Human
accugggcauacuaauaaagu

SEQ ID NO: 2244776 - RNA, 15 nt, Human
accugggcauaucca

SEQ ID NO: 2244777 - RNA, 21 nt, Human
accuggccccaugucucucag

SEQ ID NO: 2244778 - RNA, 21 nt, Human
accuggccaccugaggugggc

SEQ ID NO: 2244779 - RNA, 23 nt, Human
accuggccccaugucucucagaa

SEQ ID NO: 2244780 - RNA, 12 nt, Human
accuggccucug

SEQ ID NO: 2244781 - RNA, 13 nt, Human
accuggccucugc

SEQ ID NO: 2244782 - RNA, 12 nt, Human
uccacccaccuc

SEQ ID NO: 2244783 - RNA, 18 nt, Human
uccaccaucaagccacca

SEQ ID NO: 2244784 - RNA, 13 nt, Human
uccacccaccuca

SEQ ID NO: 2244785 - RNA, 17 nt, Human
uccacccaggagccccg

SEQ ID NO: 2244786 - RNA, 20 nt, Human
accuggccaccugagguggg

SEQ ID NO: 2244787 - RNA, 22 nt, Human
uccaccccaucccuccccaguu

SEQ ID NO: 2244788 - RNA, 12 nt, Human
uccaccccaucc

SEQ ID NO: 2244789 - RNA, 20 nt, Human
uccaccccaucccuccccag

SEQ ID NO: 2244790 - RNA, 23 nt, Human
uccaccccagugcacccacucug

SEQ ID NO: 2244791 - RNA, 20 nt, Human
uccaccccagugcacccacu

SEQ ID NO: 2244792 - RNA, 22 nt, Human
uccacccauccuaccaaugcau

SEQ ID NO: 2244793 - RNA, 21 nt, Human
uccaccaugggguccuaccaa

SEQ ID NO: 2244794 - RNA, 16 nt, Human
uccacauuguuuuaaa

SEQ ID NO: 2244795 - RNA, 17 nt, Human
uccacauuguuuuaaaa

SEQ ID NO: 2244796 - RNA, 23 nt, Human
uccaccaugggguccuaccaaua

SEQ ID NO: 2244797 - RNA, 20 nt, Human
uccacccaggagccccgagg

SEQ ID NO: 2244798 - RNA, 23 nt, Human
uccaaggagaaacagagacaggc

SEQ ID NO: 2244799 - RNA, 12 nt, Human
uccaaggaguuc

SEQ ID NO: 2244800 - RNA, 21 nt, Human
uccaaggaguuccaugaagac

SEQ ID NO: 2244801 - RNA, 16 nt, Human
uccaaggcagaagcag

SEQ ID NO: 2244802 - RNA, 20 nt, Human
uccaaggaggggcuguaaaa

SEQ ID NO: 2244803 - RNA, 23 nt, Human
uccaaggcagaagcagcagggga

SEQ ID NO: 2244804 - RNA, 16 nt, Human
uccaagggcuucugca

SEQ ID NO: 2244805 - RNA, 19 nt, Human
uccaagggcuucugcaccc

SEQ ID NO: 2244806 - RNA, 21 nt, Human
uccaaggggaaucagaacuca

SEQ ID NO: 2244807 - RNA, 21 nt, Human
uccaagggcuucugcacccuc

SEQ ID NO: 2244808 - RNA, 22 nt, Human
uccaagggcuucugcacccucc

SEQ ID NO: 2244809 - RNA, 22 nt, Human
uccaaggagaaacagagacagg

SEQ ID NO: 2244810 - RNA, 20 nt, Human
uccaaggagaaacagagaca

SEQ ID NO: 2244811 - RNA, 19 nt, Human
uccaaggagaaacagagac

SEQ ID NO: 2244812 - RNA, 16 nt, Human
uccaaggagaaacaga

SEQ ID NO: 2244813 - RNA, 15 nt, Human
uccaaggagaaacag

SEQ ID NO: 2244814 - RNA, 18 nt, Human
uccaacaaaggguuuuaa

SEQ ID NO: 2244815 - RNA, 22 nt, Human
uccaacaaaggguuuuaaugua

SEQ ID NO: 2244816 - RNA, 23 nt, Human
uccaaggaaaccacagcugcugg

SEQ ID NO: 2244817 - RNA, 22 nt, Human
uccaaauguccuccagaagccu

SEQ ID NO: 2244818 - RNA, 20 nt, Human
uccaaauguccuccagaagc

SEQ ID NO: 2244819 - RNA, 19 nt, Human
uccaaauguccuccagaag

SEQ ID NO: 2244820 - RNA, 17 nt, Human
uccaaauguccuccaga

SEQ ID NO: 2244821 - RNA, 13 nt, Human
uccaaauucacaa

SEQ ID NO: 2244822 - RNA, 19 nt, Human
uccaaaugcagcuuuaaaa

SEQ ID NO: 2244823 - RNA, 20 nt, Human
uccaaaaagauuuucagaaa

SEQ ID NO: 2244824 - RNA, 20 nt, Human
uccaaauggcgucuggaagu

SEQ ID NO: 2244825 - RNA, 18 nt, Human
uccaaauggcgucuggaa

SEQ ID NO: 2244826 - RNA, 13 nt, Human
uccaaaaaaauac

SEQ ID NO: 2244827 - RNA, 14 nt, Human
uccaaaaaaauacu

SEQ ID NO: 2244828 - RNA, 15 nt, Human
uccaaaaaaauacug

SEQ ID NO: 2244829 - RNA, 22 nt, Human
uccacauccuuucuaaacaaga

SEQ ID NO: 2244830 - RNA, 19 nt, Human
uccacauccuccacguucu

SEQ ID NO: 2244831 - RNA, 19 nt, Human
uccacaucuacguuuuugg

SEQ ID NO: 2244832 - RNA, 21 nt, Human
uccacaucuacguuuuuggug

SEQ ID NO: 2244833 - RNA, 12 nt, Human
uccacaucugcc

SEQ ID NO: 2244834 - RNA, 13 nt, Human
uccacaucugccu

SEQ ID NO: 2244835 - RNA, 15 nt, Human
uccacaugggagccg

SEQ ID NO: 2244836 - RNA, 14 nt, Human
uccacauuguuuua

SEQ ID NO: 2244837 - RNA, 15 nt, Human
uccacauuguuuuaa

SEQ ID NO: 2244838 - RNA, 14 nt, Human
uccacaucugccuu

SEQ ID NO: 2244839 - RNA, 15 nt, Human
uccacaucugccuua

SEQ ID NO: 2244840 - RNA, 18 nt, Human
uccacaucugccuuaaaa

SEQ ID NO: 2244841 - RNA, 13 nt, Human
uccacauccucca

SEQ ID NO: 2244842 - RNA, 12 nt, Human
uccacauccucc

SEQ ID NO: 2244843 - RNA, 14 nt, Human
uccacaucccggga

SEQ ID NO: 2244844 - RNA, 19 nt, Human
uccaauuccuugcacauag

SEQ ID NO: 2244845 - RNA, 22 nt, Human
uccacauaaggaaacuggguuc

SEQ ID NO: 2244846 - RNA, 21 nt, Human
uccaaugucuuuuuaagcuua

SEQ ID NO: 2244847 - RNA, 18 nt, Human
uccaauguggcaaggaaa

SEQ ID NO: 2244848 - RNA, 15 nt, Human
uccaauuaaggauuu

SEQ ID NO: 2244849 - RNA, 19 nt, Human
uccaauguuuagcaaauac

SEQ ID NO: 2244850 - RNA, 17 nt, Human
uccaauguuuagcaaau

SEQ ID NO: 2244851 - RNA, 17 nt, Human
uccaauuaaggauuuua

SEQ ID NO: 2244852 - RNA, 16 nt, Human
uccaauuaaggauuuu

SEQ ID NO: 2244853 - RNA, 23 nt, Human
uccaagggcuucugcacccucca

SEQ ID NO: 2244854 - RNA, 20 nt, Human
accugcuuggguggagaagc

SEQ ID NO: 2244855 - RNA, 19 nt, Human
accuggaauuguggggcaa

SEQ ID NO: 2244856 - RNA, 18 nt, Human
accugcuuggguggagaa

SEQ ID NO: 2244857 - RNA, 21 nt, Human
accugcuuggguggagaagcc

SEQ ID NO: 2244858 - RNA, 21 nt, Human
accugcuucaugcucagcccu

SEQ ID NO: 2244859 - RNA, 23 nt, Human
accugcuucaugcucagcccuga

SEQ ID NO: 2244860 - RNA, 19 nt, Human
accugcuucaugcucagcc

SEQ ID NO: 2244861 - RNA, 20 nt, Human
accuggaauauauaaccagu

SEQ ID NO: 2244862 - RNA, 21 nt, Human
accugcuggccccucaccugg

SEQ ID NO: 2244863 - RNA, 17 nt, Human
accugcuggguaaacug

SEQ ID NO: 2244864 - RNA, 19 nt, Human
accugcuggccccucaccu

SEQ ID NO: 2244865 - RNA, 17 nt, Human
accugcuggccccucac

SEQ ID NO: 2244866 - RNA, 16 nt, Human
accugcuggccccuca

SEQ ID NO: 2244867 - RNA, 15 nt, Human
accugcuggccccuc

SEQ ID NO: 2244868 - RNA, 14 nt, Human
accugcuggccccu

SEQ ID NO: 2244869 - RNA, 23 nt, Human
accugcugagggaccagccaaga

SEQ ID NO: 2244870 - RNA, 20 nt, Human
accugcugagggaccagcca

SEQ ID NO: 2244871 - RNA, 19 nt, Human
accugcugagggaccagcc

SEQ ID NO: 2244872 - RNA, 13 nt, Human
accugcuggcccc

SEQ ID NO: 2244873 - RNA, 18 nt, Human
accugcugagggaccagc

SEQ ID NO: 2244874 - RNA, 12 nt, Human
accugcucuccu

SEQ ID NO: 2244875 - RNA, 21 nt, Human
accugcgucucauacucaccu

SEQ ID NO: 2244876 - RNA, 16 nt, Human
accugcggugcuaucu

SEQ ID NO: 2244877 - RNA, 16 nt, Human
accugcggcugcugug

SEQ ID NO: 2244878 - RNA, 22 nt, Human
accugcggcugcugugugccuu

SEQ ID NO: 2244879 - RNA, 21 nt, Human
accugcuagacacauuuuuaa

SEQ ID NO: 2244880 - RNA, 13 nt, Human
accugcucccagg

SEQ ID NO: 2244881 - RNA, 17 nt, Human
accugcucccaggccag

SEQ ID NO: 2244882 - RNA, 14 nt, Human
accugccuguagcc

SEQ ID NO: 2244883 - RNA, 11 nt, Human
accugccugua

SEQ ID NO: 2244884 - RNA, 18 nt, Human
accugccuccugccugcc

SEQ ID NO: 2244885 - RNA, 13 nt, Human
accugccuggguu

SEQ ID NO: 2244886 - RNA, 23 nt, Human
accugccuguugggccaggagcc

SEQ ID NO: 2244887 - RNA, 23 nt, Human
accugccucggccucccaaagug

SEQ ID NO: 2244888 - RNA, 21 nt, Human
accugccucggccucccaaag

SEQ ID NO: 2244889 - RNA, 14 nt, Human
accugccuccugcc

SEQ ID NO: 2244890 - RNA, 17 nt, Human
accugccuccugccugc

SEQ ID NO: 2244891 - RNA, 21 nt, Human
accugccugacauuuggagug

SEQ ID NO: 2244892 - RNA, 12 nt, Human
ucauuuuuaauc

SEQ ID NO: 2244893 - RNA, 21 nt, Human
ucauuuuguugcuuuugugaa

SEQ ID NO: 2244894 - RNA, 16 nt, Human
ucauuuuuaaucauga

SEQ ID NO: 2244895 - RNA, 22 nt, Human
ucauuuugguaaaauacuucuu

SEQ ID NO: 2244896 - RNA, 16 nt, Human
ucauuuugcauucaaa

SEQ ID NO: 2244897 - RNA, 17 nt, Human
ucauuuugcauucaaau

SEQ ID NO: 2244898 - RNA, 19 nt, Human
ucauuuuuaguagagacag

SEQ ID NO: 2244899 - RNA, 18 nt, Human
ucauuuuuaaucaugaaa

SEQ ID NO: 2244900 - RNA, 19 nt, Human
ucauuuuuaaucaugaaau

SEQ ID NO: 2244901 - RNA, 22 nt, Human
ucauuuuuccuucccuucucca

SEQ ID NO: 2244902 - RNA, 14 nt, Human
ucauuuuugaauac

SEQ ID NO: 2244903 - RNA, 18 nt, Human
ucauuuuuuuuaagaaaa

SEQ ID NO: 2244904 - RNA, 17 nt, Human
ucauuuuuuuuaagaaa

SEQ ID NO: 2244905 - RNA, 12 nt, Human
ucauuuuuguac

SEQ ID NO: 2244906 - RNA, 15 nt, Human
ucauuuuuguacagu

SEQ ID NO: 2244907 - RNA, 19 nt, Human
uccaaaaagauuuucagaa

SEQ ID NO: 2244908 - RNA, 16 nt, Human
ucauuugucacacacu

SEQ ID NO: 2244909 - RNA, 20 nt, Human
ucauuugguucauuaauucu

SEQ ID NO: 2244910 - RNA, 15 nt, Human
ucauuuucugcauuu

SEQ ID NO: 2244911 - RNA, 14 nt, Human
ucauuuugcauuca

SEQ ID NO: 2244912 - RNA, 15 nt, Human
ucauuuugagcugaa

SEQ ID NO: 2244913 - RNA, 16 nt, Human
ucauuuucugcaagcc

SEQ ID NO: 2244914 - RNA, 18 nt, Human
ucauuuucugcaagccug

SEQ ID NO: 2244915 - RNA, 21 nt, Human
ucauuuucuuaucuucugcaa

SEQ ID NO: 2244916 - RNA, 13 nt, Human
ucauuuucugcaa

SEQ ID NO: 2244917 - RNA, 14 nt, Human
ucauuuucugcaag

SEQ ID NO: 2244918 - RNA, 23 nt, Human
ucauuugggguagcuagaggaac

SEQ ID NO: 2244919 - RNA, 17 nt, Human
accuggagccccugggu

SEQ ID NO: 2244920 - RNA, 18 nt, Human
ucauuugguucauuaauu

SEQ ID NO: 2244921 - RNA, 13 nt, Human
ucauuugcuuuuu

SEQ ID NO: 2244922 - RNA, 14 nt, Human
ucauuugucacaca

SEQ ID NO: 2244923 - RNA, 15 nt, Human
accuggagccccugg

SEQ ID NO: 2244924 - RNA, 16 nt, Human
accuggagccccuggg

SEQ ID NO: 2244925 - RNA, 14 nt, Human
accuggagccccug

SEQ ID NO: 2244926 - RNA, 22 nt, Human
accuggagagcuagaaccugga

SEQ ID NO: 2244927 - RNA, 23 nt, Human
accuggagagcuagaaccuggag

SEQ ID NO: 2244928 - RNA, 23 nt, Human
accuggagaacuagaaccuggag

SEQ ID NO: 2244929 - RNA, 13 nt, Human
accuggagaccag

SEQ ID NO: 2244930 - RNA, 20 nt, Human
accuggagagccagaaccug

SEQ ID NO: 2244931 - RNA, 22 nt, Human
accuggagagccagaaccugga

SEQ ID NO: 2244932 - RNA, 23 nt, Human
accuggagagccagaaccuggag

SEQ ID NO: 2244933 - RNA, 13 nt, Human
accuggagagcua

SEQ ID NO: 2244934 - RNA, 21 nt, Human
accuggagagcuagaaccuag

SEQ ID NO: 2244935 - RNA, 20 nt, Human
accuggagagcuagaaccug

SEQ ID NO: 2244936 - RNA, 15 nt, Human
accugauguguacau

SEQ ID NO: 2244937 - RNA, 22 nt, Human
accugauguguacaucccaugu

SEQ ID NO: 2244938 - RNA, 21 nt, Human
accugauguuaaaauuccauc

SEQ ID NO: 2244939 - RNA, 11 nt, Human
accugauucaa

SEQ ID NO: 2244940 - RNA, 13 nt, Human
accugauguguac

SEQ ID NO: 2244941 - RNA, 21 nt, Human
accugauggcacuuagcuauc

SEQ ID NO: 2244942 - RNA, 19 nt, Human
accugauucaacuaaaaaa

SEQ ID NO: 2244943 - RNA, 11 nt, Human
accugauuuuu

SEQ ID NO: 2244944 - RNA, 20 nt, Human
accugauuuuuuuuccuuuu

SEQ ID NO: 2244945 - RNA, 13 nt, Human
accugcaaaaaau

SEQ ID NO: 2244946 - RNA, 17 nt, Human
accugauuuuuuuuccu

SEQ ID NO: 2244947 - RNA, 16 nt, Human
accugauuuuuuuucc

SEQ ID NO: 2244948 - RNA, 16 nt, Human
accugaggggccucuu

SEQ ID NO: 2244949 - RNA, 14 nt, Human
accugaggcugugg

SEQ ID NO: 2244950 - RNA, 23 nt, Human
accugagggcagaaagguucugc

SEQ ID NO: 2244951 - RNA, 20 nt, Human
accugauccuggaggcccag

SEQ ID NO: 2244952 - RNA, 13 nt, Human
accugauccugga

SEQ ID NO: 2244953 - RNA, 22 nt, Human
accugauccuggaggcccaguu

SEQ ID NO: 2244954 - RNA, 14 nt, Human
accugaggggccuc

SEQ ID NO: 2244955 - RNA, 19 nt, Human
accugaggcuccugugcua

SEQ ID NO: 2244956 - RNA, 12 nt, Human
accugaggcugu

SEQ ID NO: 2244957 - RNA, 16 nt, Human
accugaggcuccugug

SEQ ID NO: 2244958 - RNA, 16 nt, Human
accugcaccucccccc

SEQ ID NO: 2244959 - RNA, 15 nt, Human
accugcaccuccccc

SEQ ID NO: 2244960 - RNA, 14 nt, Human
accugcaccucccc

SEQ ID NO: 2244961 - RNA, 18 nt, Human
accugcaagggcucccca

SEQ ID NO: 2244962 - RNA, 20 nt, Human
accugcaagggcuccccacu

SEQ ID NO: 2244963 - RNA, 15 nt, Human
accugcaaaaaauag

SEQ ID NO: 2244964 - RNA, 15 nt, Human
accugcaaagaucug

SEQ ID NO: 2244965 - RNA, 22 nt, Human
accugcaaagaucuguccucag

SEQ ID NO: 2244966 - RNA, 16 nt, Human
accugcaaagaucugu

SEQ ID NO: 2244967 - RNA, 16 nt, Human
accugccaggaagcca

SEQ ID NO: 2244968 - RNA, 17 nt, Human
accugccaggaagccag

SEQ ID NO: 2244969 - RNA, 20 nt, Human
accugcaccuccccccacug

SEQ ID NO: 2244970 - RNA, 19 nt, Human
accugccaggaagccagca

SEQ ID NO: 2244971 - RNA, 13 nt, Human
accugccucagga

SEQ ID NO: 2244972 - RNA, 18 nt, Human
accugccaggaagccagc

SEQ ID NO: 2244973 - RNA, 18 nt, Human
accugcaccuccccccac

SEQ ID NO: 2244974 - RNA, 17 nt, Human
accugcaccucccccca

SEQ ID NO: 2244975 - RNA, 21 nt, Human
accugccucccuucaugcaug

SEQ ID NO: 2244976 - RNA, 23 nt, Human
accugccucccuucaugcaugga

SEQ ID NO: 2244977 - RNA, 19 nt, Human
accugcaccuccccccacu

SEQ ID NO: 2244978 - RNA, 13 nt, Human
accugccuccugc

SEQ ID NO: 2244979 - RNA, 22 nt, Human
accugccucccuucaugcaugg

SEQ ID NO: 2244980 - RNA, 17 nt, Human
accugccucggccuccc

SEQ ID NO: 2244981 - RNA, 15 nt, Human
ucauaaucuuugcuu

SEQ ID NO: 2244982 - RNA, 14 nt, Human
ucauaaucuuugcu

SEQ ID NO: 2244983 - RNA, 12 nt, Human
ucauaaugacuu

SEQ ID NO: 2244984 - RNA, 16 nt, Human
ucauaauaaguugcau

SEQ ID NO: 2244985 - RNA, 14 nt, Human
accugaaccuagga

SEQ ID NO: 2244986 - RNA, 19 nt, Human
ucauaauaaauaucuguac

SEQ ID NO: 2244987 - RNA, 18 nt, Human
accugaagacucauucuu

SEQ ID NO: 2244988 - RNA, 16 nt, Human
accugaagaaucacaa

SEQ ID NO: 2244989 - RNA, 14 nt, Human
accugaagaaucac

SEQ ID NO: 2244990 - RNA, 11 nt, Human
accugaagaau

SEQ ID NO: 2244991 - RNA, 19 nt, Human
accugaauuuuggcugugu

SEQ ID NO: 2244992 - RNA, 23 nt, Human
accugagcccggaugcuucucca

SEQ ID NO: 2244993 - RNA, 21 nt, Human
accugagcccggaugcuucuc

SEQ ID NO: 2244994 - RNA, 23 nt, Human
accugaggcccuucucuccagcc

SEQ ID NO: 2244995 - RNA, 17 nt, Human
accugagccccaaaagg

SEQ ID NO: 2244996 - RNA, 12 nt, Human
accugagcccca

SEQ ID NO: 2244997 - RNA, 19 nt, Human
accugaccaacauggagaa

SEQ ID NO: 2244998 - RNA, 16 nt, Human
accugagccagccugc

SEQ ID NO: 2244999 - RNA, 18 nt, Human
accugagcaggaccucug

SEQ ID NO: 2245000 - RNA, 17 nt, Human
accugaccaacauggag

SEQ ID NO: 2245001 - RNA, 15 nt, Human
accugaccccugcuc

SEQ ID NO: 2245002 - RNA, 17 nt, Human
accugaccccugacccc

SEQ ID NO: 2245003 - RNA, 19 nt, Human
accugacacucccuugggc

SEQ ID NO: 2245004 - RNA, 12 nt, Human
accugacagaug

SEQ ID NO: 2245005 - RNA, 22 nt, Human
accugacagaugucagccgagc

SEQ ID NO: 2245006 - RNA, 23 nt, Human
accugaagaguggucagaacaga

SEQ ID NO: 2245007 - RNA, 16 nt, Human
accugacaagcacugc

SEQ ID NO: 2245008 - RNA, 17 nt, Human
accugacacucccuugg

SEQ ID NO: 2245009 - RNA, 16 nt, Human
accugacacucccuug

SEQ ID NO: 2245010 - RNA, 17 nt, Human
acgaagggaaaugucuu

SEQ ID NO: 2245011 - RNA, 14 nt, Human
acgaaguguugcau

SEQ ID NO: 2245012 - RNA, 14 nt, Human
acgaauacuuuugc

SEQ ID NO: 2245013 - RNA, 22 nt, Human
acgaauacuuuugcccuuugau

SEQ ID NO: 2245014 - RNA, 14 nt, Human
acgacaaggaaagg

SEQ ID NO: 2245015 - RNA, 14 nt, Human
acgaauauugcuga

SEQ ID NO: 2245016 - RNA, 23 nt, Human
uccagggacagaggccccagccu

SEQ ID NO: 2245017 - RNA, 21 nt, Human
uccagggacagaggccccagc

SEQ ID NO: 2245018 - RNA, 19 nt, Human
uccagggacagaggcccca

SEQ ID NO: 2245019 - RNA, 15 nt, Human
uccagggacagaggc

SEQ ID NO: 2245020 - RNA, 14 nt, Human
uccagggacagagg

SEQ ID NO: 2245021 - RNA, 19 nt, Human
uccagggagcauuuuccuc

SEQ ID NO: 2245022 - RNA, 14 nt, Human
uccagggacugaag

SEQ ID NO: 2245023 - RNA, 20 nt, Human
uccagggaugccaucugugg

SEQ ID NO: 2245024 - RNA, 18 nt, Human
uccagggaguccccuccc

SEQ ID NO: 2245025 - RNA, 17 nt, Human
uccagggccacgugcca

SEQ ID NO: 2245026 - RNA, 14 nt, Human
acgaacuuccaugg

SEQ ID NO: 2245027 - RNA, 23 nt, Human
uccacgcugucuccagaccccca

SEQ ID NO: 2245028 - RNA, 22 nt, Human
uccacgcugucuccagaccccc

SEQ ID NO: 2245029 - RNA, 21 nt, Human
uccacgcugucuccagacccc

SEQ ID NO: 2245030 - RNA, 20 nt, Human
uccacgcugucuccagaccc

SEQ ID NO: 2245031 - RNA, 19 nt, Human
uccacgcugucuccagacc

SEQ ID NO: 2245032 - RNA, 18 nt, Human
uccacgcugucuccagac

SEQ ID NO: 2245033 - RNA, 17 nt, Human
uccacgcugucuccaga

SEQ ID NO: 2245034 - RNA, 16 nt, Human
uccacgcugucuccag

SEQ ID NO: 2245035 - RNA, 15 nt, Human
uccacgcugucucca

SEQ ID NO: 2245036 - RNA, 12 nt, Human
uccacgcugucu

SEQ ID NO: 2245037 - RNA, 22 nt, Human
uccacgagcuguuuacuaggga

SEQ ID NO: 2245038 - RNA, 22 nt, Human
uccacggagccacuccucugac

SEQ ID NO: 2245039 - RNA, 14 nt, Human
uccacggcucuagg

SEQ ID NO: 2245040 - RNA, 22 nt, Human
uccaggcucuuuggggucagcc

SEQ ID NO: 2245041 - RNA, 20 nt, Human
uccacggcucuagguggggc

SEQ ID NO: 2245042 - RNA, 21 nt, Human
uccacggagccacuccucuga

SEQ ID NO: 2245043 - RNA, 20 nt, Human
uccacggagccacuccucug

SEQ ID NO: 2245044 - RNA, 15 nt, Human
uccacggagccacuc

SEQ ID NO: 2245045 - RNA, 14 nt, Human
uccacggagccacu

SEQ ID NO: 2245046 - RNA, 23 nt, Human
uccagggaagcuggccgaggguc

SEQ ID NO: 2245047 - RNA, 23 nt, Human
uccaggcucuuuggggucagcca

SEQ ID NO: 2245048 - RNA, 16 nt, Human
uccaggcugccguggg

SEQ ID NO: 2245049 - RNA, 18 nt, Human
uccaggcugggagagccu

SEQ ID NO: 2245050 - RNA, 14 nt, Human
uccaggcugggaga

SEQ ID NO: 2245051 - RNA, 17 nt, Human
uccaggcugggagagcc

SEQ ID NO: 2245052 - RNA, 23 nt, Human
acgccaggggaaaaucagccugc

SEQ ID NO: 2245053 - RNA, 11 nt, Human
acgccauccca

SEQ ID NO: 2245054 - RNA, 14 nt, Human
acgccaucccagcc

SEQ ID NO: 2245055 - RNA, 15 nt, Human
acgccaucccagccc

SEQ ID NO: 2245056 - RNA, 16 nt, Human
acgccaucccagcccc

SEQ ID NO: 2245057 - RNA, 17 nt, Human
acgccaucccagcccca

SEQ ID NO: 2245058 - RNA, 16 nt, Human
acgcccaacccuuccc

SEQ ID NO: 2245059 - RNA, 18 nt, Human
acgccaucccagccccaa

SEQ ID NO: 2245060 - RNA, 21 nt, Human
acgaggggugucuugggcaga

SEQ ID NO: 2245061 - RNA, 14 nt, Human
acgagguaugaggu

SEQ ID NO: 2245062 - RNA, 18 nt, Human
acgaggggugucuugggc

SEQ ID NO: 2245063 - RNA, 20 nt, Human
acgaggggugucuugggcag

SEQ ID NO: 2245064 - RNA, 18 nt, Human
acgccaggggaaaaucag

SEQ ID NO: 2245065 - RNA, 17 nt, Human
acgagucaauccccuca

SEQ ID NO: 2245066 - RNA, 16 nt, Human
acgaguaauuuauugu

SEQ ID NO: 2245067 - RNA, 15 nt, Human
acgacugcccggcag

SEQ ID NO: 2245068 - RNA, 20 nt, Human
acgacaauagcuuuacccuc

SEQ ID NO: 2245069 - RNA, 19 nt, Human
acgacaaggaaaggcaaau

SEQ ID NO: 2245070 - RNA, 22 nt, Human
acgacaaagccaaacucugcca

SEQ ID NO: 2245071 - RNA, 23 nt, Human
acgaggcccucgggcccagcccc

SEQ ID NO: 2245072 - RNA, 21 nt, Human
acgaggcccucgggcccagcc

SEQ ID NO: 2245073 - RNA, 22 nt, Human
acgaggcccucgggcccagccc

SEQ ID NO: 2245074 - RNA, 22 nt, Human
acgacuucagggcagggcucug

SEQ ID NO: 2245075 - RNA, 20 nt, Human
acgaggcccucgggcccagc

SEQ ID NO: 2245076 - RNA, 14 nt, Human
acgacuucagggca

SEQ ID NO: 2245077 - RNA, 12 nt, Human
acgacugucucc

SEQ ID NO: 2245078 - RNA, 17 nt, Human
acgaccacagggucugc

SEQ ID NO: 2245079 - RNA, 13 nt, Human
acgaccuuuaccu

SEQ ID NO: 2245080 - RNA, 20 nt, Human
acgccgcccuaaaagcacac

SEQ ID NO: 2245081 - RNA, 23 nt, Human
acgcccuccccuccccugcugca

SEQ ID NO: 2245082 - RNA, 20 nt, Human
acgccggggacagaggccug

SEQ ID NO: 2245083 - RNA, 18 nt, Human
acgcccuccccuccccug

SEQ ID NO: 2245084 - RNA, 19 nt, Human
acgcccuccccuccccugc

SEQ ID NO: 2245085 - RNA, 21 nt, Human
acgcccuccccuccccugcug

SEQ ID NO: 2245086 - RNA, 22 nt, Human
acgcccuccccuccccugcugc

SEQ ID NO: 2245087 - RNA, 23 nt, Human
acgcgugcacacaccagagccca

SEQ ID NO: 2245088 - RNA, 20 nt, Human
acgcgugcacacaccagagc

SEQ ID NO: 2245089 - RNA, 21 nt, Human
acgccggggacagaggccugc

SEQ ID NO: 2245090 - RNA, 22 nt, Human
acgccggggacagaggccugcc

SEQ ID NO: 2245091 - RNA, 23 nt, Human
acgccggggacagaggccugccc

SEQ ID NO: 2245092 - RNA, 16 nt, Human
acgcccaugugugagu

SEQ ID NO: 2245093 - RNA, 21 nt, Human
acgccccagauaccagccccu

SEQ ID NO: 2245094 - RNA, 14 nt, Human
acgcccauguguga

SEQ ID NO: 2245095 - RNA, 14 nt, Human
acgcccccacuggu

SEQ ID NO: 2245096 - RNA, 23 nt, Human
acgcccccccccaccccuggggg

SEQ ID NO: 2245097 - RNA, 13 nt, Human
acgcccuauuuuu

SEQ ID NO: 2245098 - RNA, 20 nt, Human
acgcccguccugccuguggc

SEQ ID NO: 2245099 - RNA, 12 nt, Human
acgcccuccccu

SEQ ID NO: 2245100 - RNA, 13 nt, Human
acgcccuccccuc

SEQ ID NO: 2245101 - RNA, 14 nt, Human
acgcccuccccucc

SEQ ID NO: 2245102 - RNA, 15 nt, Human
acgcccuccccuccc

SEQ ID NO: 2245103 - RNA, 16 nt, Human
acgcccccccccaccc

SEQ ID NO: 2245104 - RNA, 14 nt, Human
acgcccccccccac

SEQ ID NO: 2245105 - RNA, 16 nt, Human
acgcccguccugccug

SEQ ID NO: 2245106 - RNA, 18 nt, Human
acgcccguccugccugug

SEQ ID NO: 2245107 - RNA, 19 nt, Human
acgcccguccugccugugg

SEQ ID NO: 2245108 - RNA, 18 nt, Human
acgcuacccgggaagggg

SEQ ID NO: 2245109 - RNA, 21 nt, Human
acgcguguguacacgggacug

SEQ ID NO: 2245110 - RNA, 23 nt, Human
acgcguguguacacgggacugac

SEQ ID NO: 2245111 - RNA, 16 nt, Human
acgcuaaagagcccuu

SEQ ID NO: 2245112 - RNA, 17 nt, Human
acgcuaaagagcccuug

SEQ ID NO: 2245113 - RNA, 16 nt, Human
acgcucucuggccuuc

SEQ ID NO: 2245114 - RNA, 15 nt, Human
acgcucucuggccuu

SEQ ID NO: 2245115 - RNA, 13 nt, Human
acgcuacccggga

SEQ ID NO: 2245116 - RNA, 17 nt, Human
acgcuacccgggaaggg

SEQ ID NO: 2245117 - RNA, 19 nt, Human
acggagucccaccuuggcu

SEQ ID NO: 2245118 - RNA, 18 nt, Human
acggagccccaggccucu

SEQ ID NO: 2245119 - RNA, 21 nt, Human
acggagccccaggccucugug

SEQ ID NO: 2245120 - RNA, 20 nt, Human
acggagcccagcccucccca

SEQ ID NO: 2245121 - RNA, 15 nt, Human
acggagcccagcccu

SEQ ID NO: 2245122 - RNA, 21 nt, Human
acggagccacuccucugacuc

SEQ ID NO: 2245123 - RNA, 18 nt, Human
acgcugaauaaaugucuu

SEQ ID NO: 2245124 - RNA, 19 nt, Human
acgcugaauaaaugucuuu

SEQ ID NO: 2245125 - RNA, 14 nt, Human
acgcugccugcccg

SEQ ID NO: 2245126 - RNA, 15 nt, Human
acgcugccugcccac

SEQ ID NO: 2245127 - RNA, 13 nt, Human
acgcugccugccc

SEQ ID NO: 2245128 - RNA, 12 nt, Human
acgcugccugcc

SEQ ID NO: 2245129 - RNA, 21 nt, Human
acgcuaaagagcccuugccuc

SEQ ID NO: 2245130 - RNA, 18 nt, Human
acgcuaaagagcccuugc

SEQ ID NO: 2245131 - RNA, 20 nt, Human
acgcuaaagagcccuugccu

SEQ ID NO: 2245132 - RNA, 12 nt, Human
acgcugaauaaa

SEQ ID NO: 2245133 - RNA, 13 nt, Human
acgcugaauaaau

SEQ ID NO: 2245134 - RNA, 15 nt, Human
acgcugaauaaaugu

SEQ ID NO: 2245135 - RNA, 16 nt, Human
acgcugaauaaauguc

SEQ ID NO: 2245136 - RNA, 17 nt, Human
acgcucucuggccuucg

SEQ ID NO: 2245137 - RNA, 22 nt, Human
acggcaggacaacgaggaagcc

SEQ ID NO: 2245138 - RNA, 18 nt, Human
acggccagggagaagcuc

SEQ ID NO: 2245139 - RNA, 23 nt, Human
acggccagggagaagcuccucuc

SEQ ID NO: 2245140 - RNA, 17 nt, Human
acggccagggagaagcu

SEQ ID NO: 2245141 - RNA, 13 nt, Human
acggccaggccag

SEQ ID NO: 2245142 - RNA, 21 nt, Human
acggcaggacaacgaggaagc

SEQ ID NO: 2245143 - RNA, 16 nt, Human
acggccaggccagagg

SEQ ID NO: 2245144 - RNA, 13 nt, Human
acggcacccaccc

SEQ ID NO: 2245145 - RNA, 12 nt, Human
acggauuccaaa

SEQ ID NO: 2245146 - RNA, 15 nt, Human
acggauuuauuuuuc

SEQ ID NO: 2245147 - RNA, 23 nt, Human
acggauuagggcauuugagaaau

SEQ ID NO: 2245148 - RNA, 13 nt, Human
acggauuauuuuu

SEQ ID NO: 2245149 - RNA, 16 nt, Human
acggauuauuuuuuca

SEQ ID NO: 2245150 - RNA, 17 nt, Human
acggauuauuuuuucag

SEQ ID NO: 2245151 - RNA, 18 nt, Human
acggauuauuuuuucaga

SEQ ID NO: 2245152 - RNA, 19 nt, Human
acggauuauuuuuucagac

SEQ ID NO: 2245153 - RNA, 20 nt, Human
acggauuauuuuuucagacc

SEQ ID NO: 2245154 - RNA, 21 nt, Human
acggauuauuuuuucagaccg

SEQ ID NO: 2245155 - RNA, 21 nt, Human
acggagucccaccuuggcugc

SEQ ID NO: 2245156 - RNA, 22 nt, Human
acggaugccuuccccugggccc

SEQ ID NO: 2245157 - RNA, 22 nt, Human
acggauuagggcauuugagaaa

SEQ ID NO: 2245158 - RNA, 12 nt, Human
uccaugaaaaug

SEQ ID NO: 2245159 - RNA, 22 nt, Human
uccaugaaaacguuuuauugug

SEQ ID NO: 2245160 - RNA, 21 nt, Human
uccaugaaaacguuuuauugu

SEQ ID NO: 2245161 - RNA, 19 nt, Human
uccaugaaaacguuuuauu

SEQ ID NO: 2245162 - RNA, 18 nt, Human
uccaugaaaacguuuuau

SEQ ID NO: 2245163 - RNA, 15 nt, Human
uccaugaaaacguuu

SEQ ID NO: 2245164 - RNA, 11 nt, Human
uccaugaaaac

SEQ ID NO: 2245165 - RNA, 22 nt, Human
uccaugaagauguagaggagaa

SEQ ID NO: 2245166 - RNA, 14 nt, Human
uccaugaauguauc

SEQ ID NO: 2245167 - RNA, 13 nt, Human
uccaugaauguau

SEQ ID NO: 2245168 - RNA, 12 nt, Human
uccaugaaugua

SEQ ID NO: 2245169 - RNA, 20 nt, Human
uccaugaaucgcuucucuuu

SEQ ID NO: 2245170 - RNA, 15 nt, Human
uccaugaaggcagag

SEQ ID NO: 2245171 - RNA, 18 nt, Human
uccaugaaucgcuucucu

SEQ ID NO: 2245172 - RNA, 19 nt, Human
uccaugaaucgcuucucuu

SEQ ID NO: 2245173 - RNA, 16 nt, Human
uccaugaauguaucag

SEQ ID NO: 2245174 - RNA, 15 nt, Human
uccaugaauguauca

SEQ ID NO: 2245175 - RNA, 21 nt, Human
uccaugaauguaucaggaaau

SEQ ID NO: 2245176 - RNA, 15 nt, Human
uccaucuggcagggu

SEQ ID NO: 2245177 - RNA, 13 nt, Human
uccaucuuuacaa

SEQ ID NO: 2245178 - RNA, 16 nt, Human
uccaucuucuuugcag

SEQ ID NO: 2245179 - RNA, 18 nt, Human
uccaucuuuccugauggc

SEQ ID NO: 2245180 - RNA, 14 nt, Human
uccaucuucagcuu

SEQ ID NO: 2245181 - RNA, 16 nt, Human
uccaucuucagcuucu

SEQ ID NO: 2245182 - RNA, 23 nt, Human
uccaucuucagcuucuucaucuu

SEQ ID NO: 2245183 - RNA, 15 nt, Human
uccaucuucuuugca

SEQ ID NO: 2245184 - RNA, 20 nt, Human
uccaucucuuguuuaaauuc

SEQ ID NO: 2245185 - RNA, 11 nt, Human
uccauccugag

SEQ ID NO: 2245186 - RNA, 14 nt, Human
uccauugugugagu

SEQ ID NO: 2245187 - RNA, 14 nt, Human
uccauuguuugaaa

SEQ ID NO: 2245188 - RNA, 20 nt, Human
uccauuguuugaaacaaaga

SEQ ID NO: 2245189 - RNA, 21 nt, Human
uccauuguuugaaacaaagaa

SEQ ID NO: 2245190 - RNA, 22 nt, Human
uccauugguuuaccugugaaau

SEQ ID NO: 2245191 - RNA, 23 nt, Human
uccauuguaaaccacaaggcugu

SEQ ID NO: 2245192 - RNA, 23 nt, Human
uccauuguuugaaacaaagaagg

SEQ ID NO: 2245193 - RNA, 19 nt, Human
uccauuguuuggagacauu

SEQ ID NO: 2245194 - RNA, 18 nt, Human
uccaugaguuugcccugg

SEQ ID NO: 2245195 - RNA, 19 nt, Human
uccaugagcaccccaaggc

SEQ ID NO: 2245196 - RNA, 13 nt, Human
uccaugagcaccc

SEQ ID NO: 2245197 - RNA, 15 nt, Human
uccaugagcacccca

SEQ ID NO: 2245198 - RNA, 16 nt, Human
uccauuggaucucauu

SEQ ID NO: 2245199 - RNA, 20 nt, Human
uccauugacauguacagaga

SEQ ID NO: 2245200 - RNA, 21 nt, Human
uccauugacauguacagagaa

SEQ ID NO: 2245201 - RNA, 20 nt, Human
uccaugaccuaguuuuccau

SEQ ID NO: 2245202 - RNA, 15 nt, Human
uccaugaguccccug

SEQ ID NO: 2245203 - RNA, 16 nt, Human
uccaugaguccccugu

SEQ ID NO: 2245204 - RNA, 17 nt, Human
uccaugaguccccuguu

SEQ ID NO: 2245205 - RNA, 14 nt, Human
acggccgcuccagg

SEQ ID NO: 2245206 - RNA, 19 nt, Human
acggccugaugcucccucc

SEQ ID NO: 2245207 - RNA, 18 nt, Human
acggccugaugcucccuc

SEQ ID NO: 2245208 - RNA, 15 nt, Human
acggccugaugcucc

SEQ ID NO: 2245209 - RNA, 15 nt, Human
acggccgcuccaggg

SEQ ID NO: 2245210 - RNA, 18 nt, Human
acggccgcuccaggggug

SEQ ID NO: 2245211 - RNA, 14 nt, Human
acggcucacugcag

SEQ ID NO: 2245212 - RNA, 22 nt, Human
acggccugaugcucccuccccu

SEQ ID NO: 2245213 - RNA, 20 nt, Human
acggccugaugcucccuccc

SEQ ID NO: 2245214 - RNA, 21 nt, Human
acggccuucaacugaaaagac

SEQ ID NO: 2245215 - RNA, 19 nt, Human
uccagucugcugcccucca

SEQ ID NO: 2245216 - RNA, 18 nt, Human
uccagucugcugcccucc

SEQ ID NO: 2245217 - RNA, 16 nt, Human
uccagucugcugcccu

SEQ ID NO: 2245218 - RNA, 15 nt, Human
uccagucugcugccc

SEQ ID NO: 2245219 - RNA, 15 nt, Human
acggcucacugcagc

SEQ ID NO: 2245220 - RNA, 22 nt, Human
uccagucugcugcccuccaucc

SEQ ID NO: 2245221 - RNA, 20 nt, Human
uccagucugcugcccuccau

SEQ ID NO: 2245222 - RNA, 19 nt, Human
uccagucuuccugacacuu

SEQ ID NO: 2245223 - RNA, 15 nt, Human
uccagucuuccugac

SEQ ID NO: 2245224 - RNA, 23 nt, Human
uccagucuuccugacacuuuaau

SEQ ID NO: 2245225 - RNA, 22 nt, Human
uccagucuuccugacacuuuaa

SEQ ID NO: 2245226 - RNA, 21 nt, Human
uccagucuuccugacacuuua

SEQ ID NO: 2245227 - RNA, 22 nt, Human
uccaucccuacccccuaagagc

SEQ ID NO: 2245228 - RNA, 20 nt, Human
uccagugaggcucugcccuu

SEQ ID NO: 2245229 - RNA, 18 nt, Human
uccagugaggcucugccc

SEQ ID NO: 2245230 - RNA, 19 nt, Human
uccagugaggcucugcccu

SEQ ID NO: 2245231 - RNA, 17 nt, Human
uccagugaggcucugcc

SEQ ID NO: 2245232 - RNA, 14 nt, Human
uccagugagacagc

SEQ ID NO: 2245233 - RNA, 15 nt, Human
ucccaaagugcuggg

SEQ ID NO: 2245234 - RNA, 20 nt, Human
ucccaaagugcugggauuac

SEQ ID NO: 2245235 - RNA, 16 nt, Human
ucccaaagugcuggga

SEQ ID NO: 2245236 - RNA, 14 nt, Human
uccauuugugugug

SEQ ID NO: 2245237 - RNA, 15 nt, Human
uccauuugcaaggga

SEQ ID NO: 2245238 - RNA, 12 nt, Human
uccauuugcaag

SEQ ID NO: 2245239 - RNA, 14 nt, Human
ucccacaaaggaga

SEQ ID NO: 2245240 - RNA, 23 nt, Human
ucccaauuucagacucccauucc

SEQ ID NO: 2245241 - RNA, 18 nt, Human
ucccaauuucagacuccc

SEQ ID NO: 2245242 - RNA, 17 nt, Human
ucccaauuucagacucc

SEQ ID NO: 2245243 - RNA, 15 nt, Human
ucccaauucacaucu

SEQ ID NO: 2245244 - RNA, 19 nt, Human
ucccaauuaggaaguguaa

SEQ ID NO: 2245245 - RNA, 15 nt, Human
ucccaauuaggaagu

SEQ ID NO: 2245246 - RNA, 14 nt, Human
ucccaauuaggaag

SEQ ID NO: 2245247 - RNA, 20 nt, Human
ucccaauuaggaaguguaac

SEQ ID NO: 2245248 - RNA, 13 nt, Human
ucccacaggcagc

SEQ ID NO: 2245249 - RNA, 21 nt, Human
ucccacaggacauuucucuaa

SEQ ID NO: 2245250 - RNA, 18 nt, Human
ucccacaggacauuucuc

SEQ ID NO: 2245251 - RNA, 17 nt, Human
ucccacaggacauuucu

SEQ ID NO: 2245252 - RNA, 15 nt, Human
ucccacaggcccuuc

SEQ ID NO: 2245253 - RNA, 17 nt, Human
ucccacaggcccuuccu

SEQ ID NO: 2245254 - RNA, 21 nt, Human
ucccacaggcccuuccucucc

SEQ ID NO: 2245255 - RNA, 22 nt, Human
ucccacaggcccuuccucucca

SEQ ID NO: 2245256 - RNA, 23 nt, Human
ucccacagugacucgggcuccug

SEQ ID NO: 2245257 - RNA, 17 nt, Human
ucccacaggcagcuuua

SEQ ID NO: 2245258 - RNA, 14 nt, Human
ucccacaggcagcu

SEQ ID NO: 2245259 - RNA, 15 nt, Human
ucccacaggcagcuu

SEQ ID NO: 2245260 - RNA, 14 nt, Human
acgggguccuucaa

SEQ ID NO: 2245261 - RNA, 16 nt, Human
acggggggccccaguc

SEQ ID NO: 2245262 - RNA, 22 nt, Human
acggggggccccagucagccuc

SEQ ID NO: 2245263 - RNA, 18 nt, Human
acggggcucuucucauuu

SEQ ID NO: 2245264 - RNA, 14 nt, Human
acggggggccccag

SEQ ID NO: 2245265 - RNA, 15 nt, Human
acggggggccccagu

SEQ ID NO: 2245266 - RNA, 14 nt, Human
acgguauuaugcuu

SEQ ID NO: 2245267 - RNA, 17 nt, Human
acgguauuaugcuucuu

SEQ ID NO: 2245268 - RNA, 18 nt, Human
acgguauuaugcuucuug

SEQ ID NO: 2245269 - RNA, 23 nt, Human
acggggggccccagucagccucu

SEQ ID NO: 2245270 - RNA, 18 nt, Human
acgggugggcggcuggag

SEQ ID NO: 2245271 - RNA, 14 nt, Human
acggggaggccaag

SEQ ID NO: 2245272 - RNA, 14 nt, Human
acggggccggccag

SEQ ID NO: 2245273 - RNA, 23 nt, Human
acggggaggccaagugcaggcug

SEQ ID NO: 2245274 - RNA, 15 nt, Human
acggggcucuucuca

SEQ ID NO: 2245275 - RNA, 15 nt, Human
acggggccggccagg

SEQ ID NO: 2245276 - RNA, 18 nt, Human
acggggccggccaggugg

SEQ ID NO: 2245277 - RNA, 12 nt, Human
acggggagaaaa

SEQ ID NO: 2245278 - RNA, 14 nt, Human
acggggacugggga

SEQ ID NO: 2245279 - RNA, 19 nt, Human
ucccacccccuucucugcu

SEQ ID NO: 2245280 - RNA, 17 nt, Human
ucccacccccuucucug

SEQ ID NO: 2245281 - RNA, 20 nt, Human
ucccacccccaucucucccu

SEQ ID NO: 2245282 - RNA, 22 nt, Human
ucccacccccacccccagcuca

SEQ ID NO: 2245283 - RNA, 23 nt, Human
ucccacccccacccccagcucaa

SEQ ID NO: 2245284 - RNA, 22 nt, Human
ucccacccccuucucugcucca

SEQ ID NO: 2245285 - RNA, 15 nt, Human
ucccacccgaugcug

SEQ ID NO: 2245286 - RNA, 16 nt, Human
ucccacccgaugcugc

SEQ ID NO: 2245287 - RNA, 21 nt, Human
ucccacccccuucucugcucc

SEQ ID NO: 2245288 - RNA, 20 nt, Human
ucccacccccuucucugcuc

SEQ ID NO: 2245289 - RNA, 20 nt, Human
ucccacccgaugcugcuuuc

SEQ ID NO: 2245290 - RNA, 17 nt, Human
ucccacccgaugcugcu

SEQ ID NO: 2245291 - RNA, 18 nt, Human
ucccacccgaugcugcuu

SEQ ID NO: 2245292 - RNA, 22 nt, Human
ucccaccaggcugcucagggcu

SEQ ID NO: 2245293 - RNA, 16 nt, Human
ucccacccacauguga

SEQ ID NO: 2245294 - RNA, 15 nt, Human
ucccacccacaugug

SEQ ID NO: 2245295 - RNA, 12 nt, Human
ucccacccaccg

SEQ ID NO: 2245296 - RNA, 19 nt, Human
ucccacccaccgccacaau

SEQ ID NO: 2245297 - RNA, 18 nt, Human
ucccacccacaugugaca

SEQ ID NO: 2245298 - RNA, 22 nt, Human
ucccacccacaugugacacaua

SEQ ID NO: 2245299 - RNA, 11 nt, Human
ucccaccccac

SEQ ID NO: 2245300 - RNA, 14 nt, Human
ucccaccccacaca

SEQ ID NO: 2245301 - RNA, 19 nt, Human
ucccaccaacccucagagc

SEQ ID NO: 2245302 - RNA, 17 nt, Human
ucccaccacagcaggug

SEQ ID NO: 2245303 - RNA, 15 nt, Human
ucccaccacccugag

SEQ ID NO: 2245304 - RNA, 15 nt, Human
ucccaccacagcagg

SEQ ID NO: 2245305 - RNA, 18 nt, Human
ucccaccaaggucuucag

SEQ ID NO: 2245306 - RNA, 17 nt, Human
ucccaccaggcugcuca

SEQ ID NO: 2245307 - RNA, 20 nt, Human
uccuacccugcgcccagucc

SEQ ID NO: 2245308 - RNA, 16 nt, Human
uccguuagcuccugug

SEQ ID NO: 2245309 - RNA, 17 nt, Human
uccguuagcuccugugg

SEQ ID NO: 2245310 - RNA, 13 nt, Human
uccuaccucagcc

SEQ ID NO: 2245311 - RNA, 12 nt, Human
uccuaccucagc

SEQ ID NO: 2245312 - RNA, 20 nt, Human
uccuaccgaaaccuugccuu

SEQ ID NO: 2245313 - RNA, 15 nt, Human
uccguuaaaauacca

SEQ ID NO: 2245314 - RNA, 15 nt, Human
uccguuagcuccugu

SEQ ID NO: 2245315 - RNA, 17 nt, Human
uccgugggacggugccc

SEQ ID NO: 2245316 - RNA, 24 nt, Human
uccgugcuuguuugcucaccuggg

SEQ ID NO: 2245317 - RNA, 16 nt, Human
uccgugggacggugcc

SEQ ID NO: 2245318 - RNA, 23 nt, Human
uccgugggacggugcccaagcca

SEQ ID NO: 2245319 - RNA, 13 nt, Human
uccguuaaaauac

SEQ ID NO: 2245320 - RNA, 13 nt, Human
uccgugcugacag

SEQ ID NO: 2245321 - RNA, 21 nt, Human
uccgugcugacagcugcuccu

SEQ ID NO: 2245322 - RNA, 19 nt, Human
uccgugcugacagcugcuc

SEQ ID NO: 2245323 - RNA, 18 nt, Human
uccgugcugacagcugcu

SEQ ID NO: 2245324 - RNA, 17 nt, Human
uccgugcugacagcugc

SEQ ID NO: 2245325 - RNA, 16 nt, Human
uccgugcuuccucagu

SEQ ID NO: 2245326 - RNA, 21 nt, Human
uccggcccuccuacccugcgc

SEQ ID NO: 2245327 - RNA, 23 nt, Human
uccggcccuccuacccugcgccc

SEQ ID NO: 2245328 - RNA, 14 nt, Human
uccggccuccccuc

SEQ ID NO: 2245329 - RNA, 21 nt, Human
uccggccugaugacagagcga

SEQ ID NO: 2245330 - RNA, 15 nt, Human
uccggcgucagccuc

SEQ ID NO: 2245331 - RNA, 16 nt, Human
uccggcgucagccucc

SEQ ID NO: 2245332 - RNA, 17 nt, Human
uccggcgucagccucca

SEQ ID NO: 2245333 - RNA, 18 nt, Human
uccggcgucagccuccag

SEQ ID NO: 2245334 - RNA, 19 nt, Human
uccggcgucagccuccagc

SEQ ID NO: 2245335 - RNA, 21 nt, Human
uccggcgucagccuccagccu

SEQ ID NO: 2245336 - RNA, 22 nt, Human
uccggcgucagccuccagccuc

SEQ ID NO: 2245337 - RNA, 18 nt, Human
uccggcaguucugggugc

SEQ ID NO: 2245338 - RNA, 14 nt, Human
uccggcccccagag

SEQ ID NO: 2245339 - RNA, 18 nt, Human
uccggcccccagagcgcc

SEQ ID NO: 2245340 - RNA, 23 nt, Human
uccggauuggcuuguguguuuca

SEQ ID NO: 2245341 - RNA, 16 nt, Human
uccggauuuaauuuga

SEQ ID NO: 2245342 - RNA, 15 nt, Human
acuccacuuucauag

SEQ ID NO: 2245343 - RNA, 14 nt, Human
acuccagaaaguga

SEQ ID NO: 2245344 - RNA, 18 nt, Human
acuccagaaagugacaag

SEQ ID NO: 2245345 - RNA, 19 nt, Human
acucgauucauauugaaua

SEQ ID NO: 2245346 - RNA, 21 nt, Human
acucgaggacuguauuuguga

SEQ ID NO: 2245347 - RNA, 23 nt, Human
acucgagaccuuuucaacuuggc

SEQ ID NO: 2245348 - RNA, 19 nt, Human
acucgaggacuguauuugu

SEQ ID NO: 2245349 - RNA, 16 nt, Human
acucgaguuacagaca

SEQ ID NO: 2245350 - RNA, 21 nt, Human
acuccuugugguuuaugucau

SEQ ID NO: 2245351 - RNA, 18 nt, Human
acuccuugugguuuaugu
